United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 89

SEQ ID NO: 4046725 - RNA, 18 nt, Molluscum contagiosum virus
caagacccagcaaggccc

SEQ ID NO: 4046726 - RNA, 15 nt, Molluscum contagiosum virus
caagacgcugcuggc

SEQ ID NO: 4046727 - RNA, 16 nt, Molluscum contagiosum virus
caagacgcugcuggcg

SEQ ID NO: 4046728 - RNA, 13 nt, Molluscum contagiosum virus
caagacgggcacg

SEQ ID NO: 4046729 - RNA, 18 nt, Molluscum contagiosum virus
caagaggggagccagccu

SEQ ID NO: 4046730 - RNA, 15 nt, Molluscum contagiosum virus
caagaucaaccgcaa

SEQ ID NO: 4046731 - RNA, 14 nt, Molluscum contagiosum virus
caagauucugcgga

SEQ ID NO: 4046732 - RNA, 17 nt, Molluscum contagiosum virus
caagcacaacgggcucg

SEQ ID NO: 4046733 - RNA, 19 nt, Molluscum contagiosum virus
caagcaccgccugcugcag

SEQ ID NO: 4046734 - RNA, 20 nt, Molluscum contagiosum virus
caagcacuacauggacgugc

SEQ ID NO: 4046735 - RNA, 16 nt, Molluscum contagiosum virus
caagcagcgcgccacc

SEQ ID NO: 4046736 - RNA, 15 nt, Molluscum contagiosum virus
caagcaggcaugcaa

SEQ ID NO: 4046737 - RNA, 14 nt, Molluscum contagiosum virus
caagcaguaccugc

SEQ ID NO: 4046738 - RNA, 15 nt, Molluscum contagiosum virus
caagcaguaccugcu

SEQ ID NO: 4046739 - RNA, 13 nt, Molluscum contagiosum virus
caagcagucucau

SEQ ID NO: 4046740 - RNA, 14 nt, Molluscum contagiosum virus
caagcccgaguucg

SEQ ID NO: 4046741 - RNA, 16 nt, Molluscum contagiosum virus
caagcccgcgcgcgag

SEQ ID NO: 4046742 - RNA, 15 nt, Molluscum contagiosum virus
caagccguccgccuc

SEQ ID NO: 4046743 - RNA, 21 nt, Molluscum contagiosum virus
caagcgagaucccuccgagac

SEQ ID NO: 4046744 - RNA, 16 nt, Molluscum contagiosum virus
caagcgcaacacggcc

SEQ ID NO: 4046745 - RNA, 14 nt, Molluscum contagiosum virus
caagcgcccgcgag

SEQ ID NO: 4046746 - RNA, 16 nt, Molluscum contagiosum virus
caagcgcccucgugua

SEQ ID NO: 4046747 - RNA, 21 nt, Molluscum contagiosum virus
caagcgccgccaugcugcgcg

SEQ ID NO: 4046748 - RNA, 16 nt, Molluscum contagiosum virus
caagcgccgcucggua

SEQ ID NO: 4046749 - RNA, 18 nt, Molluscum contagiosum virus
caagcgcuacuugcuggc

SEQ ID NO: 4046750 - RNA, 21 nt, Molluscum contagiosum virus
caagcgcuacuugcuggcgcg

SEQ ID NO: 4046751 - RNA, 17 nt, Molluscum contagiosum virus
caagcugcaccggcgcg

SEQ ID NO: 4046752 - RNA, 10 nt, Molluscum contagiosum virus
caagcugccc

SEQ ID NO: 4046753 - RNA, 19 nt, Molluscum contagiosum virus
caagcuggaggcugccccu

SEQ ID NO: 4046754 - RNA, 20 nt, Molluscum contagiosum virus
caagcuucgggccgcugccg

SEQ ID NO: 4046755 - RNA, 14 nt, Molluscum contagiosum virus
caaggaaaggcacc

SEQ ID NO: 4046756 - RNA, 21 nt, Molluscum contagiosum virus
caaggaaaggcacccaccagg

SEQ ID NO: 4046757 - RNA, 23 nt, Molluscum contagiosum virus
caaggaaaggcacccaccaggaa

SEQ ID NO: 4046758 - RNA, 18 nt, Molluscum contagiosum virus
caaggaaaggcacccgca

SEQ ID NO: 4046759 - RNA, 19 nt, Molluscum contagiosum virus
caaggacaucuacagccgc

SEQ ID NO: 4046760 - RNA, 16 nt, Molluscum contagiosum virus
caaggaucucugcccu

SEQ ID NO: 4046761 - RNA, 21 nt, Molluscum contagiosum virus
caaggccgcgcccaagaagaa

SEQ ID NO: 4046762 - RNA, 21 nt, Molluscum contagiosum virus
caagggcagcucaagcugcuc

SEQ ID NO: 4046763 - RNA, 12 nt, Molluscum contagiosum virus
caagggccugcg

SEQ ID NO: 4046764 - RNA, 23 nt, Molluscum contagiosum virus
caaggugcuguccuucugguucc

SEQ ID NO: 4046765 - RNA, 12 nt, Molluscum contagiosum virus
uucguggccaaa

SEQ ID NO: 4046766 - RNA, 16 nt, Molluscum contagiosum virus
uucuaggccucagccg

SEQ ID NO: 4046767 - RNA, 11 nt, Molluscum contagiosum virus
uucugccugcu

SEQ ID NO: 4046768 - RNA, 14 nt, Molluscum contagiosum virus
uucugcgcagggac

SEQ ID NO: 4046769 - RNA, 14 nt, Molluscum contagiosum virus
uucugcugcacaca

SEQ ID NO: 4046770 - RNA, 23 nt, Molluscum contagiosum virus
uucugcuugcggcacacaugcua

SEQ ID NO: 4046771 - RNA, 23 nt, Molluscum contagiosum virus
uucugguuccugcgcuccgacgc

SEQ ID NO: 4046772 - RNA, 22 nt, Molluscum contagiosum virus
uucuugguguucugcgcgccgc

SEQ ID NO: 4046773 - RNA, 13 nt, Molluscum contagiosum virus
uugaccagcucca

SEQ ID NO: 4046774 - RNA, 19 nt, Molluscum contagiosum virus
uugaucgacauggagcgca

SEQ ID NO: 4046775 - RNA, 12 nt, Molluscum contagiosum virus
uugcacauuaaa

SEQ ID NO: 4046776 - RNA, 16 nt, Molluscum contagiosum virus
uugcacgugcgugccc

SEQ ID NO: 4046777 - RNA, 16 nt, Molluscum contagiosum virus
uugccgcgccuugagc

SEQ ID NO: 4046778 - RNA, 17 nt, Molluscum contagiosum virus
uugccgcuugagcagca

SEQ ID NO: 4046779 - RNA, 13 nt, Molluscum contagiosum virus
uugccugagaagc

SEQ ID NO: 4046780 - RNA, 16 nt, Molluscum contagiosum virus
uugccugcacugagaa

SEQ ID NO: 4046781 - RNA, 13 nt, Molluscum contagiosum virus
uugcgagccagcc

SEQ ID NO: 4046782 - RNA, 12 nt, Molluscum contagiosum virus
uugcgcgcgccc

SEQ ID NO: 4046783 - RNA, 22 nt, Molluscum contagiosum virus
uugcgcgcgcccucgcgcgcag

SEQ ID NO: 4046784 - RNA, 14 nt, Molluscum contagiosum virus
uugcgcguccacaa

SEQ ID NO: 4046785 - RNA, 23 nt, Molluscum contagiosum virus
uugcguguugaacucgagcacgu

SEQ ID NO: 4046786 - RNA, 20 nt, Molluscum contagiosum virus
uugcucgcgcuccugcguga

SEQ ID NO: 4046787 - RNA, 20 nt, Molluscum contagiosum virus
uugcugcugccgcgcggcac

SEQ ID NO: 4046788 - RNA, 17 nt, Molluscum contagiosum virus
uuggacagcaagcagcg

SEQ ID NO: 4046789 - RNA, 16 nt, Molluscum contagiosum virus
uuggacgagcugcuuc

SEQ ID NO: 4046790 - RNA, 10 nt, Molluscum contagiosum virus
uuggccaggc

SEQ ID NO: 4046791 - RNA, 16 nt, Molluscum contagiosum virus
uuggcgagcgcugccg

SEQ ID NO: 4046792 - RNA, 16 nt, Molluscum contagiosum virus
uuggcgcgcaagcgcu

SEQ ID NO: 4046793 - RNA, 13 nt, Molluscum contagiosum virus
uugggcacugcua

SEQ ID NO: 4046794 - RNA, 21 nt, Molluscum contagiosum virus
uuggggcggcggggcugcugg

SEQ ID NO: 4046795 - RNA, 12 nt, Molluscum contagiosum virus
uuguccaaugcu

SEQ ID NO: 4046796 - RNA, 21 nt, Molluscum contagiosum virus
uugucgagacaggccggggcc

SEQ ID NO: 4046797 - RNA, 24 nt, Molluscum contagiosum virus
uugugaugauuugauggcugcuca

SEQ ID NO: 4046798 - RNA, 12 nt, Molluscum contagiosum virus
uugugcucgcuu

SEQ ID NO: 4046799 - RNA, 21 nt, Molluscum contagiosum virus
uuguuuuucgggaagcacagu

SEQ ID NO: 4046800 - RNA, 23 nt, Molluscum contagiosum virus
uuuccggacgauaaauggaccuc

SEQ ID NO: 4046801 - RNA, 18 nt, Molluscum contagiosum virus
uuuccuugccuucucgaa

SEQ ID NO: 4046802 - RNA, 15 nt, Molluscum contagiosum virus
uuucgggaagcacag

SEQ ID NO: 4046803 - RNA, 15 nt, Molluscum contagiosum virus
uuucguacgcggagg

SEQ ID NO: 4046804 - RNA, 18 nt, Molluscum contagiosum virus
uuugacacgcucaucucg

SEQ ID NO: 4046805 - RNA, 21 nt, Molluscum contagiosum virus
uuugcaaguucgcugcuggca

SEQ ID NO: 4046806 - RNA, 20 nt, Molluscum contagiosum virus
uuuucccgaggcguccagcg

SEQ ID NO: 4046807 - RNA, 18 nt, Molluscum contagiosum virus
uuuugcacagugugccga

SEQ ID NO: 4046808 - RNA, 14 nt, Molluscum contagiosum virus
uggcgggcgugccc

SEQ ID NO: 4046809 - RNA, 18 nt, Molluscum contagiosum virus
uggcggggaucuugcgug

SEQ ID NO: 4046810 - RNA, 14 nt, Molluscum contagiosum virus
uggcggugagcgcc

SEQ ID NO: 4046811 - RNA, 14 nt, Molluscum contagiosum virus
uggcguucgacggc

SEQ ID NO: 4046812 - RNA, 18 nt, Molluscum contagiosum virus
uggcguugccgagcgagc

SEQ ID NO: 4046813 - RNA, 14 nt, Molluscum contagiosum virus
uggcguugcugcug

SEQ ID NO: 4046814 - RNA, 16 nt, Molluscum contagiosum virus
uggcucuucucgcagc

SEQ ID NO: 4046815 - RNA, 14 nt, Molluscum contagiosum virus
uggcuucuccaccu

SEQ ID NO: 4046816 - RNA, 17 nt, Molluscum contagiosum virus
uggcuugcugcaguaug

SEQ ID NO: 4046817 - RNA, 14 nt, Molluscum contagiosum virus
accugcggcugcgg

SEQ ID NO: 4046818 - RNA, 17 nt, Molluscum contagiosum virus
accugcggcugcggcgc

SEQ ID NO: 4046819 - RNA, 15 nt, Molluscum contagiosum virus
accugcucgggcugc

SEQ ID NO: 4046820 - RNA, 14 nt, Molluscum contagiosum virus
accuggaacgcgag

SEQ ID NO: 4046821 - RNA, 12 nt, Molluscum contagiosum virus
accuggccuucg

SEQ ID NO: 4046822 - RNA, 22 nt, Molluscum contagiosum virus
accugggcgucgugcaccugga

SEQ ID NO: 4046823 - RNA, 21 nt, Molluscum contagiosum virus
accuggucguugucgggaaug

SEQ ID NO: 4046824 - RNA, 15 nt, Molluscum contagiosum virus
accuguaugaucugc

SEQ ID NO: 4046825 - RNA, 19 nt, Molluscum contagiosum virus
accuguucuuucagcgcgc

SEQ ID NO: 4046826 - RNA, 18 nt, Molluscum contagiosum virus
accuuggcgcugcacagu

SEQ ID NO: 4046827 - RNA, 12 nt, Murray Valley encephalitis virus
aaccccaggagg

SEQ ID NO: 4046828 - RNA, 18 nt, Murray Valley encephalitis virus
aagaggagucccugccaa

SEQ ID NO: 4046829 - RNA, 13 nt, Murray Valley encephalitis virus
aagcuguaaggcg

SEQ ID NO: 4046830 - RNA, 15 nt, Murray Valley encephalitis virus
aaggacuagagguua

SEQ ID NO: 4046831 - RNA, 18 nt, Murray Valley encephalitis virus
aaggcaccgagcgccgaa

SEQ ID NO: 4046832 - RNA, 23 nt, Murray Valley encephalitis virus
acaccugggaaaagacuaggaga

SEQ ID NO: 4046833 - RNA, 14 nt, Murray Valley encephalitis virus
accaaccccaggag

SEQ ID NO: 4046834 - RNA, 15 nt, Murray Valley encephalitis virus
acggacuagagguua

SEQ ID NO: 4046835 - RNA, 12 nt, Murray Valley encephalitis virus
acuggguaaaca

SEQ ID NO: 4046836 - RNA, 22 nt, Murray Valley encephalitis virus
agaaccgucucggaagaggagu

SEQ ID NO: 4046837 - RNA, 15 nt, Murray Valley encephalitis virus
agaagaccacaggau

SEQ ID NO: 4046838 - RNA, 14 nt, Murray Valley encephalitis virus
agaggagaccccac

SEQ ID NO: 4046839 - RNA, 13 nt, Murray Valley encephalitis virus
agagguuagagga

SEQ ID NO: 4046840 - RNA, 17 nt, Murray Valley encephalitis virus
agcccgggccgggagga

SEQ ID NO: 4046841 - RNA, 11 nt, Murray Valley encephalitis virus
agccucccaga

SEQ ID NO: 4046842 - RNA, 22 nt, Murray Valley encephalitis virus
aggccagccgguuaggcugcca

SEQ ID NO: 4046843 - RNA, 15 nt, Murray Valley encephalitis virus
aggcccccgcagccc

SEQ ID NO: 4046844 - RNA, 20 nt, Murray Valley encephalitis virus
agucacaaggcaccgagcgc

SEQ ID NO: 4046845 - RNA, 19 nt, Murray Valley encephalitis virus
aucugugaggccccaggag

SEQ ID NO: 4046846 - RNA, 19 nt, Murray Valley encephalitis virus
caagcucgccgaagcugua

SEQ ID NO: 4046847 - RNA, 22 nt, Murray Valley encephalitis virus
caccgagcgccgaacacuguga

SEQ ID NO: 4046848 - RNA, 20 nt, Murray Valley encephalitis virus
cagaucgcgaaagcgccacu

SEQ ID NO: 4046849 - RNA, 15 nt, Murray Valley encephalitis virus
caggaggacuggguu

SEQ ID NO: 4046850 - RNA, 19 nt, Murray Valley encephalitis virus
ccacgguuggaaagccucc

SEQ ID NO: 4046851 - RNA, 23 nt, Murray Valley encephalitis virus
ccccaggaggacuggguaaacaa

SEQ ID NO: 4046852 - RNA, 23 nt, Murray Valley encephalitis virus
ccccaggaggacuggguuaccaa

SEQ ID NO: 4046853 - RNA, 19 nt, Murray Valley encephalitis virus
ccugcgaccaaccccagga

SEQ ID NO: 4046854 - RNA, 13 nt, Murray Valley encephalitis virus
ccugggaaaagac

SEQ ID NO: 4046855 - RNA, 15 nt, Murray Valley encephalitis virus
cgaccaaccccagga

SEQ ID NO: 4046856 - RNA, 18 nt, Murray Valley encephalitis virus
cgaggagugcaaucugug

SEQ ID NO: 4046857 - RNA, 13 nt, Murray Valley encephalitis virus
cgccgaagcugua

SEQ ID NO: 4046858 - RNA, 16 nt, Murray Valley encephalitis virus
cgccgaggagugcaau

SEQ ID NO: 4046859 - RNA, 18 nt, Murray Valley encephalitis virus
cuagagguuagaggagac

SEQ ID NO: 4046860 - RNA, 16 nt, Murray Valley encephalitis virus
cugugaggccccagga

SEQ ID NO: 4046861 - RNA, 21 nt, Murray Valley encephalitis virus
cuucugcucuauuccaacauc

SEQ ID NO: 4046862 - RNA, 15 nt, Murray Valley encephalitis virus
gaaaagacuaggaga

SEQ ID NO: 4046863 - RNA, 17 nt, Murray Valley encephalitis virus
gaccaaccccaggagga

SEQ ID NO: 4046864 - RNA, 22 nt, Murray Valley encephalitis virus
gcccaagcucgccgaagcugua

SEQ ID NO: 4046865 - RNA, 16 nt, Murray Valley encephalitis virus
gccccaggaggacugg

SEQ ID NO: 4046866 - RNA, 21 nt, Murray Valley encephalitis virus
gccgaacacugugacugaugg

SEQ ID NO: 4046867 - RNA, 19 nt, Murray Valley encephalitis virus
gcgaccaaccccaggagga

SEQ ID NO: 4046868 - RNA, 21 nt, Murray Valley encephalitis virus
ggacuagagguuagaggagac

SEQ ID NO: 4046869 - RNA, 15 nt, Murray Valley encephalitis virus
gggccgggaggaggu

SEQ ID NO: 4046870 - RNA, 18 nt, Murray Valley encephalitis virus
gguuggaaagccucccag

SEQ ID NO: 4046871 - RNA, 22 nt, Murray Valley encephalitis virus
gguugguagacggugcugccug

SEQ ID NO: 4046872 - RNA, 15 nt, Murray Valley encephalitis virus
guaaacaaagccgua

SEQ ID NO: 4046873 - RNA, 16 nt, Murray Valley encephalitis virus
gugaggccccaggagg

SEQ ID NO: 4046874 - RNA, 15 nt, Murray Valley encephalitis virus
gugcugccugcgacc

SEQ ID NO: 4046875 - RNA, 19 nt, Murray Valley encephalitis virus
guggacggacuagagguua

SEQ ID NO: 4046876 - RNA, 18 nt, Murray Valley encephalitis virus
guuaccaaagcugauucu

SEQ ID NO: 4046877 - RNA, 20 nt, Murray Valley encephalitis virus
guuggaaagccucccagaac

SEQ ID NO: 4046878 - RNA, 13 nt, Murray Valley encephalitis virus
uagagguuagagg

SEQ ID NO: 4046879 - RNA, 16 nt, Murray Valley encephalitis virus
uagagguuagaggaga

SEQ ID NO: 4046880 - RNA, 18 nt, Murray Valley encephalitis virus
uaguauagguaaaauuuu

SEQ ID NO: 4046881 - RNA, 18 nt, Murray Valley encephalitis virus
ucugugaggccccaggag

SEQ ID NO: 4046882 - RNA, 22 nt, Murray Valley encephalitis virus
ugacugaugggggagaagacca

SEQ ID NO: 4046883 - RNA, 21 nt, Murray Valley encephalitis virus
ugcaaucugugaggccccagg

SEQ ID NO: 4046884 - RNA, 16 nt, Murray Valley encephalitis virus
ugcgaccaaccccagg

SEQ ID NO: 4046885 - RNA, 19 nt, Murray Valley encephalitis virus
ugcugccugcgaccaaccc

SEQ ID NO: 4046886 - RNA, 23 nt, Murray Valley encephalitis virus
uguaauauaguauagguaaaauu

SEQ ID NO: 4046887 - RNA, 20 nt, Murray Valley encephalitis virus
aaccgucucggaagaggagu

SEQ ID NO: 4046888 - RNA, 15 nt, Murray Valley encephalitis virus
accaaccccaggagg

SEQ ID NO: 4046889 - RNA, 17 nt, Murray Valley encephalitis virus
accugggaaaagacuag

SEQ ID NO: 4046890 - RNA, 22 nt, Murray Valley encephalitis virus
acgguuggaaagccucccagaa

SEQ ID NO: 4046891 - RNA, 18 nt, Murray Valley encephalitis virus
acuagagguuagaggaga

SEQ ID NO: 4046892 - RNA, 20 nt, Murray Valley encephalitis virus
agaaaugaguggcccaagcu

SEQ ID NO: 4046893 - RNA, 22 nt, Murray Valley encephalitis virus
aggacuagagguuagaggagac

SEQ ID NO: 4046894 - RNA, 11 nt, Murray Valley encephalitis virus
aggaggacugg

SEQ ID NO: 4046895 - RNA, 22 nt, Murray Valley encephalitis virus
aggagugcaaucugugaggccc

SEQ ID NO: 4046896 - RNA, 21 nt, Murray Valley encephalitis virus
aggccagccgguuaggcugcc

SEQ ID NO: 4046897 - RNA, 13 nt, Murray Valley encephalitis virus
aggccccaggagg

SEQ ID NO: 4046898 - RNA, 15 nt, Murray Valley encephalitis virus
agugcaaucugugag

SEQ ID NO: 4046899 - RNA, 21 nt, Murray Valley encephalitis virus
aucugugaggccccaggagga

SEQ ID NO: 4046900 - RNA, 23 nt, Murray Valley encephalitis virus
auguaauauaguauagguaaaau

SEQ ID NO: 4046901 - RNA, 17 nt, Murray Valley encephalitis virus
auuaaguagcaagacuu

SEQ ID NO: 4046902 - RNA, 22 nt, Murray Valley encephalitis virus
auuuaauguaauauaguauagg

SEQ ID NO: 4046903 - RNA, 22 nt, Murray Valley encephalitis virus
caaucugugaggccccaggagg

SEQ ID NO: 4046904 - RNA, 13 nt, Murray Valley encephalitis virus
ccaggaggacugg

SEQ ID NO: 4046905 - RNA, 21 nt, Murray Valley encephalitis virus
cccagaaccgucucggaagag

SEQ ID NO: 4046906 - RNA, 21 nt, Murray Valley encephalitis virus
cccaggaggacuggguuacca

SEQ ID NO: 4046907 - RNA, 21 nt, Murray Valley encephalitis virus
cccccgcagcccgggccggga

SEQ ID NO: 4046908 - RNA, 17 nt, Murray Valley encephalitis virus
cugccugcgaccaaccc

SEQ ID NO: 4046909 - RNA, 12 nt, Murray Valley encephalitis virus
gaacacugugac

SEQ ID NO: 4046910 - RNA, 16 nt, Murray Valley encephalitis virus
gaccaaccccaggagg

SEQ ID NO: 4046911 - RNA, 17 nt, Murray Valley encephalitis virus
gacugaugggggagaag

SEQ ID NO: 4046912 - RNA, 20 nt, Murray Valley encephalitis virus
gacugaugggggagaagacc

SEQ ID NO: 4046913 - RNA, 13 nt, Murray Valley encephalitis virus
gaggccccaggag

SEQ ID NO: 4046914 - RNA, 15 nt, Murray Valley encephalitis virus
gagucccugccaaca

SEQ ID NO: 4046915 - RNA, 19 nt, Murray Valley encephalitis virus
gccugcgaccaaccccagg

SEQ ID NO: 4046916 - RNA, 20 nt, Murray Valley encephalitis virus
gccugcgaccaaccccagga

SEQ ID NO: 4046917 - RNA, 15 nt, Murray Valley encephalitis virus
gcgaccaaccccagg

SEQ ID NO: 4046918 - RNA, 18 nt, Murray Valley encephalitis virus
ggaaaagacuaggagauc

SEQ ID NO: 4046919 - RNA, 17 nt, Murray Valley encephalitis virus
ggaagaggagucccugc

SEQ ID NO: 4046920 - RNA, 14 nt, Murray Valley encephalitis virus
ggaggaggugaugc

SEQ ID NO: 4046921 - RNA, 16 nt, Murray Valley encephalitis virus
ggcgaaggacuagagg

SEQ ID NO: 4046922 - RNA, 17 nt, Murray Valley encephalitis virus
gguggacggacuagagg

SEQ ID NO: 4046923 - RNA, 13 nt, Murray Valley encephalitis virus
gugaggccccagg

SEQ ID NO: 4046924 - RNA, 19 nt, Murray Valley encephalitis virus
ucucaaaagcaucaaacaa

SEQ ID NO: 4046925 - RNA, 13 nt, Murray Valley encephalitis virus
ugaggccccagga

SEQ ID NO: 4046926 - RNA, 22 nt, Murray Valley encephalitis virus
ugccugcgaccaaccccaggag

SEQ ID NO: 4046927 - RNA, 18 nt, Murray Valley encephalitis virus
ugcgaccaaccccaggag

SEQ ID NO: 4046928 - RNA, 20 nt, Murray Valley encephalitis virus
ugcgaccaaccccaggagga

SEQ ID NO: 4046929 - RNA, 15 nt, Murray Valley encephalitis virus
ugcucuauuccaaca

SEQ ID NO: 4046930 - RNA, 15 nt, Murray Valley encephalitis virus
uugauagaaaauuuu

SEQ ID NO: 4046931 - RNA, 17 nt, Murray Valley encephalitis virus
aaccccaggaggacugg

SEQ ID NO: 4046932 - RNA, 21 nt, Murray Valley encephalitis virus
aaucugugaggccccaggagg

SEQ ID NO: 4046933 - RNA, 22 nt, Murray Valley encephalitis virus
acagcauauugacaccugggaa

SEQ ID NO: 4046934 - RNA, 23 nt, Murray Valley encephalitis virus
acugaugggggagaagaccacag

SEQ ID NO: 4046935 - RNA, 17 nt, Murray Valley encephalitis virus
acuggguuaccaaagcu

SEQ ID NO: 4046936 - RNA, 14 nt, Murray Valley encephalitis virus
agacggugcugccu

SEQ ID NO: 4046937 - RNA, 16 nt, Murray Valley encephalitis virus
agagguuagaggagac

SEQ ID NO: 4046938 - RNA, 12 nt, Murray Valley encephalitis virus
aggccccaggag

SEQ ID NO: 4046939 - RNA, 14 nt, Murray Valley encephalitis virus
aggccccaggagga

SEQ ID NO: 4046940 - RNA, 19 nt, Murray Valley encephalitis virus
agguuagaggagacccugc

SEQ ID NO: 4046941 - RNA, 11 nt, Murray Valley encephalitis virus
aaccccaggag

SEQ ID NO: 4046942 - RNA, 13 nt, Murray Valley encephalitis virus
aaccccaggagga

SEQ ID NO: 4046943 - RNA, 18 nt, Murray Valley encephalitis virus
aaccccggcgaaggacua

SEQ ID NO: 4046944 - RNA, 13 nt, Murray Valley encephalitis virus
aagccguaaggcc

SEQ ID NO: 4046945 - RNA, 22 nt, Murray Valley encephalitis virus
aagcgccacuucgccgaggagu

SEQ ID NO: 4046946 - RNA, 18 nt, Murray Valley encephalitis virus
accccaggaggacugggu

SEQ ID NO: 4046947 - RNA, 23 nt, Murray Valley encephalitis virus
acggacuagagguuagaggagac

SEQ ID NO: 4046948 - RNA, 14 nt, Murray Valley encephalitis virus
acuugauagucagg

SEQ ID NO: 4046949 - RNA, 14 nt, Murray Valley encephalitis virus
agccguaaggcccc

SEQ ID NO: 4046950 - RNA, 18 nt, Murray Valley encephalitis virus
aggagaucuucugcucua

SEQ ID NO: 4046951 - RNA, 13 nt, Murray Valley encephalitis virus
aggaggacugggu

SEQ ID NO: 4046952 - RNA, 18 nt, Murray Valley encephalitis virus
aggccccaggaggacugg

SEQ ID NO: 4046953 - RNA, 22 nt, Murray Valley encephalitis virus
aucuucugcucuauuccaacau

SEQ ID NO: 4046954 - RNA, 22 nt, Murray Valley encephalitis virus
caacaucagucacaaggcaccg

SEQ ID NO: 4046955 - RNA, 13 nt, Murray Valley encephalitis virus
caaccccaggagg

SEQ ID NO: 4046956 - RNA, 20 nt, Murray Valley encephalitis virus
caaucugugaggccccagga

SEQ ID NO: 4046957 - RNA, 20 nt, Murray Valley encephalitis virus
caccugggaaaagacuagga

SEQ ID NO: 4046958 - RNA, 14 nt, Murray Valley encephalitis virus
caggaggacugggu

SEQ ID NO: 4046959 - RNA, 15 nt, Murray Valley encephalitis virus
caggccagccgguua

SEQ ID NO: 4046960 - RNA, 15 nt, Murray Valley encephalitis virus
ccacuucgccgagga

SEQ ID NO: 4046961 - RNA, 21 nt, Murray Valley encephalitis virus
cccaggaggacuggguaaaca

SEQ ID NO: 4046962 - RNA, 23 nt, Murray Valley encephalitis virus
ccgcagcccgggccgggaggagg

SEQ ID NO: 4046963 - RNA, 19 nt, Murray Valley encephalitis virus
cggguggacggacuagagg

SEQ ID NO: 4046964 - RNA, 22 nt, Murray Valley encephalitis virus
cgucucggaagaggagucccug

SEQ ID NO: 4046965 - RNA, 21 nt, Murray Valley encephalitis virus
cuagagguuagaggagacccu

SEQ ID NO: 4046966 - RNA, 16 nt, Murray Valley encephalitis virus
cuucgccgaggagugc

SEQ ID NO: 4046967 - RNA, 14 nt, Murray Valley encephalitis virus
gaggccccaggagg

SEQ ID NO: 4046968 - RNA, 15 nt, Murray Valley encephalitis virus
gaggccccaggagga

SEQ ID NO: 4046969 - RNA, 13 nt, Murray Valley encephalitis virus
gaucuucugcucu

SEQ ID NO: 4046970 - RNA, 17 nt, Murray Valley encephalitis virus
gcagcccgggccgggag

SEQ ID NO: 4046971 - RNA, 14 nt, Murray Valley encephalitis virus
gccgaacacuguga

SEQ ID NO: 4046972 - RNA, 18 nt, Murray Valley encephalitis virus
gcgaccaaccccaggagg

SEQ ID NO: 4046973 - RNA, 13 nt, Murray Valley encephalitis virus
ggccccaggagga

SEQ ID NO: 4046974 - RNA, 21 nt, Murray Valley encephalitis virus
ucugugaggccccaggaggac

SEQ ID NO: 4046975 - RNA, 17 nt, Murray Valley encephalitis virus
ugaaauuaaguaaaauu

SEQ ID NO: 4046976 - RNA, 19 nt, Murray Valley encephalitis virus
ugcgaccaaccccaggagg

SEQ ID NO: 4046977 - RNA, 15 nt, Murray Valley encephalitis virus
uggagaugaagcccg

SEQ ID NO: 4046978 - RNA, 19 nt, Murray Valley encephalitis virus
ugguagacggugcugccug

SEQ ID NO: 4046979 - RNA, 21 nt, Murray Valley encephalitis virus
caaucugugaggccccaggag

SEQ ID NO: 4046980 - RNA, 15 nt, Murray Valley encephalitis virus
caggaggacugggua

SEQ ID NO: 4046981 - RNA, 14 nt, Murray Valley encephalitis virus
ccaaccccaggagg

SEQ ID NO: 4046982 - RNA, 21 nt, Murray Valley encephalitis virus
ccagccgguuaggcugccacc

SEQ ID NO: 4046983 - RNA, 14 nt, Murray Valley encephalitis virus
ccaggaggacuggg

SEQ ID NO: 4046984 - RNA, 15 nt, Murray Valley encephalitis virus
ccccaggaggacugg

SEQ ID NO: 4046985 - RNA, 13 nt, Murray Valley encephalitis virus
ccguaaggccccc

SEQ ID NO: 4046986 - RNA, 17 nt, Murray Valley encephalitis virus
ccugcggaagaaaugag

SEQ ID NO: 4046987 - RNA, 17 nt, Murray Valley encephalitis virus
cuagagguuagaggaga

SEQ ID NO: 4046988 - RNA, 21 nt, Murray Valley encephalitis virus
cuagagguuagaggagacccc

SEQ ID NO: 4046989 - RNA, 22 nt, Murray Valley encephalitis virus
cugccugcgaccaaccccagga

SEQ ID NO: 4046990 - RNA, 17 nt, Murray Valley encephalitis virus
cugcgaccaaccccagg

SEQ ID NO: 4046991 - RNA, 22 nt, Murray Valley encephalitis virus
cugcgaccaaccccaggaggac

SEQ ID NO: 4046992 - RNA, 16 nt, Murray Valley encephalitis virus
cugggaaaagacuagg

SEQ ID NO: 4046993 - RNA, 20 nt, Murray Valley encephalitis virus
cugugaggccccaggaggac

SEQ ID NO: 4046994 - RNA, 15 nt, Murray Valley encephalitis virus
gaagaggagucccug

SEQ ID NO: 4046995 - RNA, 22 nt, Murray Valley encephalitis virus
gaccaaccccaggaggacuggg

SEQ ID NO: 4046996 - RNA, 24 nt, Murray Valley encephalitis virus
gacuagagguuagaggagacccug

SEQ ID NO: 4046997 - RNA, 16 nt, Murray Valley encephalitis virus
gacugaugggggagaa

SEQ ID NO: 4046998 - RNA, 18 nt, Murray Valley encephalitis virus
gacuggguuaccaaagcu

SEQ ID NO: 4046999 - RNA, 20 nt, Murray Valley encephalitis virus
gagucccugccaacaaugga

SEQ ID NO: 4047000 - RNA, 22 nt, Murray Valley encephalitis virus
gagugcaaucugugaggcccca

SEQ ID NO: 4047001 - RNA, 20 nt, Murray Valley encephalitis virus
ggacuagagguuagaggaga

SEQ ID NO: 4047002 - RNA, 15 nt, Murray Valley encephalitis virus
ggagaagaccacagg

SEQ ID NO: 4047003 - RNA, 19 nt, Murray Valley encephalitis virus
ggagugcaaucugugaggc

SEQ ID NO: 4047004 - RNA, 15 nt, Murray Valley encephalitis virus
gguagacggugcugc

SEQ ID NO: 4047005 - RNA, 12 nt, Murray Valley encephalitis virus
gucucggaagag

SEQ ID NO: 4047006 - RNA, 14 nt, Murray Valley encephalitis virus
guuaggcugccacc

SEQ ID NO: 4047007 - RNA, 15 nt, Murray Valley encephalitis virus
ugaggccccaggagg

SEQ ID NO: 4047008 - RNA, 16 nt, Murray Valley encephalitis virus
ugaggccccaggagga

SEQ ID NO: 4047009 - RNA, 16 nt, Murray Valley encephalitis virus
ugaguggcccaagcuc

SEQ ID NO: 4047010 - RNA, 21 nt, Murray Valley encephalitis virus
ugcgaccaaccccaggaggac

SEQ ID NO: 4047011 - RNA, 16 nt, Murray Valley encephalitis virus
ugugaggccccaggag

SEQ ID NO: 4047012 - RNA, 19 nt, Norwalk virus
aacacaucuagccccuucu

SEQ ID NO: 4047013 - RNA, 16 nt, Norwalk virus
aaccaggcccuucaca

SEQ ID NO: 4047014 - RNA, 17 nt, Norwalk virus
aacucacgugccccucu

SEQ ID NO: 4047015 - RNA, 20 nt, Norwalk virus
aacucacgugccccucuccc

SEQ ID NO: 4047016 - RNA, 20 nt, Norwalk virus
aagccugugggaacugccag

SEQ ID NO: 4047017 - RNA, 22 nt, Norwalk virus
aaucuuggggaauucaaagcau

SEQ ID NO: 4047018 - RNA, 12 nt, Norwalk virus
acacaucuagcc

SEQ ID NO: 4047019 - RNA, 18 nt, Norwalk virus
acacucccaaaucugcca

SEQ ID NO: 4047020 - RNA, 17 nt, Norwalk virus
acacugucuucugugcc

SEQ ID NO: 4047021 - RNA, 19 nt, Norwalk virus
acaugugauugcugauguu

SEQ ID NO: 4047022 - RNA, 14 nt, Norwalk virus
accacauugagauc

SEQ ID NO: 4047023 - RNA, 18 nt, Norwalk virus
accccaguuucauuguca

SEQ ID NO: 4047024 - RNA, 22 nt, Norwalk virus
accccauugaggugccuuugga

SEQ ID NO: 4047025 - RNA, 16 nt, Norwalk virus
acccgucuggcuccca

SEQ ID NO: 4047026 - RNA, 13 nt, Norwalk virus
acugccagcucgg

SEQ ID NO: 4047027 - RNA, 16 nt, Norwalk virus
acugucuucugugcca

SEQ ID NO: 4047028 - RNA, 13 nt, Norwalk virus
agacaccaccccu

SEQ ID NO: 4047029 - RNA, 21 nt, Norwalk virus
agagugugcaguuccaaaaug

SEQ ID NO: 4047030 - RNA, 22 nt, Norwalk virus
agccccuucuguauaccccccu

SEQ ID NO: 4047031 - RNA, 22 nt, Norwalk virus
aguaguaucggcauuuccccag

SEQ ID NO: 4047032 - RNA, 18 nt, Norwalk virus
agucgcgacugcuggaca

SEQ ID NO: 4047033 - RNA, 16 nt, Norwalk virus
agugugguugacucca

SEQ ID NO: 4047034 - RNA, 18 nt, Norwalk virus
aguuaugacuugccccag

SEQ ID NO: 4047035 - RNA, 22 nt, Norwalk virus
auaccacgcggaggcucucaau

SEQ ID NO: 4047036 - RNA, 19 nt, Norwalk virus
auaugacacaguuuggcca

SEQ ID NO: 4047037 - RNA, 11 nt, Norwalk virus
aucaauuauug

SEQ ID NO: 4047038 - RNA, 19 nt, Norwalk virus
caguaguaucggcauuucc

SEQ ID NO: 4047039 - RNA, 17 nt, Norwalk virus
caucaagcguggauggc

SEQ ID NO: 4047040 - RNA, 18 nt, Norwalk virus
ccaauggggcuagcucgg

SEQ ID NO: 4047041 - RNA, 17 nt, Norwalk virus
ccauucuagccagaccc

SEQ ID NO: 4047042 - RNA, 19 nt, Norwalk virus
ccauuggguuuccagaccu

SEQ ID NO: 4047043 - RNA, 22 nt, Norwalk virus
ccauuggguuuccagaccucgg

SEQ ID NO: 4047044 - RNA, 18 nt, Norwalk virus
cccaaguugaccuuugga

SEQ ID NO: 4047045 - RNA, 18 nt, Norwalk virus
ccccaaggugaauuuacu

SEQ ID NO: 4047046 - RNA, 15 nt, Norwalk virus
cccugucuauuacca

SEQ ID NO: 4047047 - RNA, 23 nt, Norwalk virus
ccuacgguggagcagaaaaccag

SEQ ID NO: 4047048 - RNA, 21 nt, Norwalk virus
ccucuaagcaaaaacagguuc

SEQ ID NO: 4047049 - RNA, 21 nt, Norwalk virus
cgaucaauggggucuuugucu

SEQ ID NO: 4047050 - RNA, 15 nt, Norwalk virus
cgcggaggcucucaa

SEQ ID NO: 4047051 - RNA, 19 nt, Norwalk virus
cgcuaguggcgcuggucag

SEQ ID NO: 4047052 - RNA, 20 nt, Norwalk virus
cgggcauacagguugguggc

SEQ ID NO: 4047053 - RNA, 14 nt, Norwalk virus
cugaauuggauggc

SEQ ID NO: 4047054 - RNA, 14 nt, Norwalk virus
cuucacacucccaa

SEQ ID NO: 4047055 - RNA, 19 nt, Norwalk virus
cuuggggaauucaaagcau

SEQ ID NO: 4047056 - RNA, 20 nt, Norwalk virus
gacaaguuaauccuauugau

SEQ ID NO: 4047057 - RNA, 19 nt, Norwalk virus
gagcuccagucacccgcau

SEQ ID NO: 4047058 - RNA, 15 nt, Norwalk virus
gagguuaaugcuucu

SEQ ID NO: 4047059 - RNA, 16 nt, Norwalk virus
gauccgguggcuucau

SEQ ID NO: 4047060 - RNA, 15 nt, Norwalk virus
gcaagaaaauucuuu

SEQ ID NO: 4047061 - RNA, 14 nt, Norwalk virus
gcugcccugcucca

SEQ ID NO: 4047062 - RNA, 14 nt, Norwalk virus
ggauggcacacccu

SEQ ID NO: 4047063 - RNA, 18 nt, Norwalk virus
ggcaggagcuccagucac

SEQ ID NO: 4047064 - RNA, 13 nt, Norwalk virus
ggcaucauauuca

SEQ ID NO: 4047065 - RNA, 15 nt, Norwalk virus
gggcccugcccccau

SEQ ID NO: 4047066 - RNA, 17 nt, Norwalk virus
ggguccacaacagcugc

SEQ ID NO: 4047067 - RNA, 22 nt, Norwalk virus
gguuuccucacuugugucccca

SEQ ID NO: 4047068 - RNA, 17 nt, Norwalk virus
guccucugcuaccacau

SEQ ID NO: 4047069 - RNA, 14 nt, Norwalk virus
guuugaccagugcu

SEQ ID NO: 4047070 - RNA, 14 nt, Norwalk virus
guuuuuagucccuc

SEQ ID NO: 4047071 - RNA, 23 nt, Norwalk virus
uaaacaugacagggaaaugauug

SEQ ID NO: 4047072 - RNA, 16 nt, Norwalk virus
uaauaauuuugugcaa

SEQ ID NO: 4047073 - RNA, 13 nt, Norwalk virus
uaaugcuucugac

SEQ ID NO: 4047074 - RNA, 18 nt, Norwalk virus
uaauuagguuuaauuuga

SEQ ID NO: 4047075 - RNA, 19 nt, Norwalk virus
uacacugucuucugugcca

SEQ ID NO: 4047076 - RNA, 17 nt, Norwalk virus
uaccacgcggaggcucu

SEQ ID NO: 4047077 - RNA, 13 nt, Norwalk virus
uacuauuucccca

SEQ ID NO: 4047078 - RNA, 18 nt, Norwalk virus
uaguaucggcauuucccc

SEQ ID NO: 4047079 - RNA, 19 nt, Norwalk virus
uaguaucggcauuucccca

SEQ ID NO: 4047080 - RNA, 13 nt, Norwalk virus
uaucaauaugaca

SEQ ID NO: 4047081 - RNA, 20 nt, Norwalk virus
ucaaucaucugguauuagua

SEQ ID NO: 4047082 - RNA, 15 nt, Norwalk virus
ucacgugccccucuc

SEQ ID NO: 4047083 - RNA, 18 nt, Norwalk virus
ucaggauuaugcuagcug

SEQ ID NO: 4047084 - RNA, 17 nt, Norwalk virus
uccgguggcuucauguc

SEQ ID NO: 4047085 - RNA, 16 nt, Norwalk virus
uccuccgugcuggggg

SEQ ID NO: 4047086 - RNA, 17 nt, Norwalk virus
ucucccaaucaguagua

SEQ ID NO: 4047087 - RNA, 20 nt, Norwalk virus
ucugcgccgauaauggccca

SEQ ID NO: 4047088 - RNA, 21 nt, Norwalk virus
ucuggauggccgccugguugg

SEQ ID NO: 4047089 - RNA, 23 nt, Norwalk virus
ucuugcuagugaacaagccccua

SEQ ID NO: 4047090 - RNA, 14 nt, Norwalk virus
ucuugguucaauuc

SEQ ID NO: 4047091 - RNA, 14 nt, Norwalk virus
ugaccuuuggaaga

SEQ ID NO: 4047092 - RNA, 22 nt, Norwalk virus
ugaugcagcaagaucuguggca

SEQ ID NO: 4047093 - RNA, 19 nt, Norwalk virus
ugcauacccccugguuuug

SEQ ID NO: 4047094 - RNA, 17 nt, Norwalk virus
ugcuuccacagcaggua

SEQ ID NO: 4047095 - RNA, 19 nt, Norwalk virus
uggauaauuaauaauuuug

SEQ ID NO: 4047096 - RNA, 19 nt, Norwalk virus
uggcacacccuuucacccu

SEQ ID NO: 4047097 - RNA, 16 nt, Norwalk virus
uggccauucuagccag

SEQ ID NO: 4047098 - RNA, 18 nt, Norwalk virus
ugguuauuucaauacaga

SEQ ID NO: 4047099 - RNA, 19 nt, Norwalk virus
uguaaucaaccuuacugaa

SEQ ID NO: 4047100 - RNA, 22 nt, Norwalk virus
uguacucuggauggccgccugg

SEQ ID NO: 4047101 - RNA, 19 nt, Norwalk virus
ugucuucugugccacgugg

SEQ ID NO: 4047102 - RNA, 17 nt, Norwalk virus
uguggcaggagcuccag

SEQ ID NO: 4047103 - RNA, 15 nt, Norwalk virus
ugugguugacuccac

SEQ ID NO: 4047104 - RNA, 16 nt, Norwalk virus
uguguccccaaugggg

SEQ ID NO: 4047105 - RNA, 23 nt, Norwalk virus
uguuguaauaugaaaugugggca

SEQ ID NO: 4047106 - RNA, 18 nt, Norwalk virus
uucccauaccauuugccu

SEQ ID NO: 4047107 - RNA, 19 nt, Norwalk virus
uucuuguuuuuagucccuc

SEQ ID NO: 4047108 - RNA, 19 nt, Norwalk virus
uugagauccgguggcuuca

SEQ ID NO: 4047109 - RNA, 19 nt, Norwalk virus
uuuaauuagguuuaauuug

SEQ ID NO: 4047110 - RNA, 17 nt, Norwalk virus
acugucuucugugccac

SEQ ID NO: 4047111 - RNA, 16 nt, Norwalk virus
agcaacucucuuucca

SEQ ID NO: 4047112 - RNA, 16 nt, Norwalk virus
agcagguucuucgaca

SEQ ID NO: 4047113 - RNA, 21 nt, Norwalk virus
agcuggauuucccccccauca

SEQ ID NO: 4047114 - RNA, 17 nt, Norwalk virus
aggaauguucucuuuca

SEQ ID NO: 4047115 - RNA, 17 nt, Norwalk virus
aggacucuagaccccau

SEQ ID NO: 4047116 - RNA, 14 nt, Norwalk virus
agggcccugccccc

SEQ ID NO: 4047117 - RNA, 21 nt, Norwalk virus
agguuuaauuagguuuaauuu

SEQ ID NO: 4047118 - RNA, 16 nt, Norwalk virus
aguccucugcuaccac

SEQ ID NO: 4047119 - RNA, 11 nt, Norwalk virus
auauucauuua

SEQ ID NO: 4047120 - RNA, 13 nt, Norwalk virus
auauucauuuaau

SEQ ID NO: 4047121 - RNA, 14 nt, Norwalk virus
auccgguggcuuca

SEQ ID NO: 4047122 - RNA, 20 nt, Norwalk virus
auggcgugagagugucugcu

SEQ ID NO: 4047123 - RNA, 20 nt, Norwalk virus
auguccagagugugcaguuc

SEQ ID NO: 4047124 - RNA, 17 nt, Norwalk virus
auguuguaauaugaaau

SEQ ID NO: 4047125 - RNA, 14 nt, Norwalk virus
cacaucuagccccu

SEQ ID NO: 4047126 - RNA, 12 nt, Norwalk virus
cacuuuuguccc

SEQ ID NO: 4047127 - RNA, 16 nt, Norwalk virus
cagcaagaucuguggc

SEQ ID NO: 4047128 - RNA, 17 nt, Norwalk virus
cagcagguagugcucug

SEQ ID NO: 4047129 - RNA, 20 nt, Norwalk virus
caggcccuucacacucccaa

SEQ ID NO: 4047130 - RNA, 19 nt, Norwalk virus
cagguugccauuauucgca

SEQ ID NO: 4047131 - RNA, 18 nt, Norwalk virus
caguuucauugucacaug

SEQ ID NO: 4047132 - RNA, 23 nt, Norwalk virus
cauaauuggugcaauugcugcuu

SEQ ID NO: 4047133 - RNA, 18 nt, Norwalk virus
aacaaaauuugcaacugc

SEQ ID NO: 4047134 - RNA, 16 nt, Norwalk virus
aacagccucuucuaca

SEQ ID NO: 4047135 - RNA, 12 nt, Norwalk virus
aaugauagaaau

SEQ ID NO: 4047136 - RNA, 18 nt, Norwalk virus
aauuggugcaauugcugc

SEQ ID NO: 4047137 - RNA, 15 nt, Norwalk virus
acaaaauuugcaacu

SEQ ID NO: 4047138 - RNA, 13 nt, Norwalk virus
acaccccccuccg

SEQ ID NO: 4047139 - RNA, 15 nt, Norwalk virus
accccauugaggugc

SEQ ID NO: 4047140 - RNA, 23 nt, Norwalk virus
accucggugguugugauuggcau

SEQ ID NO: 4047141 - RNA, 15 nt, Norwalk virus
acgcggaggcucuca

SEQ ID NO: 4047142 - RNA, 18 nt, Norwalk virus
acucaucgagauuuggaa

SEQ ID NO: 4047143 - RNA, 13 nt, Norwalk virus
caucuuaauccuu

SEQ ID NO: 4047144 - RNA, 18 nt, Norwalk virus
caugcgccuugugugcau

SEQ ID NO: 4047145 - RNA, 14 nt, Norwalk virus
cauguugccaagau

SEQ ID NO: 4047146 - RNA, 20 nt, Norwalk virus
cauuuccccagacaaugucc

SEQ ID NO: 4047147 - RNA, 15 nt, Norwalk virus
ccagagugugcaguu

SEQ ID NO: 4047148 - RNA, 15 nt, Norwalk virus
ccagauuuuaucaau

SEQ ID NO: 4047149 - RNA, 17 nt, Norwalk virus
ccaggcccuucacacuc

SEQ ID NO: 4047150 - RNA, 14 nt, Norwalk virus
ccccaucacacccg

SEQ ID NO: 4047151 - RNA, 16 nt, Norwalk virus
ccugauuuuaauuucu

SEQ ID NO: 4047152 - RNA, 14 nt, Norwalk virus
ccuucacacuccca

SEQ ID NO: 4047153 - RNA, 20 nt, Norwalk virus
cgagucacaaaacucaucga

SEQ ID NO: 4047154 - RNA, 13 nt, Norwalk virus
cgaguuaugacuu

SEQ ID NO: 4047155 - RNA, 17 nt, Norwalk virus
cggaggcaacacaucua

SEQ ID NO: 4047156 - RNA, 12 nt, Norwalk virus
cuccauaccacg

SEQ ID NO: 4047157 - RNA, 13 nt, Norwalk virus
cugguuggcacca

SEQ ID NO: 4047158 - RNA, 22 nt, Norwalk virus
cuuuggaagauccccaauuaug

SEQ ID NO: 4047159 - RNA, 20 nt, Norwalk virus
gaagauguuaggaauguucu

SEQ ID NO: 4047160 - RNA, 18 nt, Norwalk virus
gcaacacaucuagccccu

SEQ ID NO: 4047161 - RNA, 20 nt, Norwalk virus
gcacuguaaucaaccuuacu

SEQ ID NO: 4047162 - RNA, 13 nt, Norwalk virus
gcaguuccaaaau

SEQ ID NO: 4047163 - RNA, 21 nt, Norwalk virus
gcugccgaucaauggggucuu

SEQ ID NO: 4047164 - RNA, 13 nt, Norwalk virus
ggaaaucuuucuc

SEQ ID NO: 4047165 - RNA, 19 nt, Norwalk virus
ggagcgggcauacagguug

SEQ ID NO: 4047166 - RNA, 20 nt, Norwalk virus
ggauccuguagcagguucuu

SEQ ID NO: 4047167 - RNA, 16 nt, Norwalk virus
ggcaagagguaggcuu

SEQ ID NO: 4047168 - RNA, 17 nt, Norwalk virus
ggcccuucacacuccca

SEQ ID NO: 4047169 - RNA, 18 nt, Norwalk virus
ggccgccugguuggcacc

SEQ ID NO: 4047170 - RNA, 14 nt, Norwalk virus
gggcauacagguug

SEQ ID NO: 4047171 - RNA, 14 nt, Norwalk virus
gguucaacagccuc

SEQ ID NO: 4047172 - RNA, 18 nt, Norwalk virus
guaucggcauuuccccag

SEQ ID NO: 4047173 - RNA, 20 nt, Norwalk virus
gucugcucccgaguccucug

SEQ ID NO: 4047174 - RNA, 20 nt, Norwalk virus
gugccuuuggaagauguuag

SEQ ID NO: 4047175 - RNA, 15 nt, Norwalk virus
guggcuucaugucag

SEQ ID NO: 4047176 - RNA, 16 nt, Norwalk virus
guugaccuuuggaaga

SEQ ID NO: 4047177 - RNA, 16 nt, Norwalk virus
guuggcaccaccccag

SEQ ID NO: 4047178 - RNA, 15 nt, Norwalk virus
uaauccaaauuauuc

SEQ ID NO: 4047179 - RNA, 15 nt, Norwalk virus
uaauuugcccugucu

SEQ ID NO: 4047180 - RNA, 15 nt, Norwalk virus
uacacugucuucugu

SEQ ID NO: 4047181 - RNA, 19 nt, Norwalk virus
uacagugugguugacucca

SEQ ID NO: 4047182 - RNA, 23 nt, Norwalk virus
uacuguaggugaggcugcccugc

SEQ ID NO: 4047183 - RNA, 13 nt, Norwalk virus
ucaaagcauaccc

SEQ ID NO: 4047184 - RNA, 19 nt, Norwalk virus
ucacacccgucuggcuccc

SEQ ID NO: 4047185 - RNA, 21 nt, Norwalk virus
ucacacccgucuggcucccaa

SEQ ID NO: 4047186 - RNA, 22 nt, Norwalk virus
uccaaauuauuccccuucaucc

SEQ ID NO: 4047187 - RNA, 13 nt, Norwalk virus
uccacaacagcug

SEQ ID NO: 4047188 - RNA, 13 nt, Norwalk virus
uccgcacuggugg

SEQ ID NO: 4047189 - RNA, 21 nt, Norwalk virus
uccgcacugguggugguacug

SEQ ID NO: 4047190 - RNA, 12 nt, Norwalk virus
ucucaauacagu

SEQ ID NO: 4047191 - RNA, 23 nt, Norwalk virus
ucugggagcgggcauacagguug

SEQ ID NO: 4047192 - RNA, 21 nt, Norwalk virus
ucuuaauccuuucuugcucca

SEQ ID NO: 4047193 - RNA, 13 nt, Norwalk virus
ucuuuguuucaug

SEQ ID NO: 4047194 - RNA, 13 nt, Norwalk virus
ugaacaagccccu

SEQ ID NO: 4047195 - RNA, 13 nt, Norwalk virus
ugacuccacccgg

SEQ ID NO: 4047196 - RNA, 18 nt, Norwalk virus
ugccagguccuggugcuu

SEQ ID NO: 4047197 - RNA, 12 nt, Norwalk virus
ugccccaguccu

SEQ ID NO: 4047198 - RNA, 13 nt, Norwalk virus
ugccuuuggaaga

SEQ ID NO: 4047199 - RNA, 22 nt, Norwalk virus
ugcgccgauaauggcccaagcc

SEQ ID NO: 4047200 - RNA, 18 nt, Norwalk virus
ugcugaugcagcaagauc

SEQ ID NO: 4047201 - RNA, 13 nt, Norwalk virus
ugggucaaguauu

SEQ ID NO: 4047202 - RNA, 15 nt, Norwalk virus
uguauaccccccugg

SEQ ID NO: 4047203 - RNA, 16 nt, Norwalk virus
ugugauuggcauauca

SEQ ID NO: 4047204 - RNA, 21 nt, Norwalk virus
uuaccacaagaguacauuuca

SEQ ID NO: 4047205 - RNA, 16 nt, Norwalk virus
uuagcuggauuucccc

SEQ ID NO: 4047206 - RNA, 19 nt, Norwalk virus
uucuuagcuggauuucccc

SEQ ID NO: 4047207 - RNA, 18 nt, Norwalk virus
uuguaauaugaaaugugg

SEQ ID NO: 4047208 - RNA, 20 nt, Norwalk virus
uuuccccaaauaauaccccc

SEQ ID NO: 4047209 - RNA, 16 nt, Norwalk virus
uuuccugcauaccccc

SEQ ID NO: 4047210 - RNA, 16 nt, Norwalk virus
aucauauucauuuaau

SEQ ID NO: 4047211 - RNA, 21 nt, Norwalk virus
augaaaugugggcaucauauu

SEQ ID NO: 4047212 - RNA, 17 nt, Norwalk virus
auggcgcuaguggcgcu

SEQ ID NO: 4047213 - RNA, 20 nt, Norwalk virus
auuaguaauccaaauuauuc

SEQ ID NO: 4047214 - RNA, 17 nt, Norwalk virus
auuuaauuagguuuaau

SEQ ID NO: 4047215 - RNA, 20 nt, Norwalk virus
auuucaauacagacagguug

SEQ ID NO: 4047216 - RNA, 22 nt, Norwalk virus
auuugaguuuggguccccaucu

SEQ ID NO: 4047217 - RNA, 19 nt, Norwalk virus
auuuggaaaucuuucucca

SEQ ID NO: 4047218 - RNA, 21 nt, Norwalk virus
caaagguaucaacaaaauuug

SEQ ID NO: 4047219 - RNA, 14 nt, Norwalk virus
caacucucuuucca

SEQ ID NO: 4047220 - RNA, 17 nt, Norwalk virus
caagauaagagggaccu

SEQ ID NO: 4047221 - RNA, 14 nt, Norwalk virus
caaguuaauccuau

SEQ ID NO: 4047222 - RNA, 18 nt, Norwalk virus
caaguugaccuuuggaag

SEQ ID NO: 4047223 - RNA, 19 nt, Norwalk virus
cacagcagguagugcucug

SEQ ID NO: 4047224 - RNA, 21 nt, Norwalk virus
cacccuuuugagggcccugcc

SEQ ID NO: 4047225 - RNA, 22 nt, Norwalk virus
cacugguggugguacuggugau

SEQ ID NO: 4047226 - RNA, 19 nt, Norwalk virus
cacuuuugucccccaucuu

SEQ ID NO: 4047227 - RNA, 22 nt, Norwalk virus
caggcaaauggcauuggcagug

SEQ ID NO: 4047228 - RNA, 14 nt, Norwalk virus
cagguccuggugcu

SEQ ID NO: 4047229 - RNA, 12 nt, Norwalk virus
cagguucaauca

SEQ ID NO: 4047230 - RNA, 17 nt, Norwalk virus
cagucgcgacugcugga

SEQ ID NO: 4047231 - RNA, 21 nt, Norwalk virus
caguucccauaccauuugccu

SEQ ID NO: 4047232 - RNA, 14 nt, Norwalk virus
caucauauucauuu

SEQ ID NO: 4047233 - RNA, 13 nt, Norwalk virus
caucuagccccuu

SEQ ID NO: 4047234 - RNA, 12 nt, Norwalk virus
caucuaucacaa

SEQ ID NO: 4047235 - RNA, 13 nt, Norwalk virus
caugcgccuugug

SEQ ID NO: 4047236 - RNA, 16 nt, Norwalk virus
caugcuguacaccccc

SEQ ID NO: 4047237 - RNA, 20 nt, Norwalk virus
cauugaggugccuuuggaag

SEQ ID NO: 4047238 - RNA, 16 nt, Norwalk virus
cauuguagauuggaau

SEQ ID NO: 4047239 - RNA, 20 nt, Norwalk virus
ccaggcccuucacacuccca

SEQ ID NO: 4047240 - RNA, 11 nt, Norwalk virus
ccaguuucauu

SEQ ID NO: 4047241 - RNA, 20 nt, Norwalk virus
ccaugcgccuugugugcaug

SEQ ID NO: 4047242 - RNA, 14 nt, Norwalk virus
ccauugaguucucu

SEQ ID NO: 4047243 - RNA, 20 nt, Norwalk virus
cccaguuucauugucacaug

SEQ ID NO: 4047244 - RNA, 19 nt, Norwalk virus
ccccaguccugauuuuaau

SEQ ID NO: 4047245 - RNA, 15 nt, Norwalk virus
ccccaguuucauugu

SEQ ID NO: 4047246 - RNA, 13 nt, Norwalk virus
ccgcacugguggu

SEQ ID NO: 4047247 - RNA, 15 nt, Norwalk virus
ccgucuggcucccaa

SEQ ID NO: 4047248 - RNA, 13 nt, Norwalk virus
ccuucacacuccc

SEQ ID NO: 4047249 - RNA, 14 nt, Norwalk virus
cgcuggucaguugg

SEQ ID NO: 4047250 - RNA, 11 nt, Norwalk virus
cgucuggcucc

SEQ ID NO: 4047251 - RNA, 12 nt, Norwalk virus
cgucuggcuccc

SEQ ID NO: 4047252 - RNA, 16 nt, Norwalk virus
cgugccccucucccaa

SEQ ID NO: 4047253 - RNA, 17 nt, Norwalk virus
cuaaaaauuuggcaacu

SEQ ID NO: 4047254 - RNA, 20 nt, Norwalk virus
cuacacugucuucugugcca

SEQ ID NO: 4047255 - RNA, 12 nt, Norwalk virus
cuagccccuucu

SEQ ID NO: 4047256 - RNA, 20 nt, Norwalk virus
cucacgugccccucucccaa

SEQ ID NO: 4047257 - RNA, 18 nt, Norwalk virus
cucaucgagauuuggaaa

SEQ ID NO: 4047258 - RNA, 23 nt, Norwalk virus
cuccaaagccaaagguaucaaca

SEQ ID NO: 4047259 - RNA, 21 nt, Norwalk virus
cuccacccgguucaacagccu

SEQ ID NO: 4047260 - RNA, 17 nt, Norwalk virus
cucccgaguccucugcu

SEQ ID NO: 4047261 - RNA, 14 nt, Norwalk virus
cuccgcacuggugg

SEQ ID NO: 4047262 - RNA, 20 nt, Norwalk virus
cucugucuaacucacgugcc

SEQ ID NO: 4047263 - RNA, 22 nt, Norwalk virus
cugacacuuuugucccccaucu

SEQ ID NO: 4047264 - RNA, 19 nt, Norwalk virus
cugccauugaguucucugu

SEQ ID NO: 4047265 - RNA, 16 nt, Norwalk virus
cugguuggcaccaccc

SEQ ID NO: 4047266 - RNA, 13 nt, Norwalk virus
cugucuauuacca

SEQ ID NO: 4047267 - RNA, 15 nt, Norwalk virus
cugugggaacugcca

SEQ ID NO: 4047268 - RNA, 15 nt, Norwalk virus
cuucuguauaccccc

SEQ ID NO: 4047269 - RNA, 16 nt, Norwalk virus
cuucugugccacgugg

SEQ ID NO: 4047270 - RNA, 14 nt, Norwalk virus
cuuucuugcuccau

SEQ ID NO: 4047271 - RNA, 13 nt, Norwalk virus
gaaaugugggcau

SEQ ID NO: 4047272 - RNA, 23 nt, Norwalk virus
gaaaugugggcaucauauucauu

SEQ ID NO: 4047273 - RNA, 12 nt, Norwalk virus
gaacaagccccu

SEQ ID NO: 4047274 - RNA, 15 nt, Norwalk virus
gacuugccccagucc

SEQ ID NO: 4047275 - RNA, 19 nt, Norwalk virus
gagauuuggaaaucuuucu

SEQ ID NO: 4047276 - RNA, 15 nt, Norwalk virus
gaguuugggucccca

SEQ ID NO: 4047277 - RNA, 18 nt, Norwalk virus
gcaauugcugcuuccaca

SEQ ID NO: 4047278 - RNA, 23 nt, Norwalk virus
gcacugguggugguacuggugau

SEQ ID NO: 4047279 - RNA, 23 nt, Norwalk virus
gccaagauaagagggaccuccaa

SEQ ID NO: 4047280 - RNA, 15 nt, Norwalk virus
gcccccauuggguuu

SEQ ID NO: 4047281 - RNA, 23 nt, Norwalk virus
gcccccauuggguuuccagaccu

SEQ ID NO: 4047282 - RNA, 16 nt, Norwalk virus
gcggcccuccaaagcc

SEQ ID NO: 4047283 - RNA, 17 nt, Norwalk virus
gcuuauaauuugcccug

SEQ ID NO: 4047284 - RNA, 14 nt, Norwalk virus
ggcaggagcuccag

SEQ ID NO: 4047285 - RNA, 18 nt, Norwalk virus
gggaacugccagcucggc

SEQ ID NO: 4047286 - RNA, 13 nt, Norwalk virus
ggguaucagguug

SEQ ID NO: 4047287 - RNA, 23 nt, Norwalk virus
gguauuggucuuuuucaugucaa

SEQ ID NO: 4047288 - RNA, 15 nt, Norwalk virus
gguccacaacagcug

SEQ ID NO: 4047289 - RNA, 15 nt, Norwalk virus
ggugccuuuggaaga

SEQ ID NO: 4047290 - RNA, 16 nt, Norwalk virus
gguggcuucaugucag

SEQ ID NO: 4047291 - RNA, 21 nt, Norwalk virus
guaccggagguuaaugcuucu

SEQ ID NO: 4047292 - RNA, 15 nt, Norwalk virus
guaucagguugaagc

SEQ ID NO: 4047293 - RNA, 14 nt, Norwalk virus
gucgcgacugcugg

SEQ ID NO: 4047294 - RNA, 17 nt, Norwalk virus
gugauugcugauguuag

SEQ ID NO: 4047295 - RNA, 13 nt, Norwalk virus
gugccuuuggaag

SEQ ID NO: 4047296 - RNA, 23 nt, Norwalk virus
gugcuggggguuugaccagugcu

SEQ ID NO: 4047297 - RNA, 15 nt, Norwalk virus
guugaccuuuggaag

SEQ ID NO: 4047298 - RNA, 17 nt, Norwalk virus
uaagcaaaaacagguuc

SEQ ID NO: 4047299 - RNA, 13 nt, Norwalk virus
uaauccaaauuau

SEQ ID NO: 4047300 - RNA, 13 nt, Norwalk virus
uacauuucacauc

SEQ ID NO: 4047301 - RNA, 18 nt, Norwalk virus
uaguaauccaaauuauuc

SEQ ID NO: 4047302 - RNA, 17 nt, Norwalk virus
uaguuuccugcauaccc

SEQ ID NO: 4047303 - RNA, 15 nt, Norwalk virus
uaucggcauuucccc

SEQ ID NO: 4047304 - RNA, 20 nt, Norwalk virus
uaugacuugccccaguccug

SEQ ID NO: 4047305 - RNA, 17 nt, Norwalk virus
ucaauacagacagguug

SEQ ID NO: 4047306 - RNA, 12 nt, Norwalk virus
ucaaucaucugg

SEQ ID NO: 4047307 - RNA, 15 nt, Norwalk virus
ucccaaucaguagua

SEQ ID NO: 4047308 - RNA, 13 nt, Norwalk virus
ucccccccaucac

SEQ ID NO: 4047309 - RNA, 14 nt, Norwalk virus
ucgagauuuggaaa

SEQ ID NO: 4047310 - RNA, 15 nt, Norwalk virus
ucuaagcaaaaacag

SEQ ID NO: 4047311 - RNA, 19 nt, Norwalk virus
ucuaagcaaaaacagguuc

SEQ ID NO: 4047312 - RNA, 17 nt, Norwalk virus
ugaauuuacuauuuccc

SEQ ID NO: 4047313 - RNA, 16 nt, Norwalk virus
ugagagugucugcucc

SEQ ID NO: 4047314 - RNA, 12 nt, Norwalk virus
ugcaagcccccc

SEQ ID NO: 4047315 - RNA, 20 nt, Norwalk virus
ugcaugcuguacaccccccu

SEQ ID NO: 4047316 - RNA, 15 nt, Norwalk virus
ugccgaucaaugggg

SEQ ID NO: 4047317 - RNA, 18 nt, Norwalk virus
ugcuagcugguaaugccu

SEQ ID NO: 4047318 - RNA, 14 nt, Norwalk virus
ugcucccgaguccu

SEQ ID NO: 4047319 - RNA, 19 nt, Norwalk virus
uggaagauccccaauuaug

SEQ ID NO: 4047320 - RNA, 19 nt, Norwalk virus
uggagcagaaaaccaggcc

SEQ ID NO: 4047321 - RNA, 15 nt, Norwalk virus
uggcaggagcuccag

SEQ ID NO: 4047322 - RNA, 23 nt, Norwalk virus
uggcccaagccauaauuggugca

SEQ ID NO: 4047323 - RNA, 16 nt, Norwalk virus
ugggaacugccagcuc

SEQ ID NO: 4047324 - RNA, 20 nt, Norwalk virus
uguaggugaggcugcccugc

SEQ ID NO: 4047325 - RNA, 14 nt, Norwalk virus
ugugguugacucca

SEQ ID NO: 4047326 - RNA, 15 nt, Norwalk virus
uucauaauaaugaua

SEQ ID NO: 4047327 - RNA, 23 nt, Norwalk virus
uugaagcuucaaaucaauuauug

SEQ ID NO: 4047328 - RNA, 22 nt, Norwalk virus
uuguaauaugaaaugugggcau

SEQ ID NO: 4047329 - RNA, 14 nt, Norwalk virus
uugugcaagccccc

SEQ ID NO: 4047330 - RNA, 15 nt, Norwalk virus
uuucacaucuugcua

SEQ ID NO: 4047331 - RNA, 22 nt, Norwalk virus
uuucacaucuugcuagugaaca

SEQ ID NO: 4047332 - RNA, 16 nt, Norwalk virus
aaucaucugguauuag

SEQ ID NO: 4047333 - RNA, 13 nt, Norwalk virus
aauuggauggcac

SEQ ID NO: 4047334 - RNA, 15 nt, Norwalk virus
acaugugauugcuga

SEQ ID NO: 4047335 - RNA, 15 nt, Norwalk virus
acgugccccucuccc

SEQ ID NO: 4047336 - RNA, 14 nt, Norwalk virus
acucuggauggccg

SEQ ID NO: 4047337 - RNA, 15 nt, Norwalk virus
agacagguugccauu

SEQ ID NO: 4047338 - RNA, 15 nt, Norwalk virus
agacccaguaugaug

SEQ ID NO: 4047339 - RNA, 23 nt, Norwalk virus
agcaacucucuuuccacauguga

SEQ ID NO: 4047340 - RNA, 21 nt, Norwalk virus
agccagacccaguaugaugua

SEQ ID NO: 4047341 - RNA, 19 nt, Norwalk virus
agccucuucuacacugucu

SEQ ID NO: 4047342 - RNA, 17 nt, Norwalk virus
agcgggcauacagguug

SEQ ID NO: 4047343 - RNA, 22 nt, Norwalk virus
agcgggcauacagguugguggc

SEQ ID NO: 4047344 - RNA, 15 nt, Norwalk virus
aggcaaauggcauug

SEQ ID NO: 4047345 - RNA, 17 nt, Norwalk virus
aggcugcccugcuccac

SEQ ID NO: 4047346 - RNA, 13 nt, Norwalk virus
agggaaaugauug

SEQ ID NO: 4047347 - RNA, 19 nt, Norwalk virus
aguaauccaaauuauuccc

SEQ ID NO: 4047348 - RNA, 14 nt, Norwalk virus
auccauuucucgaa

SEQ ID NO: 4047349 - RNA, 18 nt, Norwalk virus
auucuagccagacccagu

SEQ ID NO: 4047350 - RNA, 12 nt, Norwalk virus
auuggauggcac

SEQ ID NO: 4047351 - RNA, 19 nt, Norwalk virus
auuggcagugguaauuaug

SEQ ID NO: 4047352 - RNA, 16 nt, Norwalk virus
auuuaauuagguuuaa

SEQ ID NO: 4047353 - RNA, 21 nt, Norwalk virus
auuucccccccaucacacccg

SEQ ID NO: 4047354 - RNA, 19 nt, Norwalk virus
caaagcauacccugauggu

SEQ ID NO: 4047355 - RNA, 15 nt, Norwalk virus
caagagguaggcuug

SEQ ID NO: 4047356 - RNA, 14 nt, Norwalk virus
caauuaaagccugu

SEQ ID NO: 4047357 - RNA, 20 nt, Norwalk virus
cacaagaguacauuucacau

SEQ ID NO: 4047358 - RNA, 19 nt, Norwalk virus
cacaucuagccccuucugu

SEQ ID NO: 4047359 - RNA, 17 nt, Norwalk virus
cacccuuuugagggccc

SEQ ID NO: 4047360 - RNA, 15 nt, Norwalk virus
cacgcggaggcucuc

SEQ ID NO: 4047361 - RNA, 11 nt, Norwalk virus
cagacagguug

SEQ ID NO: 4047362 - RNA, 12 nt, Norwalk virus
cagagugugcag

SEQ ID NO: 4047363 - RNA, 18 nt, Norwalk virus
caggcccuucacacuccc

SEQ ID NO: 4047364 - RNA, 18 nt, Norwalk virus
cagguagugcucugggag

SEQ ID NO: 4047365 - RNA, 20 nt, Norwalk virus
aaaugugggcaucauauuca

SEQ ID NO: 4047366 - RNA, 22 nt, Norwalk virus
aacagccucuucuacacugucu

SEQ ID NO: 4047367 - RNA, 14 nt, Norwalk virus
aagauguuaggaau

SEQ ID NO: 4047368 - RNA, 19 nt, Norwalk virus
aagcaacucucuuuccaca

SEQ ID NO: 4047369 - RNA, 14 nt, Norwalk virus
aagcuucaaaucaa

SEQ ID NO: 4047370 - RNA, 17 nt, Norwalk virus
aagguaucaacaaaauu

SEQ ID NO: 4047371 - RNA, 18 nt, Norwalk virus
aauucaggcaaauggcau

SEQ ID NO: 4047372 - RNA, 23 nt, Norwalk virus
acaaauguauaaugguuggguug

SEQ ID NO: 4047373 - RNA, 23 nt, Norwalk virus
acaagcaacucucuuuccacaug

SEQ ID NO: 4047374 - RNA, 22 nt, Norwalk virus
acacaguuuggccauucuagcc

SEQ ID NO: 4047375 - RNA, 16 nt, Norwalk virus
accacuaguugggucg

SEQ ID NO: 4047376 - RNA, 15 nt, Norwalk virus
accagugcugaugca

SEQ ID NO: 4047377 - RNA, 18 nt, Norwalk virus
accuccaauggcacugua

SEQ ID NO: 4047378 - RNA, 11 nt, Norwalk virus
acucuggaugg

SEQ ID NO: 4047379 - RNA, 18 nt, Norwalk virus
acugccagcucggcaaga

SEQ ID NO: 4047380 - RNA, 17 nt, Norwalk virus
acuguaggugaggcugc

SEQ ID NO: 4047381 - RNA, 19 nt, Norwalk virus
agcuccagucacccgcauu

SEQ ID NO: 4047382 - RNA, 16 nt, Norwalk virus
aggcugcccugcucca

SEQ ID NO: 4047383 - RNA, 19 nt, Norwalk virus
agggaccuccaauggcacu

SEQ ID NO: 4047384 - RNA, 17 nt, Norwalk virus
agggcccugcccccauu

SEQ ID NO: 4047385 - RNA, 15 nt, Norwalk virus
aggugaggcugcccu

SEQ ID NO: 4047386 - RNA, 20 nt, Norwalk virus
agguuaaugcuucugacccu

SEQ ID NO: 4047387 - RNA, 13 nt, Norwalk virus
agucaggauuaug

SEQ ID NO: 4047388 - RNA, 20 nt, Norwalk virus
auaauuuugugcaagccccc

SEQ ID NO: 4047389 - RNA, 13 nt, Norwalk virus
auaugaaaugugg

SEQ ID NO: 4047390 - RNA, 20 nt, Norwalk virus
auccuauugaucccuggaua

SEQ ID NO: 4047391 - RNA, 20 nt, Norwalk virus
augcuguacaccccccuccg

SEQ ID NO: 4047392 - RNA, 12 nt, Norwalk virus
auggcacacccu

SEQ ID NO: 4047393 - RNA, 15 nt, Norwalk virus
auuuaauuagguuua

SEQ ID NO: 4047394 - RNA, 15 nt, Norwalk virus
caaagcauacccuga

SEQ ID NO: 4047395 - RNA, 19 nt, Norwalk virus
caaaucugccauugaguuc

SEQ ID NO: 4047396 - RNA, 20 nt, Norwalk virus
caacagccucuucuacacug

SEQ ID NO: 4047397 - RNA, 23 nt, Norwalk virus
cacaagaguacauuucacaucuu

SEQ ID NO: 4047398 - RNA, 15 nt, Norwalk virus
cacgugccccucucc

SEQ ID NO: 4047399 - RNA, 21 nt, Norwalk virus
cacugguggugguacugguga

SEQ ID NO: 4047400 - RNA, 19 nt, Norwalk virus
cagucgcgacugcuggaca

SEQ ID NO: 4047401 - RNA, 24 nt, Norwalk virus
caucaagcguggauggcgcuagug

SEQ ID NO: 4047402 - RNA, 15 nt, Norwalk virus
caucugguauuagua

SEQ ID NO: 4047403 - RNA, 20 nt, Norwalk virus
cauuucacaucuugcuagug

SEQ ID NO: 4047404 - RNA, 19 nt, Norwalk virus
ccaaaucugccauugaguu

SEQ ID NO: 4047405 - RNA, 12 nt, Norwalk virus
ccaauggcacug

SEQ ID NO: 4047406 - RNA, 14 nt, Norwalk virus
ccaccccaguuuca

SEQ ID NO: 4047407 - RNA, 18 nt, Norwalk virus
ccaucuaucacaaaugua

SEQ ID NO: 4047408 - RNA, 21 nt, Norwalk virus
ccuggauaauuaauaauuuug

SEQ ID NO: 4047409 - RNA, 19 nt, Norwalk virus
ccugguuggcaccacccca

SEQ ID NO: 4047410 - RNA, 15 nt, Norwalk virus
cggcccuccaaagcc

SEQ ID NO: 4047411 - RNA, 18 nt, Norwalk virus
cgguguacucuggauggc

SEQ ID NO: 4047412 - RNA, 15 nt, Norwalk virus
cgugccccucuccca

SEQ ID NO: 4047413 - RNA, 15 nt, Norwalk virus
cuauagcacaagcaa

SEQ ID NO: 4047414 - RNA, 15 nt, Norwalk virus
cucaauacagugugg

SEQ ID NO: 4047415 - RNA, 21 nt, Norwalk virus
cucaucgagauuuggaaaucu

SEQ ID NO: 4047416 - RNA, 21 nt, Norwalk virus
cuccauaccacgcggaggcuc

SEQ ID NO: 4047417 - RNA, 21 nt, Norwalk virus
cucggguccacaacagcugcc

SEQ ID NO: 4047418 - RNA, 13 nt, Norwalk virus
cucuuuccacaug

SEQ ID NO: 4047419 - RNA, 23 nt, Norwalk virus
cugaugcagcaagaucuguggca

SEQ ID NO: 4047420 - RNA, 14 nt, Norwalk virus
cugcccugcuccac

SEQ ID NO: 4047421 - RNA, 18 nt, Norwalk virus
cugguuuugguucacaua

SEQ ID NO: 4047422 - RNA, 15 nt, Norwalk virus
cugucuucugugcca

SEQ ID NO: 4047423 - RNA, 21 nt, Norwalk virus
cugugggaacugccagcucgg

SEQ ID NO: 4047424 - RNA, 12 nt, Norwalk virus
cuugcuagugaa

SEQ ID NO: 4047425 - RNA, 19 nt, Norwalk virus
cuuuugucccccaucuugg

SEQ ID NO: 4047426 - RNA, 19 nt, Norwalk virus
gaaaucuuucuccauacca

SEQ ID NO: 4047427 - RNA, 15 nt, Norwalk virus
gaaaugugggcauca

SEQ ID NO: 4047428 - RNA, 16 nt, Norwalk virus
gaauuuacuauuuccc

SEQ ID NO: 4047429 - RNA, 19 nt, Norwalk virus
gaauuuacuauuuccccaa

SEQ ID NO: 4047430 - RNA, 17 nt, Norwalk virus
gacacuuuuguccccca

SEQ ID NO: 4047431 - RNA, 20 nt, Norwalk virus
gacagcagucgcgacugcug

SEQ ID NO: 4047432 - RNA, 14 nt, Norwalk virus
gauaauaguuuccu

SEQ ID NO: 4047433 - RNA, 17 nt, Norwalk virus
gcuucaugucaguuccc

SEQ ID NO: 4047434 - RNA, 16 nt, Norwalk virus
ggacucuagaccccau

SEQ ID NO: 4047435 - RNA, 13 nt, Norwalk virus
ggcaccaccccag

SEQ ID NO: 4047436 - RNA, 20 nt, Norwalk virus
ggcgcuaguggcgcugguca

SEQ ID NO: 4047437 - RNA, 18 nt, Norwalk virus
ggcuucaugucaguuccc

SEQ ID NO: 4047438 - RNA, 16 nt, Norwalk virus
gguccacaacagcugc

SEQ ID NO: 4047439 - RNA, 13 nt, Norwalk virus
gguccuggugcuu

SEQ ID NO: 4047440 - RNA, 14 nt, Norwalk virus
ggugcaauugcugc

SEQ ID NO: 4047441 - RNA, 22 nt, Norwalk virus
gucgcgacugcuggacaaguua

SEQ ID NO: 4047442 - RNA, 14 nt, Norwalk virus
gucuauuaccacaa

SEQ ID NO: 4047443 - RNA, 18 nt, Norwalk virus
gugagagugucugcuccc

SEQ ID NO: 4047444 - RNA, 14 nt, Norwalk virus
gugaggcugcccug

SEQ ID NO: 4047445 - RNA, 20 nt, Norwalk virus
uaauccuauugaucccugga

SEQ ID NO: 4047446 - RNA, 19 nt, Norwalk virus
uaauccuuucuugcuccau

SEQ ID NO: 4047447 - RNA, 22 nt, Norwalk virus
uaaugcuucugacccucuugca

SEQ ID NO: 4047448 - RNA, 22 nt, Norwalk virus
uacaccccccuccgcacuggug

SEQ ID NO: 4047449 - RNA, 15 nt, Norwalk virus
uauaauuugcccugu

SEQ ID NO: 4047450 - RNA, 20 nt, Norwalk virus
uaugacacaguuuggccauu

SEQ ID NO: 4047451 - RNA, 23 nt, Norwalk virus
ucauauucauuuaauuagguuua

SEQ ID NO: 4047452 - RNA, 19 nt, Norwalk virus
uccacagcagguagugcuc

SEQ ID NO: 4047453 - RNA, 22 nt, Norwalk virus
uccacccgguucaacagccucu

SEQ ID NO: 4047454 - RNA, 15 nt, Norwalk virus
uccagaccucggugg

SEQ ID NO: 4047455 - RNA, 20 nt, Norwalk virus
uccagaccucggugguugug

SEQ ID NO: 4047456 - RNA, 15 nt, Norwalk virus
ucccccaucuugguu

SEQ ID NO: 4047457 - RNA, 20 nt, Norwalk virus
ucuacacugucuucugugcc

SEQ ID NO: 4047458 - RNA, 17 nt, Norwalk virus
ucuaucacaaauguaua

SEQ ID NO: 4047459 - RNA, 22 nt, Norwalk virus
ugaagcuucaaaucaauuauug

SEQ ID NO: 4047460 - RNA, 17 nt, Norwalk virus
ugaggcugcccugcucc

SEQ ID NO: 4047461 - RNA, 20 nt, Norwalk virus
ugaguuuggguccccaucuu

SEQ ID NO: 4047462 - RNA, 20 nt, Norwalk virus
ugccacgugguuauuucaau

SEQ ID NO: 4047463 - RNA, 20 nt, Norwalk virus
ugcgccuugugugcaugcug

SEQ ID NO: 4047464 - RNA, 12 nt, Norwalk virus
ugcuggacaagu

SEQ ID NO: 4047465 - RNA, 19 nt, Norwalk virus
ugcuggggguuugaccagu

SEQ ID NO: 4047466 - RNA, 17 nt, Norwalk virus
ugcuuauaauuugcccu

SEQ ID NO: 4047467 - RNA, 17 nt, Norwalk virus
uggcagugguaauuaug

SEQ ID NO: 4047468 - RNA, 15 nt, Norwalk virus
ugugcaugcuguaca

SEQ ID NO: 4047469 - RNA, 14 nt, Norwalk virus
uguuaggacucuag

SEQ ID NO: 4047470 - RNA, 21 nt, Norwalk virus
uuaauuagguuuaauuagguu

SEQ ID NO: 4047471 - RNA, 13 nt, Norwalk virus
uuacuauuucccc

SEQ ID NO: 4047472 - RNA, 21 nt, Norwalk virus
uucaauacagacagguugcca

SEQ ID NO: 4047473 - RNA, 19 nt, Norwalk virus
uucacauaaucuuacuaua

SEQ ID NO: 4047474 - RNA, 20 nt, Norwalk virus
uucauugucacauguugcca

SEQ ID NO: 4047475 - RNA, 16 nt, Norwalk virus
uucuucgacagcaguc

SEQ ID NO: 4047476 - RNA, 14 nt, Norwalk virus
uugaggugccuuug

SEQ ID NO: 4047477 - RNA, 20 nt, Norwalk virus
uuggguccccaucuuaaucc

SEQ ID NO: 4047478 - RNA, 17 nt, Norwalk virus
uuuaauuagguuuaauu

SEQ ID NO: 4047479 - RNA, 14 nt, Norwalk virus
uuuacuauuucccc

SEQ ID NO: 4047480 - RNA, 12 nt, Norwalk virus
uuucaauacaga

SEQ ID NO: 4047481 - RNA, 14 nt, Respiratory syncytial virus
aaaaagaucucaaa

SEQ ID NO: 4047482 - RNA, 18 nt, Respiratory syncytial virus
aaaaauggggcaaauaaa

SEQ ID NO: 4047483 - RNA, 13 nt, Respiratory syncytial virus
aaaaauucccaua

SEQ ID NO: 4047484 - RNA, 23 nt, Respiratory syncytial virus
aaaagugcucuacuauccacaaa

SEQ ID NO: 4047485 - RNA, 20 nt, Respiratory syncytial virus
aaaauaccaauguaacauua

SEQ ID NO: 4047486 - RNA, 20 nt, Respiratory syncytial virus
aaaaucacucuacaaaacaa

SEQ ID NO: 4047487 - RNA, 13 nt, Respiratory syncytial virus
aaacccaucugga

SEQ ID NO: 4047488 - RNA, 22 nt, Respiratory syncytial virus
aaacuaagugauucaacaauga

SEQ ID NO: 4047489 - RNA, 17 nt, Respiratory syncytial virus
aaagaucucacuaugaa

SEQ ID NO: 4047490 - RNA, 23 nt, Respiratory syncytial virus
aaagcccuauaacaucaaauuca

SEQ ID NO: 4047491 - RNA, 15 nt, Respiratory syncytial virus
aaauaaagaucugaa

SEQ ID NO: 4047492 - RNA, 13 nt, Respiratory syncytial virus
aaauaauauugca

SEQ ID NO: 4047493 - RNA, 21 nt, Respiratory syncytial virus
aaauccagaacacacaaguca

SEQ ID NO: 4047494 - RNA, 21 nt, Respiratory syncytial virus
aaaucguggaaucauaaagac

SEQ ID NO: 4047495 - RNA, 12 nt, Respiratory syncytial virus
aaaugaaauuug

SEQ ID NO: 4047496 - RNA, 14 nt, Respiratory syncytial virus
aaauucccauagcu

SEQ ID NO: 4047497 - RNA, 15 nt, Respiratory syncytial virus
aaauuuucuacaaca

SEQ ID NO: 4047498 - RNA, 23 nt, Respiratory syncytial virus
aacaauaccaaaaauaccaaugu

SEQ ID NO: 4047499 - RNA, 11 nt, Respiratory syncytial virus
aacaaugccag

SEQ ID NO: 4047500 - RNA, 16 nt, Respiratory syncytial virus
aacacacuugaaaaua

SEQ ID NO: 4047501 - RNA, 19 nt, Respiratory syncytial virus
aacaccaagugucaaguca

SEQ ID NO: 4047502 - RNA, 15 nt, Respiratory syncytial virus
aacacucaauccuaa

SEQ ID NO: 4047503 - RNA, 15 nt, Respiratory syncytial virus
aacagagcuaccaaa

SEQ ID NO: 4047504 - RNA, 15 nt, Respiratory syncytial virus
aacaucaaaaaaagu

SEQ ID NO: 4047505 - RNA, 12 nt, Respiratory syncytial virus
aaccaaacaucu

SEQ ID NO: 4047506 - RNA, 16 nt, Respiratory syncytial virus
aaccacugaauucaaa

SEQ ID NO: 4047507 - RNA, 12 nt, Respiratory syncytial virus
aaccagcaaagu

SEQ ID NO: 4047508 - RNA, 14 nt, Respiratory syncytial virus
aacgccaaaacaaa

SEQ ID NO: 4047509 - RNA, 15 nt, Respiratory syncytial virus
aacuaagugauucaa

SEQ ID NO: 4047510 - RNA, 15 nt, Respiratory syncytial virus
aagaugcaacaagcc

SEQ ID NO: 4047511 - RNA, 19 nt, Respiratory syncytial virus
aagauggggcaaauacaaa

SEQ ID NO: 4047512 - RNA, 16 nt, Respiratory syncytial virus
aaguaaccaaagaaag

SEQ ID NO: 4047513 - RNA, 21 nt, Respiratory syncytial virus
aagucaacccugcaauccaca

SEQ ID NO: 4047514 - RNA, 13 nt, Respiratory syncytial virus
aagucauuguuca

SEQ ID NO: 4047515 - RNA, 22 nt, Respiratory syncytial virus
aagugaaauacuaggaaugcuu

SEQ ID NO: 4047516 - RNA, 23 nt, Respiratory syncytial virus
aagugcucuacuauccacaaaca

SEQ ID NO: 4047517 - RNA, 18 nt, Respiratory syncytial virus
aagugucucucaauccaa

SEQ ID NO: 4047518 - RNA, 18 nt, Respiratory syncytial virus
aaguuagauuacaaaauu

SEQ ID NO: 4047519 - RNA, 18 nt, Respiratory syncytial virus
aauacaaugucuuagaaa

SEQ ID NO: 4047520 - RNA, 16 nt, Respiratory syncytial virus
aauauacaaguaugau

SEQ ID NO: 4047521 - RNA, 22 nt, Respiratory syncytial virus
aaucaacucuggggcaaauaac

SEQ ID NO: 4047522 - RNA, 22 nt, Respiratory syncytial virus
aaucaagaucuauaugaugcug

SEQ ID NO: 4047523 - RNA, 20 nt, Respiratory syncytial virus
aaucauuggaggaaauccaa

SEQ ID NO: 4047524 - RNA, 16 nt, Respiratory syncytial virus
aauccaauuucacaac

SEQ ID NO: 4047525 - RNA, 15 nt, Respiratory syncytial virus
aauccacaacaguca

SEQ ID NO: 4047526 - RNA, 16 nt, Respiratory syncytial virus
aaugagacagaugaua

SEQ ID NO: 4047527 - RNA, 20 nt, Respiratory syncytial virus
aauggagccugaaaauuaua

SEQ ID NO: 4047528 - RNA, 20 nt, Respiratory syncytial virus
aaugucuuagaaaaagacga

SEQ ID NO: 4047529 - RNA, 12 nt, Respiratory syncytial virus
aauuugaaaaua

SEQ ID NO: 4047530 - RNA, 21 nt, Respiratory syncytial virus
aauuuguuugacaaugaugaa

SEQ ID NO: 4047531 - RNA, 23 nt, Respiratory syncytial virus
aauuuuuuaauaacuuuuaguga

SEQ ID NO: 4047532 - RNA, 14 nt, Respiratory syncytial virus
acaaagcacacucc

SEQ ID NO: 4047533 - RNA, 12 nt, Respiratory syncytial virus
acaaucugaaau

SEQ ID NO: 4047534 - RNA, 23 nt, Respiratory syncytial virus
acaaucugaaauaacaacuucau

SEQ ID NO: 4047535 - RNA, 17 nt, Respiratory syncytial virus
acaaugaccaauuauau

SEQ ID NO: 4047536 - RNA, 19 nt, Respiratory syncytial virus
acaauugugaaauuaaauu

SEQ ID NO: 4047537 - RNA, 19 nt, Respiratory syncytial virus
acacaagagucacacaauc

SEQ ID NO: 4047538 - RNA, 13 nt, Respiratory syncytial virus
acacuaacacugu

SEQ ID NO: 4047539 - RNA, 22 nt, Respiratory syncytial virus
acacuaacacuguauucaauua

SEQ ID NO: 4047540 - RNA, 12 nt, Respiratory syncytial virus
acacuaauacac

SEQ ID NO: 4047541 - RNA, 17 nt, Respiratory syncytial virus
acacucaacaaagauca

SEQ ID NO: 4047542 - RNA, 21 nt, Respiratory syncytial virus
acagaagauaaaaauggggca

SEQ ID NO: 4047543 - RNA, 16 nt, Respiratory syncytial virus
acagcagaagaacuag

SEQ ID NO: 4047544 - RNA, 15 nt, Respiratory syncytial virus
acaucaauaaguuau

SEQ ID NO: 4047545 - RNA, 11 nt, Respiratory syncytial virus
acaucagugag

SEQ ID NO: 4047546 - RNA, 15 nt, Respiratory syncytial virus
acaucauggaaaagu

SEQ ID NO: 4047547 - RNA, 20 nt, Respiratory syncytial virus
acaucauugcuuuaugugaa

SEQ ID NO: 4047548 - RNA, 13 nt, Respiratory syncytial virus
acaucucaccaug

SEQ ID NO: 4047549 - RNA, 24 nt, Respiratory syncytial virus
acauuccuggucaacuaugaaaug

SEQ ID NO: 4047550 - RNA, 15 nt, Respiratory syncytial virus
acauugacauauuca

SEQ ID NO: 4047551 - RNA, 18 nt, Respiratory syncytial virus
accaaaauaaccauauau

SEQ ID NO: 4047552 - RNA, 16 nt, Respiratory syncytial virus
accaaacaaaaaaccu

SEQ ID NO: 4047553 - RNA, 13 nt, Respiratory syncytial virus
accacaaaaccaa

SEQ ID NO: 4047554 - RNA, 13 nt, Respiratory syncytial virus
accaccaccaagc

SEQ ID NO: 4047555 - RNA, 23 nt, Respiratory syncytial virus
accauauauacucaccgaaucaa

SEQ ID NO: 4047556 - RNA, 22 nt, Respiratory syncytial virus
accauauauugaacaacccaaa

SEQ ID NO: 4047557 - RNA, 16 nt, Respiratory syncytial virus
accauuaguuaauaua

SEQ ID NO: 4047558 - RNA, 14 nt, Respiratory syncytial virus
accauucaaugaaa

SEQ ID NO: 4047559 - RNA, 15 nt, Respiratory syncytial virus
acccauggaagauua

SEQ ID NO: 4047560 - RNA, 17 nt, Respiratory syncytial virus
acccucaccucuuuaca

SEQ ID NO: 4047561 - RNA, 16 nt, Respiratory syncytial virus
accuauugugaacaag

SEQ ID NO: 4047562 - RNA, 22 nt, Respiratory syncytial virus
acuauguauaaucaaaagaaca

SEQ ID NO: 4047563 - RNA, 19 nt, Respiratory syncytial virus
acucuugaagaaauuaaug

SEQ ID NO: 4047564 - RNA, 13 nt, Respiratory syncytial virus
acuuauaauugca

SEQ ID NO: 4047565 - RNA, 14 nt, Respiratory syncytial virus
agaacacacuauau

SEQ ID NO: 4047566 - RNA, 15 nt, Respiratory syncytial virus
agaauucucaagcaa

SEQ ID NO: 4047567 - RNA, 19 nt, Respiratory syncytial virus
agacuauaauaauaucacu

SEQ ID NO: 4047568 - RNA, 19 nt, Respiratory syncytial virus
agagacaucauaacacaca

SEQ ID NO: 4047569 - RNA, 21 nt, Respiratory syncytial virus
agauacuauaguuacaaaaaa

SEQ ID NO: 4047570 - RNA, 12 nt, Respiratory syncytial virus
agaucaacuucu

SEQ ID NO: 4047571 - RNA, 16 nt, Respiratory syncytial virus
agaucaucccaaguca

SEQ ID NO: 4047572 - RNA, 21 nt, Respiratory syncytial virus
agcaagcccaccacaaaacaa

SEQ ID NO: 4047573 - RNA, 15 nt, Respiratory syncytial virus
agcacuaaauacaaa

SEQ ID NO: 4047574 - RNA, 22 nt, Respiratory syncytial virus
agccaauccaaaacuagccacc

SEQ ID NO: 4047575 - RNA, 15 nt, Respiratory syncytial virus
agccugaaaauuaua

SEQ ID NO: 4047576 - RNA, 19 nt, Respiratory syncytial virus
agcucgagucaauacauag

SEQ ID NO: 4047577 - RNA, 19 nt, Respiratory syncytial virus
agcuucaacaacaccaagu

SEQ ID NO: 4047578 - RNA, 21 nt, Respiratory syncytial virus
aggaaucaagaucuauaugau

SEQ ID NO: 4047579 - RNA, 16 nt, Respiratory syncytial virus
agguauguuauaugcu

SEQ ID NO: 4047580 - RNA, 19 nt, Respiratory syncytial virus
agguauuacugaugauaua

SEQ ID NO: 4047581 - RNA, 13 nt, Respiratory syncytial virus
agguuuaugaaua

SEQ ID NO: 4047582 - RNA, 19 nt, Respiratory syncytial virus
aguaaguuucaaagaagac

SEQ ID NO: 4047583 - RNA, 19 nt, Respiratory syncytial virus
aguaguuaauuaaaaauaa

SEQ ID NO: 4047584 - RNA, 15 nt, Respiratory syncytial virus
aguauugauacuccu

SEQ ID NO: 4047585 - RNA, 23 nt, Respiratory syncytial virus
agucaacacgccaggcaaaauca

SEQ ID NO: 4047586 - RNA, 13 nt, Respiratory syncytial virus
agugaacaacccu

SEQ ID NO: 4047587 - RNA, 21 nt, Respiratory syncytial virus
aguugccaauccucaaaacaa

SEQ ID NO: 4047588 - RNA, 15 nt, Respiratory syncytial virus
auaaaaauauccaca

SEQ ID NO: 4047589 - RNA, 17 nt, Respiratory syncytial virus
auaaacccaacaaauga

SEQ ID NO: 4047590 - RNA, 19 nt, Respiratory syncytial virus
auaacaauagaauucucaa

SEQ ID NO: 4047591 - RNA, 19 nt, Respiratory syncytial virus
auaacaugcuauacugaca

SEQ ID NO: 4047592 - RNA, 15 nt, Respiratory syncytial virus
auaacuauagaauua

SEQ ID NO: 4047593 - RNA, 20 nt, Respiratory syncytial virus
auacaacacaaaauauggca

SEQ ID NO: 4047594 - RNA, 19 nt, Respiratory syncytial virus
auacacucaacaaagauca

SEQ ID NO: 4047595 - RNA, 20 nt, Respiratory syncytial virus
auacauuauauuauguaaau

SEQ ID NO: 4047596 - RNA, 18 nt, Respiratory syncytial virus
auagaguuccaacaaaag

SEQ ID NO: 4047597 - RNA, 18 nt, Respiratory syncytial virus
auaguuagacagcaaagu

SEQ ID NO: 4047598 - RNA, 18 nt, Respiratory syncytial virus
auauacuugauaaaucau

SEQ ID NO: 4047599 - RNA, 15 nt, Respiratory syncytial virus
auaucaacuagcaaa

SEQ ID NO: 4047600 - RNA, 18 nt, Respiratory syncytial virus
auaucaacuagcaaauca

SEQ ID NO: 4047601 - RNA, 15 nt, Respiratory syncytial virus
auaugcccaaaaauu

SEQ ID NO: 4047602 - RNA, 14 nt, Respiratory syncytial virus
auaugcugaacaac

SEQ ID NO: 4047603 - RNA, 23 nt, Respiratory syncytial virus
auauggaaacauacgugaacaaa

SEQ ID NO: 4047604 - RNA, 18 nt, Respiratory syncytial virus
auauuaaugggaaagaaa

SEQ ID NO: 4047605 - RNA, 18 nt, Respiratory syncytial virus
auauuucaaucaaaacaa

SEQ ID NO: 4047606 - RNA, 15 nt, Respiratory syncytial virus
aucaaauucaaccau

SEQ ID NO: 4047607 - RNA, 18 nt, Respiratory syncytial virus
aucaacuagcaaaucaau

SEQ ID NO: 4047608 - RNA, 14 nt, Respiratory syncytial virus
aucaagaucuauau

SEQ ID NO: 4047609 - RNA, 22 nt, Respiratory syncytial virus
aucaagaucuauaugaugcugc

SEQ ID NO: 4047610 - RNA, 23 nt, Respiratory syncytial virus
aucauauucauagccucggcaaa

SEQ ID NO: 4047611 - RNA, 20 nt, Respiratory syncytial virus
auccaauuucacaacaaugc

SEQ ID NO: 4047612 - RNA, 15 nt, Respiratory syncytial virus
auccauucuggcaau

SEQ ID NO: 4047613 - RNA, 18 nt, Respiratory syncytial virus
aucugucaacauagacaa

SEQ ID NO: 4047614 - RNA, 15 nt, Respiratory syncytial virus
aucuguuaaaaagau

SEQ ID NO: 4047615 - RNA, 15 nt, Respiratory syncytial virus
augauaacaacaaua

SEQ ID NO: 4047616 - RNA, 13 nt, Respiratory syncytial virus
augauacacucaa

SEQ ID NO: 4047617 - RNA, 19 nt, Respiratory syncytial virus
augauacacucaacaaaga

SEQ ID NO: 4047618 - RNA, 16 nt, Respiratory syncytial virus
augauagugacaauga

SEQ ID NO: 4047619 - RNA, 21 nt, Respiratory syncytial virus
augauugcaauacugaacaaa

SEQ ID NO: 4047620 - RNA, 15 nt, Respiratory syncytial virus
augccaucacaaaug

SEQ ID NO: 4047621 - RNA, 20 nt, Respiratory syncytial virus
augcuaaucauaaauucacu

SEQ ID NO: 4047622 - RNA, 16 nt, Respiratory syncytial virus
auggacacaacacaca

SEQ ID NO: 4047623 - RNA, 20 nt, Respiratory syncytial virus
auggccuaauagaugacaau

SEQ ID NO: 4047624 - RNA, 22 nt, Respiratory syncytial virus
auguauagcggcauuaguaaua

SEQ ID NO: 4047625 - RNA, 15 nt, Respiratory syncytial virus
auguguucaaugcaa

SEQ ID NO: 4047626 - RNA, 22 nt, Respiratory syncytial virus
auuaaauucuccaaaaaacuaa

SEQ ID NO: 4047627 - RNA, 14 nt, Respiratory syncytial virus
auuaucaaagaaaa

SEQ ID NO: 4047628 - RNA, 17 nt, Respiratory syncytial virus
auucaaaucaacauuga

SEQ ID NO: 4047629 - RNA, 14 nt, Respiratory syncytial virus
auucauacaaacuu

SEQ ID NO: 4047630 - RNA, 23 nt, Respiratory syncytial virus
auucauaugaagaaauaaaugau

SEQ ID NO: 4047631 - RNA, 21 nt, Respiratory syncytial virus
auugcaauacugaacaaacuc

SEQ ID NO: 4047632 - RNA, 14 nt, Respiratory syncytial virus
auuguuuaugaaug

SEQ ID NO: 4047633 - RNA, 16 nt, Respiratory syncytial virus
auuuauacacaaaauu

SEQ ID NO: 4047634 - RNA, 13 nt, Respiratory syncytial virus
auuucacaacaau

SEQ ID NO: 4047635 - RNA, 21 nt, Respiratory syncytial virus
auuugugcauguuauuacaag

SEQ ID NO: 4047636 - RNA, 23 nt, Respiratory syncytial virus
caaaaaaaugcuaaaagaaaugg

SEQ ID NO: 4047637 - RNA, 17 nt, Respiratory syncytial virus
caaaaagauacaaucaa

SEQ ID NO: 4047638 - RNA, 22 nt, Respiratory syncytial virus
caaaagaacacacuauauuuca

SEQ ID NO: 4047639 - RNA, 21 nt, Respiratory syncytial virus
caaaauuuguuugacaaugau

SEQ ID NO: 4047640 - RNA, 12 nt, Respiratory syncytial virus
caaagaaaaugg

SEQ ID NO: 4047641 - RNA, 20 nt, Respiratory syncytial virus
caaagaaagcccuauaacau

SEQ ID NO: 4047642 - RNA, 23 nt, Respiratory syncytial virus
caaagaucaacuucugucaucca

SEQ ID NO: 4047643 - RNA, 15 nt, Respiratory syncytial virus
caaauaaaacaucau

SEQ ID NO: 4047644 - RNA, 16 nt, Respiratory syncytial virus
caaauucacaucaccu

SEQ ID NO: 4047645 - RNA, 17 nt, Respiratory syncytial virus
caacaaugaccaauuau

SEQ ID NO: 4047646 - RNA, 15 nt, Respiratory syncytial virus
caacacacaaugaca

SEQ ID NO: 4047647 - RNA, 12 nt, Respiratory syncytial virus
caacaccaccaa

SEQ ID NO: 4047648 - RNA, 13 nt, Respiratory syncytial virus
caacagaagacca

SEQ ID NO: 4047649 - RNA, 13 nt, Respiratory syncytial virus
caaccaaacaucu

SEQ ID NO: 4047650 - RNA, 18 nt, Respiratory syncytial virus
caaccauggacacaacac

SEQ ID NO: 4047651 - RNA, 21 nt, Respiratory syncytial virus
caaccauggacacaacacaca

SEQ ID NO: 4047652 - RNA, 15 nt, Respiratory syncytial virus
caacccugcaaucca

SEQ ID NO: 4047653 - RNA, 20 nt, Respiratory syncytial virus
caacgccaaaacaaaccacc

SEQ ID NO: 4047654 - RNA, 21 nt, Respiratory syncytial virus
caacuaaucaaacaaaaccca

SEQ ID NO: 4047655 - RNA, 20 nt, Respiratory syncytial virus
caacuagcaaaucaauguca

SEQ ID NO: 4047656 - RNA, 15 nt, Respiratory syncytial virus
caacugaaauucaaa

SEQ ID NO: 4047657 - RNA, 22 nt, Respiratory syncytial virus
caacuucaugcauaaccacacu

SEQ ID NO: 4047658 - RNA, 19 nt, Respiratory syncytial virus
caagaccaaaaacacaaca

SEQ ID NO: 4047659 - RNA, 17 nt, Respiratory syncytial virus
caagcagaaauggaaca

SEQ ID NO: 4047660 - RNA, 13 nt, Respiratory syncytial virus
caagcccacaaaa

SEQ ID NO: 4047661 - RNA, 21 nt, Respiratory syncytial virus
caaggaccaacgcaccaccaa

SEQ ID NO: 4047662 - RNA, 18 nt, Respiratory syncytial virus
caagucauuguucaucag

SEQ ID NO: 4047663 - RNA, 21 nt, Respiratory syncytial virus
caauaaagggcaaauucacau

SEQ ID NO: 4047664 - RNA, 14 nt, Respiratory syncytial virus
caauauuuaucaau

SEQ ID NO: 4047665 - RNA, 16 nt, Respiratory syncytial virus
caauccucaaaacaaa

SEQ ID NO: 4047666 - RNA, 19 nt, Respiratory syncytial virus
caaucugucugaaacuaca

SEQ ID NO: 4047667 - RNA, 13 nt, Respiratory syncytial virus
caaugacaccaca

SEQ ID NO: 4047668 - RNA, 11 nt, Respiratory syncytial virus
caaugaugaag

SEQ ID NO: 4047669 - RNA, 20 nt, Respiratory syncytial virus
caauguaacauuaagcaaga

SEQ ID NO: 4047670 - RNA, 14 nt, Respiratory syncytial virus
caaugucacuaaca

SEQ ID NO: 4047671 - RNA, 15 nt, Respiratory syncytial virus
caaugucacuaacac

SEQ ID NO: 4047672 - RNA, 17 nt, Respiratory syncytial virus
cacaaaaaaaccaacca

SEQ ID NO: 4047673 - RNA, 13 nt, Respiratory syncytial virus
cacaaucugaaau

SEQ ID NO: 4047674 - RNA, 12 nt, Respiratory syncytial virus
caccaagcccac

SEQ ID NO: 4047675 - RNA, 14 nt, Respiratory syncytial virus
caccaugcaagcca

SEQ ID NO: 4047676 - RNA, 20 nt, Respiratory syncytial virus
cacccugugaaaucaaggca

SEQ ID NO: 4047677 - RNA, 15 nt, Respiratory syncytial virus
caccuguaagcacuu

SEQ ID NO: 4047678 - RNA, 16 nt, Respiratory syncytial virus
cacuaaauacaaaaaa

SEQ ID NO: 4047679 - RNA, 13 nt, Respiratory syncytial virus
cacuaauacacau

SEQ ID NO: 4047680 - RNA, 20 nt, Respiratory syncytial virus
cacuagcugaaacauguaaa

SEQ ID NO: 4047681 - RNA, 20 nt, Respiratory syncytial virus
cagaauacaggcaugacucu

SEQ ID NO: 4047682 - RNA, 22 nt, Respiratory syncytial virus
cagagacaucauaacacacaga

SEQ ID NO: 4047683 - RNA, 23 nt, Respiratory syncytial virus
cagagcuaccaaauuccuagaau

SEQ ID NO: 4047684 - RNA, 13 nt, Respiratory syncytial virus
cagaucaagaaca

SEQ ID NO: 4047685 - RNA, 14 nt, Respiratory syncytial virus
cagauguaagcagc

SEQ ID NO: 4047686 - RNA, 12 nt, Respiratory syncytial virus
cagcaagcccac

SEQ ID NO: 4047687 - RNA, 22 nt, Respiratory syncytial virus
cagccaauccaaaacuagccac

SEQ ID NO: 4047688 - RNA, 22 nt, Respiratory syncytial virus
caggaaaaacaauaaacaaacu

SEQ ID NO: 4047689 - RNA, 15 nt, Respiratory syncytial virus
augaucacagacaug

SEQ ID NO: 4047690 - RNA, 15 nt, Respiratory syncytial virus
augcaauucaaaauu

SEQ ID NO: 4047691 - RNA, 20 nt, Respiratory syncytial virus
augcauaaccacacuccaua

SEQ ID NO: 4047692 - RNA, 19 nt, Respiratory syncytial virus
augccaguguuacaaaaug

SEQ ID NO: 4047693 - RNA, 14 nt, Respiratory syncytial virus
augcuaaaagaaau

SEQ ID NO: 4047694 - RNA, 13 nt, Respiratory syncytial virus
augggacaaaaug

SEQ ID NO: 4047695 - RNA, 20 nt, Respiratory syncytial virus
augucuagauuaggaagaga

SEQ ID NO: 4047696 - RNA, 15 nt, Respiratory syncytial virus
auuaagacuaacaau

SEQ ID NO: 4047697 - RNA, 17 nt, Respiratory syncytial virus
auuaaugggaaagaaau

SEQ ID NO: 4047698 - RNA, 16 nt, Respiratory syncytial virus
auuacauaauguaaau

SEQ ID NO: 4047699 - RNA, 13 nt, Respiratory syncytial virus
auuaucaaagaaa

SEQ ID NO: 4047700 - RNA, 19 nt, Respiratory syncytial virus
auucaaaaaugccaucaca

SEQ ID NO: 4047701 - RNA, 20 nt, Respiratory syncytial virus
auugauaaaacaagaauuag

SEQ ID NO: 4047702 - RNA, 18 nt, Respiratory syncytial virus
auugcaauacugaacaaa

SEQ ID NO: 4047703 - RNA, 16 nt, Respiratory syncytial virus
auuuacuuaaaaagau

SEQ ID NO: 4047704 - RNA, 14 nt, Respiratory syncytial virus
auuuacuuauaaaa

SEQ ID NO: 4047705 - RNA, 17 nt, Respiratory syncytial virus
auuuguaagugaacaac

SEQ ID NO: 4047706 - RNA, 17 nt, Respiratory syncytial virus
caaaaacacaacaacaa

SEQ ID NO: 4047707 - RNA, 18 nt, Respiratory syncytial virus
caaaauggaucccauuau

SEQ ID NO: 4047708 - RNA, 11 nt, Respiratory syncytial virus
caaaccaccac

SEQ ID NO: 4047709 - RNA, 22 nt, Respiratory syncytial virus
caaagacugaugaucacagaca

SEQ ID NO: 4047710 - RNA, 19 nt, Respiratory syncytial virus
caaagucacacuaacaacu

SEQ ID NO: 4047711 - RNA, 13 nt, Respiratory syncytial virus
caaauaaucauug

SEQ ID NO: 4047712 - RNA, 13 nt, Respiratory syncytial virus
caaauacaaaaau

SEQ ID NO: 4047713 - RNA, 15 nt, Respiratory syncytial virus
caaauacaaaaaugg

SEQ ID NO: 4047714 - RNA, 17 nt, Respiratory syncytial virus
caaauauggaaacauac

SEQ ID NO: 4047715 - RNA, 18 nt, Respiratory syncytial virus
caaauggagccugaaaau

SEQ ID NO: 4047716 - RNA, 15 nt, Respiratory syncytial virus
caaauuggaagcaca

SEQ ID NO: 4047717 - RNA, 20 nt, Respiratory syncytial virus
caacaaagaucaacuucugu

SEQ ID NO: 4047718 - RNA, 18 nt, Respiratory syncytial virus
caacacaagagucacaca

SEQ ID NO: 4047719 - RNA, 16 nt, Respiratory syncytial virus
caacaggaaaaacaau

SEQ ID NO: 4047720 - RNA, 19 nt, Respiratory syncytial virus
caaccaucaagacaaccaa

SEQ ID NO: 4047721 - RNA, 15 nt, Respiratory syncytial virus
caagcccacaaaaaa

SEQ ID NO: 4047722 - RNA, 17 nt, Respiratory syncytial virus
caaggaaucaagaucua

SEQ ID NO: 4047723 - RNA, 19 nt, Respiratory syncytial virus
caagucauuguucaucaga

SEQ ID NO: 4047724 - RNA, 23 nt, Respiratory syncytial virus
caagucauuguucaucagaucua

SEQ ID NO: 4047725 - RNA, 17 nt, Respiratory syncytial virus
caauauuuaucaaucau

SEQ ID NO: 4047726 - RNA, 15 nt, Respiratory syncytial virus
caaucauccaugcca

SEQ ID NO: 4047727 - RNA, 18 nt, Respiratory syncytial virus
caauccaugaauuucaac

SEQ ID NO: 4047728 - RNA, 17 nt, Respiratory syncytial virus
caaugacagacuagaag

SEQ ID NO: 4047729 - RNA, 22 nt, Respiratory syncytial virus
caaugagggguucuacauaaua

SEQ ID NO: 4047730 - RNA, 15 nt, Respiratory syncytial virus
caaugaucuaucacu

SEQ ID NO: 4047731 - RNA, 22 nt, Respiratory syncytial virus
cacaaugacaccacaccacaaa

SEQ ID NO: 4047732 - RNA, 17 nt, Respiratory syncytial virus
cacacaacaccaacaga

SEQ ID NO: 4047733 - RNA, 14 nt, Respiratory syncytial virus
cacacuaagcaagg

SEQ ID NO: 4047734 - RNA, 14 nt, Respiratory syncytial virus
cacagaagaugcua

SEQ ID NO: 4047735 - RNA, 15 nt, Respiratory syncytial virus
caccaccaaaacaaa

SEQ ID NO: 4047736 - RNA, 15 nt, Respiratory syncytial virus
caccaccaagacacu

SEQ ID NO: 4047737 - RNA, 23 nt, Respiratory syncytial virus
caccaccaagcccacaaaaaaac

SEQ ID NO: 4047738 - RNA, 17 nt, Respiratory syncytial virus
caccggcaaccaacaau

SEQ ID NO: 4047739 - RNA, 20 nt, Respiratory syncytial virus
caccucuuuacaaaaccaca

SEQ ID NO: 4047740 - RNA, 16 nt, Respiratory syncytial virus
cacuuaaauuuaacuc

SEQ ID NO: 4047741 - RNA, 16 nt, Respiratory syncytial virus
cagaagauaaaaaugg

SEQ ID NO: 4047742 - RNA, 22 nt, Respiratory syncytial virus
cagacguauugaagaaaaccau

SEQ ID NO: 4047743 - RNA, 15 nt, Respiratory syncytial virus
cagaucaagaacaca

SEQ ID NO: 4047744 - RNA, 16 nt, Respiratory syncytial virus
cagauuuauauacuug

SEQ ID NO: 4047745 - RNA, 13 nt, Respiratory syncytial virus
cagucagcaaagg

SEQ ID NO: 4047746 - RNA, 17 nt, Respiratory syncytial virus
cauagcuacacacuaac

SEQ ID NO: 4047747 - RNA, 19 nt, Respiratory syncytial virus
cauagcuacacacuaacac

SEQ ID NO: 4047748 - RNA, 17 nt, Respiratory syncytial virus
cauauauugaaagcaac

SEQ ID NO: 4047749 - RNA, 13 nt, Respiratory syncytial virus
cauaucugcucau

SEQ ID NO: 4047750 - RNA, 20 nt, Respiratory syncytial virus
caucaacaucucaccaugca

SEQ ID NO: 4047751 - RNA, 14 nt, Respiratory syncytial virus
caucaucaaacuau

SEQ ID NO: 4047752 - RNA, 20 nt, Respiratory syncytial virus
cauccaacggagcacaggag

SEQ ID NO: 4047753 - RNA, 20 nt, Respiratory syncytial virus
caucuauaaaccaucucacu

SEQ ID NO: 4047754 - RNA, 20 nt, Respiratory syncytial virus
caugaauuucaacacaagag

SEQ ID NO: 4047755 - RNA, 18 nt, Respiratory syncytial virus
caugcaagccaucaucca

SEQ ID NO: 4047756 - RNA, 18 nt, Respiratory syncytial virus
caugcauaaccacacucc

SEQ ID NO: 4047757 - RNA, 19 nt, Respiratory syncytial virus
cauuaccaagugaaguaaa

SEQ ID NO: 4047758 - RNA, 14 nt, Respiratory syncytial virus
cauuugauaacaau

SEQ ID NO: 4047759 - RNA, 19 nt, Respiratory syncytial virus
ccaaaaauuggguggagaa

SEQ ID NO: 4047760 - RNA, 13 nt, Respiratory syncytial virus
ccaaaacaaacca

SEQ ID NO: 4047761 - RNA, 15 nt, Respiratory syncytial virus
ccaacacaacaaacc

SEQ ID NO: 4047762 - RNA, 14 nt, Respiratory syncytial virus
ccaaccaaacaucu

SEQ ID NO: 4047763 - RNA, 18 nt, Respiratory syncytial virus
ccaauauuuaucaaucau

SEQ ID NO: 4047764 - RNA, 18 nt, Respiratory syncytial virus
ccacaaaaaaaccaacca

SEQ ID NO: 4047765 - RNA, 18 nt, Respiratory syncytial virus
ccaucaagacaaccaaaa

SEQ ID NO: 4047766 - RNA, 15 nt, Respiratory syncytial virus
ccaucacaaaugcaa

SEQ ID NO: 4047767 - RNA, 16 nt, Respiratory syncytial virus
ccaucagugucagaaa

SEQ ID NO: 4047768 - RNA, 13 nt, Respiratory syncytial virus
ccauccaaccaaa

SEQ ID NO: 4047769 - RNA, 12 nt, Respiratory syncytial virus
ccucaaaccaca

SEQ ID NO: 4047770 - RNA, 17 nt, Respiratory syncytial virus
ccucguuagaacagauu

SEQ ID NO: 4047771 - RNA, 20 nt, Respiratory syncytial virus
ccucuuuacaaaaccacauc

SEQ ID NO: 4047772 - RNA, 18 nt, Respiratory syncytial virus
ccuggaaagaaaaccacc

SEQ ID NO: 4047773 - RNA, 17 nt, Respiratory syncytial virus
ccuuguaguauaaauuc

SEQ ID NO: 4047774 - RNA, 15 nt, Respiratory syncytial virus
cgggauaucauguaa

SEQ ID NO: 4047775 - RNA, 18 nt, Respiratory syncytial virus
cuaaaauuaucauuuuga

SEQ ID NO: 4047776 - RNA, 15 nt, Respiratory syncytial virus
cuaacacuguauuca

SEQ ID NO: 4047777 - RNA, 21 nt, Respiratory syncytial virus
cuaagauauuaagacuaacaa

SEQ ID NO: 4047778 - RNA, 20 nt, Respiratory syncytial virus
cuaagugauucaacaaugac

SEQ ID NO: 4047779 - RNA, 17 nt, Respiratory syncytial virus
cuaaucauaaauucacu

SEQ ID NO: 4047780 - RNA, 16 nt, Respiratory syncytial virus
cuacaaagcacacucc

SEQ ID NO: 4047781 - RNA, 18 nt, Respiratory syncytial virus
cuagcaaaucaaugucac

SEQ ID NO: 4047782 - RNA, 13 nt, Respiratory syncytial virus
cuauaaaccaucu

SEQ ID NO: 4047783 - RNA, 16 nt, Respiratory syncytial virus
cucaacaauaccaaaa

SEQ ID NO: 4047784 - RNA, 18 nt, Respiratory syncytial virus
cucaccaugcaagccauc

SEQ ID NO: 4047785 - RNA, 20 nt, Respiratory syncytial virus
cucaccgaaucaaccauuca

SEQ ID NO: 4047786 - RNA, 17 nt, Respiratory syncytial virus
cucccuugguuagagau

SEQ ID NO: 4047787 - RNA, 15 nt, Respiratory syncytial virus
cugaaauaacaacuu

SEQ ID NO: 4047788 - RNA, 14 nt, Respiratory syncytial virus
cugaauacaacaca

SEQ ID NO: 4047789 - RNA, 19 nt, Respiratory syncytial virus
cuggaaagaaaaccaccac

SEQ ID NO: 4047790 - RNA, 21 nt, Respiratory syncytial virus
cuguauucaauuauaguuauu

SEQ ID NO: 4047791 - RNA, 23 nt, Respiratory syncytial virus
cugugauagaguuccaacaaaag

SEQ ID NO: 4047792 - RNA, 23 nt, Respiratory syncytial virus
aaaaaguuaauguccaacaaugu

SEQ ID NO: 4047793 - RNA, 23 nt, Respiratory syncytial virus
aaaacuaagugauucaacaauga

SEQ ID NO: 4047794 - RNA, 22 nt, Respiratory syncytial virus
aaaaguuaauguccaacaaugu

SEQ ID NO: 4047795 - RNA, 13 nt, Respiratory syncytial virus
aaaaucaaccaau

SEQ ID NO: 4047796 - RNA, 18 nt, Respiratory syncytial virus
aaaaugcuaaaagaaaug

SEQ ID NO: 4047797 - RNA, 22 nt, Respiratory syncytial virus
aaaauugauaaaacaagaauua

SEQ ID NO: 4047798 - RNA, 19 nt, Respiratory syncytial virus
aaaauuuguuugacaauga

SEQ ID NO: 4047799 - RNA, 19 nt, Respiratory syncytial virus
aaacaaucagcauguguug

SEQ ID NO: 4047800 - RNA, 13 nt, Respiratory syncytial virus
aaacauacgugaa

SEQ ID NO: 4047801 - RNA, 23 nt, Respiratory syncytial virus
aaacuaagugauucaacaaugac

SEQ ID NO: 4047802 - RNA, 13 nt, Respiratory syncytial virus
aaacuauugcaca

SEQ ID NO: 4047803 - RNA, 12 nt, Respiratory syncytial virus
aaagaaaaagac

SEQ ID NO: 4047804 - RNA, 21 nt, Respiratory syncytial virus
aaagaucugaacacacuugaa

SEQ ID NO: 4047805 - RNA, 12 nt, Respiratory syncytial virus
aaagauggggca

SEQ ID NO: 4047806 - RNA, 13 nt, Respiratory syncytial virus
aaagcaaauggag

SEQ ID NO: 4047807 - RNA, 18 nt, Respiratory syncytial virus
aaaguuagauuacaaaau

SEQ ID NO: 4047808 - RNA, 12 nt, Respiratory syncytial virus
aaauaagcaaga

SEQ ID NO: 4047809 - RNA, 21 nt, Respiratory syncytial virus
aaauauggaaacauacgugaa

SEQ ID NO: 4047810 - RNA, 22 nt, Respiratory syncytial virus
aaaucaaccagaaucaaaauca

SEQ ID NO: 4047811 - RNA, 21 nt, Respiratory syncytial virus
aaaucaguuaaaaauauuaug

SEQ ID NO: 4047812 - RNA, 19 nt, Respiratory syncytial virus
aaaucuuauauuaaaaauu

SEQ ID NO: 4047813 - RNA, 20 nt, Respiratory syncytial virus
aaaugaucagacaaacgaua

SEQ ID NO: 4047814 - RNA, 14 nt, Respiratory syncytial virus
aaaugauggaauua

SEQ ID NO: 4047815 - RNA, 14 nt, Respiratory syncytial virus
aaauggagccugaa

SEQ ID NO: 4047816 - RNA, 21 nt, Respiratory syncytial virus
aaauuaauacauuuaacuaau

SEQ ID NO: 4047817 - RNA, 14 nt, Respiratory syncytial virus
aacaaauauccaca

SEQ ID NO: 4047818 - RNA, 13 nt, Respiratory syncytial virus
aacaccaacagaa

SEQ ID NO: 4047819 - RNA, 19 nt, Respiratory syncytial virus
aacacgccaggcaaaauca

SEQ ID NO: 4047820 - RNA, 17 nt, Respiratory syncytial virus
aacauaccuaagaucca

SEQ ID NO: 4047821 - RNA, 11 nt, Respiratory syncytial virus
aaccaaacauc

SEQ ID NO: 4047822 - RNA, 17 nt, Respiratory syncytial virus
aaccacacuccauaguu

SEQ ID NO: 4047823 - RNA, 15 nt, Respiratory syncytial virus
aacguuggggcaaau

SEQ ID NO: 4047824 - RNA, 21 nt, Respiratory syncytial virus
aacuaagugauucaacaauga

SEQ ID NO: 4047825 - RNA, 20 nt, Respiratory syncytial virus
aacuagcuaaugucaacaua

SEQ ID NO: 4047826 - RNA, 15 nt, Respiratory syncytial virus
aacucaaacaauuca

SEQ ID NO: 4047827 - RNA, 23 nt, Respiratory syncytial virus
aacuucaugcauaaccacacucc

SEQ ID NO: 4047828 - RNA, 14 nt, Respiratory syncytial virus
aagaaaauggugug

SEQ ID NO: 4047829 - RNA, 22 nt, Respiratory syncytial virus
aaggcauguagucuaacaugcc

SEQ ID NO: 4047830 - RNA, 15 nt, Respiratory syncytial virus
aaggcuccacauaca

SEQ ID NO: 4047831 - RNA, 16 nt, Respiratory syncytial virus
aaguaccacuuaaauu

SEQ ID NO: 4047832 - RNA, 13 nt, Respiratory syncytial virus
aagucaaguugaa

SEQ ID NO: 4047833 - RNA, 20 nt, Respiratory syncytial virus
aagucacacuaacaacugca

SEQ ID NO: 4047834 - RNA, 13 nt, Respiratory syncytial virus
aagugaacaaaau

SEQ ID NO: 4047835 - RNA, 14 nt, Respiratory syncytial virus
aagugaacaaaauc

SEQ ID NO: 4047836 - RNA, 14 nt, Respiratory syncytial virus
aaguguuugaaaaa

SEQ ID NO: 4047837 - RNA, 16 nt, Respiratory syncytial virus
aaguugaaugauacac

SEQ ID NO: 4047838 - RNA, 18 nt, Respiratory syncytial virus
guaccuaccaccaagccc

SEQ ID NO: 4047839 - RNA, 21 nt, Respiratory syncytial virus
guaccuaccaccaagcccaca

SEQ ID NO: 4047840 - RNA, 16 nt, Respiratory syncytial virus
gucaacuaugaaauga

SEQ ID NO: 4047841 - RNA, 15 nt, Respiratory syncytial virus
gucaagucaacccug

SEQ ID NO: 4047842 - RNA, 12 nt, Respiratory syncytial virus
gugaaacaaaua

SEQ ID NO: 4047843 - RNA, 11 nt, Respiratory syncytial virus
gugaacaaacu

SEQ ID NO: 4047844 - RNA, 17 nt, Respiratory syncytial virus
guuaaaucuuaaaucua

SEQ ID NO: 4047845 - RNA, 15 nt, Respiratory syncytial virus
guucaaauggagccu

SEQ ID NO: 4047846 - RNA, 17 nt, Respiratory syncytial virus
guucaaauggagccuga

SEQ ID NO: 4047847 - RNA, 22 nt, Respiratory syncytial virus
guucaucagaucuaguacucaa

SEQ ID NO: 4047848 - RNA, 23 nt, Respiratory syncytial virus
guugccaauccucaaaacaaaug

SEQ ID NO: 4047849 - RNA, 22 nt, Respiratory syncytial virus
uaaauaucaacuagcaaaucaa

SEQ ID NO: 4047850 - RNA, 17 nt, Respiratory syncytial virus
uaaaugcugguaaaucc

SEQ ID NO: 4047851 - RNA, 23 nt, Respiratory syncytial virus
uaaggaacucaaaagaauuacug

SEQ ID NO: 4047852 - RNA, 16 nt, Respiratory syncytial virus
uaagugauucaacaau

SEQ ID NO: 4047853 - RNA, 21 nt, Respiratory syncytial virus
uaauaguaugcucaacaacau

SEQ ID NO: 4047854 - RNA, 16 nt, Respiratory syncytial virus
uaaucaaaagaacaca

SEQ ID NO: 4047855 - RNA, 22 nt, Respiratory syncytial virus
uaaucauaaucuccaucaugau

SEQ ID NO: 4047856 - RNA, 15 nt, Respiratory syncytial virus
uaaugggaaagaaau

SEQ ID NO: 4047857 - RNA, 13 nt, Respiratory syncytial virus
uaauuaugaugug

SEQ ID NO: 4047858 - RNA, 19 nt, Respiratory syncytial virus
uacaaaaccacaucaacau

SEQ ID NO: 4047859 - RNA, 19 nt, Respiratory syncytial virus
uacaagaugcaacaagcca

SEQ ID NO: 4047860 - RNA, 18 nt, Respiratory syncytial virus
uacacaugauaacaacaa

SEQ ID NO: 4047861 - RNA, 14 nt, Respiratory syncytial virus
uacacucaacaaag

SEQ ID NO: 4047862 - RNA, 14 nt, Respiratory syncytial virus
uacacucaacaaua

SEQ ID NO: 4047863 - RNA, 23 nt, Respiratory syncytial virus
uaccacaggaaauccagaacaca

SEQ ID NO: 4047864 - RNA, 17 nt, Respiratory syncytial virus
uagaaguaaccaaagaa

SEQ ID NO: 4047865 - RNA, 19 nt, Respiratory syncytial virus
uagaggcuaucaaacauca

SEQ ID NO: 4047866 - RNA, 23 nt, Respiratory syncytial virus
uagaguuacuauguauaaucaaa

SEQ ID NO: 4047867 - RNA, 14 nt, Respiratory syncytial virus
uagauuccuaguuu

SEQ ID NO: 4047868 - RNA, 16 nt, Respiratory syncytial virus
uagcuaaugucaacau

SEQ ID NO: 4047869 - RNA, 13 nt, Respiratory syncytial virus
uagcuacacacua

SEQ ID NO: 4047870 - RNA, 14 nt, Respiratory syncytial virus
uaguagacaaaauc

SEQ ID NO: 4047871 - RNA, 23 nt, Respiratory syncytial virus
uauaacaaccacugaauucaaaa

SEQ ID NO: 4047872 - RNA, 22 nt, Respiratory syncytial virus
uauaacaucaaauucaaccauu

SEQ ID NO: 4047873 - RNA, 11 nt, Respiratory syncytial virus
uauaacuaaac

SEQ ID NO: 4047874 - RNA, 14 nt, Respiratory syncytial virus
uauaguuauuuaaa

SEQ ID NO: 4047875 - RNA, 15 nt, Respiratory syncytial virus
uauauuucaaucaaa

SEQ ID NO: 4047876 - RNA, 23 nt, Respiratory syncytial virus
uaucaacuagcaaaucaauguca

SEQ ID NO: 4047877 - RNA, 17 nt, Respiratory syncytial virus
uaucauuaaucaaugau

SEQ ID NO: 4047878 - RNA, 18 nt, Respiratory syncytial virus
uaucauuggauuuucuua

SEQ ID NO: 4047879 - RNA, 19 nt, Respiratory syncytial virus
uauccauucuggcaaugau

SEQ ID NO: 4047880 - RNA, 17 nt, Respiratory syncytial virus
uaucucaagucaaugag

SEQ ID NO: 4047881 - RNA, 15 nt, Respiratory syncytial virus
uauuaacucaaacaa

SEQ ID NO: 4047882 - RNA, 16 nt, Respiratory syncytial virus
uauuaacucaaacaau

SEQ ID NO: 4047883 - RNA, 21 nt, Respiratory syncytial virus
uauuaaugggaaagaaaugaa

SEQ ID NO: 4047884 - RNA, 14 nt, Respiratory syncytial virus
uauuucaaucaaaa

SEQ ID NO: 4047885 - RNA, 23 nt, Respiratory syncytial virus
ucaaaacaacacucuugaagaaa

SEQ ID NO: 4047886 - RNA, 17 nt, Respiratory syncytial virus
ucaaaccacaaaaccaa

SEQ ID NO: 4047887 - RNA, 22 nt, Respiratory syncytial virus
ucaacaccaccaaaacaaacau

SEQ ID NO: 4047888 - RNA, 18 nt, Respiratory syncytial virus
ucaaccaauggaaaauac

SEQ ID NO: 4047889 - RNA, 15 nt, Respiratory syncytial virus
ucaagaacacaaccc

SEQ ID NO: 4047890 - RNA, 21 nt, Respiratory syncytial virus
ucaagaccaaaaacacaacaa

SEQ ID NO: 4047891 - RNA, 21 nt, Respiratory syncytial virus
ucaauaaagggcaaauucaca

SEQ ID NO: 4047892 - RNA, 17 nt, Respiratory syncytial virus
ucacacaaucugaaaua

SEQ ID NO: 4047893 - RNA, 21 nt, Respiratory syncytial virus
ucacccagaauccccagcuug

SEQ ID NO: 4047894 - RNA, 21 nt, Respiratory syncytial virus
ucagugaguugauucauacaa

SEQ ID NO: 4047895 - RNA, 19 nt, Respiratory syncytial virus
ucauaaucaccaacccucu

SEQ ID NO: 4047896 - RNA, 18 nt, Respiratory syncytial virus
ucauagacaacccaucua

SEQ ID NO: 4047897 - RNA, 20 nt, Respiratory syncytial virus
ucauagccucggcaaaccac

SEQ ID NO: 4047898 - RNA, 13 nt, Respiratory syncytial virus
ucauaugaagaaa

SEQ ID NO: 4047899 - RNA, 14 nt, Respiratory syncytial virus
ucaugauaaacuca

SEQ ID NO: 4047900 - RNA, 14 nt, Respiratory syncytial virus
ucauguucuuacaa

SEQ ID NO: 4047901 - RNA, 10 nt, Respiratory syncytial virus
uccaacaaug

SEQ ID NO: 4047902 - RNA, 15 nt, Respiratory syncytial virus
ucccauagcuacaca

SEQ ID NO: 4047903 - RNA, 16 nt, Respiratory syncytial virus
ucuaaagaaacuaaau

SEQ ID NO: 4047904 - RNA, 20 nt, Respiratory syncytial virus
ucuaacaugccuaaaaucaa

SEQ ID NO: 4047905 - RNA, 17 nt, Respiratory syncytial virus
ucucaaaccucaaacca

SEQ ID NO: 4047906 - RNA, 18 nt, Respiratory syncytial virus
ucugaaacuacaucacaa

SEQ ID NO: 4047907 - RNA, 17 nt, Respiratory syncytial virus
ucuggagccucagauca

SEQ ID NO: 4047908 - RNA, 15 nt, Respiratory syncytial virus
caacagucaagacca

SEQ ID NO: 4047909 - RNA, 19 nt, Respiratory syncytial virus
caaccaaaauaaccauaua

SEQ ID NO: 4047910 - RNA, 17 nt, Respiratory syncytial virus
caaccauggacacaaca

SEQ ID NO: 4047911 - RNA, 22 nt, Respiratory syncytial virus
caacgccaaaacaaaccaccaa

SEQ ID NO: 4047912 - RNA, 14 nt, Respiratory syncytial virus
caagacacuagaaa

SEQ ID NO: 4047913 - RNA, 16 nt, Respiratory syncytial virus
caagcccaccacaaaa

SEQ ID NO: 4047914 - RNA, 15 nt, Respiratory syncytial virus
caaucagccaaucca

SEQ ID NO: 4047915 - RNA, 23 nt, Respiratory syncytial virus
caauccuaaugcuuaccacauca

SEQ ID NO: 4047916 - RNA, 17 nt, Respiratory syncytial virus
caaugaucuaucacuug

SEQ ID NO: 4047917 - RNA, 21 nt, Respiratory syncytial virus
cacaaaauuaaacaacauauu

SEQ ID NO: 4047918 - RNA, 15 nt, Respiratory syncytial virus
cacaaaccaccacca

SEQ ID NO: 4047919 - RNA, 22 nt, Respiratory syncytial virus
cacaaagacugaugaucacaga

SEQ ID NO: 4047920 - RNA, 19 nt, Respiratory syncytial virus
cacaaaucacauuauccau

SEQ ID NO: 4047921 - RNA, 16 nt, Respiratory syncytial virus
cacacaaucugaaaua

SEQ ID NO: 4047922 - RNA, 14 nt, Respiratory syncytial virus
cacauggggcaaau

SEQ ID NO: 4047923 - RNA, 16 nt, Respiratory syncytial virus
caccauuaguuaauau

SEQ ID NO: 4047924 - RNA, 19 nt, Respiratory syncytial virus
cacuaacacuguauucaau

SEQ ID NO: 4047925 - RNA, 16 nt, Respiratory syncytial virus
cacuguauucaauuau

SEQ ID NO: 4047926 - RNA, 23 nt, Respiratory syncytial virus
cacuuauaauugcagccaucaua

SEQ ID NO: 4047927 - RNA, 18 nt, Respiratory syncytial virus
cacuugaaaauauaacaa

SEQ ID NO: 4047928 - RNA, 15 nt, Respiratory syncytial virus
cagaaacacaucaau

SEQ ID NO: 4047929 - RNA, 15 nt, Respiratory syncytial virus
cagaaucaaaaucaa

SEQ ID NO: 4047930 - RNA, 16 nt, Respiratory syncytial virus
cagccaauccaaaacu

SEQ ID NO: 4047931 - RNA, 19 nt, Respiratory syncytial virus
cagugauacauacaaucaa

SEQ ID NO: 4047932 - RNA, 23 nt, Respiratory syncytial virus
caguguauuagacuugacagcag

SEQ ID NO: 4047933 - RNA, 23 nt, Respiratory syncytial virus
caguuaaagaucucacuaugaaa

SEQ ID NO: 4047934 - RNA, 13 nt, Respiratory syncytial virus
cauaaaaaccaca

SEQ ID NO: 4047935 - RNA, 16 nt, Respiratory syncytial virus
cauaaaaauacucaga

SEQ ID NO: 4047936 - RNA, 20 nt, Respiratory syncytial virus
cauaaaaauacucagagaug

SEQ ID NO: 4047937 - RNA, 23 nt, Respiratory syncytial virus
cauagcuacacacuaacacugua

SEQ ID NO: 4047938 - RNA, 18 nt, Respiratory syncytial virus
caucuauaaaccaucuca

SEQ ID NO: 4047939 - RNA, 20 nt, Respiratory syncytial virus
caugagaccauugucacuug

SEQ ID NO: 4047940 - RNA, 20 nt, Respiratory syncytial virus
cauggagaagaugcaaacaa

SEQ ID NO: 4047941 - RNA, 22 nt, Respiratory syncytial virus
cauggagaagaugcaaacaaca

SEQ ID NO: 4047942 - RNA, 17 nt, Respiratory syncytial virus
cauuaaucaaugauaug

SEQ ID NO: 4047943 - RNA, 23 nt, Respiratory syncytial virus
cauuuguaagugaacaacccuca

SEQ ID NO: 4047944 - RNA, 21 nt, Respiratory syncytial virus
ccaacaaaugagacagaugau

SEQ ID NO: 4047945 - RNA, 13 nt, Respiratory syncytial virus
ccaacccucugug

SEQ ID NO: 4047946 - RNA, 18 nt, Respiratory syncytial virus
ccacagaaaagccaacca

SEQ ID NO: 4047947 - RNA, 22 nt, Respiratory syncytial virus
ccagaagcacaccagucacacu

SEQ ID NO: 4047948 - RNA, 16 nt, Respiratory syncytial virus
ccauagcuacacacua

SEQ ID NO: 4047949 - RNA, 16 nt, Respiratory syncytial virus
cgaggucauugcuuga

SEQ ID NO: 4047950 - RNA, 20 nt, Respiratory syncytial virus
cgaugacccugcaucacuua

SEQ ID NO: 4047951 - RNA, 11 nt, Respiratory syncytial virus
cggagcacagg

SEQ ID NO: 4047952 - RNA, 15 nt, Respiratory syncytial virus
cggcaaccaacaauc

SEQ ID NO: 4047953 - RNA, 13 nt, Respiratory syncytial virus
cuaauaauaauau

SEQ ID NO: 4047954 - RNA, 15 nt, Respiratory syncytial virus
cuaaucaaacaaaac

SEQ ID NO: 4047955 - RNA, 16 nt, Respiratory syncytial virus
cuacacacuaacacug

SEQ ID NO: 4047956 - RNA, 14 nt, Respiratory syncytial virus
cuacaucacaaacc

SEQ ID NO: 4047957 - RNA, 23 nt, Respiratory syncytial virus
cuagaggcuaucaaacaucagcu

SEQ ID NO: 4047958 - RNA, 18 nt, Respiratory syncytial virus
cuagugaaacaaauaucc

SEQ ID NO: 4047959 - RNA, 15 nt, Respiratory syncytial virus
cuauauuucaaucaa

SEQ ID NO: 4047960 - RNA, 14 nt, Respiratory syncytial virus
cuaucauuggauuu

SEQ ID NO: 4047961 - RNA, 15 nt, Respiratory syncytial virus
cuauggcaagacuca

SEQ ID NO: 4047962 - RNA, 20 nt, Respiratory syncytial virus
cuauugugaacaagcaaagc

SEQ ID NO: 4047963 - RNA, 14 nt, Respiratory syncytial virus
cucaaacaauucaa

SEQ ID NO: 4047964 - RNA, 19 nt, Respiratory syncytial virus
cucucaauccaacaucaga

SEQ ID NO: 4047965 - RNA, 19 nt, Respiratory syncytial virus
cugaaauaacaacuucaug

SEQ ID NO: 4047966 - RNA, 16 nt, Respiratory syncytial virus
cugaacucaacaguga

SEQ ID NO: 4047967 - RNA, 19 nt, Respiratory syncytial virus
cugaugauauauacacaau

SEQ ID NO: 4047968 - RNA, 16 nt, Respiratory syncytial virus
cugcucaccaacaaua

SEQ ID NO: 4047969 - RNA, 20 nt, Respiratory syncytial virus
cugcucauagacaacccauc

SEQ ID NO: 4047970 - RNA, 21 nt, Respiratory syncytial virus
cuggaaagaaaaccaccacca

SEQ ID NO: 4047971 - RNA, 17 nt, Respiratory syncytial virus
cuguacaucaacacaca

SEQ ID NO: 4047972 - RNA, 14 nt, Respiratory syncytial virus
cuuaaagcagucaa

SEQ ID NO: 4047973 - RNA, 14 nt, Respiratory syncytial virus
cuuagaaugcauug

SEQ ID NO: 4047974 - RNA, 24 nt, Respiratory syncytial virus
gaaaacacucaacccaacacauga

SEQ ID NO: 4047975 - RNA, 21 nt, Respiratory syncytial virus
gaaaauacauccauaacaaua

SEQ ID NO: 4047976 - RNA, 15 nt, Respiratory syncytial virus
gaacaacucaaagaa

SEQ ID NO: 4047977 - RNA, 18 nt, Respiratory syncytial virus
gaacaacucaaagaaaau

SEQ ID NO: 4047978 - RNA, 22 nt, Respiratory syncytial virus
gaacaagcccaauuaucaaaga

SEQ ID NO: 4047979 - RNA, 22 nt, Respiratory syncytial virus
gaagaaaaccauaaaaaccaca

SEQ ID NO: 4047980 - RNA, 23 nt, Respiratory syncytial virus
uuaaccuuuuucuucuacaucag

SEQ ID NO: 4047981 - RNA, 19 nt, Respiratory syncytial virus
uuaaucacagaagaugcua

SEQ ID NO: 4047982 - RNA, 17 nt, Respiratory syncytial virus
uuaauuuauacacaaaa

SEQ ID NO: 4047983 - RNA, 13 nt, Respiratory syncytial virus
uuacaaaaccaca

SEQ ID NO: 4047984 - RNA, 22 nt, Respiratory syncytial virus
uuacaaaaccacaucaacaucu

SEQ ID NO: 4047985 - RNA, 20 nt, Respiratory syncytial virus
uuaccaagugaaguaaaucu

SEQ ID NO: 4047986 - RNA, 12 nt, Respiratory syncytial virus
uuagaaaaagac

SEQ ID NO: 4047987 - RNA, 16 nt, Respiratory syncytial virus
uuauuaauggaaauuc

SEQ ID NO: 4047988 - RNA, 13 nt, Respiratory syncytial virus
uucaaauacauaa

SEQ ID NO: 4047989 - RNA, 19 nt, Respiratory syncytial virus
uucaugcauaaccacacuc

SEQ ID NO: 4047990 - RNA, 19 nt, Respiratory syncytial virus
uuugauaacaaugaagaag

SEQ ID NO: 4047991 - RNA, 14 nt, Respiratory syncytial virus
uuugcuaaucauaa

SEQ ID NO: 4047992 - RNA, 12 nt, Respiratory syncytial virus
acaaacaaacca

SEQ ID NO: 4047993 - RNA, 22 nt, Respiratory syncytial virus
acaaagacugaugaucacagac

SEQ ID NO: 4047994 - RNA, 17 nt, Respiratory syncytial virus
acaaaugcaaaaaucau

SEQ ID NO: 4047995 - RNA, 15 nt, Respiratory syncytial virus
acaacacacaaugac

SEQ ID NO: 4047996 - RNA, 23 nt, Respiratory syncytial virus
acaagagucacacaaucugaaau

SEQ ID NO: 4047997 - RNA, 18 nt, Respiratory syncytial virus
acaagcccaauuaucaaa

SEQ ID NO: 4047998 - RNA, 13 nt, Respiratory syncytial virus
acaauauauauau

SEQ ID NO: 4047999 - RNA, 18 nt, Respiratory syncytial virus
acaaugaagaagaaucua

SEQ ID NO: 4048000 - RNA, 14 nt, Respiratory syncytial virus
acaaugaucuauca

SEQ ID NO: 4048001 - RNA, 21 nt, Respiratory syncytial virus
acaaugccaguguuacaaaau

SEQ ID NO: 4048002 - RNA, 16 nt, Respiratory syncytial virus
acacaucgucaagaua

SEQ ID NO: 4048003 - RNA, 19 nt, Respiratory syncytial virus
acacuguauucaauuauag

SEQ ID NO: 4048004 - RNA, 14 nt, Respiratory syncytial virus
acagcaaaguuacu

SEQ ID NO: 4048005 - RNA, 18 nt, Respiratory syncytial virus
acaucaaauucaaccauu

SEQ ID NO: 4048006 - RNA, 16 nt, Respiratory syncytial virus
acaucaucaaacuauu

SEQ ID NO: 4048007 - RNA, 18 nt, Respiratory syncytial virus
accaacgcaccaccaaga

SEQ ID NO: 4048008 - RNA, 13 nt, Respiratory syncytial virus
accaagacacuag

SEQ ID NO: 4048009 - RNA, 19 nt, Respiratory syncytial virus
accaugcaagccaucaucc

SEQ ID NO: 4048010 - RNA, 21 nt, Respiratory syncytial virus
accauggacacaacacacaau

SEQ ID NO: 4048011 - RNA, 15 nt, Respiratory syncytial virus
acccauccaaccaaa

SEQ ID NO: 4048012 - RNA, 14 nt, Respiratory syncytial virus
accuaccaccaagc

SEQ ID NO: 4048013 - RNA, 14 nt, Respiratory syncytial virus
accuagaaaaagaa

SEQ ID NO: 4048014 - RNA, 16 nt, Respiratory syncytial virus
accuagaaaaagaaag

SEQ ID NO: 4048015 - RNA, 18 nt, Respiratory syncytial virus
accucuuuacaaaaccac

SEQ ID NO: 4048016 - RNA, 22 nt, Respiratory syncytial virus
acuaacaacugcaaucauacaa

SEQ ID NO: 4048017 - RNA, 22 nt, Respiratory syncytial virus
acuagcaaaucaaugucacuaa

SEQ ID NO: 4048018 - RNA, 14 nt, Respiratory syncytial virus
acucacccauccaa

SEQ ID NO: 4048019 - RNA, 15 nt, Respiratory syncytial virus
acucucaucuauaaa

SEQ ID NO: 4048020 - RNA, 12 nt, Respiratory syncytial virus
acuugaugaaag

SEQ ID NO: 4048021 - RNA, 20 nt, Respiratory syncytial virus
acuugauugaugcaauucaa

SEQ ID NO: 4048022 - RNA, 17 nt, Respiratory syncytial virus
agaaacacaucaauaag

SEQ ID NO: 4048023 - RNA, 21 nt, Respiratory syncytial virus
agaacuagcuaaugucaacau

SEQ ID NO: 4048024 - RNA, 13 nt, Respiratory syncytial virus
agaaucaauaaag

SEQ ID NO: 4048025 - RNA, 18 nt, Respiratory syncytial virus
agagaugcgggauaucau

SEQ ID NO: 4048026 - RNA, 17 nt, Respiratory syncytial virus
agagaugggcagcaauu

SEQ ID NO: 4048027 - RNA, 20 nt, Respiratory syncytial virus
agagaugggcagcaauucau

SEQ ID NO: 4048028 - RNA, 19 nt, Respiratory syncytial virus
agauauagaaguaaccaaa

SEQ ID NO: 4048029 - RNA, 19 nt, Respiratory syncytial virus
agaucccaagaaaaaagau

SEQ ID NO: 4048030 - RNA, 14 nt, Respiratory syncytial virus
agaucuauaugaug

SEQ ID NO: 4048031 - RNA, 15 nt, Respiratory syncytial virus
agaucugaacacacu

SEQ ID NO: 4048032 - RNA, 18 nt, Respiratory syncytial virus
agauggggcaaauacaaa

SEQ ID NO: 4048033 - RNA, 21 nt, Respiratory syncytial virus
agauuaggaagagaagacacc

SEQ ID NO: 4048034 - RNA, 17 nt, Respiratory syncytial virus
agcaaaucaaugucacu

SEQ ID NO: 4048035 - RNA, 22 nt, Respiratory syncytial virus
agcacacucccauaauauacaa

SEQ ID NO: 4048036 - RNA, 16 nt, Respiratory syncytial virus
agcagacguauugaag

SEQ ID NO: 4048037 - RNA, 21 nt, Respiratory syncytial virus
agccucggcaaaccacaaagu

SEQ ID NO: 4048038 - RNA, 19 nt, Respiratory syncytial virus
agcuacacacuaacacugu

SEQ ID NO: 4048039 - RNA, 22 nt, Respiratory syncytial virus
aggcuccacauacacagcugcu

SEQ ID NO: 4048040 - RNA, 14 nt, Respiratory syncytial virus
agugaguugauuca

SEQ ID NO: 4048041 - RNA, 11 nt, Respiratory syncytial virus
aguuaauuaaa

SEQ ID NO: 4048042 - RNA, 16 nt, Respiratory syncytial virus
aguucaaauggagccu

SEQ ID NO: 4048043 - RNA, 23 nt, Respiratory syncytial virus
aguugaaugauacacucaacaaa

SEQ ID NO: 4048044 - RNA, 14 nt, Respiratory syncytial virus
aguugccaauccuc

SEQ ID NO: 4048045 - RNA, 22 nt, Respiratory syncytial virus
aguugccaauccucaaaacaaa

SEQ ID NO: 4048046 - RNA, 19 nt, Respiratory syncytial virus
auaaauaucaacuagcaaa

SEQ ID NO: 4048047 - RNA, 15 nt, Respiratory syncytial virus
auaaccauauauacu

SEQ ID NO: 4048048 - RNA, 16 nt, Respiratory syncytial virus
auaacuauagaauuaa

SEQ ID NO: 4048049 - RNA, 16 nt, Respiratory syncytial virus
auaagaauuugauaag

SEQ ID NO: 4048050 - RNA, 20 nt, Respiratory syncytial virus
auaaugauacuaccugacaa

SEQ ID NO: 4048051 - RNA, 15 nt, Respiratory syncytial virus
auaccaaacaaaaaa

SEQ ID NO: 4048052 - RNA, 20 nt, Respiratory syncytial virus
auacucaccgaaucaaccau

SEQ ID NO: 4048053 - RNA, 18 nt, Respiratory syncytial virus
auacuccuaauuaugaug

SEQ ID NO: 4048054 - RNA, 19 nt, Respiratory syncytial virus
auacugacaaauuaauaca

SEQ ID NO: 4048055 - RNA, 19 nt, Respiratory syncytial virus
auaguucaaauggagccug

SEQ ID NO: 4048056 - RNA, 17 nt, Respiratory syncytial virus
auaucauguaaaagcaa

SEQ ID NO: 4048057 - RNA, 13 nt, Respiratory syncytial virus
auaugcccaaaaa

SEQ ID NO: 4048058 - RNA, 21 nt, Respiratory syncytial virus
auauuaaugggaaagaaauga

SEQ ID NO: 4048059 - RNA, 18 nt, Respiratory syncytial virus
aucaaaagaacacacuau

SEQ ID NO: 4048060 - RNA, 16 nt, Respiratory syncytial virus
aucaaacaaaacccau

SEQ ID NO: 4048061 - RNA, 14 nt, Respiratory syncytial virus
aucaaagaaaaccu

SEQ ID NO: 4048062 - RNA, 21 nt, Respiratory syncytial virus
aucaaugucacuaacaccauu

SEQ ID NO: 4048063 - RNA, 19 nt, Respiratory syncytial virus
aucagugucagaaauaaag

SEQ ID NO: 4048064 - RNA, 16 nt, Respiratory syncytial virus
auccgaugaauuauua

SEQ ID NO: 4048065 - RNA, 20 nt, Respiratory syncytial virus
aucugaacacacuugaaaau

SEQ ID NO: 4048066 - RNA, 20 nt, Respiratory syncytial virus
aucuuaaagcagucaaaaau

SEQ ID NO: 4048067 - RNA, 20 nt, Respiratory syncytial virus
augauacacucaacaaagau

SEQ ID NO: 4048068 - RNA, 19 nt, Respiratory syncytial virus
augcauaaccacacuccau

SEQ ID NO: 4048069 - RNA, 11 nt, Respiratory syncytial virus
aaaaaaaaugg

SEQ ID NO: 4048070 - RNA, 20 nt, Respiratory syncytial virus
aaaaaugcuaaaagaaaugg

SEQ ID NO: 4048071 - RNA, 17 nt, Respiratory syncytial virus
aaaaccauaaaaaccac

SEQ ID NO: 4048072 - RNA, 15 nt, Respiratory syncytial virus
aaaacccaucuggag

SEQ ID NO: 4048073 - RNA, 21 nt, Respiratory syncytial virus
aaaaccuggaaagaaaaccac

SEQ ID NO: 4048074 - RNA, 17 nt, Respiratory syncytial virus
aaaacuaagugauucaa

SEQ ID NO: 4048075 - RNA, 12 nt, Respiratory syncytial virus
aaaacuauacaa

SEQ ID NO: 4048076 - RNA, 12 nt, Respiratory syncytial virus
aaaagucauaau

SEQ ID NO: 4048077 - RNA, 13 nt, Respiratory syncytial virus
aaaaguuagauua

SEQ ID NO: 4048078 - RNA, 19 nt, Respiratory syncytial virus
aaaauggcucuuagcaaag

SEQ ID NO: 4048079 - RNA, 12 nt, Respiratory syncytial virus
aaacaaaaagau

SEQ ID NO: 4048080 - RNA, 13 nt, Respiratory syncytial virus
aaacaacauauua

SEQ ID NO: 4048081 - RNA, 13 nt, Respiratory syncytial virus
aaaccaaccauca

SEQ ID NO: 4048082 - RNA, 19 nt, Respiratory syncytial virus
aaacccaucuggagccuca

SEQ ID NO: 4048083 - RNA, 14 nt, Respiratory syncytial virus
aaagaaaugggaga

SEQ ID NO: 4048084 - RNA, 21 nt, Respiratory syncytial virus
aaagaaaugggagagguagcu

SEQ ID NO: 4048085 - RNA, 12 nt, Respiratory syncytial virus
aaagaacaacag

SEQ ID NO: 4048086 - RNA, 20 nt, Respiratory syncytial virus
aaagucauaauaccaacaua

SEQ ID NO: 4048087 - RNA, 16 nt, Respiratory syncytial virus
aaaguuagauuacaaa

SEQ ID NO: 4048088 - RNA, 13 nt, Respiratory syncytial virus
aaauaaagaucug

SEQ ID NO: 4048089 - RNA, 14 nt, Respiratory syncytial virus
aaaucagaacugaa

SEQ ID NO: 4048090 - RNA, 13 nt, Respiratory syncytial virus
aaaugcaaacaug

SEQ ID NO: 4048091 - RNA, 15 nt, Respiratory syncytial virus
aaauuaauacauuua

SEQ ID NO: 4048092 - RNA, 15 nt, Respiratory syncytial virus
aaauuuaaauccaaa

SEQ ID NO: 4048093 - RNA, 13 nt, Respiratory syncytial virus
aacaacccaaaag

SEQ ID NO: 4048094 - RNA, 20 nt, Respiratory syncytial virus
aacaaugccaguguuacaaa

SEQ ID NO: 4048095 - RNA, 16 nt, Respiratory syncytial virus
aacaccaccaaaacaa

SEQ ID NO: 4048096 - RNA, 22 nt, Respiratory syncytial virus
aacauacuagugaaacaaauau

SEQ ID NO: 4048097 - RNA, 18 nt, Respiratory syncytial virus
aacaugccuaaaaucaaa

SEQ ID NO: 4048098 - RNA, 23 nt, Respiratory syncytial virus
aaccacugaauucaaaaaugcca

SEQ ID NO: 4048099 - RNA, 17 nt, Respiratory syncytial virus
aacuugaugaaagacag

SEQ ID NO: 4048100 - RNA, 22 nt, Respiratory syncytial virus
aagaacacaaccccaacauacc

SEQ ID NO: 4048101 - RNA, 16 nt, Respiratory syncytial virus
aagacaaccaaaaaag

SEQ ID NO: 4048102 - RNA, 22 nt, Respiratory syncytial virus
aagcacacucccauaauauaca

SEQ ID NO: 4048103 - RNA, 18 nt, Respiratory syncytial virus
aagucaaguugaaugaua

SEQ ID NO: 4048104 - RNA, 21 nt, Respiratory syncytial virus
aagucauaauaccaacauacc

SEQ ID NO: 4048105 - RNA, 21 nt, Respiratory syncytial virus
aaguguuagaccucaaaaacu

SEQ ID NO: 4048106 - RNA, 14 nt, Respiratory syncytial virus
aaguuacauauuca

SEQ ID NO: 4048107 - RNA, 14 nt, Respiratory syncytial virus
aauaaccaaauuag

SEQ ID NO: 4048108 - RNA, 15 nt, Respiratory syncytial virus
aauacaaaaaauaua

SEQ ID NO: 4048109 - RNA, 15 nt, Respiratory syncytial virus
aauacaaaaauggcu

SEQ ID NO: 4048110 - RNA, 20 nt, Respiratory syncytial virus
aauacauuuaacuaaugcau

SEQ ID NO: 4048111 - RNA, 15 nt, Respiratory syncytial virus
aauagguauguuaua

SEQ ID NO: 4048112 - RNA, 17 nt, Respiratory syncytial virus
aauaucaacuagcaaau

SEQ ID NO: 4048113 - RNA, 14 nt, Respiratory syncytial virus
aaucauaaucucca

SEQ ID NO: 4048114 - RNA, 15 nt, Respiratory syncytial virus
aauccaauuucacaa

SEQ ID NO: 4048115 - RNA, 20 nt, Respiratory syncytial virus
aaucuagcuauucauaugaa

SEQ ID NO: 4048116 - RNA, 19 nt, Respiratory syncytial virus
aauggggcaaauaaaacau

SEQ ID NO: 4048117 - RNA, 18 nt, Respiratory syncytial virus
aauguccuaaaaaaugaa

SEQ ID NO: 4048118 - RNA, 20 nt, Respiratory syncytial virus
aauugcagccaucauauuca

SEQ ID NO: 4048119 - RNA, 21 nt, Respiratory syncytial virus
acaaaauuuguuugacaauga

SEQ ID NO: 4048120 - RNA, 21 nt, Respiratory syncytial virus
uauaacaucaaauucaaccau

SEQ ID NO: 4048121 - RNA, 23 nt, Respiratory syncytial virus
uauaauaaauaucaacuagcaaa

SEQ ID NO: 4048122 - RNA, 13 nt, Respiratory syncytial virus
uauaguaacauca

SEQ ID NO: 4048123 - RNA, 16 nt, Respiratory syncytial virus
uauauuaaaaauuccc

SEQ ID NO: 4048124 - RNA, 21 nt, Respiratory syncytial virus
uaucaacuagcaaaucaaugu

SEQ ID NO: 4048125 - RNA, 15 nt, Respiratory syncytial virus
uauuaaucacagaag

SEQ ID NO: 4048126 - RNA, 16 nt, Respiratory syncytial virus
ucaacacacaacacca

SEQ ID NO: 4048127 - RNA, 12 nt, Respiratory syncytial virus
ucaacaccacca

SEQ ID NO: 4048128 - RNA, 18 nt, Respiratory syncytial virus
ucaacaucucaccaugca

SEQ ID NO: 4048129 - RNA, 21 nt, Respiratory syncytial virus
ucaacuaugaaaugaaacuau

SEQ ID NO: 4048130 - RNA, 22 nt, Respiratory syncytial virus
ucaagaucuauaugaugcugca

SEQ ID NO: 4048131 - RNA, 15 nt, Respiratory syncytial virus
ucaaucaugaugggu

SEQ ID NO: 4048132 - RNA, 12 nt, Respiratory syncytial virus
ucacccauccaa

SEQ ID NO: 4048133 - RNA, 13 nt, Respiratory syncytial virus
ucacuaacaccau

SEQ ID NO: 4048134 - RNA, 14 nt, Respiratory syncytial virus
ucaugcauaaccac

SEQ ID NO: 4048135 - RNA, 21 nt, Respiratory syncytial virus
uccacaaacaaggcuguaguc

SEQ ID NO: 4048136 - RNA, 11 nt, Respiratory syncytial virus
uccuacaaaaa

SEQ ID NO: 4048137 - RNA, 11 nt, Respiratory syncytial virus
ucuaacaugcc

SEQ ID NO: 4048138 - RNA, 21 nt, Respiratory syncytial virus
ucugaacuucaucgaaacucu

SEQ ID NO: 4048139 - RNA, 21 nt, Respiratory syncytial virus
ucuuaaaucuauagcacaaau

SEQ ID NO: 4048140 - RNA, 17 nt, Respiratory syncytial virus
ugaaaauauaacaacca

SEQ ID NO: 4048141 - RNA, 21 nt, Respiratory syncytial virus
ugaaauaacaacuucaugcau

SEQ ID NO: 4048142 - RNA, 18 nt, Respiratory syncytial virus
ugaaauucaaaucaacau

SEQ ID NO: 4048143 - RNA, 19 nt, Respiratory syncytial virus
ugaacacacuugaaaauau

SEQ ID NO: 4048144 - RNA, 17 nt, Respiratory syncytial virus
ugaauacaacacaaaau

SEQ ID NO: 4048145 - RNA, 15 nt, Respiratory syncytial virus
ugaaugauacacuca

SEQ ID NO: 4048146 - RNA, 10 nt, Respiratory syncytial virus
aucagugagu

SEQ ID NO: 4048147 - RNA, 16 nt, Respiratory syncytial virus
aucauaacacacagau

SEQ ID NO: 4048148 - RNA, 19 nt, Respiratory syncytial virus
aucaugauugcaauacuga

SEQ ID NO: 4048149 - RNA, 19 nt, Respiratory syncytial virus
auccaauuucacaacaaug

SEQ ID NO: 4048150 - RNA, 19 nt, Respiratory syncytial virus
aucgaaacucucaucuaua

SEQ ID NO: 4048151 - RNA, 18 nt, Respiratory syncytial virus
aucgucaagauauuaaug

SEQ ID NO: 4048152 - RNA, 13 nt, Respiratory syncytial virus
aucucaccaugca

SEQ ID NO: 4048153 - RNA, 16 nt, Respiratory syncytial virus
aucugaaauaacaacu

SEQ ID NO: 4048154 - RNA, 17 nt, Respiratory syncytial virus
augaccaauuauaugaa

SEQ ID NO: 4048155 - RNA, 18 nt, Respiratory syncytial virus
augccaauauuuaucaau

SEQ ID NO: 4048156 - RNA, 22 nt, Respiratory syncytial virus
augcuuaccacaucaucaaacu

SEQ ID NO: 4048157 - RNA, 17 nt, Respiratory syncytial virus
auggaauuaacacacug

SEQ ID NO: 4048158 - RNA, 20 nt, Respiratory syncytial virus
auggacacaacacacaauga

SEQ ID NO: 4048159 - RNA, 16 nt, Respiratory syncytial virus
auggagccugaaaauu

SEQ ID NO: 4048160 - RNA, 19 nt, Respiratory syncytial virus
auguuauuacaaguaguga

SEQ ID NO: 4048161 - RNA, 23 nt, Respiratory syncytial virus
auuaaaaauaaucauaacaauga

SEQ ID NO: 4048162 - RNA, 16 nt, Respiratory syncytial virus
auuaagacuaacaaua

SEQ ID NO: 4048163 - RNA, 14 nt, Respiratory syncytial virus
auuauuacauaaug

SEQ ID NO: 4048164 - RNA, 20 nt, Respiratory syncytial virus
auuauuaucauuaaucaaug

SEQ ID NO: 4048165 - RNA, 15 nt, Respiratory syncytial virus
auucaaaucaacauu

SEQ ID NO: 4048166 - RNA, 23 nt, Respiratory syncytial virus
auucacccaagauaagaguguac

SEQ ID NO: 4048167 - RNA, 20 nt, Respiratory syncytial virus
auuuauuuugaaucaauaug

SEQ ID NO: 4048168 - RNA, 14 nt, Respiratory syncytial virus
auuuuaucaaacaa

SEQ ID NO: 4048169 - RNA, 12 nt, Respiratory syncytial virus
caaaaacagaug

SEQ ID NO: 4048170 - RNA, 17 nt, Respiratory syncytial virus
caaaacccaucuggagc

SEQ ID NO: 4048171 - RNA, 14 nt, Respiratory syncytial virus
caaaacuauacaaa

SEQ ID NO: 4048172 - RNA, 23 nt, Respiratory syncytial virus
caaaacuuuauguuaaacagaau

SEQ ID NO: 4048173 - RNA, 14 nt, Respiratory syncytial virus
caaaauauggcacu

SEQ ID NO: 4048174 - RNA, 17 nt, Respiratory syncytial virus
caaagaaaccauagaaa

SEQ ID NO: 4048175 - RNA, 14 nt, Respiratory syncytial virus
caaauaaaacauca

SEQ ID NO: 4048176 - RNA, 13 nt, Respiratory syncytial virus
caaauaacaaugg

SEQ ID NO: 4048177 - RNA, 15 nt, Respiratory syncytial virus
caaauucacaucacc

SEQ ID NO: 4048178 - RNA, 22 nt, Respiratory syncytial virus
caacauaccuaagauccaucag

SEQ ID NO: 4048179 - RNA, 14 nt, Respiratory syncytial virus
caaccaacacaaag

SEQ ID NO: 4048180 - RNA, 20 nt, Respiratory syncytial virus
caacccugcaauccacaaca

SEQ ID NO: 4048181 - RNA, 23 nt, Respiratory syncytial virus
caagaaaaaagauaguaucauau

SEQ ID NO: 4048182 - RNA, 19 nt, Respiratory syncytial virus
caagauuaaauccaacaau

SEQ ID NO: 4048183 - RNA, 15 nt, Respiratory syncytial virus
caagcagaaauggaa

SEQ ID NO: 4048184 - RNA, 20 nt, Respiratory syncytial virus
caaguaugaucucaauccau

SEQ ID NO: 4048185 - RNA, 19 nt, Respiratory syncytial virus
caauagaauucucaagcaa

SEQ ID NO: 4048186 - RNA, 13 nt, Respiratory syncytial virus
caaucaaaacaac

SEQ ID NO: 4048187 - RNA, 18 nt, Respiratory syncytial virus
caaugucacuaacaccau

SEQ ID NO: 4048188 - RNA, 17 nt, Respiratory syncytial virus
cacaacaacaaccaaaa

SEQ ID NO: 4048189 - RNA, 15 nt, Respiratory syncytial virus
cacaauauauauauu

SEQ ID NO: 4048190 - RNA, 12 nt, Respiratory syncytial virus
cacaaucugaaa

SEQ ID NO: 4048191 - RNA, 24 nt, Respiratory syncytial virus
cacaaucugaaauaacaacuucau

SEQ ID NO: 4048192 - RNA, 21 nt, Respiratory syncytial virus
cacaaucuucuaccagaggug

SEQ ID NO: 4048193 - RNA, 15 nt, Respiratory syncytial virus
cacacuauauuucaa

SEQ ID NO: 4048194 - RNA, 18 nt, Respiratory syncytial virus
cacacuccauaguucaaa

SEQ ID NO: 4048195 - RNA, 15 nt, Respiratory syncytial virus
cacaugacaucauug

SEQ ID NO: 4048196 - RNA, 23 nt, Respiratory syncytial virus
caccaaucugauggcacaaaaca

SEQ ID NO: 4048197 - RNA, 14 nt, Respiratory syncytial virus
caccacaaaacaac

SEQ ID NO: 4048198 - RNA, 22 nt, Respiratory syncytial virus
cacuaacacuguauucaauuau

SEQ ID NO: 4048199 - RNA, 17 nt, Respiratory syncytial virus
cacugcucaccaacaau

SEQ ID NO: 4048200 - RNA, 15 nt, Respiratory syncytial virus
cacuguauucaauua

SEQ ID NO: 4048201 - RNA, 22 nt, Respiratory syncytial virus
cagacaugagaccauugucacu

SEQ ID NO: 4048202 - RNA, 20 nt, Respiratory syncytial virus
cagagacaucauaacacaca

SEQ ID NO: 4048203 - RNA, 14 nt, Respiratory syncytial virus
cagaggaugguacu

SEQ ID NO: 4048204 - RNA, 13 nt, Respiratory syncytial virus
cauaauauacaag

SEQ ID NO: 4048205 - RNA, 21 nt, Respiratory syncytial virus
cauaaugggagaauacagagg

SEQ ID NO: 4048206 - RNA, 17 nt, Respiratory syncytial virus
cauacuaauaacaagua

SEQ ID NO: 4048207 - RNA, 16 nt, Respiratory syncytial virus
cauagcuacacacuaa

SEQ ID NO: 4048208 - RNA, 16 nt, Respiratory syncytial virus
cauaguucaaauggag

SEQ ID NO: 4048209 - RNA, 18 nt, Respiratory syncytial virus
cauaguucaaauggagcc

SEQ ID NO: 4048210 - RNA, 18 nt, Respiratory syncytial virus
cauaugcugaacaacuca

SEQ ID NO: 4048211 - RNA, 18 nt, Respiratory syncytial virus
caucaacacacaacacca

SEQ ID NO: 4048212 - RNA, 22 nt, Respiratory syncytial virus
caucauuauugucuuugacuca

SEQ ID NO: 4048213 - RNA, 22 nt, Respiratory syncytial virus
cauccaacggagcacaggagau

SEQ ID NO: 4048214 - RNA, 16 nt, Respiratory syncytial virus
cauccaugccagcaga

SEQ ID NO: 4048215 - RNA, 21 nt, Respiratory syncytial virus
caugagaccauugucacuuga

SEQ ID NO: 4048216 - RNA, 20 nt, Respiratory syncytial virus
cauggaaaaguuugcuccug

SEQ ID NO: 4048217 - RNA, 20 nt, Respiratory syncytial virus
cauguuauuaaucacagaag

SEQ ID NO: 4048218 - RNA, 20 nt, Respiratory syncytial virus
cauuaauagaacacauaaau

SEQ ID NO: 4048219 - RNA, 19 nt, Respiratory syncytial virus
cauuauaaacccaacaaau

SEQ ID NO: 4048220 - RNA, 12 nt, Respiratory syncytial virus
ccaaaacaaaca

SEQ ID NO: 4048221 - RNA, 12 nt, Respiratory syncytial virus
ccauaacaaaac

SEQ ID NO: 4048222 - RNA, 16 nt, Respiratory syncytial virus
ccauccaaccaaacau

SEQ ID NO: 4048223 - RNA, 22 nt, Respiratory syncytial virus
ccuagaaggggaagugaacaaa

SEQ ID NO: 4048224 - RNA, 23 nt, Respiratory syncytial virus
ccugaaaauuauaguaauuuaaa

SEQ ID NO: 4048225 - RNA, 14 nt, Respiratory syncytial virus
cgauaauauaacag

SEQ ID NO: 4048226 - RNA, 12 nt, Respiratory syncytial virus
cuaaacaaucag

SEQ ID NO: 4048227 - RNA, 17 nt, Respiratory syncytial virus
cuaaagaucccaagaaa

SEQ ID NO: 4048228 - RNA, 20 nt, Respiratory syncytial virus
cuaaucaaacaaaacccauc

SEQ ID NO: 4048229 - RNA, 20 nt, Respiratory syncytial virus
cuacacacuaacacuguauu

SEQ ID NO: 4048230 - RNA, 16 nt, Respiratory syncytial virus
cuagcaaaucaauguc

SEQ ID NO: 4048231 - RNA, 15 nt, Respiratory syncytial virus
cuauaugaugcugca

SEQ ID NO: 4048232 - RNA, 14 nt, Respiratory syncytial virus
cucuacaaaacaaa

SEQ ID NO: 4048233 - RNA, 11 nt, Respiratory syncytial virus
cugaacaaacu

SEQ ID NO: 4048234 - RNA, 13 nt, Respiratory syncytial virus
cugaacaacucaa

SEQ ID NO: 4048235 - RNA, 17 nt, Respiratory syncytial virus
cuggaaagaaaaccacc

SEQ ID NO: 4048236 - RNA, 16 nt, Respiratory syncytial virus
cugucauccagcaaau

SEQ ID NO: 4048237 - RNA, 21 nt, Respiratory syncytial virus
cuuaaagcagucaaaaaucac

SEQ ID NO: 4048238 - RNA, 16 nt, Respiratory syncytial virus
cuugauaaaucaugaa

SEQ ID NO: 4048239 - RNA, 16 nt, Respiratory syncytial virus
cuugaugaaagacagg

SEQ ID NO: 4048240 - RNA, 17 nt, Respiratory syncytial virus
cuuucuaccuacauucu

SEQ ID NO: 4048241 - RNA, 19 nt, Respiratory syncytial virus
gaaaaccaccaccaagccc

SEQ ID NO: 4048242 - RNA, 22 nt, Respiratory syncytial virus
gaaaaccaccaccaagcccaca

SEQ ID NO: 4048243 - RNA, 15 nt, Respiratory syncytial virus
gaaaacuugaugaaa

SEQ ID NO: 4048244 - RNA, 21 nt, Respiratory syncytial virus
gaaagauggggcaaauacaaa

SEQ ID NO: 4048245 - RNA, 18 nt, Respiratory syncytial virus
gaacacaaccccaacaua

SEQ ID NO: 4048246 - RNA, 19 nt, Respiratory syncytial virus
gaagauaaaaauggggcaa

SEQ ID NO: 4048247 - RNA, 15 nt, Respiratory syncytial virus
gaagcacuaaauaca

SEQ ID NO: 4048248 - RNA, 15 nt, Respiratory syncytial virus
gaaguaaccaaagaa

SEQ ID NO: 4048249 - RNA, 15 nt, Respiratory syncytial virus
gaauuacugugacaa

SEQ ID NO: 4048250 - RNA, 14 nt, Respiratory syncytial virus
gaauuugaaaauau

SEQ ID NO: 4048251 - RNA, 17 nt, Respiratory syncytial virus
gacuucaaaaacagaug

SEQ ID NO: 4048252 - RNA, 16 nt, Respiratory syncytial virus
gagaagacaugauaga

SEQ ID NO: 4048253 - RNA, 17 nt, Respiratory syncytial virus
gauaggauugaugaaaa

SEQ ID NO: 4048254 - RNA, 20 nt, Respiratory syncytial virus
gauaucauguaaaagcaaau

SEQ ID NO: 4048255 - RNA, 20 nt, Respiratory syncytial virus
gaugaaguagcauuguuaaa

SEQ ID NO: 4048256 - RNA, 21 nt, Respiratory syncytial virus
gaugacaauugugaaauuaaa

SEQ ID NO: 4048257 - RNA, 21 nt, Respiratory syncytial virus
gaugauauauacacaauauau

SEQ ID NO: 4048258 - RNA, 22 nt, Respiratory syncytial virus
gauggcaaaagacacaucagau

SEQ ID NO: 4048259 - RNA, 20 nt, Respiratory syncytial virus
gauggggcaaauacaaaaau

SEQ ID NO: 4048260 - RNA, 16 nt, Respiratory syncytial virus
gcaaauacaccaucca

SEQ ID NO: 4048261 - RNA, 23 nt, Respiratory syncytial virus
gcaaauucacaucaccuaaagau

SEQ ID NO: 4048262 - RNA, 14 nt, Respiratory syncytial virus
gcaaugauaaucuc

SEQ ID NO: 4048263 - RNA, 14 nt, Respiratory syncytial virus
gcacuaaauacaaa

SEQ ID NO: 4048264 - RNA, 16 nt, Respiratory syncytial virus
gccaaaacaaaccacc

SEQ ID NO: 4048265 - RNA, 10 nt, Respiratory syncytial virus
gccacccgga

SEQ ID NO: 4048266 - RNA, 16 nt, Respiratory syncytial virus
gccaucacaaaugcaa

SEQ ID NO: 4048267 - RNA, 14 nt, Respiratory syncytial virus
gccuacaaagcaca

SEQ ID NO: 4048268 - RNA, 18 nt, Respiratory syncytial virus
gcuauucauaugaagaaa

SEQ ID NO: 4048269 - RNA, 14 nt, Respiratory syncytial virus
gcuuaacaacugaa

SEQ ID NO: 4048270 - RNA, 18 nt, Respiratory syncytial virus
ggaaaauaaguguaaugg

SEQ ID NO: 4048271 - RNA, 17 nt, Respiratory syncytial virus
ggaacccuccacucaac

SEQ ID NO: 4048272 - RNA, 22 nt, Respiratory syncytial virus
ggacugcuccuauacugcaagg

SEQ ID NO: 4048273 - RNA, 11 nt, Respiratory syncytial virus
ggagccucaga

SEQ ID NO: 4048274 - RNA, 18 nt, Respiratory syncytial virus
ggagcuuaccuagaaaaa

SEQ ID NO: 4048275 - RNA, 16 nt, Respiratory syncytial virus
guaaccuugcauuugu

SEQ ID NO: 4048276 - RNA, 16 nt, Respiratory syncytial virus
guaauuuaaaauuaag

SEQ ID NO: 4048277 - RNA, 12 nt, Respiratory syncytial virus
guauuacugaug

SEQ ID NO: 4048278 - RNA, 22 nt, Respiratory syncytial virus
guauuacugaugauauauacac

SEQ ID NO: 4048279 - RNA, 19 nt, Respiratory syncytial virus
guauucaauuauaguuauu

SEQ ID NO: 4048280 - RNA, 17 nt, Respiratory syncytial virus
gucauaauaccaacaua

SEQ ID NO: 4048281 - RNA, 17 nt, Respiratory syncytial virus
gucugaaacuacaucac

SEQ ID NO: 4048282 - RNA, 12 nt, Respiratory syncytial virus
gucuuagaaaaa

SEQ ID NO: 4048283 - RNA, 16 nt, Respiratory syncytial virus
guggcauugcuguauc

SEQ ID NO: 4048284 - RNA, 20 nt, Respiratory syncytial virus
gugucucucaauccaacauc

SEQ ID NO: 4048285 - RNA, 17 nt, Respiratory syncytial virus
guuaaaaauaacaugcu

SEQ ID NO: 4048286 - RNA, 20 nt, Respiratory syncytial virus
guuacuauguauaaucaaaa

SEQ ID NO: 4048287 - RNA, 18 nt, Respiratory syncytial virus
guucuacauaauaaaaga

SEQ ID NO: 4048288 - RNA, 18 nt, Respiratory syncytial virus
guugaaugauacacucaa

SEQ ID NO: 4048289 - RNA, 15 nt, Respiratory syncytial virus
guuggggcaaaugca

SEQ ID NO: 4048290 - RNA, 23 nt, Respiratory syncytial virus
guuugaacacauuaaauaaaagc

SEQ ID NO: 4048291 - RNA, 16 nt, Respiratory syncytial virus
uaaaaauacucagaga

SEQ ID NO: 4048292 - RNA, 17 nt, Respiratory syncytial virus
uaaaaauucccauagcu

SEQ ID NO: 4048293 - RNA, 23 nt, Respiratory syncytial virus
uaaaaauucccauagcuacacac

SEQ ID NO: 4048294 - RNA, 19 nt, Respiratory syncytial virus
uaaaacaauugaauaccag

SEQ ID NO: 4048295 - RNA, 21 nt, Respiratory syncytial virus
uaaauaucaacuagcaaauca

SEQ ID NO: 4048296 - RNA, 19 nt, Respiratory syncytial virus
uaaauccgaugaauuauua

SEQ ID NO: 4048297 - RNA, 16 nt, Respiratory syncytial virus
uaaauuccauacuaau

SEQ ID NO: 4048298 - RNA, 20 nt, Respiratory syncytial virus
uaacaacugcaaucauacaa

SEQ ID NO: 4048299 - RNA, 14 nt, Respiratory syncytial virus
uaacaaugaagaag

SEQ ID NO: 4048300 - RNA, 15 nt, Respiratory syncytial virus
uaacaccauuaguua

SEQ ID NO: 4048301 - RNA, 16 nt, Respiratory syncytial virus
uaaccauauauacuca

SEQ ID NO: 4048302 - RNA, 19 nt, Respiratory syncytial virus
uaauauuguagugaaaucc

SEQ ID NO: 4048303 - RNA, 15 nt, Respiratory syncytial virus
uaaucacagaagaug

SEQ ID NO: 4048304 - RNA, 22 nt, Respiratory syncytial virus
uaauccaaaagauaaugaugua

SEQ ID NO: 4048305 - RNA, 22 nt, Respiratory syncytial virus
uaaugcuuaccacaucaucaaa

SEQ ID NO: 4048306 - RNA, 10 nt, Respiratory syncytial virus
uacaacccag

SEQ ID NO: 4048307 - RNA, 17 nt, Respiratory syncytial virus
uacauaaagccacaaag

SEQ ID NO: 4048308 - RNA, 15 nt, Respiratory syncytial virus
uacauuuaacuaaug

SEQ ID NO: 4048309 - RNA, 24 nt, Respiratory syncytial virus
uaccaagagcucgagucaauacau

SEQ ID NO: 4048310 - RNA, 12 nt, Respiratory syncytial virus
uacgugaacaaa

SEQ ID NO: 4048311 - RNA, 20 nt, Respiratory syncytial virus
uacuaggaaugcuucacaca

SEQ ID NO: 4048312 - RNA, 16 nt, Respiratory syncytial virus
uacugaauacaacaca

SEQ ID NO: 4048313 - RNA, 18 nt, Respiratory syncytial virus
uacuguuagucaucacag

SEQ ID NO: 4048314 - RNA, 20 nt, Respiratory syncytial virus
uagcauuuauucguaaaucc

SEQ ID NO: 4048315 - RNA, 15 nt, Respiratory syncytial virus
uagcuacacacuaac

SEQ ID NO: 4048316 - RNA, 20 nt, Respiratory syncytial virus
uagcuacacacuaacacugu

SEQ ID NO: 4048317 - RNA, 14 nt, Respiratory syncytial virus
uaguauaaauucca

SEQ ID NO: 4048318 - RNA, 19 nt, Respiratory syncytial virus
agcuauucauaugaagaaa

SEQ ID NO: 4048319 - RNA, 17 nt, Respiratory syncytial virus
agcugaaacauguaaag

SEQ ID NO: 4048320 - RNA, 19 nt, Respiratory syncytial virus
agcugcuguucaauacaau

SEQ ID NO: 4048321 - RNA, 23 nt, Respiratory syncytial virus
agcuggcauaugauguaaccaca

SEQ ID NO: 4048322 - RNA, 16 nt, Respiratory syncytial virus
agcuuaauccaaaaga

SEQ ID NO: 4048323 - RNA, 13 nt, Respiratory syncytial virus
aguaaccaaagaa

SEQ ID NO: 4048324 - RNA, 14 nt, Respiratory syncytial virus
aguacucaaauaag

SEQ ID NO: 4048325 - RNA, 11 nt, Respiratory syncytial virus
agucaaaacau

SEQ ID NO: 4048326 - RNA, 22 nt, Respiratory syncytial virus
agucaaaacaucacugaagaau

SEQ ID NO: 4048327 - RNA, 20 nt, Respiratory syncytial virus
agucaacccugcaauccaca

SEQ ID NO: 4048328 - RNA, 23 nt, Respiratory syncytial virus
aguguaguauuaggcaaugcugc

SEQ ID NO: 4048329 - RNA, 14 nt, Respiratory syncytial virus
aguguuacaaaaug

SEQ ID NO: 4048330 - RNA, 16 nt, Respiratory syncytial virus
aguuacaaaaaaagau

SEQ ID NO: 4048331 - RNA, 20 nt, Respiratory syncytial virus
auaaauuuaaauccaaaucu

SEQ ID NO: 4048332 - RNA, 22 nt, Respiratory syncytial virus
auaaggaacucaaaagaauuac

SEQ ID NO: 4048333 - RNA, 16 nt, Respiratory syncytial virus
auaaucccuuuucaaa

SEQ ID NO: 4048334 - RNA, 17 nt, Respiratory syncytial virus
auaaucucaacuucacu

SEQ ID NO: 4048335 - RNA, 12 nt, Respiratory syncytial virus
auacaaagaaac

SEQ ID NO: 4048336 - RNA, 15 nt, Respiratory syncytial virus
auacauaaagccaca

SEQ ID NO: 4048337 - RNA, 17 nt, Respiratory syncytial virus
auacuauaguuacaaaa

SEQ ID NO: 4048338 - RNA, 21 nt, Respiratory syncytial virus
auacuugauaaaucaugaaug

SEQ ID NO: 4048339 - RNA, 13 nt, Respiratory syncytial virus
auagaaguaacca

SEQ ID NO: 4048340 - RNA, 17 nt, Respiratory syncytial virus
auagaugacaauuguga

SEQ ID NO: 4048341 - RNA, 22 nt, Respiratory syncytial virus
auagcuacacacuaacacugua

SEQ ID NO: 4048342 - RNA, 18 nt, Respiratory syncytial virus
auaguucaaauggagccu

SEQ ID NO: 4048343 - RNA, 12 nt, Respiratory syncytial virus
auauaaaacaau

SEQ ID NO: 4048344 - RNA, 19 nt, Respiratory syncytial virus
auauaguaacaucaaaaaa

SEQ ID NO: 4048345 - RNA, 18 nt, Respiratory syncytial virus
auaugcuaugucuagauu

SEQ ID NO: 4048346 - RNA, 12 nt, Respiratory syncytial virus
auauugaacaac

SEQ ID NO: 4048347 - RNA, 17 nt, Respiratory syncytial virus
auauuugcccuaauaau

SEQ ID NO: 4048348 - RNA, 14 nt, Respiratory syncytial virus
aucaaacuauuaac

SEQ ID NO: 4048349 - RNA, 14 nt, Respiratory syncytial virus
aucaacuagcaaau

SEQ ID NO: 4048350 - RNA, 20 nt, Respiratory syncytial virus
aucaaugucacuaacaccau

SEQ ID NO: 4048351 - RNA, 20 nt, Respiratory syncytial virus
aucacaauaucugucaacau

SEQ ID NO: 4048352 - RNA, 19 nt, Respiratory syncytial virus
aucagaucuaguacucaaa

SEQ ID NO: 4048353 - RNA, 14 nt, Respiratory syncytial virus
aucagcuucuccaa

SEQ ID NO: 4048354 - RNA, 23 nt, Respiratory syncytial virus
aauagcaccuaaucauguucuua

SEQ ID NO: 4048355 - RNA, 22 nt, Respiratory syncytial virus
aauauacugaauacaacacaaa

SEQ ID NO: 4048356 - RNA, 19 nt, Respiratory syncytial virus
aauaucugucaacauagac

SEQ ID NO: 4048357 - RNA, 11 nt, Respiratory syncytial virus
aaucaaaacaa

SEQ ID NO: 4048358 - RNA, 21 nt, Respiratory syncytial virus
aaucaauaaagggcaaauuca

SEQ ID NO: 4048359 - RNA, 15 nt, Respiratory syncytial virus
aaucagccaauccaa

SEQ ID NO: 4048360 - RNA, 21 nt, Respiratory syncytial virus
aaucauuggaggaaauccaac

SEQ ID NO: 4048361 - RNA, 22 nt, Respiratory syncytial virus
aauuaaaaauaaucauaacaau

SEQ ID NO: 4048362 - RNA, 15 nt, Respiratory syncytial virus
aauugauaaaacaag

SEQ ID NO: 4048363 - RNA, 17 nt, Respiratory syncytial virus
aauuuacuuaaaaagau

SEQ ID NO: 4048364 - RNA, 14 nt, Respiratory syncytial virus
aauuucaacacaag

SEQ ID NO: 4048365 - RNA, 18 nt, Respiratory syncytial virus
aauuuguuugacaaugau

SEQ ID NO: 4048366 - RNA, 15 nt, Respiratory syncytial virus
aauuuucuacaacau

SEQ ID NO: 4048367 - RNA, 22 nt, Respiratory syncytial virus
acaaaaccuuugagcuaccaag

SEQ ID NO: 4048368 - RNA, 16 nt, Respiratory syncytial virus
acaaacgauaauauaa

SEQ ID NO: 4048369 - RNA, 15 nt, Respiratory syncytial virus
acaaagugggaagca

SEQ ID NO: 4048370 - RNA, 23 nt, Respiratory syncytial virus
acaaaugaucagaaaaaguuaau

SEQ ID NO: 4048371 - RNA, 15 nt, Respiratory syncytial virus
acaacccaucuauca

SEQ ID NO: 4048372 - RNA, 22 nt, Respiratory syncytial virus
acaagauuaaauccaacaaugg

SEQ ID NO: 4048373 - RNA, 15 nt, Respiratory syncytial virus
acacaacacacaaug

SEQ ID NO: 4048374 - RNA, 18 nt, Respiratory syncytial virus
acacaacacacaaugaca

SEQ ID NO: 4048375 - RNA, 19 nt, Respiratory syncytial virus
acacaugauaacaacaaua

SEQ ID NO: 4048376 - RNA, 16 nt, Respiratory syncytial virus
acacgccaggcaaaau

SEQ ID NO: 4048377 - RNA, 14 nt, Respiratory syncytial virus
acacucaacaaaga

SEQ ID NO: 4048378 - RNA, 20 nt, Respiratory syncytial virus
acacucccauaauauacaag

SEQ ID NO: 4048379 - RNA, 15 nt, Respiratory syncytial virus
acagcagaagaacua

SEQ ID NO: 4048380 - RNA, 23 nt, Respiratory syncytial virus
acaggccacauuuacauuccugg

SEQ ID NO: 4048381 - RNA, 16 nt, Respiratory syncytial virus
acaucaacaucucacc

SEQ ID NO: 4048382 - RNA, 16 nt, Respiratory syncytial virus
acaucagugaguugau

SEQ ID NO: 4048383 - RNA, 21 nt, Respiratory syncytial virus
acaucgucaagauauuaaugg

SEQ ID NO: 4048384 - RNA, 23 nt, Respiratory syncytial virus
acaugcagugcagucagcaaagg

SEQ ID NO: 4048385 - RNA, 15 nt, Respiratory syncytial virus
acauguccaaaaaca

SEQ ID NO: 4048386 - RNA, 19 nt, Respiratory syncytial virus
acauugagauagaaucuag

SEQ ID NO: 4048387 - RNA, 14 nt, Respiratory syncytial virus
accaaaauaaccau

SEQ ID NO: 4048388 - RNA, 23 nt, Respiratory syncytial virus
accaacauaccuaagauccauca

SEQ ID NO: 4048389 - RNA, 18 nt, Respiratory syncytial virus
accacaucaacaucucac

SEQ ID NO: 4048390 - RNA, 21 nt, Respiratory syncytial virus
acccauccaaccaaacaucua

SEQ ID NO: 4048391 - RNA, 15 nt, Respiratory syncytial virus
acccaucuggagccu

SEQ ID NO: 4048392 - RNA, 23 nt, Respiratory syncytial virus
accuagaaggggaagugaacaaa

SEQ ID NO: 4048393 - RNA, 19 nt, Respiratory syncytial virus
accuaucacaaccuccauc

SEQ ID NO: 4048394 - RNA, 20 nt, Respiratory syncytial virus
acgccaaucagccaauccaa

SEQ ID NO: 4048395 - RNA, 23 nt, Respiratory syncytial virus
acuaacaccauuaguuaauauaa

SEQ ID NO: 4048396 - RNA, 16 nt, Respiratory syncytial virus
acucaaauaaguuaau

SEQ ID NO: 4048397 - RNA, 23 nt, Respiratory syncytial virus
acucaggaaugaggaaagugaaa

SEQ ID NO: 4048398 - RNA, 13 nt, Respiratory syncytial virus
acucuugaagaaa

SEQ ID NO: 4048399 - RNA, 13 nt, Respiratory syncytial virus
acuugaugaaaga

SEQ ID NO: 4048400 - RNA, 21 nt, Respiratory syncytial virus
agaaaauggugugauuaacua

SEQ ID NO: 4048401 - RNA, 21 nt, Respiratory syncytial virus
agaagacccuacgccaaguga

SEQ ID NO: 4048402 - RNA, 17 nt, Respiratory syncytial virus
agacaucauaacacaca

SEQ ID NO: 4048403 - RNA, 16 nt, Respiratory syncytial virus
agacguauugaagaaa

SEQ ID NO: 4048404 - RNA, 22 nt, Respiratory syncytial virus
agagcucgagucaauacauagc

SEQ ID NO: 4048405 - RNA, 12 nt, Respiratory syncytial virus
agauaaaaaugg

SEQ ID NO: 4048406 - RNA, 19 nt, Respiratory syncytial virus
agauauuaagacuaacaau

SEQ ID NO: 4048407 - RNA, 22 nt, Respiratory syncytial virus
agauauuaaugggaaagaaaug

SEQ ID NO: 4048408 - RNA, 19 nt, Respiratory syncytial virus
agaucuaguacucaaauaa

SEQ ID NO: 4048409 - RNA, 24 nt, Respiratory syncytial virus
agaugcuaaucauaaauucacugg

SEQ ID NO: 4048410 - RNA, 16 nt, Respiratory syncytial virus
agauggcaaaagacac

SEQ ID NO: 4048411 - RNA, 17 nt, Respiratory syncytial virus
agauggcaaaagacaca

SEQ ID NO: 4048412 - RNA, 14 nt, Respiratory syncytial virus
agcauaucaaacau

SEQ ID NO: 4048413 - RNA, 22 nt, Respiratory syncytial virus
agcauaugcugaacaacucaaa

SEQ ID NO: 4048414 - RNA, 14 nt, Respiratory syncytial virus
agccacaaagucaa

SEQ ID NO: 4048415 - RNA, 22 nt, Respiratory syncytial virus
agccuacaaagcacacucccau

SEQ ID NO: 4048416 - RNA, 17 nt, Respiratory syncytial virus
agcuauucauaugaaga

SEQ ID NO: 4048417 - RNA, 17 nt, Respiratory syncytial virus
aaugggaaagaaaugaa

SEQ ID NO: 4048418 - RNA, 20 nt, Respiratory syncytial virus
aaugucaacauacuagugaa

SEQ ID NO: 4048419 - RNA, 17 nt, Respiratory syncytial virus
aauguccuaaaaaauga

SEQ ID NO: 4048420 - RNA, 18 nt, Respiratory syncytial virus
aaugucuuagaaaaagac

SEQ ID NO: 4048421 - RNA, 15 nt, Respiratory syncytial virus
aauuaaauucuccaa

SEQ ID NO: 4048422 - RNA, 13 nt, Respiratory syncytial virus
aauucaaaaaugc

SEQ ID NO: 4048423 - RNA, 11 nt, Respiratory syncytial virus
aauugaacaac

SEQ ID NO: 4048424 - RNA, 13 nt, Respiratory syncytial virus
acaaagaaaccau

SEQ ID NO: 4048425 - RNA, 14 nt, Respiratory syncytial virus
acaacaauaaucuc

SEQ ID NO: 4048426 - RNA, 21 nt, Respiratory syncytial virus
acaacaucuagguauuacuga

SEQ ID NO: 4048427 - RNA, 19 nt, Respiratory syncytial virus
acaacucaaagaaaauggu

SEQ ID NO: 4048428 - RNA, 16 nt, Respiratory syncytial virus
acaagagucacacaau

SEQ ID NO: 4048429 - RNA, 21 nt, Respiratory syncytial virus
acaaguaugaucucaauccau

SEQ ID NO: 4048430 - RNA, 21 nt, Respiratory syncytial virus
acaaguuaaaucuuaaaucua

SEQ ID NO: 4048431 - RNA, 19 nt, Respiratory syncytial virus
acaauauauauauuagugu

SEQ ID NO: 4048432 - RNA, 16 nt, Respiratory syncytial virus
acaccaccaaaacaaa

SEQ ID NO: 4048433 - RNA, 16 nt, Respiratory syncytial virus
acacuguauucaauua

SEQ ID NO: 4048434 - RNA, 15 nt, Respiratory syncytial virus
acagcuucuaugaag

SEQ ID NO: 4048435 - RNA, 19 nt, Respiratory syncytial virus
acagucaagaccaaaaaca

SEQ ID NO: 4048436 - RNA, 20 nt, Respiratory syncytial virus
acauacuagugaaacaaaua

SEQ ID NO: 4048437 - RNA, 16 nt, Respiratory syncytial virus
acaucaaaaaaaguca

SEQ ID NO: 4048438 - RNA, 23 nt, Respiratory syncytial virus
acaucagugaguugauucauaca

SEQ ID NO: 4048439 - RNA, 16 nt, Respiratory syncytial virus
acauguccaaaaacaa

SEQ ID NO: 4048440 - RNA, 17 nt, Respiratory syncytial virus
acauguccaaaaacaag

SEQ ID NO: 4048441 - RNA, 14 nt, Respiratory syncytial virus
accaaacaucuaua

SEQ ID NO: 4048442 - RNA, 22 nt, Respiratory syncytial virus
accaagcccacaaaaaaaccaa

SEQ ID NO: 4048443 - RNA, 20 nt, Respiratory syncytial virus
accacacuccauaguucaaa

SEQ ID NO: 4048444 - RNA, 13 nt, Respiratory syncytial virus
acccaacaaauga

SEQ ID NO: 4048445 - RNA, 20 nt, Respiratory syncytial virus
acccuccacucaaccuccuc

SEQ ID NO: 4048446 - RNA, 22 nt, Respiratory syncytial virus
accucuuuacaaaaccacauca

SEQ ID NO: 4048447 - RNA, 22 nt, Respiratory syncytial virus
accuggaaagaaaaccaccacc

SEQ ID NO: 4048448 - RNA, 14 nt, Respiratory syncytial virus
accuguaagcacuu

SEQ ID NO: 4048449 - RNA, 15 nt, Respiratory syncytial virus
acgauuugcaaucaa

SEQ ID NO: 4048450 - RNA, 18 nt, Respiratory syncytial virus
acuacaguuaaagaucuc

SEQ ID NO: 4048451 - RNA, 17 nt, Respiratory syncytial virus
acuauuaacucaaacaa

SEQ ID NO: 4048452 - RNA, 17 nt, Respiratory syncytial virus
acucaagaagugcagug

SEQ ID NO: 4048453 - RNA, 19 nt, Respiratory syncytial virus
acucaggaaugaggaaagu

SEQ ID NO: 4048454 - RNA, 15 nt, Respiratory syncytial virus
acucuacaaaacaaa

SEQ ID NO: 4048455 - RNA, 22 nt, Respiratory syncytial virus
acugaugauauauacacaauau

SEQ ID NO: 4048456 - RNA, 14 nt, Respiratory syncytial virus
acuguauucaauua

SEQ ID NO: 4048457 - RNA, 22 nt, Respiratory syncytial virus
acuucaugcauaaccacacucc

SEQ ID NO: 4048458 - RNA, 18 nt, Respiratory syncytial virus
agaaaacuugaugaaaga

SEQ ID NO: 4048459 - RNA, 21 nt, Respiratory syncytial virus
agaaacauuugauaacaauga

SEQ ID NO: 4048460 - RNA, 20 nt, Respiratory syncytial virus
agaauaccaaacaaaaaacc

SEQ ID NO: 4048461 - RNA, 12 nt, Respiratory syncytial virus
agacaaacgaua

SEQ ID NO: 4048462 - RNA, 17 nt, Respiratory syncytial virus
agacauaagaugaaaga

SEQ ID NO: 4048463 - RNA, 12 nt, Respiratory syncytial virus
agacuaacaaua

SEQ ID NO: 4048464 - RNA, 22 nt, Respiratory syncytial virus
agacuugauugaugcaauucaa

SEQ ID NO: 4048465 - RNA, 19 nt, Respiratory syncytial virus
agagaagacaugauagaaa

SEQ ID NO: 4048466 - RNA, 17 nt, Respiratory syncytial virus
agaggcuaucaaacauc

SEQ ID NO: 4048467 - RNA, 14 nt, Respiratory syncytial virus
agaguuccaacaaa

SEQ ID NO: 4048468 - RNA, 22 nt, Respiratory syncytial virus
agauaguaucauaucugucaac

SEQ ID NO: 4048469 - RNA, 14 nt, Respiratory syncytial virus
agcaacaauccaac

SEQ ID NO: 4048470 - RNA, 12 nt, Respiratory syncytial virus
agcacaaaucac

SEQ ID NO: 4048471 - RNA, 21 nt, Respiratory syncytial virus
agcacuaaauacaaaaaauau

SEQ ID NO: 4048472 - RNA, 22 nt, Respiratory syncytial virus
agcacuuauauguuaacaaaua

SEQ ID NO: 4048473 - RNA, 13 nt, Respiratory syncytial virus
agcagaagaacua

SEQ ID NO: 4048474 - RNA, 21 nt, Respiratory syncytial virus
agcagauuuacuuauaaaaga

SEQ ID NO: 4048475 - RNA, 22 nt, Respiratory syncytial virus
agccacccggaaaaaauagaua

SEQ ID NO: 4048476 - RNA, 13 nt, Respiratory syncytial virus
agccaucauccau

SEQ ID NO: 4048477 - RNA, 17 nt, Respiratory syncytial virus
agccaugaccaaaucaa

SEQ ID NO: 4048478 - RNA, 16 nt, Respiratory syncytial virus
agcccacaaaaaaacc

SEQ ID NO: 4048479 - RNA, 18 nt, Respiratory syncytial virus
agcccaccacaaaacaac

SEQ ID NO: 4048480 - RNA, 22 nt, Respiratory syncytial virus
agcccuauaacaucaaauucaa

SEQ ID NO: 4048481 - RNA, 21 nt, Respiratory syncytial virus
aggaaauccaacuaaucacaa

SEQ ID NO: 4048482 - RNA, 21 nt, Respiratory syncytial virus
aggggaagugaacaaaaucaa

SEQ ID NO: 4048483 - RNA, 15 nt, Respiratory syncytial virus
aguaaccuugcauuu

SEQ ID NO: 4048484 - RNA, 17 nt, Respiratory syncytial virus
agucaaguugaaugaua

SEQ ID NO: 4048485 - RNA, 21 nt, Respiratory syncytial virus
agucacacaaucugaaauaac

SEQ ID NO: 4048486 - RNA, 15 nt, Respiratory syncytial virus
agucucuauguaaaa

SEQ ID NO: 4048487 - RNA, 16 nt, Respiratory syncytial virus
agugaaauacuaggaa

SEQ ID NO: 4048488 - RNA, 12 nt, Respiratory syncytial virus
agugaauuauua

SEQ ID NO: 4048489 - RNA, 22 nt, Respiratory syncytial virus
agugucauaacacucaauccua

SEQ ID NO: 4048490 - RNA, 20 nt, Respiratory syncytial virus
agugucuuaaccagcaaagu

SEQ ID NO: 4048491 - RNA, 13 nt, Respiratory syncytial virus
aguucaaauggag

SEQ ID NO: 4048492 - RNA, 23 nt, Respiratory syncytial virus
aguuguuaccuauugugaacaag

SEQ ID NO: 4048493 - RNA, 15 nt, Respiratory syncytial virus
aguuugcuccugaau

SEQ ID NO: 4048494 - RNA, 18 nt, Respiratory syncytial virus
auaaaaaucuuauauuaa

SEQ ID NO: 4048495 - RNA, 18 nt, Respiratory syncytial virus
auaaacccaacaaaugag

SEQ ID NO: 4048496 - RNA, 18 nt, Respiratory syncytial virus
auaaagggcaaauucaca

SEQ ID NO: 4048497 - RNA, 15 nt, Respiratory syncytial virus
auaacaaugaacuaa

SEQ ID NO: 4048498 - RNA, 15 nt, Respiratory syncytial virus
auacacucaacaaua

SEQ ID NO: 4048499 - RNA, 19 nt, Respiratory syncytial virus
auacauagcauucaccaau

SEQ ID NO: 4048500 - RNA, 17 nt, Respiratory syncytial virus
auacauccauaacaaua

SEQ ID NO: 4048501 - RNA, 13 nt, Respiratory syncytial virus
auacauuuaacua

SEQ ID NO: 4048502 - RNA, 17 nt, Respiratory syncytial virus
auacgccaaucagccaa

SEQ ID NO: 4048503 - RNA, 21 nt, Respiratory syncytial virus
auacucaccgaaucaaccauu

SEQ ID NO: 4048504 - RNA, 14 nt, Respiratory syncytial virus
auagcuacacacua

SEQ ID NO: 4048505 - RNA, 18 nt, Respiratory syncytial virus
auaugggaaaugauggaa

SEQ ID NO: 4048506 - RNA, 23 nt, Respiratory syncytial virus
aucaaaaaacugagggacaauga

SEQ ID NO: 4048507 - RNA, 17 nt, Respiratory syncytial virus
aucagugucagaaauaa

SEQ ID NO: 4048508 - RNA, 14 nt, Respiratory syncytial virus
aucauauauugaaa

SEQ ID NO: 4048509 - RNA, 19 nt, Respiratory syncytial virus
aucaucgugcuuauacaag

SEQ ID NO: 4048510 - RNA, 22 nt, Respiratory syncytial virus
aucaugauggguucuuagaaug

SEQ ID NO: 4048511 - RNA, 19 nt, Respiratory syncytial virus
auccaucuguuaaaaagau

SEQ ID NO: 4048512 - RNA, 17 nt, Respiratory syncytial virus
aucccaagaaaaaagau

SEQ ID NO: 4048513 - RNA, 13 nt, Respiratory syncytial virus
auccuacaaaaaa

SEQ ID NO: 4048514 - RNA, 18 nt, Respiratory syncytial virus
aucucaccaugcaagcca

SEQ ID NO: 4048515 - RNA, 15 nt, Respiratory syncytial virus
aucuuauauuaaaaa

SEQ ID NO: 4048516 - RNA, 18 nt, Respiratory syncytial virus
augaaauuugaaguguua

SEQ ID NO: 4048517 - RNA, 22 nt, Respiratory syncytial virus
augauacuguagggaacaagcc

SEQ ID NO: 4048518 - RNA, 12 nt, Respiratory syncytial virus
augauauauaca

SEQ ID NO: 4048519 - RNA, 16 nt, Respiratory syncytial virus
cuuauauuaaaaauuc

SEQ ID NO: 4048520 - RNA, 17 nt, Respiratory syncytial virus
cuugauugaugcaauuc

SEQ ID NO: 4048521 - RNA, 14 nt, Respiratory syncytial virus
cuugcugcagucac

SEQ ID NO: 4048522 - RNA, 14 nt, Respiratory syncytial virus
gaaagauggggcaa

SEQ ID NO: 4048523 - RNA, 20 nt, Respiratory syncytial virus
gaaagauggggcaaauacaa

SEQ ID NO: 4048524 - RNA, 22 nt, Respiratory syncytial virus
gaaauccaacuaaucacaauau

SEQ ID NO: 4048525 - RNA, 17 nt, Respiratory syncytial virus
gaaauucaaaucaacau

SEQ ID NO: 4048526 - RNA, 18 nt, Respiratory syncytial virus
gaacacacuugaaaauau

SEQ ID NO: 4048527 - RNA, 19 nt, Respiratory syncytial virus
gaacacauuaaauaaaagc

SEQ ID NO: 4048528 - RNA, 16 nt, Respiratory syncytial virus
gaagcacuaaauacaa

SEQ ID NO: 4048529 - RNA, 17 nt, Respiratory syncytial virus
gaaguagcauuguuaaa

SEQ ID NO: 4048530 - RNA, 21 nt, Respiratory syncytial virus
gaaucgaguauuuugugacac

SEQ ID NO: 4048531 - RNA, 16 nt, Respiratory syncytial virus
gacaaacgauaauaua

SEQ ID NO: 4048532 - RNA, 16 nt, Respiratory syncytial virus
gaccaacaaacaaacc

SEQ ID NO: 4048533 - RNA, 19 nt, Respiratory syncytial virus
gaccucguuagaacagauu

SEQ ID NO: 4048534 - RNA, 22 nt, Respiratory syncytial virus
gacugaugaucacagacaugag

SEQ ID NO: 4048535 - RNA, 17 nt, Respiratory syncytial virus
gacuugauugaugcaau

SEQ ID NO: 4048536 - RNA, 21 nt, Respiratory syncytial virus
gagaaaacuugaugaaagaca

SEQ ID NO: 4048537 - RNA, 15 nt, Respiratory syncytial virus
gauaacaaugaagaa

SEQ ID NO: 4048538 - RNA, 16 nt, Respiratory syncytial virus
gauaacaaugaagaag

SEQ ID NO: 4048539 - RNA, 20 nt, Respiratory syncytial virus
gauauagaaguaaccaaaga

SEQ ID NO: 4048540 - RNA, 17 nt, Respiratory syncytial virus
gaucuaguacucaaaua

SEQ ID NO: 4048541 - RNA, 13 nt, Respiratory syncytial virus
gcaaaccacaaag

SEQ ID NO: 4048542 - RNA, 22 nt, Respiratory syncytial virus
gcauguuauuacaaguagugau

SEQ ID NO: 4048543 - RNA, 17 nt, Respiratory syncytial virus
gcauuaagccuacaaag

SEQ ID NO: 4048544 - RNA, 16 nt, Respiratory syncytial virus
gccaguguuacaaaau

SEQ ID NO: 4048545 - RNA, 17 nt, Respiratory syncytial virus
gcuacacacuaacacug

SEQ ID NO: 4048546 - RNA, 20 nt, Respiratory syncytial virus
ggaugauaauauuauguaua

SEQ ID NO: 4048547 - RNA, 14 nt, Respiratory syncytial virus
ggcaaauaaaucaa

SEQ ID NO: 4048548 - RNA, 18 nt, Respiratory syncytial virus
ggggcaaaugcaaacaug

SEQ ID NO: 4048549 - RNA, 16 nt, Respiratory syncytial virus
guauuacugaugauau

SEQ ID NO: 4048550 - RNA, 17 nt, Respiratory syncytial virus
gugcuagcacaaaugcc

SEQ ID NO: 4048551 - RNA, 23 nt, Respiratory syncytial virus
guuaauagguauguuauaugcua

SEQ ID NO: 4048552 - RNA, 20 nt, Respiratory syncytial virus
guuaccaaucuguacaucaa

SEQ ID NO: 4048553 - RNA, 14 nt, Respiratory syncytial virus
guucaacuaaucaa

SEQ ID NO: 4048554 - RNA, 21 nt, Respiratory syncytial virus
uaaaaaaaauggggcaaauaa

SEQ ID NO: 4048555 - RNA, 13 nt, Respiratory syncytial virus
uaaagaucucacu

SEQ ID NO: 4048556 - RNA, 13 nt, Respiratory syncytial virus
uaaauuccauacu

SEQ ID NO: 4048557 - RNA, 14 nt, Respiratory syncytial virus
uaacaacugaaauu

SEQ ID NO: 4048558 - RNA, 12 nt, Respiratory syncytial virus
uaaccacacucc

SEQ ID NO: 4048559 - RNA, 19 nt, Respiratory syncytial virus
uaacguuggggcaaaugca

SEQ ID NO: 4048560 - RNA, 22 nt, Respiratory syncytial virus
uaauaauguccuaaaaaaugaa

SEQ ID NO: 4048561 - RNA, 20 nt, Respiratory syncytial virus
uacacaugauaacaacaaua

SEQ ID NO: 4048562 - RNA, 18 nt, Respiratory syncytial virus
uacuagcuucaacaacac

SEQ ID NO: 4048563 - RNA, 20 nt, Respiratory syncytial virus
uagaaacauuugauaacaau

SEQ ID NO: 4048564 - RNA, 14 nt, Respiratory syncytial virus
uagcaaaucaaugu

SEQ ID NO: 4048565 - RNA, 16 nt, Respiratory syncytial virus
uagcuacacacuaaca

SEQ ID NO: 4048566 - RNA, 18 nt, Respiratory syncytial virus
uagcuacacacuaacacu

SEQ ID NO: 4048567 - RNA, 23 nt, Respiratory syncytial virus
uagcuacacacuaacacuguauu

SEQ ID NO: 4048568 - RNA, 15 nt, Respiratory syncytial virus
uaguauuaggcaaug

SEQ ID NO: 4048569 - RNA, 15 nt, Respiratory syncytial virus
uagucauaauuauuu

SEQ ID NO: 4048570 - RNA, 13 nt, Respiratory syncytial virus
uauaacaaccacu

SEQ ID NO: 4048571 - RNA, 16 nt, Respiratory syncytial virus
uauaauaauaucacua

SEQ ID NO: 4048572 - RNA, 19 nt, Respiratory syncytial virus
uauagaaguaaccaaagaa

SEQ ID NO: 4048573 - RNA, 24 nt, Respiratory syncytial virus
uauaugaugcugcaaaagcauaug

SEQ ID NO: 4048574 - RNA, 16 nt, Respiratory syncytial virus
uaugaaaacacucaac

SEQ ID NO: 4048575 - RNA, 22 nt, Respiratory syncytial virus
uaugccaauauuuaucaaucau

SEQ ID NO: 4048576 - RNA, 13 nt, Respiratory syncytial virus
uauggauaaaagc

SEQ ID NO: 4048577 - RNA, 14 nt, Respiratory syncytial virus
uauguuauaugcua

SEQ ID NO: 4048578 - RNA, 16 nt, Respiratory syncytial virus
uauuaauggaaauucu

SEQ ID NO: 4048579 - RNA, 19 nt, Respiratory syncytial virus
uauuauguuacaacaaauu

SEQ ID NO: 4048580 - RNA, 16 nt, Respiratory syncytial virus
uauucauaugaagaaa

SEQ ID NO: 4048581 - RNA, 15 nt, Respiratory syncytial virus
uauugcacaaagugg

SEQ ID NO: 4048582 - RNA, 13 nt, Respiratory syncytial virus
uauuucaaucaaa

SEQ ID NO: 4048583 - RNA, 20 nt, Respiratory syncytial virus
uauuuguaaaaaaugagaac

SEQ ID NO: 4048584 - RNA, 12 nt, Respiratory syncytial virus
ucaaaacaacac

SEQ ID NO: 4048585 - RNA, 20 nt, Respiratory syncytial virus
ucaaaacaucacugaagaau

SEQ ID NO: 4048586 - RNA, 22 nt, Respiratory syncytial virus
ucaaaacuauacaaagaaacca

SEQ ID NO: 4048587 - RNA, 13 nt, Respiratory syncytial virus
ucaaaccacaaaa

SEQ ID NO: 4048588 - RNA, 21 nt, Respiratory syncytial virus
ucaaacuauuaacucaaacaa

SEQ ID NO: 4048589 - RNA, 23 nt, Respiratory syncytial virus
ucaaagucuaugcuauauugaau

SEQ ID NO: 4048590 - RNA, 18 nt, Respiratory syncytial virus
ucaaauggaguuaguguc

SEQ ID NO: 4048591 - RNA, 19 nt, Respiratory syncytial virus
ucaacaaagaucaacuucu

SEQ ID NO: 4048592 - RNA, 23 nt, Respiratory syncytial virus
ucaacacaagagucacacaaucu

SEQ ID NO: 4048593 - RNA, 15 nt, Respiratory syncytial virus
ucaacuguuagugau

SEQ ID NO: 4048594 - RNA, 17 nt, Respiratory syncytial virus
ucaagauauuaauggga

SEQ ID NO: 4048595 - RNA, 15 nt, Respiratory syncytial virus
ucaagcuuaacaacu

SEQ ID NO: 4048596 - RNA, 11 nt, Respiratory syncytial virus
ucaauacauag

SEQ ID NO: 4048597 - RNA, 15 nt, Respiratory syncytial virus
ucaaugucacuaaca

SEQ ID NO: 4048598 - RNA, 18 nt, Respiratory syncytial virus
ucacacaaucugaaauaa

SEQ ID NO: 4048599 - RNA, 16 nt, Respiratory syncytial virus
ucaccaacccucugug

SEQ ID NO: 4048600 - RNA, 20 nt, Respiratory syncytial virus
ucaccucuuuacaaaaccac

SEQ ID NO: 4048601 - RNA, 18 nt, Respiratory syncytial virus
ucagagaaauugaacaac

SEQ ID NO: 4048602 - RNA, 18 nt, Respiratory syncytial virus
ucagaucuaguacucaaa

SEQ ID NO: 4048603 - RNA, 22 nt, Respiratory syncytial virus
ucagugaguugauucauacaaa

SEQ ID NO: 4048604 - RNA, 21 nt, Respiratory syncytial virus
ucaugauugcaauacugaaca

SEQ ID NO: 4048605 - RNA, 22 nt, Respiratory syncytial virus
ucaugcuauggcaaaacuaaau

SEQ ID NO: 4048606 - RNA, 18 nt, Respiratory syncytial virus
ucauguaaaagcaaaugg

SEQ ID NO: 4048607 - RNA, 18 nt, Respiratory syncytial virus
ucauuguucaucagaucu

SEQ ID NO: 4048608 - RNA, 17 nt, Respiratory syncytial virus
uccaacacaacaaacca

SEQ ID NO: 4048609 - RNA, 22 nt, Respiratory syncytial virus
uccauaguucaaauggagccug

SEQ ID NO: 4048610 - RNA, 15 nt, Respiratory syncytial virus
uccaugccagcagau

SEQ ID NO: 4048611 - RNA, 18 nt, Respiratory syncytial virus
ucuacuauccacaaacaa

SEQ ID NO: 4048612 - RNA, 19 nt, Respiratory syncytial virus
ucuaugacccauuaguguu

SEQ ID NO: 4048613 - RNA, 13 nt, Respiratory syncytial virus
ucucaauccauga

SEQ ID NO: 4048614 - RNA, 23 nt, Respiratory syncytial virus
ucuuaaaucuauagcacaaauca

SEQ ID NO: 4048615 - RNA, 15 nt, Respiratory syncytial virus
ucuuuacaaaaccac

SEQ ID NO: 4048616 - RNA, 19 nt, Respiratory syncytial virus
ugaaagauggggcaaauac

SEQ ID NO: 4048617 - RNA, 22 nt, Respiratory syncytial virus
ugaaauccaauuucacaacaau

SEQ ID NO: 4048618 - RNA, 23 nt, Respiratory syncytial virus
ugaagaauuuuaucaaacaacau

SEQ ID NO: 4048619 - RNA, 15 nt, Respiratory syncytial virus
ugaugcaauucaaaa

SEQ ID NO: 4048620 - RNA, 13 nt, Respiratory syncytial virus
ugcagaaacacau

SEQ ID NO: 4048621 - RNA, 11 nt, Respiratory syncytial virus
ugccaucacaa

SEQ ID NO: 4048622 - RNA, 15 nt, Respiratory syncytial virus
ugcuagcacaaaugc

SEQ ID NO: 4048623 - RNA, 19 nt, Respiratory syncytial virus
ugcucuacuauccacaaac

SEQ ID NO: 4048624 - RNA, 15 nt, Respiratory syncytial virus
uggcuaaggcaguga

SEQ ID NO: 4048625 - RNA, 19 nt, Respiratory syncytial virus
uggggcaaauaaaacauca

SEQ ID NO: 4048626 - RNA, 19 nt, Respiratory syncytial virus
uggucaacuaugaaaugaa

SEQ ID NO: 4048627 - RNA, 17 nt, Respiratory syncytial virus
ugucauccagcaaauac

SEQ ID NO: 4048628 - RNA, 18 nt, Respiratory syncytial virus
uguuaacauugucaagcu

SEQ ID NO: 4048629 - RNA, 18 nt, Respiratory syncytial virus
uuagauaaauauaaaagu

SEQ ID NO: 4048630 - RNA, 18 nt, Respiratory syncytial virus
uuaucaaagaaaaccucu

SEQ ID NO: 4048631 - RNA, 10 nt, Respiratory syncytial virus
uucaacaaug

SEQ ID NO: 4048632 - RNA, 21 nt, Respiratory syncytial virus
uucaacacaagagucacacaa

SEQ ID NO: 4048633 - RNA, 21 nt, Respiratory syncytial virus
uucaacuuuguaccuugcagc

SEQ ID NO: 4048634 - RNA, 18 nt, Respiratory syncytial virus
uuccauggagaagaugca

SEQ ID NO: 4048635 - RNA, 19 nt, Respiratory syncytial virus
uucuuacaaugguuucaua

SEQ ID NO: 4048636 - RNA, 18 nt, Respiratory syncytial virus
uugauugaugcaauucaa

SEQ ID NO: 4048637 - RNA, 18 nt, Respiratory syncytial virus
uuuauauguauauuaacu

SEQ ID NO: 4048638 - RNA, 22 nt, Respiratory syncytial virus
uuugaacacauuaaauaaaagc

SEQ ID NO: 4048639 - RNA, 15 nt, Respiratory syncytial virus
uuuuaauaacuuuua

SEQ ID NO: 4048640 - RNA, 17 nt, Respiratory syncytial virus
aaaaagucauaauacca

SEQ ID NO: 4048641 - RNA, 14 nt, Respiratory syncytial virus
aaaagaauaccaaa

SEQ ID NO: 4048642 - RNA, 19 nt, Respiratory syncytial virus
aaaaucagaacugaagcau

SEQ ID NO: 4048643 - RNA, 14 nt, Respiratory syncytial virus
aaaccacaaaguca

SEQ ID NO: 4048644 - RNA, 14 nt, Respiratory syncytial virus
aaagccaaccauca

SEQ ID NO: 4048645 - RNA, 22 nt, Respiratory syncytial virus
aaauacaccauccaacggagca

SEQ ID NO: 4048646 - RNA, 23 nt, Respiratory syncytial virus
aaauacauaaagccacaaaguca

SEQ ID NO: 4048647 - RNA, 23 nt, Respiratory syncytial virus
aaauaucaacuagcaaaucaaug

SEQ ID NO: 4048648 - RNA, 15 nt, Respiratory syncytial virus
aaauauggaaacaua

SEQ ID NO: 4048649 - RNA, 12 nt, Respiratory syncytial virus
aaaucaacauug

SEQ ID NO: 4048650 - RNA, 19 nt, Respiratory syncytial virus
aaauccuacaaaaaaaugc

SEQ ID NO: 4048651 - RNA, 19 nt, Respiratory syncytial virus
aaaucuauagcacaaauca

SEQ ID NO: 4048652 - RNA, 22 nt, Respiratory syncytial virus
aaaugagacagaugauacugua

SEQ ID NO: 4048653 - RNA, 21 nt, Respiratory syncytial virus
aaauggcucuuagcaaaguca

SEQ ID NO: 4048654 - RNA, 16 nt, Respiratory syncytial virus
aaauuccauacuaaua

SEQ ID NO: 4048655 - RNA, 22 nt, Respiratory syncytial virus
aaauucccauagcuacacacua

SEQ ID NO: 4048656 - RNA, 17 nt, Respiratory syncytial virus
aacaacugaaauucaaa

SEQ ID NO: 4048657 - RNA, 22 nt, Respiratory syncytial virus
aacacacuauauuucaaucaaa

SEQ ID NO: 4048658 - RNA, 13 nt, Respiratory syncytial virus
aacagcaagauua

SEQ ID NO: 4048659 - RNA, 15 nt, Respiratory syncytial virus
aacaggaaaaacaau

SEQ ID NO: 4048660 - RNA, 16 nt, Respiratory syncytial virus
aacauacgugaacaaa

SEQ ID NO: 4048661 - RNA, 22 nt, Respiratory syncytial virus
aacaucagagaaauugaacaac

SEQ ID NO: 4048662 - RNA, 19 nt, Respiratory syncytial virus
aacaucagcuuaauccaaa

SEQ ID NO: 4048663 - RNA, 19 nt, Respiratory syncytial virus
aaccaucaagacaaccaaa

SEQ ID NO: 4048664 - RNA, 18 nt, Respiratory syncytial virus
aaccaucaauaacccaaa

SEQ ID NO: 4048665 - RNA, 13 nt, Respiratory syncytial virus
aacucaaagaaaa

SEQ ID NO: 4048666 - RNA, 14 nt, Respiratory syncytial virus
aagaccaacaaaca

SEQ ID NO: 4048667 - RNA, 18 nt, Respiratory syncytial virus
aagaucugaacacacuug

SEQ ID NO: 4048668 - RNA, 20 nt, Respiratory syncytial virus
aagaugcaaacaacagagcu

SEQ ID NO: 4048669 - RNA, 15 nt, Respiratory syncytial virus
aagcacacagcuaca

SEQ ID NO: 4048670 - RNA, 16 nt, Respiratory syncytial virus
aagcacuaaauacaaa

SEQ ID NO: 4048671 - RNA, 17 nt, Respiratory syncytial virus
aaggggaagugaacaaa

SEQ ID NO: 4048672 - RNA, 17 nt, Respiratory syncytial virus
aaguaguuaauuaaaaa

SEQ ID NO: 4048673 - RNA, 13 nt, Respiratory syncytial virus
aagugauguuacg

SEQ ID NO: 4048674 - RNA, 18 nt, Respiratory syncytial virus
aaguuaauguccaacaau

SEQ ID NO: 4048675 - RNA, 12 nt, Respiratory syncytial virus
aauaaccaaauu

SEQ ID NO: 4048676 - RNA, 22 nt, Respiratory syncytial virus
aauacaaaaaauauacugaaua

SEQ ID NO: 4048677 - RNA, 13 nt, Respiratory syncytial virus
aauacaaaaaugg

SEQ ID NO: 4048678 - RNA, 23 nt, Respiratory syncytial virus
aauauccacauggggcaaauaau

SEQ ID NO: 4048679 - RNA, 22 nt, Respiratory syncytial virus
aauauuguuaucauuaauugcc

SEQ ID NO: 4048680 - RNA, 12 nt, Respiratory syncytial virus
aaucaaaacaac

SEQ ID NO: 4048681 - RNA, 22 nt, Respiratory syncytial virus
aaucaaugucacuaacaccauu

SEQ ID NO: 4048682 - RNA, 14 nt, Respiratory syncytial virus
aaucuuauauuaaa

SEQ ID NO: 4048683 - RNA, 23 nt, Respiratory syncytial virus
aaugaaacuauugcacaaagugg

SEQ ID NO: 4048684 - RNA, 23 nt, Respiratory syncytial virus
ugacaacaaaggagcauucaaau

SEQ ID NO: 4048685 - RNA, 14 nt, Respiratory syncytial virus
ugauaaaucaugaa

SEQ ID NO: 4048686 - RNA, 20 nt, Respiratory syncytial virus
ugaucuaggaggaauaaauu

SEQ ID NO: 4048687 - RNA, 16 nt, Respiratory syncytial virus
ugaugcaauucaaaau

SEQ ID NO: 4048688 - RNA, 20 nt, Respiratory syncytial virus
ugaugugcagaaacacauca

SEQ ID NO: 4048689 - RNA, 18 nt, Respiratory syncytial virus
ugcauguuauuacaagua

SEQ ID NO: 4048690 - RNA, 18 nt, Respiratory syncytial virus
ugcauuuaguaacuaaau

SEQ ID NO: 4048691 - RNA, 19 nt, Respiratory syncytial virus
ugccaauauuuaucaauca

SEQ ID NO: 4048692 - RNA, 23 nt, Respiratory syncytial virus
ugccaauccucaaaacaaaugca

SEQ ID NO: 4048693 - RNA, 16 nt, Respiratory syncytial virus
ugccaucacaaaugca

SEQ ID NO: 4048694 - RNA, 13 nt, Respiratory syncytial virus
ugcuagcacaaau

SEQ ID NO: 4048695 - RNA, 23 nt, Respiratory syncytial virus
uggaaacauacgugaacaaacuu

SEQ ID NO: 4048696 - RNA, 21 nt, Respiratory syncytial virus
uggaaauucugcuaaugugua

SEQ ID NO: 4048697 - RNA, 21 nt, Respiratory syncytial virus
uggagaagaugcaaacaacag

SEQ ID NO: 4048698 - RNA, 23 nt, Respiratory syncytial virus
uggcaaugauaaucucaacuuca

SEQ ID NO: 4048699 - RNA, 19 nt, Respiratory syncytial virus
uggcauuguauuugugcau

SEQ ID NO: 4048700 - RNA, 20 nt, Respiratory syncytial virus
uggcuaaggcagugauacau

SEQ ID NO: 4048701 - RNA, 20 nt, Respiratory syncytial virus
uguaccuugcagcauaugca

SEQ ID NO: 4048702 - RNA, 12 nt, Respiratory syncytial virus
uguauucaauua

SEQ ID NO: 4048703 - RNA, 12 nt, Respiratory syncytial virus
uguccaacaaug

SEQ ID NO: 4048704 - RNA, 18 nt, Respiratory syncytial virus
uuaaaaauucccauagcu

SEQ ID NO: 4048705 - RNA, 22 nt, Respiratory syncytial virus
uuaaauucuccaaaaaacuaag

SEQ ID NO: 4048706 - RNA, 18 nt, Respiratory syncytial virus
uuaacucaaacaauucaa

SEQ ID NO: 4048707 - RNA, 20 nt, Respiratory syncytial virus
uuaagucuauggauaaaagc

SEQ ID NO: 4048708 - RNA, 16 nt, Respiratory syncytial virus
uuaaucacagaagaug

SEQ ID NO: 4048709 - RNA, 20 nt, Respiratory syncytial virus
uuaccagggaauuuaguguu

SEQ ID NO: 4048710 - RNA, 24 nt, Respiratory syncytial virus
uuauauuaaaaauucccauagcua

SEQ ID NO: 4048711 - RNA, 12 nt, Respiratory syncytial virus
uucacaacaaug

SEQ ID NO: 4048712 - RNA, 13 nt, Respiratory syncytial virus
uucaccaucauaa

SEQ ID NO: 4048713 - RNA, 13 nt, Respiratory syncytial virus
uuccauacuaaua

SEQ ID NO: 4048714 - RNA, 16 nt, Respiratory syncytial virus
uucccauagcuacaca

SEQ ID NO: 4048715 - RNA, 18 nt, Respiratory syncytial virus
uuccuagaaucaauaaag

SEQ ID NO: 4048716 - RNA, 17 nt, Respiratory syncytial virus
uucuacauaauaaaaga

SEQ ID NO: 4048717 - RNA, 18 nt, Respiratory syncytial virus
uugccaauccucaaaaca

SEQ ID NO: 4048718 - RNA, 13 nt, Respiratory syncytial virus
uugucaagcuuaa

SEQ ID NO: 4048719 - RNA, 16 nt, Respiratory syncytial virus
uuguuugacaaugaug

SEQ ID NO: 4048720 - RNA, 17 nt, Respiratory syncytial virus
uuucaaaacuauacaaa

SEQ ID NO: 4048721 - RNA, 16 nt, Respiratory syncytial virus
uuugcccuaauaauaa

SEQ ID NO: 4048722 - RNA, 15 nt, Respiratory syncytial virus
uuuguuugacaauga

SEQ ID NO: 4048723 - RNA, 13 nt, Respiratory syncytial virus
ucugucaacucaa

SEQ ID NO: 4048724 - RNA, 15 nt, Respiratory syncytial virus
ucuuagcaaagucaa

SEQ ID NO: 4048725 - RNA, 18 nt, Respiratory syncytial virus
ugaaaauauaacaaccac

SEQ ID NO: 4048726 - RNA, 20 nt, Respiratory syncytial virus
ugaaauaaaaauagaagaac

SEQ ID NO: 4048727 - RNA, 13 nt, Respiratory syncytial virus
ugaaauaacaacu

SEQ ID NO: 4048728 - RNA, 16 nt, Respiratory syncytial virus
ugaaauaacaacuuca

SEQ ID NO: 4048729 - RNA, 17 nt, Respiratory syncytial virus
ugaacaacccucaccuc

SEQ ID NO: 4048730 - RNA, 13 nt, Respiratory syncytial virus
ugaagaaaaccau

SEQ ID NO: 4048731 - RNA, 15 nt, Respiratory syncytial virus
ugaauuugaaaauau

SEQ ID NO: 4048732 - RNA, 21 nt, Respiratory syncytial virus
ugauacauacaaucaaauuga

SEQ ID NO: 4048733 - RNA, 16 nt, Respiratory syncytial virus
ugauagaaaaaaucag

SEQ ID NO: 4048734 - RNA, 16 nt, Respiratory syncytial virus
ugaugaucacagacau

SEQ ID NO: 4048735 - RNA, 12 nt, Respiratory syncytial virus
ugcaaaaaucau

SEQ ID NO: 4048736 - RNA, 15 nt, Respiratory syncytial virus
ugcaagcagaaaugg

SEQ ID NO: 4048737 - RNA, 19 nt, Respiratory syncytial virus
ugcauuggcuaaggcagug

SEQ ID NO: 4048738 - RNA, 23 nt, Respiratory syncytial virus
ugccagcagacguauugaagaaa

SEQ ID NO: 4048739 - RNA, 15 nt, Respiratory syncytial virus
ugccaucacaaaugc

SEQ ID NO: 4048740 - RNA, 13 nt, Respiratory syncytial virus
ugcuaaucauaaa

SEQ ID NO: 4048741 - RNA, 19 nt, Respiratory syncytial virus
ugcuaaucauaaauucacu

SEQ ID NO: 4048742 - RNA, 15 nt, Respiratory syncytial virus
uggaaagaaaaccac

SEQ ID NO: 4048743 - RNA, 18 nt, Respiratory syncytial virus
uggaaauucugcuaaugu

SEQ ID NO: 4048744 - RNA, 13 nt, Respiratory syncytial virus
uggacacaacaca

SEQ ID NO: 4048745 - RNA, 18 nt, Respiratory syncytial virus
uggagaagaugcaaacaa

SEQ ID NO: 4048746 - RNA, 11 nt, Respiratory syncytial virus
uggagccugaa

SEQ ID NO: 4048747 - RNA, 17 nt, Respiratory syncytial virus
uggauguaacaacacau

SEQ ID NO: 4048748 - RNA, 14 nt, Respiratory syncytial virus
uggauuuucuuaaa

SEQ ID NO: 4048749 - RNA, 17 nt, Respiratory syncytial virus
uggcacuuuuccuaugc

SEQ ID NO: 4048750 - RNA, 23 nt, Respiratory syncytial virus
uggcauuguauuugugcauguua

SEQ ID NO: 4048751 - RNA, 17 nt, Respiratory syncytial virus
ugggcagcaauucauug

SEQ ID NO: 4048752 - RNA, 21 nt, Respiratory syncytial virus
uggguuaauagguauguuaua

SEQ ID NO: 4048753 - RNA, 20 nt, Respiratory syncytial virus
uguagucagcuuaucaaaug

SEQ ID NO: 4048754 - RNA, 15 nt, Respiratory syncytial virus
ugucacuaacaccau

SEQ ID NO: 4048755 - RNA, 13 nt, Respiratory syncytial virus
uguuacaacaaau

SEQ ID NO: 4048756 - RNA, 23 nt, Respiratory syncytial virus
uguuggaucugcaaucgccagug

SEQ ID NO: 4048757 - RNA, 17 nt, Respiratory syncytial virus
gaagagaagacaccaua

SEQ ID NO: 4048758 - RNA, 11 nt, Respiratory syncytial virus
gaauguaaugc

SEQ ID NO: 4048759 - RNA, 16 nt, Respiratory syncytial virus
gaauuaacacacugcu

SEQ ID NO: 4048760 - RNA, 13 nt, Respiratory syncytial virus
gacaauugugaaa

SEQ ID NO: 4048761 - RNA, 14 nt, Respiratory syncytial virus
gacaucaaaaaacu

SEQ ID NO: 4048762 - RNA, 20 nt, Respiratory syncytial virus
gagagacauaagaugaaaga

SEQ ID NO: 4048763 - RNA, 13 nt, Respiratory syncytial virus
gagcuaccaaauu

SEQ ID NO: 4048764 - RNA, 21 nt, Respiratory syncytial virus
gagcuaccaaauuccuagaau

SEQ ID NO: 4048765 - RNA, 18 nt, Respiratory syncytial virus
gaguuacuauguauaauc

SEQ ID NO: 4048766 - RNA, 17 nt, Respiratory syncytial virus
gauggcaauccaagccc

SEQ ID NO: 4048767 - RNA, 15 nt, Respiratory syncytial virus
gauggcacaaaacag

SEQ ID NO: 4048768 - RNA, 14 nt, Respiratory syncytial virus
gcaaauaacaaugg

SEQ ID NO: 4048769 - RNA, 17 nt, Respiratory syncytial virus
gcaagcccaccacaaaa

SEQ ID NO: 4048770 - RNA, 19 nt, Respiratory syncytial virus
gcacaaagugggaagcacu

SEQ ID NO: 4048771 - RNA, 16 nt, Respiratory syncytial virus
gcacaaaucacauuau

SEQ ID NO: 4048772 - RNA, 15 nt, Respiratory syncytial virus
gcaccuaaucauguu

SEQ ID NO: 4048773 - RNA, 16 nt, Respiratory syncytial virus
gcacuaaauacaaaaa

SEQ ID NO: 4048774 - RNA, 18 nt, Respiratory syncytial virus
gcauuaguaauaaccaaa

SEQ ID NO: 4048775 - RNA, 13 nt, Respiratory syncytial virus
gccaaaacaaacc

SEQ ID NO: 4048776 - RNA, 13 nt, Respiratory syncytial virus
gccaguguuacaa

SEQ ID NO: 4048777 - RNA, 17 nt, Respiratory syncytial virus
gccucagaucaucccaa

SEQ ID NO: 4048778 - RNA, 24 nt, Respiratory syncytial virus
gcuaaucauaaucuccaucaugau

SEQ ID NO: 4048779 - RNA, 17 nt, Respiratory syncytial virus
gcuauucauaugaagaa

SEQ ID NO: 4048780 - RNA, 17 nt, Respiratory syncytial virus
gcugaacaacucaaaga

SEQ ID NO: 4048781 - RNA, 17 nt, Respiratory syncytial virus
gcuuaacaacugaaauu

SEQ ID NO: 4048782 - RNA, 15 nt, Respiratory syncytial virus
ggagccugaaaauua

SEQ ID NO: 4048783 - RNA, 11 nt, Respiratory syncytial virus
ggcaaaugcaa

SEQ ID NO: 4048784 - RNA, 15 nt, Respiratory syncytial virus
ggcuaaggcagugau

SEQ ID NO: 4048785 - RNA, 12 nt, Respiratory syncytial virus
ggggcaaauaaa

SEQ ID NO: 4048786 - RNA, 13 nt, Respiratory syncytial virus
gguacugugacaa

SEQ ID NO: 4048787 - RNA, 19 nt, Respiratory syncytial virus
gguucuacauaauaaaaga

SEQ ID NO: 4048788 - RNA, 12 nt, Respiratory syncytial virus
guaaaagcaaau

SEQ ID NO: 4048789 - RNA, 19 nt, Respiratory syncytial virus
augguugguuuaagagaag

SEQ ID NO: 4048790 - RNA, 22 nt, Respiratory syncytial virus
auguaacaacacaucgucaaga

SEQ ID NO: 4048791 - RNA, 16 nt, Respiratory syncytial virus
augugaauuugaaaau

SEQ ID NO: 4048792 - RNA, 16 nt, Respiratory syncytial virus
augugcagaaacacau

SEQ ID NO: 4048793 - RNA, 15 nt, Respiratory syncytial virus
auguggcauguuauu

SEQ ID NO: 4048794 - RNA, 18 nt, Respiratory syncytial virus
auuaaacaacauauuaac

SEQ ID NO: 4048795 - RNA, 17 nt, Respiratory syncytial virus
auuaaauccaacaaugg

SEQ ID NO: 4048796 - RNA, 21 nt, Respiratory syncytial virus
auuaagccuacaaagcacacu

SEQ ID NO: 4048797 - RNA, 20 nt, Respiratory syncytial virus
auuaaggagagacauaagau

SEQ ID NO: 4048798 - RNA, 15 nt, Respiratory syncytial virus
auuaccgcaauccuu

SEQ ID NO: 4048799 - RNA, 15 nt, Respiratory syncytial virus
auuauguaucaaaua

SEQ ID NO: 4048800 - RNA, 15 nt, Respiratory syncytial virus
auugaagaaaaccau

SEQ ID NO: 4048801 - RNA, 23 nt, Respiratory syncytial virus
auugcuuuaugugaauuugaaaa

SEQ ID NO: 4048802 - RNA, 19 nt, Respiratory syncytial virus
auuuuagucauaauuauuu

SEQ ID NO: 4048803 - RNA, 12 nt, Respiratory syncytial virus
caaaaaaaccaa

SEQ ID NO: 4048804 - RNA, 16 nt, Respiratory syncytial virus
caaaaauaaugauacu

SEQ ID NO: 4048805 - RNA, 16 nt, Respiratory syncytial virus
caaaagaacacacuau

SEQ ID NO: 4048806 - RNA, 16 nt, Respiratory syncytial virus
caaaauuaaacaacau

SEQ ID NO: 4048807 - RNA, 21 nt, Respiratory syncytial virus
caaaauuuucuacaacaucua

SEQ ID NO: 4048808 - RNA, 13 nt, Respiratory syncytial virus
caaagaugauaua

SEQ ID NO: 4048809 - RNA, 22 nt, Respiratory syncytial virus
caaaggaaguaccuaccaccaa

SEQ ID NO: 4048810 - RNA, 16 nt, Respiratory syncytial virus
caaagucacacuaaca

SEQ ID NO: 4048811 - RNA, 17 nt, Respiratory syncytial virus
caaauaaaucaauucag

SEQ ID NO: 4048812 - RNA, 18 nt, Respiratory syncytial virus
caaaugcaaaaaucaucc

SEQ ID NO: 4048813 - RNA, 13 nt, Respiratory syncytial virus
caaauggagccug

SEQ ID NO: 4048814 - RNA, 15 nt, Respiratory syncytial virus
caaauggagccugaa

SEQ ID NO: 4048815 - RNA, 14 nt, Respiratory syncytial virus
caacaauccaaccu

SEQ ID NO: 4048816 - RNA, 13 nt, Respiratory syncytial virus
caggcaaaaucaa

SEQ ID NO: 4048817 - RNA, 18 nt, Respiratory syncytial virus
cagugauacauacaauca

SEQ ID NO: 4048818 - RNA, 21 nt, Respiratory syncytial virus
cauacaagaugcaacaagcca

SEQ ID NO: 4048819 - RNA, 14 nt, Respiratory syncytial virus
cauaguucaaaugg

SEQ ID NO: 4048820 - RNA, 22 nt, Respiratory syncytial virus
cauaucaucgugcuuauacaag

SEQ ID NO: 4048821 - RNA, 18 nt, Respiratory syncytial virus
cauccaaccaaacaucua

SEQ ID NO: 4048822 - RNA, 18 nt, Respiratory syncytial virus
caucucacuuacauuauu

SEQ ID NO: 4048823 - RNA, 16 nt, Respiratory syncytial virus
caucuggagccucaga

SEQ ID NO: 4048824 - RNA, 18 nt, Respiratory syncytial virus
caugaauuucaacacaag

SEQ ID NO: 4048825 - RNA, 16 nt, Respiratory syncytial virus
caugcagugcagucag

SEQ ID NO: 4048826 - RNA, 11 nt, Respiratory syncytial virus
ccaaacaaaaa

SEQ ID NO: 4048827 - RNA, 15 nt, Respiratory syncytial virus
ccaacaaaugagaca

SEQ ID NO: 4048828 - RNA, 12 nt, Respiratory syncytial virus
ccaacacaugac

SEQ ID NO: 4048829 - RNA, 19 nt, Respiratory syncytial virus
ccaacagaagaccaacaaa

SEQ ID NO: 4048830 - RNA, 14 nt, Respiratory syncytial virus
ccaacgcaccacca

SEQ ID NO: 4048831 - RNA, 15 nt, Respiratory syncytial virus
ccaauccaaaacuag

SEQ ID NO: 4048832 - RNA, 20 nt, Respiratory syncytial virus
ccaaucugauggcacaaaac

SEQ ID NO: 4048833 - RNA, 18 nt, Respiratory syncytial virus
ccaauuaucaaagaaaac

SEQ ID NO: 4048834 - RNA, 16 nt, Respiratory syncytial virus
ccaccaagcccacaaa

SEQ ID NO: 4048835 - RNA, 23 nt, Respiratory syncytial virus
ccagagacaucauaacacacaga

SEQ ID NO: 4048836 - RNA, 14 nt, Respiratory syncytial virus
ccaggcaaaaucaa

SEQ ID NO: 4048837 - RNA, 20 nt, Respiratory syncytial virus
ccaguggcauugcuguaucu

SEQ ID NO: 4048838 - RNA, 17 nt, Respiratory syncytial virus
ccaucacaaaugcaaaa

SEQ ID NO: 4048839 - RNA, 16 nt, Respiratory syncytial virus
ccaucuggagccucag

SEQ ID NO: 4048840 - RNA, 16 nt, Respiratory syncytial virus
ccauggacacaacaca

SEQ ID NO: 4048841 - RNA, 16 nt, Respiratory syncytial virus
ccuaagauccaucagu

SEQ ID NO: 4048842 - RNA, 17 nt, Respiratory syncytial virus
ccucaaaacaaaugcaa

SEQ ID NO: 4048843 - RNA, 15 nt, Respiratory syncytial virus
cgauaguuauuuaaa

SEQ ID NO: 4048844 - RNA, 14 nt, Respiratory syncytial virus
cuaauacacaugau

SEQ ID NO: 4048845 - RNA, 20 nt, Respiratory syncytial virus
cuaaucauaaucuccaucau

SEQ ID NO: 4048846 - RNA, 16 nt, Respiratory syncytial virus
cuaauggccuaauaga

SEQ ID NO: 4048847 - RNA, 16 nt, Respiratory syncytial virus
cuaccaccaagcccac

SEQ ID NO: 4048848 - RNA, 20 nt, Respiratory syncytial virus
cuagaggcuaucaaacauca

SEQ ID NO: 4048849 - RNA, 17 nt, Respiratory syncytial virus
cuagcaaaucaauguca

SEQ ID NO: 4048850 - RNA, 18 nt, Respiratory syncytial virus
cuaguaaguuucaaagaa

SEQ ID NO: 4048851 - RNA, 12 nt, Respiratory syncytial virus
cuauacaaagaa

SEQ ID NO: 4048852 - RNA, 20 nt, Respiratory syncytial virus
cucaaaccacaaaaccaaag

SEQ ID NO: 4048853 - RNA, 22 nt, Respiratory syncytial virus
cucaacagugaugacaucaaaa

SEQ ID NO: 4048854 - RNA, 16 nt, Respiratory syncytial virus
cucaauccaugaauuu

SEQ ID NO: 4048855 - RNA, 22 nt, Respiratory syncytial virus
cuccauaguucaaauggagccu

SEQ ID NO: 4048856 - RNA, 14 nt, Respiratory syncytial virus
cucggcaaaccaca

SEQ ID NO: 4048857 - RNA, 19 nt, Respiratory syncytial virus
cucucaucuauaaaccauc

SEQ ID NO: 4048858 - RNA, 13 nt, Respiratory syncytial virus
cucuuagcaaagu

SEQ ID NO: 4048859 - RNA, 16 nt, Respiratory syncytial virus
cugaaacuacaucaca

SEQ ID NO: 4048860 - RNA, 23 nt, Respiratory syncytial virus
cugaaauaacaacuucaugcaua

SEQ ID NO: 4048861 - RNA, 13 nt, Respiratory syncytial virus
cugacaaauuaau

SEQ ID NO: 4048862 - RNA, 21 nt, Respiratory syncytial virus
cuggucaacuaugaaaugaaa

SEQ ID NO: 4048863 - RNA, 19 nt, Respiratory syncytial virus
cuguagggaacaagcccaa

SEQ ID NO: 4048864 - RNA, 18 nt, Respiratory syncytial virus
cuuauauguuaacaaaua

SEQ ID NO: 4048865 - RNA, 13 nt, Respiratory syncytial virus
cuucaccaucaua

SEQ ID NO: 4048866 - RNA, 21 nt, Respiratory syncytial virus
cuucaccaucauaaucaccaa

SEQ ID NO: 4048867 - RNA, 13 nt, Respiratory syncytial virus
cuucacuucacca

SEQ ID NO: 4048868 - RNA, 21 nt, Respiratory syncytial virus
gaaacuacaucacaaaccacc

SEQ ID NO: 4048869 - RNA, 16 nt, Respiratory syncytial virus
gaaagaaaugaaauuu

SEQ ID NO: 4048870 - RNA, 14 nt, Respiratory syncytial virus
gaauacaacacaaa

SEQ ID NO: 4048871 - RNA, 21 nt, Respiratory syncytial virus
gaauuagauaaauauaaaagu

SEQ ID NO: 4048872 - RNA, 13 nt, Respiratory syncytial virus
gacacuagaaaag

SEQ ID NO: 4048873 - RNA, 18 nt, Respiratory syncytial virus
gacacucucaaucaucua

SEQ ID NO: 4048874 - RNA, 15 nt, Respiratory syncytial virus
gacauaagaugaaag

SEQ ID NO: 4048875 - RNA, 15 nt, Respiratory syncytial virus
gacaugauagaaaaa

SEQ ID NO: 4048876 - RNA, 22 nt, Respiratory syncytial virus
gacccugcaucacuuacaauau

SEQ ID NO: 4048877 - RNA, 16 nt, Respiratory syncytial virus
gagguagcuccagaau

SEQ ID NO: 4048878 - RNA, 20 nt, Respiratory syncytial virus
gagucacacaaucugaaaua

SEQ ID NO: 4048879 - RNA, 20 nt, Respiratory syncytial virus
gauaaaaauggggcaaauaa

SEQ ID NO: 4048880 - RNA, 19 nt, Respiratory syncytial virus
gauaaaaguuagauuacaa

SEQ ID NO: 4048881 - RNA, 15 nt, Respiratory syncytial virus
gauaaauauaaaagu

SEQ ID NO: 4048882 - RNA, 21 nt, Respiratory syncytial virus
gauagaaucuagaaaauccua

SEQ ID NO: 4048883 - RNA, 18 nt, Respiratory syncytial virus
gauauuaaugggaaagaa

SEQ ID NO: 4048884 - RNA, 21 nt, Respiratory syncytial virus
gaucucaaaccucaaaccaca

SEQ ID NO: 4048885 - RNA, 15 nt, Respiratory syncytial virus
gauuccuaguuuaua

SEQ ID NO: 4048886 - RNA, 13 nt, Respiratory syncytial virus
gcaaauaaaacau

SEQ ID NO: 4048887 - RNA, 13 nt, Respiratory syncytial virus
gcaaauacaaaaa

SEQ ID NO: 4048888 - RNA, 16 nt, Respiratory syncytial virus
gcaaaucaaugucacu

SEQ ID NO: 4048889 - RNA, 11 nt, Respiratory syncytial virus
gcaagcccacc

SEQ ID NO: 4048890 - RNA, 17 nt, Respiratory syncytial virus
gcaagcuggcauaugau

SEQ ID NO: 4048891 - RNA, 14 nt, Respiratory syncytial virus
gcaccuaaucaugu

SEQ ID NO: 4048892 - RNA, 13 nt, Respiratory syncytial virus
gcauaaugggaga

SEQ ID NO: 4048893 - RNA, 14 nt, Respiratory syncytial virus
gccuauaacaaaug

SEQ ID NO: 4048894 - RNA, 16 nt, Respiratory syncytial virus
gccucggcaaaccaca

SEQ ID NO: 4048895 - RNA, 17 nt, Respiratory syncytial virus
ggaaauucugcuaaugu

SEQ ID NO: 4048896 - RNA, 16 nt, Respiratory syncytial virus
ggagauaguauugaua

SEQ ID NO: 4048897 - RNA, 12 nt, Respiratory syncytial virus
ggcaaugcugcu

SEQ ID NO: 4048898 - RNA, 23 nt, Respiratory syncytial virus
guagaguuacuauguauaaucaa

SEQ ID NO: 4048899 - RNA, 13 nt, Respiratory syncytial virus
gucaacuaugaaa

SEQ ID NO: 4048900 - RNA, 23 nt, Respiratory syncytial virus
gucaagcuuaacaacugaaauuc

SEQ ID NO: 4048901 - RNA, 17 nt, Respiratory syncytial virus
gucauuguucaucagau

SEQ ID NO: 4048902 - RNA, 16 nt, Respiratory syncytial virus
guccuuggaugaaaga

SEQ ID NO: 4048903 - RNA, 16 nt, Respiratory syncytial virus
gucuauggauaaaagc

SEQ ID NO: 4048904 - RNA, 17 nt, Respiratory syncytial virus
gugcagaaacacaucaa

SEQ ID NO: 4048905 - RNA, 16 nt, Respiratory syncytial virus
gugcauguuauuacaa

SEQ ID NO: 4048906 - RNA, 15 nt, Respiratory syncytial virus
guuagauuacaaaau

SEQ ID NO: 4048907 - RNA, 23 nt, Respiratory syncytial virus
guugaaugauacacucaacaaag

SEQ ID NO: 4048908 - RNA, 22 nt, Respiratory syncytial virus
guuuaugaauuauacacucaac

SEQ ID NO: 4048909 - RNA, 17 nt, Respiratory syncytial virus
uaaauaucaacuagcaa

SEQ ID NO: 4048910 - RNA, 22 nt, Respiratory syncytial virus
uaaauucacuggguuaauaggu

SEQ ID NO: 4048911 - RNA, 19 nt, Respiratory syncytial virus
uaaguuaauaaaaauaucc

SEQ ID NO: 4048912 - RNA, 13 nt, Respiratory syncytial virus
uaauauaacagca

SEQ ID NO: 4048913 - RNA, 20 nt, Respiratory syncytial virus
uacacacuaacacuguauuc

SEQ ID NO: 4048914 - RNA, 18 nt, Respiratory syncytial virus
uacauaaagccacaaagu

SEQ ID NO: 4048915 - RNA, 16 nt, Respiratory syncytial virus
uacauagcauucacca

SEQ ID NO: 4048916 - RNA, 19 nt, Respiratory syncytial virus
uacauuuaacuaaugcauu

SEQ ID NO: 4048917 - RNA, 16 nt, Respiratory syncytial virus
uacuagcuucaacaac

SEQ ID NO: 4048918 - RNA, 18 nt, Respiratory syncytial virus
uacuagugaaacaaauau

SEQ ID NO: 4048919 - RNA, 12 nt, Respiratory syncytial virus
uacuugauaaau

SEQ ID NO: 4048920 - RNA, 14 nt, Respiratory syncytial virus
uagaggcuaucaaa

SEQ ID NO: 4048921 - RNA, 18 nt, Respiratory syncytial virus
uagcaaaucaaugucacu

SEQ ID NO: 4048922 - RNA, 20 nt, Respiratory syncytial virus
uagcuauucauaugaagaaa

SEQ ID NO: 4048923 - RNA, 13 nt, Respiratory syncytial virus
uagugaauuauua

SEQ ID NO: 4048924 - RNA, 22 nt, Respiratory syncytial virus
uaguucaaauggagccugaaaa

SEQ ID NO: 4048925 - RNA, 22 nt, Respiratory syncytial virus
uauaauaaauaucaacuagcaa

SEQ ID NO: 4048926 - RNA, 14 nt, Respiratory syncytial virus
uauaguaauuuaaa

SEQ ID NO: 4048927 - RNA, 14 nt, Respiratory syncytial virus
uauauauuaguguc

SEQ ID NO: 4048928 - RNA, 17 nt, Respiratory syncytial virus
uaugaaucaauuaucug

SEQ ID NO: 4048929 - RNA, 16 nt, Respiratory syncytial virus
uaugaucucaauccau

SEQ ID NO: 4048930 - RNA, 14 nt, Respiratory syncytial virus
uauuaaaaauuccc

SEQ ID NO: 4048931 - RNA, 16 nt, Respiratory syncytial virus
uauuaagacuaacaau

SEQ ID NO: 4048932 - RNA, 13 nt, Respiratory syncytial virus
ucaaaacaaccaa

SEQ ID NO: 4048933 - RNA, 16 nt, Respiratory syncytial virus
ucaaaccucaaaccac

SEQ ID NO: 4048934 - RNA, 14 nt, Respiratory syncytial virus
ucaacacacaacac

SEQ ID NO: 4048935 - RNA, 17 nt, Respiratory syncytial virus
ucaacuguuagugauau

SEQ ID NO: 4048936 - RNA, 22 nt, Respiratory syncytial virus
ucaagaccaaaaacacaacaac

SEQ ID NO: 4048937 - RNA, 13 nt, Respiratory syncytial virus
ucaaggaaaauaa

SEQ ID NO: 4048938 - RNA, 14 nt, Respiratory syncytial virus
ucaauccaacauca

SEQ ID NO: 4048939 - RNA, 17 nt, Respiratory syncytial virus
ucaauccaacaucagag

SEQ ID NO: 4048940 - RNA, 14 nt, Respiratory syncytial virus
ucaauccuaaugcu

SEQ ID NO: 4048941 - RNA, 18 nt, Respiratory syncytial virus
ucaaugucacuaacacca

SEQ ID NO: 4048942 - RNA, 18 nt, Respiratory syncytial virus
ucacauuauccauucugg

SEQ ID NO: 4048943 - RNA, 18 nt, Respiratory syncytial virus
ucacuaugaaaacacuca

SEQ ID NO: 4048944 - RNA, 20 nt, Respiratory syncytial virus
ucagagaaauugaacaaccu

SEQ ID NO: 4048945 - RNA, 13 nt, Respiratory syncytial virus
ucagaucauccca

SEQ ID NO: 4048946 - RNA, 11 nt, Respiratory syncytial virus
ucagugaguug

SEQ ID NO: 4048947 - RNA, 13 nt, Respiratory syncytial virus
ucauaucugcuca

SEQ ID NO: 4048948 - RNA, 18 nt, Respiratory syncytial virus
ucaucuauaaaccaucuc

SEQ ID NO: 4048949 - RNA, 13 nt, Respiratory syncytial virus
ucaugaauguaua

SEQ ID NO: 4048950 - RNA, 21 nt, Respiratory syncytial virus
uccacaagagcauaaccauca

SEQ ID NO: 4048951 - RNA, 17 nt, Respiratory syncytial virus
ucccauagcuacacacu

SEQ ID NO: 4048952 - RNA, 20 nt, Respiratory syncytial virus
uccugcaccuagaaggggaa

SEQ ID NO: 4048953 - RNA, 14 nt, Respiratory syncytial virus
ucuauaaaccaucu

SEQ ID NO: 4048954 - RNA, 22 nt, Respiratory syncytial virus
ucugaaacuacaucacaaacca

SEQ ID NO: 4048955 - RNA, 14 nt, Respiratory syncytial virus
ucuucacuucacca

SEQ ID NO: 4048956 - RNA, 19 nt, Respiratory syncytial virus
ugaaaauauaguaacauca

SEQ ID NO: 4048957 - RNA, 21 nt, Respiratory syncytial virus
ugaaacuacaucacaaaccac

SEQ ID NO: 4048958 - RNA, 14 nt, Respiratory syncytial virus
ugaaaucaaggcau

SEQ ID NO: 4048959 - RNA, 14 nt, Respiratory syncytial virus
ugaacuaauccuaa

SEQ ID NO: 4048960 - RNA, 19 nt, Respiratory syncytial virus
ugaacucaacagugaugac

SEQ ID NO: 4048961 - RNA, 23 nt, Respiratory syncytial virus
ugaaugauacacucaacaaagau

SEQ ID NO: 4048962 - RNA, 16 nt, Respiratory syncytial virus
ugacaauugugaaauu

SEQ ID NO: 4048963 - RNA, 14 nt, Respiratory syncytial virus
ugacaccacaccac

SEQ ID NO: 4048964 - RNA, 13 nt, Respiratory syncytial virus
ugauaacaacaau

SEQ ID NO: 4048965 - RNA, 17 nt, Respiratory syncytial virus
ugauaacaaugaagaag

SEQ ID NO: 4048966 - RNA, 22 nt, Respiratory syncytial virus
ugauaaguaccacuuaaauuua

SEQ ID NO: 4048967 - RNA, 20 nt, Respiratory syncytial virus
ugauacacucaacaaagauc

SEQ ID NO: 4048968 - RNA, 22 nt, Respiratory syncytial virus
ugauacauacaaucaaauugaa

SEQ ID NO: 4048969 - RNA, 16 nt, Respiratory syncytial virus
ugcaauacugaacaaa

SEQ ID NO: 4048970 - RNA, 13 nt, Respiratory syncytial virus
ugcagcaacaauc

SEQ ID NO: 4048971 - RNA, 20 nt, Respiratory syncytial virus
ugcauuuguaagugaacaac

SEQ ID NO: 4048972 - RNA, 22 nt, Respiratory syncytial virus
uggaaaauacauccauaacaau

SEQ ID NO: 4048973 - RNA, 11 nt, Respiratory syncytial virus
uggagccucag

SEQ ID NO: 4048974 - RNA, 15 nt, Respiratory syncytial virus
uggauguaacaacac

SEQ ID NO: 4048975 - RNA, 16 nt, Respiratory syncytial virus
uggauguaacaacaca

SEQ ID NO: 4048976 - RNA, 20 nt, Respiratory syncytial virus
uggcauuguauuugugcaug

SEQ ID NO: 4048977 - RNA, 19 nt, Respiratory syncytial virus
uguagaguuacuauguaua

SEQ ID NO: 4048978 - RNA, 14 nt, Respiratory syncytial virus
uguuauuacaagua

SEQ ID NO: 4048979 - RNA, 20 nt, Respiratory syncytial virus
uguuauuacaaguagugaua

SEQ ID NO: 4048980 - RNA, 19 nt, Respiratory syncytial virus
uuaaaaucugaacuucauc

SEQ ID NO: 4048981 - RNA, 22 nt, Respiratory syncytial virus
uuaacaacugaaauucaaauca

SEQ ID NO: 4048982 - RNA, 15 nt, Respiratory syncytial virus
uuauuaaucacagaa

SEQ ID NO: 4048983 - RNA, 13 nt, Respiratory syncytial virus
uucaaugaaaucc

SEQ ID NO: 4048984 - RNA, 16 nt, Respiratory syncytial virus
uucacaucaccuaaag

SEQ ID NO: 4048985 - RNA, 16 nt, Respiratory syncytial virus
uucauugaguaugaua

SEQ ID NO: 4048986 - RNA, 15 nt, Respiratory syncytial virus
uugauagacaaucau

SEQ ID NO: 4048987 - RNA, 15 nt, Respiratory syncytial virus
uugaucuaggaggaa

SEQ ID NO: 4048988 - RNA, 22 nt, Respiratory syncytial virus
uugcaaaaagccaugaccaaau

SEQ ID NO: 4048989 - RNA, 23 nt, Respiratory syncytial virus
uuggcuaaggcagugauacauac

SEQ ID NO: 4048990 - RNA, 11 nt, Respiratory syncytial virus
uuuaauaacuu

SEQ ID NO: 4048991 - RNA, 21 nt, Respiratory syncytial virus
uuucaaucaaaacaaccaaaa

SEQ ID NO: 4048992 - RNA, 22 nt, Respiratory syncytial virus
uuuuaauaacuuuuagugaacu

SEQ ID NO: 4048993 - RNA, 22 nt, Respiratory syncytial virus
uuuucaaaacuauacaaagaaa

SEQ ID NO: 4048994 - RNA, 20 nt, Reston Ebola virus (REBOV)
aaaauauuacugaugaaauu

SEQ ID NO: 4048995 - RNA, 17 nt, Reston Ebola virus (REBOV)
aauagcaaaguuaaauu

SEQ ID NO: 4048996 - RNA, 16 nt, Reston Ebola virus (REBOV)
agaucauuccaaacuu

SEQ ID NO: 4048997 - RNA, 15 nt, Reston Ebola virus (REBOV)
agcaauauucugaau

SEQ ID NO: 4048998 - RNA, 17 nt, Reston Ebola virus (REBOV)
aggaaacaaaagcgauc

SEQ ID NO: 4048999 - RNA, 24 nt, Reston Ebola virus (REBOV)
aggaaccagcccaggaagcgcagc

SEQ ID NO: 4049000 - RNA, 19 nt, Reston Ebola virus (REBOV)
aggguuacucuaaggagaa

SEQ ID NO: 4049001 - RNA, 14 nt, Reston Ebola virus (REBOV)
agugauaauguaaa

SEQ ID NO: 4049002 - RNA, 19 nt, Reston Ebola virus (REBOV)
aguuaagaucaaaugcaaa

SEQ ID NO: 4049003 - RNA, 21 nt, Reston Ebola virus (REBOV)
auagacuaaaaaucugauugu

SEQ ID NO: 4049004 - RNA, 21 nt, Reston Ebola virus (REBOV)
auccuaguauuuauuagaaug

SEQ ID NO: 4049005 - RNA, 14 nt, Reston Ebola virus (REBOV)
caaguaaucaugau

SEQ ID NO: 4049006 - RNA, 22 nt, Reston Ebola virus (REBOV)
ccacgccagcacccacaacauc

SEQ ID NO: 4049007 - RNA, 15 nt, Reston Ebola virus (REBOV)
cccaggcucuucaau

SEQ ID NO: 4049008 - RNA, 18 nt, Reston Ebola virus (REBOV)
cugaaaaugcuaagaaga

SEQ ID NO: 4049009 - RNA, 18 nt, Reston Ebola virus (REBOV)
cugaggaagauuaagaaa

SEQ ID NO: 4049010 - RNA, 13 nt, Reston Ebola virus (REBOV)
cugagucccacca

SEQ ID NO: 4049011 - RNA, 20 nt, Reston Ebola virus (REBOV)
cugauuguauagaauuauaa

SEQ ID NO: 4049012 - RNA, 15 nt, Reston Ebola virus (REBOV)
cuuaaaauaaguaca

SEQ ID NO: 4049013 - RNA, 16 nt, Reston Ebola virus (REBOV)
cuucaguuaaguaaca

SEQ ID NO: 4049014 - RNA, 15 nt, Reston Ebola virus (REBOV)
gagcccacagaccaa

SEQ ID NO: 4049015 - RNA, 21 nt, Reston Ebola virus (REBOV)
gauccaaggcucgaacaacuc

SEQ ID NO: 4049016 - RNA, 23 nt, Reston Ebola virus (REBOV)
gauucacugagucccaccaggaa

SEQ ID NO: 4049017 - RNA, 22 nt, Reston Ebola virus (REBOV)
gauuguauagaauuauaaaaga

SEQ ID NO: 4049018 - RNA, 14 nt, Reston Ebola virus (REBOV)
gcaauuaauaauau

SEQ ID NO: 4049019 - RNA, 12 nt, Reston Ebola virus (REBOV)
guuuuucugcuu

SEQ ID NO: 4049020 - RNA, 21 nt, Reston Ebola virus (REBOV)
uagcucuuugaauuggaagau

SEQ ID NO: 4049021 - RNA, 17 nt, Reston Ebola virus (REBOV)
uaugauauuucucuuaa

SEQ ID NO: 4049022 - RNA, 13 nt, Reston Ebola virus (REBOV)
aaaugauaaugau

SEQ ID NO: 4049023 - RNA, 15 nt, Reston Ebola virus (REBOV)
aaauguaacccagau

SEQ ID NO: 4049024 - RNA, 16 nt, Reston Ebola virus (REBOV)
aagcgagguugauaac

SEQ ID NO: 4049025 - RNA, 22 nt, Reston Ebola virus (REBOV)
aauuuaauuaaacuucaaagug

SEQ ID NO: 4049026 - RNA, 22 nt, Reston Ebola virus (REBOV)
acaacuccgcccagagcccaca

SEQ ID NO: 4049027 - RNA, 22 nt, Reston Ebola virus (REBOV)
acaauguaccaagugaacagcc

SEQ ID NO: 4049028 - RNA, 13 nt, Reston Ebola virus (REBOV)
acagcagcaaacc

SEQ ID NO: 4049029 - RNA, 15 nt, Reston Ebola virus (REBOV)
acauuauaagaaugu

SEQ ID NO: 4049030 - RNA, 18 nt, Reston Ebola virus (REBOV)
accaggaaccagcccagg

SEQ ID NO: 4049031 - RNA, 20 nt, Reston Ebola virus (REBOV)
accaggaaccagcccaggaa

SEQ ID NO: 4049032 - RNA, 20 nt, Reston Ebola virus (REBOV)
agacuugaccgauucaucua

SEQ ID NO: 4049033 - RNA, 19 nt, Reston Ebola virus (REBOV)
agccgaacaacacagcauc

SEQ ID NO: 4049034 - RNA, 17 nt, Reston Ebola virus (REBOV)
aggcaagccacaaccuu

SEQ ID NO: 4049035 - RNA, 19 nt, Reston Ebola virus (REBOV)
agucaaaaauaaugucaau

SEQ ID NO: 4049036 - RNA, 17 nt, Reston Ebola virus (REBOV)
auccccgaugacccagg

SEQ ID NO: 4049037 - RNA, 15 nt, Reston Ebola virus (REBOV)
auuaauuaugcauuu

SEQ ID NO: 4049038 - RNA, 22 nt, Reston Ebola virus (REBOV)
cagucuugaguaauaaucauuu

SEQ ID NO: 4049039 - RNA, 19 nt, Reston Ebola virus (REBOV)
caguuccuaucuuuaaaua

SEQ ID NO: 4049040 - RNA, 17 nt, Reston Ebola virus (REBOV)
cauuuaguaauaaugau

SEQ ID NO: 4049041 - RNA, 14 nt, Reston Ebola virus (REBOV)
ccaucggcaagcaa

SEQ ID NO: 4049042 - RNA, 21 nt, Reston Ebola virus (REBOV)
cuagcuuuaguaguuaagauc

SEQ ID NO: 4049043 - RNA, 14 nt, Reston Ebola virus (REBOV)
cuuuaaauaaugau

SEQ ID NO: 4049044 - RNA, 15 nt, Reston Ebola virus (REBOV)
gaauaagauaaugau

SEQ ID NO: 4049045 - RNA, 15 nt, Reston Ebola virus (REBOV)
gaguuuuuuaaucua

SEQ ID NO: 4049046 - RNA, 15 nt, Reston Ebola virus (REBOV)
gaugacccaggaccc

SEQ ID NO: 4049047 - RNA, 15 nt, Reston Ebola virus (REBOV)
gcagcaaaccaggaa

SEQ ID NO: 4049048 - RNA, 18 nt, Reston Ebola virus (REBOV)
gcuaguaauuuuaaucuc

SEQ ID NO: 4049049 - RNA, 19 nt, Reston Ebola virus (REBOV)
guaauaugagugauaaugu

SEQ ID NO: 4049050 - RNA, 21 nt, Reston Ebola virus (REBOV)
uaacauagacugaaaaugcua

SEQ ID NO: 4049051 - RNA, 12 nt, Reston Ebola virus (REBOV)
uacugaugaaau

SEQ ID NO: 4049052 - RNA, 14 nt, Reston Ebola virus (REBOV)
uagacugaaaaugc

SEQ ID NO: 4049053 - RNA, 16 nt, Reston Ebola virus (REBOV)
uagacugaaaaugcua

SEQ ID NO: 4049054 - RNA, 12 nt, Reston Ebola virus (REBOV)
uaugaauugugc

SEQ ID NO: 4049055 - RNA, 20 nt, Reston Ebola virus (REBOV)
uccaaggcucgaacaacucc

SEQ ID NO: 4049056 - RNA, 20 nt, Reston Ebola virus (REBOV)
ucgagcuauuauucugcuag

SEQ ID NO: 4049057 - RNA, 20 nt, Reston Ebola virus (REBOV)
ucucaggguuacucuaagga

SEQ ID NO: 4049058 - RNA, 14 nt, Reston Ebola virus (REBOV)
ucuucaguuaagua

SEQ ID NO: 4049059 - RNA, 16 nt, Reston Ebola virus (REBOV)
ugcauaaucagaaugg

SEQ ID NO: 4049060 - RNA, 17 nt, Reston Ebola virus (REBOV)
uucggaccugcagcaga

SEQ ID NO: 4049061 - RNA, 22 nt, Reston Ebola virus (REBOV)
aaauauaacaagugaugaagau

SEQ ID NO: 4049062 - RNA, 22 nt, Reston Ebola virus (REBOV)
aacuauugacgcuguugaugau

SEQ ID NO: 4049063 - RNA, 20 nt, Reston Ebola virus (REBOV)
aaguaagguagcugauucac

SEQ ID NO: 4049064 - RNA, 15 nt, Reston Ebola virus (REBOV)
acaugacuugaaugu

SEQ ID NO: 4049065 - RNA, 14 nt, Reston Ebola virus (REBOV)
acauuauaagaaug

SEQ ID NO: 4049066 - RNA, 15 nt, Reston Ebola virus (REBOV)
accaagugaacagcc

SEQ ID NO: 4049067 - RNA, 14 nt, Reston Ebola virus (REBOV)
accaggaaccagcc

SEQ ID NO: 4049068 - RNA, 17 nt, Reston Ebola virus (REBOV)
acccaaugacaaccacc

SEQ ID NO: 4049069 - RNA, 22 nt, Reston Ebola virus (REBOV)
aguccaaccaugacaagcgagg

SEQ ID NO: 4049070 - RNA, 16 nt, Reston Ebola virus (REBOV)
agugauucuuaaucua

SEQ ID NO: 4049071 - RNA, 23 nt, Reston Ebola virus (REBOV)
aucuuaaaauaaguacaugaaug

SEQ ID NO: 4049072 - RNA, 12 nt, Reston Ebola virus (REBOV)
augacccaggac

SEQ ID NO: 4049073 - RNA, 21 nt, Reston Ebola virus (REBOV)
augauuaauauauuaagaaaa

SEQ ID NO: 4049074 - RNA, 17 nt, Reston Ebola virus (REBOV)
auggcuaagauuucaau

SEQ ID NO: 4049075 - RNA, 22 nt, Reston Ebola virus (REBOV)
auuuacuugaaugcugaccacu

SEQ ID NO: 4049076 - RNA, 18 nt, Reston Ebola virus (REBOV)
auuuagaguguaugaauu

SEQ ID NO: 4049077 - RNA, 12 nt, Reston Ebola virus (REBOV)
caaaaauaaugu

SEQ ID NO: 4049078 - RNA, 19 nt, Reston Ebola virus (REBOV)
caagaccacgccagcaccc

SEQ ID NO: 4049079 - RNA, 14 nt, Reston Ebola virus (REBOV)
ccaacagcagcaaa

SEQ ID NO: 4049080 - RNA, 23 nt, Reston Ebola virus (REBOV)
gacaauggaucccggcuggaauu

SEQ ID NO: 4049081 - RNA, 12 nt, Reston Ebola virus (REBOV)
gagguauaacaa

SEQ ID NO: 4049082 - RNA, 21 nt, Reston Ebola virus (REBOV)
gauauuucucuuaauaaugau

SEQ ID NO: 4049083 - RNA, 16 nt, Reston Ebola virus (REBOV)
gauuggaguaaaagua

SEQ ID NO: 4049084 - RNA, 14 nt, Reston Ebola virus (REBOV)
gcuucuuugcuuga

SEQ ID NO: 4049085 - RNA, 14 nt, Reston Ebola virus (REBOV)
uccgauccaaggcu

SEQ ID NO: 4049086 - RNA, 14 nt, Reston Ebola virus (REBOV)
ucgggauagaacaa

SEQ ID NO: 4049087 - RNA, 18 nt, Reston Ebola virus (REBOV)
ucuauaagugauucuuaa

SEQ ID NO: 4049088 - RNA, 18 nt, Reston Ebola virus (REBOV)
ugaggaagauuaagaaaa

SEQ ID NO: 4049089 - RNA, 20 nt, Reston Ebola virus (REBOV)
uuaguaauaaugauucuuaa

SEQ ID NO: 4049090 - RNA, 15 nt, Reston Ebola virus (REBOV)
uucgagcuauuauuc

SEQ ID NO: 4049091 - RNA, 12 nt, Reston Ebola virus (REBOV)
uucuucuucaac

SEQ ID NO: 4049092 - RNA, 13 nt, Reston Ebola virus (REBOV)
uugccccaagucc

SEQ ID NO: 4049093 - RNA, 22 nt, Reston Ebola virus (REBOV)
uauuacuuauugauaagaauac

SEQ ID NO: 4049094 - RNA, 19 nt, Reston Ebola virus (REBOV)
ucaaagugauuaaaugaua

SEQ ID NO: 4049095 - RNA, 14 nt, Reston Ebola virus (REBOV)
uccgcccagagccc

SEQ ID NO: 4049096 - RNA, 15 nt, Reston Ebola virus (REBOV)
ucuauucuaaucaga

SEQ ID NO: 4049097 - RNA, 16 nt, Reston Ebola virus (REBOV)
ugaagacuccccccca

SEQ ID NO: 4049098 - RNA, 12 nt, Reston Ebola virus (REBOV)
ugcgagauuucc

SEQ ID NO: 4049099 - RNA, 21 nt, Reston Ebola virus (REBOV)
uguaacuuuauuuuaauaaca

SEQ ID NO: 4049100 - RNA, 24 nt, Reston Ebola virus (REBOV)
uguggauugacccauucugcuuaa

SEQ ID NO: 4049101 - RNA, 21 nt, Reston Ebola virus (REBOV)
uuauucugcuaguaauuccga

SEQ ID NO: 4049102 - RNA, 17 nt, Reston Ebola virus (REBOV)
uugacgcuguugaugau

SEQ ID NO: 4049103 - RNA, 20 nt, Reston Ebola virus (REBOV)
uuugaucaaguaaucaugau

SEQ ID NO: 4049104 - RNA, 10 nt, Reston Ebola virus (REBOV)
aaaccaggaa

SEQ ID NO: 4049105 - RNA, 16 nt, Reston Ebola virus (REBOV)
aacaagugaugaagau

SEQ ID NO: 4049106 - RNA, 19 nt, Reston Ebola virus (REBOV)
acagguuucaccgcgaacc

SEQ ID NO: 4049107 - RNA, 20 nt, Reston Ebola virus (REBOV)
acgccagcacccacaacauc

SEQ ID NO: 4049108 - RNA, 14 nt, Reston Ebola virus (REBOV)
agagacggccaaca

SEQ ID NO: 4049109 - RNA, 16 nt, Reston Ebola virus (REBOV)
agcaaucagaaauugg

SEQ ID NO: 4049110 - RNA, 21 nt, Reston Ebola virus (REBOV)
agguggucuuuuugaaaugga

SEQ ID NO: 4049111 - RNA, 23 nt, Reston Ebola virus (REBOV)
auaauuguuuaguaauaugagug

SEQ ID NO: 4049112 - RNA, 21 nt, Reston Ebola virus (REBOV)
augaaugagaauuaguugugg

SEQ ID NO: 4049113 - RNA, 12 nt, Reston Ebola virus (REBOV)
caagcaauauuc

SEQ ID NO: 4049114 - RNA, 14 nt, Reston Ebola virus (REBOV)
cacaacagaacuga

SEQ ID NO: 4049115 - RNA, 14 nt, Reston Ebola virus (REBOV)
ccagcccaggaagc

SEQ ID NO: 4049116 - RNA, 13 nt, Reston Ebola virus (REBOV)
cuaguaauuuuaa

SEQ ID NO: 4049117 - RNA, 23 nt, Reston Ebola virus (REBOV)
cucaggguuacucuaaggagaaa

SEQ ID NO: 4049118 - RNA, 15 nt, Reston Ebola virus (REBOV)
cuuuauuuuaauaac

SEQ ID NO: 4049119 - RNA, 23 nt, Reston Ebola virus (REBOV)
gaacuauugacgcuguugaugau

SEQ ID NO: 4049120 - RNA, 20 nt, Reston Ebola virus (REBOV)
uaacaauggcuaagauuuca

SEQ ID NO: 4049121 - RNA, 16 nt, Reston Ebola virus (REBOV)
uacucuaaggagaaau

SEQ ID NO: 4049122 - RNA, 19 nt, Reston Ebola virus (REBOV)
uagacuaaaaaucugauug

SEQ ID NO: 4049123 - RNA, 12 nt, Reston Ebola virus (REBOV)
uauccaaauguu

SEQ ID NO: 4049124 - RNA, 20 nt, Reston Ebola virus (REBOV)
uccccgaugacccaggaccc

SEQ ID NO: 4049125 - RNA, 18 nt, Reston Ebola virus (REBOV)
ugaacagccgaacaacac

SEQ ID NO: 4049126 - RNA, 16 nt, Reston Ebola virus (REBOV)
ugagucccaccaggaa

SEQ ID NO: 4049127 - RNA, 14 nt, Reston Ebola virus (REBOV)
uuaaauucuccuaa

SEQ ID NO: 4049128 - RNA, 14 nt, Reston Ebola virus (REBOV)
uuaaucuaauuuuc

SEQ ID NO: 4049129 - RNA, 20 nt, Reston Ebola virus (REBOV)
uuccauuuaguaauaaugau

SEQ ID NO: 4049130 - RNA, 20 nt, Reston Ebola virus (REBOV)
uugaugagggggcagcagua

SEQ ID NO: 4049131 - RNA, 23 nt, Reston Ebola virus (REBOV)
uugacaauccccuaccagaccac

SEQ ID NO: 4049132 - RNA, 16 nt, Reston Ebola virus [REBOV]
aacaaugccuaacuau

SEQ ID NO: 4049133 - RNA, 13 nt, Reston Ebola virus [REBOV]
aacagaaaagcua

SEQ ID NO: 4049134 - RNA, 19 nt, Reston Ebola virus [REBOV]
aacagcagcaaaccaggaa

SEQ ID NO: 4049135 - RNA, 16 nt, Reston Ebola virus [REBOV]
aacccaaugacaacca

SEQ ID NO: 4049136 - RNA, 16 nt, Reston Ebola virus [REBOV]
aagaccacgccagcac

SEQ ID NO: 4049137 - RNA, 17 nt, Reston Ebola virus [REBOV]
aagagacggccaacagc

SEQ ID NO: 4049138 - RNA, 12 nt, Reston Ebola virus [REBOV]
aagcuaaauaca

SEQ ID NO: 4049139 - RNA, 17 nt, Reston Ebola virus [REBOV]
aaguacaugaaugagaa

SEQ ID NO: 4049140 - RNA, 17 nt, Reston Ebola virus [REBOV]
aauugggauuauuggag

SEQ ID NO: 4049141 - RNA, 19 nt, Reston Ebola virus [REBOV]
aauuguuagagguaacaag

SEQ ID NO: 4049142 - RNA, 17 nt, Reston Ebola virus [REBOV]
acaauccccuaccagac

SEQ ID NO: 4049143 - RNA, 14 nt, Reston Ebola virus [REBOV]
accacgccagcacc

SEQ ID NO: 4049144 - RNA, 16 nt, Reston Ebola virus [REBOV]
acugagucccaccagg

SEQ ID NO: 4049145 - RNA, 20 nt, Reston Ebola virus [REBOV]
agagacggccaacagcagca

SEQ ID NO: 4049146 - RNA, 12 nt, Reston Ebola virus [REBOV]
agauaaauggac

SEQ ID NO: 4049147 - RNA, 22 nt, Reston Ebola virus [REBOV]
agauuuagaguguaugaauugu

SEQ ID NO: 4049148 - RNA, 14 nt, Reston Ebola virus [REBOV]
agcauccauugaag

SEQ ID NO: 4049149 - RNA, 16 nt, Reston Ebola virus [REBOV]
agcuaaauacacuuaa

SEQ ID NO: 4049150 - RNA, 14 nt, Reston Ebola virus [REBOV]
auaacaugucaaug

SEQ ID NO: 4049151 - RNA, 12 nt, Reston Ebola virus [REBOV]
aucuuuaaauaa

SEQ ID NO: 4049152 - RNA, 21 nt, Reston Ebola virus [REBOV]
augcaaacauuauaagaaugu

SEQ ID NO: 4049153 - RNA, 16 nt, Reston Ebola virus [REBOV]
augugaucuaauagau

SEQ ID NO: 4049154 - RNA, 22 nt, Reston Ebola virus [REBOV]
aaaaucugauuguauagaauua

SEQ ID NO: 4049155 - RNA, 23 nt, Reston Ebola virus [REBOV]
aaauuuacuugaaugcugaccac

SEQ ID NO: 4049156 - RNA, 19 nt, Reston Ebola virus [REBOV]
aacaacuccgcccagagcc

SEQ ID NO: 4049157 - RNA, 16 nt, Reston Ebola virus [REBOV]
aacaaucgcuaguaau

SEQ ID NO: 4049158 - RNA, 15 nt, Reston Ebola virus [REBOV]
aacacagcauccauu

SEQ ID NO: 4049159 - RNA, 13 nt, Reston Ebola virus [REBOV]
aacauagacugaa

SEQ ID NO: 4049160 - RNA, 22 nt, Reston Ebola virus [REBOV]
aacauccccgaugacccaggac

SEQ ID NO: 4049161 - RNA, 21 nt, Reston Ebola virus [REBOV]
aagagacggccaacagcagca

SEQ ID NO: 4049162 - RNA, 14 nt, Reston Ebola virus [REBOV]
aaucuaacacugaa

SEQ ID NO: 4049163 - RNA, 16 nt, Reston Ebola virus [REBOV]
aaugacaaccaccauu

SEQ ID NO: 4049164 - RNA, 18 nt, Reston Ebola virus [REBOV]
aauuggagauaaauggac

SEQ ID NO: 4049165 - RNA, 14 nt, Reston Ebola virus [REBOV]
acaaucacagguuu

SEQ ID NO: 4049166 - RNA, 20 nt, Reston Ebola virus [REBOV]
acagcagcaaaccaggaacc

SEQ ID NO: 4049167 - RNA, 16 nt, Reston Ebola virus [REBOV]
accaagucagcccgga

SEQ ID NO: 4049168 - RNA, 18 nt, Reston Ebola virus [REBOV]
accaggaaccagcccagg

SEQ ID NO: 4049169 - RNA, 18 nt, Reston Ebola virus [REBOV]
acugagucccaccaggaa

SEQ ID NO: 4049170 - RNA, 15 nt, Reston Ebola virus [REBOV]
acuuuauuuuaauaa

SEQ ID NO: 4049171 - RNA, 15 nt, Reston Ebola virus [REBOV]
agaucauuccaaacu

SEQ ID NO: 4049172 - RNA, 17 nt, Reston Ebola virus [REBOV]
agcacccacaacauccc

SEQ ID NO: 4049173 - RNA, 18 nt, Reston Ebola virus [REBOV]
agcgcagccggaccaagu

SEQ ID NO: 4049174 - RNA, 17 nt, Reston Ebola virus [REBOV]
aggaaccagcccaggaa

SEQ ID NO: 4049175 - RNA, 20 nt, Reston Ebola virus [REBOV]
aggaccaucuuguugcauug

SEQ ID NO: 4049176 - RNA, 22 nt, Reston Ebola virus [REBOV]
aggaccaucuuguugcauugag

SEQ ID NO: 4049177 - RNA, 19 nt, Reston Ebola virus [REBOV]
agguagcugauucacugag

SEQ ID NO: 4049178 - RNA, 18 nt, Reston Ebola virus [REBOV]
agguauuuugucuagagu

SEQ ID NO: 4049179 - RNA, 15 nt, Reston Ebola virus [REBOV]
auaagugauucuuaa

SEQ ID NO: 4049180 - RNA, 22 nt, Reston Ebola virus [REBOV]
auggucuuauuugaauaugaca

SEQ ID NO: 4049181 - RNA, 18 nt, Reston Ebola virus [REBOV]
aacaaucgcuaguaauuu

SEQ ID NO: 4049182 - RNA, 20 nt, Reston Ebola virus [REBOV]
aagaguuuaaguaauauaca

SEQ ID NO: 4049183 - RNA, 21 nt, Reston Ebola virus [REBOV]
acaacuccgcccagagcccac

SEQ ID NO: 4049184 - RNA, 18 nt, Reston Ebola virus [REBOV]
acagcagcaaaccaggaa

SEQ ID NO: 4049185 - RNA, 23 nt, Reston Ebola virus [REBOV]
accaccauugccccaaguccaac

SEQ ID NO: 4049186 - RNA, 13 nt, Reston Ebola virus [REBOV]
accaggaaccagc

SEQ ID NO: 4049187 - RNA, 17 nt, Reston Ebola virus [REBOV]
acggagaugaucuuaau

SEQ ID NO: 4049188 - RNA, 23 nt, Reston Ebola virus [REBOV]
acugaggacuuacucacuucuua

SEQ ID NO: 4049189 - RNA, 15 nt, Reston Ebola virus [REBOV]
acuuaucuuaaauga

SEQ ID NO: 4049190 - RNA, 20 nt, Reston Ebola virus [REBOV]
acuucaaagugauuaaauga

SEQ ID NO: 4049191 - RNA, 17 nt, Reston Ebola virus [REBOV]
agaaaagcuauugauuu

SEQ ID NO: 4049192 - RNA, 20 nt, Reston Ebola virus [REBOV]
agaguguaugaauugugcag

SEQ ID NO: 4049193 - RNA, 17 nt, Reston Ebola virus [REBOV]
agcagcaaaccaggaac

SEQ ID NO: 4049194 - RNA, 16 nt, Reston Ebola virus [REBOV]
agcccacagaccaaga

SEQ ID NO: 4049195 - RNA, 21 nt, Reston Ebola virus [REBOV]
agcuauuauucugcuaguaau

SEQ ID NO: 4049196 - RNA, 22 nt, Reston Ebola virus [REBOV]
agguggucuuuuugaaauggag

SEQ ID NO: 4049197 - RNA, 15 nt, Reston Ebola virus [REBOV]
aguaugccaaucuua

SEQ ID NO: 4049198 - RNA, 14 nt, Reston Ebola virus [REBOV]
auacuguuaagaga

SEQ ID NO: 4049199 - RNA, 19 nt, Reston Ebola virus [REBOV]
auauaauguaaauauaaca

SEQ ID NO: 4049200 - RNA, 17 nt, Reston Ebola virus [REBOV]
auaugaccucaagucaa

SEQ ID NO: 4049201 - RNA, 21 nt, Reston Ebola virus [REBOV]
auaugaccucaagucaaaaau

SEQ ID NO: 4049202 - RNA, 16 nt, Reston Ebola virus [REBOV]
auaugagugauaaugu

SEQ ID NO: 4049203 - RNA, 15 nt, Reston Ebola virus [REBOV]
auccgauccaaggcu

SEQ ID NO: 4049204 - RNA, 16 nt, Reston Ebola virus [REBOV]
aucuauggacagguug

SEQ ID NO: 4049205 - RNA, 16 nt, Reston Ebola virus [REBOV]
aucuucaguuaaguaa

SEQ ID NO: 4049206 - RNA, 18 nt, Reston Ebola virus [REBOV]
auguaaauauaacaagug

SEQ ID NO: 4049207 - RNA, 21 nt, Reston Ebola virus [REBOV]
auuaucagcauuucuuaaaug

SEQ ID NO: 4049208 - RNA, 14 nt, Reston Ebola virus [REBOV]
auugaagacucccc

SEQ ID NO: 4049209 - RNA, 23 nt, Reston Ebola virus [REBOV]
auugacaauccccuaccagacca

SEQ ID NO: 4049210 - RNA, 14 nt, Reston Ebola virus [REBOV]
auugccccaagucc

SEQ ID NO: 4049211 - RNA, 16 nt, Reston Ebola virus [REBOV]
auuuauuagaauguac

SEQ ID NO: 4049212 - RNA, 14 nt, Reston Ebola virus [REBOV]
auuucucuuaauaa

SEQ ID NO: 4049213 - RNA, 13 nt, Reston Ebola virus [REBOV]
auuugaacauagu

SEQ ID NO: 4049214 - RNA, 15 nt, Reston Ebola virus [REBOV]
caacuccgcccagag

SEQ ID NO: 4049215 - RNA, 18 nt, Reston Ebola virus [REBOV]
caaugaaacuacccaggc

SEQ ID NO: 4049216 - RNA, 17 nt, Reston Ebola virus [REBOV]
cacugagucccaccagg

SEQ ID NO: 4049217 - RNA, 21 nt, Reston Ebola virus [REBOV]
cacugagucccaccaggaaac

SEQ ID NO: 4049218 - RNA, 23 nt, Reston Ebola virus [REBOV]
cacuuuaucauagcguaacacau

SEQ ID NO: 4049219 - RNA, 22 nt, Reston Ebola virus [REBOV]
cagaacugaggacuuacucacu

SEQ ID NO: 4049220 - RNA, 17 nt, Reston Ebola virus [REBOV]
cagcagcaaaccaggaa

SEQ ID NO: 4049221 - RNA, 12 nt, Reston Ebola virus [REBOV]
caggcucuucaa

SEQ ID NO: 4049222 - RNA, 20 nt, Reston Ebola virus [REBOV]
caugacuuuauugacaaucc

SEQ ID NO: 4049223 - RNA, 14 nt, Reston Ebola virus [REBOV]
cauuuaaacaugcu

SEQ ID NO: 4049224 - RNA, 23 nt, Reston Ebola virus [REBOV]
ccaagugaacagccgaacaacac

SEQ ID NO: 4049225 - RNA, 14 nt, Reston Ebola virus [REBOV]
ccaggaaacaaaag

SEQ ID NO: 4049226 - RNA, 18 nt, Reston Ebola virus [REBOV]
cccaaguccaaccaugac

SEQ ID NO: 4049227 - RNA, 19 nt, Reston Ebola virus [REBOV]
cccacagaccaagaccacg

SEQ ID NO: 4049228 - RNA, 13 nt, Reston Ebola virus [REBOV]
ccgaugacccagg

SEQ ID NO: 4049229 - RNA, 14 nt, Reston Ebola virus [REBOV]
ccgaugacccagga

SEQ ID NO: 4049230 - RNA, 13 nt, Reston Ebola virus [REBOV]
ccuuaugcuucau

SEQ ID NO: 4049231 - RNA, 13 nt, Reston Ebola virus [REBOV]
cgaugacccagga

SEQ ID NO: 4049232 - RNA, 16 nt, Reston Ebola virus [REBOV]
cgaugacccaggaccc

SEQ ID NO: 4049233 - RNA, 15 nt, Reston Ebola virus [REBOV]
cgcaagagacggcca

SEQ ID NO: 4049234 - RNA, 16 nt, Reston Ebola virus [REBOV]
cgcccagagcccacag

SEQ ID NO: 4049235 - RNA, 17 nt, Reston Ebola virus [REBOV]
cuaaccucauauuuuga

SEQ ID NO: 4049236 - RNA, 23 nt, Reston Ebola virus [REBOV]
cuagccaaugaaacuacccaggc

SEQ ID NO: 4049237 - RNA, 17 nt, Reston Ebola virus [REBOV]
cugagucccaccaggaa

SEQ ID NO: 4049238 - RNA, 16 nt, Reston Ebola virus [REBOV]
cugcuucuuugcuuga

SEQ ID NO: 4049239 - RNA, 15 nt, Reston Ebola virus [REBOV]
gaccaagucagcccg

SEQ ID NO: 4049240 - RNA, 13 nt, Reston Ebola virus [REBOV]
gagcuucuacuau

SEQ ID NO: 4049241 - RNA, 20 nt, Reston Ebola virus [REBOV]
gaucuuaaucuauggacagg

SEQ ID NO: 4049242 - RNA, 16 nt, Reston Ebola virus [REBOV]
gaugacccaggacccg

SEQ ID NO: 4049243 - RNA, 21 nt, Reston Ebola virus [REBOV]
gcaaaccaggaaccagcccag

SEQ ID NO: 4049244 - RNA, 15 nt, Reston Ebola virus [REBOV]
gcacaagauguuaug

SEQ ID NO: 4049245 - RNA, 20 nt, Reston Ebola virus [REBOV]
gcuucauagguggucuuuuu

SEQ ID NO: 4049246 - RNA, 13 nt, Reston Ebola virus [REBOV]
ggaagauuaagaa

SEQ ID NO: 4049247 - RNA, 20 nt, Reston Ebola virus [REBOV]
ggaagcgcagccggaccaag

SEQ ID NO: 4049248 - RNA, 20 nt, Reston Ebola virus [REBOV]
ggagagacaaucacagguuu

SEQ ID NO: 4049249 - RNA, 21 nt, Reston Ebola virus [REBOV]
ggccacaacagaacugaggac

SEQ ID NO: 4049250 - RNA, 12 nt, Reston Ebola virus [REBOV]
ggcucgaacaac

SEQ ID NO: 4049251 - RNA, 18 nt, Reston Ebola virus [REBOV]
ggcuuccauuuuuacaug

SEQ ID NO: 4049252 - RNA, 16 nt, Reston Ebola virus [REBOV]
guaccaagugaacagc

SEQ ID NO: 4049253 - RNA, 21 nt, Reston Ebola virus [REBOV]
gucagcuagccaaugaaacua

SEQ ID NO: 4049254 - RNA, 14 nt, Reston Ebola virus [REBOV]
uacugaugaaauua

SEQ ID NO: 4049255 - RNA, 20 nt, Reston Ebola virus [REBOV]
uauuugaauaugacaacauc

SEQ ID NO: 4049256 - RNA, 15 nt, Reston Ebola virus [REBOV]
ucaaagugauuaaau

SEQ ID NO: 4049257 - RNA, 18 nt, Reston Ebola virus [REBOV]
uccaaggcucgaacaacu

SEQ ID NO: 4049258 - RNA, 17 nt, Reston Ebola virus [REBOV]
ucgcauuuaaacaugcu

SEQ ID NO: 4049259 - RNA, 18 nt, Reston Ebola virus [REBOV]
ugaacagccgaacaacac

SEQ ID NO: 4049260 - RNA, 14 nt, Reston Ebola virus [REBOV]
ugacccaggacccg

SEQ ID NO: 4049261 - RNA, 15 nt, Reston Ebola virus [REBOV]
ugauaacaauguacc

SEQ ID NO: 4049262 - RNA, 15 nt, Reston Ebola virus [REBOV]
ugaugaaauuaacca

SEQ ID NO: 4049263 - RNA, 15 nt, Reston Ebola virus [REBOV]
ugcauaaucagaaug

SEQ ID NO: 4049264 - RNA, 18 nt, Reston Ebola virus [REBOV]
uggagauuaucagcauuu

SEQ ID NO: 4049265 - RNA, 17 nt, Reston Ebola virus [REBOV]
uguaucacguuaaagau

SEQ ID NO: 4049266 - RNA, 21 nt, Reston Ebola virus [REBOV]
uguguugauuuauucugagau

SEQ ID NO: 4049267 - RNA, 23 nt, Reston Ebola virus [REBOV]
uguugcauugagccacaugauug

SEQ ID NO: 4049268 - RNA, 22 nt, Reston Ebola virus [REBOV]
uuaagaucaaaugcaaacauua

SEQ ID NO: 4049269 - RNA, 14 nt, Reston Ebola virus [REBOV]
uuacuugaaugcug

SEQ ID NO: 4049270 - RNA, 14 nt, Reston Ebola virus [REBOV]
uuucuuuuguaauu

SEQ ID NO: 4049271 - RNA, 20 nt, Reston Ebola virus [REBOV]
uuuuuacauguguauauaac

SEQ ID NO: 4049272 - RNA, 13 nt, Reston Ebola virus [REBOV]
aaaaaauauuacu

SEQ ID NO: 4049273 - RNA, 23 nt, Reston Ebola virus [REBOV]
aaaagcuauugauuuucuucuuc

SEQ ID NO: 4049274 - RNA, 17 nt, Reston Ebola virus [REBOV]
aaagcuauugauuuucu

SEQ ID NO: 4049275 - RNA, 18 nt, Reston Ebola virus [REBOV]
aacaacuccgcccagagc

SEQ ID NO: 4049276 - RNA, 21 nt, Reston Ebola virus [REBOV]
aacaugucaaugcuauacugu

SEQ ID NO: 4049277 - RNA, 19 nt, Reston Ebola virus [REBOV]
aaccaggaaccagcccagg

SEQ ID NO: 4049278 - RNA, 18 nt, Reston Ebola virus [REBOV]
aacuaaaccaagcaauau

SEQ ID NO: 4049279 - RNA, 13 nt, Reston Ebola virus [REBOV]
aacuacccaggcu

SEQ ID NO: 4049280 - RNA, 16 nt, Reston Ebola virus [REBOV]
aacuccgcccagagcc

SEQ ID NO: 4049281 - RNA, 17 nt, Reston Ebola virus [REBOV]
aagaccacgccagcacc

SEQ ID NO: 4049282 - RNA, 13 nt, Reston Ebola virus [REBOV]
aaucagaaauugg

SEQ ID NO: 4049283 - RNA, 24 nt, Reston Ebola virus [REBOV]
aaucgcuaguaauuuuaaucucca

SEQ ID NO: 4049284 - RNA, 14 nt, Reston Ebola virus [REBOV]
acaacacagcaucc

SEQ ID NO: 4049285 - RNA, 17 nt, Reston Ebola virus [REBOV]
accaggaaccagcccag

SEQ ID NO: 4049286 - RNA, 19 nt, Reston Ebola virus [REBOV]
accaggaaccagcccagga

SEQ ID NO: 4049287 - RNA, 19 nt, Reston Ebola virus [REBOV]
acuacccaggcucuucaau

SEQ ID NO: 4049288 - RNA, 20 nt, Reston Ebola virus [REBOV]
acuccgcccagagcccacag

SEQ ID NO: 4049289 - RNA, 11 nt, Reston Ebola virus [REBOV]
acuugaaugcu

SEQ ID NO: 4049290 - RNA, 16 nt, Reston Ebola virus [REBOV]
agacuauugaacuauu

SEQ ID NO: 4049291 - RNA, 14 nt, Reston Ebola virus [REBOV]
agcgcagccggacc

SEQ ID NO: 4049292 - RNA, 19 nt, Reston Ebola virus [REBOV]
agcuauuaguuauuacuua

SEQ ID NO: 4049293 - RNA, 21 nt, Reston Ebola virus [REBOV]
agcugauucacugagucccac

SEQ ID NO: 4049294 - RNA, 22 nt, Reston Ebola virus [REBOV]
aggacuuacucacuucuuaaca

SEQ ID NO: 4049295 - RNA, 17 nt, Reston Ebola virus [REBOV]
aggcucgaacaacuccg

SEQ ID NO: 4049296 - RNA, 15 nt, Reston Ebola virus [REBOV]
auaaauaauacuuua

SEQ ID NO: 4049297 - RNA, 17 nt, Reston Ebola virus [REBOV]
auccccgaugacccagg

SEQ ID NO: 4049298 - RNA, 20 nt, Reston Ebola virus [REBOV]
auccccgaugacccaggacc

SEQ ID NO: 4049299 - RNA, 14 nt, Reston Ebola virus [REBOV]
augaaacuacccag

SEQ ID NO: 4049300 - RNA, 12 nt, Reston Ebola virus [REBOV]
augacccaggac

SEQ ID NO: 4049301 - RNA, 13 nt, Reston Ebola virus [REBOV]
auuaagaguuuaa

SEQ ID NO: 4049302 - RNA, 18 nt, Reston Ebola virus [REBOV]
auuggaguaaaaguauaa

SEQ ID NO: 4049303 - RNA, 16 nt, Reston Ebola virus [REBOV]
caaauuaaacaugacu

SEQ ID NO: 4049304 - RNA, 16 nt, Reston Ebola virus [REBOV]
caacagcagcaaacca

SEQ ID NO: 4049305 - RNA, 20 nt, Reston Ebola virus [REBOV]
caagucagcccggacucacu

SEQ ID NO: 4049306 - RNA, 22 nt, Reston Ebola virus [REBOV]
caauagcaaaguuaaauucucc

SEQ ID NO: 4049307 - RNA, 20 nt, Reston Ebola virus [REBOV]
caaucacagguuucaccgcg

SEQ ID NO: 4049308 - RNA, 16 nt, Reston Ebola virus [REBOV]
cagagcccacagacca

SEQ ID NO: 4049309 - RNA, 19 nt, Reston Ebola virus [REBOV]
cagaucuuuacuauuggac

SEQ ID NO: 4049310 - RNA, 16 nt, Reston Ebola virus [REBOV]
cagcagcaaaccagga

SEQ ID NO: 4049311 - RNA, 20 nt, Reston Ebola virus [REBOV]
caggaagcgcagccggacca

SEQ ID NO: 4049312 - RNA, 23 nt, Reston Ebola virus [REBOV]
caucuuguugcauugagccacau

SEQ ID NO: 4049313 - RNA, 13 nt, Reston Ebola virus [REBOV]
ccaaucuuuuccu

SEQ ID NO: 4049314 - RNA, 12 nt, Reston Ebola virus [REBOV]
ccagcccaggaa

SEQ ID NO: 4049315 - RNA, 13 nt, Reston Ebola virus [REBOV]
ccauugccccaag

SEQ ID NO: 4049316 - RNA, 21 nt, Reston Ebola virus [REBOV]
ccauugccccaaguccaacca

SEQ ID NO: 4049317 - RNA, 14 nt, Reston Ebola virus [REBOV]
cccaaguccaacca

SEQ ID NO: 4049318 - RNA, 16 nt, Reston Ebola virus [REBOV]
cccgaugacccaggac

SEQ ID NO: 4049319 - RNA, 20 nt, Reston Ebola virus [REBOV]
cccgcaagagacggccaaca

SEQ ID NO: 4049320 - RNA, 23 nt, Reston Ebola virus [REBOV]
ccuaacuauugggcggcuuccau

SEQ ID NO: 4049321 - RNA, 14 nt, Reston Ebola virus [REBOV]
ccuaccagaccacg

SEQ ID NO: 4049322 - RNA, 20 nt, Reston Ebola virus [REBOV]
cgaacaacuccgcccagagc

SEQ ID NO: 4049323 - RNA, 14 nt, Reston Ebola virus [REBOV]
cggaccaagucagc

SEQ ID NO: 4049324 - RNA, 15 nt, Reston Ebola virus [REBOV]
cggaccugcagcaga

SEQ ID NO: 4049325 - RNA, 14 nt, Reston Ebola virus [REBOV]
auucugcuaguaau

SEQ ID NO: 4049326 - RNA, 18 nt, Reston Ebola virus [REBOV]
auucugcuaguaauuccg

SEQ ID NO: 4049327 - RNA, 14 nt, Reston Ebola virus [REBOV]
auugauaagaauac

SEQ ID NO: 4049328 - RNA, 14 nt, Reston Ebola virus [REBOV]
auugcauugagcac

SEQ ID NO: 4049329 - RNA, 15 nt, Reston Ebola virus [REBOV]
auuuauuuaacaagg

SEQ ID NO: 4049330 - RNA, 21 nt, Reston Ebola virus [REBOV]
caaccaccauugccccaaguc

SEQ ID NO: 4049331 - RNA, 22 nt, Reston Ebola virus [REBOV]
cagccgaacaacacagcaucca

SEQ ID NO: 4049332 - RNA, 17 nt, Reston Ebola virus [REBOV]
caggacccgcaagagac

SEQ ID NO: 4049333 - RNA, 15 nt, Reston Ebola virus [REBOV]
cagucaaaacuaaac

SEQ ID NO: 4049334 - RNA, 15 nt, Reston Ebola virus [REBOV]
ccaggaaccagccca

SEQ ID NO: 4049335 - RNA, 15 nt, Reston Ebola virus [REBOV]
ccccgaugacccagg

SEQ ID NO: 4049336 - RNA, 16 nt, Reston Ebola virus [REBOV]
cgacaaaacaccgcua

SEQ ID NO: 4049337 - RNA, 19 nt, Reston Ebola virus [REBOV]
cggaccaagucagcccgga

SEQ ID NO: 4049338 - RNA, 14 nt, Reston Ebola virus [REBOV]
cgggcuacgucagc

SEQ ID NO: 4049339 - RNA, 20 nt, Reston Ebola virus [REBOV]
cuaaucagagguauaacaau

SEQ ID NO: 4049340 - RNA, 14 nt, Reston Ebola virus [REBOV]
cuaaucuauuuucg

SEQ ID NO: 4049341 - RNA, 20 nt, Reston Ebola virus [REBOV]
cucaggguuacucuaaggag

SEQ ID NO: 4049342 - RNA, 14 nt, Reston Ebola virus [REBOV]
cugagguauuuugu

SEQ ID NO: 4049343 - RNA, 15 nt, Reston Ebola virus [REBOV]
cuuuuugaaauggag

SEQ ID NO: 4049344 - RNA, 16 nt, Reston Ebola virus [REBOV]
gaacaacuccgcccag

SEQ ID NO: 4049345 - RNA, 15 nt, Reston Ebola virus [REBOV]
gaacagccgaacaac

SEQ ID NO: 4049346 - RNA, 16 nt, Reston Ebola virus [REBOV]
gagagacaaucacagg

SEQ ID NO: 4049347 - RNA, 19 nt, Reston Ebola virus [REBOV]
gagcccacagaccaagacc

SEQ ID NO: 4049348 - RNA, 14 nt, Reston Ebola virus [REBOV]
gagggggcagcagu

SEQ ID NO: 4049349 - RNA, 15 nt, Reston Ebola virus [REBOV]
gcagcaaaccaggaa

SEQ ID NO: 4049350 - RNA, 15 nt, Reston Ebola virus [REBOV]
gcgggccacaacaga

SEQ ID NO: 4049351 - RNA, 15 nt, Reston Ebola virus [REBOV]
ggacagcuguugaug

SEQ ID NO: 4049352 - RNA, 13 nt, Reston Ebola virus [REBOV]
ggccacaacagaa

SEQ ID NO: 4049353 - RNA, 23 nt, Reston Ebola virus [REBOV]
ggguuacucuaaggagaaauauu

SEQ ID NO: 4049354 - RNA, 20 nt, Reston Ebola virus [REBOV]
gguguaaugcauaaucagaa

SEQ ID NO: 4049355 - RNA, 15 nt, Reston Ebola virus [REBOV]
guaaucaugauuuua

SEQ ID NO: 4049356 - RNA, 20 nt, Reston Ebola virus [REBOV]
guauauaaccaaucuuuucc

SEQ ID NO: 4049357 - RNA, 18 nt, Reston Ebola virus [REBOV]
uaacacaucauaacuuua

SEQ ID NO: 4049358 - RNA, 21 nt, Reston Ebola virus [REBOV]
uaacauagacugaaaaugcua

SEQ ID NO: 4049359 - RNA, 21 nt, Reston Ebola virus [REBOV]
uaagaagagauuggaguaaaa

SEQ ID NO: 4049360 - RNA, 14 nt, Reston Ebola virus [REBOV]
uaagaucaaaugca

SEQ ID NO: 4049361 - RNA, 23 nt, Reston Ebola virus [REBOV]
uaaucuaaggccauuaagaguuu

SEQ ID NO: 4049362 - RNA, 18 nt, Reston Ebola virus [REBOV]
uaaucuauggacagguug

SEQ ID NO: 4049363 - RNA, 14 nt, Reston Ebola virus [REBOV]
uacuauuggacagc

SEQ ID NO: 4049364 - RNA, 17 nt, Reston Ebola virus [REBOV]
uagaguauacucaaaau

SEQ ID NO: 4049365 - RNA, 23 nt, Reston Ebola virus [REBOV]
uaguuaagaucaaaugcaaacau

SEQ ID NO: 4049366 - RNA, 13 nt, Reston Ebola virus [REBOV]
uauuuaacaaggc

SEQ ID NO: 4049367 - RNA, 16 nt, Reston Ebola virus [REBOV]
ugagucccaccaggaa

SEQ ID NO: 4049368 - RNA, 21 nt, Reston Ebola virus [REBOV]
ugaucuuaaucuauggacagg

SEQ ID NO: 4049369 - RNA, 12 nt, Reston Ebola virus [REBOV]
ugcagcagaagg

SEQ ID NO: 4049370 - RNA, 17 nt, Reston Ebola virus [REBOV]
ugcuaauagguuuguau

SEQ ID NO: 4049371 - RNA, 13 nt, Reston Ebola virus [REBOV]
ugcuugauuuaca

SEQ ID NO: 4049372 - RNA, 17 nt, Reston Ebola virus [REBOV]
uugugggucuuaucuag

SEQ ID NO: 4049373 - RNA, 22 nt, Reston Ebola virus [REBOV]
auucacugagucccaccaggaa

SEQ ID NO: 4049374 - RNA, 19 nt, Reston Ebola virus [REBOV]
auugauuuucuucuucaac

SEQ ID NO: 4049375 - RNA, 14 nt, Reston Ebola virus [REBOV]
caauagacuaaaaa

SEQ ID NO: 4049376 - RNA, 18 nt, Reston Ebola virus [REBOV]
caaugacucguuaacaau

SEQ ID NO: 4049377 - RNA, 16 nt, Reston Ebola virus [REBOV]
caccauugccccaagu

SEQ ID NO: 4049378 - RNA, 14 nt, Reston Ebola virus [REBOV]
cagagcccacagac

SEQ ID NO: 4049379 - RNA, 13 nt, Reston Ebola virus [REBOV]
cagcacccacaac

SEQ ID NO: 4049380 - RNA, 20 nt, Reston Ebola virus [REBOV]
cagcagcaaaccaggaacca

SEQ ID NO: 4049381 - RNA, 15 nt, Reston Ebola virus [REBOV]
cagccggaccaaguc

SEQ ID NO: 4049382 - RNA, 14 nt, Reston Ebola virus [REBOV]
caggaaccagccca

SEQ ID NO: 4049383 - RNA, 16 nt, Reston Ebola virus [REBOV]
caggacccgcaagaga

SEQ ID NO: 4049384 - RNA, 14 nt, Reston Ebola virus [REBOV]
caguuaaguaacau

SEQ ID NO: 4049385 - RNA, 17 nt, Reston Ebola virus [REBOV]
cauagacugaaaaugcu

SEQ ID NO: 4049386 - RNA, 19 nt, Reston Ebola virus [REBOV]
cauccccgaugacccagga

SEQ ID NO: 4049387 - RNA, 21 nt, Reston Ebola virus [REBOV]
caugauuuuaugauaauucuu

SEQ ID NO: 4049388 - RNA, 17 nt, Reston Ebola virus [REBOV]
ccagagcccacagacca

SEQ ID NO: 4049389 - RNA, 19 nt, Reston Ebola virus [REBOV]
ccagcccaggaagcgcagc

SEQ ID NO: 4049390 - RNA, 15 nt, Reston Ebola virus [REBOV]
cccacagaccaagac

SEQ ID NO: 4049391 - RNA, 14 nt, Reston Ebola virus [REBOV]
cccaucggcaagca

SEQ ID NO: 4049392 - RNA, 19 nt, Reston Ebola virus [REBOV]
ccccgaugacccaggaccc

SEQ ID NO: 4049393 - RNA, 18 nt, Reston Ebola virus [REBOV]
ccugcagcagaaggcauc

SEQ ID NO: 4049394 - RNA, 14 nt, Reston Ebola virus [REBOV]
cgaugacccaggac

SEQ ID NO: 4049395 - RNA, 20 nt, Reston Ebola virus [REBOV]
cgcaagagacggccaacagc

SEQ ID NO: 4049396 - RNA, 14 nt, Reston Ebola virus [REBOV]
cggccaacagcagc

SEQ ID NO: 4049397 - RNA, 20 nt, Reston Ebola virus [REBOV]
cgggccacaacagaacugag

SEQ ID NO: 4049398 - RNA, 16 nt, Reston Ebola virus [REBOV]
cuccgcccagagccca

SEQ ID NO: 4049399 - RNA, 20 nt, Reston Ebola virus [REBOV]
cuccgcccagagcccacaga

SEQ ID NO: 4049400 - RNA, 20 nt, Reston Ebola virus [REBOV]
cuugaguaauaaucauuucu

SEQ ID NO: 4049401 - RNA, 19 nt, Reston Ebola virus [REBOV]
gaacccaaugacaaccacc

SEQ ID NO: 4049402 - RNA, 16 nt, Reston Ebola virus [REBOV]
gagagagaaaaaucuc

SEQ ID NO: 4049403 - RNA, 20 nt, Reston Ebola virus [REBOV]
gaucuuuacuauuggacagc

SEQ ID NO: 4049404 - RNA, 14 nt, Reston Ebola virus [REBOV]
gcuaaauacacuua

SEQ ID NO: 4049405 - RNA, 15 nt, Reston Ebola virus [REBOV]
ggucuuuuugaaaug

SEQ ID NO: 4049406 - RNA, 22 nt, Reston Ebola virus [REBOV]
guaagguagcugauucacugag

SEQ ID NO: 4049407 - RNA, 20 nt, Reston Ebola virus [REBOV]
guaauauacauauacacuua

SEQ ID NO: 4049408 - RNA, 17 nt, Reston Ebola virus [REBOV]
guacaugaaugagaauu

SEQ ID NO: 4049409 - RNA, 17 nt, Reston Ebola virus [REBOV]
guggucuuuuugaaaug

SEQ ID NO: 4049410 - RNA, 21 nt, Reston Ebola virus [REBOV]
uaaaaguauaaaauaaauuua

SEQ ID NO: 4049411 - RNA, 13 nt, Reston Ebola virus [REBOV]
uaaauaauacuuu

SEQ ID NO: 4049412 - RNA, 15 nt, Reston Ebola virus [REBOV]
uaagaauacacuuua

SEQ ID NO: 4049413 - RNA, 22 nt, Reston Ebola virus [REBOV]
uaaggaguuuuuuaaucuaauu

SEQ ID NO: 4049414 - RNA, 17 nt, Reston Ebola virus [REBOV]
uaauccuaguauuuauu

SEQ ID NO: 4049415 - RNA, 19 nt, Reston Ebola virus [REBOV]
uaauguaaauauaacaagu

SEQ ID NO: 4049416 - RNA, 14 nt, Reston Ebola virus [REBOV]
uacacuuaagacuu

SEQ ID NO: 4049417 - RNA, 17 nt, Reston Ebola virus [REBOV]
uacauguguauauaacc

SEQ ID NO: 4049418 - RNA, 22 nt, Reston Ebola virus [REBOV]
uacauugaggguguaaugcaua

SEQ ID NO: 4049419 - RNA, 18 nt, Reston Ebola virus [REBOV]
uagacuaaaaaucugauu

SEQ ID NO: 4049420 - RNA, 15 nt, Reston Ebola virus [REBOV]
uagcaaucagaaauu

SEQ ID NO: 4049421 - RNA, 13 nt, Reston Ebola virus [REBOV]
uauuaguaauuga

SEQ ID NO: 4049422 - RNA, 13 nt, Reston Ebola virus [REBOV]
uauuuuaauaaca

SEQ ID NO: 4049423 - RNA, 19 nt, Reston Ebola virus [REBOV]
ucuauccaagauguggcuc

SEQ ID NO: 4049424 - RNA, 14 nt, Reston Ebola virus [REBOV]
ucugauuguggauu

SEQ ID NO: 4049425 - RNA, 12 nt, Reston Ebola virus [REBOV]
ucugcuucuuug

SEQ ID NO: 4049426 - RNA, 17 nt, Reston Ebola virus [REBOV]
ugacuugaauguaauaa

SEQ ID NO: 4049427 - RNA, 17 nt, Reston Ebola virus [REBOV]
uggauccgauccaaggc

SEQ ID NO: 4049428 - RNA, 18 nt, Reston Ebola virus [REBOV]
ugucaaugcuauacuguu

SEQ ID NO: 4049429 - RNA, 21 nt, Reston Ebola virus [REBOV]
uuaagcgcacacaaaaacauu

SEQ ID NO: 4049430 - RNA, 22 nt, Reston Ebola virus [REBOV]
uuaagcgcacacaaaaacauua

SEQ ID NO: 4049431 - RNA, 18 nt, Reston Ebola virus [REBOV]
uuacgccuagauaacuaa

SEQ ID NO: 4049432 - RNA, 20 nt, Reston Ebola virus [REBOV]
uucaacccagucaaaacuaa

SEQ ID NO: 4049433 - RNA, 16 nt, Reston Ebola virus [REBOV]
cuaaucuauuuucgcu

SEQ ID NO: 4049434 - RNA, 18 nt, Reston Ebola virus [REBOV]
cuauuauucugcuaguaa

SEQ ID NO: 4049435 - RNA, 15 nt, Reston Ebola virus [REBOV]
cuccgcccagagccc

SEQ ID NO: 4049436 - RNA, 21 nt, Reston Ebola virus [REBOV]
cucguuaacaaucgcuaguaa

SEQ ID NO: 4049437 - RNA, 19 nt, Reston Ebola virus [REBOV]
cugucgaauccuaggacca

SEQ ID NO: 4049438 - RNA, 22 nt, Reston Ebola virus [REBOV]
cugucgaauccuaggaccaucu

SEQ ID NO: 4049439 - RNA, 15 nt, Reston Ebola virus [REBOV]
cuuugcuuauauugg

SEQ ID NO: 4049440 - RNA, 15 nt, Reston Ebola virus [REBOV]
cuuugcuugauuuac

SEQ ID NO: 4049441 - RNA, 14 nt, Reston Ebola virus [REBOV]
gaaccagcccagga

SEQ ID NO: 4049442 - RNA, 16 nt, Reston Ebola virus [REBOV]
gaaccagcccaggaag

SEQ ID NO: 4049443 - RNA, 18 nt, Reston Ebola virus [REBOV]
gacccaggacccgcaaga

SEQ ID NO: 4049444 - RNA, 14 nt, Reston Ebola virus [REBOV]
gagacaauuuacca

SEQ ID NO: 4049445 - RNA, 13 nt, Reston Ebola virus [REBOV]
gaugauaauauau

SEQ ID NO: 4049446 - RNA, 13 nt, Reston Ebola virus [REBOV]
gccagcacccaca

SEQ ID NO: 4049447 - RNA, 17 nt, Reston Ebola virus [REBOV]
gcucuauagucuauucu

SEQ ID NO: 4049448 - RNA, 19 nt, Reston Ebola virus [REBOV]
guaagauuuuguguugauu

SEQ ID NO: 4049449 - RNA, 13 nt, Reston Ebola virus [REBOV]
gucuuuuugaaau

SEQ ID NO: 4049450 - RNA, 12 nt, Reston Ebola virus [REBOV]
guuauuacuuau

SEQ ID NO: 4049451 - RNA, 20 nt, Reston Ebola virus [REBOV]
uaagaucaaaugcaaacauu

SEQ ID NO: 4049452 - RNA, 21 nt, Reston Ebola virus [REBOV]
uaagauuuuguguugauuuau

SEQ ID NO: 4049453 - RNA, 22 nt, Reston Ebola virus [REBOV]
uauauaaccaaucuuuuccuau

SEQ ID NO: 4049454 - RNA, 18 nt, Reston Ebola virus [REBOV]
uaucugcaguaaccagaa

SEQ ID NO: 4049455 - RNA, 14 nt, Reston Ebola virus [REBOV]
uauucuaaucagag

SEQ ID NO: 4049456 - RNA, 17 nt, Reston Ebola virus [REBOV]
ucaaagugauuaaauga

SEQ ID NO: 4049457 - RNA, 10 nt, Reston Ebola virus [REBOV]
ucacagguuu

SEQ ID NO: 4049458 - RNA, 20 nt, Reston Ebola virus [REBOV]
ucauauuuugaucaaguaau

SEQ ID NO: 4049459 - RNA, 15 nt, Reston Ebola virus [REBOV]
uccauuuaguaauaa

SEQ ID NO: 4049460 - RNA, 18 nt, Reston Ebola virus [REBOV]
uccccgaugacccaggac

SEQ ID NO: 4049461 - RNA, 15 nt, Reston Ebola virus [REBOV]
ucuauggacagguug

SEQ ID NO: 4049462 - RNA, 12 nt, Reston Ebola virus [REBOV]
ucuauucuaauc

SEQ ID NO: 4049463 - RNA, 23 nt, Reston Ebola virus [REBOV]
ucuucaauuauuucugcgggcca

SEQ ID NO: 4049464 - RNA, 16 nt, Reston Ebola virus [REBOV]
ugaauugugcagauuu

SEQ ID NO: 4049465 - RNA, 11 nt, Reston Ebola virus [REBOV]
ugacccaggac

SEQ ID NO: 4049466 - RNA, 14 nt, Reston Ebola virus [REBOV]
ugacgcuguugaug

SEQ ID NO: 4049467 - RNA, 20 nt, Reston Ebola virus [REBOV]
ugauuguguguauuaaauua

SEQ ID NO: 4049468 - RNA, 16 nt, Reston Ebola virus [REBOV]
ugcaauugucaagagu

SEQ ID NO: 4049469 - RNA, 18 nt, Reston Ebola virus [REBOV]
ugcuucuuugcuugauuu

SEQ ID NO: 4049470 - RNA, 15 nt, Reston Ebola virus [REBOV]
uuaagaucaaaugca

SEQ ID NO: 4049471 - RNA, 18 nt, Reston Ebola virus [REBOV]
uuauuuuuaaaauuuacu

SEQ ID NO: 4049472 - RNA, 19 nt, Reston Ebola virus [REBOV]
uucaccgcgaacccaauga

SEQ ID NO: 4049473 - RNA, 19 nt, Reston Ebola virus [REBOV]
uugaaauggagauuaucag

SEQ ID NO: 4049474 - RNA, 13 nt, Reston Ebola virus [REBOV]
uuguugaguuaac

SEQ ID NO: 4049475 - RNA, 13 nt, Reston Ebola virus [REBOV]
uuuuaaucuaauu

SEQ ID NO: 4049476 - RNA, 13 nt, Rubella virus
aaugacagcugcg

SEQ ID NO: 4049477 - RNA, 14 nt, Rubella virus
acacccccccgccc

SEQ ID NO: 4049478 - RNA, 16 nt, Rubella virus
acagagaccaggaccg

SEQ ID NO: 4049479 - RNA, 13 nt, Rubella virus
accagggcacuca

SEQ ID NO: 4049480 - RNA, 19 nt, Rubella virus
acccccugcugcgcacugc

SEQ ID NO: 4049481 - RNA, 19 nt, Rubella virus
acccgcacuaggccacuag

SEQ ID NO: 4049482 - RNA, 13 nt, Rubella virus
accgacugcugcg

SEQ ID NO: 4049483 - RNA, 17 nt, Rubella virus
accgaggcacccaccga

SEQ ID NO: 4049484 - RNA, 16 nt, Rubella virus
accgcccaguacccgc

SEQ ID NO: 4049485 - RNA, 21 nt, Rubella virus
accgggcgugggggcucugcc

SEQ ID NO: 4049486 - RNA, 16 nt, Rubella virus
accuccuacgcugccg

SEQ ID NO: 4049487 - RNA, 17 nt, Rubella virus
accuccuacgcugccgc

SEQ ID NO: 4049488 - RNA, 21 nt, Rubella virus
accuccuacgcugccgcagcc

SEQ ID NO: 4049489 - RNA, 22 nt, Rubella virus
accugcauuucaccaaccuggg

SEQ ID NO: 4049490 - RNA, 18 nt, Rubella virus
acgccuacuccucuggcg

SEQ ID NO: 4049491 - RNA, 14 nt, Rubella virus
acgcugccgcagcc

SEQ ID NO: 4049492 - RNA, 22 nt, Rubella virus
acucgacgaggacggccgcugg

SEQ ID NO: 4049493 - RNA, 15 nt, Rubella virus
acuucaacccuggcg

SEQ ID NO: 4049494 - RNA, 15 nt, Rubella virus
acuugcuccccagcc

SEQ ID NO: 4049495 - RNA, 11 nt, Rubella virus
agagcgccccc

SEQ ID NO: 4049496 - RNA, 15 nt, Rubella virus
agccaucgcgggcgc

SEQ ID NO: 4049497 - RNA, 18 nt, Rubella virus
agcccgaauugccacggc

SEQ ID NO: 4049498 - RNA, 18 nt, Rubella virus
agccucggcccucuggcu

SEQ ID NO: 4049499 - RNA, 15 nt, Rubella virus
agcgacgugcugccc

SEQ ID NO: 4049500 - RNA, 13 nt, Rubella virus
agcgcccccggcu

SEQ ID NO: 4049501 - RNA, 16 nt, Rubella virus
agcucacucugggcgc

SEQ ID NO: 4049502 - RNA, 22 nt, Rubella virus
aggccacuagauccccgcaccu

SEQ ID NO: 4049503 - RNA, 21 nt, Rubella virus
aggcuuucaccuaccucugca

SEQ ID NO: 4049504 - RNA, 15 nt, Rubella virus
auccacgcccacacc

SEQ ID NO: 4049505 - RNA, 17 nt, Rubella virus
augcgguggggccuucc

SEQ ID NO: 4049506 - RNA, 16 nt, Rubella virus
caacgucaccacugaa

SEQ ID NO: 4049507 - RNA, 16 nt, Rubella virus
caacucuccguugccg

SEQ ID NO: 4049508 - RNA, 18 nt, Rubella virus
caauggcgaggaccucgg

SEQ ID NO: 4049509 - RNA, 16 nt, Rubella virus
cacaccacugcugugu

SEQ ID NO: 4049510 - RNA, 14 nt, Rubella virus
caccaaccugggca

SEQ ID NO: 4049511 - RNA, 16 nt, Rubella virus
caccgaggcacccacc

SEQ ID NO: 4049512 - RNA, 21 nt, Rubella virus
caccgcccaguacccgccuac

SEQ ID NO: 4049513 - RNA, 18 nt, Rubella virus
caccgcgcgcgccgggcu

SEQ ID NO: 4049514 - RNA, 14 nt, Rubella virus
caccuaccucugca

SEQ ID NO: 4049515 - RNA, 22 nt, Rubella virus
cacgaccgccgccacccccgcc

SEQ ID NO: 4049516 - RNA, 20 nt, Rubella virus
cacuagauccccgcaccugu

SEQ ID NO: 4049517 - RNA, 21 nt, Rubella virus
cacucgacgaggacggccgcu

SEQ ID NO: 4049518 - RNA, 17 nt, Rubella virus
cagcauuacggccacca

SEQ ID NO: 4049519 - RNA, 13 nt, Rubella virus
cagcgacgcggcc

SEQ ID NO: 4049520 - RNA, 19 nt, Rubella virus
caggcgcccgcugccccga

SEQ ID NO: 4049521 - RNA, 12 nt, Rubella virus
caggucccgccc

SEQ ID NO: 4049522 - RNA, 22 nt, Rubella virus
caguucgcccgguggcccugcc

SEQ ID NO: 4049523 - RNA, 17 nt, Rubella virus
caucgcgggcgccgcca

SEQ ID NO: 4049524 - RNA, 20 nt, Rubella virus
ccaccaccaucagcugccgu

SEQ ID NO: 4049525 - RNA, 16 nt, Rubella virus
ccacggcgcugacacc

SEQ ID NO: 4049526 - RNA, 20 nt, Rubella virus
ccagccucggcccucuggcu

SEQ ID NO: 4049527 - RNA, 16 nt, Rubella virus
cccaguacccgccuac

SEQ ID NO: 4049528 - RNA, 16 nt, Rubella virus
ccccaggccuuccuug

SEQ ID NO: 4049529 - RNA, 13 nt, Rubella virus
cccccgccacugc

SEQ ID NO: 4049530 - RNA, 18 nt, Rubella virus
cccccugcugcgcacugc

SEQ ID NO: 4049531 - RNA, 13 nt, Rubella virus
ccccgccacugcg

SEQ ID NO: 4049532 - RNA, 14 nt, Rubella virus
ccccgcgcuggugg

SEQ ID NO: 4049533 - RNA, 14 nt, Rubella virus
cccgcacuaggcca

SEQ ID NO: 4049534 - RNA, 18 nt, Rubella virus
cccuaccaagucagcugc

SEQ ID NO: 4049535 - RNA, 21 nt, Rubella virus
cccugcgcucauguacaaccc

SEQ ID NO: 4049536 - RNA, 14 nt, Rubella virus
ccgcacuaggccac

SEQ ID NO: 4049537 - RNA, 17 nt, Rubella virus
ccgccacaacagccuca

SEQ ID NO: 4049538 - RNA, 18 nt, Rubella virus
ccgggcgugggggcucug

SEQ ID NO: 4049539 - RNA, 16 nt, Rubella virus
ccuaccucugcacugc

SEQ ID NO: 4049540 - RNA, 21 nt, Rubella virus
ccuccccgguuugccaacgcc

SEQ ID NO: 4049541 - RNA, 14 nt, Rubella virus
ccugagcgacuggc

SEQ ID NO: 4049542 - RNA, 23 nt, Rubella virus
ccugcuggggcuuccccaccgac

SEQ ID NO: 4049543 - RNA, 19 nt, Rubella virus
ccuggcauccaccgggccc

SEQ ID NO: 4049544 - RNA, 23 nt, Rubella virus
ccuggguacccgcagccccuugc

SEQ ID NO: 4049545 - RNA, 17 nt, Rubella virus
ccuggucgacgccgacg

SEQ ID NO: 4049546 - RNA, 15 nt, Rubella virus
ccugugcgcacgggc

SEQ ID NO: 4049547 - RNA, 16 nt, Rubella virus
cgacccccugcugcgc

SEQ ID NO: 4049548 - RNA, 22 nt, Rubella virus
cgacccccugcugcgcacugcc

SEQ ID NO: 4049549 - RNA, 23 nt, Rubella virus
cgacggcgacagcgccccgcuuc

SEQ ID NO: 4049550 - RNA, 22 nt, Rubella virus
cgacuugcuccccagccucggc

SEQ ID NO: 4049551 - RNA, 13 nt, Rubella virus
aaacccgcacuag

SEQ ID NO: 4049552 - RNA, 23 nt, Rubella virus
aaugcccgaguggauccacgccc

SEQ ID NO: 4049553 - RNA, 13 nt, Rubella virus
aauugccacggcc

SEQ ID NO: 4049554 - RNA, 16 nt, Rubella virus
accaccaucagcugcc

SEQ ID NO: 4049555 - RNA, 17 nt, Rubella virus
accaccaucagcugccg

SEQ ID NO: 4049556 - RNA, 17 nt, Rubella virus
accagcgaccccuggca

SEQ ID NO: 4049557 - RNA, 13 nt, Rubella virus
accaucagcugcc

SEQ ID NO: 4049558 - RNA, 18 nt, Rubella virus
acccaccgaggccugcgu

SEQ ID NO: 4049559 - RNA, 13 nt, Rubella virus
acccccgcgcugg

SEQ ID NO: 4049560 - RNA, 19 nt, Rubella virus
acccgguuuggcugcgcua

SEQ ID NO: 4049561 - RNA, 14 nt, Rubella virus
accgcccgccccga

SEQ ID NO: 4049562 - RNA, 18 nt, Rubella virus
accggcaaucagcagucc

SEQ ID NO: 4049563 - RNA, 22 nt, Rubella virus
acgcgcuggcaccgacugcugc

SEQ ID NO: 4049564 - RNA, 14 nt, Rubella virus
acgcggccugcugg

SEQ ID NO: 4049565 - RNA, 16 nt, Rubella virus
acggccaccaccacca

SEQ ID NO: 4049566 - RNA, 22 nt, Rubella virus
acggccgcugggacccugcgcu

SEQ ID NO: 4049567 - RNA, 23 nt, Rubella virus
acuccggagggccccgccgccgc

SEQ ID NO: 4049568 - RNA, 18 nt, Rubella virus
acugcaccggggugcgcc

SEQ ID NO: 4049569 - RNA, 14 nt, Rubella virus
acugccccuggacc

SEQ ID NO: 4049570 - RNA, 21 nt, Rubella virus
acugcgccggcccccugccac

SEQ ID NO: 4049571 - RNA, 15 nt, Rubella virus
acuggcaccagggca

SEQ ID NO: 4049572 - RNA, 21 nt, Rubella virus
acuugcuccccagccucggcc

SEQ ID NO: 4049573 - RNA, 20 nt, Rubella virus
agagcgcccccggcugcgcc

SEQ ID NO: 4049574 - RNA, 20 nt, Rubella virus
agccccccugugcgcacggg

SEQ ID NO: 4049575 - RNA, 22 nt, Rubella virus
agcgcccccggcugcgccuggu

SEQ ID NO: 4049576 - RNA, 17 nt, Rubella virus
agcuacguccagcaccc

SEQ ID NO: 4049577 - RNA, 15 nt, Rubella virus
agcucacucugggcg

SEQ ID NO: 4049578 - RNA, 23 nt, Rubella virus
agcuggccucuuacuucaacccu

SEQ ID NO: 4049579 - RNA, 17 nt, Rubella virus
aggcacccaccgaggcc

SEQ ID NO: 4049580 - RNA, 19 nt, Rubella virus
aggcacccaccgaggccug

SEQ ID NO: 4049581 - RNA, 16 nt, Rubella virus
aggccacuggagccug

SEQ ID NO: 4049582 - RNA, 16 nt, Rubella virus
agggcuugggggccug

SEQ ID NO: 4049583 - RNA, 23 nt, Rubella virus
aguucgcccgguggcccugccac

SEQ ID NO: 4049584 - RNA, 14 nt, Rubella virus
auacgcgcuggacc

SEQ ID NO: 4049585 - RNA, 15 nt, Rubella virus
auacgcgcuggaccg

SEQ ID NO: 4049586 - RNA, 18 nt, Rubella virus
auuucaccaaccugggca

SEQ ID NO: 4049587 - RNA, 15 nt, Rubella virus
caacccuggcggcag

SEQ ID NO: 4049588 - RNA, 17 nt, Rubella virus
caacccuugcgggcccg

SEQ ID NO: 4049589 - RNA, 19 nt, Rubella virus
cacagcgacgcggccugcu

SEQ ID NO: 4049590 - RNA, 22 nt, Rubella virus
caccgaggcacccaccgaggcc

SEQ ID NO: 4049591 - RNA, 13 nt, Rubella virus
caccuucugggcu

SEQ ID NO: 4049592 - RNA, 20 nt, Rubella virus
cacggccccgauugggccuc

SEQ ID NO: 4049593 - RNA, 21 nt, Rubella virus
cacucgcuggcuuacucgcuu

SEQ ID NO: 4049594 - RNA, 15 nt, Rubella virus
cagcagucccggugg

SEQ ID NO: 4049595 - RNA, 14 nt, Rubella virus
cagccccccugugc

SEQ ID NO: 4049596 - RNA, 20 nt, Rubella virus
cagccccuugcgcgcgcauc

SEQ ID NO: 4049597 - RNA, 15 nt, Rubella virus
cagcgacgugcugcc

SEQ ID NO: 4049598 - RNA, 20 nt, Rubella virus
caggccuuccuugccgggcu

SEQ ID NO: 4049599 - RNA, 15 nt, Rubella virus
caggcgcccgcugcc

SEQ ID NO: 4049600 - RNA, 13 nt, Rubella virus
cagggccccgccc

SEQ ID NO: 4049601 - RNA, 23 nt, Rubella virus
cagggguacaacccccccgccua

SEQ ID NO: 4049602 - RNA, 13 nt, Rubella virus
caguacccgccua

SEQ ID NO: 4049603 - RNA, 14 nt, Rubella virus
cagugcgcggccuc

SEQ ID NO: 4049604 - RNA, 19 nt, Rubella virus
cauccaggcgcccgcugcc

SEQ ID NO: 4049605 - RNA, 22 nt, Rubella virus
cauuugcgagauccccacugau

SEQ ID NO: 4049606 - RNA, 11 nt, Rubella virus
ccacaccaccg

SEQ ID NO: 4049607 - RNA, 14 nt, Rubella virus
ccaccaucagcugc

SEQ ID NO: 4049608 - RNA, 23 nt, Rubella virus
ccacgcccacaccaccagcgacc

SEQ ID NO: 4049609 - RNA, 11 nt, Rubella virus
ccagggccccg

SEQ ID NO: 4049610 - RNA, 22 nt, Rubella virus
ccauccuuggcgcauccgcuuc

SEQ ID NO: 4049611 - RNA, 23 nt, Rubella virus
cccagccucggcccucuggcucg

SEQ ID NO: 4049612 - RNA, 17 nt, Rubella virus
ccccgaagacggcugga

SEQ ID NO: 4049613 - RNA, 14 nt, Rubella virus
ccccggcugcgccu

SEQ ID NO: 4049614 - RNA, 19 nt, Rubella virus
cccgcaccuguugcuguau

SEQ ID NO: 4049615 - RNA, 19 nt, Rubella virus
cccgcacuaggccacuaga

SEQ ID NO: 4049616 - RNA, 15 nt, Rubella virus
cccgccacugcgccg

SEQ ID NO: 4049617 - RNA, 19 nt, Rubella virus
cccgcgccccgagcugggg

SEQ ID NO: 4049618 - RNA, 15 nt, Rubella virus
cccggcagaccuggg

SEQ ID NO: 4049619 - RNA, 14 nt, Rubella virus
cccggggaccuggu

SEQ ID NO: 4049620 - RNA, 16 nt, Rubella virus
cccguucugcaacacg

SEQ ID NO: 4049621 - RNA, 19 nt, Rubella virus
cccucuggcucgccacagc

SEQ ID NO: 4049622 - RNA, 14 nt, Rubella virus
ccgaccgccgcccg

SEQ ID NO: 4049623 - RNA, 19 nt, Rubella virus
ccgccgcggcgccgccgcc

SEQ ID NO: 4049624 - RNA, 18 nt, Rubella virus
ccgcgccugucgccgccg

SEQ ID NO: 4049625 - RNA, 17 nt, Rubella virus
ccgcgcgcgccgggcuc

SEQ ID NO: 4049626 - RNA, 16 nt, Rubella virus
ccgcgucggcggcacg

SEQ ID NO: 4049627 - RNA, 19 nt, Rubella virus
ccgcugggacccugcgcuc

SEQ ID NO: 4049628 - RNA, 19 nt, Rubella virus
ccggagggccccgccgccg

SEQ ID NO: 4049629 - RNA, 16 nt, Rubella virus
ccggcagaccugggcg

SEQ ID NO: 4049630 - RNA, 14 nt, Rubella virus
ccggcgugguguau

SEQ ID NO: 4049631 - RNA, 13 nt, Rubella virus
ccgguggggccuc

SEQ ID NO: 4049632 - RNA, 19 nt, Rubella virus
ccguggcgcguggccugcg

SEQ ID NO: 4049633 - RNA, 20 nt, Rubella virus
ccucaaugacagcugcggcg

SEQ ID NO: 4049634 - RNA, 15 nt, Rubella virus
ccucgaggccacugg

SEQ ID NO: 4049635 - RNA, 14 nt, Rubella virus
ccucucaccaccgc

SEQ ID NO: 4049636 - RNA, 19 nt, Rubella virus
ccugauauuuauggugugc

SEQ ID NO: 4049637 - RNA, 22 nt, Rubella virus
ccugcgugaccucguggcuuug

SEQ ID NO: 4049638 - RNA, 21 nt, Rubella virus
ccugcugcgcacugccccugg

SEQ ID NO: 4049639 - RNA, 12 nt, Rubella virus
ccuggcggcagc

SEQ ID NO: 4049640 - RNA, 13 nt, Rubella virus
ccugucgccgccg

SEQ ID NO: 4049641 - RNA, 22 nt, Rubella virus
ccugucgccgccgcggcgccgc

SEQ ID NO: 4049642 - RNA, 13 nt, Rubella virus
ccuugccgggcuc

SEQ ID NO: 4049643 - RNA, 14 nt, Rubella virus
cgacgcggccugcu

SEQ ID NO: 4049644 - RNA, 13 nt, Rubella virus
cgacgugcugccc

SEQ ID NO: 4049645 - RNA, 12 nt, Rubella virus
cgacuugcuccc

SEQ ID NO: 4049646 - RNA, 17 nt, Rubella virus
cgcacguuagcgccacc

SEQ ID NO: 4049647 - RNA, 14 nt, Rubella virus
cgcacuaggccacu

SEQ ID NO: 4049648 - RNA, 12 nt, Rubella virus
cgcagccccccu

SEQ ID NO: 4049649 - RNA, 13 nt, Rubella virus
cgcagggacuggu

SEQ ID NO: 4049650 - RNA, 23 nt, Rubella virus
cgcagggacugguccagggcccc

SEQ ID NO: 4049651 - RNA, 20 nt, Rubella virus
cgcauccgcuucggugcccc

SEQ ID NO: 4049652 - RNA, 16 nt, Rubella virus
cgccacucaagcaccu

SEQ ID NO: 4049653 - RNA, 15 nt, Rubella virus
cgcccccggcugcgc

SEQ ID NO: 4049654 - RNA, 20 nt, Rubella virus
cgcccgccucuccacgaccc

SEQ ID NO: 4049655 - RNA, 21 nt, Rubella virus
aagcaccuguccccgugcgcc

SEQ ID NO: 4049656 - RNA, 12 nt, Rubella virus
acacccccccgc

SEQ ID NO: 4049657 - RNA, 14 nt, Rubella virus
acacgccgcacgga

SEQ ID NO: 4049658 - RNA, 20 nt, Rubella virus
accaccagcgaccccuggca

SEQ ID NO: 4049659 - RNA, 16 nt, Rubella virus
acccccugcugcgcac

SEQ ID NO: 4049660 - RNA, 22 nt, Rubella virus
accccuggcauccaccgggccc

SEQ ID NO: 4049661 - RNA, 14 nt, Rubella virus
acccuugcgggccc

SEQ ID NO: 4049662 - RNA, 20 nt, Rubella virus
acccuugcgggcccgagccg

SEQ ID NO: 4049663 - RNA, 20 nt, Rubella virus
accuaccucugcacugcacc

SEQ ID NO: 4049664 - RNA, 20 nt, Rubella virus
accucgaggccacuggagcc

SEQ ID NO: 4049665 - RNA, 16 nt, Rubella virus
acgacccccugcugcg

SEQ ID NO: 4049666 - RNA, 19 nt, Rubella virus
acgaccgaccgccgcccgc

SEQ ID NO: 4049667 - RNA, 14 nt, Rubella virus
acgaccgccgccac

SEQ ID NO: 4049668 - RNA, 20 nt, Rubella virus
acgaccgccgccacccccgc

SEQ ID NO: 4049669 - RNA, 18 nt, Rubella virus
acgcccucgcggccuucg

SEQ ID NO: 4049670 - RNA, 17 nt, Rubella virus
acgccgacgacccccug

SEQ ID NO: 4049671 - RNA, 19 nt, Rubella virus
acgccucucaccaccgcgg

SEQ ID NO: 4049672 - RNA, 20 nt, Rubella virus
acgccugucauaggcucuca

SEQ ID NO: 4049673 - RNA, 20 nt, Rubella virus
acuagauccccgcaccuguu

SEQ ID NO: 4049674 - RNA, 12 nt, Rubella virus
agaccugggcgg

SEQ ID NO: 4049675 - RNA, 15 nt, Rubella virus
agcauuacggccacc

SEQ ID NO: 4049676 - RNA, 20 nt, Rubella virus
agcgccucgcuagugggccc

SEQ ID NO: 4049677 - RNA, 13 nt, Rubella virus
agcuggggccacc

SEQ ID NO: 4049678 - RNA, 17 nt, Rubella virus
aggcgcccgcugccccg

SEQ ID NO: 4049679 - RNA, 14 nt, Rubella virus
agggguacaacccc

SEQ ID NO: 4049680 - RNA, 20 nt, Rubella virus
aguacccgccuacccgguuu

SEQ ID NO: 4049681 - RNA, 15 nt, Rubella virus
agugggcugcugccc

SEQ ID NO: 4049682 - RNA, 15 nt, Rubella virus
aguucgucaccgccg

SEQ ID NO: 4049683 - RNA, 10 nt, Rubella virus
aucagcugcc

SEQ ID NO: 4049684 - RNA, 13 nt, Rubella virus
auccaccgggccc

SEQ ID NO: 4049685 - RNA, 14 nt, Rubella virus
augcaaaccgggcg

SEQ ID NO: 4049686 - RNA, 17 nt, Rubella virus
augcccgaguggaucca

SEQ ID NO: 4049687 - RNA, 15 nt, Rubella virus
augcgguggggccuu

SEQ ID NO: 4049688 - RNA, 14 nt, Rubella virus
auggcggcaccucc

SEQ ID NO: 4049689 - RNA, 13 nt, Rubella virus
auggugugccgcc

SEQ ID NO: 4049690 - RNA, 15 nt, Rubella virus
caaccugggcacccc

SEQ ID NO: 4049691 - RNA, 19 nt, Rubella virus
caaugugcgugugaccggg

SEQ ID NO: 4049692 - RNA, 14 nt, Rubella virus
cacacacaccacug

SEQ ID NO: 4049693 - RNA, 21 nt, Rubella virus
cacagcgacgcggccugcugg

SEQ ID NO: 4049694 - RNA, 20 nt, Rubella virus
cacauggacuucuggugugu

SEQ ID NO: 4049695 - RNA, 19 nt, Rubella virus
caccgaggcacccaccgag

SEQ ID NO: 4049696 - RNA, 15 nt, Rubella virus
caccgccgcccuccu

SEQ ID NO: 4049697 - RNA, 20 nt, Rubella virus
caccgcgcgcgccgggcucc

SEQ ID NO: 4049698 - RNA, 13 nt, Rubella virus
acaacccccccgc

SEQ ID NO: 4049699 - RNA, 15 nt, Rubella virus
acaaucaaccugccg

SEQ ID NO: 4049700 - RNA, 20 nt, Rubella virus
acacagcgacgcggccugcu

SEQ ID NO: 4049701 - RNA, 22 nt, Rubella virus
acacagcgacgcggccugcugg

SEQ ID NO: 4049702 - RNA, 15 nt, Rubella virus
accaagucagcugcg

SEQ ID NO: 4049703 - RNA, 16 nt, Rubella virus
accccgacgccucuca

SEQ ID NO: 4049704 - RNA, 16 nt, Rubella virus
acccgcacuaggccac

SEQ ID NO: 4049705 - RNA, 18 nt, Rubella virus
acccggcagaccugggcg

SEQ ID NO: 4049706 - RNA, 17 nt, Rubella virus
accgcgcgcgccgggcu

SEQ ID NO: 4049707 - RNA, 23 nt, Rubella virus
accgcgcgggucaucgaccccgc

SEQ ID NO: 4049708 - RNA, 13 nt, Rubella virus
accucggcgccgu

SEQ ID NO: 4049709 - RNA, 18 nt, Rubella virus
accugagcgacuggcacc

SEQ ID NO: 4049710 - RNA, 20 nt, Rubella virus
accugcauuucaccaaccug

SEQ ID NO: 4049711 - RNA, 20 nt, Rubella virus
acgccagcgacgugcugccc

SEQ ID NO: 4049712 - RNA, 15 nt, Rubella virus
acgcccacaccacca

SEQ ID NO: 4049713 - RNA, 15 nt, Rubella virus
acgcgcuggcaccga

SEQ ID NO: 4049714 - RNA, 22 nt, Rubella virus
acggucgccguuggcaccgcgc

SEQ ID NO: 4049715 - RNA, 18 nt, Rubella virus
acguuagcgccaccccgc

SEQ ID NO: 4049716 - RNA, 18 nt, Rubella virus
acuccacauacgcgcugg

SEQ ID NO: 4049717 - RNA, 19 nt, Rubella virus
acucgacgaggacggccgc

SEQ ID NO: 4049718 - RNA, 15 nt, Rubella virus
acugccccuggaccc

SEQ ID NO: 4049719 - RNA, 13 nt, Rubella virus
agacccgcucggc

SEQ ID NO: 4049720 - RNA, 21 nt, Rubella virus
agauccccgcaccuguugcug

SEQ ID NO: 4049721 - RNA, 19 nt, Rubella virus
agcagucccgguggggccu

SEQ ID NO: 4049722 - RNA, 21 nt, Rubella virus
agcgccucgcuagugggcccc

SEQ ID NO: 4049723 - RNA, 18 nt, Rubella virus
agcguguucgcccuugcu

SEQ ID NO: 4049724 - RNA, 14 nt, Rubella virus
aggcgagcgcaccu

SEQ ID NO: 4049725 - RNA, 18 nt, Rubella virus
agggcuugggggccuggg

SEQ ID NO: 4049726 - RNA, 18 nt, Rubella virus
auggcgaggaccucggcg

SEQ ID NO: 4049727 - RNA, 19 nt, Rubella virus
auuuauggugugccgccgc

SEQ ID NO: 4049728 - RNA, 20 nt, Rubella virus
caacccuugcgggcccgagc

SEQ ID NO: 4049729 - RNA, 18 nt, Rubella virus
caacgccauuccccugac

SEQ ID NO: 4049730 - RNA, 22 nt, Rubella virus
cacaccaccagcgaccccuggc

SEQ ID NO: 4049731 - RNA, 13 nt, Rubella virus
caccaccgcggcg

SEQ ID NO: 4049732 - RNA, 18 nt, Rubella virus
cacccaccgaggccugcg

SEQ ID NO: 4049733 - RNA, 14 nt, Rubella virus
caccgacugcugcg

SEQ ID NO: 4049734 - RNA, 16 nt, Rubella virus
caccuucugggcuguc

SEQ ID NO: 4049735 - RNA, 20 nt, Rubella virus
cacgacccugacaccgaggc

SEQ ID NO: 4049736 - RNA, 21 nt, Rubella virus
cacguuagcgccaccccgcaa

SEQ ID NO: 4049737 - RNA, 16 nt, Rubella virus
cacuagauccccgcac

SEQ ID NO: 4049738 - RNA, 22 nt, Rubella virus
cacugcaccggggugcgccacu

SEQ ID NO: 4049739 - RNA, 16 nt, Rubella virus
cagacuccggccccga

SEQ ID NO: 4049740 - RNA, 15 nt, Rubella virus
cagagcgcccccggc

SEQ ID NO: 4049741 - RNA, 15 nt, Rubella virus
cagcauuacggccac

SEQ ID NO: 4049742 - RNA, 17 nt, Rubella virus
cagcgacgcggccugcu

SEQ ID NO: 4049743 - RNA, 20 nt, Rubella virus
cagcgacgugcugcccggcc

SEQ ID NO: 4049744 - RNA, 16 nt, Rubella virus
cagcucacucugggcg

SEQ ID NO: 4049745 - RNA, 12 nt, Rubella virus
cagggccccgcc

SEQ ID NO: 4049746 - RNA, 14 nt, Rubella virus
cagugcgguacccc

SEQ ID NO: 4049747 - RNA, 16 nt, Rubella virus
cauccaccgggccccu

SEQ ID NO: 4049748 - RNA, 16 nt, Rubella virus
cauccaggcgcccgcu

SEQ ID NO: 4049749 - RNA, 20 nt, Rubella virus
cauccaggcgcccgcugccc

SEQ ID NO: 4049750 - RNA, 14 nt, Rubella virus
ccaaccugggcacc

SEQ ID NO: 4049751 - RNA, 11 nt, Rubella virus
ccacaccacca

SEQ ID NO: 4049752 - RNA, 19 nt, Rubella virus
ccacagcgaacgcgcuguc

SEQ ID NO: 4049753 - RNA, 12 nt, Rubella virus
ccaccgggcccc

SEQ ID NO: 4049754 - RNA, 15 nt, Rubella virus
ccacgaccgccgcca

SEQ ID NO: 4049755 - RNA, 12 nt, Rubella virus
ccacucgcuggc

SEQ ID NO: 4049756 - RNA, 15 nt, Rubella virus
ccagacuccggcccc

SEQ ID NO: 4049757 - RNA, 17 nt, Rubella virus
ccagugcgcggccucga

SEQ ID NO: 4049758 - RNA, 14 nt, Rubella virus
ccaugggaccucga

SEQ ID NO: 4049759 - RNA, 13 nt, Rubella virus
ccccugccacgcc

SEQ ID NO: 4049760 - RNA, 23 nt, Rubella virus
ccccugggaaguucgucaccgcc

SEQ ID NO: 4049761 - RNA, 19 nt, Rubella virus
cccgagccgcccgcucacg

SEQ ID NO: 4049762 - RNA, 14 nt, Rubella virus
cccgagcuggggcc

SEQ ID NO: 4049763 - RNA, 14 nt, Rubella virus
cccgcaccuguugc

SEQ ID NO: 4049764 - RNA, 15 nt, Rubella virus
cccgcaccuguugcu

SEQ ID NO: 4049765 - RNA, 16 nt, Rubella virus
cccgcacuaggccacu

SEQ ID NO: 4049766 - RNA, 16 nt, Rubella virus
cccugcugcgcacugc

SEQ ID NO: 4049767 - RNA, 17 nt, Rubella virus
cccugcugcgcacugcc

SEQ ID NO: 4049768 - RNA, 13 nt, Rubella virus
ccgaccgccgccc

SEQ ID NO: 4049769 - RNA, 13 nt, Rubella virus
ccgccgccacccc

SEQ ID NO: 4049770 - RNA, 20 nt, Rubella virus
ccgcgccccgagcuggggcc

SEQ ID NO: 4049771 - RNA, 22 nt, Rubella virus
ccgcgcgaaacccgcacuaggc

SEQ ID NO: 4049772 - RNA, 13 nt, Rubella virus
ccgguggcccugc

SEQ ID NO: 4049773 - RNA, 22 nt, Rubella virus
ccguucugcaacacgccgcacg

SEQ ID NO: 4049774 - RNA, 21 nt, Rubella virus
ccuccucaacacccccccgcc

SEQ ID NO: 4049775 - RNA, 16 nt, Rubella virus
ccucgaggccacugga

SEQ ID NO: 4049776 - RNA, 18 nt, Rubella virus
ccucgcuagugggccccc

SEQ ID NO: 4049777 - RNA, 18 nt, Rubella virus
ccugcagggguacaaccc

SEQ ID NO: 4049778 - RNA, 14 nt, Rubella virus
ccugcgcccgccuc

SEQ ID NO: 4049779 - RNA, 15 nt, Rubella virus
ccuucguccugcugg

SEQ ID NO: 4049780 - RNA, 19 nt, Rubella virus
ccuugcgcgcgcaucugga

SEQ ID NO: 4049781 - RNA, 14 nt, Rubella virus
ccuuggcgcauccg

SEQ ID NO: 4049782 - RNA, 17 nt, Rubella virus
cgacgacccccugcugc

SEQ ID NO: 4049783 - RNA, 18 nt, Rubella virus
cgacgacccccugcugcg

SEQ ID NO: 4049784 - RNA, 14 nt, Rubella virus
cgcacugccccugg

SEQ ID NO: 4049785 - RNA, 21 nt, Rubella virus
cgcagggacugguccagggcc

SEQ ID NO: 4049786 - RNA, 18 nt, Rubella virus
cgccacucaagcaccugu

SEQ ID NO: 4049787 - RNA, 20 nt, Rubella virus
cgccacugcgccggcccccu

SEQ ID NO: 4049788 - RNA, 13 nt, Rubella virus
cgccauccuuggc

SEQ ID NO: 4049789 - RNA, 14 nt, Rubella virus
cgccauuugcgccc

SEQ ID NO: 4049790 - RNA, 18 nt, Rubella virus
cgccauuugcgcccuccc

SEQ ID NO: 4049791 - RNA, 17 nt, Rubella virus
cgcccauccaggcgccc

SEQ ID NO: 4049792 - RNA, 21 nt, Rubella virus
cgccccgagcuggggccaccg

SEQ ID NO: 4049793 - RNA, 20 nt, Rubella virus
cgccgcccuccucaacaccc

SEQ ID NO: 4049794 - RNA, 18 nt, Rubella virus
cgccgccgcggcgccgcc

SEQ ID NO: 4049795 - RNA, 19 nt, Rubella virus
cgcgaaacccgcacuaggc

SEQ ID NO: 4049796 - RNA, 11 nt, Rubella virus
cgcgcagcugg

SEQ ID NO: 4049797 - RNA, 13 nt, Rubella virus
cgcgccgggcucc

SEQ ID NO: 4049798 - RNA, 21 nt, Rubella virus
cgcugauauggcggcaccucc

SEQ ID NO: 4049799 - RNA, 18 nt, Rubella virus
cgcugucucuugaucacg

SEQ ID NO: 4049800 - RNA, 17 nt, Rubella virus
cggagggccccgccgcc

SEQ ID NO: 4049801 - RNA, 17 nt, Rubella virus
cggccccgauugggccu

SEQ ID NO: 4049802 - RNA, 21 nt, Rubella virus
cggccgcugggacccugcgcu

SEQ ID NO: 4049803 - RNA, 17 nt, Rubella virus
cgggcccgagccgcccg

SEQ ID NO: 4049804 - RNA, 20 nt, Rubella virus
cggucgccguuggcaccgcg

SEQ ID NO: 4049805 - RNA, 15 nt, Rubella virus
cggugccccccaggc

SEQ ID NO: 4049806 - RNA, 13 nt, Rubella virus
cgguggggccucg

SEQ ID NO: 4049807 - RNA, 14 nt, Rubella virus
cgucaccgccgccc

SEQ ID NO: 4049808 - RNA, 19 nt, Rubella virus
cguggccugcgcccgccuc

SEQ ID NO: 4049809 - RNA, 18 nt, Rubella virus
cuaccaagucagcugcgg

SEQ ID NO: 4049810 - RNA, 14 nt, Rubella virus
cuccacgacccuga

SEQ ID NO: 4049811 - RNA, 18 nt, Rubella virus
cucguggcuuuggagcga

SEQ ID NO: 4049812 - RNA, 19 nt, Rubella virus
cugcaccggggugcgccac

SEQ ID NO: 4049813 - RNA, 11 nt, Rubella virus
cugccacgccg

SEQ ID NO: 4049814 - RNA, 16 nt, Rubella virus
cugccccgcgccccga

SEQ ID NO: 4049815 - RNA, 17 nt, Rubella virus
cuggaccguacggccau

SEQ ID NO: 4049816 - RNA, 14 nt, Rubella virus
cuggcggcagcuac

SEQ ID NO: 4049817 - RNA, 19 nt, Rubella virus
cugggcacccccccacucg

SEQ ID NO: 4049818 - RNA, 22 nt, Rubella virus
cugggcgccauuugcgcccucc

SEQ ID NO: 4049819 - RNA, 20 nt, Rubella virus
cuggggccaccgaccaaccc

SEQ ID NO: 4049820 - RNA, 15 nt, Rubella virus
cugggugcgggccga

SEQ ID NO: 4049821 - RNA, 16 nt, Rubella virus
cuucccccccacacca

SEQ ID NO: 4049822 - RNA, 17 nt, Rubella virus
cuugcuccccagccucg

SEQ ID NO: 4049823 - RNA, 18 nt, Rubella virus
cuugugggggccacgcca

SEQ ID NO: 4049824 - RNA, 14 nt, Rubella virus
gacaccgaggcacc

SEQ ID NO: 4049825 - RNA, 22 nt, Rubella virus
cgaggccugcgugaccucgugg

SEQ ID NO: 4049826 - RNA, 12 nt, Rubella virus
cgccccccccgg

SEQ ID NO: 4049827 - RNA, 20 nt, Rubella virus
cgccccgaagacggcuggac

SEQ ID NO: 4049828 - RNA, 18 nt, Rubella virus
cgccccgagcuggggcca

SEQ ID NO: 4049829 - RNA, 13 nt, Rubella virus
cgccccgcuuccc

SEQ ID NO: 4049830 - RNA, 19 nt, Rubella virus
cgcccgaccccggggaccu

SEQ ID NO: 4049831 - RNA, 12 nt, Rubella virus
cgccgccacccc

SEQ ID NO: 4049832 - RNA, 12 nt, Rubella virus
cgccgcgccugu

SEQ ID NO: 4049833 - RNA, 19 nt, Rubella virus
cgccgggcuccagccccgc

SEQ ID NO: 4049834 - RNA, 16 nt, Rubella virus
cgccuacuccucuggc

SEQ ID NO: 4049835 - RNA, 12 nt, Rubella virus
cgccugcgccac

SEQ ID NO: 4049836 - RNA, 22 nt, Rubella virus
cgcgaaacccgcacuaggccac

SEQ ID NO: 4049837 - RNA, 19 nt, Rubella virus
cgcggcuugugggggccac

SEQ ID NO: 4049838 - RNA, 13 nt, Rubella virus
cgcguggccugcg

SEQ ID NO: 4049839 - RNA, 17 nt, Rubella virus
cgcuagugggcccccgc

SEQ ID NO: 4049840 - RNA, 23 nt, Rubella virus
cgcucggcgcgccauccuuggcg

SEQ ID NO: 4049841 - RNA, 15 nt, Rubella virus
cgcugccgcagcccc

SEQ ID NO: 4049842 - RNA, 17 nt, Rubella virus
cggagugggcugcugcc

SEQ ID NO: 4049843 - RNA, 16 nt, Rubella virus
cggcacgcgcuggcac

SEQ ID NO: 4049844 - RNA, 15 nt, Rubella virus
cggccacuggcucca

SEQ ID NO: 4049845 - RNA, 19 nt, Rubella virus
cggcccucuggcucgccac

SEQ ID NO: 4049846 - RNA, 15 nt, Rubella virus
cggccugcuggggcu

SEQ ID NO: 4049847 - RNA, 23 nt, Rubella virus
cgggagcccgaauugccacggcc

SEQ ID NO: 4049848 - RNA, 17 nt, Rubella virus
cgggccgaugcgccugc

SEQ ID NO: 4049849 - RNA, 19 nt, Rubella virus
cgggcgugggggcucugcc

SEQ ID NO: 4049850 - RNA, 16 nt, Rubella virus
cgggcucuugcucgcc

SEQ ID NO: 4049851 - RNA, 17 nt, Rubella virus
cgucaccgccgcccucc

SEQ ID NO: 4049852 - RNA, 16 nt, Rubella virus
cguccagcacccucac

SEQ ID NO: 4049853 - RNA, 22 nt, Rubella virus
cgugggggcucugccccgcgcc

SEQ ID NO: 4049854 - RNA, 15 nt, Rubella virus
cuaccucugcacugc

SEQ ID NO: 4049855 - RNA, 13 nt, Rubella virus
cucacucugggcg

SEQ ID NO: 4049856 - RNA, 14 nt, Rubella virus
cucacucugggcgc

SEQ ID NO: 4049857 - RNA, 20 nt, Rubella virus
cucuggcggguacgcgcagc

SEQ ID NO: 4049858 - RNA, 17 nt, Rubella virus
cucuggcucgccacagc

SEQ ID NO: 4049859 - RNA, 13 nt, Rubella virus
cugacugcucgcg

SEQ ID NO: 4049860 - RNA, 22 nt, Rubella virus
cugccacgcacguuagcgccac

SEQ ID NO: 4049861 - RNA, 15 nt, Rubella virus
cugcccggccacugg

SEQ ID NO: 4049862 - RNA, 20 nt, Rubella virus
cugccgcagccccccugugc

SEQ ID NO: 4049863 - RNA, 17 nt, Rubella virus
cugccguuccucgggca

SEQ ID NO: 4049864 - RNA, 18 nt, Rubella virus
cugccguuccucgggcac

SEQ ID NO: 4049865 - RNA, 22 nt, Rubella virus
cugcuuugccccaugggaccuc

SEQ ID NO: 4049866 - RNA, 18 nt, Rubella virus
cuggcaccgacugcugcg

SEQ ID NO: 4049867 - RNA, 21 nt, Rubella virus
cugggcggagugggcugcugc

SEQ ID NO: 4049868 - RNA, 17 nt, Rubella virus
cugguccagggccccgc

SEQ ID NO: 4049869 - RNA, 17 nt, Rubella virus
cuggucccguggguccu

SEQ ID NO: 4049870 - RNA, 14 nt, Rubella virus
cuguccaccaccgc

SEQ ID NO: 4049871 - RNA, 16 nt, Rubella virus
cuuccccccugggaac

SEQ ID NO: 4049872 - RNA, 16 nt, Rubella virus
cuugccgggcucuugc

SEQ ID NO: 4049873 - RNA, 15 nt, Rubella virus
gaaacgccagcgacg

SEQ ID NO: 4049874 - RNA, 22 nt, Rubella virus
gacccgcucggcgcgccauccu

SEQ ID NO: 4049875 - RNA, 14 nt, Rubella virus
gaccguacggccau

SEQ ID NO: 4049876 - RNA, 19 nt, Rubella virus
gaccucggcgccguccccc

SEQ ID NO: 4049877 - RNA, 11 nt, Rubella virus
gaccugggcgg

SEQ ID NO: 4049878 - RNA, 18 nt, Rubella virus
gacgcgcgacuugcuccc

SEQ ID NO: 4049879 - RNA, 12 nt, Rubella virus
gacggcgacagc

SEQ ID NO: 4049880 - RNA, 19 nt, Rubella virus
gacggcggcugcuuugccc

SEQ ID NO: 4049881 - RNA, 19 nt, Rubella virus
gacuccggagggccccgcc

SEQ ID NO: 4049882 - RNA, 19 nt, Rubella virus
gacugguccagggccccgc

SEQ ID NO: 4049883 - RNA, 16 nt, Rubella virus
gagugggcugcugccc

SEQ ID NO: 4049884 - RNA, 19 nt, Rubella virus
gauccacgcccacaccacc

SEQ ID NO: 4049885 - RNA, 17 nt, Rubella virus
gcacacacaccacugcu

SEQ ID NO: 4049886 - RNA, 16 nt, Rubella virus
gcaccuucugggcugu

SEQ ID NO: 4049887 - RNA, 16 nt, Rubella virus
gcacuaggccacuaga

SEQ ID NO: 4049888 - RNA, 22 nt, Rubella virus
gcagccguggcgcguggccugc

SEQ ID NO: 4049889 - RNA, 13 nt, Rubella virus
gcauuacggccac

SEQ ID NO: 4049890 - RNA, 22 nt, Rubella virus
gccaacgccauuccccugacug

SEQ ID NO: 4049891 - RNA, 21 nt, Rubella virus
gccacagcgaacgcgcugucu

SEQ ID NO: 4049892 - RNA, 18 nt, Rubella virus
gccacccccgccacugcg

SEQ ID NO: 4049893 - RNA, 19 nt, Rubella virus
gcccacaccaccagcgacc

SEQ ID NO: 4049894 - RNA, 19 nt, Rubella virus
gccccgagcuggggccacc

SEQ ID NO: 4049895 - RNA, 14 nt, Rubella virus
gcccgguggcccug

SEQ ID NO: 4049896 - RNA, 13 nt, Rubella virus
gcccucaccgcgg

SEQ ID NO: 4049897 - RNA, 13 nt, Rubella virus
gccgcccgcucac

SEQ ID NO: 4049898 - RNA, 15 nt, Rubella virus
gccuacuccucuggc

SEQ ID NO: 4049899 - RNA, 17 nt, Rubella virus
gccucgcuagugggccc

SEQ ID NO: 4049900 - RNA, 21 nt, Rubella virus
gccucuuacuucaacccuggc

SEQ ID NO: 4049901 - RNA, 22 nt, Rubella virus
gccucuuacuucaacccuggcg

SEQ ID NO: 4049902 - RNA, 23 nt, Rubella virus
gccugcgugaccucguggcuuug

SEQ ID NO: 4049903 - RNA, 19 nt, Rubella virus
gccuggguacccgcagccc

SEQ ID NO: 4049904 - RNA, 20 nt, Rubella virus
gccuuccccccugggaacug

SEQ ID NO: 4049905 - RNA, 14 nt, Rubella virus
gcgaucgcgcgacc

SEQ ID NO: 4049906 - RNA, 15 nt, Rubella virus
gcgcacgggcagcau

SEQ ID NO: 4049907 - RNA, 20 nt, Rubella virus
gcgcaucuggaauggcacac

SEQ ID NO: 4049908 - RNA, 15 nt, Rubella virus
gcgcgucggccagca

SEQ ID NO: 4049909 - RNA, 22 nt, Rubella virus
gcgcugguggaaggccuugccc

SEQ ID NO: 4049910 - RNA, 22 nt, Rubella virus
gcggcugggguugcuacaaccu

SEQ ID NO: 4049911 - RNA, 20 nt, Rubella virus
gcgugcccgcccauccaggc

SEQ ID NO: 4049912 - RNA, 17 nt, Rubella virus
gcgugggggcucugccc

SEQ ID NO: 4049913 - RNA, 17 nt, Rubella virus
gcguguucgcccuugcu

SEQ ID NO: 4049914 - RNA, 18 nt, Rubella virus
gcucugccccgcgccccg

SEQ ID NO: 4049915 - RNA, 14 nt, Rubella virus
gcugcgcacugccc

SEQ ID NO: 4049916 - RNA, 22 nt, Rubella virus
gcugcuuugccccaugggaccu

SEQ ID NO: 4049917 - RNA, 21 nt, Rubella virus
gcugggguugcuacaaccuga

SEQ ID NO: 4049918 - RNA, 17 nt, Rubella virus
gcuucuugucugggugc

SEQ ID NO: 4049919 - RNA, 13 nt, Rubella virus
ggacacagcgacg

SEQ ID NO: 4049920 - RNA, 14 nt, Rubella virus
ggaccguacggcca

SEQ ID NO: 4049921 - RNA, 12 nt, Rubella virus
ggagugggcugc

SEQ ID NO: 4049922 - RNA, 18 nt, Rubella virus
ggcacccaccgaggccug

SEQ ID NO: 4049923 - RNA, 19 nt, Rubella virus
ggccccgauugggccuccc

SEQ ID NO: 4049924 - RNA, 14 nt, Rubella virus
ggcccucuggcucg

SEQ ID NO: 4049925 - RNA, 17 nt, Rubella virus
ggcccucuggcucgcca

SEQ ID NO: 4049926 - RNA, 16 nt, Rubella virus
ggccugcgcccgccuc

SEQ ID NO: 4049927 - RNA, 13 nt, Rubella virus
ggcgccgccgccg

SEQ ID NO: 4049928 - RNA, 14 nt, Rubella virus
ggcucuugcucgcc

SEQ ID NO: 4049929 - RNA, 23 nt, Rubella virus
ggcugcgcuaugcgguggggccu

SEQ ID NO: 4049930 - RNA, 14 nt, Rubella virus
gggccccgccgccg

SEQ ID NO: 4049931 - RNA, 14 nt, Rubella virus
gggcuccagccccg

SEQ ID NO: 4049932 - RNA, 16 nt, Rubella virus
gggcuugggggccugg

SEQ ID NO: 4049933 - RNA, 17 nt, Rubella virus
gucccgguggggccucg

SEQ ID NO: 4049934 - RNA, 24 nt, Rubella virus
gucgccguuggcaccgcgcgcgcc

SEQ ID NO: 4049935 - RNA, 18 nt, Rubella virus
gucggagacccggcagac

SEQ ID NO: 4049936 - RNA, 16 nt, Rubella virus
gugcaccuucugggcu

SEQ ID NO: 4049937 - RNA, 16 nt, Rubella virus
uaccaagucagcugcg

SEQ ID NO: 4049938 - RNA, 21 nt, Rubella virus
uacgcugccgcagccccccug

SEQ ID NO: 4049939 - RNA, 14 nt, Rubella virus
uacggccaccacca

SEQ ID NO: 4049940 - RNA, 22 nt, Rubella virus
ucagcagucccgguggggccuc

SEQ ID NO: 4049941 - RNA, 21 nt, Rubella virus
ucccagacuccggccccgaag

SEQ ID NO: 4049942 - RNA, 21 nt, Rubella virus
uccccagccucggcccucugg

SEQ ID NO: 4049943 - RNA, 14 nt, Rubella virus
uccccugacugcuc

SEQ ID NO: 4049944 - RNA, 14 nt, Rubella virus
uccgcgucggcggc

SEQ ID NO: 4049945 - RNA, 20 nt, Rubella virus
uccgcuucggugccccccag

SEQ ID NO: 4049946 - RNA, 18 nt, Rubella virus
uccggagggccccgccgc

SEQ ID NO: 4049947 - RNA, 23 nt, Rubella virus
ugacuccggagggccccgccgcc

SEQ ID NO: 4049948 - RNA, 17 nt, Rubella virus
ugccccccaggccuucc

SEQ ID NO: 4049949 - RNA, 13 nt, Rubella virus
ugccgcagccccc

SEQ ID NO: 4049950 - RNA, 15 nt, Rubella virus
ugcgcacugccccug

SEQ ID NO: 4049951 - RNA, 20 nt, Rubella virus
uggcacacacaccacugcug

SEQ ID NO: 4049952 - RNA, 18 nt, Rubella virus
uggcaccgacugcugcgc

SEQ ID NO: 4049953 - RNA, 15 nt, Rubella virus
uggcaccgcgcgcgc

SEQ ID NO: 4049954 - RNA, 16 nt, Rubella virus
ugggccuccccgguuu

SEQ ID NO: 4049955 - RNA, 15 nt, Rubella virus
ugucgccgccgcggc

SEQ ID NO: 4049956 - RNA, 16 nt, Rubella virus
uugaucacgcccucgc

SEQ ID NO: 4049957 - RNA, 23 nt, Rubella virus
cgcccgcgaccccgacgccucuc

SEQ ID NO: 4049958 - RNA, 13 nt, Rubella virus
cgccgccgcggcg

SEQ ID NO: 4049959 - RNA, 15 nt, Rubella virus
cgccugcgccacggc

SEQ ID NO: 4049960 - RNA, 14 nt, Rubella virus
cgcggccugcuggg

SEQ ID NO: 4049961 - RNA, 21 nt, Rubella virus
cgcggccuucguccugcuggu

SEQ ID NO: 4049962 - RNA, 14 nt, Rubella virus
cgcugggacccugc

SEQ ID NO: 4049963 - RNA, 12 nt, Rubella virus
cggagacccggc

SEQ ID NO: 4049964 - RNA, 15 nt, Rubella virus
cggcagaccugggcg

SEQ ID NO: 4049965 - RNA, 20 nt, Rubella virus
cggccaucauggcggcaccu

SEQ ID NO: 4049966 - RNA, 14 nt, Rubella virus
cggcccccugccac

SEQ ID NO: 4049967 - RNA, 18 nt, Rubella virus
cggccccgauugggccuc

SEQ ID NO: 4049968 - RNA, 19 nt, Rubella virus
cggccccgauugggccucc

SEQ ID NO: 4049969 - RNA, 20 nt, Rubella virus
cggccccgauugggccuccc

SEQ ID NO: 4049970 - RNA, 19 nt, Rubella virus
cggccugcuggggcuuccc

SEQ ID NO: 4049971 - RNA, 14 nt, Rubella virus
cggcgacagcgccc

SEQ ID NO: 4049972 - RNA, 20 nt, Rubella virus
cggcgccgccgccgcccuca

SEQ ID NO: 4049973 - RNA, 19 nt, Rubella virus
cggcgcuauagcgccucgc

SEQ ID NO: 4049974 - RNA, 16 nt, Rubella virus
cggcugcgccuggucg

SEQ ID NO: 4049975 - RNA, 20 nt, Rubella virus
cgggccgaugcgccugcgcc

SEQ ID NO: 4049976 - RNA, 13 nt, Rubella virus
cggggccguggcc

SEQ ID NO: 4049977 - RNA, 16 nt, Rubella virus
cguccuuaccgcccgc

SEQ ID NO: 4049978 - RNA, 17 nt, Rubella virus
cuacccgguuuggcugc

SEQ ID NO: 4049979 - RNA, 18 nt, Rubella virus
cuccacgacccugacacc

SEQ ID NO: 4049980 - RNA, 22 nt, Rubella virus
cuccacgaccgccgccaccccc

SEQ ID NO: 4049981 - RNA, 15 nt, Rubella virus
cuccucaacaccccc

SEQ ID NO: 4049982 - RNA, 19 nt, Rubella virus
cucgaggccacuggagccu

SEQ ID NO: 4049983 - RNA, 20 nt, Rubella virus
cucgcggcuugugggggcca

SEQ ID NO: 4049984 - RNA, 14 nt, Rubella virus
cucggcccucuggc

SEQ ID NO: 4049985 - RNA, 18 nt, Rubella virus
cugccccgcgccccgagc

SEQ ID NO: 4049986 - RNA, 21 nt, Rubella virus
cugccgcagccccccugugcg

SEQ ID NO: 4049987 - RNA, 15 nt, Rubella virus
cuggcaccagggcac

SEQ ID NO: 4049988 - RNA, 22 nt, Rubella virus
cuggcggguacgcgcagcuggc

SEQ ID NO: 4049989 - RNA, 23 nt, Rubella virus
cugugcgcacgggcagcauuacg

SEQ ID NO: 4049990 - RNA, 12 nt, Rubella virus
cuguugcuguau

SEQ ID NO: 4049991 - RNA, 14 nt, Rubella virus
cuguugcuguauag

SEQ ID NO: 4049992 - RNA, 16 nt, Rubella virus
cuugaucacgcccucg

SEQ ID NO: 4049993 - RNA, 21 nt, Rubella virus
gaccugggcggagugggcugc

SEQ ID NO: 4049994 - RNA, 17 nt, Rubella virus
gacgacccccugcugcg

SEQ ID NO: 4049995 - RNA, 14 nt, Rubella virus
gacgcggccugcug

SEQ ID NO: 4049996 - RNA, 16 nt, Rubella virus
gacuccggagggcccc

SEQ ID NO: 4049997 - RNA, 23 nt, Rubella virus
gacuugcuccccagccucggccc

SEQ ID NO: 4049998 - RNA, 12 nt, Rubella virus
gagcuggggcca

SEQ ID NO: 4049999 - RNA, 23 nt, Rubella virus
gaggcuuucaccuaccucugcac

SEQ ID NO: 4050000 - RNA, 18 nt, Rubella virus
gcaccuacgccgagcagg

SEQ ID NO: 4050001 - RNA, 17 nt, Rubella virus
gcagccccuugcgcgcg

SEQ ID NO: 4050002 - RNA, 22 nt, Rubella virus
gcauuucaccaaccugggcacc

SEQ ID NO: 4050003 - RNA, 16 nt, Rubella virus
gccacugcgccggccc

SEQ ID NO: 4050004 - RNA, 16 nt, Rubella virus
gccagcgacgugcugc

SEQ ID NO: 4050005 - RNA, 17 nt, Rubella virus
gccaucauggcggcacc

SEQ ID NO: 4050006 - RNA, 19 nt, Rubella virus
gcccgaauugccacggccc

SEQ ID NO: 4050007 - RNA, 21 nt, Rubella virus
gcccgcucacgucguccgcgc

SEQ ID NO: 4050008 - RNA, 16 nt, Rubella virus
gccgcgccugucgccg

SEQ ID NO: 4050009 - RNA, 17 nt, Rubella virus
gccgcgccugucgccgc

SEQ ID NO: 4050010 - RNA, 17 nt, Rubella virus
gccggcccccugccacg

SEQ ID NO: 4050011 - RNA, 23 nt, Rubella virus
gccgugacuccggagggccccgc

SEQ ID NO: 4050012 - RNA, 14 nt, Rubella virus
gccguuggcaccgc

SEQ ID NO: 4050013 - RNA, 20 nt, Rubella virus
gccucuuacuucaacccugg

SEQ ID NO: 4050014 - RNA, 14 nt, Rubella virus
gcgacgcggccugc

SEQ ID NO: 4050015 - RNA, 13 nt, Rubella virus
gcgccccgagcug

SEQ ID NO: 4050016 - RNA, 21 nt, Rubella virus
gcgccccgagcuggggccacc

SEQ ID NO: 4050017 - RNA, 13 nt, Rubella virus
gcgccugcgccac

SEQ ID NO: 4050018 - RNA, 18 nt, Rubella virus
gcgcucauguacaacccu

SEQ ID NO: 4050019 - RNA, 15 nt, Rubella virus
gcggccucgacggcg

SEQ ID NO: 4050020 - RNA, 15 nt, Rubella virus
gcggcugcuuugccc

SEQ ID NO: 4050021 - RNA, 15 nt, Rubella virus
gcggcuucuugucug

SEQ ID NO: 4050022 - RNA, 18 nt, Rubella virus
gcgugggggcucugcccc

SEQ ID NO: 4050023 - RNA, 15 nt, Rubella virus
gcuacguccagcacc

SEQ ID NO: 4050024 - RNA, 15 nt, Rubella virus
gcucacucugggcgc

SEQ ID NO: 4050025 - RNA, 19 nt, Rubella virus
gcuccaaggcggcuggggu

SEQ ID NO: 4050026 - RNA, 15 nt, Rubella virus
gcuccagccccgcgc

SEQ ID NO: 4050027 - RNA, 12 nt, Rubella virus
gcucugccccgc

SEQ ID NO: 4050028 - RNA, 17 nt, Rubella virus
gcugcccggccacuggc

SEQ ID NO: 4050029 - RNA, 16 nt, Rubella virus
gcugcgcacugccccu

SEQ ID NO: 4050030 - RNA, 19 nt, Rubella virus
gcuggcaccgacugcugcg

SEQ ID NO: 4050031 - RNA, 19 nt, Rubella virus
gcuucccccccacaccacc

SEQ ID NO: 4050032 - RNA, 22 nt, Rubella virus
gcuucggugccccccaggccuu

SEQ ID NO: 4050033 - RNA, 20 nt, Rubella virus
ggacacagcgacgcggccug

SEQ ID NO: 4050034 - RNA, 15 nt, Rubella virus
ggaccucggcgccgu

SEQ ID NO: 4050035 - RNA, 18 nt, Rubella virus
ggacugguccagggcccc

SEQ ID NO: 4050036 - RNA, 21 nt, Rubella virus
ggagcccgaauugccacggcc

SEQ ID NO: 4050037 - RNA, 14 nt, Rubella virus
ggagggccccgccg

SEQ ID NO: 4050038 - RNA, 19 nt, Rubella virus
ggcacccaccgaggccugc

SEQ ID NO: 4050039 - RNA, 16 nt, Rubella virus
ggcagcauuacggcca

SEQ ID NO: 4050040 - RNA, 17 nt, Rubella virus
ggcauccaccgggcccc

SEQ ID NO: 4050041 - RNA, 16 nt, Rubella virus
ggccacuggagccugc

SEQ ID NO: 4050042 - RNA, 22 nt, Rubella virus
ggccagcgcagggacuggucca

SEQ ID NO: 4050043 - RNA, 17 nt, Rubella virus
ggccaucauggcggcac

SEQ ID NO: 4050044 - RNA, 21 nt, Rubella virus
ggccccgccccccccggagga

SEQ ID NO: 4050045 - RNA, 14 nt, Rubella virus
ggccuuccuugccg

SEQ ID NO: 4050046 - RNA, 16 nt, Rubella virus
ggcgccguccccccug

SEQ ID NO: 4050047 - RNA, 13 nt, Rubella virus
ggcgcguggccug

SEQ ID NO: 4050048 - RNA, 14 nt, Rubella virus
ggcgcguggccugc

SEQ ID NO: 4050049 - RNA, 20 nt, Rubella virus
ggcgugggggcucugccccg

SEQ ID NO: 4050050 - RNA, 15 nt, Rubella virus
ggcucuugcucgcca

SEQ ID NO: 4050051 - RNA, 18 nt, Rubella virus
ggcuguccaccaccgccc

SEQ ID NO: 4050052 - RNA, 20 nt, Rubella virus
gggggaggcaauugccaucu

SEQ ID NO: 4050053 - RNA, 21 nt, Rubella virus
guaccacccuaccgcgugcga

SEQ ID NO: 4050054 - RNA, 13 nt, Rubella virus
guccccccuggga

SEQ ID NO: 4050055 - RNA, 21 nt, Rubella virus
gugagccccaugggacgcgcg

SEQ ID NO: 4050056 - RNA, 13 nt, Rubella virus
gugcgcggccucg

SEQ ID NO: 4050057 - RNA, 15 nt, Rubella virus
guggaaggccuugcc

SEQ ID NO: 4050058 - RNA, 14 nt, Rubella virus
guggcccugccacg

SEQ ID NO: 4050059 - RNA, 15 nt, Rubella virus
gugggggcucugccc

SEQ ID NO: 4050060 - RNA, 22 nt, Rubella virus
guugaucugcgggcuguccacc

SEQ ID NO: 4050061 - RNA, 21 nt, Rubella virus
uaccagugcgguacccccgcg

SEQ ID NO: 4050062 - RNA, 13 nt, Rubella virus
uaccgcccgcccc

SEQ ID NO: 4050063 - RNA, 22 nt, Rubella virus
uagauccccgcaccuguugcug

SEQ ID NO: 4050064 - RNA, 14 nt, Rubella virus
uauggcggcaccuc

SEQ ID NO: 4050065 - RNA, 17 nt, Rubella virus
ucaauggcgaggaccuc

SEQ ID NO: 4050066 - RNA, 19 nt, Rubella virus
ucaauggcgaggaccucgg

SEQ ID NO: 4050067 - RNA, 16 nt, Rubella virus
ucaccaaccugggcac

SEQ ID NO: 4050068 - RNA, 12 nt, Rubella virus
uccccccuggga

SEQ ID NO: 4050069 - RNA, 22 nt, Rubella virus
ucgacgaggacggccgcuggga

SEQ ID NO: 4050070 - RNA, 18 nt, Rubella virus
ucgccgccgcggcgccgc

SEQ ID NO: 4050071 - RNA, 13 nt, Rubella virus
ucuggcucgccac

SEQ ID NO: 4050072 - RNA, 16 nt, Rubella virus
ugagcgacuggcacca

SEQ ID NO: 4050073 - RNA, 21 nt, Rubella virus
ugcauuucaccaaccugggca

SEQ ID NO: 4050074 - RNA, 23 nt, Rubella virus
ugccacggccccgauugggccuc

SEQ ID NO: 4050075 - RNA, 21 nt, Rubella virus
ugcccgaguggauccacgccc

SEQ ID NO: 4050076 - RNA, 17 nt, Rubella virus
ugcccggccacuggcuc

SEQ ID NO: 4050077 - RNA, 19 nt, Rubella virus
ugccgcagccccccugugc

SEQ ID NO: 4050078 - RNA, 20 nt, Rubella virus
ugccuucggacacagcgacg

SEQ ID NO: 4050079 - RNA, 14 nt, Rubella virus
ugcgccucgcuggc

SEQ ID NO: 4050080 - RNA, 15 nt, Rubella virus
ugcgcgucggccagc

SEQ ID NO: 4050081 - RNA, 22 nt, Rubella virus
ugcgcucauguacaacccuugc

SEQ ID NO: 4050082 - RNA, 16 nt, Rubella virus
ugcgggcccgagccgc

SEQ ID NO: 4050083 - RNA, 22 nt, Rubella virus
ugcgguggggccuuccccccug

SEQ ID NO: 4050084 - RNA, 19 nt, Rubella virus
ugcuggggcuuccccaccg

SEQ ID NO: 4050085 - RNA, 14 nt, Rubella virus
uggacccggcgagg

SEQ ID NO: 4050086 - RNA, 19 nt, Rubella virus
ugcgccacggcgcugacac

SEQ ID NO: 4050087 - RNA, 19 nt, Rubella virus
ugcgcccucccacucgcug

SEQ ID NO: 4050088 - RNA, 19 nt, Rubella virus
ugcuacaaccugagcgacu

SEQ ID NO: 4050089 - RNA, 22 nt, Rubella virus
ugcugcccggccacuggcucca

SEQ ID NO: 4050090 - RNA, 22 nt, Rubella virus
ugcugugucggagacccggcag

SEQ ID NO: 4050091 - RNA, 14 nt, Rubella virus
ugcuuugccccaug

SEQ ID NO: 4050092 - RNA, 15 nt, Rubella virus
uggcaccgacugcug

SEQ ID NO: 4050093 - RNA, 14 nt, Rubella virus
uggcgaggaccucg

SEQ ID NO: 4050094 - RNA, 21 nt, Rubella virus
uggcgaggaccucggcgccgu

SEQ ID NO: 4050095 - RNA, 17 nt, Rubella virus
uggcgcguggccugcgc

SEQ ID NO: 4050096 - RNA, 16 nt, Rubella virus
ugggguaaaggcgagc

SEQ ID NO: 4050097 - RNA, 18 nt, Rubella virus
uggguacccgcagccccu

SEQ ID NO: 4050098 - RNA, 13 nt, Rubella virus
uguccccgugcgc

SEQ ID NO: 4050099 - RNA, 17 nt, Rubella virus
ugugucggagacccggc

SEQ ID NO: 4050100 - RNA, 13 nt, Rubella virus
uucguccugcugg

SEQ ID NO: 4050101 - RNA, 22 nt, Rubella virus
uugccgggcucuugcucgccac

SEQ ID NO: 4050102 - RNA, 15 nt, Rubella virus
aacccgcacuaggcc

SEQ ID NO: 4050103 - RNA, 12 nt, Rubella virus
aagucagcugcg

SEQ ID NO: 4050104 - RNA, 13 nt, Rubella virus
gacagcgccccgc

SEQ ID NO: 4050105 - RNA, 17 nt, Rubella virus
gacaguucgcccggugg

SEQ ID NO: 4050106 - RNA, 13 nt, Rubella virus
gaccccggggacc

SEQ ID NO: 4050107 - RNA, 15 nt, Rubella virus
gacgcggccugcugg

SEQ ID NO: 4050108 - RNA, 16 nt, Rubella virus
gacggccgcugggacc

SEQ ID NO: 4050109 - RNA, 20 nt, Rubella virus
gacuuccgcgucggcggcac

SEQ ID NO: 4050110 - RNA, 17 nt, Rubella virus
gagaccaggaccgucug

SEQ ID NO: 4050111 - RNA, 15 nt, Rubella virus
gagggcuugggggcc

SEQ ID NO: 4050112 - RNA, 24 nt, Rubella virus
gagggcuugggggccuggguaccc

SEQ ID NO: 4050113 - RNA, 23 nt, Rubella virus
gcaaaccgggcgugggggcucug

SEQ ID NO: 4050114 - RNA, 14 nt, Rubella virus
gcaccagggcacuc

SEQ ID NO: 4050115 - RNA, 19 nt, Rubella virus
gcacgcgcuggcaccgacu

SEQ ID NO: 4050116 - RNA, 15 nt, Rubella virus
gcacugccccuggac

SEQ ID NO: 4050117 - RNA, 16 nt, Rubella virus
gcauccgcuucggugc

SEQ ID NO: 4050118 - RNA, 17 nt, Rubella virus
gccacccccgccacugc

SEQ ID NO: 4050119 - RNA, 19 nt, Rubella virus
gccagugcgcggccucgac

SEQ ID NO: 4050120 - RNA, 16 nt, Rubella virus
gccaucauggcggcac

SEQ ID NO: 4050121 - RNA, 16 nt, Rubella virus
gcccaguacccgccua

SEQ ID NO: 4050122 - RNA, 18 nt, Rubella virus
gcccauugguggcagcuc

SEQ ID NO: 4050123 - RNA, 23 nt, Rubella virus
gccccgagcuggggccaccgacc

SEQ ID NO: 4050124 - RNA, 18 nt, Rubella virus
gccccgccgccgccgcgg

SEQ ID NO: 4050125 - RNA, 14 nt, Rubella virus
gccccgcgccccga

SEQ ID NO: 4050126 - RNA, 13 nt, Rubella virus
gccccuuggggcu

SEQ ID NO: 4050127 - RNA, 12 nt, Rubella virus
gccgcagccccc

SEQ ID NO: 4050128 - RNA, 14 nt, Rubella virus
gccgcggcaaccgg

SEQ ID NO: 4050129 - RNA, 19 nt, Rubella virus
gccgcugggacccugcgcu

SEQ ID NO: 4050130 - RNA, 20 nt, Rubella virus
gccgugacuccggagggccc

SEQ ID NO: 4050131 - RNA, 13 nt, Rubella virus
gccguggccagcg

SEQ ID NO: 4050132 - RNA, 17 nt, Rubella virus
gccguuccucgggcacg

SEQ ID NO: 4050133 - RNA, 18 nt, Rubella virus
gccucaaugacagcugcg

SEQ ID NO: 4050134 - RNA, 16 nt, Rubella virus
gccucggcccucuggc

SEQ ID NO: 4050135 - RNA, 17 nt, Rubella virus
gccucuccacgacccug

SEQ ID NO: 4050136 - RNA, 17 nt, Rubella virus
gccugcgcccgccucuc

SEQ ID NO: 4050137 - RNA, 13 nt, Rubella virus
gccugcuggggcu

SEQ ID NO: 4050138 - RNA, 15 nt, Rubella virus
gcgaacuccacgacc

SEQ ID NO: 4050139 - RNA, 14 nt, Rubella virus
gcgcacgggcagca

SEQ ID NO: 4050140 - RNA, 18 nt, Rubella virus
gcgcagcuggccucuuac

SEQ ID NO: 4050141 - RNA, 20 nt, Rubella virus
gcgcccccggcugcgccugg

SEQ ID NO: 4050142 - RNA, 14 nt, Rubella virus
gcgccccgagcugg

SEQ ID NO: 4050143 - RNA, 22 nt, Rubella virus
gcgcccgccucuccacgacccu

SEQ ID NO: 4050144 - RNA, 23 nt, Rubella virus
gcgcccgccucuccacgacccug

SEQ ID NO: 4050145 - RNA, 16 nt, Rubella virus
gcgccgggcuccagcc

SEQ ID NO: 4050146 - RNA, 16 nt, Rubella virus
gcgccugcgccacggc

SEQ ID NO: 4050147 - RNA, 13 nt, Rubella virus
gcgcgcgugcacc

SEQ ID NO: 4050148 - RNA, 19 nt, Rubella virus
gcgcguacaaucaaccugc

SEQ ID NO: 4050149 - RNA, 18 nt, Rubella virus
gcgcugauauggcggcac

SEQ ID NO: 4050150 - RNA, 18 nt, Rubella virus
gcggccuucguccugcug

SEQ ID NO: 4050151 - RNA, 19 nt, Rubella virus
gcggcgcuauagcgccucg

SEQ ID NO: 4050152 - RNA, 13 nt, Rubella virus
gcgucggcggcac

SEQ ID NO: 4050153 - RNA, 18 nt, Rubella virus
gcgugcaccuucugggcu

SEQ ID NO: 4050154 - RNA, 15 nt, Rubella virus
gcguggccugcgccc

SEQ ID NO: 4050155 - RNA, 17 nt, Rubella virus
gcuagcuacguccagca

SEQ ID NO: 4050156 - RNA, 17 nt, Rubella virus
gcucgcggcuugugggg

SEQ ID NO: 4050157 - RNA, 18 nt, Rubella virus
gcugcccggccacuggcu

SEQ ID NO: 4050158 - RNA, 19 nt, Rubella virus
gcugcgcuaugcggugggg

SEQ ID NO: 4050159 - RNA, 21 nt, Rubella virus
gcuggaccguacggccaugcu

SEQ ID NO: 4050160 - RNA, 16 nt, Rubella virus
gcuugugggggccacg

SEQ ID NO: 4050161 - RNA, 22 nt, Rubella virus
ggagcacgaccgaccgccgccc

SEQ ID NO: 4050162 - RNA, 21 nt, Rubella virus
ggcaccagggcacucaugucu

SEQ ID NO: 4050163 - RNA, 22 nt, Rubella virus
ggcaccuugcgcgucggccagc

SEQ ID NO: 4050164 - RNA, 13 nt, Rubella virus
ggcacgacggcca

SEQ ID NO: 4050165 - RNA, 23 nt, Rubella virus
ggccacuagauccccgcaccugu

SEQ ID NO: 4050166 - RNA, 15 nt, Rubella virus
ggccacuggagccug

SEQ ID NO: 4050167 - RNA, 16 nt, Rubella virus
ggccccgccgccgccg

SEQ ID NO: 4050168 - RNA, 15 nt, Rubella virus
ggccucgggagcccg

SEQ ID NO: 4050169 - RNA, 17 nt, Rubella virus
ggccugcuggggcuucc

SEQ ID NO: 4050170 - RNA, 22 nt, Rubella virus
ggcggcaccuccuacgcugccg

SEQ ID NO: 4050171 - RNA, 11 nt, Rubella virus
ggcggcagcua

SEQ ID NO: 4050172 - RNA, 23 nt, Rubella virus
gggacugguccagggccccgccc

SEQ ID NO: 4050173 - RNA, 15 nt, Rubella virus
ggggccguggccagc

SEQ ID NO: 4050174 - RNA, 14 nt, Rubella virus
gguacgcgcagcug

SEQ ID NO: 4050175 - RNA, 12 nt, Rubella virus
gucccggugggg

SEQ ID NO: 4050176 - RNA, 17 nt, Rubella virus
gucgccgccgcggcgcc

SEQ ID NO: 4050177 - RNA, 22 nt, Rubella virus
gugcgagggcuugggggccugg

SEQ ID NO: 4050178 - RNA, 21 nt, Rubella virus
guggcagcucacucugggcgc

SEQ ID NO: 4050179 - RNA, 21 nt, Rubella virus
uacaaccugagcgacuggcac

SEQ ID NO: 4050180 - RNA, 16 nt, Rubella virus
uaccucugcacugcac

SEQ ID NO: 4050181 - RNA, 22 nt, Rubella virus
uauggcacacacaccacugcug

SEQ ID NO: 4050182 - RNA, 15 nt, Rubella virus
ucaaugacagcugcg

SEQ ID NO: 4050183 - RNA, 14 nt, Rubella virus
ucaccaaccugggc

SEQ ID NO: 4050184 - RNA, 13 nt, Rubella virus
ucacucugggcgc

SEQ ID NO: 4050185 - RNA, 18 nt, Rubella virus
uccacauacgcgcuggac

SEQ ID NO: 4050186 - RNA, 19 nt, Rubella virus
uccagggccccgccccccc

SEQ ID NO: 4050187 - RNA, 20 nt, Rubella virus
uccccacugaugucucgugc

SEQ ID NO: 4050188 - RNA, 22 nt, Rubella virus
uccccagccucggcccucuggc

SEQ ID NO: 4050189 - RNA, 16 nt, Rubella virus
uccccgcaccuguugc

SEQ ID NO: 4050190 - RNA, 13 nt, Rubella virus
ucgcgggcgccgc

SEQ ID NO: 4050191 - RNA, 16 nt, Rubella virus
ugccccuggacccggc

SEQ ID NO: 4050192 - RNA, 12 nt, Rubella virus
ugccgggcucuu

SEQ ID NO: 4050193 - RNA, 15 nt, Rubella virus
ugcgccggcccccug

SEQ ID NO: 4050194 - RNA, 14 nt, Rubella virus
ugcgccugcgccac

SEQ ID NO: 4050195 - RNA, 18 nt, Rubella virus
ugcgccuggucgacgccg

SEQ ID NO: 4050196 - RNA, 21 nt, Rubella virus
ugcgcggccucgacggcgaca

SEQ ID NO: 4050197 - RNA, 17 nt, Rubella virus
ugcuccccagccucggc

SEQ ID NO: 4050198 - RNA, 15 nt, Rubella virus
uggcagcucacucug

SEQ ID NO: 4050199 - RNA, 14 nt, Rubella virus
ugggacgcgcgacu

SEQ ID NO: 4050200 - RNA, 15 nt, Rubella virus
uggggccucgggagc

SEQ ID NO: 4050201 - RNA, 20 nt, Rubella virus
uggguacccgcagccccuug

SEQ ID NO: 4050202 - RNA, 17 nt, Rubella virus
uggugagccccauggga

SEQ ID NO: 4050203 - RNA, 15 nt, Rubella virus
ugguggaaggccuug

SEQ ID NO: 4050204 - RNA, 20 nt, Rubella virus
ugucggagacccggcagacc

SEQ ID NO: 4050205 - RNA, 13 nt, Rubella virus
uguugcuguauag

SEQ ID NO: 4050206 - RNA, 14 nt, Rubella virus
uucccccccacacc

SEQ ID NO: 4050207 - RNA, 20 nt, Rubella virus
uugaaccugccuucggacac

SEQ ID NO: 4050208 - RNA, 16 nt, Rubella virus
uuucaccuaccucugc

SEQ ID NO: 4050209 - RNA, 20 nt, Rubella virus
cacugcgccggcccccugcc

SEQ ID NO: 4050210 - RNA, 19 nt, Rubella virus
cagcgaccccuggcaucca

SEQ ID NO: 4050211 - RNA, 16 nt, Rubella virus
caggcgcccgcugccc

SEQ ID NO: 4050212 - RNA, 14 nt, Rubella virus
cagggacuggucca

SEQ ID NO: 4050213 - RNA, 21 nt, Rubella virus
cagggguacaacccccccgcc

SEQ ID NO: 4050214 - RNA, 17 nt, Rubella virus
cauccaggcgcccgcug

SEQ ID NO: 4050215 - RNA, 13 nt, Rubella virus
caucgaccccgcc

SEQ ID NO: 4050216 - RNA, 16 nt, Rubella virus
caucgcgggcgccgcc

SEQ ID NO: 4050217 - RNA, 20 nt, Rubella virus
cauuugcgcccucccacucg

SEQ ID NO: 4050218 - RNA, 17 nt, Rubella virus
ccagccccgcgcugaua

SEQ ID NO: 4050219 - RNA, 13 nt, Rubella virus
ccccaugggaccu

SEQ ID NO: 4050220 - RNA, 18 nt, Rubella virus
ccccgugcgccucgcugg

SEQ ID NO: 4050221 - RNA, 15 nt, Rubella virus
cccgaagacggcugg

SEQ ID NO: 4050222 - RNA, 22 nt, Rubella virus
cccgcccuaccaagucagcugc

SEQ ID NO: 4050223 - RNA, 17 nt, Rubella virus
cccggccacuggcucca

SEQ ID NO: 4050224 - RNA, 18 nt, Rubella virus
cccgugcgccucgcuggc

SEQ ID NO: 4050225 - RNA, 17 nt, Rubella virus
cccucccacucgcuggc

SEQ ID NO: 4050226 - RNA, 19 nt, Rubella virus
ccgagcuggggccaccgac

SEQ ID NO: 4050227 - RNA, 17 nt, Rubella virus
ccgaugcgccugcgcca

SEQ ID NO: 4050228 - RNA, 15 nt, Rubella virus
ccgcaccuguugcug

SEQ ID NO: 4050229 - RNA, 22 nt, Rubella virus
ccgcagccccccugugcgcacg

SEQ ID NO: 4050230 - RNA, 22 nt, Rubella virus
ccgcccuaccaagucagcugcg

SEQ ID NO: 4050231 - RNA, 22 nt, Rubella virus
ccggcgugguguauggcacaca

SEQ ID NO: 4050232 - RNA, 16 nt, Rubella virus
ccucaaugacagcugc

SEQ ID NO: 4050233 - RNA, 16 nt, Rubella virus
ccuccuacgcugccgc

SEQ ID NO: 4050234 - RNA, 18 nt, Rubella virus
ccucggcccucuggcucg

SEQ ID NO: 4050235 - RNA, 15 nt, Rubella virus
ccugcugcgcacugc

SEQ ID NO: 4050236 - RNA, 15 nt, Rubella virus
ccuugccgggcucuu

SEQ ID NO: 4050237 - RNA, 16 nt, Rubella virus
cgacgcggccugcugg

SEQ ID NO: 4050238 - RNA, 23 nt, Rubella virus
cgaggcacccaccgaggccugcg

SEQ ID NO: 4050239 - RNA, 13 nt, Rubella virus
cgcaccuguugcu

SEQ ID NO: 4050240 - RNA, 21 nt, Rubella virus
cgcacugccccuggacccggc

SEQ ID NO: 4050241 - RNA, 16 nt, Rubella virus
cgcagggacuggucca

SEQ ID NO: 4050242 - RNA, 18 nt, Rubella virus
cgccacugcgccggcccc

SEQ ID NO: 4050243 - RNA, 15 nt, Rubella virus
cgccgccgcccucac

SEQ ID NO: 4050244 - RNA, 14 nt, Rubella virus
cgccggcccccugc

SEQ ID NO: 4050245 - RNA, 22 nt, Rubella virus
cgccuacccgguuuggcugcgc

SEQ ID NO: 4050246 - RNA, 19 nt, Rubella virus
cgcgacuugcuccccagcc

SEQ ID NO: 4050247 - RNA, 21 nt, Rubella virus
cgcgccccgagcuggggccac

SEQ ID NO: 4050248 - RNA, 16 nt, Rubella virus
cgcguggccugcgccc

SEQ ID NO: 4050249 - RNA, 12 nt, Rubella virus
cgcugggacccu

SEQ ID NO: 4050250 - RNA, 18 nt, Rubella virus
cggagugggcugcugccc

SEQ ID NO: 4050251 - RNA, 22 nt, Rubella virus
cggcacgcgcuggcaccgacug

SEQ ID NO: 4050252 - RNA, 15 nt, Rubella virus
cggccgcugggaccc

SEQ ID NO: 4050253 - RNA, 13 nt, Rubella virus
cggcugcgccugg

SEQ ID NO: 4050254 - RNA, 19 nt, Rubella virus
cggcuggacuugccgcggc

SEQ ID NO: 4050255 - RNA, 16 nt, Rubella virus
cgggcacgacggccau

SEQ ID NO: 4050256 - RNA, 18 nt, Rubella virus
cgggcucuugcucgccac

SEQ ID NO: 4050257 - RNA, 11 nt, Rubella virus
cguccugcugg

SEQ ID NO: 4050258 - RNA, 19 nt, Rubella virus
cgugacuccggagggcccc

SEQ ID NO: 4050259 - RNA, 20 nt, Rubella virus
cguggccugcgcccgccucu

SEQ ID NO: 4050260 - RNA, 16 nt, Rubella virus
cguggcgcguggccug

SEQ ID NO: 4050261 - RNA, 19 nt, Rubella virus
cgugggggcucugccccgc

SEQ ID NO: 4050262 - RNA, 15 nt, Rubella virus
cguguucgcccuugc

SEQ ID NO: 4050263 - RNA, 12 nt, Rubella virus
cucaccaccgcg

SEQ ID NO: 4050264 - RNA, 15 nt, Rubella virus
cuccaaggcggcugg

SEQ ID NO: 4050265 - RNA, 17 nt, Rubella virus
cuccaaggcggcugggg

SEQ ID NO: 4050266 - RNA, 15 nt, Rubella virus
cuccggagggccccg

SEQ ID NO: 4050267 - RNA, 20 nt, Rubella virus
cucggcccucuggcucgcca

SEQ ID NO: 4050268 - RNA, 12 nt, Rubella virus
cucucaccaccg

SEQ ID NO: 4050269 - RNA, 16 nt, Rubella virus
cugagcgacuggcacc

SEQ ID NO: 4050270 - RNA, 21 nt, Rubella virus
cugcgcuaugcgguggggccu

SEQ ID NO: 4050271 - RNA, 19 nt, Rubella virus
cugcugcgcaugccagugc

SEQ ID NO: 4050272 - RNA, 13 nt, Rubella virus
cuggcggcagcua

SEQ ID NO: 4050273 - RNA, 15 nt, Rubella virus
cugguguguggagca

SEQ ID NO: 4050274 - RNA, 17 nt, Rubella virus
cugucaacgccuacucc

SEQ ID NO: 4050275 - RNA, 21 nt, Rubella virus
cugucgccgccgcggcgccgc

SEQ ID NO: 4050276 - RNA, 17 nt, Rubella virus
cugugcgcacgggcagc

SEQ ID NO: 4050277 - RNA, 20 nt, Rubella virus
cuugucugggugcgggccga

SEQ ID NO: 4050278 - RNA, 13 nt, Rubella virus
gaaggccuugccc

SEQ ID NO: 4050279 - RNA, 19 nt, Rubella virus
gacacagcgacgcggccug

SEQ ID NO: 4050280 - RNA, 20 nt, Rubella virus
gacacagcgacgcggccugc

SEQ ID NO: 4050281 - RNA, 22 nt, Rubella virus
gacacagcgacgcggccugcug

SEQ ID NO: 4050282 - RNA, 17 nt, Rubella virus
gacagcugcggcggcuu

SEQ ID NO: 4050283 - RNA, 15 nt, Rubella virus
gacccggcagaccug

SEQ ID NO: 4050284 - RNA, 19 nt, Rubella virus
gacccggcgaggugugggu

SEQ ID NO: 4050285 - RNA, 21 nt, Rubella virus
gaccugcauuucaccaaccug

SEQ ID NO: 4050286 - RNA, 15 nt, Rubella virus
gacgacccccugcug

SEQ ID NO: 4050287 - RNA, 17 nt, Rubella virus
gacgaggacggccgcug

SEQ ID NO: 4050288 - RNA, 20 nt, Rubella virus
gacggccaucauggcggcac

SEQ ID NO: 4050289 - RNA, 18 nt, Rubella virus
gacggcgacagcgccccg

SEQ ID NO: 4050290 - RNA, 12 nt, Rubella virus
gacgugcugccc

SEQ ID NO: 4050291 - RNA, 15 nt, Rubella virus
gagagcgaucgcgcg

SEQ ID NO: 4050292 - RNA, 14 nt, Rubella virus
gaggacggccgcug

SEQ ID NO: 4050293 - RNA, 15 nt, Rubella virus
gagugggcugcugcc

SEQ ID NO: 4050294 - RNA, 16 nt, Rubella virus
gauccccgcaccuguu

SEQ ID NO: 4050295 - RNA, 12 nt, Rubella virus
gaugucucgugc

SEQ ID NO: 4050296 - RNA, 18 nt, Rubella virus
gauuguggacggcggcug

SEQ ID NO: 4050297 - RNA, 14 nt, Rubella virus
gcaccuguccccgu

SEQ ID NO: 4050298 - RNA, 16 nt, Rubella virus
gcauccaccgggcccc

SEQ ID NO: 4050299 - RNA, 21 nt, Rubella virus
gcauugagacccgcucggcgc

SEQ ID NO: 4050300 - RNA, 22 nt, Rubella virus
gccaccaccaccaucagcugcc

SEQ ID NO: 4050301 - RNA, 15 nt, Rubella virus
gccagcgcagggacu

SEQ ID NO: 4050302 - RNA, 17 nt, Rubella virus
gccccccaggccuuccu

SEQ ID NO: 4050303 - RNA, 21 nt, Rubella virus
gccccccugugcgcacgggca

SEQ ID NO: 4050304 - RNA, 15 nt, Rubella virus
gccccgagcuggggc

SEQ ID NO: 4050305 - RNA, 16 nt, Rubella virus
gccccgccccccccgg

SEQ ID NO: 4050306 - RNA, 16 nt, Rubella virus
gccgccacccccgcca

SEQ ID NO: 4050307 - RNA, 16 nt, Rubella virus
gccgcggcgugcccgc

SEQ ID NO: 4050308 - RNA, 18 nt, Rubella virus
gccgcugggacccugcgc

SEQ ID NO: 4050309 - RNA, 22 nt, Rubella virus
gccggccucaaugacagcugcg

SEQ ID NO: 4050310 - RNA, 16 nt, Rubella virus
gccucaacccccgcgc

SEQ ID NO: 4050311 - RNA, 23 nt, Rubella virus
gccucgcuagugggcccccgcgc

SEQ ID NO: 4050312 - RNA, 19 nt, Rubella virus
gccugcgugaccucguggc

SEQ ID NO: 4050313 - RNA, 17 nt, Rubella virus
gcgaaacccgcacuagg

SEQ ID NO: 4050314 - RNA, 21 nt, Rubella virus
gcgcauccgcuucggugcccc

SEQ ID NO: 4050315 - RNA, 22 nt, Rubella virus
gcgcauugagacccgcucggcg

SEQ ID NO: 4050316 - RNA, 17 nt, Rubella virus
gcgcugacacccggugc

SEQ ID NO: 4050317 - RNA, 21 nt, Rubella virus
gcggcuugugggggccacgcc

SEQ ID NO: 4050318 - RNA, 14 nt, Rubella virus
gcgggcuguccacc

SEQ ID NO: 4050319 - RNA, 20 nt, Rubella virus
gcgggcuguccaccaccgcc

SEQ ID NO: 4050320 - RNA, 16 nt, Rubella virus
gcgguggggccuuccc

SEQ ID NO: 4050321 - RNA, 15 nt, Rubella virus
gcuccaaggcggcug

SEQ ID NO: 4050322 - RNA, 16 nt, Rubella virus
gcugauauggcggcac

SEQ ID NO: 4050323 - RNA, 21 nt, Rubella virus
gcugcccauugguggcagcuc

SEQ ID NO: 4050324 - RNA, 15 nt, Rubella virus
gcugcccggccacug

SEQ ID NO: 4050325 - RNA, 18 nt, Rubella virus
gcugccgcagccccccug

SEQ ID NO: 4050326 - RNA, 17 nt, Rubella virus
gcugccguuccucgggc

SEQ ID NO: 4050327 - RNA, 18 nt, Rubella virus
gcugccguuccucgggca

SEQ ID NO: 4050328 - RNA, 15 nt, Rubella virus
gcugcgcacugcccc

SEQ ID NO: 4050329 - RNA, 18 nt, Rubella virus
gcuuucaccuaccucugc

SEQ ID NO: 4050330 - RNA, 18 nt, Rubella virus
ggacggccgcugggaccc

SEQ ID NO: 4050331 - RNA, 16 nt, Rubella virus
ggcaccgcgcgcgccg

SEQ ID NO: 4050332 - RNA, 22 nt, Rubella virus
ggcaccgcgcgcgccgggcucc

SEQ ID NO: 4050333 - RNA, 18 nt, Rubella virus
ggcagcauuacggccacc

SEQ ID NO: 4050334 - RNA, 23 nt, Rubella virus
ggccccgaagccaucgcgggcgc

SEQ ID NO: 4050335 - RNA, 16 nt, Rubella virus
ggcccucuggcucgcc

SEQ ID NO: 4050336 - RNA, 15 nt, Rubella virus
ggccgaugcgccugc

SEQ ID NO: 4050337 - RNA, 13 nt, Rubella virus
ggccugcuggggc

SEQ ID NO: 4050338 - RNA, 22 nt, Rubella virus
ggccuggguacccgcagccccu

SEQ ID NO: 4050339 - RNA, 14 nt, Rubella virus
ggccuuccccccug

SEQ ID NO: 4050340 - RNA, 17 nt, Rubella virus
ggcggagugggcugcug

SEQ ID NO: 4050341 - RNA, 23 nt, Rubella virus
ggcggcugcuuugccccauggga

SEQ ID NO: 4050342 - RNA, 15 nt, Rubella virus
ggcggcuucuugucu

SEQ ID NO: 4050343 - RNA, 15 nt, Rubella virus
ggcgugggggcucug

SEQ ID NO: 4050344 - RNA, 20 nt, Rubella virus
ggcuccaaggcggcuggggu

SEQ ID NO: 4050345 - RNA, 13 nt, Rubella virus
ggcuccagccccg

SEQ ID NO: 4050346 - RNA, 19 nt, Rubella virus
ggguacaacccccccgccu

SEQ ID NO: 4050347 - RNA, 20 nt, Rubella virus
ggguacaacccccccgccua

SEQ ID NO: 4050348 - RNA, 16 nt, Rubella virus
gguccagggccccgcc

SEQ ID NO: 4050349 - RNA, 12 nt, Rubella virus
guccagggcccc

SEQ ID NO: 4050350 - RNA, 14 nt, Rubella virus
gucccgcccgaccc

SEQ ID NO: 4050351 - RNA, 22 nt, Rubella virus
gucgccguuggcaccgcgcgcg

SEQ ID NO: 4050352 - RNA, 18 nt, Rubella virus
gugcaccuucugggcugu

SEQ ID NO: 4050353 - RNA, 15 nt, Rubella virus
gugccgccgcgccug

SEQ ID NO: 4050354 - RNA, 16 nt, Rubella virus
guggcgcguggccugc

SEQ ID NO: 4050355 - RNA, 12 nt, Rubella virus
gugggggcucug

SEQ ID NO: 4050356 - RNA, 22 nt, Rubella virus
guuccucgggcacgacggccau

SEQ ID NO: 4050357 - RNA, 21 nt, Rubella virus
uagauccccgcaccuguugcu

SEQ ID NO: 4050358 - RNA, 21 nt, Rubella virus
ucaacccuggcggcagcuacu

SEQ ID NO: 4050359 - RNA, 14 nt, Rubella virus
ucaccacugaacac

SEQ ID NO: 4050360 - RNA, 15 nt, Rubella virus
ucaccgccgcccucc

SEQ ID NO: 4050361 - RNA, 15 nt, Rubella virus
ucauggcggcaccuu

SEQ ID NO: 4050362 - RNA, 10 nt, Rubella virus
uccaccaccg

SEQ ID NO: 4050363 - RNA, 19 nt, Rubella virus
uccgcuucggugcccccca

SEQ ID NO: 4050364 - RNA, 21 nt, Rubella virus
uccuuaccgcccgccccgaag

SEQ ID NO: 4050365 - RNA, 22 nt, Rubella virus
ucgccgccgcggcgccgccgcc

SEQ ID NO: 4050366 - RNA, 14 nt, Rubella virus
ucgcgggcgccgcc

SEQ ID NO: 4050367 - RNA, 19 nt, Rubella virus
ucgcuagugggcccccgcg

SEQ ID NO: 4050368 - RNA, 23 nt, Rubella virus
ucuggcggguacgcgcagcuggc

SEQ ID NO: 4050369 - RNA, 19 nt, Rubella virus
ugacuccggagggccccgc

SEQ ID NO: 4050370 - RNA, 18 nt, Rubella virus
ugcaccggggugcgccac

SEQ ID NO: 4050371 - RNA, 15 nt, Rubella virus
ugcaccuucugggcu

SEQ ID NO: 4050372 - RNA, 13 nt, Rubella virus
ugccgcggcgugc

SEQ ID NO: 4050373 - RNA, 15 nt, Rubella virus
ugcgcacgggcagca

SEQ ID NO: 4050374 - RNA, 20 nt, Rubella virus
ugcgcggccucgacggcgac

SEQ ID NO: 4050375 - RNA, 23 nt, Rubella virus
ugcucgcggcuugugggggccac

SEQ ID NO: 4050376 - RNA, 20 nt, Rubella virus
ugcuggucccguggguccug

SEQ ID NO: 4050377 - RNA, 21 nt, Rubella virus
uggcacacagcgcgcgugcac

SEQ ID NO: 4050378 - RNA, 21 nt, Rubella virus
uggcauccaccgggccccuug

SEQ ID NO: 4050379 - RNA, 20 nt, Rubella virus
uggggccuuccccccuggga

SEQ ID NO: 4050380 - RNA, 14 nt, Rubella virus
uggugagccccaug

SEQ ID NO: 4050381 - RNA, 12 nt, Rubella virus
ugucgccgccgc

SEQ ID NO: 4050382 - RNA, 17 nt, Rubella virus
ugucgccgccgcggcgc

SEQ ID NO: 4050383 - RNA, 17 nt, Rubella virus
uucaccaaccugggcac

SEQ ID NO: 4050384 - RNA, 15 nt, SARS coronavirus
aaaacgaacaugaaa

SEQ ID NO: 4050385 - RNA, 22 nt, SARS coronavirus
aaaaugaaagagcucagcccca

SEQ ID NO: 4050386 - RNA, 15 nt, SARS coronavirus
aaacacucaugauga

SEQ ID NO: 4050387 - RNA, 22 nt, SARS coronavirus
aaacauucccaccaacagagcc

SEQ ID NO: 4050388 - RNA, 22 nt, SARS coronavirus
aaacugcccucgcgcuauugcu

SEQ ID NO: 4050389 - RNA, 14 nt, SARS coronavirus
aaacuuguguccuu

SEQ ID NO: 4050390 - RNA, 12 nt, SARS coronavirus
aaaucaaauguu

SEQ ID NO: 4050391 - RNA, 21 nt, SARS coronavirus
aaaucgccaaccaauuuaaca

SEQ ID NO: 4050392 - RNA, 20 nt, SARS coronavirus
aacaaaucgccaaccaauuu

SEQ ID NO: 4050393 - RNA, 18 nt, SARS coronavirus
aacaacauugccaaaagg

SEQ ID NO: 4050394 - RNA, 15 nt, SARS coronavirus
aacagagccuaaaaa

SEQ ID NO: 4050395 - RNA, 14 nt, SARS coronavirus
aacauacuucaucu

SEQ ID NO: 4050396 - RNA, 17 nt, SARS coronavirus
aacgucacucaagcauu

SEQ ID NO: 4050397 - RNA, 18 nt, SARS coronavirus
aacuaaucagggcugcug

SEQ ID NO: 4050398 - RNA, 18 nt, SARS coronavirus
aacugguguuauugcuga

SEQ ID NO: 4050399 - RNA, 14 nt, SARS coronavirus
aagaagcagcccac

SEQ ID NO: 4050400 - RNA, 17 nt, SARS coronavirus
aagagaucacuguggcu

SEQ ID NO: 4050401 - RNA, 22 nt, SARS coronavirus
aagcauuaaacacacuuguuaa

SEQ ID NO: 4050402 - RNA, 11 nt, SARS coronavirus
aagcucagccu

SEQ ID NO: 4050403 - RNA, 12 nt, SARS coronavirus
aagcucagccuu

SEQ ID NO: 4050404 - RNA, 14 nt, SARS coronavirus
aaggucaccaaacu

SEQ ID NO: 4050405 - RNA, 23 nt, SARS coronavirus
aauaaaccucaugugcuugaaga

SEQ ID NO: 4050406 - RNA, 19 nt, SARS coronavirus
aauaaauuugcacuaacuu

SEQ ID NO: 4050407 - RNA, 23 nt, SARS coronavirus
aauaaugcuagggagagcugccu

SEQ ID NO: 4050408 - RNA, 19 nt, SARS coronavirus
aauagcuucuuaggagaau

SEQ ID NO: 4050409 - RNA, 21 nt, SARS coronavirus
aauagugguccagaugaccaa

SEQ ID NO: 4050410 - RNA, 14 nt, SARS coronavirus
aaucugaacucuuc

SEQ ID NO: 4050411 - RNA, 17 nt, SARS coronavirus
aaugaaagagcucagcc

SEQ ID NO: 4050412 - RNA, 18 nt, SARS coronavirus
aaugaucuuugcuucucc

SEQ ID NO: 4050413 - RNA, 13 nt, SARS coronavirus
aauuaaaaugucu

SEQ ID NO: 4050414 - RNA, 21 nt, SARS coronavirus
aauuauuaugagauguuggcu

SEQ ID NO: 4050415 - RNA, 21 nt, SARS coronavirus
aauucuacuaauguuguuaua

SEQ ID NO: 4050416 - RNA, 12 nt, SARS coronavirus
acaaacauucuu

SEQ ID NO: 4050417 - RNA, 13 nt, SARS coronavirus
acaaauaauuacu

SEQ ID NO: 4050418 - RNA, 13 nt, SARS coronavirus
acaacaaggccaa

SEQ ID NO: 4050419 - RNA, 21 nt, SARS coronavirus
acaaguagguuuaguuaacuu

SEQ ID NO: 4050420 - RNA, 17 nt, SARS coronavirus
acaaucaaaaagaguug

SEQ ID NO: 4050421 - RNA, 21 nt, SARS coronavirus
acacagaggaacuucuuuucu

SEQ ID NO: 4050422 - RNA, 17 nt, SARS coronavirus
acacucaugaugaccac

SEQ ID NO: 4050423 - RNA, 18 nt, SARS coronavirus
acagagccuaaaaaggac

SEQ ID NO: 4050424 - RNA, 18 nt, SARS coronavirus
acagccuuuucaccugcu

SEQ ID NO: 4050425 - RNA, 20 nt, SARS coronavirus
acagccuuuucaccugcuca

SEQ ID NO: 4050426 - RNA, 23 nt, SARS coronavirus
acauuggccgcaaauugcacaau

SEQ ID NO: 4050427 - RNA, 15 nt, SARS coronavirus
accaaaacuuuucau

SEQ ID NO: 4050428 - RNA, 14 nt, SARS coronavirus
accaaacugcugca

SEQ ID NO: 4050429 - RNA, 18 nt, SARS coronavirus
acccaaaauguucucuau

SEQ ID NO: 4050430 - RNA, 19 nt, SARS coronavirus
acccaaggaaauuucgggg

SEQ ID NO: 4050431 - RNA, 13 nt, SARS coronavirus
accccaagguuua

SEQ ID NO: 4050432 - RNA, 17 nt, SARS coronavirus
acccgacgaguucgugg

SEQ ID NO: 4050433 - RNA, 21 nt, SARS coronavirus
accgugcuacaacuuccucaa

SEQ ID NO: 4050434 - RNA, 15 nt, SARS coronavirus
acgcauacaaaacau

SEQ ID NO: 4050435 - RNA, 13 nt, SARS coronavirus
acguuauaauaag

SEQ ID NO: 4050436 - RNA, 19 nt, SARS coronavirus
acuaaaagaaccuugccca

SEQ ID NO: 4050437 - RNA, 18 nt, SARS coronavirus
acuaagaaaucugcugcu

SEQ ID NO: 4050438 - RNA, 19 nt, SARS coronavirus
acuaagaaaucugcugcug

SEQ ID NO: 4050439 - RNA, 20 nt, SARS coronavirus
acuaagaaaucugcugcuga

SEQ ID NO: 4050440 - RNA, 21 nt, SARS coronavirus
acuaaucagggcugcugaaau

SEQ ID NO: 4050441 - RNA, 16 nt, SARS coronavirus
acucaaagaagacuac

SEQ ID NO: 4050442 - RNA, 20 nt, SARS coronavirus
acucagguguuaaagacuau

SEQ ID NO: 4050443 - RNA, 23 nt, SARS coronavirus
acucuuagaucaauuacugcaca

SEQ ID NO: 4050444 - RNA, 17 nt, SARS coronavirus
acugacaauaaccagaa

SEQ ID NO: 4050445 - RNA, 13 nt, SARS coronavirus
acugcugaacaag

SEQ ID NO: 4050446 - RNA, 18 nt, SARS coronavirus
acuucuauuaccuaggaa

SEQ ID NO: 4050447 - RNA, 17 nt, SARS coronavirus
acuucuauuugugcuuu

SEQ ID NO: 4050448 - RNA, 12 nt, SARS coronavirus
acuuuucaauua

SEQ ID NO: 4050449 - RNA, 12 nt, SARS coronavirus
agagacaaaaga

SEQ ID NO: 4050450 - RNA, 18 nt, SARS coronavirus
agagauauugauuaucau

SEQ ID NO: 4050451 - RNA, 15 nt, SARS coronavirus
agaucaguuucacca

SEQ ID NO: 4050452 - RNA, 21 nt, SARS coronavirus
agaucaguuucaccaaaacuu

SEQ ID NO: 4050453 - RNA, 17 nt, SARS coronavirus
agcgccaggacaaacug

SEQ ID NO: 4050454 - RNA, 23 nt, SARS coronavirus
agcugcaagacguuguuaaccag

SEQ ID NO: 4050455 - RNA, 21 nt, SARS coronavirus
aggaacugauuacaaacauug

SEQ ID NO: 4050456 - RNA, 16 nt, SARS coronavirus
aggacgcaauggggca

SEQ ID NO: 4050457 - RNA, 22 nt, SARS coronavirus
agggggguuuacuauccugaug

SEQ ID NO: 4050458 - RNA, 22 nt, SARS coronavirus
aguaaugccuguuucuauggcu

SEQ ID NO: 4050459 - RNA, 21 nt, SARS coronavirus
agucaagggagaugauguaag

SEQ ID NO: 4050460 - RNA, 20 nt, SARS coronavirus
aguuacccaaaauguucucu

SEQ ID NO: 4050461 - RNA, 15 nt, SARS coronavirus
auaacaaugcugcca

SEQ ID NO: 4050462 - RNA, 14 nt, SARS coronavirus
auaauggaccccaa

SEQ ID NO: 4050463 - RNA, 14 nt, SARS coronavirus
auacacccaaagac

SEQ ID NO: 4050464 - RNA, 20 nt, SARS coronavirus
auaccuacuaacuuuucaau

SEQ ID NO: 4050465 - RNA, 16 nt, SARS coronavirus
auacuuauagcacugc

SEQ ID NO: 4050466 - RNA, 12 nt, SARS coronavirus
aucauuaacaac

SEQ ID NO: 4050467 - RNA, 16 nt, SARS coronavirus
aucuuggcgacauuuc

SEQ ID NO: 4050468 - RNA, 14 nt, SARS coronavirus
augaaagagcucag

SEQ ID NO: 4050469 - RNA, 17 nt, SARS coronavirus
augaaagagcucagccc

SEQ ID NO: 4050470 - RNA, 15 nt, SARS coronavirus
augaagcucagccuu

SEQ ID NO: 4050471 - RNA, 17 nt, SARS coronavirus
augaaggcaaagcauac

SEQ ID NO: 4050472 - RNA, 23 nt, SARS coronavirus
augacaaagauccacaauucaaa

SEQ ID NO: 4050473 - RNA, 20 nt, SARS coronavirus
augagauguuggcuuuguug

SEQ ID NO: 4050474 - RNA, 16 nt, SARS coronavirus
ccaggaucuagaagaa

SEQ ID NO: 4050475 - RNA, 14 nt, SARS coronavirus
ccauuaaaugauua

SEQ ID NO: 4050476 - RNA, 21 nt, SARS coronavirus
ccauuaaauuggaugacaaag

SEQ ID NO: 4050477 - RNA, 14 nt, SARS coronavirus
cccaggagaggaac

SEQ ID NO: 4050478 - RNA, 17 nt, SARS coronavirus
ccgcagagacaaaagaa

SEQ ID NO: 4050479 - RNA, 18 nt, SARS coronavirus
ccgcauuacauuuggugg

SEQ ID NO: 4050480 - RNA, 20 nt, SARS coronavirus
ccgugcuacaacuuccucaa

SEQ ID NO: 4050481 - RNA, 20 nt, SARS coronavirus
ccuacggcgcuaacaaagaa

SEQ ID NO: 4050482 - RNA, 21 nt, SARS coronavirus
ccuaggaacuggcccagaagc

SEQ ID NO: 4050483 - RNA, 14 nt, SARS coronavirus
ccuauuggagcugg

SEQ ID NO: 4050484 - RNA, 15 nt, SARS coronavirus
ccuauuuuguuggcu

SEQ ID NO: 4050485 - RNA, 18 nt, SARS coronavirus
ccucuucucgcuccucau

SEQ ID NO: 4050486 - RNA, 17 nt, SARS coronavirus
ccuggcagcaguagggg

SEQ ID NO: 4050487 - RNA, 20 nt, SARS coronavirus
ccuugcaccccaccugcucu

SEQ ID NO: 4050488 - RNA, 21 nt, SARS coronavirus
ccuugcaccccaccugcucuu

SEQ ID NO: 4050489 - RNA, 24 nt, SARS coronavirus
ccuuuaagugcuauggcguuucug

SEQ ID NO: 4050490 - RNA, 13 nt, SARS coronavirus
cgaacaaauuaaa

SEQ ID NO: 4050491 - RNA, 22 nt, SARS coronavirus
cgauaaugcauuuaauugcacu

SEQ ID NO: 4050492 - RNA, 14 nt, SARS coronavirus
cgcuauugcugcua

SEQ ID NO: 4050493 - RNA, 22 nt, SARS coronavirus
cgggggacaauugugaccagac

SEQ ID NO: 4050494 - RNA, 19 nt, SARS coronavirus
cgguacucgacauaccuau

SEQ ID NO: 4050495 - RNA, 16 nt, SARS coronavirus
cuaaaaaggacaaaaa

SEQ ID NO: 4050496 - RNA, 16 nt, SARS coronavirus
cuaauccagcaaugga

SEQ ID NO: 4050497 - RNA, 15 nt, SARS coronavirus
cuaaucuugcugcua

SEQ ID NO: 4050498 - RNA, 20 nt, SARS coronavirus
cuaauuuuggugcaauuuca

SEQ ID NO: 4050499 - RNA, 17 nt, SARS coronavirus
cuacaucacgaacgcuu

SEQ ID NO: 4050500 - RNA, 16 nt, SARS coronavirus
cuacauuuaugcucaa

SEQ ID NO: 4050501 - RNA, 13 nt, SARS coronavirus
cuaccgaagagcu

SEQ ID NO: 4050502 - RNA, 16 nt, SARS coronavirus
cuagagaucucauuug

SEQ ID NO: 4050503 - RNA, 21 nt, SARS coronavirus
cuaguuagugguacugccacu

SEQ ID NO: 4050504 - RNA, 14 nt, SARS coronavirus
cuauccugaugaaa

SEQ ID NO: 4050505 - RNA, 19 nt, SARS coronavirus
cuauuccuuguuuuaauaa

SEQ ID NO: 4050506 - RNA, 14 nt, SARS coronavirus
cuauuuguuaccau

SEQ ID NO: 4050507 - RNA, 12 nt, SARS coronavirus
cucacucagcau

SEQ ID NO: 4050508 - RNA, 17 nt, SARS coronavirus
cucacucagcauggcaa

SEQ ID NO: 4050509 - RNA, 22 nt, SARS coronavirus
cucacugaugauaugauugcug

SEQ ID NO: 4050510 - RNA, 19 nt, SARS coronavirus
cucagcauggcaaggagga

SEQ ID NO: 4050511 - RNA, 16 nt, SARS coronavirus
cucauuguugcugcuc

SEQ ID NO: 4050512 - RNA, 23 nt, SARS coronavirus
cuccgggggacaauugugaccag

SEQ ID NO: 4050513 - RNA, 13 nt, SARS coronavirus
cuccuggcagcag

SEQ ID NO: 4050514 - RNA, 17 nt, SARS coronavirus
cucgcgcuauugcugcu

SEQ ID NO: 4050515 - RNA, 15 nt, SARS coronavirus
cucuugcugacaaua

SEQ ID NO: 4050516 - RNA, 14 nt, SARS coronavirus
cugagcuugacuca

SEQ ID NO: 4050517 - RNA, 21 nt, SARS coronavirus
cugaugauaugauugcugccu

SEQ ID NO: 4050518 - RNA, 15 nt, SARS coronavirus
cugauuacaaacauu

SEQ ID NO: 4050519 - RNA, 18 nt, SARS coronavirus
cugcaaguacuguucaug

SEQ ID NO: 4050520 - RNA, 24 nt, SARS coronavirus
cugcaaguacuguucaugcuacag

SEQ ID NO: 4050521 - RNA, 20 nt, SARS coronavirus
cugccaaaagagaucacugu

SEQ ID NO: 4050522 - RNA, 13 nt, SARS coronavirus
cugcucgaauggc

SEQ ID NO: 4050523 - RNA, 21 nt, SARS coronavirus
cuggaacaaaugcuucaucug

SEQ ID NO: 4050524 - RNA, 14 nt, SARS coronavirus
cuggucuaaacgaa

SEQ ID NO: 4050525 - RNA, 20 nt, SARS coronavirus
cuguaguacagcgcugugca

SEQ ID NO: 4050526 - RNA, 16 nt, SARS coronavirus
cuguugauuguucuca

SEQ ID NO: 4050527 - RNA, 21 nt, SARS coronavirus
cuuauguccuucccacaagca

SEQ ID NO: 4050528 - RNA, 21 nt, SARS coronavirus
cuucaggcuguuugcucguac

SEQ ID NO: 4050529 - RNA, 22 nt, SARS coronavirus
cuucuccaaugucuaugcagau

SEQ ID NO: 4050530 - RNA, 22 nt, SARS coronavirus
cuucugcuaaucuugcugcuac

SEQ ID NO: 4050531 - RNA, 13 nt, SARS coronavirus
cuugaaagagcca

SEQ ID NO: 4050532 - RNA, 12 nt, SARS coronavirus
cuugaagauccu

SEQ ID NO: 4050533 - RNA, 22 nt, SARS coronavirus
cuugagagcaaaguuucuggua

SEQ ID NO: 4050534 - RNA, 17 nt, SARS coronavirus
cuugcuagucacacuag

SEQ ID NO: 4050535 - RNA, 10 nt, SARS coronavirus
cuugcugcug

SEQ ID NO: 4050536 - RNA, 24 nt, SARS coronavirus
cuugcuuucgugguauucuugcua

SEQ ID NO: 4050537 - RNA, 23 nt, SARS coronavirus
cuugguuuauuacacagaggaac

SEQ ID NO: 4050538 - RNA, 14 nt, SARS coronavirus
cuuuaauugacuuc

SEQ ID NO: 4050539 - RNA, 22 nt, SARS coronavirus
cuuuaggugcugauaguucaau

SEQ ID NO: 4050540 - RNA, 16 nt, SARS coronavirus
cuuugaaauauuuugg

SEQ ID NO: 4050541 - RNA, 20 nt, SARS coronavirus
cuuugcuucaccauuaagag

SEQ ID NO: 4050542 - RNA, 13 nt, SARS coronavirus
cuuugugcucuag

SEQ ID NO: 4050543 - RNA, 22 nt, SARS coronavirus
cuuuucuccacaaauaauuacu

SEQ ID NO: 4050544 - RNA, 21 nt, SARS coronavirus
guauugaaaaugcuacauucu

SEQ ID NO: 4050545 - RNA, 19 nt, SARS coronavirus
guauuuuuaauacuuugcu

SEQ ID NO: 4050546 - RNA, 19 nt, SARS coronavirus
gugacaacagauguuucau

SEQ ID NO: 4050547 - RNA, 21 nt, SARS coronavirus
gugacaacagauguuucaucu

SEQ ID NO: 4050548 - RNA, 17 nt, SARS coronavirus
gugcaccacuuuugaug

SEQ ID NO: 4050549 - RNA, 13 nt, SARS coronavirus
gugcuugcugcug

SEQ ID NO: 4050550 - RNA, 15 nt, SARS coronavirus
guggucauucaaccc

SEQ ID NO: 4050551 - RNA, 13 nt, SARS coronavirus
guguaaaauuaau

SEQ ID NO: 4050552 - RNA, 14 nt, SARS coronavirus
guuagauuauccau

SEQ ID NO: 4050553 - RNA, 21 nt, SARS coronavirus
guuagauuauccauaaaacga

SEQ ID NO: 4050554 - RNA, 19 nt, SARS coronavirus
guugacuuccagguuacaa

SEQ ID NO: 4050555 - RNA, 23 nt, SARS coronavirus
guuucaccaaaacuuuucaucag

SEQ ID NO: 4050556 - RNA, 16 nt, SARS coronavirus
guuuuaaauaaacgaa

SEQ ID NO: 4050557 - RNA, 18 nt, SARS coronavirus
guuuuuaaugcuacuaaa

SEQ ID NO: 4050558 - RNA, 18 nt, SARS coronavirus
uaaaaagccucgccaaaa

SEQ ID NO: 4050559 - RNA, 14 nt, SARS coronavirus
uaaacaacuccugg

SEQ ID NO: 4050560 - RNA, 16 nt, SARS coronavirus
uaaacaacuccuggaa

SEQ ID NO: 4050561 - RNA, 15 nt, SARS coronavirus
uaacugcacugaugu

SEQ ID NO: 4050562 - RNA, 21 nt, SARS coronavirus
uaagagaaagacagaaugaau

SEQ ID NO: 4050563 - RNA, 13 nt, SARS coronavirus
uaauaacaaugcu

SEQ ID NO: 4050564 - RNA, 18 nt, SARS coronavirus
uaauacuuugcuucacca

SEQ ID NO: 4050565 - RNA, 15 nt, SARS coronavirus
uaaugccuguuucua

SEQ ID NO: 4050566 - RNA, 16 nt, SARS coronavirus
uaauucaagaaauuca

SEQ ID NO: 4050567 - RNA, 15 nt, SARS coronavirus
uaauugacuucuauu

SEQ ID NO: 4050568 - RNA, 17 nt, SARS coronavirus
uaauuguguugcugauu

SEQ ID NO: 4050569 - RNA, 14 nt, SARS coronavirus
uacaaaacauuccc

SEQ ID NO: 4050570 - RNA, 16 nt, SARS coronavirus
uacaguguugccaccu

SEQ ID NO: 4050571 - RNA, 20 nt, SARS coronavirus
uacaucaccagauguugauc

SEQ ID NO: 4050572 - RNA, 12 nt, SARS coronavirus
uacauuacacau

SEQ ID NO: 4050573 - RNA, 17 nt, SARS coronavirus
uacuacaauuugccuau

SEQ ID NO: 4050574 - RNA, 21 nt, SARS coronavirus
uacuacagacaauacauuugu

SEQ ID NO: 4050575 - RNA, 23 nt, SARS coronavirus
uacucuaauaacaccauugcuau

SEQ ID NO: 4050576 - RNA, 22 nt, SARS coronavirus
uaguauuuuuaauacuuugcuu

SEQ ID NO: 4050577 - RNA, 17 nt, SARS coronavirus
uagugagacaauuauuu

SEQ ID NO: 4050578 - RNA, 16 nt, SARS coronavirus
uauaaauugccagaug

SEQ ID NO: 4050579 - RNA, 15 nt, SARS coronavirus
uauuagacauuucac

SEQ ID NO: 4050580 - RNA, 19 nt, SARS coronavirus
uauuccuagccuggauuau

SEQ ID NO: 4050581 - RNA, 15 nt, SARS coronavirus
uauucgauaaugcau

SEQ ID NO: 4050582 - RNA, 18 nt, SARS coronavirus
uauucggaguuagaugau

SEQ ID NO: 4050583 - RNA, 14 nt, SARS coronavirus
uauugauuaucauu

SEQ ID NO: 4050584 - RNA, 19 nt, SARS coronavirus
uauuuauuuugcugccaca

SEQ ID NO: 4050585 - RNA, 12 nt, SARS coronavirus
ucaacaauuugg

SEQ ID NO: 4050586 - RNA, 14 nt, SARS coronavirus
ucaacgcauguaga

SEQ ID NO: 4050587 - RNA, 16 nt, SARS coronavirus
ucaacuccuggcagca

SEQ ID NO: 4050588 - RNA, 21 nt, SARS coronavirus
ucaacugucaagauccagcug

SEQ ID NO: 4050589 - RNA, 19 nt, SARS coronavirus
ucaagaaauucaacuccug

SEQ ID NO: 4050590 - RNA, 20 nt, SARS coronavirus
ucaagaaauucaacuccugg

SEQ ID NO: 4050591 - RNA, 20 nt, SARS coronavirus
ucaagcauuaaacacacuug

SEQ ID NO: 4050592 - RNA, 22 nt, SARS coronavirus
ucaagccucuucucgcuccuca

SEQ ID NO: 4050593 - RNA, 23 nt, SARS coronavirus
ucaagccucuucucgcuccucau

SEQ ID NO: 4050594 - RNA, 21 nt, SARS coronavirus
ucacagcucucacucagcaug

SEQ ID NO: 4050595 - RNA, 14 nt, SARS coronavirus
ucaccaaacugcug

SEQ ID NO: 4050596 - RNA, 22 nt, SARS coronavirus
ucacucauugaccuucaagaau

SEQ ID NO: 4050597 - RNA, 20 nt, SARS coronavirus
ucacuuuaauugacuucuau

SEQ ID NO: 4050598 - RNA, 15 nt, SARS coronavirus
ucagcauggcaagga

SEQ ID NO: 4050599 - RNA, 14 nt, SARS coronavirus
ucauuguugcugcu

SEQ ID NO: 4050600 - RNA, 15 nt, SARS coronavirus
ucauuguugcugcuc

SEQ ID NO: 4050601 - RNA, 13 nt, SARS coronavirus
uccaaucaacacc

SEQ ID NO: 4050602 - RNA, 13 nt, SARS coronavirus
uccagaacaaacc

SEQ ID NO: 4050603 - RNA, 22 nt, SARS coronavirus
uccagaacaaacccaaggaaau

SEQ ID NO: 4050604 - RNA, 15 nt, SARS coronavirus
uccagaugaccaaau

SEQ ID NO: 4050605 - RNA, 18 nt, SARS coronavirus
ucccaccaacagagccua

SEQ ID NO: 4050606 - RNA, 23 nt, SARS coronavirus
uccugcaaguacuguucaugcua

SEQ ID NO: 4050607 - RNA, 17 nt, SARS coronavirus
ucgccacuuuuucucau

SEQ ID NO: 4050608 - RNA, 17 nt, SARS coronavirus
ucgcgcuauugcugcua

SEQ ID NO: 4050609 - RNA, 12 nt, SARS coronavirus
ucuaauuucagg

SEQ ID NO: 4050610 - RNA, 22 nt, SARS coronavirus
ucuaguuagugguacugccacu

SEQ ID NO: 4050611 - RNA, 13 nt, SARS coronavirus
ucuauaucaagau

SEQ ID NO: 4050612 - RNA, 16 nt, SARS coronavirus
ucuauaucaagauguu

SEQ ID NO: 4050613 - RNA, 20 nt, SARS coronavirus
ucuaugagaaccaaaaacaa

SEQ ID NO: 4050614 - RNA, 17 nt, SARS coronavirus
ucucauuguugcugcuc

SEQ ID NO: 4050615 - RNA, 20 nt, SARS coronavirus
ucuccugcaaguacuguuca

SEQ ID NO: 4050616 - RNA, 13 nt, SARS coronavirus
ucugucuaugcau

SEQ ID NO: 4050617 - RNA, 18 nt, SARS coronavirus
ucuuccauuuuauucuaa

SEQ ID NO: 4050618 - RNA, 13 nt, SARS coronavirus
ugaaacuucucau

SEQ ID NO: 4050619 - RNA, 11 nt, SARS coronavirus
ugaaagagcuc

SEQ ID NO: 4050620 - RNA, 13 nt, SARS coronavirus
ugaacucuucuga

SEQ ID NO: 4050621 - RNA, 14 nt, SARS coronavirus
ugaacucuucugaa

SEQ ID NO: 4050622 - RNA, 17 nt, SARS coronavirus
ugaacucuucugaagga

SEQ ID NO: 4050623 - RNA, 15 nt, SARS coronavirus
ugaacuuuuaaaugc

SEQ ID NO: 4050624 - RNA, 21 nt, SARS coronavirus
ugaaggucaccaaacugcugc

SEQ ID NO: 4050625 - RNA, 20 nt, SARS coronavirus
ugacaaagauccacaauuca

SEQ ID NO: 4050626 - RNA, 22 nt, SARS coronavirus
ugacaauaaccagaauggagga

SEQ ID NO: 4050627 - RNA, 22 nt, SARS coronavirus
ugacgcauacaaaacauuccca

SEQ ID NO: 4050628 - RNA, 20 nt, SARS coronavirus
ugacggcaaaaugaaagagc

SEQ ID NO: 4050629 - RNA, 15 nt, SARS coronavirus
ugacguuauaauaag

SEQ ID NO: 4050630 - RNA, 19 nt, SARS coronavirus
ugacuuccagguuacaaua

SEQ ID NO: 4050631 - RNA, 18 nt, SARS coronavirus
ugacuucuauuugugcuu

SEQ ID NO: 4050632 - RNA, 16 nt, SARS coronavirus
ugagagagacauaucu

SEQ ID NO: 4050633 - RNA, 14 nt, SARS coronavirus
ugauauuaaugcua

SEQ ID NO: 4050634 - RNA, 14 nt, SARS coronavirus
ugaugaaaauggua

SEQ ID NO: 4050635 - RNA, 22 nt, SARS coronavirus
ugauguuucuacagcaauucau

SEQ ID NO: 4050636 - RNA, 19 nt, SARS coronavirus
ugauguuucugauuucacu

SEQ ID NO: 4050637 - RNA, 13 nt, SARS coronavirus
ugauuacaaacau

SEQ ID NO: 4050638 - RNA, 19 nt, SARS coronavirus
ugauucagguuuugcugca

SEQ ID NO: 4050639 - RNA, 20 nt, SARS coronavirus
ugauuccguucgagauccua

SEQ ID NO: 4050640 - RNA, 21 nt, SARS coronavirus
ugauuucuccagacaacuuca

SEQ ID NO: 4050641 - RNA, 19 nt, SARS coronavirus
ugcaagaucaguuucacca

SEQ ID NO: 4050642 - RNA, 18 nt, SARS coronavirus
ugcaauuuacugcugcua

SEQ ID NO: 4050643 - RNA, 22 nt, SARS coronavirus
ugcacuagcacacacuuugcuu

SEQ ID NO: 4050644 - RNA, 13 nt, SARS coronavirus
ugcaguugccuca

SEQ ID NO: 4050645 - RNA, 23 nt, SARS coronavirus
ugcaugggagagaaaaaaaauuu

SEQ ID NO: 4050646 - RNA, 23 nt, SARS coronavirus
ugccaaaaggcuucuacgcagag

SEQ ID NO: 4050647 - RNA, 14 nt, SARS coronavirus
ugccaccucugcuc

SEQ ID NO: 4050648 - RNA, 20 nt, SARS coronavirus
ugcccucgcgcuauugcugc

SEQ ID NO: 4050649 - RNA, 13 nt, SARS coronavirus
ugccuauucuaau

SEQ ID NO: 4050650 - RNA, 17 nt, SARS coronavirus
ugcuaaucuugcugcua

SEQ ID NO: 4050651 - RNA, 20 nt, SARS coronavirus
ugcuaauuugcuucuccaau

SEQ ID NO: 4050652 - RNA, 16 nt, SARS coronavirus
ugcuacaacuuccuca

SEQ ID NO: 4050653 - RNA, 19 nt, SARS coronavirus
ugcuagagaucucauuugu

SEQ ID NO: 4050654 - RNA, 15 nt, SARS coronavirus
ugcuuaucauggcag

SEQ ID NO: 4050655 - RNA, 18 nt, SARS coronavirus
uggaaacuauaaauuaaa

SEQ ID NO: 4050656 - RNA, 20 nt, SARS coronavirus
uggaagucacaccuucggga

SEQ ID NO: 4050657 - RNA, 20 nt, SARS coronavirus
uggaaugucacgcauuggca

SEQ ID NO: 4050658 - RNA, 15 nt, SARS coronavirus
uggagcuucugcuga

SEQ ID NO: 4050659 - RNA, 15 nt, SARS coronavirus
uggcgacauuucagg

SEQ ID NO: 4050660 - RNA, 19 nt, SARS coronavirus
uggcuacuaccgaagagcu

SEQ ID NO: 4050661 - RNA, 15 nt, SARS coronavirus
uggcuauuucaccga

SEQ ID NO: 4050662 - RNA, 23 nt, SARS coronavirus
ugggagagaaaaaaaauuucuaa

SEQ ID NO: 4050663 - RNA, 22 nt, SARS coronavirus
ugguaccuucaugaaggucacc

SEQ ID NO: 4050664 - RNA, 20 nt, SARS coronavirus
ugguauuuauuuugcugcca

SEQ ID NO: 4050665 - RNA, 18 nt, SARS coronavirus
uggugguuauucugagga

SEQ ID NO: 4050666 - RNA, 15 nt, SARS coronavirus
ugucgucaacauuca

SEQ ID NO: 4050667 - RNA, 16 nt, SARS coronavirus
ugucguuacugaaggu

SEQ ID NO: 4050668 - RNA, 13 nt, SARS coronavirus
ugugacucuucuu

SEQ ID NO: 4050669 - RNA, 13 nt, SARS coronavirus
ugugucaauuuua

SEQ ID NO: 4050670 - RNA, 21 nt, SARS coronavirus
uguuauuggccauuaaaugau

SEQ ID NO: 4050671 - RNA, 16 nt, SARS coronavirus
uguucuauaucaagau

SEQ ID NO: 4050672 - RNA, 20 nt, SARS coronavirus
uguugcaguugccucaaggg

SEQ ID NO: 4050673 - RNA, 20 nt, SARS coronavirus
uguugucuuccuacauguca

SEQ ID NO: 4050674 - RNA, 14 nt, SARS coronavirus
uguuuauuuucuua

SEQ ID NO: 4050675 - RNA, 18 nt, SARS coronavirus
uuaaauaaacgaacaaau

SEQ ID NO: 4050676 - RNA, 22 nt, SARS coronavirus
uuaaggaugguauuuauuuugc

SEQ ID NO: 4050677 - RNA, 14 nt, SARS coronavirus
uuacaaauuuuaga

SEQ ID NO: 4050678 - RNA, 12 nt, SARS coronavirus
uuacugcugcua

SEQ ID NO: 4050679 - RNA, 20 nt, SARS coronavirus
uuagacauuucaccuugcgc

SEQ ID NO: 4050680 - RNA, 20 nt, SARS coronavirus
uuauaaauauagguaucuua

SEQ ID NO: 4050681 - RNA, 21 nt, SARS coronavirus
uuauccauaaaacgaacauga

SEQ ID NO: 4050682 - RNA, 12 nt, SARS coronavirus
uucaaacaugca

SEQ ID NO: 4050683 - RNA, 19 nt, SARS coronavirus
uucaauagugagacaauua

SEQ ID NO: 4050684 - RNA, 17 nt, SARS coronavirus
uucccaccaacagagcc

SEQ ID NO: 4050685 - RNA, 13 nt, SARS coronavirus
uucucuuccugac

SEQ ID NO: 4050686 - RNA, 22 nt, SARS coronavirus
uucugucgucaacauucaaaaa

SEQ ID NO: 4050687 - RNA, 15 nt, SARS coronavirus
uugccaccucugcuc

SEQ ID NO: 4050688 - RNA, 14 nt, SARS coronavirus
uugccuauucuaau

SEQ ID NO: 4050689 - RNA, 20 nt, SARS coronavirus
uugccucaagggugcaugcu

SEQ ID NO: 4050690 - RNA, 14 nt, SARS coronavirus
uugcuauuuggaau

SEQ ID NO: 4050691 - RNA, 18 nt, SARS coronavirus
uugcugccuacacugcug

SEQ ID NO: 4050692 - RNA, 15 nt, SARS coronavirus
uugugcuaguuacca

SEQ ID NO: 4050693 - RNA, 15 nt, SARS coronavirus
uugugcuugcugcug

SEQ ID NO: 4050694 - RNA, 12 nt, SARS coronavirus
uuguugcugcuc

SEQ ID NO: 4050695 - RNA, 18 nt, SARS coronavirus
uuuaccagaccucuaauu

SEQ ID NO: 4050696 - RNA, 22 nt, SARS coronavirus
uuuacgauacauagucuacucu

SEQ ID NO: 4050697 - RNA, 16 nt, SARS coronavirus
uuuacuaccagcuuga

SEQ ID NO: 4050698 - RNA, 13 nt, SARS coronavirus
uuuacugcugcua

SEQ ID NO: 4050699 - RNA, 18 nt, SARS coronavirus
uuugacuuguauuucucu

SEQ ID NO: 4050700 - RNA, 16 nt, SARS coronavirus
uuuggugguuuuaauu

SEQ ID NO: 4050701 - RNA, 19 nt, SARS coronavirus
gacgaguucguggugguga

SEQ ID NO: 4050702 - RNA, 15 nt, SARS coronavirus
gacgugguccagaac

SEQ ID NO: 4050703 - RNA, 19 nt, SARS coronavirus
gacuacuguauaccauaua

SEQ ID NO: 4050704 - RNA, 20 nt, SARS coronavirus
gacugaugaagcucagccuu

SEQ ID NO: 4050705 - RNA, 21 nt, SARS coronavirus
gagauguuggcuuuguuggaa

SEQ ID NO: 4050706 - RNA, 20 nt, SARS coronavirus
gagccaguucucaagggugu

SEQ ID NO: 4050707 - RNA, 22 nt, SARS coronavirus
gagccuaaaaaggacaaaaaga

SEQ ID NO: 4050708 - RNA, 21 nt, SARS coronavirus
gaggacgcaauggggcaaggc

SEQ ID NO: 4050709 - RNA, 17 nt, SARS coronavirus
gaguuagaugaugaaga

SEQ ID NO: 4050710 - RNA, 19 nt, SARS coronavirus
gaguugcuaauccagcaau

SEQ ID NO: 4050711 - RNA, 14 nt, SARS coronavirus
gaugaagcucagcc

SEQ ID NO: 4050712 - RNA, 16 nt, SARS coronavirus
gauugcgauugcaaug

SEQ ID NO: 4050713 - RNA, 16 nt, SARS coronavirus
gauuucuccagacaac

SEQ ID NO: 4050714 - RNA, 20 nt, SARS coronavirus
gcaacgacaauauugcuuug

SEQ ID NO: 4050715 - RNA, 17 nt, SARS coronavirus
gcaauggggcaaggcca

SEQ ID NO: 4050716 - RNA, 17 nt, SARS coronavirus
gcaauuuacugcugcua

SEQ ID NO: 4050717 - RNA, 17 nt, SARS coronavirus
gcacacacuuugcuuuu

SEQ ID NO: 4050718 - RNA, 14 nt, SARS coronavirus
gcagauucuuuugu

SEQ ID NO: 4050719 - RNA, 19 nt, SARS coronavirus
gcaguugccucaagggugc

SEQ ID NO: 4050720 - RNA, 16 nt, SARS coronavirus
gcauguaacuuugaau

SEQ ID NO: 4050721 - RNA, 12 nt, SARS coronavirus
gccacugcugga

SEQ ID NO: 4050722 - RNA, 22 nt, SARS coronavirus
gcccucgcgcuauugcugcuag

SEQ ID NO: 4050723 - RNA, 14 nt, SARS coronavirus
gcgcuaacaaagaa

SEQ ID NO: 4050724 - RNA, 23 nt, SARS coronavirus
gcguacuucuuuuucuugcuuuc

SEQ ID NO: 4050725 - RNA, 17 nt, SARS coronavirus
gcguuccaaucaacacc

SEQ ID NO: 4050726 - RNA, 14 nt, SARS coronavirus
gcuacaacuuccuc

SEQ ID NO: 4050727 - RNA, 15 nt, SARS coronavirus
gcuauaccuacuaac

SEQ ID NO: 4050728 - RNA, 13 nt, SARS coronavirus
gcucaauaaaaga

SEQ ID NO: 4050729 - RNA, 13 nt, SARS coronavirus
gcucaaugugguc

SEQ ID NO: 4050730 - RNA, 20 nt, SARS coronavirus
gcuccaagugccucugcauu

SEQ ID NO: 4050731 - RNA, 21 nt, SARS coronavirus
gcucuugugguucuugcugca

SEQ ID NO: 4050732 - RNA, 16 nt, SARS coronavirus
gcugaacaagcacauu

SEQ ID NO: 4050733 - RNA, 19 nt, SARS coronavirus
gcugaacucaaaugcucug

SEQ ID NO: 4050734 - RNA, 18 nt, SARS coronavirus
gcugccaccgugcuacaa

SEQ ID NO: 4050735 - RNA, 19 nt, SARS coronavirus
gcugccuacacugcugcuc

SEQ ID NO: 4050736 - RNA, 17 nt, SARS coronavirus
gcuugagucuacacaaa

SEQ ID NO: 4050737 - RNA, 14 nt, SARS coronavirus
gcuugauguggcuu

SEQ ID NO: 4050738 - RNA, 13 nt, SARS coronavirus
gcuugugcugacg

SEQ ID NO: 4050739 - RNA, 15 nt, SARS coronavirus
ggaacaacauugcca

SEQ ID NO: 4050740 - RNA, 11 nt, SARS coronavirus
ggagaggaacu

SEQ ID NO: 4050741 - RNA, 20 nt, SARS coronavirus
ggaggacuugaaagagccac

SEQ ID NO: 4050742 - RNA, 19 nt, SARS coronavirus
ggcaaaaugaaagagcuca

SEQ ID NO: 4050743 - RNA, 22 nt, SARS coronavirus
ggccaaacugucacuaagaaau

SEQ ID NO: 4050744 - RNA, 16 nt, SARS coronavirus
ggccauuaaaugauua

SEQ ID NO: 4050745 - RNA, 12 nt, SARS coronavirus
ggcucuucagga

SEQ ID NO: 4050746 - RNA, 23 nt, SARS coronavirus
ggcuucuacgcagagggaagcag

SEQ ID NO: 4050747 - RNA, 23 nt, SARS coronavirus
ggcuucugcuaaucuugcugcua

SEQ ID NO: 4050748 - RNA, 17 nt, SARS coronavirus
ggggaaauucuccugcu

SEQ ID NO: 4050749 - RNA, 12 nt, SARS coronavirus
gguauucuugcu

SEQ ID NO: 4050750 - RNA, 17 nt, SARS coronavirus
ggucaccaaacugcugc

SEQ ID NO: 4050751 - RNA, 18 nt, SARS coronavirus
guaaaaauugacaaugcu

SEQ ID NO: 4050752 - RNA, 22 nt, SARS coronavirus
guaacacaacaacuaaucaggg

SEQ ID NO: 4050753 - RNA, 15 nt, SARS coronavirus
guaaugccuguuucu

SEQ ID NO: 4050754 - RNA, 22 nt, SARS coronavirus
guacgacuguacuacuaaaaga

SEQ ID NO: 4050755 - RNA, 23 nt, SARS coronavirus
gucacuaagaaaucugcugcuga

SEQ ID NO: 4050756 - RNA, 13 nt, SARS coronavirus
gucauacugcuga

SEQ ID NO: 4050757 - RNA, 17 nt, SARS coronavirus
guccagaugaccaaauu

SEQ ID NO: 4050758 - RNA, 14 nt, SARS coronavirus
gugcguacugcugc

SEQ ID NO: 4050759 - RNA, 17 nt, SARS coronavirus
guguugguaccuucaug

SEQ ID NO: 4050760 - RNA, 14 nt, SARS coronavirus
guuaaagacccacc

SEQ ID NO: 4050761 - RNA, 18 nt, SARS coronavirus
guuaccaucuauucacau

SEQ ID NO: 4050762 - RNA, 24 nt, SARS coronavirus
guucaagcuccuaauuacacucaa

SEQ ID NO: 4050763 - RNA, 17 nt, SARS coronavirus
guugaaugaucuuugcu

SEQ ID NO: 4050764 - RNA, 22 nt, SARS coronavirus
guugcaguugccucaagggugc

SEQ ID NO: 4050765 - RNA, 18 nt, SARS coronavirus
guugcuguucuauaucaa

SEQ ID NO: 4050766 - RNA, 21 nt, SARS coronavirus
uaaaaauuuaaaugaaucacu

SEQ ID NO: 4050767 - RNA, 14 nt, SARS coronavirus
uaacaaugcugcca

SEQ ID NO: 4050768 - RNA, 20 nt, SARS coronavirus
uaaccagaaugcucaagcau

SEQ ID NO: 4050769 - RNA, 15 nt, SARS coronavirus
uaagaagaauuauuc

SEQ ID NO: 4050770 - RNA, 14 nt, SARS coronavirus
uaagguacaacacu

SEQ ID NO: 4050771 - RNA, 12 nt, SARS coronavirus
uaauuacuacag

SEQ ID NO: 4050772 - RNA, 15 nt, SARS coronavirus
uaauuuuaauggacu

SEQ ID NO: 4050773 - RNA, 14 nt, SARS coronavirus
uacaacuuccucaa

SEQ ID NO: 4050774 - RNA, 22 nt, SARS coronavirus
uacaauugucguuacugaaggu

SEQ ID NO: 4050775 - RNA, 19 nt, SARS coronavirus
uacacucaacauacuucau

SEQ ID NO: 4050776 - RNA, 15 nt, SARS coronavirus
uacagccuuuucacc

SEQ ID NO: 4050777 - RNA, 22 nt, SARS coronavirus
uacaucaccagauguugaucuu

SEQ ID NO: 4050778 - RNA, 16 nt, SARS coronavirus
uaccaaaauaauugcg

SEQ ID NO: 4050779 - RNA, 19 nt, SARS coronavirus
uaccaaccuuacagaguug

SEQ ID NO: 4050780 - RNA, 21 nt, SARS coronavirus
uaccagaccucuaauuucagg

SEQ ID NO: 4050781 - RNA, 15 nt, SARS coronavirus
uaccaugaacaacaa

SEQ ID NO: 4050782 - RNA, 14 nt, SARS coronavirus
uaccuucaugaagg

SEQ ID NO: 4050783 - RNA, 17 nt, SARS coronavirus
uaccuuuuaaggauggu

SEQ ID NO: 4050784 - RNA, 15 nt, SARS coronavirus
uacuaaaaugucuga

SEQ ID NO: 4050785 - RNA, 14 nt, SARS coronavirus
uacugccacugcug

SEQ ID NO: 4050786 - RNA, 15 nt, SARS coronavirus
uacuuauagcacugc

SEQ ID NO: 4050787 - RNA, 19 nt, SARS coronavirus
uagcuacuucguugcuucc

SEQ ID NO: 4050788 - RNA, 21 nt, SARS coronavirus
uagggaggacuugaaagagcc

SEQ ID NO: 4050789 - RNA, 15 nt, SARS coronavirus
uagggguaauacuua

SEQ ID NO: 4050790 - RNA, 17 nt, SARS coronavirus
uagucaagggagaugau

SEQ ID NO: 4050791 - RNA, 18 nt, SARS coronavirus
uauaccuacuaacuuuuc

SEQ ID NO: 4050792 - RNA, 15 nt, SARS coronavirus
uaugguucaaacaug

SEQ ID NO: 4050793 - RNA, 22 nt, SARS coronavirus
uauucuacuggaaacaauguau

SEQ ID NO: 4050794 - RNA, 16 nt, SARS coronavirus
uauugaggacuugcuc

SEQ ID NO: 4050795 - RNA, 17 nt, SARS coronavirus
uauuggccauuaaauga

SEQ ID NO: 4050796 - RNA, 16 nt, SARS coronavirus
ucaaauaccuuuugcu

SEQ ID NO: 4050797 - RNA, 16 nt, SARS coronavirus
ucaaccuauagaugua

SEQ ID NO: 4050798 - RNA, 23 nt, SARS coronavirus
ucaagaaucacuuacaacaacau

SEQ ID NO: 4050799 - RNA, 19 nt, SARS coronavirus
ucaagugugcuaaaugaua

SEQ ID NO: 4050800 - RNA, 19 nt, SARS coronavirus
ucaauuagcauuacuacag

SEQ ID NO: 4050801 - RNA, 18 nt, SARS coronavirus
ucacacuagccauccuua

SEQ ID NO: 4050802 - RNA, 23 nt, SARS coronavirus
ucagacaaggaacugauuacaaa

SEQ ID NO: 4050803 - RNA, 18 nt, SARS coronavirus
ucagcauggcaaggagga

SEQ ID NO: 4050804 - RNA, 19 nt, SARS coronavirus
ucauacaucaccagauguu

SEQ ID NO: 4050805 - RNA, 21 nt, SARS coronavirus
ucaugaaggucaccaaacugc

SEQ ID NO: 4050806 - RNA, 20 nt, SARS coronavirus
ucauuguugcugcucuagua

SEQ ID NO: 4050807 - RNA, 14 nt, SARS coronavirus
uccagacaacuuca

SEQ ID NO: 4050808 - RNA, 22 nt, SARS coronavirus
uccuauuggagcuggcauuugu

SEQ ID NO: 4050809 - RNA, 12 nt, SARS coronavirus
ucggauggcuug

SEQ ID NO: 4050810 - RNA, 15 nt, SARS coronavirus
ucggggaccaagacc

SEQ ID NO: 4050811 - RNA, 20 nt, SARS coronavirus
ucuaauaacaccauugcuau

SEQ ID NO: 4050812 - RNA, 20 nt, SARS coronavirus
ucucaaaauccacuugcuga

SEQ ID NO: 4050813 - RNA, 15 nt, SARS coronavirus
ucucauuguugcugc

SEQ ID NO: 4050814 - RNA, 17 nt, SARS coronavirus
ucuccgggggacaauug

SEQ ID NO: 4050815 - RNA, 16 nt, SARS coronavirus
ucuccugcaaguacug

SEQ ID NO: 4050816 - RNA, 20 nt, SARS coronavirus
ucuggcucuuguggccagua

SEQ ID NO: 4050817 - RNA, 17 nt, SARS coronavirus
ucuuagaucaauuacug

SEQ ID NO: 4050818 - RNA, 13 nt, SARS coronavirus
ucuuaggagaaug

SEQ ID NO: 4050819 - RNA, 16 nt, SARS coronavirus
ucuucucgcuccucau

SEQ ID NO: 4050820 - RNA, 14 nt, SARS coronavirus
ucuuguggccagua

SEQ ID NO: 4050821 - RNA, 13 nt, SARS coronavirus
ugaaaauuauucu

SEQ ID NO: 4050822 - RNA, 23 nt, SARS coronavirus
ugaaagagccaccacauuuucau

SEQ ID NO: 4050823 - RNA, 16 nt, SARS coronavirus
ugaaagagcucagccc

SEQ ID NO: 4050824 - RNA, 15 nt, SARS coronavirus
ugaacucaaaugcuc

SEQ ID NO: 4050825 - RNA, 13 nt, SARS coronavirus
ugaagcucagccu

SEQ ID NO: 4050826 - RNA, 18 nt, SARS coronavirus
ugacaauaaccagaaugg

SEQ ID NO: 4050827 - RNA, 20 nt, SARS coronavirus
ugacguuauaauaaguucaa

SEQ ID NO: 4050828 - RNA, 14 nt, SARS coronavirus
ugacucauucaaag

SEQ ID NO: 4050829 - RNA, 14 nt, SARS coronavirus
ugaugaccacacaa

SEQ ID NO: 4050830 - RNA, 18 nt, SARS coronavirus
ugcacaccuaauguuacu

SEQ ID NO: 4050831 - RNA, 21 nt, SARS coronavirus
ugccaccgugcuacaacuucc

SEQ ID NO: 4050832 - RNA, 17 nt, SARS coronavirus
ugccuacacugcugcuc

SEQ ID NO: 4050833 - RNA, 18 nt, SARS coronavirus
ugccuauauggaagagcc

SEQ ID NO: 4050834 - RNA, 14 nt, SARS coronavirus
ugcucaaguaugau

SEQ ID NO: 4050835 - RNA, 15 nt, SARS coronavirus
ugcucuacaacucaa

SEQ ID NO: 4050836 - RNA, 24 nt, SARS coronavirus
ugcugacgguacucgacauaccua

SEQ ID NO: 4050837 - RNA, 22 nt, SARS coronavirus
ugcugccuacacugcugcucua

SEQ ID NO: 4050838 - RNA, 18 nt, SARS coronavirus
ugcuuugcuaguacagua

SEQ ID NO: 4050839 - RNA, 22 nt, SARS coronavirus
ugcuuuuuagccuuucugcuau

SEQ ID NO: 4050840 - RNA, 14 nt, SARS coronavirus
uggaacaaaugcuu

SEQ ID NO: 4050841 - RNA, 15 nt, SARS coronavirus
uggaaugucacgcau

SEQ ID NO: 4050842 - RNA, 20 nt, SARS coronavirus
uggagagguuuuuaaugcua

SEQ ID NO: 4050843 - RNA, 19 nt, SARS coronavirus
uggaugauuucuccagaca

SEQ ID NO: 4050844 - RNA, 13 nt, SARS coronavirus
uggcgcugcucuu

SEQ ID NO: 4050845 - RNA, 13 nt, SARS coronavirus
uggggcaaggcca

SEQ ID NO: 4050846 - RNA, 18 nt, SARS coronavirus
uggggcaaggccaaaaca

SEQ ID NO: 4050847 - RNA, 23 nt, SARS coronavirus
uggggcaaggccaaaacagcgcc

SEQ ID NO: 4050848 - RNA, 14 nt, SARS coronavirus
ugguaccuucauga

SEQ ID NO: 4050849 - RNA, 21 nt, SARS coronavirus
uggugguuuuaauuuuucaca

SEQ ID NO: 4050850 - RNA, 22 nt, SARS coronavirus
uguccuuuuggagagguuuuua

SEQ ID NO: 4050851 - RNA, 12 nt, SARS coronavirus
ugugcagaauga

SEQ ID NO: 4050852 - RNA, 12 nt, SARS coronavirus
uguuaacugcac

SEQ ID NO: 4050853 - RNA, 16 nt, SARS coronavirus
uguucuuggacaauca

SEQ ID NO: 4050854 - RNA, 19 nt, SARS coronavirus
uguucuuggacaaucaaaa

SEQ ID NO: 4050855 - RNA, 15 nt, SARS coronavirus
uuaaucaauguguaa

SEQ ID NO: 4050856 - RNA, 11 nt, SARS coronavirus
uuaauuguuau

SEQ ID NO: 4050857 - RNA, 20 nt, SARS coronavirus
uuacaccuggaacaaaugcu

SEQ ID NO: 4050858 - RNA, 22 nt, SARS coronavirus
uuacaggcagacuucaaagccu

SEQ ID NO: 4050859 - RNA, 20 nt, SARS coronavirus
uuaccagaccucuaauuuca

SEQ ID NO: 4050860 - RNA, 17 nt, SARS coronavirus
uuacugcacagccagua

SEQ ID NO: 4050861 - RNA, 15 nt, SARS coronavirus
uuauagcacugcuug

SEQ ID NO: 4050862 - RNA, 18 nt, SARS coronavirus
uucaaaaaucauacauca

SEQ ID NO: 4050863 - RNA, 21 nt, SARS coronavirus
uucaagaaucacuuacaacaa

SEQ ID NO: 4050864 - RNA, 17 nt, SARS coronavirus
uucacaucuuuugcuug

SEQ ID NO: 4050865 - RNA, 18 nt, SARS coronavirus
uucuaauuguguugcuga

SEQ ID NO: 4050866 - RNA, 22 nt, SARS coronavirus
uucugcugauucaacucaggca

SEQ ID NO: 4050867 - RNA, 23 nt, SARS coronavirus
uugaauacacccaaagaccacau

SEQ ID NO: 4050868 - RNA, 18 nt, SARS coronavirus
uugacuuguauuucucua

SEQ ID NO: 4050869 - RNA, 15 nt, SARS coronavirus
uugcugauuauaauu

SEQ ID NO: 4050870 - RNA, 18 nt, SARS coronavirus
uugcuucuccaaugucua

SEQ ID NO: 4050871 - RNA, 18 nt, SARS coronavirus
uuggaaugucacgcauug

SEQ ID NO: 4050872 - RNA, 18 nt, SARS coronavirus
uuguaagguacaacacua

SEQ ID NO: 4050873 - RNA, 20 nt, SARS coronavirus
uuguacauaauaaagcuugu

SEQ ID NO: 4050874 - RNA, 21 nt, SARS coronavirus
uuguguuuaauggcacuucuu

SEQ ID NO: 4050875 - RNA, 15 nt, SARS coronavirus
uuguugcaguugccu

SEQ ID NO: 4050876 - RNA, 15 nt, SARS coronavirus
uuguugcugcucuag

SEQ ID NO: 4050877 - RNA, 15 nt, SARS coronavirus
uuuaacaagcuuguu

SEQ ID NO: 4050878 - RNA, 12 nt, SARS coronavirus
uuuaaguugccu

SEQ ID NO: 4050879 - RNA, 21 nt, SARS coronavirus
uuuaauagcuucuuaggagaa

SEQ ID NO: 4050880 - RNA, 17 nt, SARS coronavirus
uuuacccaauaauacug

SEQ ID NO: 4050881 - RNA, 17 nt, SARS coronavirus
uuucaucgaggccacgc

SEQ ID NO: 4050882 - RNA, 17 nt, SARS coronavirus
uuucaucuuguugacuu

SEQ ID NO: 4050883 - RNA, 17 nt, SARS coronavirus
uuucugauuucacugau

SEQ ID NO: 4050884 - RNA, 20 nt, SARS coronavirus
uuugagagagacauaucuaa

SEQ ID NO: 4050885 - RNA, 20 nt, SARS coronavirus
uuugcuugucgcugcaggua

SEQ ID NO: 4050886 - RNA, 22 nt, SARS coronavirus
uuugguuuucacucgaaaucca

SEQ ID NO: 4050887 - RNA, 12 nt, SARS coronavirus
uuuuauucuaau

SEQ ID NO: 4050888 - RNA, 13 nt, SARS coronavirus
uuuucaaccuuua

SEQ ID NO: 4050889 - RNA, 20 nt, SARS coronavirus
uuuucaaccuuuaagugcua

SEQ ID NO: 4050890 - RNA, 14 nt, SARS coronavirus
uuuuuaaugcuacu

SEQ ID NO: 4050891 - RNA, 17 nt, SARS coronavirus
ucggauggcuuguuauu

SEQ ID NO: 4050892 - RNA, 17 nt, SARS coronavirus
ucuaaaaagccucgcca

SEQ ID NO: 4050893 - RNA, 22 nt, SARS coronavirus
ucuacuggaaacaauguauucc

SEQ ID NO: 4050894 - RNA, 16 nt, SARS coronavirus
ucuagaagaaccuugu

SEQ ID NO: 4050895 - RNA, 21 nt, SARS coronavirus
ucuaugagggggguuuacuau

SEQ ID NO: 4050896 - RNA, 21 nt, SARS coronavirus
ucucacucagcauggcaagga

SEQ ID NO: 4050897 - RNA, 18 nt, SARS coronavirus
ucuucaaagagauuucaa

SEQ ID NO: 4050898 - RNA, 18 nt, SARS coronavirus
ucuuggcgacauuucagg

SEQ ID NO: 4050899 - RNA, 16 nt, SARS coronavirus
ucuuugcuguuucuaa

SEQ ID NO: 4050900 - RNA, 12 nt, SARS coronavirus
ugaaaauuauuc

SEQ ID NO: 4050901 - RNA, 11 nt, SARS coronavirus
ugaaacuucuc

SEQ ID NO: 4050902 - RNA, 16 nt, SARS coronavirus
ugaaugaucuuugcuu

SEQ ID NO: 4050903 - RNA, 18 nt, SARS coronavirus
ugacaaugcuucuccugc

SEQ ID NO: 4050904 - RNA, 18 nt, SARS coronavirus
ugacagguuaauuacagg

SEQ ID NO: 4050905 - RNA, 22 nt, SARS coronavirus
ugaccagaccgcucauggaaag

SEQ ID NO: 4050906 - RNA, 16 nt, SARS coronavirus
ugacucugagccaguu

SEQ ID NO: 4050907 - RNA, 16 nt, SARS coronavirus
ugacucuucuuccugc

SEQ ID NO: 4050908 - RNA, 22 nt, SARS coronavirus
ugacucuucuuccugcggcuga

SEQ ID NO: 4050909 - RNA, 14 nt, SARS coronavirus
ugagauuuuuuacu

SEQ ID NO: 4050910 - RNA, 19 nt, SARS coronavirus
ugagcaauauauuaaaugg

SEQ ID NO: 4050911 - RNA, 19 nt, SARS coronavirus
ugaucuuggcgacauuuca

SEQ ID NO: 4050912 - RNA, 12 nt, SARS coronavirus
ugaugaagcuca

SEQ ID NO: 4050913 - RNA, 15 nt, SARS coronavirus
ugaugccuuuucgcu

SEQ ID NO: 4050914 - RNA, 22 nt, SARS coronavirus
ugaugccuuuucgcuugauguu

SEQ ID NO: 4050915 - RNA, 14 nt, SARS coronavirus
ugauuguauuuaca

SEQ ID NO: 4050916 - RNA, 18 nt, SARS coronavirus
ugcaacugagggagccuu

SEQ ID NO: 4050917 - RNA, 15 nt, SARS coronavirus
ugcacaauuugcucc

SEQ ID NO: 4050918 - RNA, 23 nt, SARS coronavirus
ugcacucucagguauugcugcug

SEQ ID NO: 4050919 - RNA, 22 nt, SARS coronavirus
ugcccucgcgcuauugcugcua

SEQ ID NO: 4050920 - RNA, 14 nt, SARS coronavirus
ugccuacacugcug

SEQ ID NO: 4050921 - RNA, 14 nt, SARS coronavirus
ugccuauauggaag

SEQ ID NO: 4050922 - RNA, 18 nt, SARS coronavirus
ugcuauccccaugugauu

SEQ ID NO: 4050923 - RNA, 19 nt, SARS coronavirus
ugcuauuccuuguuuuaau

SEQ ID NO: 4050924 - RNA, 14 nt, SARS coronavirus
ugcuccaagugccu

SEQ ID NO: 4050925 - RNA, 20 nt, SARS coronavirus
ugcugccuacacugcugcuc

SEQ ID NO: 4050926 - RNA, 16 nt, SARS coronavirus
ugcuggacuaauugcc

SEQ ID NO: 4050927 - RNA, 20 nt, SARS coronavirus
ugcuggacuaauugccaucg

SEQ ID NO: 4050928 - RNA, 15 nt, SARS coronavirus
ugcuggcacacacau

SEQ ID NO: 4050929 - RNA, 24 nt, SARS coronavirus
ugcuucaccauuaagagaaagaca

SEQ ID NO: 4050930 - RNA, 14 nt, SARS coronavirus
ugcuuccuucaggc

SEQ ID NO: 4050931 - RNA, 12 nt, SARS coronavirus
ugcuugcugcug

SEQ ID NO: 4050932 - RNA, 20 nt, SARS coronavirus
uggaagagcccuaaugugua

SEQ ID NO: 4050933 - RNA, 14 nt, SARS coronavirus
uggaugacaaagau

SEQ ID NO: 4050934 - RNA, 14 nt, SARS coronavirus
uggcauggaaguca

SEQ ID NO: 4050935 - RNA, 16 nt, SARS coronavirus
uggcccagaagcuuca

SEQ ID NO: 4050936 - RNA, 16 nt, SARS coronavirus
uggcugacuuaucaug

SEQ ID NO: 4050937 - RNA, 21 nt, SARS coronavirus
uggcuuugugcucuaggaaag

SEQ ID NO: 4050938 - RNA, 18 nt, SARS coronavirus
uggguugcaacugaggga

SEQ ID NO: 4050939 - RNA, 21 nt, SARS coronavirus
uggucauucaacccagaaaca

SEQ ID NO: 4050940 - RNA, 16 nt, SARS coronavirus
uggugacggcaaaaug

SEQ ID NO: 4050941 - RNA, 20 nt, SARS coronavirus
uggugacggcaaaaugaaag

SEQ ID NO: 4050942 - RNA, 18 nt, SARS coronavirus
ugguuuucacucgaaauc

SEQ ID NO: 4050943 - RNA, 19 nt, SARS coronavirus
uguauuccagacucaagca

SEQ ID NO: 4050944 - RNA, 20 nt, SARS coronavirus
ugucaagauccagcuggugg

SEQ ID NO: 4050945 - RNA, 21 nt, SARS coronavirus
ugucacgcauuggcauggaag

SEQ ID NO: 4050946 - RNA, 15 nt, SARS coronavirus
ugucuacagaauuaa

SEQ ID NO: 4050947 - RNA, 17 nt, SARS coronavirus
ugugacucuucuuccug

SEQ ID NO: 4050948 - RNA, 17 nt, SARS coronavirus
ugugucaauuuuaauuu

SEQ ID NO: 4050949 - RNA, 17 nt, SARS coronavirus
uguuacaggguuucaua

SEQ ID NO: 4050950 - RNA, 12 nt, SARS coronavirus
uguuauugcuga

SEQ ID NO: 4050951 - RNA, 21 nt, SARS coronavirus
uguuucaucuuguugacuucc

SEQ ID NO: 4050952 - RNA, 15 nt, SARS coronavirus
uguuucugauuucac

SEQ ID NO: 4050953 - RNA, 16 nt, SARS coronavirus
uuaaauaaacgaacaa

SEQ ID NO: 4050954 - RNA, 23 nt, SARS coronavirus
uuaaauggccuugguauguuugg

SEQ ID NO: 4050955 - RNA, 17 nt, SARS coronavirus
uuaacauugcuuaucau

SEQ ID NO: 4050956 - RNA, 21 nt, SARS coronavirus
uuacaacaacaucaacugcau

SEQ ID NO: 4050957 - RNA, 17 nt, SARS coronavirus
uuacauuugguggaccc

SEQ ID NO: 4050958 - RNA, 20 nt, SARS coronavirus
uuacuacagacacugguauu

SEQ ID NO: 4050959 - RNA, 19 nt, SARS coronavirus
uuagaugaugaagaaccua

SEQ ID NO: 4050960 - RNA, 19 nt, SARS coronavirus
uuauaauuauaaauugcca

SEQ ID NO: 4050961 - RNA, 14 nt, SARS coronavirus
uuaucauggagcca

SEQ ID NO: 4050962 - RNA, 15 nt, SARS coronavirus
uuauuauucuguuug

SEQ ID NO: 4050963 - RNA, 13 nt, SARS coronavirus
uuauucugaggau

SEQ ID NO: 4050964 - RNA, 21 nt, SARS coronavirus
uuauuuaagccucuaacuaag

SEQ ID NO: 4050965 - RNA, 18 nt, SARS coronavirus
uucaaacaugcacaccua

SEQ ID NO: 4050966 - RNA, 22 nt, SARS coronavirus
uucaacccagaaacaaacauuc

SEQ ID NO: 4050967 - RNA, 18 nt, SARS coronavirus
uucaagaaauucaacucc

SEQ ID NO: 4050968 - RNA, 19 nt, SARS coronavirus
uucuacgcagagggaagca

SEQ ID NO: 4050969 - RNA, 20 nt, SARS coronavirus
uucuacugaaugugcuaauu

SEQ ID NO: 4050970 - RNA, 14 nt, SARS coronavirus
uucucauuguugcu

SEQ ID NO: 4050971 - RNA, 16 nt, SARS coronavirus
uucucauuguuuugac

SEQ ID NO: 4050972 - RNA, 17 nt, SARS coronavirus
uucucauuguuuugacu

SEQ ID NO: 4050973 - RNA, 11 nt, SARS coronavirus
uucuccugcuc

SEQ ID NO: 4050974 - RNA, 19 nt, SARS coronavirus
uucugaaggaguuccugau

SEQ ID NO: 4050975 - RNA, 13 nt, SARS coronavirus
uucuguuuggaac

SEQ ID NO: 4050976 - RNA, 15 nt, SARS coronavirus
uugagagagacauau

SEQ ID NO: 4050977 - RNA, 18 nt, SARS coronavirus
uugcauaugcacuguagu

SEQ ID NO: 4050978 - RNA, 21 nt, SARS coronavirus
uugccucaagggugcaugcuc

SEQ ID NO: 4050979 - RNA, 18 nt, SARS coronavirus
uuggaugacaaagaucca

SEQ ID NO: 4050980 - RNA, 14 nt, SARS coronavirus
uuguugacuuccag

SEQ ID NO: 4050981 - RNA, 12 nt, SARS coronavirus
uuuaacauugcu

SEQ ID NO: 4050982 - RNA, 22 nt, SARS coronavirus
uuuaacucaggauuuauuucuu

SEQ ID NO: 4050983 - RNA, 23 nt, SARS coronavirus
uuuaccagaccucuaauuucagg

SEQ ID NO: 4050984 - RNA, 21 nt, SARS coronavirus
uuucaggauugcuauuuggaa

SEQ ID NO: 4050985 - RNA, 12 nt, SARS coronavirus
uuugaacuuuua

SEQ ID NO: 4050986 - RNA, 20 nt, SARS coronavirus
uuugcaauuuacugcugcua

SEQ ID NO: 4050987 - RNA, 22 nt, SARS coronavirus
uuuguacauaauaaagcuuguu

SEQ ID NO: 4050988 - RNA, 15 nt, SARS coronavirus
uuuucaucagacaag

SEQ ID NO: 4050989 - RNA, 14 nt, SARS coronavirus
augauguucaagcu

SEQ ID NO: 4050990 - RNA, 14 nt, SARS coronavirus
augcauuuaauugc

SEQ ID NO: 4050991 - RNA, 15 nt, SARS coronavirus
augccuguuucuaug

SEQ ID NO: 4050992 - RNA, 24 nt, SARS coronavirus
augccuugauauauuuucuacaau

SEQ ID NO: 4050993 - RNA, 12 nt, SARS coronavirus
augcuucaucug

SEQ ID NO: 4050994 - RNA, 15 nt, SARS coronavirus
augucgacacuucuu

SEQ ID NO: 4050995 - RNA, 16 nt, SARS coronavirus
augugauuuuaauagc

SEQ ID NO: 4050996 - RNA, 18 nt, SARS coronavirus
auguucaagcuccuaauu

SEQ ID NO: 4050997 - RNA, 20 nt, SARS coronavirus
auuacuacagaaguaaugcc

SEQ ID NO: 4050998 - RNA, 14 nt, SARS coronavirus
auuagacauuucac

SEQ ID NO: 4050999 - RNA, 20 nt, SARS coronavirus
auuauaaauauagguaucuu

SEQ ID NO: 4051000 - RNA, 19 nt, SARS coronavirus
auuauccacugaccuuauu

SEQ ID NO: 4051001 - RNA, 22 nt, SARS coronavirus
auucaacccagaaacaaacauu

SEQ ID NO: 4051002 - RNA, 19 nt, SARS coronavirus
auucgauaaugcauuuaau

SEQ ID NO: 4051003 - RNA, 19 nt, SARS coronavirus
auucuacugaaugugcuaa

SEQ ID NO: 4051004 - RNA, 22 nt, SARS coronavirus
auucuacuggaaacaauguauu

SEQ ID NO: 4051005 - RNA, 17 nt, SARS coronavirus
auucucuuccugacauu

SEQ ID NO: 4051006 - RNA, 16 nt, SARS coronavirus
auucuuuggaauguca

SEQ ID NO: 4051007 - RNA, 13 nt, SARS coronavirus
auugcuuaucaug

SEQ ID NO: 4051008 - RNA, 12 nt, SARS coronavirus
auugcuuugcua

SEQ ID NO: 4051009 - RNA, 13 nt, SARS coronavirus
auugggcaagcug

SEQ ID NO: 4051010 - RNA, 13 nt, SARS coronavirus
auuuauuuugcug

SEQ ID NO: 4051011 - RNA, 15 nt, SARS coronavirus
auuucaaccauuuca

SEQ ID NO: 4051012 - RNA, 13 nt, SARS coronavirus
auuucuuccauuu

SEQ ID NO: 4051013 - RNA, 20 nt, SARS coronavirus
auuugcaauuuacugcugcu

SEQ ID NO: 4051014 - RNA, 19 nt, SARS coronavirus
auuuuggugguuuuaauuu

SEQ ID NO: 4051015 - RNA, 19 nt, SARS coronavirus
auuuuuaauacuuugcuuc

SEQ ID NO: 4051016 - RNA, 19 nt, SARS coronavirus
caaacugguguuauugcug

SEQ ID NO: 4051017 - RNA, 16 nt, SARS coronavirus
caacugucaagaucca

SEQ ID NO: 4051018 - RNA, 15 nt, SARS coronavirus
caacuuccucaagga

SEQ ID NO: 4051019 - RNA, 18 nt, SARS coronavirus
caagcuccuaauuacacu

SEQ ID NO: 4051020 - RNA, 14 nt, SARS coronavirus
caaggccaaacugu

SEQ ID NO: 4051021 - RNA, 18 nt, SARS coronavirus
caaguaugaugaaaaugg

SEQ ID NO: 4051022 - RNA, 13 nt, SARS coronavirus
caauaaauuugca

SEQ ID NO: 4051023 - RNA, 15 nt, SARS coronavirus
caauauugcuuugcu

SEQ ID NO: 4051024 - RNA, 19 nt, SARS coronavirus
caauggggcaaggccaaaa

SEQ ID NO: 4051025 - RNA, 17 nt, SARS coronavirus
caaugugccucuccggg

SEQ ID NO: 4051026 - RNA, 21 nt, SARS coronavirus
caauuuggccgugauguuucu

SEQ ID NO: 4051027 - RNA, 23 nt, SARS coronavirus
cacauaaacgaacuuauggauuu

SEQ ID NO: 4051028 - RNA, 19 nt, SARS coronavirus
caccugcucaagacauuug

SEQ ID NO: 4051029 - RNA, 16 nt, SARS coronavirus
cacuaagaaaucugcu

SEQ ID NO: 4051030 - RNA, 15 nt, SARS coronavirus
cacuagcacacacuu

SEQ ID NO: 4051031 - RNA, 22 nt, SARS coronavirus
cacucagcauggcaaggaggaa

SEQ ID NO: 4051032 - RNA, 18 nt, SARS coronavirus
cacucgcugaugcuggcu

SEQ ID NO: 4051033 - RNA, 15 nt, SARS coronavirus
cagcccacugugacu

SEQ ID NO: 4051034 - RNA, 21 nt, SARS coronavirus
caucacgaacgcuuucuuauu

SEQ ID NO: 4051035 - RNA, 23 nt, SARS coronavirus
caugaaaauuauucucuuccuga

SEQ ID NO: 4051036 - RNA, 14 nt, SARS coronavirus
caugaugaccacac

SEQ ID NO: 4051037 - RNA, 21 nt, SARS coronavirus
cauggaugauuucuccagaca

SEQ ID NO: 4051038 - RNA, 20 nt, SARS coronavirus
cauggguuguguccuugcuu

SEQ ID NO: 4051039 - RNA, 14 nt, SARS coronavirus
cauuaacgcuucug

SEQ ID NO: 4051040 - RNA, 14 nt, SARS coronavirus
cauucuuacagccu

SEQ ID NO: 4051041 - RNA, 13 nt, SARS coronavirus
cauucuucucaau

SEQ ID NO: 4051042 - RNA, 15 nt, SARS coronavirus
cauucuucucaaugu

SEQ ID NO: 4051043 - RNA, 14 nt, SARS coronavirus
cauuguugcugcuc

SEQ ID NO: 4051044 - RNA, 21 nt, SARS coronavirus
cauuugcaauuuacugcugcu

SEQ ID NO: 4051045 - RNA, 18 nt, SARS coronavirus
ccaagaccuaaucagaca

SEQ ID NO: 4051046 - RNA, 18 nt, SARS coronavirus
ccaauaugguagcuuuug

SEQ ID NO: 4051047 - RNA, 20 nt, SARS coronavirus
ccacagcgccagcaauuugu

SEQ ID NO: 4051048 - RNA, 15 nt, SARS coronavirus
ccaccucugcucacu

SEQ ID NO: 4051049 - RNA, 21 nt, SARS coronavirus
ccacuuuuucucauuguugcu

SEQ ID NO: 4051050 - RNA, 15 nt, SARS coronavirus
ccagaaacaaacauu

SEQ ID NO: 4051051 - RNA, 17 nt, SARS coronavirus
ccaguucucaagggugu

SEQ ID NO: 4051052 - RNA, 21 nt, SARS coronavirus
ccauccuuacugcgcuucgau

SEQ ID NO: 4051053 - RNA, 22 nt, SARS coronavirus
cccaugugauuuuaauagcuuc

SEQ ID NO: 4051054 - RNA, 14 nt, SARS coronavirus
ccccaccugcucuu

SEQ ID NO: 4051055 - RNA, 20 nt, SARS coronavirus
cccuuucuuugcuguuucua

SEQ ID NO: 4051056 - RNA, 12 nt, SARS coronavirus
ccgcagagacaa

SEQ ID NO: 4051057 - RNA, 12 nt, SARS coronavirus
ccuaauguguaa

SEQ ID NO: 4051058 - RNA, 19 nt, SARS coronavirus
ccucgcgcuauugcugcua

SEQ ID NO: 4051059 - RNA, 19 nt, SARS coronavirus
ccuucgggaacauggcuga

SEQ ID NO: 4051060 - RNA, 12 nt, SARS coronavirus
cgacacuucuua

SEQ ID NO: 4051061 - RNA, 15 nt, SARS coronavirus
cgaggccacgcggag

SEQ ID NO: 4051062 - RNA, 15 nt, SARS coronavirus
cgcauacaaaacauu

SEQ ID NO: 4051063 - RNA, 21 nt, SARS coronavirus
cgcauuggcauggaagucaca

SEQ ID NO: 4051064 - RNA, 18 nt, SARS coronavirus
cggagguacaaauugaca

SEQ ID NO: 4051065 - RNA, 18 nt, SARS coronavirus
cggcaaaaugaaagagcu

SEQ ID NO: 4051066 - RNA, 12 nt, SARS coronavirus
cgguacuauuac

SEQ ID NO: 4051067 - RNA, 16 nt, SARS coronavirus
cguacccgcucaaugu

SEQ ID NO: 4051068 - RNA, 12 nt, SARS coronavirus
cguacugcugca

SEQ ID NO: 4051069 - RNA, 14 nt, SARS coronavirus
cgugguccagaaca

SEQ ID NO: 4051070 - RNA, 12 nt, SARS coronavirus
cguugcauuucu

SEQ ID NO: 4051071 - RNA, 16 nt, SARS coronavirus
cuaacaaagaaggcau

SEQ ID NO: 4051072 - RNA, 15 nt, SARS coronavirus
cuaagaaaucugcug

SEQ ID NO: 4051073 - RNA, 16 nt, SARS coronavirus
cuaagaaaucugcugc

SEQ ID NO: 4051074 - RNA, 17 nt, SARS coronavirus
cuaagaaaucugcugcu

SEQ ID NO: 4051075 - RNA, 16 nt, SARS coronavirus
cuaagaggucuuuuau

SEQ ID NO: 4051076 - RNA, 21 nt, SARS coronavirus
cuaauaaaccucaugugcuug

SEQ ID NO: 4051077 - RNA, 16 nt, SARS coronavirus
cuaaucuugcugcuac

SEQ ID NO: 4051078 - RNA, 15 nt, SARS coronavirus
cuaauguuacuauca

SEQ ID NO: 4051079 - RNA, 21 nt, SARS coronavirus
cuaauuuuggugcaauuucaa

SEQ ID NO: 4051080 - RNA, 14 nt, SARS coronavirus
cuacacugcugcuc

SEQ ID NO: 4051081 - RNA, 17 nt, SARS coronavirus
cuacacugcugcucuag

SEQ ID NO: 4051082 - RNA, 23 nt, SARS coronavirus
cuacagacaauacauuugucuca

SEQ ID NO: 4051083 - RNA, 18 nt, SARS coronavirus
cuacagcaauucaugcag

SEQ ID NO: 4051084 - RNA, 16 nt, SARS coronavirus
cuacuaccgaagagcu

SEQ ID NO: 4051085 - RNA, 19 nt, SARS coronavirus
cuagcacacacuuugcuuu

SEQ ID NO: 4051086 - RNA, 23 nt, SARS coronavirus
cuagcggagguggugaaacugcc

SEQ ID NO: 4051087 - RNA, 22 nt, SARS coronavirus
cuaggaacuggcccagaagcuu

SEQ ID NO: 4051088 - RNA, 16 nt, SARS coronavirus
cuagggcgcugugaca

SEQ ID NO: 4051089 - RNA, 23 nt, SARS coronavirus
cuaugcaguugcauaugcacugu

SEQ ID NO: 4051090 - RNA, 18 nt, SARS coronavirus
cuaugucuuuaggugcug

SEQ ID NO: 4051091 - RNA, 21 nt, SARS coronavirus
cucaagucaaacaaauguaca

SEQ ID NO: 4051092 - RNA, 14 nt, SARS coronavirus
cucacucagcaugg

SEQ ID NO: 4051093 - RNA, 22 nt, SARS coronavirus
cucacuuuaauugacuucuauu

SEQ ID NO: 4051094 - RNA, 15 nt, SARS coronavirus
cucauggaaagugaa

SEQ ID NO: 4051095 - RNA, 20 nt, SARS coronavirus
cuccugcaaguacuguucau

SEQ ID NO: 4051096 - RNA, 19 nt, SARS coronavirus
cucguacccgcucaaugug

SEQ ID NO: 4051097 - RNA, 16 nt, SARS coronavirus
cucuaggaaagguuuu

SEQ ID NO: 4051098 - RNA, 19 nt, SARS coronavirus
cugaaugugcuaauuugcu

SEQ ID NO: 4051099 - RNA, 17 nt, SARS coronavirus
cugaugaagcucagccu

SEQ ID NO: 4051100 - RNA, 14 nt, SARS coronavirus
aaaagaagcagccc

SEQ ID NO: 4051101 - RNA, 12 nt, SARS coronavirus
aaaaucuauugu

SEQ ID NO: 4051102 - RNA, 19 nt, SARS coronavirus
aaaauuauccacugaccuu

SEQ ID NO: 4051103 - RNA, 20 nt, SARS coronavirus
aaaauuauccacugaccuua

SEQ ID NO: 4051104 - RNA, 15 nt, SARS coronavirus
aaacaaacauucuuc

SEQ ID NO: 4051105 - RNA, 14 nt, SARS coronavirus
aaacgaacaugaaa

SEQ ID NO: 4051106 - RNA, 22 nt, SARS coronavirus
aaagaagcagcccacugugacu

SEQ ID NO: 4051107 - RNA, 22 nt, SARS coronavirus
aaaugaaagagcucagccccag

SEQ ID NO: 4051108 - RNA, 12 nt, SARS coronavirus
aaauucaagaau

SEQ ID NO: 4051109 - RNA, 20 nt, SARS coronavirus
aacaacuccuggaacaaugg

SEQ ID NO: 4051110 - RNA, 15 nt, SARS coronavirus
aaccauuucaacaau

SEQ ID NO: 4051111 - RNA, 21 nt, SARS coronavirus
aacgaacaugaaaauuauucu

SEQ ID NO: 4051112 - RNA, 17 nt, SARS coronavirus
aacgaacuuauggauuu

SEQ ID NO: 4051113 - RNA, 22 nt, SARS coronavirus
aacuaacuauuauuauuauucu

SEQ ID NO: 4051114 - RNA, 23 nt, SARS coronavirus
aacugcccucgcgcuauugcugc

SEQ ID NO: 4051115 - RNA, 15 nt, SARS coronavirus
aagaaaucugcugcu

SEQ ID NO: 4051116 - RNA, 19 nt, SARS coronavirus
aagaaccuuguaccaaagu

SEQ ID NO: 4051117 - RNA, 12 nt, SARS coronavirus
aagaagaauuau

SEQ ID NO: 4051118 - RNA, 11 nt, SARS coronavirus
aagagaaagac

SEQ ID NO: 4051119 - RNA, 15 nt, SARS coronavirus
aagagauuucaacca

SEQ ID NO: 4051120 - RNA, 22 nt, SARS coronavirus
aagcagcccacugugacucuuc

SEQ ID NO: 4051121 - RNA, 21 nt, SARS coronavirus
caauggggcaaggccaaaaca

SEQ ID NO: 4051122 - RNA, 21 nt, SARS coronavirus
caauugcuuacucuaauaaca

SEQ ID NO: 4051123 - RNA, 16 nt, SARS coronavirus
caauuuacugcugcua

SEQ ID NO: 4051124 - RNA, 16 nt, SARS coronavirus
cacaauucaaagacaa

SEQ ID NO: 4051125 - RNA, 13 nt, SARS coronavirus
cacacacuuugcu

SEQ ID NO: 4051126 - RNA, 22 nt, SARS coronavirus
cacacgugaaguguucgcucaa

SEQ ID NO: 4051127 - RNA, 15 nt, SARS coronavirus
caccauuaagagaaa

SEQ ID NO: 4051128 - RNA, 18 nt, SARS coronavirus
caccgaaguuuacuacca

SEQ ID NO: 4051129 - RNA, 13 nt, SARS coronavirus
cacgucagcugca

SEQ ID NO: 4051130 - RNA, 13 nt, SARS coronavirus
cagaaacaaacau

SEQ ID NO: 4051131 - RNA, 21 nt, SARS coronavirus
cagaaguaaugccuguuucua

SEQ ID NO: 4051132 - RNA, 16 nt, SARS coronavirus
cagaggcggcagucaa

SEQ ID NO: 4051133 - RNA, 23 nt, SARS coronavirus
cagaguuguaguacuuucuuuug

SEQ ID NO: 4051134 - RNA, 18 nt, SARS coronavirus
cagcaauuugucaugaag

SEQ ID NO: 4051135 - RNA, 14 nt, SARS coronavirus
cagcauggcaagga

SEQ ID NO: 4051136 - RNA, 18 nt, SARS coronavirus
cagcugcagccuauuuug

SEQ ID NO: 4051137 - RNA, 19 nt, SARS coronavirus
cagcuugagucuacacaaa

SEQ ID NO: 4051138 - RNA, 15 nt, SARS coronavirus
caggaucuagaagaa

SEQ ID NO: 4051139 - RNA, 20 nt, SARS coronavirus
cauaacuaugacuacuguau

SEQ ID NO: 4051140 - RNA, 19 nt, SARS coronavirus
caugaguggagcuucugcu

SEQ ID NO: 4051141 - RNA, 14 nt, SARS coronavirus
cauugauuguauuu

SEQ ID NO: 4051142 - RNA, 22 nt, SARS coronavirus
cauuuggugcuggcgcugcucu

SEQ ID NO: 4051143 - RNA, 14 nt, SARS coronavirus
ccacaaaacaguac

SEQ ID NO: 4051144 - RNA, 21 nt, SARS coronavirus
ccacagagaaaucaaauguug

SEQ ID NO: 4051145 - RNA, 20 nt, SARS coronavirus
ccagaacaaacccaaggaaa

SEQ ID NO: 4051146 - RNA, 23 nt, SARS coronavirus
ccaucaggaacauacgagggcaa

SEQ ID NO: 4051147 - RNA, 13 nt, SARS coronavirus
cccagaaacaaac

SEQ ID NO: 4051148 - RNA, 14 nt, SARS coronavirus
ccccaacuuugaaa

SEQ ID NO: 4051149 - RNA, 15 nt, SARS coronavirus
cccucgaggccaggg

SEQ ID NO: 4051150 - RNA, 14 nt, SARS coronavirus
ccgugauguuucug

SEQ ID NO: 4051151 - RNA, 14 nt, SARS coronavirus
ccuaaaaaggacaa

SEQ ID NO: 4051152 - RNA, 18 nt, SARS coronavirus
ccuaaucagacaaggaac

SEQ ID NO: 4051153 - RNA, 17 nt, SARS coronavirus
ccucuucucgcuccuca

SEQ ID NO: 4051154 - RNA, 18 nt, SARS coronavirus
cgcaauggggcaaggcca

SEQ ID NO: 4051155 - RNA, 18 nt, SARS coronavirus
cgcagagggaagcagagg

SEQ ID NO: 4051156 - RNA, 15 nt, SARS coronavirus
cgcucaauaaaagau

SEQ ID NO: 4051157 - RNA, 15 nt, SARS coronavirus
cugcuaaucuugcug

SEQ ID NO: 4051158 - RNA, 17 nt, SARS coronavirus
cuguacuacuaaaagaa

SEQ ID NO: 4051159 - RNA, 17 nt, SARS coronavirus
cuguucaugcuacagca

SEQ ID NO: 4051160 - RNA, 13 nt, SARS coronavirus
cuuauagcacugc

SEQ ID NO: 4051161 - RNA, 17 nt, SARS coronavirus
cuucaaaauuccaugag

SEQ ID NO: 4051162 - RNA, 12 nt, SARS coronavirus
cuucucaaugug

SEQ ID NO: 4051163 - RNA, 15 nt, SARS coronavirus
cuugcugcugucuac

SEQ ID NO: 4051164 - RNA, 18 nt, SARS coronavirus
cuugcuuguuuugugcuu

SEQ ID NO: 4051165 - RNA, 15 nt, SARS coronavirus
cuuuuucuugcuuuc

SEQ ID NO: 4051166 - RNA, 12 nt, SARS coronavirus
gaaaucagggcu

SEQ ID NO: 4051167 - RNA, 13 nt, SARS coronavirus
gaaaucugcugcu

SEQ ID NO: 4051168 - RNA, 12 nt, SARS coronavirus
gaagcucagccu

SEQ ID NO: 4051169 - RNA, 17 nt, SARS coronavirus
gaaugaucuuugcuucu

SEQ ID NO: 4051170 - RNA, 16 nt, SARS coronavirus
gacaaagauccacaau

SEQ ID NO: 4051171 - RNA, 20 nt, SARS coronavirus
gacacucgcugaugcuggcu

SEQ ID NO: 4051172 - RNA, 23 nt, SARS coronavirus
gaccacacaaggcagaugggcua

SEQ ID NO: 4051173 - RNA, 13 nt, SARS coronavirus
gaccacauuggca

SEQ ID NO: 4051174 - RNA, 12 nt, SARS coronavirus
gacuaccaaauu

SEQ ID NO: 4051175 - RNA, 15 nt, SARS coronavirus
gagcucagccccaga

SEQ ID NO: 4051176 - RNA, 17 nt, SARS coronavirus
gaggacuugaaagagcc

SEQ ID NO: 4051177 - RNA, 12 nt, SARS coronavirus
gaguacauaucu

SEQ ID NO: 4051178 - RNA, 23 nt, SARS coronavirus
gaugaagcucagccuuugccgca

SEQ ID NO: 4051179 - RNA, 22 nt, SARS coronavirus
gcaaauugcacaauuugcucca

SEQ ID NO: 4051180 - RNA, 20 nt, SARS coronavirus
gcaagaucaguuucaccaaa

SEQ ID NO: 4051181 - RNA, 18 nt, SARS coronavirus
gcaauucaccauuucacc

SEQ ID NO: 4051182 - RNA, 20 nt, SARS coronavirus
gcacucucagguauugcugc

SEQ ID NO: 4051183 - RNA, 19 nt, SARS coronavirus
gcaucuaauaaaccucaug

SEQ ID NO: 4051184 - RNA, 22 nt, SARS coronavirus
gcaucuaauaaaccucaugugc

SEQ ID NO: 4051185 - RNA, 18 nt, SARS coronavirus
gccacuuuuucucauugu

SEQ ID NO: 4051186 - RNA, 15 nt, SARS coronavirus
gccccccgcauuaca

SEQ ID NO: 4051187 - RNA, 19 nt, SARS coronavirus
gcccucgcgcuauugcugc

SEQ ID NO: 4051188 - RNA, 17 nt, SARS coronavirus
gccgacgacgacuacua

SEQ ID NO: 4051189 - RNA, 15 nt, SARS coronavirus
gcgccgaccccaagg

SEQ ID NO: 4051190 - RNA, 15 nt, SARS coronavirus
gcgcuauugcugcua

SEQ ID NO: 4051191 - RNA, 15 nt, SARS coronavirus
gcuagggagagcugc

SEQ ID NO: 4051192 - RNA, 13 nt, SARS coronavirus
gcuauugcugcua

SEQ ID NO: 4051193 - RNA, 12 nt, SARS coronavirus
gcucaauguggu

SEQ ID NO: 4051194 - RNA, 22 nt, SARS coronavirus
gcugccuauauggaagagcccu

SEQ ID NO: 4051195 - RNA, 15 nt, SARS coronavirus
gcuggcgcugcucuu

SEQ ID NO: 4051196 - RNA, 15 nt, SARS coronavirus
gcuucuccugcaagu

SEQ ID NO: 4051197 - RNA, 13 nt, SARS coronavirus
gcuugauguggcu

SEQ ID NO: 4051198 - RNA, 11 nt, SARS coronavirus
gcuugcugcug

SEQ ID NO: 4051199 - RNA, 12 nt, SARS coronavirus
ggcaaaaugaaa

SEQ ID NO: 4051200 - RNA, 22 nt, SARS coronavirus
ggccaaaacagcgccgacccca

SEQ ID NO: 4051201 - RNA, 16 nt, SARS coronavirus
ggcgcuaacaaagaag

SEQ ID NO: 4051202 - RNA, 19 nt, SARS coronavirus
ggcuacuaccgaagagcua

SEQ ID NO: 4051203 - RNA, 13 nt, SARS coronavirus
gguauugcugcug

SEQ ID NO: 4051204 - RNA, 13 nt, SARS coronavirus
guaguacuuucuu

SEQ ID NO: 4051205 - RNA, 23 nt, SARS coronavirus
gucaagccucuucucgcuccuca

SEQ ID NO: 4051206 - RNA, 23 nt, SARS coronavirus
gucaccaaacugcugcauuuaga

SEQ ID NO: 4051207 - RNA, 14 nt, SARS coronavirus
gucacucaagcauu

SEQ ID NO: 4051208 - RNA, 14 nt, SARS coronavirus
gucauucaacccag

SEQ ID NO: 4051209 - RNA, 22 nt, SARS coronavirus
gugccucugcauucuuuggaau

SEQ ID NO: 4051210 - RNA, 15 nt, SARS coronavirus
gugcguacugcugca

SEQ ID NO: 4051211 - RNA, 21 nt, SARS coronavirus
guuguuaaccagaaugcucaa

SEQ ID NO: 4051212 - RNA, 21 nt, SARS coronavirus
guuuccuauuccuagccugga

SEQ ID NO: 4051213 - RNA, 23 nt, SARS coronavirus
guuugcucguacccgcucaaugu

SEQ ID NO: 4051214 - RNA, 15 nt, SARS coronavirus
uaaaaauuuaaauga

SEQ ID NO: 4051215 - RNA, 23 nt, SARS coronavirus
uaaaacgaacaugaaaauuauuc

SEQ ID NO: 4051216 - RNA, 17 nt, SARS coronavirus
uaacagugucacagaua

SEQ ID NO: 4051217 - RNA, 19 nt, SARS coronavirus
uaacuaugacuacuguaua

SEQ ID NO: 4051218 - RNA, 16 nt, SARS coronavirus
uaauaacaaugcugcc

SEQ ID NO: 4051219 - RNA, 15 nt, SARS coronavirus
uaaugcuagggagag

SEQ ID NO: 4051220 - RNA, 15 nt, SARS coronavirus
uacacugcugcucua

SEQ ID NO: 4051221 - RNA, 14 nt, SARS coronavirus
uacaggcagacuuc

SEQ ID NO: 4051222 - RNA, 19 nt, SARS coronavirus
uacauuuaugcucaaguau

SEQ ID NO: 4051223 - RNA, 17 nt, SARS coronavirus
uaccauacaguuucuuu

SEQ ID NO: 4051224 - RNA, 13 nt, SARS coronavirus
uaccuuuugcuau

SEQ ID NO: 4051225 - RNA, 15 nt, SARS coronavirus
uacuacagacaauac

SEQ ID NO: 4051226 - RNA, 15 nt, SARS coronavirus
uacuaucaacuguca

SEQ ID NO: 4051227 - RNA, 20 nt, SARS coronavirus
uacuucuuuuucuugcuuuc

SEQ ID NO: 4051228 - RNA, 11 nt, SARS coronavirus
uagaauuauua

SEQ ID NO: 4051229 - RNA, 18 nt, SARS coronavirus
uagauucccucgaggcca

SEQ ID NO: 4051230 - RNA, 23 nt, SARS coronavirus
uaggaacuggcccagaagcuuca

SEQ ID NO: 4051231 - RNA, 18 nt, SARS coronavirus
uaguauuuuuaauacuuu

SEQ ID NO: 4051232 - RNA, 16 nt, SARS coronavirus
uagugguacugccacu

SEQ ID NO: 4051233 - RNA, 20 nt, SARS coronavirus
uauaaauuaaauacagacca

SEQ ID NO: 4051234 - RNA, 15 nt, SARS coronavirus
uauaucaagauguua

SEQ ID NO: 4051235 - RNA, 22 nt, SARS coronavirus
uaugaugaaaaugguacaauca

SEQ ID NO: 4051236 - RNA, 18 nt, SARS coronavirus
uauggcguuucugccacu

SEQ ID NO: 4051237 - RNA, 14 nt, SARS coronavirus
uaugguucaaacau

SEQ ID NO: 4051238 - RNA, 23 nt, SARS coronavirus
uauguacaucugcggagauucua

SEQ ID NO: 4051239 - RNA, 13 nt, SARS coronavirus
uauucucuuccug

SEQ ID NO: 4051240 - RNA, 19 nt, SARS coronavirus
uauuuaaagccaacuacau

SEQ ID NO: 4051241 - RNA, 18 nt, SARS coronavirus
ucaaauaccuuuugcuau

SEQ ID NO: 4051242 - RNA, 14 nt, SARS coronavirus
ucaaauucaagaau

SEQ ID NO: 4051243 - RNA, 18 nt, SARS coronavirus
ucaaauucaagaaucacu

SEQ ID NO: 4051244 - RNA, 18 nt, SARS coronavirus
ucaacaccaaaacucaaa

SEQ ID NO: 4051245 - RNA, 21 nt, SARS coronavirus
ucaacgcauguagaauuauua

SEQ ID NO: 4051246 - RNA, 22 nt, SARS coronavirus
ucaacugacaauaaccagaaug

SEQ ID NO: 4051247 - RNA, 20 nt, SARS coronavirus
ucaagaaucacuuacaacaa

SEQ ID NO: 4051248 - RNA, 14 nt, SARS coronavirus
ucaaggaacaacau

SEQ ID NO: 4051249 - RNA, 21 nt, SARS coronavirus
ucaaguaugaugaaaauggua

SEQ ID NO: 4051250 - RNA, 15 nt, SARS coronavirus
ucacaucuuuugcuu

SEQ ID NO: 4051251 - RNA, 16 nt, SARS coronavirus
ucaccaaacugcugca

SEQ ID NO: 4051252 - RNA, 17 nt, SARS coronavirus
ucacguaugugccaucc

SEQ ID NO: 4051253 - RNA, 18 nt, SARS coronavirus
ucacuaagaaaucugcug

SEQ ID NO: 4051254 - RNA, 19 nt, SARS coronavirus
ucacuaagaaaucugcugc

SEQ ID NO: 4051255 - RNA, 14 nt, SARS coronavirus
ucaggauugcuauu

SEQ ID NO: 4051256 - RNA, 23 nt, SARS coronavirus
ucaggcauaaacacucaugauga

SEQ ID NO: 4051257 - RNA, 16 nt, SARS coronavirus
ucaucagacaagagga

SEQ ID NO: 4051258 - RNA, 18 nt, SARS coronavirus
ucaucugaaguugcuguu

SEQ ID NO: 4051259 - RNA, 17 nt, SARS coronavirus
ucaugaaggcaaagcau

SEQ ID NO: 4051260 - RNA, 21 nt, SARS coronavirus
ucaugguuacaaucuugcuuu

SEQ ID NO: 4051261 - RNA, 13 nt, SARS coronavirus
ucauuaacaacac

SEQ ID NO: 4051262 - RNA, 20 nt, SARS coronavirus
ucauucguuucggaagaaac

SEQ ID NO: 4051263 - RNA, 19 nt, SARS coronavirus
ucauuggugcugugaucau

SEQ ID NO: 4051264 - RNA, 20 nt, SARS coronavirus
ucauuguuuugacuuguauu

SEQ ID NO: 4051265 - RNA, 23 nt, SARS coronavirus
ucauuugcaauuuacugcugcua

SEQ ID NO: 4051266 - RNA, 19 nt, SARS coronavirus
uccaagugccucugcauuc

SEQ ID NO: 4051267 - RNA, 13 nt, SARS coronavirus
uccaaugucuaug

SEQ ID NO: 4051268 - RNA, 14 nt, SARS coronavirus
uccagaacaaaccc

SEQ ID NO: 4051269 - RNA, 17 nt, SARS coronavirus
uccauaaaacgaacaug

SEQ ID NO: 4051270 - RNA, 23 nt, SARS coronavirus
uccaugaguggagcuucugcuga

SEQ ID NO: 4051271 - RNA, 20 nt, SARS coronavirus
ucccuaauauuacaaacuug

SEQ ID NO: 4051272 - RNA, 12 nt, SARS coronavirus
uccuggcagcag

SEQ ID NO: 4051273 - RNA, 12 nt, SARS coronavirus
ucgaggccaggg

SEQ ID NO: 4051274 - RNA, 18 nt, SARS coronavirus
ucgccacuuuuucucauu

SEQ ID NO: 4051275 - RNA, 15 nt, SARS coronavirus
ucgcuugauguuuca

SEQ ID NO: 4051276 - RNA, 17 nt, SARS coronavirus
aaaccaacguagugccc

SEQ ID NO: 4051277 - RNA, 21 nt, SARS coronavirus
aaaccuugcaccccaccugcu

SEQ ID NO: 4051278 - RNA, 17 nt, SARS coronavirus
aaacgaacaugaaacuu

SEQ ID NO: 4051279 - RNA, 20 nt, SARS coronavirus
aaacgaacaugaaacuucuc

SEQ ID NO: 4051280 - RNA, 22 nt, SARS coronavirus
aaagacaacgucauacugcuga

SEQ ID NO: 4051281 - RNA, 16 nt, SARS coronavirus
aaagccucgccaaaaa

SEQ ID NO: 4051282 - RNA, 16 nt, SARS coronavirus
aaauauuagacauuuc

SEQ ID NO: 4051283 - RNA, 13 nt, SARS coronavirus
aaaucugcugcug

SEQ ID NO: 4051284 - RNA, 23 nt, SARS coronavirus
aaaugauuaugguuuuuacacca

SEQ ID NO: 4051285 - RNA, 18 nt, SARS coronavirus
aaauuaaauacagaccac

SEQ ID NO: 4051286 - RNA, 14 nt, SARS coronavirus
aaauuuuagagcca

SEQ ID NO: 4051287 - RNA, 12 nt, SARS coronavirus
aacaagcacauu

SEQ ID NO: 4051288 - RNA, 13 nt, SARS coronavirus
aacaagcuuguua

SEQ ID NO: 4051289 - RNA, 13 nt, SARS coronavirus
aacauucuucuca

SEQ ID NO: 4051290 - RNA, 17 nt, SARS coronavirus
aacugauuacaaacauu

SEQ ID NO: 4051291 - RNA, 20 nt, SARS coronavirus
aagaccuaaucagacaagga

SEQ ID NO: 4051292 - RNA, 20 nt, SARS coronavirus
aagcugcaagacguuguuaa

SEQ ID NO: 4051293 - RNA, 20 nt, SARS coronavirus
aagucagguaauuuuaaaca

SEQ ID NO: 4051294 - RNA, 16 nt, SARS coronavirus
aaguugcuguucuaua

SEQ ID NO: 4051295 - RNA, 15 nt, SARS coronavirus
aauaaagauggguuu

SEQ ID NO: 4051296 - RNA, 23 nt, SARS coronavirus
aauacuuugcuucaccauuaaga

SEQ ID NO: 4051297 - RNA, 16 nt, SARS coronavirus
aauagcguacuucuuu

SEQ ID NO: 4051298 - RNA, 23 nt, SARS coronavirus
aauauuacaaacuuguguccuuu

SEQ ID NO: 4051299 - RNA, 14 nt, SARS coronavirus
aaucagacaaggaa

SEQ ID NO: 4051300 - RNA, 16 nt, SARS coronavirus
aaugugcaaauacaca

SEQ ID NO: 4051301 - RNA, 16 nt, SARS coronavirus
aauuuacugcugcuau

SEQ ID NO: 4051302 - RNA, 14 nt, SARS coronavirus
aauuuuaauuuuaa

SEQ ID NO: 4051303 - RNA, 21 nt, SARS coronavirus
aauuuuagagccauucuuaca

SEQ ID NO: 4051304 - RNA, 18 nt, SARS coronavirus
acaaacauucuucucaau

SEQ ID NO: 4051305 - RNA, 19 nt, SARS coronavirus
acaaacccaaggaaauuuc

SEQ ID NO: 4051306 - RNA, 15 nt, SARS coronavirus
acaaagauccacaau

SEQ ID NO: 4051307 - RNA, 15 nt, SARS coronavirus
acaaaugcuucaucu

SEQ ID NO: 4051308 - RNA, 16 nt, SARS coronavirus
acaauaaauuugcacu

SEQ ID NO: 4051309 - RNA, 18 nt, SARS coronavirus
acacaaggcagaugggcu

SEQ ID NO: 4051310 - RNA, 18 nt, SARS coronavirus
acagcucucacucagcau

SEQ ID NO: 4051311 - RNA, 14 nt, SARS coronavirus
acauaaacgaacuu

SEQ ID NO: 4051312 - RNA, 15 nt, SARS coronavirus
acaugaaaauuauuc

SEQ ID NO: 4051313 - RNA, 14 nt, SARS coronavirus
acaugaaacuucuc

SEQ ID NO: 4051314 - RNA, 21 nt, SARS coronavirus
acauuggccgcaaauugcaca

SEQ ID NO: 4051315 - RNA, 15 nt, SARS coronavirus
acauuucaggcauua

SEQ ID NO: 4051316 - RNA, 13 nt, SARS coronavirus
acccaaagaccac

SEQ ID NO: 4051317 - RNA, 18 nt, SARS coronavirus
acccagaaacaaacauuc

SEQ ID NO: 4051318 - RNA, 15 nt, SARS coronavirus
acccucuugcugaca

SEQ ID NO: 4051319 - RNA, 16 nt, SARS coronavirus
accgcuacaagccuca

SEQ ID NO: 4051320 - RNA, 16 nt, SARS coronavirus
accugccaaaagagau

SEQ ID NO: 4051321 - RNA, 17 nt, SARS coronavirus
accuucaugaaggucac

SEQ ID NO: 4051322 - RNA, 16 nt, SARS coronavirus
acgaacaugaaacuuc

SEQ ID NO: 4051323 - RNA, 17 nt, SARS coronavirus
acgcauacaaaacauuc

SEQ ID NO: 4051324 - RNA, 13 nt, SARS coronavirus
acguacugccaca

SEQ ID NO: 4051325 - RNA, 21 nt, SARS coronavirus
acguacugccacaaaacagua

SEQ ID NO: 4051326 - RNA, 14 nt, SARS coronavirus
acgucauacugcug

SEQ ID NO: 4051327 - RNA, 17 nt, SARS coronavirus
acuaagaagaauuauuc

SEQ ID NO: 4051328 - RNA, 13 nt, SARS coronavirus
acuacaauuugcc

SEQ ID NO: 4051329 - RNA, 19 nt, SARS coronavirus
acuauuauuauuauucugu

SEQ ID NO: 4051330 - RNA, 18 nt, SARS coronavirus
acucaggcauaaacacuc

SEQ ID NO: 4051331 - RNA, 22 nt, SARS coronavirus
acucugagccaguucucaaggg

SEQ ID NO: 4051332 - RNA, 14 nt, SARS coronavirus
acugagggagccuu

SEQ ID NO: 4051333 - RNA, 16 nt, SARS coronavirus
acugaugaagcucagc

SEQ ID NO: 4051334 - RNA, 22 nt, SARS coronavirus
acugauguuucuacagcaauuc

SEQ ID NO: 4051335 - RNA, 22 nt, SARS coronavirus
acugcacagccaguaaaaauug

SEQ ID NO: 4051336 - RNA, 17 nt, SARS coronavirus
acugccacaaaacagua

SEQ ID NO: 4051337 - RNA, 18 nt, SARS coronavirus
acuguacuacuaaaagaa

SEQ ID NO: 4051338 - RNA, 17 nt, SARS coronavirus
acuuacgagaguuugug

SEQ ID NO: 4051339 - RNA, 12 nt, SARS coronavirus
acuuauagcacu

SEQ ID NO: 4051340 - RNA, 15 nt, SARS coronavirus
acuugcacuagcaca

SEQ ID NO: 4051341 - RNA, 19 nt, SARS coronavirus
agaaagugaguacgaacuu

SEQ ID NO: 4051342 - RNA, 15 nt, SARS coronavirus
agaaugcucaagcau

SEQ ID NO: 4051343 - RNA, 13 nt, SARS coronavirus
agacaacuucaaa

SEQ ID NO: 4051344 - RNA, 15 nt, SARS coronavirus
agagacaaaagaagc

SEQ ID NO: 4051345 - RNA, 14 nt, SARS coronavirus
agaucacuguggcu

SEQ ID NO: 4051346 - RNA, 17 nt, SARS coronavirus
agaugaccaaauuggcu

SEQ ID NO: 4051347 - RNA, 16 nt, SARS coronavirus
agcauuaaacacacuu

SEQ ID NO: 4051348 - RNA, 14 nt, SARS coronavirus
agccaguucucaag

SEQ ID NO: 4051349 - RNA, 20 nt, SARS coronavirus
agccauucuuacagccuuuu

SEQ ID NO: 4051350 - RNA, 14 nt, SARS coronavirus
agcgccagcaauuu

SEQ ID NO: 4051351 - RNA, 22 nt, SARS coronavirus
agcucuaauuuuggugcaauuu

SEQ ID NO: 4051352 - RNA, 20 nt, SARS coronavirus
agcucucacucagcauggca

SEQ ID NO: 4051353 - RNA, 23 nt, SARS coronavirus
aggaacaacauugccaaaaggcu

SEQ ID NO: 4051354 - RNA, 12 nt, SARS coronavirus
aggaacuucuuu

SEQ ID NO: 4051355 - RNA, 23 nt, SARS coronavirus
aggagauguugugagauucccua

SEQ ID NO: 4051356 - RNA, 19 nt, SARS coronavirus
agggaggacuugaaagagc

SEQ ID NO: 4051357 - RNA, 21 nt, SARS coronavirus
agggcuuccaguucauuugca

SEQ ID NO: 4051358 - RNA, 19 nt, SARS coronavirus
aggucaccaaacugcugca

SEQ ID NO: 4051359 - RNA, 22 nt, SARS coronavirus
aggucgcuaaaaauuuaaauga

SEQ ID NO: 4051360 - RNA, 16 nt, SARS coronavirus
aguacagcgcugugca

SEQ ID NO: 4051361 - RNA, 14 nt, SARS coronavirus
agucuacacaaauu

SEQ ID NO: 4051362 - RNA, 15 nt, SARS coronavirus
aguuagaugaugaag

SEQ ID NO: 4051363 - RNA, 14 nt, SARS coronavirus
aguugccucaaggg

SEQ ID NO: 4051364 - RNA, 12 nt, SARS coronavirus
auaacaaugcug

SEQ ID NO: 4051365 - RNA, 16 nt, SARS coronavirus
auaauuauaaauugcc

SEQ ID NO: 4051366 - RNA, 19 nt, SARS coronavirus
aucaauuacugcacagcca

SEQ ID NO: 4051367 - RNA, 11 nt, SARS coronavirus
aucugcugcug

SEQ ID NO: 4051368 - RNA, 17 nt, SARS coronavirus
aucuugcugcuacuaaa

SEQ ID NO: 4051369 - RNA, 17 nt, SARS coronavirus
augaguggagcuucugc

SEQ ID NO: 4051370 - RNA, 17 nt, SARS coronavirus
augcaguugcauaugca

SEQ ID NO: 4051371 - RNA, 20 nt, SARS coronavirus
augccuguuucuauggcuaa

SEQ ID NO: 4051372 - RNA, 20 nt, SARS coronavirus
augcuacuaaauucccuucu

SEQ ID NO: 4051373 - RNA, 20 nt, SARS coronavirus
auggcacacuaugguucaaa

SEQ ID NO: 4051374 - RNA, 14 nt, SARS coronavirus
augguucaaacaug

SEQ ID NO: 4051375 - RNA, 20 nt, SARS coronavirus
augguucaaacaugcacacc

SEQ ID NO: 4051376 - RNA, 23 nt, SARS coronavirus
auguaguucgugaucuaccuucu

SEQ ID NO: 4051377 - RNA, 16 nt, SARS coronavirus
augucgacacuucuua

SEQ ID NO: 4051378 - RNA, 17 nt, SARS coronavirus
augugcaaauacacaca

SEQ ID NO: 4051379 - RNA, 19 nt, SARS coronavirus
auguuacuaucaacuguca

SEQ ID NO: 4051380 - RNA, 22 nt, SARS coronavirus
auuaaauggccuugguauguuu

SEQ ID NO: 4051381 - RNA, 14 nt, SARS coronavirus
ucuugugcagaaug

SEQ ID NO: 4051382 - RNA, 14 nt, SARS coronavirus
ugaaacuucucauu

SEQ ID NO: 4051383 - RNA, 16 nt, SARS coronavirus
ugaacuuuuaaaugca

SEQ ID NO: 4051384 - RNA, 21 nt, SARS coronavirus
ugacaacccuuucuuugcugu

SEQ ID NO: 4051385 - RNA, 13 nt, SARS coronavirus
ugacauggaugau

SEQ ID NO: 4051386 - RNA, 19 nt, SARS coronavirus
ugacgcauacaaaacauuc

SEQ ID NO: 4051387 - RNA, 15 nt, SARS coronavirus
ugagauguuggcuuu

SEQ ID NO: 4051388 - RNA, 20 nt, SARS coronavirus
ugaugaaaaugguacaauca

SEQ ID NO: 4051389 - RNA, 22 nt, SARS coronavirus
ugaugaccacacaaggcagaug

SEQ ID NO: 4051390 - RNA, 18 nt, SARS coronavirus
ugcaccccaccugcucuu

SEQ ID NO: 4051391 - RNA, 21 nt, SARS coronavirus
ugcacuaacuugcacuagcac

SEQ ID NO: 4051392 - RNA, 14 nt, SARS coronavirus
ugcacuagcacaca

SEQ ID NO: 4051393 - RNA, 22 nt, SARS coronavirus
ugcaguugcauaugcacuguag

SEQ ID NO: 4051394 - RNA, 13 nt, SARS coronavirus
ugcaucuaauaaa

SEQ ID NO: 4051395 - RNA, 23 nt, SARS coronavirus
ugccacaaaacaguacaacguca

SEQ ID NO: 4051396 - RNA, 13 nt, SARS coronavirus
ugccgcagagaca

SEQ ID NO: 4051397 - RNA, 23 nt, SARS coronavirus
ugcgagcuauaucacuaucagga

SEQ ID NO: 4051398 - RNA, 13 nt, SARS coronavirus
ugcuaauuugcuu

SEQ ID NO: 4051399 - RNA, 18 nt, SARS coronavirus
ugcuagggagagcugccu

SEQ ID NO: 4051400 - RNA, 14 nt, SARS coronavirus
ugcugucuacagaa

SEQ ID NO: 4051401 - RNA, 22 nt, SARS coronavirus
ugcuuguuuugugcuugcugcu

SEQ ID NO: 4051402 - RNA, 19 nt, SARS coronavirus
uggauuauguuacuacaau

SEQ ID NO: 4051403 - RNA, 20 nt, SARS coronavirus
uggcuacuaccgaagagcua

SEQ ID NO: 4051404 - RNA, 19 nt, SARS coronavirus
uggcuagcggaggugguga

SEQ ID NO: 4051405 - RNA, 14 nt, SARS coronavirus
uggugaaacugccc

SEQ ID NO: 4051406 - RNA, 20 nt, SARS coronavirus
uguaacuuugaauuguguga

SEQ ID NO: 4051407 - RNA, 19 nt, SARS coronavirus
uguaggcuugauguggcuu

SEQ ID NO: 4051408 - RNA, 17 nt, SARS coronavirus
ugugcucuaggaaaggu

SEQ ID NO: 4051409 - RNA, 16 nt, SARS coronavirus
uguucccucaggagau

SEQ ID NO: 4051410 - RNA, 19 nt, SARS coronavirus
uguuggaagugcaaaucca

SEQ ID NO: 4051411 - RNA, 22 nt, SARS coronavirus
uguuuuaauaaugcuuauuaua

SEQ ID NO: 4051412 - RNA, 14 nt, SARS coronavirus
uuaaacaacuccug

SEQ ID NO: 4051413 - RNA, 22 nt, SARS coronavirus
uuaaugcuacuaaauucccuuc

SEQ ID NO: 4051414 - RNA, 20 nt, SARS coronavirus
uuacagaguuguaguacuuu

SEQ ID NO: 4051415 - RNA, 19 nt, SARS coronavirus
uuacagccuuuucaccugc

SEQ ID NO: 4051416 - RNA, 18 nt, SARS coronavirus
uuaggagaaugacaaaaa

SEQ ID NO: 4051417 - RNA, 13 nt, SARS coronavirus
uuauuauuauucu

SEQ ID NO: 4051418 - RNA, 12 nt, SARS coronavirus
uucaagaaauuc

SEQ ID NO: 4051419 - RNA, 22 nt, SARS coronavirus
uucaauagugagacaauuauuu

SEQ ID NO: 4051420 - RNA, 15 nt, SARS coronavirus
uucacagcucucacu

SEQ ID NO: 4051421 - RNA, 13 nt, SARS coronavirus
uucaucgaggcca

SEQ ID NO: 4051422 - RNA, 15 nt, SARS coronavirus
uucaucuuguugacu

SEQ ID NO: 4051423 - RNA, 15 nt, SARS coronavirus
uuccauuuuauucua

SEQ ID NO: 4051424 - RNA, 17 nt, SARS coronavirus
uucccucgaggccaggg

SEQ ID NO: 4051425 - RNA, 13 nt, SARS coronavirus
uuccuauuccuag

SEQ ID NO: 4051426 - RNA, 20 nt, SARS coronavirus
uuccugacauugauuguauu

SEQ ID NO: 4051427 - RNA, 19 nt, SARS coronavirus
uucgauaaugcauuuaauu

SEQ ID NO: 4051428 - RNA, 23 nt, SARS coronavirus
uucucauuguuuugacuuguauu

SEQ ID NO: 4051429 - RNA, 15 nt, SARS coronavirus
uucuuauuauuucuu

SEQ ID NO: 4051430 - RNA, 13 nt, SARS coronavirus
uugcugaacucaa

SEQ ID NO: 4051431 - RNA, 22 nt, SARS coronavirus
uugcugcuacuaaaaugucuga

SEQ ID NO: 4051432 - RNA, 18 nt, SARS coronavirus
uugcuggacuaauugcca

SEQ ID NO: 4051433 - RNA, 18 nt, SARS coronavirus
uugcuuguuuugugcuug

SEQ ID NO: 4051434 - RNA, 13 nt, SARS coronavirus
uugcuuuugcuug

SEQ ID NO: 4051435 - RNA, 15 nt, SARS coronavirus
uuggcauggaaguca

SEQ ID NO: 4051436 - RNA, 15 nt, SARS coronavirus
uugggcaagcugcaa

SEQ ID NO: 4051437 - RNA, 15 nt, SARS coronavirus
uuguaguacuuucuu

SEQ ID NO: 4051438 - RNA, 17 nt, SARS coronavirus
uuguuaccaucuauuca

SEQ ID NO: 4051439 - RNA, 14 nt, SARS coronavirus
uuuaacaagcuugu

SEQ ID NO: 4051440 - RNA, 21 nt, SARS coronavirus
uuuaaggaugguauuuauuuu

SEQ ID NO: 4051441 - RNA, 22 nt, SARS coronavirus
uuuaagugcuauggcguuucug

SEQ ID NO: 4051442 - RNA, 18 nt, SARS coronavirus
uuuacaucuugcgagcua

SEQ ID NO: 4051443 - RNA, 20 nt, SARS coronavirus
uuucaagugugcuaaaugau

SEQ ID NO: 4051444 - RNA, 23 nt, SARS coronavirus
uuucugccacuaaguugaaugau

SEQ ID NO: 4051445 - RNA, 15 nt, SARS coronavirus
uuuugcuugugcuga

SEQ ID NO: 4051446 - RNA, 22 nt, SARS coronavirus
aaaacguacugccacaaaacag

SEQ ID NO: 4051447 - RNA, 20 nt, SARS coronavirus
aaaagacugaugaagcucag

SEQ ID NO: 4051448 - RNA, 23 nt, SARS coronavirus
aaaaucauacaucaccagauguu

SEQ ID NO: 4051449 - RNA, 15 nt, SARS coronavirus
aaaaugucugagugu

SEQ ID NO: 4051450 - RNA, 19 nt, SARS coronavirus
aaaauuauucucuuccuga

SEQ ID NO: 4051451 - RNA, 20 nt, SARS coronavirus
aaaauuccaugaguggagcu

SEQ ID NO: 4051452 - RNA, 15 nt, SARS coronavirus
aaaauuucuaauugu

SEQ ID NO: 4051453 - RNA, 19 nt, SARS coronavirus
aaacaguacaacgucacuc

SEQ ID NO: 4051454 - RNA, 23 nt, SARS coronavirus
aaacugguguuauugcugauuau

SEQ ID NO: 4051455 - RNA, 13 nt, SARS coronavirus
aaagagccaccac

SEQ ID NO: 4051456 - RNA, 16 nt, SARS coronavirus
aaagagccaccacauu

SEQ ID NO: 4051457 - RNA, 15 nt, SARS coronavirus
aaagauggcagcuag

SEQ ID NO: 4051458 - RNA, 17 nt, SARS coronavirus
aaauauuagacauuuca

SEQ ID NO: 4051459 - RNA, 19 nt, SARS coronavirus
aaauauuagacauuucacc

SEQ ID NO: 4051460 - RNA, 20 nt, SARS coronavirus
aaauuauucucuuccugaca

SEQ ID NO: 4051461 - RNA, 17 nt, SARS coronavirus
aaauugacaaugcuucu

SEQ ID NO: 4051462 - RNA, 15 nt, SARS coronavirus
aacaaauuaaaaugu

SEQ ID NO: 4051463 - RNA, 17 nt, SARS coronavirus
aacaacuaaucagggcu

SEQ ID NO: 4051464 - RNA, 23 nt, SARS coronavirus
aacaaggcgauuagucaaauuca

SEQ ID NO: 4051465 - RNA, 17 nt, SARS coronavirus
aacagcgccgaccccaa

SEQ ID NO: 4051466 - RNA, 22 nt, SARS coronavirus
aacauggcugacuuaucaugga

SEQ ID NO: 4051467 - RNA, 20 nt, SARS coronavirus
aacauguuuauuuucuuauu

SEQ ID NO: 4051468 - RNA, 17 nt, SARS coronavirus
aaccuuuaagugcuaug

SEQ ID NO: 4051469 - RNA, 13 nt, SARS coronavirus
aacuacuuuguuu

SEQ ID NO: 4051470 - RNA, 16 nt, SARS coronavirus
aagacguuguuaacca

SEQ ID NO: 4051471 - RNA, 13 nt, SARS coronavirus
aagacuaccaaau

SEQ ID NO: 4051472 - RNA, 22 nt, SARS coronavirus
aaggaacugauuacaaacauug

SEQ ID NO: 4051473 - RNA, 16 nt, SARS coronavirus
aaggaccugccaaaag

SEQ ID NO: 4051474 - RNA, 13 nt, SARS coronavirus
aaguguaauuaca

SEQ ID NO: 4051475 - RNA, 16 nt, SARS coronavirus
aauaaacgaacaaauu

SEQ ID NO: 4051476 - RNA, 18 nt, SARS coronavirus
aauauauuaaauggccuu

SEQ ID NO: 4051477 - RNA, 14 nt, SARS coronavirus
aauauuacaaacuu

SEQ ID NO: 4051478 - RNA, 14 nt, SARS coronavirus
aauggcacuucuug

SEQ ID NO: 4051479 - RNA, 15 nt, SARS coronavirus
acaaaagaagcagcc

SEQ ID NO: 4051480 - RNA, 14 nt, SARS coronavirus
acaauucuacuaau

SEQ ID NO: 4051481 - RNA, 13 nt, SARS coronavirus
acacucaugauga

SEQ ID NO: 4051482 - RNA, 16 nt, SARS coronavirus
acauggcuauuucacc

SEQ ID NO: 4051483 - RNA, 19 nt, SARS coronavirus
acauuugguggacccacag

SEQ ID NO: 4051484 - RNA, 19 nt, SARS coronavirus
acauuuucaucgaggccac

SEQ ID NO: 4051485 - RNA, 17 nt, SARS coronavirus
accaaagucuaaacgaa

SEQ ID NO: 4051486 - RNA, 20 nt, SARS coronavirus
accaacagagccuaaaaagg

SEQ ID NO: 4051487 - RNA, 14 nt, SARS coronavirus
accaauuuaacaag

SEQ ID NO: 4051488 - RNA, 22 nt, SARS coronavirus
accacauuuucaucgaggccac

SEQ ID NO: 4051489 - RNA, 12 nt, SARS coronavirus
accucaugugcu

SEQ ID NO: 4051490 - RNA, 23 nt, SARS coronavirus
acgaguucgugguggugacggca

SEQ ID NO: 4051491 - RNA, 20 nt, SARS coronavirus
acgcaauggggcaaggccaa

SEQ ID NO: 4051492 - RNA, 22 nt, SARS coronavirus
acguacuuguuguuuuaaauaa

SEQ ID NO: 4051493 - RNA, 15 nt, SARS coronavirus
acuacaauuugccua

SEQ ID NO: 4051494 - RNA, 16 nt, SARS coronavirus
acuauaaauuaaauac

SEQ ID NO: 4051495 - RNA, 21 nt, SARS coronavirus
acuaugguucaaacaugcaca

SEQ ID NO: 4051496 - RNA, 14 nt, SARS coronavirus
acugaugaagcuca

SEQ ID NO: 4051497 - RNA, 21 nt, SARS coronavirus
acuugucauuggugcugugau

SEQ ID NO: 4051498 - RNA, 15 nt, SARS coronavirus
agaaaucugcugcug

SEQ ID NO: 4051499 - RNA, 23 nt, SARS coronavirus
agaauuauuaugagauguuggcu

SEQ ID NO: 4051500 - RNA, 20 nt, SARS coronavirus
agacagauugaaccagcuug

SEQ ID NO: 4051501 - RNA, 19 nt, SARS coronavirus
agagacaaaagaagcagcc

SEQ ID NO: 4051502 - RNA, 17 nt, SARS coronavirus
agagcugccuauaugga

SEQ ID NO: 4051503 - RNA, 14 nt, SARS coronavirus
agauggguuucucu

SEQ ID NO: 4051504 - RNA, 18 nt, SARS coronavirus
agauucccucgaggccag

SEQ ID NO: 4051505 - RNA, 22 nt, SARS coronavirus
agauugacaaaggaauuuacca

SEQ ID NO: 4051506 - RNA, 15 nt, SARS coronavirus
agcacaaguagguuu

SEQ ID NO: 4051507 - RNA, 17 nt, SARS coronavirus
agcacacacuuugcuuu

SEQ ID NO: 4051508 - RNA, 12 nt, SARS coronavirus
agccucuucucg

SEQ ID NO: 4051509 - RNA, 13 nt, SARS coronavirus
agccuuucugcua

SEQ ID NO: 4051510 - RNA, 17 nt, SARS coronavirus
agcucagccccagaugg

SEQ ID NO: 4051511 - RNA, 13 nt, SARS coronavirus
agcuuguuuuccu

SEQ ID NO: 4051512 - RNA, 23 nt, SARS coronavirus
aggaacuggcccagaagcuucac

SEQ ID NO: 4051513 - RNA, 14 nt, SARS coronavirus
aggcauaaacacuc

SEQ ID NO: 4051514 - RNA, 17 nt, SARS coronavirus
aggcaucuaaaaagccu

SEQ ID NO: 4051515 - RNA, 18 nt, SARS coronavirus
aggccaacaacaacaagg

SEQ ID NO: 4051516 - RNA, 21 nt, SARS coronavirus
aggccaacaacaacaaggcca

SEQ ID NO: 4051517 - RNA, 17 nt, SARS coronavirus
aggcggcagucaagccu

SEQ ID NO: 4051518 - RNA, 14 nt, SARS coronavirus
aggguuucauacua

SEQ ID NO: 4051519 - RNA, 13 nt, SARS coronavirus
aguaauagguuuc

SEQ ID NO: 4051520 - RNA, 21 nt, SARS coronavirus
aguacauaucugaugccuuuu

SEQ ID NO: 4051521 - RNA, 22 nt, SARS coronavirus
agucgaggcggagguacaaauu

SEQ ID NO: 4051522 - RNA, 16 nt, SARS coronavirus
agucuacucuugugca

SEQ ID NO: 4051523 - RNA, 16 nt, SARS coronavirus
agugagacaauuauuu

SEQ ID NO: 4051524 - RNA, 19 nt, SARS coronavirus
aguuucugguaaaggccaa

SEQ ID NO: 4051525 - RNA, 17 nt, SARS coronavirus
aguuugaugaggaugac

SEQ ID NO: 4051526 - RNA, 18 nt, SARS coronavirus
auaauaaguucaauagug

SEQ ID NO: 4051527 - RNA, 16 nt, SARS coronavirus
auaauuacuacagaca

SEQ ID NO: 4051528 - RNA, 14 nt, SARS coronavirus
auacaaaacauucc

SEQ ID NO: 4051529 - RNA, 13 nt, SARS coronavirus
auacacccaaaga

SEQ ID NO: 4051530 - RNA, 13 nt, SARS coronavirus
auacaguuucuuu

SEQ ID NO: 4051531 - RNA, 18 nt, SARS coronavirus
auacugcugaacaagcac

SEQ ID NO: 4051532 - RNA, 12 nt, SARS coronavirus
auacuucaucua

SEQ ID NO: 4051533 - RNA, 21 nt, SARS coronavirus
auagcuucuuaggagaaugac

SEQ ID NO: 4051534 - RNA, 17 nt, SARS coronavirus
auaucuaaugugccuuu

SEQ ID NO: 4051535 - RNA, 16 nt, SARS coronavirus
aucaacaccaauagug

SEQ ID NO: 4051536 - RNA, 15 nt, SARS coronavirus
aucaacugucaagau

SEQ ID NO: 4051537 - RNA, 21 nt, SARS coronavirus
aucagacacucuuuauuuaac

SEQ ID NO: 4051538 - RNA, 13 nt, SARS coronavirus
aucuauuguggcu

SEQ ID NO: 4051539 - RNA, 14 nt, SARS coronavirus
augaaacuucucau

SEQ ID NO: 4051540 - RNA, 16 nt, SARS coronavirus
augaccaaauuggcua

SEQ ID NO: 4051541 - RNA, 15 nt, SARS coronavirus
augaccacacaaggc

SEQ ID NO: 4051542 - RNA, 18 nt, SARS coronavirus
augcaguugcauaugcac

SEQ ID NO: 4051543 - RNA, 13 nt, SARS coronavirus
auggcacuucuug

SEQ ID NO: 4051544 - RNA, 13 nt, SARS coronavirus
auggguuucucua

SEQ ID NO: 4051545 - RNA, 19 nt, SARS coronavirus
auguaaacguuuucgcaau

SEQ ID NO: 4051546 - RNA, 18 nt, SARS coronavirus
augucgacacuucuuaug

SEQ ID NO: 4051547 - RNA, 12 nt, SARS coronavirus
auuacaaacauu

SEQ ID NO: 4051548 - RNA, 21 nt, SARS coronavirus
auuauuaacaauucuacuaau

SEQ ID NO: 4051549 - RNA, 18 nt, SARS coronavirus
auucaacccagaaacaaa

SEQ ID NO: 4051550 - RNA, 22 nt, SARS coronavirus
auucaacugacaauaaccagaa

SEQ ID NO: 4051551 - RNA, 13 nt, SARS coronavirus
auucagguuuugc

SEQ ID NO: 4051552 - RNA, 23 nt, SARS coronavirus
auucuguuuggaacuuuaacauu

SEQ ID NO: 4051553 - RNA, 23 nt, SARS coronavirus
auugaaccagcuugagagcaaag

SEQ ID NO: 4051554 - RNA, 18 nt, SARS coronavirus
auugaccgccucaaugag

SEQ ID NO: 4051555 - RNA, 20 nt, SARS coronavirus
auugacgcauacaaaacauu

SEQ ID NO: 4051556 - RNA, 22 nt, SARS coronavirus
auuucaaccauuucaacaauuu

SEQ ID NO: 4051557 - RNA, 17 nt, SARS coronavirus
auuucuuccauuuuauu

SEQ ID NO: 4051558 - RNA, 21 nt, SARS coronavirus
auuugcaauuuacugcugcua

SEQ ID NO: 4051559 - RNA, 15 nt, SARS coronavirus
auuugguggacccac

SEQ ID NO: 4051560 - RNA, 14 nt, SARS coronavirus
auuuugcugccaca

SEQ ID NO: 4051561 - RNA, 15 nt, SARS coronavirus
auuuuggugcaauuu

SEQ ID NO: 4051562 - RNA, 14 nt, SARS coronavirus
auuuugguuuucac

SEQ ID NO: 4051563 - RNA, 18 nt, SARS coronavirus
gaaaaaaaauuucuaauu

SEQ ID NO: 4051564 - RNA, 12 nt, SARS coronavirus
gaaaauuauucu

SEQ ID NO: 4051565 - RNA, 11 nt, SARS coronavirus
gaaacaaacau

SEQ ID NO: 4051566 - RNA, 14 nt, SARS coronavirus
gaaagacagaauga

SEQ ID NO: 4051567 - RNA, 14 nt, SARS coronavirus
gaaaucugcugcug

SEQ ID NO: 4051568 - RNA, 13 nt, SARS coronavirus
gaacaacauugcc

SEQ ID NO: 4051569 - RNA, 23 nt, SARS coronavirus
gaacuugucauuggugcugugau

SEQ ID NO: 4051570 - RNA, 21 nt, SARS coronavirus
gaaggucaccaaacugcugca

SEQ ID NO: 4051571 - RNA, 20 nt, SARS coronavirus
gaaugugcuaauuugcuucu

SEQ ID NO: 4051572 - RNA, 23 nt, SARS coronavirus
gacacucccuagggcgcugugac

SEQ ID NO: 4051573 - RNA, 16 nt, SARS coronavirus
gaccuaaucagacaag

SEQ ID NO: 4051574 - RNA, 21 nt, SARS coronavirus
gacugaugaagcucagccuuu

SEQ ID NO: 4051575 - RNA, 18 nt, SARS coronavirus
gacuuucaggauugcuau

SEQ ID NO: 4051576 - RNA, 19 nt, SARS coronavirus
gagcugccuauauggaaga

SEQ ID NO: 4051577 - RNA, 16 nt, SARS coronavirus
gaggacuugaaagagc

SEQ ID NO: 4051578 - RNA, 19 nt, SARS coronavirus
gauaguucaauugcuuacu

SEQ ID NO: 4051579 - RNA, 17 nt, SARS coronavirus
gaugaccaaauuggcua

SEQ ID NO: 4051580 - RNA, 13 nt, SARS coronavirus
gaugcuguugauu

SEQ ID NO: 4051581 - RNA, 14 nt, SARS coronavirus
gcaaauugcacaau

SEQ ID NO: 4051582 - RNA, 21 nt, SARS coronavirus
gcaaguacuguucaugcuaca

SEQ ID NO: 4051583 - RNA, 14 nt, SARS coronavirus
gcaauccuaauaac

SEQ ID NO: 4051584 - RNA, 16 nt, SARS coronavirus
gcaauuuacugcugcu

SEQ ID NO: 4051585 - RNA, 17 nt, SARS coronavirus
gcacaccuaauguuacu

SEQ ID NO: 4051586 - RNA, 21 nt, SARS coronavirus
gcauuaaacacacuuguuaaa

SEQ ID NO: 4051587 - RNA, 23 nt, SARS coronavirus
gcauuacauuugguggacccaca

SEQ ID NO: 4051588 - RNA, 20 nt, SARS coronavirus
gcauucuuuggaaugucacg

SEQ ID NO: 4051589 - RNA, 21 nt, SARS coronavirus
gccacuuuuucucauuguugc

SEQ ID NO: 4051590 - RNA, 19 nt, SARS coronavirus
gccagggcguuccaaucaa

SEQ ID NO: 4051591 - RNA, 15 nt, SARS coronavirus
gccaguucucaaggg

SEQ ID NO: 4051592 - RNA, 16 nt, SARS coronavirus
gcccucgcgcuauugc

SEQ ID NO: 4051593 - RNA, 19 nt, SARS coronavirus
gccgcagagacaaaagaag

SEQ ID NO: 4051594 - RNA, 18 nt, SARS coronavirus
gccuauuuuguuggcuau

SEQ ID NO: 4051595 - RNA, 17 nt, SARS coronavirus
gccuugaauacacccaa

SEQ ID NO: 4051596 - RNA, 20 nt, SARS coronavirus
gccuuucuccccugauggca

SEQ ID NO: 4051597 - RNA, 17 nt, SARS coronavirus
gcggcagucaagccucu

SEQ ID NO: 4051598 - RNA, 20 nt, SARS coronavirus
gcuagcccuuuauaagggcu

SEQ ID NO: 4051599 - RNA, 12 nt, SARS coronavirus
gcuauugcugcu

SEQ ID NO: 4051600 - RNA, 15 nt, SARS coronavirus
gcugcaaguuugaug

SEQ ID NO: 4051601 - RNA, 15 nt, SARS coronavirus
gcugcagguauggag

SEQ ID NO: 4051602 - RNA, 17 nt, SARS coronavirus
gcugcuauuuguuacca

SEQ ID NO: 4051603 - RNA, 12 nt, SARS coronavirus
gcugguggugcg

SEQ ID NO: 4051604 - RNA, 17 nt, SARS coronavirus
gcugugaucauucgugg

SEQ ID NO: 4051605 - RNA, 20 nt, SARS coronavirus
gcuucugcugauucaacuca

SEQ ID NO: 4051606 - RNA, 23 nt, SARS coronavirus
gcuucugucgucaacauucaaaa

SEQ ID NO: 4051607 - RNA, 19 nt, SARS coronavirus
gcuucuuaggagaaugaca

SEQ ID NO: 4051608 - RNA, 23 nt, SARS coronavirus
gcuuguuuugugcuugcugcugu

SEQ ID NO: 4051609 - RNA, 21 nt, SARS coronavirus
ggaacauggcugacuuaucau

SEQ ID NO: 4051610 - RNA, 19 nt, SARS coronavirus
ggagccuugaauacaccca

SEQ ID NO: 4051611 - RNA, 16 nt, SARS coronavirus
ggaugacaaagaucca

SEQ ID NO: 4051612 - RNA, 14 nt, SARS coronavirus
ggcaaaaugaaaga

SEQ ID NO: 4051613 - RNA, 21 nt, SARS coronavirus
ggcaaaaugaaagagcucagc

SEQ ID NO: 4051614 - RNA, 23 nt, SARS coronavirus
ggcaaaaugaaagagcucagccc

SEQ ID NO: 4051615 - RNA, 18 nt, SARS coronavirus
ggcacugauucagguuuu

SEQ ID NO: 4051616 - RNA, 20 nt, SARS coronavirus
gguaauacuuauagcacugc

SEQ ID NO: 4051617 - RNA, 17 nt, SARS coronavirus
gguacugccacugcugg

SEQ ID NO: 4051618 - RNA, 16 nt, SARS coronavirus
gguucaacaagagcuc

SEQ ID NO: 4051619 - RNA, 21 nt, SARS coronavirus
gguuuauuacacagaggaacu

SEQ ID NO: 4051620 - RNA, 17 nt, SARS coronavirus
gucaagccucuucucgc

SEQ ID NO: 4051621 - RNA, 20 nt, SARS coronavirus
gucacgcauuggcauggaag

SEQ ID NO: 4051622 - RNA, 20 nt, SARS coronavirus
gucacuaagaaaucugcugc

SEQ ID NO: 4051623 - RNA, 15 nt, SARS coronavirus
gucuaaacgaacaug

SEQ ID NO: 4051624 - RNA, 22 nt, SARS coronavirus
gugacggcaaaaugaaagagcu

SEQ ID NO: 4051625 - RNA, 16 nt, SARS coronavirus
gugauauuaaugcuag

SEQ ID NO: 4051626 - RNA, 18 nt, SARS coronavirus
gugcaagaucaguuucac

SEQ ID NO: 4051627 - RNA, 18 nt, SARS coronavirus
gugcuaauuugcuucucc

SEQ ID NO: 4051628 - RNA, 19 nt, SARS coronavirus
gugcucuaggaaagguuuu

SEQ ID NO: 4051629 - RNA, 23 nt, SARS coronavirus
gugcuugcugcugucuacagaau

SEQ ID NO: 4051630 - RNA, 24 nt, SARS coronavirus
guuacaaucuugcuuuguugcaug

SEQ ID NO: 4051631 - RNA, 16 nt, SARS coronavirus
guucaugcuacagcaa

SEQ ID NO: 4051632 - RNA, 23 nt, SARS coronavirus
guucauuugcaauuuacugcugc

SEQ ID NO: 4051633 - RNA, 15 nt, SARS coronavirus
guugcauaugcacug

SEQ ID NO: 4051634 - RNA, 20 nt, SARS coronavirus
guuuuaauaaugcuuauuau

SEQ ID NO: 4051635 - RNA, 14 nt, SARS coronavirus
uaaaaaggacaaaa

SEQ ID NO: 4051636 - RNA, 21 nt, SARS coronavirus
uaaacgaacuaacuauuauua

SEQ ID NO: 4051637 - RNA, 15 nt, SARS coronavirus
uaaagccaacuacau

SEQ ID NO: 4051638 - RNA, 16 nt, SARS coronavirus
uaaaggccaacaacaa

SEQ ID NO: 4051639 - RNA, 14 nt, SARS coronavirus
uaaaugauauccuu

SEQ ID NO: 4051640 - RNA, 13 nt, SARS coronavirus
uaaauuggaugac

SEQ ID NO: 4051641 - RNA, 20 nt, SARS coronavirus
uaaauuugcacuaacuugca

SEQ ID NO: 4051642 - RNA, 22 nt, SARS coronavirus
uaacaacacaguuuaugauccu

SEQ ID NO: 4051643 - RNA, 13 nt, SARS coronavirus
uaacuaaacagca

SEQ ID NO: 4051644 - RNA, 16 nt, SARS coronavirus
uaacuaaacagcacaa

SEQ ID NO: 4051645 - RNA, 18 nt, SARS coronavirus
uaacugcacugauguuuc

SEQ ID NO: 4051646 - RNA, 17 nt, SARS coronavirus
uaagaaaucugcugcug

SEQ ID NO: 4051647 - RNA, 16 nt, SARS coronavirus
uaagaagaauuauucg

SEQ ID NO: 4051648 - RNA, 15 nt, SARS coronavirus
uaagcacaagaaagu

SEQ ID NO: 4051649 - RNA, 20 nt, SARS coronavirus
uaauacuuauagcacugcuu

SEQ ID NO: 4051650 - RNA, 15 nt, SARS coronavirus
uaauacuuugcuuca

SEQ ID NO: 4051651 - RNA, 14 nt, SARS coronavirus
uaaucuugcugcua

SEQ ID NO: 4051652 - RNA, 21 nt, SARS coronavirus
uaauuucaggguuguucccuc

SEQ ID NO: 4051653 - RNA, 17 nt, SARS coronavirus
uacauaucugaugccuu

SEQ ID NO: 4051654 - RNA, 15 nt, SARS coronavirus
uacuucguugcuucc

SEQ ID NO: 4051655 - RNA, 14 nt, SARS coronavirus
uaguacagcgcugu

SEQ ID NO: 4051656 - RNA, 14 nt, SARS coronavirus
uaucauuaugagga

SEQ ID NO: 4051657 - RNA, 15 nt, SARS coronavirus
uauuuugguuuucac

SEQ ID NO: 4051658 - RNA, 15 nt, SARS coronavirus
ucaaagagauuucaa

SEQ ID NO: 4051659 - RNA, 16 nt, SARS coronavirus
ucaaggaacaacauug

SEQ ID NO: 4051660 - RNA, 22 nt, SARS coronavirus
ucaaggaacaacauugccaaaa

SEQ ID NO: 4051661 - RNA, 15 nt, SARS coronavirus
ucaagucaaacaaau

SEQ ID NO: 4051662 - RNA, 18 nt, SARS coronavirus
ucaagucaaacaaaugua

SEQ ID NO: 4051663 - RNA, 20 nt, SARS coronavirus
ucaauaaaagauggcagcua

SEQ ID NO: 4051664 - RNA, 22 nt, SARS coronavirus
ucaauagugagacaauuauuua

SEQ ID NO: 4051665 - RNA, 13 nt, SARS coronavirus
ucacaccagcuug

SEQ ID NO: 4051666 - RNA, 12 nt, SARS coronavirus
ucacagaugcug

SEQ ID NO: 4051667 - RNA, 20 nt, SARS coronavirus
ucacagcucucacucagcau

SEQ ID NO: 4051668 - RNA, 19 nt, SARS coronavirus
ucaccaaacugcugcauuu

SEQ ID NO: 4051669 - RNA, 15 nt, SARS coronavirus
ucacuaagaaaucug

SEQ ID NO: 4051670 - RNA, 16 nt, SARS coronavirus
ucagguauugcugcug

SEQ ID NO: 4051671 - RNA, 21 nt, SARS coronavirus
uccaugaguggagcuucugcu

SEQ ID NO: 4051672 - RNA, 21 nt, SARS coronavirus
uccuaauuacacucaacauac

SEQ ID NO: 4051673 - RNA, 14 nt, SARS coronavirus
ucgauaaugcauuu

SEQ ID NO: 4051674 - RNA, 22 nt, SARS coronavirus
ucuaaacgaacaugaaacuucu

SEQ ID NO: 4051675 - RNA, 22 nt, SARS coronavirus
ucuaauuuuggugcaauuucaa

SEQ ID NO: 4051676 - RNA, 14 nt, SARS coronavirus
ucuccagacaacuu

SEQ ID NO: 4051677 - RNA, 23 nt, SARS coronavirus
ucugauaauggaccccaaucaaa

SEQ ID NO: 4051678 - RNA, 15 nt, SARS coronavirus
ucuuauuauuucuua

SEQ ID NO: 4051679 - RNA, 13 nt, SARS coronavirus
ucuucaaauaccu

SEQ ID NO: 4051680 - RNA, 13 nt, SARS coronavirus
ucuucugaaggag

SEQ ID NO: 4051681 - RNA, 13 nt, SARS coronavirus
ucuucuuccugcg

SEQ ID NO: 4051682 - RNA, 22 nt, SARS coronavirus
ucuugcugcuacuaaaaugucu

SEQ ID NO: 4051683 - RNA, 21 nt, SARS coronavirus
aaggaacaacauugccaaaag

SEQ ID NO: 4051684 - RNA, 22 nt, SARS coronavirus
aaggacaaaaagaaaaagacug

SEQ ID NO: 4051685 - RNA, 24 nt, SARS coronavirus
aaggcaucguauggguugcaacug

SEQ ID NO: 4051686 - RNA, 13 nt, SARS coronavirus
aaggccaaaacag

SEQ ID NO: 4051687 - RNA, 20 nt, SARS coronavirus
aaggucaccaaacugcugca

SEQ ID NO: 4051688 - RNA, 17 nt, SARS coronavirus
aagucagguaauuuuaa

SEQ ID NO: 4051689 - RNA, 15 nt, SARS coronavirus
aauaaauuugcacua

SEQ ID NO: 4051690 - RNA, 14 nt, SARS coronavirus
aaugauuaugguuu

SEQ ID NO: 4051691 - RNA, 15 nt, SARS coronavirus
aauucaacuccuggc

SEQ ID NO: 4051692 - RNA, 19 nt, SARS coronavirus
aauugacagguuaauuaca

SEQ ID NO: 4051693 - RNA, 14 nt, SARS coronavirus
aauuggaugacaaa

SEQ ID NO: 4051694 - RNA, 23 nt, SARS coronavirus
aauuguuauuggccauuaaauga

SEQ ID NO: 4051695 - RNA, 16 nt, SARS coronavirus
acaaaagaagcagccc

SEQ ID NO: 4051696 - RNA, 21 nt, SARS coronavirus
acaacauugccaaaaggcuuc

SEQ ID NO: 4051697 - RNA, 19 nt, SARS coronavirus
acaacgguacuauuaccgu

SEQ ID NO: 4051698 - RNA, 17 nt, SARS coronavirus
acaagccucacucccuu

SEQ ID NO: 4051699 - RNA, 17 nt, SARS coronavirus
acaauauugcuuugcua

SEQ ID NO: 4051700 - RNA, 15 nt, SARS coronavirus
acaaucacagaugcu

SEQ ID NO: 4051701 - RNA, 18 nt, SARS coronavirus
acacagaggaacuucuuu

SEQ ID NO: 4051702 - RNA, 19 nt, SARS coronavirus
acacuaugguucaaacaug

SEQ ID NO: 4051703 - RNA, 12 nt, SARS coronavirus
acacucuuuauu

SEQ ID NO: 4051704 - RNA, 17 nt, SARS coronavirus
acagagaaaucaaaugu

SEQ ID NO: 4051705 - RNA, 17 nt, SARS coronavirus
acagguacguuaauagu

SEQ ID NO: 4051706 - RNA, 21 nt, SARS coronavirus
acauacgagggcaauucacca

SEQ ID NO: 4051707 - RNA, 23 nt, SARS coronavirus
accagaaugcucaagcauuaaac

SEQ ID NO: 4051708 - RNA, 15 nt, SARS coronavirus
accagcuugagagca

SEQ ID NO: 4051709 - RNA, 14 nt, SARS coronavirus
accuuauguccuuc

SEQ ID NO: 4051710 - RNA, 19 nt, SARS coronavirus
accuuuaagugcuauggcg

SEQ ID NO: 4051711 - RNA, 23 nt, SARS coronavirus
accuuuuaaggaugguauuuauu

SEQ ID NO: 4051712 - RNA, 21 nt, SARS coronavirus
acgacaauauugcuuugcuag

SEQ ID NO: 4051713 - RNA, 16 nt, SARS coronavirus
acguagugccccccgc

SEQ ID NO: 4051714 - RNA, 15 nt, SARS coronavirus
acgucacucaagcau

SEQ ID NO: 4051715 - RNA, 13 nt, SARS coronavirus
acuaaauucccuu

SEQ ID NO: 4051716 - RNA, 23 nt, SARS coronavirus
acuacuuuguuugcuggcacaca

SEQ ID NO: 4051717 - RNA, 15 nt, SARS coronavirus
acucaacauacuuca

SEQ ID NO: 4051718 - RNA, 22 nt, SARS coronavirus
acucauugaccuucaagaauug

SEQ ID NO: 4051719 - RNA, 20 nt, SARS coronavirus
acucuuagaucaauuacugc

SEQ ID NO: 4051720 - RNA, 17 nt, SARS coronavirus
acugauuacaaacauug

SEQ ID NO: 4051721 - RNA, 18 nt, SARS coronavirus
acuuccucaaggaacaac

SEQ ID NO: 4051722 - RNA, 20 nt, SARS coronavirus
acuucucauuguuuugacuu

SEQ ID NO: 4051723 - RNA, 18 nt, SARS coronavirus
acuucuuuuucuugcuuu

SEQ ID NO: 4051724 - RNA, 22 nt, SARS coronavirus
acuuugcuucaccauuaagaga

SEQ ID NO: 4051725 - RNA, 12 nt, SARS coronavirus
acuuuuaaaugc

SEQ ID NO: 4051726 - RNA, 16 nt, SARS coronavirus
agaacaaacccaagga

SEQ ID NO: 4051727 - RNA, 17 nt, SARS coronavirus
agaacccauuacuuuau

SEQ ID NO: 4051728 - RNA, 18 nt, SARS coronavirus
agacauaucuaaugugcc

SEQ ID NO: 4051729 - RNA, 22 nt, SARS coronavirus
agacauuucaccuugcgcuuuu

SEQ ID NO: 4051730 - RNA, 15 nt, SARS coronavirus
agagauuucaaccau

SEQ ID NO: 4051731 - RNA, 21 nt, SARS coronavirus
agagauuucaaccauuucaac

SEQ ID NO: 4051732 - RNA, 12 nt, SARS coronavirus
agagcucagccc

SEQ ID NO: 4051733 - RNA, 21 nt, SARS coronavirus
agcguacuucuuuuucuugcu

SEQ ID NO: 4051734 - RNA, 17 nt, SARS coronavirus
aggaacauacgagggca

SEQ ID NO: 4051735 - RNA, 16 nt, SARS coronavirus
aggaacuuagauuccc

SEQ ID NO: 4051736 - RNA, 13 nt, SARS coronavirus
aggacaaaaagaa

SEQ ID NO: 4051737 - RNA, 20 nt, SARS coronavirus
aggacaaaaagaaaaagacu

SEQ ID NO: 4051738 - RNA, 14 nt, SARS coronavirus
aggacuugcucuuu

SEQ ID NO: 4051739 - RNA, 18 nt, SARS coronavirus
aggccagggcguuccaau

SEQ ID NO: 4051740 - RNA, 20 nt, SARS coronavirus
aggugcugauaguucaauug

SEQ ID NO: 4051741 - RNA, 21 nt, SARS coronavirus
aguacuagccaaaaaucuauu

SEQ ID NO: 4051742 - RNA, 16 nt, SARS coronavirus
aguacuguucaugcua

SEQ ID NO: 4051743 - RNA, 12 nt, SARS coronavirus
aguaugaugaaa

SEQ ID NO: 4051744 - RNA, 18 nt, SARS coronavirus
agugcgacauuccuauug

SEQ ID NO: 4051745 - RNA, 19 nt, SARS coronavirus
aguucgugaucuaccuucu

SEQ ID NO: 4051746 - RNA, 15 nt, SARS coronavirus
auaaaacgaacauga

SEQ ID NO: 4051747 - RNA, 16 nt, SARS coronavirus
auacaguuucuuuauu

SEQ ID NO: 4051748 - RNA, 15 nt, SARS coronavirus
auaccuuuugcuaug

SEQ ID NO: 4051749 - RNA, 18 nt, SARS coronavirus
auacgagcauguaacuuu

SEQ ID NO: 4051750 - RNA, 20 nt, SARS coronavirus
auagcgccaggacaaacugg

SEQ ID NO: 4051751 - RNA, 22 nt, SARS coronavirus
auagugguccagaugaccaaau

SEQ ID NO: 4051752 - RNA, 13 nt, SARS coronavirus
auauauuaaaugg

SEQ ID NO: 4051753 - RNA, 15 nt, SARS coronavirus
auaucugaugccuuu

SEQ ID NO: 4051754 - RNA, 16 nt, SARS coronavirus
auccuaauaacaaugc

SEQ ID NO: 4051755 - RNA, 14 nt, SARS coronavirus
aucucacauagcaa

SEQ ID NO: 4051756 - RNA, 20 nt, SARS coronavirus
aucugaaauauuagacauuu

SEQ ID NO: 4051757 - RNA, 15 nt, SARS coronavirus
aucuuagacauggca

SEQ ID NO: 4051758 - RNA, 17 nt, SARS coronavirus
aucuugacguuauaaua

SEQ ID NO: 4051759 - RNA, 18 nt, SARS coronavirus
aucuugacguuauaauaa

SEQ ID NO: 4051760 - RNA, 22 nt, SARS coronavirus
augaaaauuauucucuuccuga

SEQ ID NO: 4051761 - RNA, 14 nt, SARS coronavirus
augaagcucagccu

SEQ ID NO: 4051762 - RNA, 23 nt, SARS coronavirus
augaaggucaccaaacugcugca

SEQ ID NO: 4051763 - RNA, 15 nt, SARS coronavirus
augaucuuugcuucu

SEQ ID NO: 4051764 - RNA, 21 nt, SARS coronavirus
augauuaugguuuuuacacca

SEQ ID NO: 4051765 - RNA, 21 nt, SARS coronavirus
augcuguugauuguucucaaa

SEQ ID NO: 4051766 - RNA, 23 nt, SARS coronavirus
auggaccccaaucaaaccaacgu

SEQ ID NO: 4051767 - RNA, 18 nt, SARS coronavirus
auggaguuagauuaucca

SEQ ID NO: 4051768 - RNA, 16 nt, SARS coronavirus
auggguuguguccuug

SEQ ID NO: 4051769 - RNA, 21 nt, SARS coronavirus
augguguugucuuccuacaug

SEQ ID NO: 4051770 - RNA, 14 nt, SARS coronavirus
auguagaauuauua

SEQ ID NO: 4051771 - RNA, 21 nt, SARS coronavirus
auguauuccagacucaagcag

SEQ ID NO: 4051772 - RNA, 18 nt, SARS coronavirus
augugcuaauuugcuucu

SEQ ID NO: 4051773 - RNA, 14 nt, SARS coronavirus
auguuucuacagca

SEQ ID NO: 4051774 - RNA, 22 nt, SARS coronavirus
auuauaaauugccagaugauuu

SEQ ID NO: 4051775 - RNA, 18 nt, SARS coronavirus
auuccagacucaagcagg

SEQ ID NO: 4051776 - RNA, 19 nt, SARS coronavirus
auucccaccaacagagccu

SEQ ID NO: 4051777 - RNA, 15 nt, SARS coronavirus
auucucuuccugaca

SEQ ID NO: 4051778 - RNA, 17 nt, SARS coronavirus
auugacaaugcuucucc

SEQ ID NO: 4051779 - RNA, 20 nt, SARS coronavirus
auugaugcuacuucaacugg

SEQ ID NO: 4051780 - RNA, 14 nt, SARS coronavirus
auuggaugacaaag

SEQ ID NO: 4051781 - RNA, 22 nt, SARS coronavirus
auuguggcuuauacuaugucuu

SEQ ID NO: 4051782 - RNA, 18 nt, SARS coronavirus
auugugugcguacugcug

SEQ ID NO: 4051783 - RNA, 20 nt, SARS coronavirus
auugugugcguacugcugca

SEQ ID NO: 4051784 - RNA, 14 nt, SARS coronavirus
auuuacugcugcua

SEQ ID NO: 4051785 - RNA, 24 nt, SARS coronavirus
auuugcacuaacuugcacuagcac

SEQ ID NO: 4051786 - RNA, 13 nt, SARS coronavirus
auuuuaauagcuu

SEQ ID NO: 4051787 - RNA, 23 nt, SARS coronavirus
caaaaacguacugccacaaaaca

SEQ ID NO: 4051788 - RNA, 23 nt, SARS coronavirus
caaaaagaaaaagacugaugaag

SEQ ID NO: 4051789 - RNA, 20 nt, SARS coronavirus
caaaaugaaagagcucagcc

SEQ ID NO: 4051790 - RNA, 15 nt, SARS coronavirus
caaacccaaggaaau

SEQ ID NO: 4051791 - RNA, 18 nt, SARS coronavirus
caaacuuguguccuuuug

SEQ ID NO: 4051792 - RNA, 15 nt, SARS coronavirus
caaagaagacuacca

SEQ ID NO: 4051793 - RNA, 14 nt, SARS coronavirus
caaaguuucuggua

SEQ ID NO: 4051794 - RNA, 15 nt, SARS coronavirus
caaauaauuacuaca

SEQ ID NO: 4051795 - RNA, 14 nt, SARS coronavirus
caacaacaaggcca

SEQ ID NO: 4051796 - RNA, 11 nt, SARS coronavirus
caacaaggcca

SEQ ID NO: 4051797 - RNA, 21 nt, SARS coronavirus
caagaccuaaucagacaagga

SEQ ID NO: 4051798 - RNA, 20 nt, SARS coronavirus
caagggugcaugcucuugug

SEQ ID NO: 4051799 - RNA, 17 nt, SARS coronavirus
caagucaaacaaaugua

SEQ ID NO: 4051800 - RNA, 18 nt, SARS coronavirus
caagugugcuaaaugaua

SEQ ID NO: 4051801 - RNA, 16 nt, SARS coronavirus
caauggggcaaggcca

SEQ ID NO: 4051802 - RNA, 13 nt, SARS coronavirus
cguuucugccacu

SEQ ID NO: 4051803 - RNA, 16 nt, SARS coronavirus
cuaaacgaacaugaaa

SEQ ID NO: 4051804 - RNA, 13 nt, SARS coronavirus
cuaacuugcacua

SEQ ID NO: 4051805 - RNA, 20 nt, SARS coronavirus
cuaagaaaucugcugcugag

SEQ ID NO: 4051806 - RNA, 21 nt, SARS coronavirus
cuaaguugaaugaucuuugcu

SEQ ID NO: 4051807 - RNA, 13 nt, SARS coronavirus
cuaauaacaaugc

SEQ ID NO: 4051808 - RNA, 14 nt, SARS coronavirus
cuacaacuuccuca

SEQ ID NO: 4051809 - RNA, 21 nt, SARS coronavirus
cuacaugucacguaugugcca

SEQ ID NO: 4051810 - RNA, 21 nt, SARS coronavirus
cuacgcagagggaagcagagg

SEQ ID NO: 4051811 - RNA, 15 nt, SARS coronavirus
cuacuaaaaugucug

SEQ ID NO: 4051812 - RNA, 14 nt, SARS coronavirus
cuacuaacuuuuca

SEQ ID NO: 4051813 - RNA, 15 nt, SARS coronavirus
cuacugaaugugcua

SEQ ID NO: 4051814 - RNA, 19 nt, SARS coronavirus
cuacuucguugcuuccuuc

SEQ ID NO: 4051815 - RNA, 21 nt, SARS coronavirus
cuagccauccuuacugcgcuu

SEQ ID NO: 4051816 - RNA, 17 nt, SARS coronavirus
cuagggcgcugugacau

SEQ ID NO: 4051817 - RNA, 20 nt, SARS coronavirus
cuaugucuuuaggugcugau

SEQ ID NO: 4051818 - RNA, 21 nt, SARS coronavirus
cuauuuuguuggcuauuuaaa

SEQ ID NO: 4051819 - RNA, 16 nt, SARS coronavirus
cucaaagaagacuacc

SEQ ID NO: 4051820 - RNA, 23 nt, SARS coronavirus
cucaaugaggucgcuaaaaauuu

SEQ ID NO: 4051821 - RNA, 22 nt, SARS coronavirus
cucacucccuuucggauggcuu

SEQ ID NO: 4051822 - RNA, 19 nt, SARS coronavirus
cucagccuuugccgcagag

SEQ ID NO: 4051823 - RNA, 16 nt, SARS coronavirus
cucaggauuuauuucu

SEQ ID NO: 4051824 - RNA, 16 nt, SARS coronavirus
cucaggcauaaacacu

SEQ ID NO: 4051825 - RNA, 13 nt, SARS coronavirus
cucagguauugcu

SEQ ID NO: 4051826 - RNA, 16 nt, SARS coronavirus
cucaugugcuugaaga

SEQ ID NO: 4051827 - RNA, 18 nt, SARS coronavirus
cucgaauggcuagcggag

SEQ ID NO: 4051828 - RNA, 18 nt, SARS coronavirus
cucgccacuuuuucucau

SEQ ID NO: 4051829 - RNA, 15 nt, SARS coronavirus
cucgcuccucaucac

SEQ ID NO: 4051830 - RNA, 20 nt, SARS coronavirus
cucguacccgcucaaugugg

SEQ ID NO: 4051831 - RNA, 21 nt, SARS coronavirus
cucuaguuagugguacugcca

SEQ ID NO: 4051832 - RNA, 16 nt, SARS coronavirus
cucucagguauugcug

SEQ ID NO: 4051833 - RNA, 24 nt, SARS coronavirus
cucuggcucuuguggccaguaaca

SEQ ID NO: 4051834 - RNA, 13 nt, SARS coronavirus
cucugugcucuac

SEQ ID NO: 4051835 - RNA, 18 nt, SARS coronavirus
cucuugugcagaaugaau

SEQ ID NO: 4051836 - RNA, 19 nt, SARS coronavirus
cugaaguugcuguucuaua

SEQ ID NO: 4051837 - RNA, 18 nt, SARS coronavirus
cugacuuaucauggagcc

SEQ ID NO: 4051838 - RNA, 16 nt, SARS coronavirus
cugaugaagcucagcc

SEQ ID NO: 4051839 - RNA, 17 nt, SARS coronavirus
cugauguuucuacagca

SEQ ID NO: 4051840 - RNA, 14 nt, SARS coronavirus
cugauuacaaacau

SEQ ID NO: 4051841 - RNA, 16 nt, SARS coronavirus
cugcagccuauuuugu

SEQ ID NO: 4051842 - RNA, 20 nt, SARS coronavirus
cugcagguauggaggcgcaa

SEQ ID NO: 4051843 - RNA, 14 nt, SARS coronavirus
cugccaaaagagau

SEQ ID NO: 4051844 - RNA, 23 nt, SARS coronavirus
cugcccucgcgcuauugcugcua

SEQ ID NO: 4051845 - RNA, 12 nt, SARS coronavirus
cugcuuggcuuu

SEQ ID NO: 4051846 - RNA, 13 nt, SARS coronavirus
cuggaacaaaugc

SEQ ID NO: 4051847 - RNA, 16 nt, SARS coronavirus
cuggaacaauggaacc

SEQ ID NO: 4051848 - RNA, 13 nt, SARS coronavirus
cuggcagcaguag

SEQ ID NO: 4051849 - RNA, 22 nt, SARS coronavirus
cuguuuuucagagcgcuaccaa

SEQ ID NO: 4051850 - RNA, 22 nt, SARS coronavirus
cuuacagccuuuucaccugcuc

SEQ ID NO: 4051851 - RNA, 15 nt, SARS coronavirus
cuuagaucaauuacu

SEQ ID NO: 4051852 - RNA, 17 nt, SARS coronavirus
cuuagcucuaauuuugg

SEQ ID NO: 4051853 - RNA, 14 nt, SARS coronavirus
cuuauaggagcuga

SEQ ID NO: 4051854 - RNA, 16 nt, SARS coronavirus
cuucaaagagauuuca

SEQ ID NO: 4051855 - RNA, 14 nt, SARS coronavirus
cuuccuacauguca

SEQ ID NO: 4051856 - RNA, 11 nt, SARS coronavirus
cuucucauugu

SEQ ID NO: 4051857 - RNA, 17 nt, SARS coronavirus
cuucuggucuaaacgaa

SEQ ID NO: 4051858 - RNA, 21 nt, SARS coronavirus
cuucugucgucaacauucaaa

SEQ ID NO: 4051859 - RNA, 12 nt, SARS coronavirus
cuugaaagagcc

SEQ ID NO: 4051860 - RNA, 23 nt, SARS coronavirus
cuugaaagagccaccacauuuuc

SEQ ID NO: 4051861 - RNA, 16 nt, SARS coronavirus
cuugaagauccuugua

SEQ ID NO: 4051862 - RNA, 21 nt, SARS coronavirus
cuugaauacacccaaagacca

SEQ ID NO: 4051863 - RNA, 23 nt, SARS coronavirus
cuugauauauuuucuacaaugca

SEQ ID NO: 4051864 - RNA, 16 nt, SARS coronavirus
cuugcgaauggccgga

SEQ ID NO: 4051865 - RNA, 18 nt, SARS coronavirus
cuugguauuaacauuaca

SEQ ID NO: 4051866 - RNA, 16 nt, SARS coronavirus
cuuuaauugacuucua

SEQ ID NO: 4051867 - RNA, 17 nt, SARS coronavirus
cuuugaaaccuauuuuu

SEQ ID NO: 4051868 - RNA, 14 nt, SARS coronavirus
cuuuucaucagaca

SEQ ID NO: 4051869 - RNA, 20 nt, SARS coronavirus
gaaaaugcuacauucuucau

SEQ ID NO: 4051870 - RNA, 23 nt, SARS coronavirus
gaaacaaacauucuucucaaugu

SEQ ID NO: 4051871 - RNA, 20 nt, SARS coronavirus
gaaagguuuuaccuuuucau

SEQ ID NO: 4051872 - RNA, 17 nt, SARS coronavirus
gaacuugucauuggugc

SEQ ID NO: 4051873 - RNA, 22 nt, SARS coronavirus
gaauacacccaaagaccacauu

SEQ ID NO: 4051874 - RNA, 22 nt, SARS coronavirus
gaauggcuagcggaggugguga

SEQ ID NO: 4051875 - RNA, 13 nt, SARS coronavirus
gacaaaggaauuu

SEQ ID NO: 4051876 - RNA, 23 nt, SARS coronavirus
gacaaggaacugauuacaaacau

SEQ ID NO: 4051877 - RNA, 17 nt, SARS coronavirus
gacaaguacuucaaaaa

SEQ ID NO: 4051878 - RNA, 19 nt, SARS coronavirus
gacaauauugcuuugcuag

SEQ ID NO: 4051879 - RNA, 19 nt, SARS coronavirus
gacaauuauuuaagccucu

SEQ ID NO: 4051880 - RNA, 17 nt, SARS coronavirus
gacagauugaaccagcu

SEQ ID NO: 4051881 - RNA, 21 nt, SARS coronavirus
gaccccaagguuuacccaaua

SEQ ID NO: 4051882 - RNA, 18 nt, SARS coronavirus
cuuuugaugauguucaag

SEQ ID NO: 4051883 - RNA, 12 nt, SARS coronavirus
gaaaaugcuaca

SEQ ID NO: 4051884 - RNA, 22 nt, SARS coronavirus
gaaagagccaccacauuuucau

SEQ ID NO: 4051885 - RNA, 14 nt, SARS coronavirus
gaacaaacccaagg

SEQ ID NO: 4051886 - RNA, 18 nt, SARS coronavirus
gaacaaacccaaggaaau

SEQ ID NO: 4051887 - RNA, 20 nt, SARS coronavirus
gaagcagcccacugugacuc

SEQ ID NO: 4051888 - RNA, 14 nt, SARS coronavirus
gaaguugcuguucu

SEQ ID NO: 4051889 - RNA, 21 nt, SARS coronavirus
gacaaagauccacaauucaaa

SEQ ID NO: 4051890 - RNA, 17 nt, SARS coronavirus
gacaacagauguuucau

SEQ ID NO: 4051891 - RNA, 18 nt, SARS coronavirus
gacaacgucauacugcug

SEQ ID NO: 4051892 - RNA, 15 nt, SARS coronavirus
gacacugguauugaa

SEQ ID NO: 4051893 - RNA, 22 nt, SARS coronavirus
gacucugagccaguucucaagg

SEQ ID NO: 4051894 - RNA, 15 nt, SARS coronavirus
gacuugcucuuuaau

SEQ ID NO: 4051895 - RNA, 22 nt, SARS coronavirus
gagccuugaauacacccaaaga

SEQ ID NO: 4051896 - RNA, 20 nt, SARS coronavirus
gaggcaucuaaaaagccucg

SEQ ID NO: 4051897 - RNA, 14 nt, SARS coronavirus
gauaugauugcugc

SEQ ID NO: 4051898 - RNA, 14 nt, SARS coronavirus
gaucacuguggcua

SEQ ID NO: 4051899 - RNA, 18 nt, SARS coronavirus
gauguuucugauuucacu

SEQ ID NO: 4051900 - RNA, 21 nt, SARS coronavirus
gauugcugccuacacugcugc

SEQ ID NO: 4051901 - RNA, 21 nt, SARS coronavirus
gauugugugcguacugcugca

SEQ ID NO: 4051902 - RNA, 16 nt, SARS coronavirus
gcaagacguuguuaac

SEQ ID NO: 4051903 - RNA, 18 nt, SARS coronavirus
gcacaccuaauguuacua

SEQ ID NO: 4051904 - RNA, 22 nt, SARS coronavirus
gcacugauucagguuuugcugc

SEQ ID NO: 4051905 - RNA, 20 nt, SARS coronavirus
gcauugggcaagcugcaaga

SEQ ID NO: 4051906 - RNA, 16 nt, SARS coronavirus
gcauuucaacaccaaa

SEQ ID NO: 4051907 - RNA, 12 nt, SARS coronavirus
gcauuucuugcu

SEQ ID NO: 4051908 - RNA, 21 nt, SARS coronavirus
gcccucgcgcuauugcugcua

SEQ ID NO: 4051909 - RNA, 18 nt, SARS coronavirus
gcucggcuucauugcugg

SEQ ID NO: 4051910 - RNA, 20 nt, SARS coronavirus
gcugccuauauggaagagcc

SEQ ID NO: 4051911 - RNA, 16 nt, SARS coronavirus
gcugcugaaaucaggg

SEQ ID NO: 4051912 - RNA, 20 nt, SARS coronavirus
gcugugaucauucgugguca

SEQ ID NO: 4051913 - RNA, 19 nt, SARS coronavirus
gcuuaucauggcagacaac

SEQ ID NO: 4051914 - RNA, 20 nt, SARS coronavirus
gcuucuccaaugucuaugca

SEQ ID NO: 4051915 - RNA, 19 nt, SARS coronavirus
gcuugagagcaaaguuucu

SEQ ID NO: 4051916 - RNA, 22 nt, SARS coronavirus
gcuuguuuugugcuugcugcug

SEQ ID NO: 4051917 - RNA, 21 nt, SARS coronavirus
ggaacauacgagggcaauuca

SEQ ID NO: 4051918 - RNA, 23 nt, SARS coronavirus
ggacuugaaagagccaccacauu

SEQ ID NO: 4051919 - RNA, 19 nt, SARS coronavirus
ggagguacaaauugacagg

SEQ ID NO: 4051920 - RNA, 18 nt, SARS coronavirus
ggcaaaaugaaagagcuc

SEQ ID NO: 4051921 - RNA, 21 nt, SARS coronavirus
ggcaucuaaaaagccucgcca

SEQ ID NO: 4051922 - RNA, 15 nt, SARS coronavirus
ggugcaugcucuugu

SEQ ID NO: 4051923 - RNA, 19 nt, SARS coronavirus
gguucaacaagagcucuac

SEQ ID NO: 4051924 - RNA, 14 nt, SARS coronavirus
gguucacagcucuc

SEQ ID NO: 4051925 - RNA, 16 nt, SARS coronavirus
gguucuugcugcaagu

SEQ ID NO: 4051926 - RNA, 13 nt, SARS coronavirus
guacaacgucacu

SEQ ID NO: 4051927 - RNA, 22 nt, SARS coronavirus
caaacugguguuauugcugauu

SEQ ID NO: 4051928 - RNA, 13 nt, SARS coronavirus
caaauaccuuuug

SEQ ID NO: 4051929 - RNA, 21 nt, SARS coronavirus
caaauucaagaaucacuuaca

SEQ ID NO: 4051930 - RNA, 17 nt, SARS coronavirus
caacaacaacaaggcca

SEQ ID NO: 4051931 - RNA, 14 nt, SARS coronavirus
caacaaggccaaac

SEQ ID NO: 4051932 - RNA, 23 nt, SARS coronavirus
caacagagccuaaaaaggacaaa

SEQ ID NO: 4051933 - RNA, 11 nt, SARS coronavirus
caacuccugga

SEQ ID NO: 4051934 - RNA, 17 nt, SARS coronavirus
caacuccuggcagcagu

SEQ ID NO: 4051935 - RNA, 21 nt, SARS coronavirus
caagaaauucaacuccuggca

SEQ ID NO: 4051936 - RNA, 14 nt, SARS coronavirus
caagauccagcugg

SEQ ID NO: 4051937 - RNA, 18 nt, SARS coronavirus
caagggugucaaauuaca

SEQ ID NO: 4051938 - RNA, 16 nt, SARS coronavirus
caagucaaacaaaugu

SEQ ID NO: 4051939 - RNA, 15 nt, SARS coronavirus
caagugccucugcau

SEQ ID NO: 4051940 - RNA, 16 nt, SARS coronavirus
caauaaccagaaugga

SEQ ID NO: 4051941 - RNA, 14 nt, SARS coronavirus
caauggcuuguauu

SEQ ID NO: 4051942 - RNA, 15 nt, SARS coronavirus
caauggcuuguauug

SEQ ID NO: 4051943 - RNA, 17 nt, SARS coronavirus
caauuagcauuacuaca

SEQ ID NO: 4051944 - RNA, 22 nt, SARS coronavirus
cacaccuucgggaacauggcug

SEQ ID NO: 4051945 - RNA, 19 nt, SARS coronavirus
cacagauucaacugacaau

SEQ ID NO: 4051946 - RNA, 18 nt, SARS coronavirus
cacagcucucacucagca

SEQ ID NO: 4051947 - RNA, 13 nt, SARS coronavirus
cacaucuuuugcu

SEQ ID NO: 4051948 - RNA, 18 nt, SARS coronavirus
cacauugacgcauacaaa

SEQ ID NO: 4051949 - RNA, 21 nt, SARS coronavirus
caccauuaagagaaagacaga

SEQ ID NO: 4051950 - RNA, 20 nt, SARS coronavirus
caccauuucacccucuugcu

SEQ ID NO: 4051951 - RNA, 16 nt, SARS coronavirus
cacgaacgcuuucuua

SEQ ID NO: 4051952 - RNA, 19 nt, SARS coronavirus
cacuaagaaaucugcugcu

SEQ ID NO: 4051953 - RNA, 20 nt, SARS coronavirus
cacuaagaaaucugcugcug

SEQ ID NO: 4051954 - RNA, 19 nt, SARS coronavirus
cacucagguguuaaagacu

SEQ ID NO: 4051955 - RNA, 13 nt, SARS coronavirus
cacugcugcucua

SEQ ID NO: 4051956 - RNA, 23 nt, SARS coronavirus
cacuugcuuguuuugugcuugcu

SEQ ID NO: 4051957 - RNA, 21 nt, SARS coronavirus
cagacaaggaacugauuacaa

SEQ ID NO: 4051958 - RNA, 16 nt, SARS coronavirus
cagagccuaaaaagga

SEQ ID NO: 4051959 - RNA, 19 nt, SARS coronavirus
cagagccuaaaaaggacaa

SEQ ID NO: 4051960 - RNA, 18 nt, SARS coronavirus
cagaggaacuucuuuucu

SEQ ID NO: 4051961 - RNA, 13 nt, SARS coronavirus
cagcccacuguga

SEQ ID NO: 4051962 - RNA, 17 nt, SARS coronavirus
cagcucucacucagcau

SEQ ID NO: 4051963 - RNA, 20 nt, SARS coronavirus
cagcucucacucagcauggc

SEQ ID NO: 4051964 - RNA, 19 nt, SARS coronavirus
caggauugcuauuuggaau

SEQ ID NO: 4051965 - RNA, 14 nt, SARS coronavirus
cagguauugcugcu

SEQ ID NO: 4051966 - RNA, 18 nt, SARS coronavirus
caguugcauaugcacugu

SEQ ID NO: 4051967 - RNA, 23 nt, SARS coronavirus
cauagucuacucuugugcagaau

SEQ ID NO: 4051968 - RNA, 16 nt, SARS coronavirus
cauaucugaugccuuu

SEQ ID NO: 4051969 - RNA, 15 nt, SARS coronavirus
caucuuguugacuuc

SEQ ID NO: 4051970 - RNA, 16 nt, SARS coronavirus
caugaaggucaccaaa

SEQ ID NO: 4051971 - RNA, 21 nt, SARS coronavirus
caugaaggucaccaaacugcu

SEQ ID NO: 4051972 - RNA, 20 nt, SARS coronavirus
caugaguggagcuucugcug

SEQ ID NO: 4051973 - RNA, 18 nt, SARS coronavirus
cauugcuuaucauggcag

SEQ ID NO: 4051974 - RNA, 20 nt, SARS coronavirus
cauuggcuaccaaccuuaca

SEQ ID NO: 4051975 - RNA, 20 nt, SARS coronavirus
cauuguuuugacuuguauuu

SEQ ID NO: 4051976 - RNA, 15 nt, SARS coronavirus
cauuuggugcuggcg

SEQ ID NO: 4051977 - RNA, 13 nt, SARS coronavirus
ccaccucugcuca

SEQ ID NO: 4051978 - RNA, 20 nt, SARS coronavirus
ccagaagcuucacuucccua

SEQ ID NO: 4051979 - RNA, 12 nt, SARS coronavirus
auuauuaacaau

SEQ ID NO: 4051980 - RNA, 17 nt, SARS coronavirus
auuauucuguuuggaac

SEQ ID NO: 4051981 - RNA, 21 nt, SARS coronavirus
auucaacccagaaacaaacau

SEQ ID NO: 4051982 - RNA, 17 nt, SARS coronavirus
auucccuucugucuaug

SEQ ID NO: 4051983 - RNA, 19 nt, SARS coronavirus
auugcgauugcaauggcuu

SEQ ID NO: 4051984 - RNA, 13 nt, SARS coronavirus
auuguugcugcuc

SEQ ID NO: 4051985 - RNA, 22 nt, SARS coronavirus
auuuaagccucuaacuaagaag

SEQ ID NO: 4051986 - RNA, 13 nt, SARS coronavirus
auuuacugcugcu

SEQ ID NO: 4051987 - RNA, 15 nt, SARS coronavirus
auuucggggaccaag

SEQ ID NO: 4051988 - RNA, 19 nt, SARS coronavirus
auuucuaauuguguugcug

SEQ ID NO: 4051989 - RNA, 21 nt, SARS coronavirus
auuucuuccauuuuauucuaa

SEQ ID NO: 4051990 - RNA, 18 nt, SARS coronavirus
auuugcaauuuacugcug

SEQ ID NO: 4051991 - RNA, 13 nt, SARS coronavirus
caaaaacaaaucg

SEQ ID NO: 4051992 - RNA, 12 nt, SARS coronavirus
caaacugcugca

SEQ ID NO: 4051993 - RNA, 12 nt, SARS coronavirus
caaagaccacau

SEQ ID NO: 4051994 - RNA, 23 nt, SARS coronavirus
caaauagcgccaggacaaacugg

SEQ ID NO: 4051995 - RNA, 12 nt, SARS coronavirus
caaauuacuaca

SEQ ID NO: 4051996 - RNA, 18 nt, SARS coronavirus
caaauugcacaauuugcu

SEQ ID NO: 4051997 - RNA, 19 nt, SARS coronavirus
caacaccaaaacucaaaga

SEQ ID NO: 4051998 - RNA, 22 nt, SARS coronavirus
caacacuagggguaauacuuau

SEQ ID NO: 4051999 - RNA, 18 nt, SARS coronavirus
caacgucauacugcugaa

SEQ ID NO: 4052000 - RNA, 21 nt, SARS coronavirus
caacuacuuuguuugcuggca

SEQ ID NO: 4052001 - RNA, 18 nt, SARS coronavirus
caagauguuaacugcacu

SEQ ID NO: 4052002 - RNA, 13 nt, SARS coronavirus
caaucaacaccaa

SEQ ID NO: 4052003 - RNA, 18 nt, SARS coronavirus
caaucacagaugcuguug

SEQ ID NO: 4052004 - RNA, 13 nt, SARS coronavirus
caauggacuuaca

SEQ ID NO: 4052005 - RNA, 13 nt, SARS coronavirus
caauguguaacau

SEQ ID NO: 4052006 - RNA, 14 nt, SARS coronavirus
caauucaaagacaa

SEQ ID NO: 4052007 - RNA, 14 nt, SARS coronavirus
caauugcuuacucu

SEQ ID NO: 4052008 - RNA, 15 nt, SARS coronavirus
caauuuacugcugcu

SEQ ID NO: 4052009 - RNA, 15 nt, SARS coronavirus
caccaaacugcugca

SEQ ID NO: 4052010 - RNA, 22 nt, SARS coronavirus
cacuagccauccuuacugcgcu

SEQ ID NO: 4052011 - RNA, 15 nt, SARS coronavirus
cacucagcauggcaa

SEQ ID NO: 4052012 - RNA, 18 nt, SARS coronavirus
cacucagcauggcaagga

SEQ ID NO: 4052013 - RNA, 21 nt, SARS coronavirus
cacucucagguauugcugcug

SEQ ID NO: 4052014 - RNA, 23 nt, SARS coronavirus
cacugaugauaugauugcugccu

SEQ ID NO: 4052015 - RNA, 14 nt, SARS coronavirus
cacugauguuucua

SEQ ID NO: 4052016 - RNA, 12 nt, SARS coronavirus
cacugcugcucu

SEQ ID NO: 4052017 - RNA, 20 nt, SARS coronavirus
cacugcuggauggacauuug

SEQ ID NO: 4052018 - RNA, 21 nt, SARS coronavirus
cagaauggaggacgcaauggg

SEQ ID NO: 4052019 - RNA, 16 nt, SARS coronavirus
cagaugguacuucuau

SEQ ID NO: 4052020 - RNA, 17 nt, SARS coronavirus
cagaugguacuucuauu

SEQ ID NO: 4052021 - RNA, 15 nt, SARS coronavirus
cagcaguaggggaaa

SEQ ID NO: 4052022 - RNA, 17 nt, SARS coronavirus
cagcgccgaccccaagg

SEQ ID NO: 4052023 - RNA, 17 nt, SARS coronavirus
cagguauggaggcgcaa

SEQ ID NO: 4052024 - RNA, 20 nt, SARS coronavirus
cauacugcugaacaagcaca

SEQ ID NO: 4052025 - RNA, 13 nt, SARS coronavirus
cauagauggcaca

SEQ ID NO: 4052026 - RNA, 17 nt, SARS coronavirus
cauagauggcacacuau

SEQ ID NO: 4052027 - RNA, 14 nt, SARS coronavirus
caugacuaguuguu

SEQ ID NO: 4052028 - RNA, 13 nt, SARS coronavirus
cauucuuuggaau

SEQ ID NO: 4052029 - RNA, 20 nt, SARS coronavirus
cauugcuauaccuacuaacu

SEQ ID NO: 4052030 - RNA, 23 nt, SARS coronavirus
cauuggaguuacccaaaauguuc

SEQ ID NO: 4052031 - RNA, 19 nt, SARS coronavirus
cauuugguggacccacaga

SEQ ID NO: 4052032 - RNA, 20 nt, SARS coronavirus
ccaacuacauuuaugcucaa

SEQ ID NO: 4052033 - RNA, 17 nt, SARS coronavirus
ccaagaccuaaucagac

SEQ ID NO: 4052034 - RNA, 20 nt, SARS coronavirus
ccaccugcucuuaauuguua

SEQ ID NO: 4052035 - RNA, 16 nt, SARS coronavirus
ccagcuugagucuaca

SEQ ID NO: 4052036 - RNA, 22 nt, SARS coronavirus
ccaugaguggagcuucugcuga

SEQ ID NO: 4052037 - RNA, 23 nt, SARS coronavirus
ccaugaguggagcuucugcugau

SEQ ID NO: 4052038 - RNA, 19 nt, SARS coronavirus
ccauuuuauucuaauguua

SEQ ID NO: 4052039 - RNA, 19 nt, SARS coronavirus
ccgugcuacaacuuccuca

SEQ ID NO: 4052040 - RNA, 16 nt, SARS coronavirus
ccuauuggagcuggca

SEQ ID NO: 4052041 - RNA, 21 nt, SARS coronavirus
ccucaugugcuugaagauccu

SEQ ID NO: 4052042 - RNA, 20 nt, SARS coronavirus
ccucgcgcuauugcugcuag

SEQ ID NO: 4052043 - RNA, 16 nt, SARS coronavirus
ccugcucgaauggcua

SEQ ID NO: 4052044 - RNA, 13 nt, SARS coronavirus
ccuugcgcuuuug

SEQ ID NO: 4052045 - RNA, 12 nt, SARS coronavirus
ccuuucugcuau

SEQ ID NO: 4052046 - RNA, 20 nt, SARS coronavirus
ccuuugccgcagagacaaaa

SEQ ID NO: 4052047 - RNA, 15 nt, SARS coronavirus
cgaacuaacuauuau

SEQ ID NO: 4052048 - RNA, 17 nt, SARS coronavirus
cgaacuuauguacucau

SEQ ID NO: 4052049 - RNA, 15 nt, SARS coronavirus
cgaaguuuacuacca

SEQ ID NO: 4052050 - RNA, 18 nt, SARS coronavirus
cgaaugugcaaauacaca

SEQ ID NO: 4052051 - RNA, 19 nt, SARS coronavirus
cgauacauagucuacucuu

SEQ ID NO: 4052052 - RNA, 13 nt, SARS coronavirus
cgcuauugcugcu

SEQ ID NO: 4052053 - RNA, 15 nt, SARS coronavirus
cgcuccucaucacgu

SEQ ID NO: 4052054 - RNA, 21 nt, SARS coronavirus
cgggauugcgauugcaauggc

SEQ ID NO: 4052055 - RNA, 21 nt, SARS coronavirus
cgucauacugcugaacaagca

SEQ ID NO: 4052056 - RNA, 13 nt, SARS coronavirus
cuaauauuacaaa

SEQ ID NO: 4052057 - RNA, 16 nt, SARS coronavirus
cuaaucagggcugcug

SEQ ID NO: 4052058 - RNA, 20 nt, SARS coronavirus
cuaaucuugcugcuacuaaa

SEQ ID NO: 4052059 - RNA, 20 nt, SARS coronavirus
cuaauguuacuaucaacugu

SEQ ID NO: 4052060 - RNA, 14 nt, SARS coronavirus
cuaauguuguuaua

SEQ ID NO: 4052061 - RNA, 16 nt, SARS coronavirus
cuacacugcugcucua

SEQ ID NO: 4052062 - RNA, 17 nt, SARS coronavirus
cuacagaaguaaugccu

SEQ ID NO: 4052063 - RNA, 16 nt, SARS coronavirus
cuacuaacuuuucaau

SEQ ID NO: 4052064 - RNA, 15 nt, SARS coronavirus
cuagggcgcugugac

SEQ ID NO: 4052065 - RNA, 11 nt, SARS coronavirus
cuauguuuaua

SEQ ID NO: 4052066 - RNA, 13 nt, SARS coronavirus
cuauugcugcuag

SEQ ID NO: 4052067 - RNA, 14 nt, SARS coronavirus
cucgcuccucauca

SEQ ID NO: 4052068 - RNA, 20 nt, SARS coronavirus
cugaaauauuagacauuuca

SEQ ID NO: 4052069 - RNA, 13 nt, SARS coronavirus
cugauaauggacc

SEQ ID NO: 4052070 - RNA, 13 nt, SARS coronavirus
cugauuacaaaca

SEQ ID NO: 4052071 - RNA, 16 nt, SARS coronavirus
cugcaaguuugaugag

SEQ ID NO: 4052072 - RNA, 22 nt, SARS coronavirus
cugccaaaagagaucacugugg

SEQ ID NO: 4052073 - RNA, 15 nt, SARS coronavirus
cugcucacugaugau

SEQ ID NO: 4052074 - RNA, 20 nt, SARS coronavirus
cugcugauucaacucaggca

SEQ ID NO: 4052075 - RNA, 18 nt, SARS coronavirus
cuggcagcaguaggggaa

SEQ ID NO: 4052076 - RNA, 21 nt, SARS coronavirus
cugguauugaaaaugcuacau

SEQ ID NO: 4052077 - RNA, 21 nt, SARS coronavirus
cuguaguacagcgcugugcau

SEQ ID NO: 4052078 - RNA, 13 nt, SARS coronavirus
cugucaagaucca

SEQ ID NO: 4052079 - RNA, 12 nt, SARS coronavirus
cuguggcuacau

SEQ ID NO: 4052080 - RNA, 15 nt, SARS coronavirus
cuguuuggaacuuua

SEQ ID NO: 4052081 - RNA, 24 nt, SARS coronavirus
cuuacaguguugccaccucugcuc

SEQ ID NO: 4052082 - RNA, 18 nt, SARS coronavirus
cuuauggauuuguuuaug

SEQ ID NO: 4052083 - RNA, 23 nt, SARS coronavirus
cuucugguuuuaacacuuugaaa

SEQ ID NO: 4052084 - RNA, 20 nt, SARS coronavirus
cuucuuaggagaaugacaaa

SEQ ID NO: 4052085 - RNA, 19 nt, SARS coronavirus
cuucuucaaagagauuuca

SEQ ID NO: 4052086 - RNA, 20 nt, SARS coronavirus
cuucuucaaagagauuucaa

SEQ ID NO: 4052087 - RNA, 14 nt, SARS coronavirus
cuugaaagagccac

SEQ ID NO: 4052088 - RNA, 15 nt, SARS coronavirus
cuugacucauucaaa

SEQ ID NO: 4052089 - RNA, 20 nt, SARS coronavirus
cuugauauauuuucuacaau

SEQ ID NO: 4052090 - RNA, 20 nt, SARS coronavirus
cuugcuagucacacuagcca

SEQ ID NO: 4052091 - RNA, 18 nt, SARS coronavirus
cuugcuuuguugcaugac

SEQ ID NO: 4052092 - RNA, 15 nt, SARS coronavirus
cuuggcgacauuuca

SEQ ID NO: 4052093 - RNA, 16 nt, SARS coronavirus
cuuguaagguacaaca

SEQ ID NO: 4052094 - RNA, 22 nt, SARS coronavirus
cuuguaccaaagucuaaacgaa

SEQ ID NO: 4052095 - RNA, 15 nt, SARS coronavirus
cuuguauuucucuau

SEQ ID NO: 4052096 - RNA, 22 nt, SARS coronavirus
cuugucauuggugcugugauca

SEQ ID NO: 4052097 - RNA, 14 nt, SARS coronavirus
cuuuaaucaaugug

SEQ ID NO: 4052098 - RNA, 23 nt, SARS coronavirus
cuuuguaagcacaagaaagugag

SEQ ID NO: 4052099 - RNA, 22 nt, SARS coronavirus
cugauguuucuacagcaauuca

SEQ ID NO: 4052100 - RNA, 13 nt, SARS coronavirus
cugcaaguacugu

SEQ ID NO: 4052101 - RNA, 21 nt, SARS coronavirus
cugcaaguacuguucaugcua

SEQ ID NO: 4052102 - RNA, 23 nt, SARS coronavirus
cugccaccgugcuacaacuuccu

SEQ ID NO: 4052103 - RNA, 17 nt, Sin Nombre virus
aacaaaacuaccucauu

SEQ ID NO: 4052104 - RNA, 16 nt, Sin Nombre virus
aacaaucuaccucauu

SEQ ID NO: 4052105 - RNA, 15 nt, Sin Nombre virus
aaugcuaagucuaua

SEQ ID NO: 4052106 - RNA, 16 nt, Sin Nombre virus
aauuuuuauuuuuaua

SEQ ID NO: 4052107 - RNA, 23 nt, Sin Nombre virus
acuaaucaggguuuauugcacua

SEQ ID NO: 4052108 - RNA, 23 nt, Sin Nombre virus
acuaggguggguucaagggccaa

SEQ ID NO: 4052109 - RNA, 20 nt, Sin Nombre virus
acugcucuguucucggagca

SEQ ID NO: 4052110 - RNA, 21 nt, Sin Nombre virus
acuuguucucucuacugcucu

SEQ ID NO: 4052111 - RNA, 22 nt, Sin Nombre virus
acuuguucucucuacugcucug

SEQ ID NO: 4052112 - RNA, 23 nt, Sin Nombre virus
acuuguucucucuacugcucugu

SEQ ID NO: 4052113 - RNA, 14 nt, Sin Nombre virus
agcuuauuaaaucu

SEQ ID NO: 4052114 - RNA, 15 nt, Sin Nombre virus
aguguuauuguagua

SEQ ID NO: 4052115 - RNA, 20 nt, Sin Nombre virus
auauaaucccauuugcuuau

SEQ ID NO: 4052116 - RNA, 16 nt, Sin Nombre virus
auaucaauaacauuug

SEQ ID NO: 4052117 - RNA, 13 nt, Sin Nombre virus
augcuaagucuau

SEQ ID NO: 4052118 - RNA, 15 nt, Sin Nombre virus
auuaaguuuuguuaa

SEQ ID NO: 4052119 - RNA, 21 nt, Sin Nombre virus
auuauauucacaucuguauau

SEQ ID NO: 4052120 - RNA, 14 nt, Sin Nombre virus
caauuauaucacag

SEQ ID NO: 4052121 - RNA, 20 nt, Sin Nombre virus
cacuaggguggguucaaggg

SEQ ID NO: 4052122 - RNA, 24 nt, Sin Nombre virus
cauaaccgaaauauuuauacuaau

SEQ ID NO: 4052123 - RNA, 17 nt, Sin Nombre virus
ccagauuauauucacau

SEQ ID NO: 4052124 - RNA, 15 nt, Sin Nombre virus
ccguucaaacuggaa

SEQ ID NO: 4052125 - RNA, 12 nt, Sin Nombre virus
cucggagcauac

SEQ ID NO: 4052126 - RNA, 14 nt, Sin Nombre virus
cucuacugcucugu

SEQ ID NO: 4052127 - RNA, 20 nt, Sin Nombre virus
cucuguucucggagcauacu

SEQ ID NO: 4052128 - RNA, 12 nt, Sin Nombre virus
cugcucuguucu

SEQ ID NO: 4052129 - RNA, 17 nt, Sin Nombre virus
cuuaacaccuauauaau

SEQ ID NO: 4052130 - RNA, 16 nt, Sin Nombre virus
cuuauuacgaggcuuu

SEQ ID NO: 4052131 - RNA, 16 nt, Sin Nombre virus
gcucuguucucggagc

SEQ ID NO: 4052132 - RNA, 17 nt, Sin Nombre virus
gcucuguucucggagca

SEQ ID NO: 4052133 - RNA, 20 nt, Sin Nombre virus
guaaauucuugauugcuuuu

SEQ ID NO: 4052134 - RNA, 16 nt, Sin Nombre virus
guuaaguuuuguuaag

SEQ ID NO: 4052135 - RNA, 21 nt, Sin Nombre virus
guucaagggccaauuauauca

SEQ ID NO: 4052136 - RNA, 15 nt, Sin Nombre virus
guuuuguuaaguugu

SEQ ID NO: 4052137 - RNA, 15 nt, Sin Nombre virus
uaagcuuauuaaauc

SEQ ID NO: 4052138 - RNA, 14 nt, Sin Nombre virus
uacugcucuguucu

SEQ ID NO: 4052139 - RNA, 21 nt, Sin Nombre virus
uacugcucuguucucggagca

SEQ ID NO: 4052140 - RNA, 14 nt, Sin Nombre virus
uaguguuaagucau

SEQ ID NO: 4052141 - RNA, 15 nt, Sin Nombre virus
uauuccaaaccauga

SEQ ID NO: 4052142 - RNA, 18 nt, Sin Nombre virus
ucuauauuguuuaguguu

SEQ ID NO: 4052143 - RNA, 17 nt, Sin Nombre virus
ugauaguauuaagucau

SEQ ID NO: 4052144 - RNA, 13 nt, Sin Nombre virus
ugcuuuucaagga

SEQ ID NO: 4052145 - RNA, 22 nt, Sin Nombre virus
uguaugggggguguuuaguguu

SEQ ID NO: 4052146 - RNA, 17 nt, Sin Nombre virus
ugugagcaagaguauga

SEQ ID NO: 4052147 - RNA, 21 nt, Sin Nombre virus
uguuaaguuucgguaagucug

SEQ ID NO: 4052148 - RNA, 17 nt, Sin Nombre virus
uucgguaagucuguuaa

SEQ ID NO: 4052149 - RNA, 15 nt, Sin Nombre virus
uucucucuacugcuc

SEQ ID NO: 4052150 - RNA, 16 nt, Sin Nombre virus
uuguuaaguuguauua

SEQ ID NO: 4052151 - RNA, 16 nt, Sin Nombre virus
aaccaugacuuguucu

SEQ ID NO: 4052152 - RNA, 18 nt, Sin Nombre virus
aaccaugacuuguucucu

SEQ ID NO: 4052153 - RNA, 18 nt, Sin Nombre virus
aauaagauuuauauacau

SEQ ID NO: 4052154 - RNA, 14 nt, Sin Nombre virus
aaucaggguuuaua

SEQ ID NO: 4052155 - RNA, 20 nt, Sin Nombre virus
aauuuuuauuuuuauacaag

SEQ ID NO: 4052156 - RNA, 18 nt, Sin Nombre virus
acaaaacuaccucauuau

SEQ ID NO: 4052157 - RNA, 18 nt, Sin Nombre virus
acauagauuuauuuuaua

SEQ ID NO: 4052158 - RNA, 17 nt, Sin Nombre virus
acauuuguauauuccca

SEQ ID NO: 4052159 - RNA, 23 nt, Sin Nombre virus
acuaacacugugacucuguaaag

SEQ ID NO: 4052160 - RNA, 13 nt, Sin Nombre virus
acugcucuguucu

SEQ ID NO: 4052161 - RNA, 15 nt, Sin Nombre virus
acugcucuguucucg

SEQ ID NO: 4052162 - RNA, 17 nt, Sin Nombre virus
acugugacucuguaaag

SEQ ID NO: 4052163 - RNA, 17 nt, Sin Nombre virus
acuuguucucucuacug

SEQ ID NO: 4052164 - RNA, 21 nt, Sin Nombre virus
agauuauauucacaucuguau

SEQ ID NO: 4052165 - RNA, 21 nt, Sin Nombre virus
agcuaaaaaaaacaaauccuu

SEQ ID NO: 4052166 - RNA, 19 nt, Sin Nombre virus
aguauuaagucauauguau

SEQ ID NO: 4052167 - RNA, 16 nt, Sin Nombre virus
aaaccaugacuuguuc

SEQ ID NO: 4052168 - RNA, 19 nt, Sin Nombre virus
aaucaaaauaagauuuaua

SEQ ID NO: 4052169 - RNA, 19 nt, Sin Nombre virus
aauugauuucuucauuaca

SEQ ID NO: 4052170 - RNA, 17 nt, Sin Nombre virus
aucuugauaguauuaag

SEQ ID NO: 4052171 - RNA, 23 nt, Sin Nombre virus
aucuugauaguauuaagucauau

SEQ ID NO: 4052172 - RNA, 14 nt, Sin Nombre virus
augacuuguucucu

SEQ ID NO: 4052173 - RNA, 15 nt, Sin Nombre virus
auuaaaucuuguuaa

SEQ ID NO: 4052174 - RNA, 15 nt, Sin Nombre virus
auuccaaaccaugac

SEQ ID NO: 4052175 - RNA, 16 nt, Sin Nombre virus
auuuuaucaacucauu

SEQ ID NO: 4052176 - RNA, 20 nt, Sin Nombre virus
auuuuuauuuuuauacaagu

SEQ ID NO: 4052177 - RNA, 14 nt, Sin Nombre virus
caaaacuaccucau

SEQ ID NO: 4052178 - RNA, 22 nt, Sin Nombre virus
caauuuucuuuauuccaaacca

SEQ ID NO: 4052179 - RNA, 22 nt, Sin Nombre virus
caggucuaucccuauauuggaa

SEQ ID NO: 4052180 - RNA, 18 nt, Sin Nombre virus
caucauuaaucaggguuu

SEQ ID NO: 4052181 - RNA, 18 nt, Sin Nombre virus
caucuguauauauggaug

SEQ ID NO: 4052182 - RNA, 23 nt, Sin Nombre virus
caugacuuguucucucuacugcu

SEQ ID NO: 4052183 - RNA, 10 nt, Sin Nombre virus
cauuaacagc

SEQ ID NO: 4052184 - RNA, 22 nt, Sin Nombre virus
cauuaaucaggguuuauaaaau

SEQ ID NO: 4052185 - RNA, 15 nt, Sin Nombre virus
ccaaaccaugacuug

SEQ ID NO: 4052186 - RNA, 19 nt, Sin Nombre virus
cugcucuguucucggagca

SEQ ID NO: 4052187 - RNA, 20 nt, Sin Nombre virus
gcuuauuaaaucuuguuaag

SEQ ID NO: 4052188 - RNA, 14 nt, Sin Nombre virus
ggcacuaaucaggg

SEQ ID NO: 4052189 - RNA, 17 nt, Sin Nombre virus
ggcacuaaucaggguuu

SEQ ID NO: 4052190 - RNA, 14 nt, Sin Nombre virus
uaaaucuuguuaag

SEQ ID NO: 4052191 - RNA, 22 nt, Sin Nombre virus
ucuuuauuccaaaccaugacuu

SEQ ID NO: 4052192 - RNA, 21 nt, Sin Nombre virus
uguauauauggauguaaauuu

SEQ ID NO: 4052193 - RNA, 14 nt, Sin Nombre virus
ugugacucuguaaa

SEQ ID NO: 4052194 - RNA, 23 nt, Sin Nombre virus
uuucuuuauuccaaaccaugacu

SEQ ID NO: 4052195 - RNA, 18 nt, Sin Nombre virus
uuuucuuuauuccaaacc

SEQ ID NO: 4052196 - RNA, 20 nt, Sin Nombre virus
uuuuguuaaguuguauuaag

SEQ ID NO: 4052197 - RNA, 11 nt, Sin Nombre virus
aaguuuguuaa

SEQ ID NO: 4052198 - RNA, 14 nt, Sin Nombre virus
aauaguacaugaca

SEQ ID NO: 4052199 - RNA, 23 nt, Sin Nombre virus
aauuauaucacaggguauauaau

SEQ ID NO: 4052200 - RNA, 16 nt, Sin Nombre virus
acaaauccuuaacacc

SEQ ID NO: 4052201 - RNA, 17 nt, Sin Nombre virus
acaacaaucuaccucau

SEQ ID NO: 4052202 - RNA, 14 nt, Sin Nombre virus
acaacauuauuuca

SEQ ID NO: 4052203 - RNA, 13 nt, Sin Nombre virus
accaugacuuguu

SEQ ID NO: 4052204 - RNA, 20 nt, Sin Nombre virus
acuuguucucucuacugcuc

SEQ ID NO: 4052205 - RNA, 17 nt, Sin Nombre virus
auauguauguucuuaua

SEQ ID NO: 4052206 - RNA, 18 nt, Sin Nombre virus
auauucacaucuguauau

SEQ ID NO: 4052207 - RNA, 21 nt, Sin Nombre virus
aucaacuuauauucagggcau

SEQ ID NO: 4052208 - RNA, 21 nt, Sin Nombre virus
auuacgaggcuuuuguuccug

SEQ ID NO: 4052209 - RNA, 20 nt, Sin Nombre virus
auucccauaaccgaaauauu

SEQ ID NO: 4052210 - RNA, 12 nt, Sin Nombre virus
caaaccaugacu

SEQ ID NO: 4052211 - RNA, 22 nt, Sin Nombre virus
caugacuuguucucucuacugc

SEQ ID NO: 4052212 - RNA, 12 nt, Sin Nombre virus
cauuaacagcua

SEQ ID NO: 4052213 - RNA, 23 nt, Sin Nombre virus
ccaaaccaugacuuguucucucu

SEQ ID NO: 4052214 - RNA, 21 nt, Sin Nombre virus
cuauauuguuuaguguuauug

SEQ ID NO: 4052215 - RNA, 21 nt, Sin Nombre virus
cucuacugcucuguucucgga

SEQ ID NO: 4052216 - RNA, 20 nt, Sin Nombre virus
cuuuauuccaaaccaugacu

SEQ ID NO: 4052217 - RNA, 19 nt, Sin Nombre virus
gacacuaaugcuugcuuug

SEQ ID NO: 4052218 - RNA, 15 nt, Sin Nombre virus
gacuuguucucucua

SEQ ID NO: 4052219 - RNA, 23 nt, Sin Nombre virus
gacuuguucucucuacugcucug

SEQ ID NO: 4052220 - RNA, 23 nt, Sin Nombre virus
gcucuguucucggagcauacuac

SEQ ID NO: 4052221 - RNA, 13 nt, Sin Nombre virus
gcuuuuguuccug

SEQ ID NO: 4052222 - RNA, 18 nt, Sin Nombre virus
guaaucaacuuauauuca

SEQ ID NO: 4052223 - RNA, 16 nt, Sin Nombre virus
guuucgguaagucugu

SEQ ID NO: 4052224 - RNA, 15 nt, Sin Nombre virus
uaagucuguuaaaug

SEQ ID NO: 4052225 - RNA, 16 nt, Sin Nombre virus
uaagucuguuaaaugu

SEQ ID NO: 4052226 - RNA, 15 nt, Sin Nombre virus
uauaaguaaauucuu

SEQ ID NO: 4052227 - RNA, 19 nt, Sin Nombre virus
uauauaaucccauuugcuu

SEQ ID NO: 4052228 - RNA, 20 nt, Sin Nombre virus
uauaucaauaacauuuguau

SEQ ID NO: 4052229 - RNA, 13 nt, Sin Nombre virus
uauauuggaagau

SEQ ID NO: 4052230 - RNA, 15 nt, Sin Nombre virus
uccaaaccaugacuu

SEQ ID NO: 4052231 - RNA, 15 nt, Sin Nombre virus
ucuuuauuccaaacc

SEQ ID NO: 4052232 - RNA, 20 nt, Sin Nombre virus
uguuaaauguaguuaaucuu

SEQ ID NO: 4052233 - RNA, 19 nt, Sin Nombre virus
uuaaaucuuguuaaguuug

SEQ ID NO: 4052234 - RNA, 18 nt, Sin Nombre virus
uuaagcuuauuaaaucuu

SEQ ID NO: 4052235 - RNA, 23 nt, Sin Nombre virus
uuaucuguuuaaugcuaagucua

SEQ ID NO: 4052236 - RNA, 21 nt, Sin Nombre virus
uuccaaaccaugacuuguucu

SEQ ID NO: 4052237 - RNA, 16 nt, Sin Nombre virus
uuguaguauuguauua

SEQ ID NO: 4052238 - RNA, 14 nt, Sin Nombre virus
uuguauuaaguuuu

SEQ ID NO: 4052239 - RNA, 17 nt, Sin Nombre virus
uuucauuauauguaugu

SEQ ID NO: 4052240 - RNA, 17 nt, Sin Nombre virus
aguauuguauuauguau

SEQ ID NO: 4052241 - RNA, 13 nt, Sin Nombre virus
aucaacucauuau

SEQ ID NO: 4052242 - RNA, 16 nt, Sin Nombre virus
aucccuauauuggaag

SEQ ID NO: 4052243 - RNA, 13 nt, Sin Nombre virus
auguauguucuua

SEQ ID NO: 4052244 - RNA, 21 nt, Sin Nombre virus
auuaaccguucaaacuggaac

SEQ ID NO: 4052245 - RNA, 14 nt, Sin Nombre virus
auuaagucauaugu

SEQ ID NO: 4052246 - RNA, 16 nt, Sin Nombre virus
caacaaucuaccucau

SEQ ID NO: 4052247 - RNA, 22 nt, Sin Nombre virus
cauagauuuauuuuauauacau

SEQ ID NO: 4052248 - RNA, 14 nt, Sin Nombre virus
cccuauuaccucaa

SEQ ID NO: 4052249 - RNA, 12 nt, Sin Nombre virus
cuauuaccucaa

SEQ ID NO: 4052250 - RNA, 19 nt, Sin Nombre virus
cucucaucauuaaucaggg

SEQ ID NO: 4052251 - RNA, 16 nt, Sin Nombre virus
gaggcuuuuguuccug

SEQ ID NO: 4052252 - RNA, 20 nt, Sin Nombre virus
uaacuaacccauuaacagcu

SEQ ID NO: 4052253 - RNA, 10 nt, Sin Nombre virus
uacugcucug

SEQ ID NO: 4052254 - RNA, 13 nt, Sin Nombre virus
uauauauggaugu

SEQ ID NO: 4052255 - RNA, 17 nt, Sin Nombre virus
uauuaaaucuuguuaag

SEQ ID NO: 4052256 - RNA, 17 nt, Sin Nombre virus
uauuaaguuuuguuaag

SEQ ID NO: 4052257 - RNA, 22 nt, Sin Nombre virus
uauucacaucuguauauaugga

SEQ ID NO: 4052258 - RNA, 13 nt, Sin Nombre virus
ucuacugcucugu

SEQ ID NO: 4052259 - RNA, 13 nt, Sin Nombre virus
ucucuacugcucu

SEQ ID NO: 4052260 - RNA, 14 nt, Sin Nombre virus
ucucuacugcucug

SEQ ID NO: 4052261 - RNA, 17 nt, Sin Nombre virus
ugacuuguucucucuac

SEQ ID NO: 4052262 - RNA, 19 nt, Sin Nombre virus
uuaaguuguauuaaguuuu

SEQ ID NO: 4052263 - RNA, 19 nt, Sin Nombre virus
uuauauucacaucuguaua

SEQ ID NO: 4052264 - RNA, 21 nt, Sin Nombre virus
uuguuaaguuuguuaaguuuu

SEQ ID NO: 4052265 - RNA, 13 nt, Sin Nombre virus
uuuauaaaauuuu

SEQ ID NO: 4052266 - RNA, 22 nt, Sin Nombre virus
uuuauuccaaaccaugacuugu

SEQ ID NO: 4052267 - RNA, 18 nt, Tula virus
acacacgcacauccaaug

SEQ ID NO: 4052268 - RNA, 13 nt, Tula virus
acaguauguguuu

SEQ ID NO: 4052269 - RNA, 22 nt, Tula virus
acucagguaaucugcugcucug

SEQ ID NO: 4052270 - RNA, 15 nt, Tula virus
aguguaaguucauua

SEQ ID NO: 4052271 - RNA, 14 nt, Tula virus
auaucaaacugaac

SEQ ID NO: 4052272 - RNA, 16 nt, Tula virus
aucucuauuuaaacau

SEQ ID NO: 4052273 - RNA, 20 nt, Tula virus
augcaugauuacaauucaca

SEQ ID NO: 4052274 - RNA, 21 nt, Tula virus
auuccuggacuuuuguuccug

SEQ ID NO: 4052275 - RNA, 17 nt, Tula virus
auuuguugcucuuuucu

SEQ ID NO: 4052276 - RNA, 23 nt, Tula virus
caccaaugcaugauuacaauuca

SEQ ID NO: 4052277 - RNA, 15 nt, Tula virus
caguauguguuuaua

SEQ ID NO: 4052278 - RNA, 14 nt, Tula virus
cuauauuaacagua

SEQ ID NO: 4052279 - RNA, 13 nt, Tula virus
cuauuuguugcuc

SEQ ID NO: 4052280 - RNA, 18 nt, Tula virus
cucagacaguuguuuucu

SEQ ID NO: 4052281 - RNA, 12 nt, Tula virus
cugcucuguaug

SEQ ID NO: 4052282 - RNA, 13 nt, Tula virus
cuucaucucuauu

SEQ ID NO: 4052283 - RNA, 13 nt, Tula virus
gcucuuuucucgg

SEQ ID NO: 4052284 - RNA, 12 nt, Tula virus
uaaaauuguaag

SEQ ID NO: 4052285 - RNA, 13 nt, Tula virus
uacaauucacaca

SEQ ID NO: 4052286 - RNA, 15 nt, Tula virus
uaccacuuuacuacu

SEQ ID NO: 4052287 - RNA, 16 nt, Tula virus
uggacuuuuguuccug

SEQ ID NO: 4052288 - RNA, 18 nt, Tula virus
uguuuauaucaaacugaa

SEQ ID NO: 4052289 - RNA, 14 nt, Tula virus
uuccuuaaugcaua

SEQ ID NO: 4052290 - RNA, 19 nt, Tula virus
uugggcacaaaauucacac

SEQ ID NO: 4052291 - RNA, 14 nt, Tula virus
uuuucuucaucucu

SEQ ID NO: 4052292 - RNA, 18 nt, Tula virus
aacuaccacuuuacuacu

SEQ ID NO: 4052293 - RNA, 13 nt, Tula virus
aaugcauauguac

SEQ ID NO: 4052294 - RNA, 18 nt, Tula virus
acuauuuguugcucuuuu

SEQ ID NO: 4052295 - RNA, 14 nt, Tula virus
acugaacuguauag

SEQ ID NO: 4052296 - RNA, 18 nt, Tula virus
acugagcuaucaucucug

SEQ ID NO: 4052297 - RNA, 23 nt, Tula virus
acugagcuaucaucucugucucu

SEQ ID NO: 4052298 - RNA, 22 nt, Tula virus
acuguauagcccucauacuacu

SEQ ID NO: 4052299 - RNA, 16 nt, Tula virus
augauuacaauucaca

SEQ ID NO: 4052300 - RNA, 16 nt, Tula virus
caaaucaaacacauau

SEQ ID NO: 4052301 - RNA, 17 nt, Tula virus
cacugauuggguugggu

SEQ ID NO: 4052302 - RNA, 23 nt, Tula virus
cuauuuguugcucuuuucucgga

SEQ ID NO: 4052303 - RNA, 12 nt, Tula virus
cucggagcauac

SEQ ID NO: 4052304 - RNA, 21 nt, Tula virus
cuuaaugcauauguacuuaua

SEQ ID NO: 4052305 - RNA, 15 nt, Tula virus
gcacauccaaugaua

SEQ ID NO: 4052306 - RNA, 19 nt, Tula virus
guugggcacaaaauucaca

SEQ ID NO: 4052307 - RNA, 22 nt, Tula virus
uaagcugggguagguaaguuua

SEQ ID NO: 4052308 - RNA, 14 nt, Tula virus
uauaagcuggggua

SEQ ID NO: 4052309 - RNA, 21 nt, Tula virus
ugauuacaauucacacauaca

SEQ ID NO: 4052310 - RNA, 12 nt, Tula virus
uuaaacauuucu

SEQ ID NO: 4052311 - RNA, 16 nt, Tula virus
uucuucaucucuauuu

SEQ ID NO: 4052312 - RNA, 13 nt, Tula virus
uugauuauugcac

SEQ ID NO: 4052313 - RNA, 22 nt, Tula virus
uuguaaguccuuguuuggugua

SEQ ID NO: 4052314 - RNA, 19 nt, Tula virus
uuguugcucuuuucucgga

SEQ ID NO: 4052315 - RNA, 14 nt, Tula virus
aaaacuaccacuuu

SEQ ID NO: 4052316 - RNA, 11 nt, Tula virus
aaaucaaacac

SEQ ID NO: 4052317 - RNA, 15 nt, Tula virus
acaccaaugcaugau

SEQ ID NO: 4052318 - RNA, 16 nt, Tula virus
acuacuacucuaccuc

SEQ ID NO: 4052319 - RNA, 22 nt, Tula virus
auagcccucauacuacuuccaa

SEQ ID NO: 4052320 - RNA, 19 nt, Tula virus
augauuacaauucacacau

SEQ ID NO: 4052321 - RNA, 16 nt, Tula virus
auuuguugcucuuuuc

SEQ ID NO: 4052322 - RNA, 22 nt, Tula virus
cacucagguaaucugcugcucu

SEQ ID NO: 4052323 - RNA, 18 nt, Tula virus
cuauuuguugcucuuuuc

SEQ ID NO: 4052324 - RNA, 16 nt, Tula virus
gcacauccaaugauau

SEQ ID NO: 4052325 - RNA, 13 nt, Tula virus
guacgauuccacu

SEQ ID NO: 4052326 - RNA, 18 nt, Tula virus
gucucuuuucuucaucuc

SEQ ID NO: 4052327 - RNA, 13 nt, Tula virus
guugcucuuuucu

SEQ ID NO: 4052328 - RNA, 17 nt, Tula virus
uacuaaucguaagguag

SEQ ID NO: 4052329 - RNA, 19 nt, Tula virus
uauaucuuauauuacuaau

SEQ ID NO: 4052330 - RNA, 13 nt, Tula virus
ucugcugcucugu

SEQ ID NO: 4052331 - RNA, 22 nt, Tula virus
ucuuuucucggagcauacuacu

SEQ ID NO: 4052332 - RNA, 17 nt, Tula virus
ugagcuaucaucucugu

SEQ ID NO: 4052333 - RNA, 22 nt, Tula virus
ugggucaaaucaaacacauaua

SEQ ID NO: 4052334 - RNA, 15 nt, Tula virus
uuaaguuuaaaauug

SEQ ID NO: 4052335 - RNA, 13 nt, Tula virus
uuuguuaaguuua

SEQ ID NO: 4052336 - RNA, 15 nt, Tula virus
auguacuuauaccuu

SEQ ID NO: 4052337 - RNA, 15 nt, Tula virus
auguguuuauaucaa

SEQ ID NO: 4052338 - RNA, 16 nt, Tula virus
auugcacuacagcuug

SEQ ID NO: 4052339 - RNA, 14 nt, Tula virus
caaacugaacugua

SEQ ID NO: 4052340 - RNA, 14 nt, Tula virus
caauucacacauac

SEQ ID NO: 4052341 - RNA, 12 nt, Tula virus
cccaauaaugug

SEQ ID NO: 4052342 - RNA, 11 nt, Tula virus
cggagcauacu

SEQ ID NO: 4052343 - RNA, 22 nt, Tula virus
cuuauauuacuaaucuccuaua

SEQ ID NO: 4052344 - RNA, 23 nt, Tula virus
cuuuacuacuacucuaccucaua

SEQ ID NO: 4052345 - RNA, 22 nt, Tula virus
cuuuuuauuauuccuuaaugca

SEQ ID NO: 4052346 - RNA, 22 nt, Tula virus
gcacaaaauucacaccaaugca

SEQ ID NO: 4052347 - RNA, 23 nt, Tula virus
gcuaucaucucugucucuuuucu

SEQ ID NO: 4052348 - RNA, 16 nt, Tula virus
gcucuuuucucggagc

SEQ ID NO: 4052349 - RNA, 19 nt, Tula virus
guacacuuauauauaugca

SEQ ID NO: 4052350 - RNA, 19 nt, Tula virus
guauuaugucacuagugua

SEQ ID NO: 4052351 - RNA, 13 nt, Tula virus
guugauuauugca

SEQ ID NO: 4052352 - RNA, 19 nt, Tula virus
uacgauuccacuaccucag

SEQ ID NO: 4052353 - RNA, 16 nt, Tula virus
uacuauuuguugcucu

SEQ ID NO: 4052354 - RNA, 19 nt, Tula virus
uaucaaacugaacuguaua

SEQ ID NO: 4052355 - RNA, 15 nt, Tula virus
uaucgaucauuccug

SEQ ID NO: 4052356 - RNA, 13 nt, Tula virus
uaugaauuugaag

SEQ ID NO: 4052357 - RNA, 19 nt, Tula virus
ucacuaguguaaguucauu

SEQ ID NO: 4052358 - RNA, 18 nt, Tula virus
ucauaucgaucauuccug

SEQ ID NO: 4052359 - RNA, 14 nt, Tula virus
ucaucucuauuuaa

SEQ ID NO: 4052360 - RNA, 18 nt, Tula virus
ucgaucauuccuggacuu

SEQ ID NO: 4052361 - RNA, 14 nt, Tula virus
ucuguauguuuauu

SEQ ID NO: 4052362 - RNA, 12 nt, Tula virus
ugcucuuuucuc

SEQ ID NO: 4052363 - RNA, 23 nt, Tula virus
ugugaaacugagcuaucaucucu

SEQ ID NO: 4052364 - RNA, 18 nt, Tula virus
uguugcucuuuucucgga

SEQ ID NO: 4052365 - RNA, 22 nt, Tula virus
uguuuucuugauugcuuuucaa

SEQ ID NO: 4052366 - RNA, 13 nt, Tula virus
uuacaauucacac

SEQ ID NO: 4052367 - RNA, 14 nt, Tula virus
uuauauauaugcac

SEQ ID NO: 4052368 - RNA, 17 nt, Tula virus
uuauaucaaacugaacu

SEQ ID NO: 4052369 - RNA, 21 nt, Tula virus
uucaucucuauuuaaacauuu

SEQ ID NO: 4052370 - RNA, 15 nt, Tula virus
uuuguuaaguuuaaa

SEQ ID NO: 4052371 - RNA, 14 nt, Tula virus
acaaaauucacacc

SEQ ID NO: 4052372 - RNA, 19 nt, Tula virus
acaauucacacauacacug

SEQ ID NO: 4052373 - RNA, 15 nt, Tula virus
acauuucuaccuccg

SEQ ID NO: 4052374 - RNA, 13 nt, Tula virus
acuuuuguuccug

SEQ ID NO: 4052375 - RNA, 19 nt, Tula virus
aguccuuguuugguguaaa

SEQ ID NO: 4052376 - RNA, 22 nt, Tula virus
auaacuuuuuauuauuccuuaa

SEQ ID NO: 4052377 - RNA, 18 nt, Tula virus
aucugcugcucuguaugu

SEQ ID NO: 4052378 - RNA, 20 nt, Tula virus
augaauuugaaggguugggc

SEQ ID NO: 4052379 - RNA, 13 nt, Uukuniemi virus
agaaccuuuucuc

SEQ ID NO: 4052380 - RNA, 22 nt, Uukuniemi virus
aggugcuugcucaauugcagug

SEQ ID NO: 4052381 - RNA, 14 nt, Uukuniemi virus
agugcuccucaagg

SEQ ID NO: 4052382 - RNA, 19 nt, Uukuniemi virus
agugcuccucaagguugac

SEQ ID NO: 4052383 - RNA, 15 nt, Uukuniemi virus
aguugcaaggugcuu

SEQ ID NO: 4052384 - RNA, 23 nt, Uukuniemi virus
caucccauaacgcuuagguucau

SEQ ID NO: 4052385 - RNA, 16 nt, Uukuniemi virus
ccaaacuacagugauc

SEQ ID NO: 4052386 - RNA, 14 nt, Uukuniemi virus
cucaauugcaguga

SEQ ID NO: 4052387 - RNA, 17 nt, Uukuniemi virus
cucaauugcagugaaga

SEQ ID NO: 4052388 - RNA, 14 nt, Uukuniemi virus
gcaaggugcuugcu

SEQ ID NO: 4052389 - RNA, 13 nt, Uukuniemi virus
ucaaacaugaagu

SEQ ID NO: 4052390 - RNA, 17 nt, Uukuniemi virus
uccagugcuccucaagg

SEQ ID NO: 4052391 - RNA, 16 nt, Uukuniemi virus
ugcaaggugcuugcuc

SEQ ID NO: 4052392 - RNA, 21 nt, Uukuniemi virus
ugcagugaagaaccuuuucuc

SEQ ID NO: 4052393 - RNA, 17 nt, Uukuniemi virus
ugugacuagucuuuucu

SEQ ID NO: 4052394 - RNA, 14 nt, Uukuniemi virus
uuuaauucggccaa

SEQ ID NO: 4052395 - RNA, 21 nt, Uukuniemi virus
aaagggcuucggcccaaacua

SEQ ID NO: 4052396 - RNA, 16 nt, Uukuniemi virus
agaguuggauggacag

SEQ ID NO: 4052397 - RNA, 18 nt, Uukuniemi virus
agcacucucaaaggugau

SEQ ID NO: 4052398 - RNA, 15 nt, Uukuniemi virus
aggugauccagugcu

SEQ ID NO: 4052399 - RNA, 22 nt, Uukuniemi virus
caagaauguggagaaggcacag

SEQ ID NO: 4052400 - RNA, 15 nt, Uukuniemi virus
ccaaacuacagugau

SEQ ID NO: 4052401 - RNA, 15 nt, Uukuniemi virus
cucaauugcagugaa

SEQ ID NO: 4052402 - RNA, 21 nt, Uukuniemi virus
gaaccuuuucucugcaauggu

SEQ ID NO: 4052403 - RNA, 16 nt, Uukuniemi virus
uccagcagucgcuccc

SEQ ID NO: 4052404 - RNA, 22 nt, Uukuniemi virus
ucgcucccuagcacucucaaag

SEQ ID NO: 4052405 - RNA, 12 nt, Uukuniemi virus
ucugcccaguga

SEQ ID NO: 4052406 - RNA, 16 nt, Uukuniemi virus
ugauccagugcuccuc

SEQ ID NO: 4052407 - RNA, 19 nt, Uukuniemi virus
ugauccuacgacuggccaa

SEQ ID NO: 4052408 - RNA, 23 nt, Uukuniemi virus
aacgcuuagguucauaguugcaa

SEQ ID NO: 4052409 - RNA, 19 nt, Uukuniemi virus
acuggccaauccuugguga

SEQ ID NO: 4052410 - RNA, 14 nt, Uukuniemi virus
agcacucucaaagg

SEQ ID NO: 4052411 - RNA, 11 nt, Uukuniemi virus
auccagugcuc

SEQ ID NO: 4052412 - RNA, 16 nt, Uukuniemi virus
caaacaugaaguucau

SEQ ID NO: 4052413 - RNA, 22 nt, Uukuniemi virus
caaacaugaaguucaugugcuu

SEQ ID NO: 4052414 - RNA, 21 nt, Uukuniemi virus
caauccuuggugaauguggug

SEQ ID NO: 4052415 - RNA, 14 nt, Uukuniemi virus
cagauucugcccag

SEQ ID NO: 4052416 - RNA, 15 nt, Uukuniemi virus
cccaaacuacaguga

SEQ ID NO: 4052417 - RNA, 20 nt, Uukuniemi virus
cucccuagcacucucaaagg

SEQ ID NO: 4052418 - RNA, 17 nt, Uukuniemi virus
gaaguucaugugcuucu

SEQ ID NO: 4052419 - RNA, 20 nt, Uukuniemi virus
uaaaagggcuucggcccaaa

SEQ ID NO: 4052420 - RNA, 14 nt, Uukuniemi virus
ucugcaaugguccc

SEQ ID NO: 4052421 - RNA, 13 nt, Uukuniemi virus
ugcccagugaccu

SEQ ID NO: 4052422 - RNA, 18 nt, Uukuniemi virus
uucaccagauucugccca

SEQ ID NO: 4052423 - RNA, 14 nt, Uukuniemi virus
aacaugaaguucau

SEQ ID NO: 4052424 - RNA, 14 nt, Uukuniemi virus
aaguucaugugcuu

SEQ ID NO: 4052425 - RNA, 21 nt, Uukuniemi virus
acagauccuucaccagauucu

SEQ ID NO: 4052426 - RNA, 13 nt, Uukuniemi virus
acaguaagguucu

SEQ ID NO: 4052427 - RNA, 21 nt, Uukuniemi virus
accagauucugcccagugacc

SEQ ID NO: 4052428 - RNA, 23 nt, Uukuniemi virus
acucucaaaggugauccagugcu

SEQ ID NO: 4052429 - RNA, 13 nt, Uukuniemi virus
aguugcaaggugc

SEQ ID NO: 4052430 - RNA, 14 nt, Uukuniemi virus
augugcuucuucuu

SEQ ID NO: 4052431 - RNA, 11 nt, Uukuniemi virus
auucaaacaug

SEQ ID NO: 4052432 - RNA, 22 nt, Uukuniemi virus
cagugauccuacgacuggccaa

SEQ ID NO: 4052433 - RNA, 13 nt, Uukuniemi virus
cuagucuuuucug

SEQ ID NO: 4052434 - RNA, 19 nt, Uukuniemi virus
cucaaaggugauccagugc

SEQ ID NO: 4052435 - RNA, 21 nt, Uukuniemi virus
cucuaauuggacucuaaaagg

SEQ ID NO: 4052436 - RNA, 21 nt, Uukuniemi virus
cugcaauggucccccuuguga

SEQ ID NO: 4052437 - RNA, 16 nt, Uukuniemi virus
gauucugcccagugac

SEQ ID NO: 4052438 - RNA, 14 nt, Uukuniemi virus
uaauucggccaaau

SEQ ID NO: 4052439 - RNA, 12 nt, Uukuniemi virus
uagucuuuucug

SEQ ID NO: 4052440 - RNA, 15 nt, Uukuniemi virus
ugauccagugcuccu

SEQ ID NO: 4052441 - RNA, 21 nt, Uukuniemi virus
uggacaguaagguucuuccga

SEQ ID NO: 4052442 - RNA, 13 nt, Vaccinia virus
aaaaaaauuaaua

SEQ ID NO: 4052443 - RNA, 20 nt, Vaccinia virus
aaaaaaggagcagacccuaa

SEQ ID NO: 4052444 - RNA, 11 nt, Vaccinia virus
aaaaaaugauc

SEQ ID NO: 4052445 - RNA, 13 nt, Vaccinia virus
aaaaaauuauacu

SEQ ID NO: 4052446 - RNA, 12 nt, Vaccinia virus
aaaaaauuccca

SEQ ID NO: 4052447 - RNA, 15 nt, Vaccinia virus
aaaaacgaggauauu

SEQ ID NO: 4052448 - RNA, 17 nt, Vaccinia virus
aaaaacuacuaugcucu

SEQ ID NO: 4052449 - RNA, 14 nt, Vaccinia virus
aaaaagaauguaua

SEQ ID NO: 4052450 - RNA, 23 nt, Vaccinia virus
aaaaagaguuucaaaaauauuca

SEQ ID NO: 4052451 - RNA, 21 nt, Vaccinia virus
aaaaagauuccuauuuacaaa

SEQ ID NO: 4052452 - RNA, 20 nt, Vaccinia virus
aaaaagcucuauauuacaaa

SEQ ID NO: 4052453 - RNA, 13 nt, Vaccinia virus
aaaaaggaaucua

SEQ ID NO: 4052454 - RNA, 22 nt, Vaccinia virus
aaaaauacaugggaaaugauau

SEQ ID NO: 4052455 - RNA, 23 nt, Vaccinia virus
aaaaauacaugggaaaugauauc

SEQ ID NO: 4052456 - RNA, 19 nt, Vaccinia virus
aaaaauauuuuuauucucu

SEQ ID NO: 4052457 - RNA, 17 nt, Vaccinia virus
aaaaauccuuaaugaua

SEQ ID NO: 4052458 - RNA, 15 nt, Vaccinia virus
aaaaaucgauuuuau

SEQ ID NO: 4052459 - RNA, 18 nt, Vaccinia virus
aaaaauguuaauuuugaa

SEQ ID NO: 4052460 - RNA, 16 nt, Vaccinia virus
aaaaauuauccuauca

SEQ ID NO: 4052461 - RNA, 21 nt, Vaccinia virus
aaaaauugaauugaugauaua

SEQ ID NO: 4052462 - RNA, 15 nt, Vaccinia virus
aaaacaauaaauauu

SEQ ID NO: 4052463 - RNA, 22 nt, Vaccinia virus
aaaacauauaaaucuaaaauug

SEQ ID NO: 4052464 - RNA, 19 nt, Vaccinia virus
aaaacauauauaauaaaua

SEQ ID NO: 4052465 - RNA, 18 nt, Vaccinia virus
aaaacauggauuugguaa

SEQ ID NO: 4052466 - RNA, 15 nt, Vaccinia virus
aaaaccaaggacuuu

SEQ ID NO: 4052467 - RNA, 15 nt, Vaccinia virus
aaaaccguuaaaaug

SEQ ID NO: 4052468 - RNA, 13 nt, Vaccinia virus
aaaacuacuacaa

SEQ ID NO: 4052469 - RNA, 20 nt, Vaccinia virus
aaaacuauaugucuguagaa

SEQ ID NO: 4052470 - RNA, 18 nt, Vaccinia virus
aaaacugcguuguaucau

SEQ ID NO: 4052471 - RNA, 21 nt, Vaccinia virus
aaaagaaaaacagaacaauau

SEQ ID NO: 4052472 - RNA, 22 nt, Vaccinia virus
aaaagacaaauauauguggugu

SEQ ID NO: 4052473 - RNA, 13 nt, Vaccinia virus
aaaagacaugaua

SEQ ID NO: 4052474 - RNA, 20 nt, Vaccinia virus
aaaagacggaggauuuccau

SEQ ID NO: 4052475 - RNA, 14 nt, Vaccinia virus
aaaagaucauacaa

SEQ ID NO: 4052476 - RNA, 15 nt, Vaccinia virus
aaaagccccaauuua

SEQ ID NO: 4052477 - RNA, 16 nt, Vaccinia virus
aaaaguaagauauuau

SEQ ID NO: 4052478 - RNA, 15 nt, Vaccinia virus
aaaaguacagaauua

SEQ ID NO: 4052479 - RNA, 19 nt, Vaccinia virus
aaaaguacucaaucuguac

SEQ ID NO: 4052480 - RNA, 14 nt, Vaccinia virus
aaaaguaggaauua

SEQ ID NO: 4052481 - RNA, 13 nt, Vaccinia virus
aaaaguucauaau

SEQ ID NO: 4052482 - RNA, 22 nt, Vaccinia virus
aaaaguuuuccaucuauguaga

SEQ ID NO: 4052483 - RNA, 13 nt, Vaccinia virus
aaaauaaaaaacc

SEQ ID NO: 4052484 - RNA, 18 nt, Vaccinia virus
aaaauaaacacauagaaa

SEQ ID NO: 4052485 - RNA, 13 nt, Vaccinia virus
aaaauaauaucua

SEQ ID NO: 4052486 - RNA, 14 nt, Vaccinia virus
aaaauaauuuccaa

SEQ ID NO: 4052487 - RNA, 16 nt, Vaccinia virus
aaaauacgaauaauca

SEQ ID NO: 4052488 - RNA, 17 nt, Vaccinia virus
aaaauagcgcugaaaau

SEQ ID NO: 4052489 - RNA, 15 nt, Vaccinia virus
aaaauaguucuguaa

SEQ ID NO: 4052490 - RNA, 18 nt, Vaccinia virus
aaaauauacguguacugu

SEQ ID NO: 4052491 - RNA, 14 nt, Vaccinia virus
aaaauauagcauag

SEQ ID NO: 4052492 - RNA, 17 nt, Vaccinia virus
aaaauauaguagaauuu

SEQ ID NO: 4052493 - RNA, 21 nt, Vaccinia virus
aaaauaucacaggagcaaugu

SEQ ID NO: 4052494 - RNA, 13 nt, Vaccinia virus
aaaauauguauaa

SEQ ID NO: 4052495 - RNA, 21 nt, Vaccinia virus
uauagauccuccaguaaauga

SEQ ID NO: 4052496 - RNA, 23 nt, Vaccinia virus
uauagauggaggggauuggcauu

SEQ ID NO: 4052497 - RNA, 19 nt, Vaccinia virus
uauagcauucuuggaugaa

SEQ ID NO: 4052498 - RNA, 20 nt, Vaccinia virus
uauagcugaggguguuagaa

SEQ ID NO: 4052499 - RNA, 17 nt, Vaccinia virus
uauaguagaauuucauu

SEQ ID NO: 4052500 - RNA, 13 nt, Vaccinia virus
uauaguagaugcu

SEQ ID NO: 4052501 - RNA, 20 nt, Vaccinia virus
uauaguucuuaacaucuauu

SEQ ID NO: 4052502 - RNA, 22 nt, Vaccinia virus
uauauaagacacagaaauacua

SEQ ID NO: 4052503 - RNA, 14 nt, Vaccinia virus
uauauaagacguau

SEQ ID NO: 4052504 - RNA, 16 nt, Vaccinia virus
uauauaauaaauacuu

SEQ ID NO: 4052505 - RNA, 22 nt, Vaccinia virus
uauauaauuuuuggacaaaugu

SEQ ID NO: 4052506 - RNA, 16 nt, Vaccinia virus
uauauagcacaaaugu

SEQ ID NO: 4052507 - RNA, 22 nt, Vaccinia virus
uauauagcuauucuucuuuaaa

SEQ ID NO: 4052508 - RNA, 18 nt, Vaccinia virus
uauauagcuuauuccaca

SEQ ID NO: 4052509 - RNA, 14 nt, Vaccinia virus
uauauaguaaugaa

SEQ ID NO: 4052510 - RNA, 11 nt, Vaccinia virus
uauauauacag

SEQ ID NO: 4052511 - RNA, 18 nt, Vaccinia virus
uauauaucagauacaguu

SEQ ID NO: 4052512 - RNA, 14 nt, Vaccinia virus
uauauauuaucaua

SEQ ID NO: 4052513 - RNA, 17 nt, Vaccinia virus
uauaucaaauacaucua

SEQ ID NO: 4052514 - RNA, 23 nt, Vaccinia virus
uauaucacaacaucuauaaaagu

SEQ ID NO: 4052515 - RNA, 17 nt, Vaccinia virus
uauaucaucuacauaau

SEQ ID NO: 4052516 - RNA, 15 nt, Vaccinia virus
uauauccaauaaagc

SEQ ID NO: 4052517 - RNA, 19 nt, Vaccinia virus
uauaucgacauacuacuua

SEQ ID NO: 4052518 - RNA, 22 nt, Vaccinia virus
uauaucuguccaauuaaaugua

SEQ ID NO: 4052519 - RNA, 17 nt, Vaccinia virus
uauaugaaguaaaguau

SEQ ID NO: 4052520 - RNA, 14 nt, Vaccinia virus
uauaugauaucuuu

SEQ ID NO: 4052521 - RNA, 13 nt, Vaccinia virus
uauaugcaucaaa

SEQ ID NO: 4052522 - RNA, 16 nt, Vaccinia virus
uauaugccacguuuau

SEQ ID NO: 4052523 - RNA, 21 nt, Vaccinia virus
uauaugccacguuuauacauu

SEQ ID NO: 4052524 - RNA, 21 nt, Vaccinia virus
uauaugguauagggagaguau

SEQ ID NO: 4052525 - RNA, 20 nt, Vaccinia virus
uauauguaagauguuuagaa

SEQ ID NO: 4052526 - RNA, 13 nt, Vaccinia virus
uauauguauguaa

SEQ ID NO: 4052527 - RNA, 21 nt, Vaccinia virus
uauaugugcgagaauauccuc

SEQ ID NO: 4052528 - RNA, 17 nt, Vaccinia virus
uauauuaaaaaauguca

SEQ ID NO: 4052529 - RNA, 18 nt, Vaccinia virus
uauauuaacucagaagau

SEQ ID NO: 4052530 - RNA, 14 nt, Vaccinia virus
uauauucuaucaua

SEQ ID NO: 4052531 - RNA, 22 nt, Vaccinia virus
uauauucucuaguuacuacgau

SEQ ID NO: 4052532 - RNA, 15 nt, Vaccinia virus
uauauucuuacagua

SEQ ID NO: 4052533 - RNA, 22 nt, Vaccinia virus
uauauugagaguguauccuuga

SEQ ID NO: 4052534 - RNA, 22 nt, Vaccinia virus
uauauugauuuucguaacagau

SEQ ID NO: 4052535 - RNA, 16 nt, Vaccinia virus
uauauuguuaaacuuu

SEQ ID NO: 4052536 - RNA, 14 nt, Vaccinia virus
uauauuuagauguu

SEQ ID NO: 4052537 - RNA, 12 nt, Vaccinia virus
uauauuuccagc

SEQ ID NO: 4052538 - RNA, 16 nt, Vaccinia virus
uauauuuucauuuaaa

SEQ ID NO: 4052539 - RNA, 15 nt, Vaccinia virus
uaucaaacacauaua

SEQ ID NO: 4052540 - RNA, 12 nt, Vaccinia virus
uaucaaaucuuu

SEQ ID NO: 4052541 - RNA, 18 nt, Vaccinia virus
uaucaaauugcauaccua

SEQ ID NO: 4052542 - RNA, 13 nt, Vaccinia virus
uaucaacaucuga

SEQ ID NO: 4052543 - RNA, 17 nt, Vaccinia virus
uaucaacguaacuauau

SEQ ID NO: 4052544 - RNA, 16 nt, Vaccinia virus
uaucaaguuggccauu

SEQ ID NO: 4052545 - RNA, 21 nt, Vaccinia virus
uaucaauaacgcaaucaugau

SEQ ID NO: 4052546 - RNA, 22 nt, Vaccinia virus
uaucaauaagaaaguuaagaau

SEQ ID NO: 4052547 - RNA, 13 nt, Vaccinia virus
uaucaauagcagu

SEQ ID NO: 4052548 - RNA, 22 nt, Vaccinia virus
uaucaaucaaaacagaauauga

SEQ ID NO: 4052549 - RNA, 17 nt, Vaccinia virus
uaucaauccaacaaaug

SEQ ID NO: 4052550 - RNA, 18 nt, Vaccinia virus
uaucaauccaacaaaugc

SEQ ID NO: 4052551 - RNA, 17 nt, Vaccinia virus
uaucaauuaaauaauua

SEQ ID NO: 4052552 - RNA, 14 nt, Vaccinia virus
uaucacuccaugau

SEQ ID NO: 4052553 - RNA, 19 nt, Vaccinia virus
uaucagaccguacauacau

SEQ ID NO: 4052554 - RNA, 18 nt, Vaccinia virus
uaucagaguuacaucaaa

SEQ ID NO: 4052555 - RNA, 20 nt, Vaccinia virus
uaucagucacgauguaggaa

SEQ ID NO: 4052556 - RNA, 21 nt, Vaccinia virus
uaucauaaaagauacaaauau

SEQ ID NO: 4052557 - RNA, 15 nt, Vaccinia virus
uaucauaauuaaauu

SEQ ID NO: 4052558 - RNA, 23 nt, Vaccinia virus
uaucaucauuuugauauuacuua

SEQ ID NO: 4052559 - RNA, 14 nt, Vaccinia virus
uaucauuaaaucua

SEQ ID NO: 4052560 - RNA, 18 nt, Vaccinia virus
uaucauuaauaaagacuu

SEQ ID NO: 4052561 - RNA, 13 nt, Vaccinia virus
uaucauuaaugau

SEQ ID NO: 4052562 - RNA, 21 nt, Vaccinia virus
uaucauuucuacauuguuuau

SEQ ID NO: 4052563 - RNA, 14 nt, Vaccinia virus
uauccaacauaugg

SEQ ID NO: 4052564 - RNA, 18 nt, Vaccinia virus
uauccaacgauuuuuagu

SEQ ID NO: 4052565 - RNA, 14 nt, Vaccinia virus
uauccaagaaaaag

SEQ ID NO: 4052566 - RNA, 14 nt, Vaccinia virus
uauccaccuuauuu

SEQ ID NO: 4052567 - RNA, 21 nt, Vaccinia virus
uauccgcacaugcagaagaac

SEQ ID NO: 4052568 - RNA, 21 nt, Vaccinia virus
uauccggagacgucaucuguu

SEQ ID NO: 4052569 - RNA, 17 nt, Vaccinia virus
uauccuauauacgaaaa

SEQ ID NO: 4052570 - RNA, 19 nt, Vaccinia virus
uauccucguuuuguuuucu

SEQ ID NO: 4052571 - RNA, 15 nt, Vaccinia virus
uaucgauaauuauuu

SEQ ID NO: 4052572 - RNA, 15 nt, Vaccinia virus
uaucgauguggagau

SEQ ID NO: 4052573 - RNA, 21 nt, Vaccinia virus
uaucgcauuuucuaacgugau

SEQ ID NO: 4052574 - RNA, 15 nt, Vaccinia virus
uaucguaucauuaaa

SEQ ID NO: 4052575 - RNA, 15 nt, Vaccinia virus
uaucguaucugucaa

SEQ ID NO: 4052576 - RNA, 19 nt, Vaccinia virus
uaucuacauauuuaccaaa

SEQ ID NO: 4052577 - RNA, 20 nt, Vaccinia virus
uaucuacgauuuuuacaaaa

SEQ ID NO: 4052578 - RNA, 13 nt, Vaccinia virus
uaucuauacauac

SEQ ID NO: 4052579 - RNA, 19 nt, Vaccinia virus
uaucuauaucauccaugua

SEQ ID NO: 4052580 - RNA, 17 nt, Vaccinia virus
uaucuaugcuuacugua

SEQ ID NO: 4052581 - RNA, 20 nt, Vaccinia virus
uaucuauuuuaacaaagcau

SEQ ID NO: 4052582 - RNA, 17 nt, Vaccinia virus
uaucucaauaguuucau

SEQ ID NO: 4052583 - RNA, 18 nt, Vaccinia virus
uaucucagugcaaagauu

SEQ ID NO: 4052584 - RNA, 19 nt, Vaccinia virus
uaucucucugauacaauca

SEQ ID NO: 4052585 - RNA, 20 nt, Vaccinia virus
uaucugaguauaguguucau

SEQ ID NO: 4052586 - RNA, 13 nt, Vaccinia virus
uaucuguuuccau

SEQ ID NO: 4052587 - RNA, 16 nt, Vaccinia virus
uaucuuaucgaaugau

SEQ ID NO: 4052588 - RNA, 12 nt, Vaccinia virus
uaucuucauaga

SEQ ID NO: 4052589 - RNA, 17 nt, Vaccinia virus
uaucuuccgucaaggau

SEQ ID NO: 4052590 - RNA, 16 nt, Vaccinia virus
uaucuuguacguauau

SEQ ID NO: 4052591 - RNA, 18 nt, Vaccinia virus
uaugaaacgaacacuauu

SEQ ID NO: 4052592 - RNA, 21 nt, Vaccinia virus
uuaaauaucaaccgcaaauca

SEQ ID NO: 4052593 - RNA, 13 nt, Vaccinia virus
uuaaauauguucu

SEQ ID NO: 4052594 - RNA, 18 nt, Vaccinia virus
uuaaaucaagucuagaau

SEQ ID NO: 4052595 - RNA, 13 nt, Vaccinia virus
uuaaaucauuacu

SEQ ID NO: 4052596 - RNA, 22 nt, Vaccinia virus
uuaaaucuaacgagaauauguu

SEQ ID NO: 4052597 - RNA, 17 nt, Vaccinia virus
uuaaaugaugaaacuaa

SEQ ID NO: 4052598 - RNA, 20 nt, Vaccinia virus
uuaaauuucaguuuauguuu

SEQ ID NO: 4052599 - RNA, 21 nt, Vaccinia virus
uuaacaauauauuauuaguuu

SEQ ID NO: 4052600 - RNA, 13 nt, Vaccinia virus
uuaacaauuauca

SEQ ID NO: 4052601 - RNA, 20 nt, Vaccinia virus
uuaacaccuccacaguuuuu

SEQ ID NO: 4052602 - RNA, 16 nt, Vaccinia virus
uuaacacucucugcca

SEQ ID NO: 4052603 - RNA, 19 nt, Vaccinia virus
uuaacaucucuucauuaau

SEQ ID NO: 4052604 - RNA, 20 nt, Vaccinia virus
uuaacaucuuuuuauaucug

SEQ ID NO: 4052605 - RNA, 20 nt, Vaccinia virus
uuaacauuuuggcaaauuga

SEQ ID NO: 4052606 - RNA, 17 nt, Vaccinia virus
uuaaccuaacuaaaaga

SEQ ID NO: 4052607 - RNA, 15 nt, Vaccinia virus
uuaacggcuauucaa

SEQ ID NO: 4052608 - RNA, 22 nt, Vaccinia virus
uuaacguaucgcauuaauacug

SEQ ID NO: 4052609 - RNA, 22 nt, Vaccinia virus
uuaagagauccgauaaacauug

SEQ ID NO: 4052610 - RNA, 14 nt, Vaccinia virus
uuaagaucuaauau

SEQ ID NO: 4052611 - RNA, 18 nt, Vaccinia virus
uuaagcauauccugaaua

SEQ ID NO: 4052612 - RNA, 23 nt, Vaccinia virus
uuaagcuguucaaaauauagcau

SEQ ID NO: 4052613 - RNA, 19 nt, Vaccinia virus
uuaaguagaucaucugaaa

SEQ ID NO: 4052614 - RNA, 21 nt, Vaccinia virus
uuaaguucuggaauauuauua

SEQ ID NO: 4052615 - RNA, 18 nt, Vaccinia virus
uuaauaaauuucuuuuca

SEQ ID NO: 4052616 - RNA, 24 nt, Vaccinia virus
uuaauaauugcggguaucacuguu

SEQ ID NO: 4052617 - RNA, 13 nt, Vaccinia virus
uuaauaauuguua

SEQ ID NO: 4052618 - RNA, 15 nt, Vaccinia virus
uuaauacaaguagua

SEQ ID NO: 4052619 - RNA, 15 nt, Vaccinia virus
uuaauagaacucuuu

SEQ ID NO: 4052620 - RNA, 22 nt, Vaccinia virus
uuaauagauauauuaauacuuu

SEQ ID NO: 4052621 - RNA, 14 nt, Vaccinia virus
uuaauaucaaacaa

SEQ ID NO: 4052622 - RNA, 11 nt, Vaccinia virus
uuaauaucuuu

SEQ ID NO: 4052623 - RNA, 12 nt, Vaccinia virus
uuaauaugagua

SEQ ID NO: 4052624 - RNA, 12 nt, Vaccinia virus
uuaauauguaca

SEQ ID NO: 4052625 - RNA, 17 nt, Vaccinia virus
uuaauauguaugauuca

SEQ ID NO: 4052626 - RNA, 14 nt, Vaccinia virus
uuaauauuacuguu

SEQ ID NO: 4052627 - RNA, 23 nt, Vaccinia virus
uuaauauugauacauacauuaau

SEQ ID NO: 4052628 - RNA, 18 nt, Vaccinia virus
uuaauauugcacaaagaa

SEQ ID NO: 4052629 - RNA, 14 nt, Vaccinia virus
uuaauccaaauaug

SEQ ID NO: 4052630 - RNA, 16 nt, Vaccinia virus
uuaauccacuauauau

SEQ ID NO: 4052631 - RNA, 22 nt, Vaccinia virus
uuaauccgggugaaauuauucc

SEQ ID NO: 4052632 - RNA, 16 nt, Vaccinia virus
uuaauccuucuagaau

SEQ ID NO: 4052633 - RNA, 12 nt, Vaccinia virus
uuaaugaagauc

SEQ ID NO: 4052634 - RNA, 18 nt, Vaccinia virus
uuaaugaauaucauuaac

SEQ ID NO: 4052635 - RNA, 21 nt, Vaccinia virus
uuaaugacacuaguuaagaac

SEQ ID NO: 4052636 - RNA, 14 nt, Vaccinia virus
uuaauggaaacuau

SEQ ID NO: 4052637 - RNA, 15 nt, Vaccinia virus
uuaauguauaucuuu

SEQ ID NO: 4052638 - RNA, 15 nt, Vaccinia virus
uuaauuaauguaacu

SEQ ID NO: 4052639 - RNA, 11 nt, Vaccinia virus
uuaauuauuca

SEQ ID NO: 4052640 - RNA, 16 nt, Vaccinia virus
uuaauuccauaucuuu

SEQ ID NO: 4052641 - RNA, 15 nt, Vaccinia virus
uuaauuuauuauuga

SEQ ID NO: 4052642 - RNA, 13 nt, Vaccinia virus
uuaauuuguacau

SEQ ID NO: 4052643 - RNA, 19 nt, Vaccinia virus
uuaauuuuagaaauacuua

SEQ ID NO: 4052644 - RNA, 14 nt, Vaccinia virus
uuaauuuuuaguuu

SEQ ID NO: 4052645 - RNA, 17 nt, Vaccinia virus
uuacaaauauucacaag

SEQ ID NO: 4052646 - RNA, 19 nt, Vaccinia virus
uuacaacgccaucaugaau

SEQ ID NO: 4052647 - RNA, 21 nt, Vaccinia virus
uuacaauguagaaauuagaaa

SEQ ID NO: 4052648 - RNA, 23 nt, Vaccinia virus
uuacacacuuuguccguaaaaca

SEQ ID NO: 4052649 - RNA, 17 nt, Vaccinia virus
uuacauaaaugaaaaga

SEQ ID NO: 4052650 - RNA, 19 nt, Vaccinia virus
uuacauugcucguaaaaga

SEQ ID NO: 4052651 - RNA, 12 nt, Vaccinia virus
uuaccaacaaua

SEQ ID NO: 4052652 - RNA, 14 nt, Vaccinia virus
uuaccaacacaaag

SEQ ID NO: 4052653 - RNA, 19 nt, Vaccinia virus
uuaccagaagguguuguaa

SEQ ID NO: 4052654 - RNA, 20 nt, Vaccinia virus
uuaccaucaaaagcauuaau

SEQ ID NO: 4052655 - RNA, 19 nt, Vaccinia virus
uuacccaugcaacugaacg

SEQ ID NO: 4052656 - RNA, 16 nt, Vaccinia virus
uuacccuugucauuau

SEQ ID NO: 4052657 - RNA, 23 nt, Vaccinia virus
uuaccucuucugauaucauuaau

SEQ ID NO: 4052658 - RNA, 18 nt, Vaccinia virus
uuacgaauauauaaaaga

SEQ ID NO: 4052659 - RNA, 19 nt, Vaccinia virus
uuacgacgugcuaaucuag

SEQ ID NO: 4052660 - RNA, 14 nt, Vaccinia virus
uuacgauagacuuu

SEQ ID NO: 4052661 - RNA, 17 nt, Vaccinia virus
uuacgcaaaacauuaua

SEQ ID NO: 4052662 - RNA, 14 nt, Vaccinia virus
uuacguuacacuuu

SEQ ID NO: 4052663 - RNA, 13 nt, Vaccinia virus
uuacuaauggagu

SEQ ID NO: 4052664 - RNA, 15 nt, Vaccinia virus
uuacuagauuaaaaa

SEQ ID NO: 4052665 - RNA, 19 nt, Vaccinia virus
uuacucauuuuuuauaaaa

SEQ ID NO: 4052666 - RNA, 14 nt, Vaccinia virus
uuacugaauuauua

SEQ ID NO: 4052667 - RNA, 14 nt, Vaccinia virus
uuacuuaaaugccu

SEQ ID NO: 4052668 - RNA, 13 nt, Vaccinia virus
uuacuugugguaa

SEQ ID NO: 4052669 - RNA, 23 nt, Vaccinia virus
uuacuuugaaacaggauuuccaa

SEQ ID NO: 4052670 - RNA, 19 nt, Vaccinia virus
uuacuuugaccacauccuu

SEQ ID NO: 4052671 - RNA, 13 nt, Vaccinia virus
uuacuuuuggaau

SEQ ID NO: 4052672 - RNA, 20 nt, Vaccinia virus
uuagaaauuggucuguguua

SEQ ID NO: 4052673 - RNA, 17 nt, Vaccinia virus
uuagaagagucauuaaa

SEQ ID NO: 4052674 - RNA, 20 nt, Vaccinia virus
uuagaauauauguauguaaa

SEQ ID NO: 4052675 - RNA, 21 nt, Vaccinia virus
uuagacaacaagguaccuaua

SEQ ID NO: 4052676 - RNA, 13 nt, Vaccinia virus
uuagacuagauac

SEQ ID NO: 4052677 - RNA, 18 nt, Vaccinia virus
uuagacuguuuguagaau

SEQ ID NO: 4052678 - RNA, 15 nt, Vaccinia virus
uuagagaacauacau

SEQ ID NO: 4052679 - RNA, 17 nt, Vaccinia virus
uuagauacaauggauga

SEQ ID NO: 4052680 - RNA, 13 nt, Vaccinia virus
uuagauauucacg

SEQ ID NO: 4052681 - RNA, 21 nt, Vaccinia virus
uuagaucauuaacucuagaaa

SEQ ID NO: 4052682 - RNA, 17 nt, Vaccinia virus
uuagauccaacauuaau

SEQ ID NO: 4052683 - RNA, 22 nt, Vaccinia virus
uuagaucccggauacuggauau

SEQ ID NO: 4052684 - RNA, 18 nt, Vaccinia virus
uuagaugagaaauuauuc

SEQ ID NO: 4052685 - RNA, 22 nt, Vaccinia virus
uuagauuuauuuuuauaaaguu

SEQ ID NO: 4052686 - RNA, 19 nt, Vaccinia virus
uuagauuuuuuacacuguu

SEQ ID NO: 4052687 - RNA, 17 nt, Vaccinia virus
uuagcaaaauuauuaau

SEQ ID NO: 4052688 - RNA, 12 nt, Vaccinia virus
uuagcaauuuuc

SEQ ID NO: 4052689 - RNA, 15 nt, Vaccinia virus
uuagcaucugauuuu

SEQ ID NO: 4052690 - RNA, 16 nt, Vaccinia virus
uuagcguacacauuuu

SEQ ID NO: 4052691 - RNA, 22 nt, Vaccinia virus
uuaguaagugccacaaaacaga

SEQ ID NO: 4052692 - RNA, 15 nt, Vaccinia virus
uuaguaggcaucuuu

SEQ ID NO: 4052693 - RNA, 16 nt, Vaccinia virus
uuaguauaauuauuga

SEQ ID NO: 4052694 - RNA, 20 nt, Vaccinia virus
uuaguaucuagcucuguaaa

SEQ ID NO: 4052695 - RNA, 17 nt, Vaccinia virus
uuagucaaucuuauuca

SEQ ID NO: 4052696 - RNA, 21 nt, Vaccinia virus
uuaguccugcguuagauguua

SEQ ID NO: 4052697 - RNA, 17 nt, Vaccinia virus
uuagucgucucaaagag

SEQ ID NO: 4052698 - RNA, 15 nt, Vaccinia virus
uuagucuauuaucca

SEQ ID NO: 4052699 - RNA, 14 nt, Vaccinia virus
uuagugaaaucuuu

SEQ ID NO: 4052700 - RNA, 22 nt, Vaccinia virus
aaauauugaacuaguaguacgu

SEQ ID NO: 4052701 - RNA, 18 nt, Vaccinia virus
aaauauuuaacucaugau

SEQ ID NO: 4052702 - RNA, 20 nt, Vaccinia virus
aaauauuucauuagauguua

SEQ ID NO: 4052703 - RNA, 21 nt, Vaccinia virus
aaaucauaauaugagauguuu

SEQ ID NO: 4052704 - RNA, 19 nt, Vaccinia virus
aaaucauccguuguuauau

SEQ ID NO: 4052705 - RNA, 23 nt, Vaccinia virus
aaaucauccguuguuauauaccg

SEQ ID NO: 4052706 - RNA, 16 nt, Vaccinia virus
aaaucauuaaaaagau

SEQ ID NO: 4052707 - RNA, 22 nt, Vaccinia virus
aaaucauuagugacggaaaauc

SEQ ID NO: 4052708 - RNA, 13 nt, Vaccinia virus
aaauccaaacauu

SEQ ID NO: 4052709 - RNA, 24 nt, Vaccinia virus
aaauccaaauugcgacacuauuca

SEQ ID NO: 4052710 - RNA, 17 nt, Vaccinia virus
aaauccuccaucacuuc

SEQ ID NO: 4052711 - RNA, 17 nt, Vaccinia virus
aaaucguauaaaguuau

SEQ ID NO: 4052712 - RNA, 14 nt, Vaccinia virus
aaaucguguugugu

SEQ ID NO: 4052713 - RNA, 13 nt, Vaccinia virus
aaaucuaacuucu

SEQ ID NO: 4052714 - RNA, 23 nt, Vaccinia virus
aaaucuaucuuuagcuucugaaa

SEQ ID NO: 4052715 - RNA, 19 nt, Vaccinia virus
aaaugaaccucuggaauua

SEQ ID NO: 4052716 - RNA, 21 nt, Vaccinia virus
aaaugaacuuuuacagaucua

SEQ ID NO: 4052717 - RNA, 23 nt, Vaccinia virus
aaaugacuaauuuuguagcauua

SEQ ID NO: 4052718 - RNA, 18 nt, Vaccinia virus
aaaugauaucuuagaaua

SEQ ID NO: 4052719 - RNA, 19 nt, Vaccinia virus
aaaugaugcugguuauuau

SEQ ID NO: 4052720 - RNA, 23 nt, Vaccinia virus
aaaugaugcugguuauuauacau

SEQ ID NO: 4052721 - RNA, 17 nt, Vaccinia virus
uuauauacacauaauua

SEQ ID NO: 4052722 - RNA, 21 nt, Vaccinia virus
uuauauacacauaauuauucu

SEQ ID NO: 4052723 - RNA, 16 nt, Vaccinia virus
uuauauagauguagug

SEQ ID NO: 4052724 - RNA, 18 nt, Vaccinia virus
uuauaucuaaaaauuaga

SEQ ID NO: 4052725 - RNA, 21 nt, Vaccinia virus
uuauauuaacacauacauuuu

SEQ ID NO: 4052726 - RNA, 11 nt, Vaccinia virus
uuauauuuugu

SEQ ID NO: 4052727 - RNA, 13 nt, Vaccinia virus
uuaucaaaucuag

SEQ ID NO: 4052728 - RNA, 16 nt, Vaccinia virus
uuaucaaauggaugcu

SEQ ID NO: 4052729 - RNA, 21 nt, Vaccinia virus
uuaucagugucguaaauuacg

SEQ ID NO: 4052730 - RNA, 15 nt, Vaccinia virus
uuaucauggagugau

SEQ ID NO: 4052731 - RNA, 12 nt, Vaccinia virus
uuaucauuauua

SEQ ID NO: 4052732 - RNA, 17 nt, Vaccinia virus
uuauccgcuaaaaauuu

SEQ ID NO: 4052733 - RNA, 15 nt, Vaccinia virus
uuauccuaucaugua

SEQ ID NO: 4052734 - RNA, 17 nt, Vaccinia virus
uuaucgauauugaagau

SEQ ID NO: 4052735 - RNA, 14 nt, Vaccinia virus
uuaucuaacucuuu

SEQ ID NO: 4052736 - RNA, 22 nt, Vaccinia virus
uuaucuauaucaucuacauaau

SEQ ID NO: 4052737 - RNA, 14 nt, Vaccinia virus
uuaucuauuaucca

SEQ ID NO: 4052738 - RNA, 16 nt, Vaccinia virus
uuaucuauuucaaaaa

SEQ ID NO: 4052739 - RNA, 21 nt, Vaccinia virus
uuaucucuauagauaaugacg

SEQ ID NO: 4052740 - RNA, 23 nt, Vaccinia virus
uuaucucuuuccuagauacugua

SEQ ID NO: 4052741 - RNA, 22 nt, Vaccinia virus
uuaugaaaccauacuaauagau

SEQ ID NO: 4052742 - RNA, 14 nt, Vaccinia virus
uuaugagaauagau

SEQ ID NO: 4052743 - RNA, 19 nt, Vaccinia virus
uuaugccguuaucauuaau

SEQ ID NO: 4052744 - RNA, 18 nt, Vaccinia virus
uuauguaaaacaaacuug

SEQ ID NO: 4052745 - RNA, 21 nt, Vaccinia virus
uuauguucgguauaaaaauua

SEQ ID NO: 4052746 - RNA, 22 nt, Vaccinia virus
uuauuaaaguacguaaaucuag

SEQ ID NO: 4052747 - RNA, 13 nt, Vaccinia virus
uuauuaaaguuua

SEQ ID NO: 4052748 - RNA, 13 nt, Vaccinia virus
uuauuaauucucu

SEQ ID NO: 4052749 - RNA, 13 nt, Vaccinia virus
uuauuacauguuu

SEQ ID NO: 4052750 - RNA, 12 nt, Vaccinia virus
uuauuacauucu

SEQ ID NO: 4052751 - RNA, 13 nt, Vaccinia virus
uuauuacuaaaca

SEQ ID NO: 4052752 - RNA, 22 nt, Vaccinia virus
uuauuacuaaacuacgugaaca

SEQ ID NO: 4052753 - RNA, 19 nt, Vaccinia virus
uuauuagucugucuguaga

SEQ ID NO: 4052754 - RNA, 21 nt, Vaccinia virus
uuauuaguuuuuuauuauuga

SEQ ID NO: 4052755 - RNA, 11 nt, Vaccinia virus
uuauuaucuaa

SEQ ID NO: 4052756 - RNA, 14 nt, Vaccinia virus
uuauuaucuguaga

SEQ ID NO: 4052757 - RNA, 22 nt, Vaccinia virus
uuauucaucgucgucuacuauu

SEQ ID NO: 4052758 - RNA, 22 nt, Vaccinia virus
uuauugauacccgucuguuuaa

SEQ ID NO: 4052759 - RNA, 22 nt, Vaccinia virus
uuauugguauuucuuacauaaa

SEQ ID NO: 4052760 - RNA, 12 nt, Vaccinia virus
uuauuuaacaug

SEQ ID NO: 4052761 - RNA, 14 nt, Vaccinia virus
uuauuuaacucuuu

SEQ ID NO: 4052762 - RNA, 12 nt, Vaccinia virus
uuauuuagugua

SEQ ID NO: 4052763 - RNA, 19 nt, Vaccinia virus
uuauuucagaaauuauucg

SEQ ID NO: 4052764 - RNA, 13 nt, Vaccinia virus
uuauuucuaaaau

SEQ ID NO: 4052765 - RNA, 18 nt, Vaccinia virus
uuauuucugaauuauucc

SEQ ID NO: 4052766 - RNA, 15 nt, Vaccinia virus
uuauuucuucugaau

SEQ ID NO: 4052767 - RNA, 13 nt, Vaccinia virus
uuauuuuuggaag

SEQ ID NO: 4052768 - RNA, 21 nt, Vaccinia virus
uuauuuuuugguauaauucua

SEQ ID NO: 4052769 - RNA, 14 nt, Vaccinia virus
uuauuuuuuuggaa

SEQ ID NO: 4052770 - RNA, 21 nt, Vaccinia virus
uucaaauccgaaauugucuga

SEQ ID NO: 4052771 - RNA, 15 nt, Vaccinia virus
uucaagagaauauuc

SEQ ID NO: 4052772 - RNA, 15 nt, Vaccinia virus
uucaauaaaugauuc

SEQ ID NO: 4052773 - RNA, 22 nt, Vaccinia virus
uucaauaauucuauucuaguau

SEQ ID NO: 4052774 - RNA, 21 nt, Vaccinia virus
uucaaucucuaguuuuauuuu

SEQ ID NO: 4052775 - RNA, 16 nt, Vaccinia virus
uucaaucugagauucu

SEQ ID NO: 4052776 - RNA, 22 nt, Vaccinia virus
uucaauggauacugcaucuguu

SEQ ID NO: 4052777 - RNA, 18 nt, Vaccinia virus
uucacaaaacuagacuuu

SEQ ID NO: 4052778 - RNA, 13 nt, Vaccinia virus
uucacaaaauacg

SEQ ID NO: 4052779 - RNA, 18 nt, Vaccinia virus
uucacaauaucaguaucu

SEQ ID NO: 4052780 - RNA, 14 nt, Vaccinia virus
uucacaauucauuc

SEQ ID NO: 4052781 - RNA, 14 nt, Vaccinia virus
uucaccaauaaaaa

SEQ ID NO: 4052782 - RNA, 22 nt, Vaccinia virus
uucaccaucauacucauauaau

SEQ ID NO: 4052783 - RNA, 19 nt, Vaccinia virus
uucacucguuucauaaaga

SEQ ID NO: 4052784 - RNA, 17 nt, Vaccinia virus
uucacuuuaauagauau

SEQ ID NO: 4052785 - RNA, 17 nt, Vaccinia virus
uucagaggaauacagac

SEQ ID NO: 4052786 - RNA, 18 nt, Vaccinia virus
uucagcauuacuugauau

SEQ ID NO: 4052787 - RNA, 19 nt, Vaccinia virus
uucagcgguaaagauaucu

SEQ ID NO: 4052788 - RNA, 20 nt, Vaccinia virus
uucaguaaccaaauacauau

SEQ ID NO: 4052789 - RNA, 19 nt, Vaccinia virus
uucauaaauaaaaacuugg

SEQ ID NO: 4052790 - RNA, 14 nt, Vaccinia virus
uucauaucauucuu

SEQ ID NO: 4052791 - RNA, 14 nt, Vaccinia virus
uucaucaaacauua

SEQ ID NO: 4052792 - RNA, 17 nt, Vaccinia virus
uucauccauuuacaacu

SEQ ID NO: 4052793 - RNA, 19 nt, Vaccinia virus
uucauccguuuccuuauga

SEQ ID NO: 4052794 - RNA, 18 nt, Vaccinia virus
uucaucguaucuagauaa

SEQ ID NO: 4052795 - RNA, 18 nt, Vaccinia virus
uucauguuuauaaaaaug

SEQ ID NO: 4052796 - RNA, 15 nt, Vaccinia virus
uucauuaauaucuuu

SEQ ID NO: 4052797 - RNA, 17 nt, Vaccinia virus
uucauuaauuucugaua

SEQ ID NO: 4052798 - RNA, 15 nt, Vaccinia virus
uucauuacacaucuu

SEQ ID NO: 4052799 - RNA, 15 nt, Vaccinia virus
uucauucguaaaucu

SEQ ID NO: 4052800 - RNA, 11 nt, Vaccinia virus
uucauuucuaa

SEQ ID NO: 4052801 - RNA, 16 nt, Vaccinia virus
uuccaaaaacauauga

SEQ ID NO: 4052802 - RNA, 15 nt, Vaccinia virus
uuccaauagaugucu

SEQ ID NO: 4052803 - RNA, 14 nt, Vaccinia virus
uuccaaucauugau

SEQ ID NO: 4052804 - RNA, 20 nt, Vaccinia virus
uuccaaugauauauuuucca

SEQ ID NO: 4052805 - RNA, 21 nt, Vaccinia virus
uuccacaauacgagucauuau

SEQ ID NO: 4052806 - RNA, 14 nt, Vaccinia virus
uuccagaguguuua

SEQ ID NO: 4052807 - RNA, 15 nt, Vaccinia virus
uuccagaucuguaug

SEQ ID NO: 4052808 - RNA, 20 nt, Vaccinia virus
uuccauacguuuauauucuu

SEQ ID NO: 4052809 - RNA, 14 nt, Vaccinia virus
uuccauauagauau

SEQ ID NO: 4052810 - RNA, 18 nt, Vaccinia virus
uuccauccacaauuauug

SEQ ID NO: 4052811 - RNA, 22 nt, Vaccinia virus
uuccaugggacuauauaauuuu

SEQ ID NO: 4052812 - RNA, 23 nt, Vaccinia virus
uucccaaugguuucaucaauaga

SEQ ID NO: 4052813 - RNA, 16 nt, Vaccinia virus
uuccugugacaaaaau

SEQ ID NO: 4052814 - RNA, 16 nt, Vaccinia virus
uuccuuuaucauuaau

SEQ ID NO: 4052815 - RNA, 15 nt, Vaccinia virus
uucgauauucucauu

SEQ ID NO: 4052816 - RNA, 20 nt, Vaccinia virus
uucguugucuuuacacuuuc

SEQ ID NO: 4052817 - RNA, 18 nt, Vaccinia virus
uucguuuaucuuggaaca

SEQ ID NO: 4052818 - RNA, 18 nt, Vaccinia virus
uucuaaaaaaauauuaac

SEQ ID NO: 4052819 - RNA, 12 nt, Vaccinia virus
uucuaauacuau

SEQ ID NO: 4052820 - RNA, 12 nt, Vaccinia virus
uucuacaucuuc

SEQ ID NO: 4052821 - RNA, 13 nt, Vaccinia virus
uucuacauuuuca

SEQ ID NO: 4052822 - RNA, 21 nt, Vaccinia virus
uucuacuacuucauuaaucuu

SEQ ID NO: 4052823 - RNA, 21 nt, Vaccinia virus
uucuacuaugcacauuauucu

SEQ ID NO: 4052824 - RNA, 21 nt, Vaccinia virus
uggauaacgguacucuagaau

SEQ ID NO: 4052825 - RNA, 20 nt, Vaccinia virus
uggauagagauugagauucu

SEQ ID NO: 4052826 - RNA, 17 nt, Vaccinia virus
uggaugauauagaucuu

SEQ ID NO: 4052827 - RNA, 20 nt, Vaccinia virus
uggauggauuauaauugaug

SEQ ID NO: 4052828 - RNA, 15 nt, Vaccinia virus
uggauguacauguau

SEQ ID NO: 4052829 - RNA, 17 nt, Vaccinia virus
uggcaauaaaguuuuua

SEQ ID NO: 4052830 - RNA, 17 nt, Vaccinia virus
uggcauaggaacauuuc

SEQ ID NO: 4052831 - RNA, 14 nt, Vaccinia virus
uggccaaccuuugu

SEQ ID NO: 4052832 - RNA, 19 nt, Vaccinia virus
uggcuagauucaacauuua

SEQ ID NO: 4052833 - RNA, 22 nt, Vaccinia virus
uggcucuugaaaccaagguuuu

SEQ ID NO: 4052834 - RNA, 22 nt, Vaccinia virus
ugggaucaugcauucaaaugga

SEQ ID NO: 4052835 - RNA, 16 nt, Vaccinia virus
ugggucuaguuuucag

SEQ ID NO: 4052836 - RNA, 13 nt, Vaccinia virus
ugggugauggaua

SEQ ID NO: 4052837 - RNA, 10 nt, Vaccinia virus
ugguaaaaug

SEQ ID NO: 4052838 - RNA, 16 nt, Vaccinia virus
ugguaaaguaaaucau

SEQ ID NO: 4052839 - RNA, 22 nt, Vaccinia virus
ugguaacgucaucaucaacaau

SEQ ID NO: 4052840 - RNA, 11 nt, Vaccinia virus
ugguauauaca

SEQ ID NO: 4052841 - RNA, 12 nt, Vaccinia virus
ugguauauacau

SEQ ID NO: 4052842 - RNA, 18 nt, Vaccinia virus
ugguauauccaaaccauc

SEQ ID NO: 4052843 - RNA, 20 nt, Vaccinia virus
ugguauccuggcgaauauua

SEQ ID NO: 4052844 - RNA, 17 nt, Vaccinia virus
uggucauaauagaaugu

SEQ ID NO: 4052845 - RNA, 14 nt, Vaccinia virus
uggucauagaaaau

SEQ ID NO: 4052846 - RNA, 14 nt, Vaccinia virus
uggugaaauuauug

SEQ ID NO: 4052847 - RNA, 19 nt, Vaccinia virus
ugguguauuaaauuccagu

SEQ ID NO: 4052848 - RNA, 22 nt, Vaccinia virus
ugguuccacaauucauuuccau

SEQ ID NO: 4052849 - RNA, 19 nt, Vaccinia virus
uguaaaaaaauuauacugu

SEQ ID NO: 4052850 - RNA, 14 nt, Vaccinia virus
uguaaaauaucuuc

SEQ ID NO: 4052851 - RNA, 20 nt, Vaccinia virus
uguaaaggauaugauauguu

SEQ ID NO: 4052852 - RNA, 12 nt, Vaccinia virus
uguaagaaauaa

SEQ ID NO: 4052853 - RNA, 13 nt, Vaccinia virus
uguaagauacuug

SEQ ID NO: 4052854 - RNA, 20 nt, Vaccinia virus
uguaauacauuuugaacucu

SEQ ID NO: 4052855 - RNA, 14 nt, Vaccinia virus
uguaauaguuucca

SEQ ID NO: 4052856 - RNA, 18 nt, Vaccinia virus
uguaauuuagaauacguu

SEQ ID NO: 4052857 - RNA, 15 nt, Vaccinia virus
uguaauuuagaugug

SEQ ID NO: 4052858 - RNA, 17 nt, Vaccinia virus
uguaauuuuuguuuccg

SEQ ID NO: 4052859 - RNA, 15 nt, Vaccinia virus
uguacaauaugaaca

SEQ ID NO: 4052860 - RNA, 17 nt, Vaccinia virus
uguacauuaauaaauga

SEQ ID NO: 4052861 - RNA, 12 nt, Vaccinia virus
uguaccuauuaa

SEQ ID NO: 4052862 - RNA, 20 nt, Vaccinia virus
uguacuacaaacaggcgaug

SEQ ID NO: 4052863 - RNA, 19 nt, Vaccinia virus
uguagaagguucauauguu

SEQ ID NO: 4052864 - RNA, 18 nt, Vaccinia virus
uguagacaaauauacuuu

SEQ ID NO: 4052865 - RNA, 23 nt, Vaccinia virus
uguagauaauaacuaaaaaucaa

SEQ ID NO: 4052866 - RNA, 13 nt, Vaccinia virus
uguagauaucuuu

SEQ ID NO: 4052867 - RNA, 14 nt, Vaccinia virus
uguaggaaaaagau

SEQ ID NO: 4052868 - RNA, 12 nt, Vaccinia virus
uguaguaguaua

SEQ ID NO: 4052869 - RNA, 15 nt, Vaccinia virus
uguaguauaucuaca

SEQ ID NO: 4052870 - RNA, 21 nt, Vaccinia virus
uguagugucaauuuuaaauga

SEQ ID NO: 4052871 - RNA, 15 nt, Vaccinia virus
uguaguuauugaacu

SEQ ID NO: 4052872 - RNA, 13 nt, Vaccinia virus
uguauaaaaagaa

SEQ ID NO: 4052873 - RNA, 16 nt, Vaccinia virus
uguauaacaaauacag

SEQ ID NO: 4052874 - RNA, 17 nt, Vaccinia virus
uguauaacaaauacaga

SEQ ID NO: 4052875 - RNA, 21 nt, Vaccinia virus
uguauaacaaucguauaucuu

SEQ ID NO: 4052876 - RNA, 22 nt, Vaccinia virus
uguauagaggucagauacuggu

SEQ ID NO: 4052877 - RNA, 23 nt, Vaccinia virus
uguauaugauguuucuguuuuca

SEQ ID NO: 4052878 - RNA, 17 nt, Vaccinia virus
uguaucauauucaacau

SEQ ID NO: 4052879 - RNA, 16 nt, Vaccinia virus
uguauuaaaauacuuu

SEQ ID NO: 4052880 - RNA, 21 nt, Vaccinia virus
uguauuaguuaaauauuaaaa

SEQ ID NO: 4052881 - RNA, 18 nt, Vaccinia virus
uguauuauccaauacaga

SEQ ID NO: 4052882 - RNA, 20 nt, Vaccinia virus
uguauuauucugaauaguga

SEQ ID NO: 4052883 - RNA, 20 nt, Vaccinia virus
ugucaaugaagaguauacag

SEQ ID NO: 4052884 - RNA, 20 nt, Vaccinia virus
ugucaguaguauacaucaug

SEQ ID NO: 4052885 - RNA, 19 nt, Vaccinia virus
uguccauaggauacuuugu

SEQ ID NO: 4052886 - RNA, 18 nt, Vaccinia virus
ugucccaucagcauguag

SEQ ID NO: 4052887 - RNA, 17 nt, Vaccinia virus
ugucggcgacaugauua

SEQ ID NO: 4052888 - RNA, 19 nt, Vaccinia virus
ugucguguuccuguuuccu

SEQ ID NO: 4052889 - RNA, 20 nt, Vaccinia virus
ugucguguuccuguuuccua

SEQ ID NO: 4052890 - RNA, 21 nt, Vaccinia virus
ugucuaaacgaccaucuuuga

SEQ ID NO: 4052891 - RNA, 12 nt, Vaccinia virus
ugucuacauaaa

SEQ ID NO: 4052892 - RNA, 16 nt, Vaccinia virus
ugucuacauaaaucua

SEQ ID NO: 4052893 - RNA, 15 nt, Vaccinia virus
ugucuauuaucuguu

SEQ ID NO: 4052894 - RNA, 22 nt, Vaccinia virus
ugucucgaggcuaaaacacauu

SEQ ID NO: 4052895 - RNA, 22 nt, Vaccinia virus
ugucuggaccaucguuugucau

SEQ ID NO: 4052896 - RNA, 15 nt, Vaccinia virus
ugucuguauauguaa

SEQ ID NO: 4052897 - RNA, 23 nt, Vaccinia virus
ugugaaugguaaagaaugcuguu

SEQ ID NO: 4052898 - RNA, 18 nt, Vaccinia virus
ugugacuguuuucucauc

SEQ ID NO: 4052899 - RNA, 12 nt, Vaccinia virus
ugugauggauuu

SEQ ID NO: 4052900 - RNA, 17 nt, Vaccinia virus
ugugcuuaauguuucca

SEQ ID NO: 4052901 - RNA, 16 nt, Vaccinia virus
uguggaucugaagaag

SEQ ID NO: 4052902 - RNA, 23 nt, Vaccinia virus
ugugucaaagguuaaaccuuuau

SEQ ID NO: 4052903 - RNA, 17 nt, Vaccinia virus
uguguuuacaguaguaa

SEQ ID NO: 4052904 - RNA, 21 nt, Vaccinia virus
uguuaacugacaauugcaaaa

SEQ ID NO: 4052905 - RNA, 12 nt, Vaccinia virus
uguuaauaacug

SEQ ID NO: 4052906 - RNA, 15 nt, Vaccinia virus
uguuaauacaucacu

SEQ ID NO: 4052907 - RNA, 22 nt, Vaccinia virus
uguuacaacuuuaccaaaauua

SEQ ID NO: 4052908 - RNA, 21 nt, Vaccinia virus
uguuauacacggucuagagca

SEQ ID NO: 4052909 - RNA, 15 nt, Vaccinia virus
uguuauauauaaaag

SEQ ID NO: 4052910 - RNA, 16 nt, Vaccinia virus
uguuauauauugucua

SEQ ID NO: 4052911 - RNA, 20 nt, Vaccinia virus
uguuauuguaguauaugaua

SEQ ID NO: 4052912 - RNA, 20 nt, Vaccinia virus
uguucacaaaaauacauaaa

SEQ ID NO: 4052913 - RNA, 22 nt, Vaccinia virus
uguucagauacuauaccguugu

SEQ ID NO: 4052914 - RNA, 19 nt, Vaccinia virus
uguuccaacucgugugcuc

SEQ ID NO: 4052915 - RNA, 17 nt, Vaccinia virus
uguucgauauucucauu

SEQ ID NO: 4052916 - RNA, 16 nt, Vaccinia virus
uguucuacacauguau

SEQ ID NO: 4052917 - RNA, 14 nt, Vaccinia virus
uguugaaaaugaaa

SEQ ID NO: 4052918 - RNA, 14 nt, Vaccinia virus
uguugugaaagagu

SEQ ID NO: 4052919 - RNA, 21 nt, Vaccinia virus
uguuguuuauucaacauguac

SEQ ID NO: 4052920 - RNA, 21 nt, Vaccinia virus
uguuuaacaaagauauuacca

SEQ ID NO: 4052921 - RNA, 12 nt, Vaccinia virus
uguuuaagaaaa

SEQ ID NO: 4052922 - RNA, 11 nt, Vaccinia virus
uguuuaagaua

SEQ ID NO: 4052923 - RNA, 16 nt, Vaccinia virus
uguuuaccacaaugua

SEQ ID NO: 4052924 - RNA, 17 nt, Vaccinia virus
uguuuauacaagauuga

SEQ ID NO: 4052925 - RNA, 17 nt, Vaccinia virus
uguuuaucuauacuauu

SEQ ID NO: 4052926 - RNA, 19 nt, Vaccinia virus
uguuucgaaacuuuaucaa

SEQ ID NO: 4052927 - RNA, 23 nt, Vaccinia virus
uguuugauuucucuaucgaugca

SEQ ID NO: 4052928 - RNA, 19 nt, Vaccinia virus
uguuuggcaauaaaguuuu

SEQ ID NO: 4052929 - RNA, 23 nt, Vaccinia virus
uguuugucugagggguucgucua

SEQ ID NO: 4052930 - RNA, 23 nt, Vaccinia virus
uguuuucaauggccaucugaaau

SEQ ID NO: 4052931 - RNA, 14 nt, Vaccinia virus
uguuuucaucauuu

SEQ ID NO: 4052932 - RNA, 22 nt, Vaccinia virus
uguuuugaggcagcaaauacug

SEQ ID NO: 4052933 - RNA, 15 nt, Vaccinia virus
uguuuuuguuuucau

SEQ ID NO: 4052934 - RNA, 12 nt, Vaccinia virus
uuaaaaaaagau

SEQ ID NO: 4052935 - RNA, 19 nt, Vaccinia virus
uuaaaaaggaaaauacuau

SEQ ID NO: 4052936 - RNA, 14 nt, Vaccinia virus
uuaaaaaguuaucu

SEQ ID NO: 4052937 - RNA, 16 nt, Vaccinia virus
uuaaaaaguuaucuuu

SEQ ID NO: 4052938 - RNA, 14 nt, Vaccinia virus
uuaaaaauacgguu

SEQ ID NO: 4052939 - RNA, 13 nt, Vaccinia virus
uuaaaaauuuuca

SEQ ID NO: 4052940 - RNA, 19 nt, Vaccinia virus
uuaaaauacuaaauugaac

SEQ ID NO: 4052941 - RNA, 17 nt, Vaccinia virus
uuaaaauauuauuuaga

SEQ ID NO: 4052942 - RNA, 14 nt, Vaccinia virus
uuaaacauacuggu

SEQ ID NO: 4052943 - RNA, 20 nt, Vaccinia virus
uuaaacgaauaaaagauauu

SEQ ID NO: 4052944 - RNA, 18 nt, Vaccinia virus
uuaaacgauuuauaaaaa

SEQ ID NO: 4052945 - RNA, 23 nt, Vaccinia virus
uuaaacguaguuaugauaaauga

SEQ ID NO: 4052946 - RNA, 22 nt, Vaccinia virus
uuaaacuguaucgaucauucuu

SEQ ID NO: 4052947 - RNA, 22 nt, Vaccinia virus
uuaaacuguuuguauaauaucu

SEQ ID NO: 4052948 - RNA, 23 nt, Vaccinia virus
uuaaagagacuacaauauauucu

SEQ ID NO: 4052949 - RNA, 22 nt, Vaccinia virus
uuaaaggauaaaauauuaucca

SEQ ID NO: 4052950 - RNA, 19 nt, Vaccinia virus
uaugaacuuucaaggacuu

SEQ ID NO: 4052951 - RNA, 15 nt, Vaccinia virus
uaugaagaugauguu

SEQ ID NO: 4052952 - RNA, 16 nt, Vaccinia virus
uaugaaguacgauguu

SEQ ID NO: 4052953 - RNA, 20 nt, Vaccinia virus
uaugaccggcaaucaugaau

SEQ ID NO: 4052954 - RNA, 12 nt, Vaccinia virus
uaugacgucucu

SEQ ID NO: 4052955 - RNA, 13 nt, Vaccinia virus
uaugauaugugau

SEQ ID NO: 4052956 - RNA, 16 nt, Vaccinia virus
uaugaucauuuugaua

SEQ ID NO: 4052957 - RNA, 21 nt, Vaccinia virus
uaugauccacaaaacguauau

SEQ ID NO: 4052958 - RNA, 16 nt, Vaccinia virus
uaugaugccgguaaau

SEQ ID NO: 4052959 - RNA, 15 nt, Vaccinia virus
uaugauggauacaug

SEQ ID NO: 4052960 - RNA, 16 nt, Vaccinia virus
uaugauggguggauau

SEQ ID NO: 4052961 - RNA, 13 nt, Vaccinia virus
uaugauucuaaua

SEQ ID NO: 4052962 - RNA, 13 nt, Vaccinia virus
uaugauucuguaa

SEQ ID NO: 4052963 - RNA, 17 nt, Vaccinia virus
uaugcauccaaaguauu

SEQ ID NO: 4052964 - RNA, 18 nt, Vaccinia virus
uaugcgaguaugaugcaa

SEQ ID NO: 4052965 - RNA, 13 nt, Vaccinia virus
uaugcgauagcaa

SEQ ID NO: 4052966 - RNA, 14 nt, Vaccinia virus
uauggaaaaacuug

SEQ ID NO: 4052967 - RNA, 19 nt, Vaccinia virus
uauggacgcagauagcuau

SEQ ID NO: 4052968 - RNA, 18 nt, Vaccinia virus
uauggaucuauucaagau

SEQ ID NO: 4052969 - RNA, 15 nt, Vaccinia virus
uauggaugccacugc

SEQ ID NO: 4052970 - RNA, 22 nt, Vaccinia virus
uauggauuuggucauaauagaa

SEQ ID NO: 4052971 - RNA, 22 nt, Vaccinia virus
uaugguauugauaaaauuaaug

SEQ ID NO: 4052972 - RNA, 16 nt, Vaccinia virus
uauguaagacuugugg

SEQ ID NO: 4052973 - RNA, 15 nt, Vaccinia virus
uauguagagguguau

SEQ ID NO: 4052974 - RNA, 21 nt, Vaccinia virus
uauguauuguaccaaagauuu

SEQ ID NO: 4052975 - RNA, 16 nt, Vaccinia virus
uauguauuuaauauca

SEQ ID NO: 4052976 - RNA, 19 nt, Vaccinia virus
uaugucuuccguuggauau

SEQ ID NO: 4052977 - RNA, 19 nt, Vaccinia virus
uaugugaauaugguaugau

SEQ ID NO: 4052978 - RNA, 16 nt, Vaccinia virus
uauguguauuaucaga

SEQ ID NO: 4052979 - RNA, 22 nt, Vaccinia virus
uaugugugauauugauaucuuu

SEQ ID NO: 4052980 - RNA, 19 nt, Vaccinia virus
uauguguguagacaaucau

SEQ ID NO: 4052981 - RNA, 14 nt, Vaccinia virus
uauguugacaugua

SEQ ID NO: 4052982 - RNA, 16 nt, Vaccinia virus
uauguuucuaaauuuu

SEQ ID NO: 4052983 - RNA, 13 nt, Vaccinia virus
uauuaaaaaaugu

SEQ ID NO: 4052984 - RNA, 13 nt, Vaccinia virus
uauuaaauaucug

SEQ ID NO: 4052985 - RNA, 13 nt, Vaccinia virus
uauuaaauuuaga

SEQ ID NO: 4052986 - RNA, 23 nt, Vaccinia virus
uauuaacacuaaaaaauaaacac

SEQ ID NO: 4052987 - RNA, 22 nt, Vaccinia virus
uauuaacaguucguuugaugau

SEQ ID NO: 4052988 - RNA, 23 nt, Vaccinia virus
uauuaacgcaccuauaaagacuu

SEQ ID NO: 4052989 - RNA, 20 nt, Vaccinia virus
uauuaacuuuguucauuuau

SEQ ID NO: 4052990 - RNA, 13 nt, Vaccinia virus
uauuaauaaugau

SEQ ID NO: 4052991 - RNA, 19 nt, Vaccinia virus
uauuaaucaagucaauuau

SEQ ID NO: 4052992 - RNA, 23 nt, Vaccinia virus
uauuaauccuuucuucuugagau

SEQ ID NO: 4052993 - RNA, 13 nt, Vaccinia virus
uauuaaucuuuuu

SEQ ID NO: 4052994 - RNA, 18 nt, Vaccinia virus
uauuaaugaucacaugcu

SEQ ID NO: 4052995 - RNA, 13 nt, Vaccinia virus
uauuaauggauuu

SEQ ID NO: 4052996 - RNA, 14 nt, Vaccinia virus
uauuaauucuguaa

SEQ ID NO: 4052997 - RNA, 17 nt, Vaccinia virus
uauuaauuguaaaugau

SEQ ID NO: 4052998 - RNA, 22 nt, Vaccinia virus
uauuacaagacgucauucuaaa

SEQ ID NO: 4052999 - RNA, 19 nt, Vaccinia virus
uauuacaagaguacguuau

SEQ ID NO: 4053000 - RNA, 14 nt, Vaccinia virus
uauuacguuagcau

SEQ ID NO: 4053001 - RNA, 17 nt, Vaccinia virus
uauuauaaaaaaguuuu

SEQ ID NO: 4053002 - RNA, 14 nt, Vaccinia virus
uauuauaaacucac

SEQ ID NO: 4053003 - RNA, 19 nt, Vaccinia virus
uauuauaaacucucaacau

SEQ ID NO: 4053004 - RNA, 15 nt, Vaccinia virus
uauuaucaaauacug

SEQ ID NO: 4053005 - RNA, 10 nt, Vaccinia virus
uauuaucauc

SEQ ID NO: 4053006 - RNA, 17 nt, Vaccinia virus
uauuauccuugacuuga

SEQ ID NO: 4053007 - RNA, 13 nt, Vaccinia virus
uauuaucuauaaa

SEQ ID NO: 4053008 - RNA, 21 nt, Vaccinia virus
uauuauguuaacggaaaguau

SEQ ID NO: 4053009 - RNA, 15 nt, Vaccinia virus
uauuauuauacauga

SEQ ID NO: 4053010 - RNA, 18 nt, Vaccinia virus
uauuauugucauaaacau

SEQ ID NO: 4053011 - RNA, 15 nt, Vaccinia virus
uauuauuuaaacgaa

SEQ ID NO: 4053012 - RNA, 14 nt, Vaccinia virus
uauucaaaauauga

SEQ ID NO: 4053013 - RNA, 17 nt, Vaccinia virus
uauucaagucaaagaaa

SEQ ID NO: 4053014 - RNA, 16 nt, Vaccinia virus
uauucaucaucaauau

SEQ ID NO: 4053015 - RNA, 15 nt, Vaccinia virus
uauuccaauguuuaa

SEQ ID NO: 4053016 - RNA, 20 nt, Vaccinia virus
uauuccuaccaaacaaaauu

SEQ ID NO: 4053017 - RNA, 16 nt, Vaccinia virus
uauuccuguuaucauc

SEQ ID NO: 4053018 - RNA, 19 nt, Vaccinia virus
uauucggcauuucuaaaau

SEQ ID NO: 4053019 - RNA, 20 nt, Vaccinia virus
uauucgucgucgacuaucaa

SEQ ID NO: 4053020 - RNA, 23 nt, Vaccinia virus
uauucuaauacauaauucuucug

SEQ ID NO: 4053021 - RNA, 19 nt, Vaccinia virus
uauucuaccauagcaaauc

SEQ ID NO: 4053022 - RNA, 22 nt, Vaccinia virus
uauucuaucuccaguauuuaca

SEQ ID NO: 4053023 - RNA, 14 nt, Vaccinia virus
uauucuauuucgaa

SEQ ID NO: 4053024 - RNA, 18 nt, Vaccinia virus
uauucuguucuauucaaa

SEQ ID NO: 4053025 - RNA, 18 nt, Vaccinia virus
uauucuugcucaauagau

SEQ ID NO: 4053026 - RNA, 13 nt, Vaccinia virus
uauugaaacugag

SEQ ID NO: 4053027 - RNA, 12 nt, Vaccinia virus
uauugacaaaua

SEQ ID NO: 4053028 - RNA, 20 nt, Vaccinia virus
uauugauaaagaucuaaaaa

SEQ ID NO: 4053029 - RNA, 13 nt, Vaccinia virus
uauugauuuacua

SEQ ID NO: 4053030 - RNA, 20 nt, Vaccinia virus
uauugcgcaucgauaucuuu

SEQ ID NO: 4053031 - RNA, 18 nt, Vaccinia virus
uauuggaccgaauuacag

SEQ ID NO: 4053032 - RNA, 18 nt, Vaccinia virus
uauuguauccauacauac

SEQ ID NO: 4053033 - RNA, 21 nt, Vaccinia virus
uauuguuuaauauauuauaua

SEQ ID NO: 4053034 - RNA, 16 nt, Vaccinia virus
uauuguuuauuaucua

SEQ ID NO: 4053035 - RNA, 21 nt, Vaccinia virus
uauuguuuggguaaaacagau

SEQ ID NO: 4053036 - RNA, 16 nt, Vaccinia virus
uauuguuuugaagaaa

SEQ ID NO: 4053037 - RNA, 21 nt, Vaccinia virus
uauuuaacggcuauucaagau

SEQ ID NO: 4053038 - RNA, 15 nt, Vaccinia virus
uauuuaacucaugau

SEQ ID NO: 4053039 - RNA, 12 nt, Vaccinia virus
uauuuacaauua

SEQ ID NO: 4053040 - RNA, 18 nt, Vaccinia virus
uauuuaucaauucuucua

SEQ ID NO: 4053041 - RNA, 21 nt, Vaccinia virus
uauuuaucucuucauuauaua

SEQ ID NO: 4053042 - RNA, 13 nt, Vaccinia virus
uauuuccauaaua

SEQ ID NO: 4053043 - RNA, 14 nt, Vaccinia virus
uauuucguacauuu

SEQ ID NO: 4053044 - RNA, 18 nt, Vaccinia virus
uauuucuauauuugacuc

SEQ ID NO: 4053045 - RNA, 12 nt, Vaccinia virus
uauuucuuacau

SEQ ID NO: 4053046 - RNA, 16 nt, Vaccinia virus
uauuugacgcaucuua

SEQ ID NO: 4053047 - RNA, 23 nt, Vaccinia virus
uauuugcacacauaauccauucu

SEQ ID NO: 4053048 - RNA, 23 nt, Vaccinia virus
uauuugcgaggaugacucucaaa

SEQ ID NO: 4053049 - RNA, 19 nt, Vaccinia virus
uauuuucaguuuuauuaua

SEQ ID NO: 4053050 - RNA, 20 nt, Vaccinia virus
uauuuucuggaaguggauau

SEQ ID NO: 4053051 - RNA, 15 nt, Vaccinia virus
uauuuuguuauuaua

SEQ ID NO: 4053052 - RNA, 23 nt, Vaccinia virus
uauuuuuaauagcugcucuuugu

SEQ ID NO: 4053053 - RNA, 21 nt, Vaccinia virus
uauuuuuucuggcauuaucua

SEQ ID NO: 4053054 - RNA, 13 nt, Vaccinia virus
uauuuuuuucaua

SEQ ID NO: 4053055 - RNA, 18 nt, Vaccinia virus
ucaaaaaaagauuauucg

SEQ ID NO: 4053056 - RNA, 21 nt, Vaccinia virus
ucaaaaaacaauuuauucaga

SEQ ID NO: 4053057 - RNA, 17 nt, Vaccinia virus
ucaaaaaauaaauuaga

SEQ ID NO: 4053058 - RNA, 23 nt, Vaccinia virus
ucaaaaagauuagacauaucaga

SEQ ID NO: 4053059 - RNA, 18 nt, Vaccinia virus
ucaaaaauauucauuaau

SEQ ID NO: 4053060 - RNA, 13 nt, Vaccinia virus
ucaaaaauuuaga

SEQ ID NO: 4053061 - RNA, 13 nt, Vaccinia virus
ucaaaagaaaucu

SEQ ID NO: 4053062 - RNA, 14 nt, Vaccinia virus
ucaaaauauguaga

SEQ ID NO: 4053063 - RNA, 16 nt, Vaccinia virus
ucaaaauauguagaaa

SEQ ID NO: 4053064 - RNA, 23 nt, Vaccinia virus
ucaaacgaauaaacaauuucaca

SEQ ID NO: 4053065 - RNA, 19 nt, Vaccinia virus
ucaaacggcgcagacguau

SEQ ID NO: 4053066 - RNA, 22 nt, Vaccinia virus
ucaaacucuaaugaccacaucu

SEQ ID NO: 4053067 - RNA, 15 nt, Vaccinia virus
ucaaauaacaaacaa

SEQ ID NO: 4053068 - RNA, 16 nt, Vaccinia virus
ucaaauaggagauauu

SEQ ID NO: 4053069 - RNA, 12 nt, Vaccinia virus
ucaaauaugaaa

SEQ ID NO: 4053070 - RNA, 19 nt, Vaccinia virus
ucaaauggauaauuuaaga

SEQ ID NO: 4053071 - RNA, 20 nt, Vaccinia virus
ucaaauucucguucauguau

SEQ ID NO: 4053072 - RNA, 18 nt, Vaccinia virus
ucaacaauaugcaaauag

SEQ ID NO: 4053073 - RNA, 20 nt, Vaccinia virus
ucaacagaaucaguauauau

SEQ ID NO: 4053074 - RNA, 16 nt, Vaccinia virus
ucaacauaaauaauuc

SEQ ID NO: 4053075 - RNA, 23 nt, Vaccinia virus
ucaacgaugaaaacuuuaaauac

SEQ ID NO: 4053076 - RNA, 18 nt, Vaccinia virus
ucaacgauucuagaauau

SEQ ID NO: 4053077 - RNA, 18 nt, Vaccinia virus
aaugucgaauaacuguaa

SEQ ID NO: 4053078 - RNA, 22 nt, Vaccinia virus
aaugucuauaguucucaucuuu

SEQ ID NO: 4053079 - RNA, 14 nt, Vaccinia virus
aauguuaaaacuac

SEQ ID NO: 4053080 - RNA, 14 nt, Vaccinia virus
aauguuaauuuaua

SEQ ID NO: 4053081 - RNA, 16 nt, Vaccinia virus
aauguuaauuuugaaa

SEQ ID NO: 4053082 - RNA, 12 nt, Vaccinia virus
aauguuaccaua

SEQ ID NO: 4053083 - RNA, 19 nt, Vaccinia virus
aauguuagagacggaaaua

SEQ ID NO: 4053084 - RNA, 16 nt, Vaccinia virus
aauguuagugaugaau

SEQ ID NO: 4053085 - RNA, 19 nt, Vaccinia virus
aauguuagugaugaauauc

SEQ ID NO: 4053086 - RNA, 23 nt, Vaccinia virus
aauguuauaguuuucuaaaaugu

SEQ ID NO: 4053087 - RNA, 12 nt, Vaccinia virus
aauguucauaau

SEQ ID NO: 4053088 - RNA, 22 nt, Vaccinia virus
aauguucaugacauccauuaca

SEQ ID NO: 4053089 - RNA, 17 nt, Vaccinia virus
aauguuguuaaaugauc

SEQ ID NO: 4053090 - RNA, 21 nt, Vaccinia virus
aauuaaaaccaaguacuacaa

SEQ ID NO: 4053091 - RNA, 22 nt, Vaccinia virus
aauuaaaauaacaccauuuagu

SEQ ID NO: 4053092 - RNA, 16 nt, Vaccinia virus
aauuaaauaguuuauu

SEQ ID NO: 4053093 - RNA, 16 nt, Vaccinia virus
aauuaaucaaauggua

SEQ ID NO: 4053094 - RNA, 17 nt, Vaccinia virus
aauuaaucauauacaac

SEQ ID NO: 4053095 - RNA, 13 nt, Vaccinia virus
aauuaauucuuua

SEQ ID NO: 4053096 - RNA, 20 nt, Vaccinia virus
aauuaauucuuuauugucau

SEQ ID NO: 4053097 - RNA, 15 nt, Vaccinia virus
aauuaauuugauaau

SEQ ID NO: 4053098 - RNA, 19 nt, Vaccinia virus
aauuacgcucuacaaaaug

SEQ ID NO: 4053099 - RNA, 15 nt, Vaccinia virus
aauuacuaaaauaua

SEQ ID NO: 4053100 - RNA, 19 nt, Vaccinia virus
aauuacuaaaauauacaaa

SEQ ID NO: 4053101 - RNA, 19 nt, Vaccinia virus
aauuacuuugacaaaugua

SEQ ID NO: 4053102 - RNA, 16 nt, Vaccinia virus
aauuagaauuacaaaa

SEQ ID NO: 4053103 - RNA, 13 nt, Vaccinia virus
aauuagagaauua

SEQ ID NO: 4053104 - RNA, 19 nt, Vaccinia virus
aauuagucauacguaauga

SEQ ID NO: 4053105 - RNA, 18 nt, Vaccinia virus
aauuaguucguuggaaaa

SEQ ID NO: 4053106 - RNA, 12 nt, Vaccinia virus
aauuaguuuauu

SEQ ID NO: 4053107 - RNA, 22 nt, Vaccinia virus
aauuaguuuuucuuuacacaau

SEQ ID NO: 4053108 - RNA, 21 nt, Vaccinia virus
aauuauaauauaaaaauacuu

SEQ ID NO: 4053109 - RNA, 14 nt, Vaccinia virus
aauuauaauguuuc

SEQ ID NO: 4053110 - RNA, 17 nt, Vaccinia virus
aauuauagaacgaagua

SEQ ID NO: 4053111 - RNA, 23 nt, Vaccinia virus
aauuaucgacauagguauagaau

SEQ ID NO: 4053112 - RNA, 16 nt, Vaccinia virus
aauuaugcaaucaaug

SEQ ID NO: 4053113 - RNA, 21 nt, Vaccinia virus
aauuauuaauuuuagugaaau

SEQ ID NO: 4053114 - RNA, 14 nt, Vaccinia virus
aauuauuauccaau

SEQ ID NO: 4053115 - RNA, 17 nt, Vaccinia virus
aauuauuauuacugaau

SEQ ID NO: 4053116 - RNA, 17 nt, Vaccinia virus
aauuauucguuuacuga

SEQ ID NO: 4053117 - RNA, 20 nt, Vaccinia virus
aauucacuguauaaaaagaa

SEQ ID NO: 4053118 - RNA, 18 nt, Vaccinia virus
aauucauagccaauggau

SEQ ID NO: 4053119 - RNA, 21 nt, Vaccinia virus
aauucauccguccuucagaca

SEQ ID NO: 4053120 - RNA, 19 nt, Vaccinia virus
aauuccagauguuguaaaa

SEQ ID NO: 4053121 - RNA, 14 nt, Vaccinia virus
aauucguuagcaaa

SEQ ID NO: 4053122 - RNA, 14 nt, Vaccinia virus
aauucuaaaugaug

SEQ ID NO: 4053123 - RNA, 23 nt, Vaccinia virus
aauucucuuacgccgauauuucu

SEQ ID NO: 4053124 - RNA, 15 nt, Vaccinia virus
aauucuuaucaauaa

SEQ ID NO: 4053125 - RNA, 15 nt, Vaccinia virus
aauucuuaugauaua

SEQ ID NO: 4053126 - RNA, 19 nt, Vaccinia virus
aauucuuggauauaugaua

SEQ ID NO: 4053127 - RNA, 17 nt, Vaccinia virus
aauucuuuauaacugaa

SEQ ID NO: 4053128 - RNA, 19 nt, Vaccinia virus
uaacgaguuccauuuauau

SEQ ID NO: 4053129 - RNA, 19 nt, Vaccinia virus
uaacgauaacgucauuaau

SEQ ID NO: 4053130 - RNA, 21 nt, Vaccinia virus
uaacgauuuccaugucuacau

SEQ ID NO: 4053131 - RNA, 20 nt, Vaccinia virus
uaacgguuauaaaauuuaua

SEQ ID NO: 4053132 - RNA, 14 nt, Vaccinia virus
uaacguaucgcauu

SEQ ID NO: 4053133 - RNA, 20 nt, Vaccinia virus
uaacguccaucauuacagaa

SEQ ID NO: 4053134 - RNA, 13 nt, Vaccinia virus
uaacuaucuguaa

SEQ ID NO: 4053135 - RNA, 22 nt, Vaccinia virus
uaacuaucuguaaaagcauaug

SEQ ID NO: 4053136 - RNA, 18 nt, Vaccinia virus
uaacuccagaacaucuuc

SEQ ID NO: 4053137 - RNA, 14 nt, Vaccinia virus
uaacucuguuuuau

SEQ ID NO: 4053138 - RNA, 19 nt, Vaccinia virus
uaacucuuucgaauacuua

SEQ ID NO: 4053139 - RNA, 16 nt, Vaccinia virus
uaacugcuguguguau

SEQ ID NO: 4053140 - RNA, 17 nt, Vaccinia virus
uaacuggaucuuuauuu

SEQ ID NO: 4053141 - RNA, 18 nt, Vaccinia virus
uaacuggcggauuauuca

SEQ ID NO: 4053142 - RNA, 15 nt, Vaccinia virus
uaacuguuaucucuu

SEQ ID NO: 4053143 - RNA, 16 nt, Vaccinia virus
uaacuuacaaaaugua

SEQ ID NO: 4053144 - RNA, 19 nt, Vaccinia virus
uaacuugaugucaggaacu

SEQ ID NO: 4053145 - RNA, 16 nt, Vaccinia virus
uaagaaaaauagagag

SEQ ID NO: 4053146 - RNA, 16 nt, Vaccinia virus
uaagaaaguuaagaau

SEQ ID NO: 4053147 - RNA, 20 nt, Vaccinia virus
uaagaaugacuccuauguuu

SEQ ID NO: 4053148 - RNA, 17 nt, Vaccinia virus
uaagaccgaaauuauca

SEQ ID NO: 4053149 - RNA, 23 nt, Vaccinia virus
uaagacuaaugcuugaaaaugga

SEQ ID NO: 4053150 - RNA, 13 nt, Vaccinia virus
uaagacugucaau

SEQ ID NO: 4053151 - RNA, 19 nt, Vaccinia virus
uaagacuuauucucuacau

SEQ ID NO: 4053152 - RNA, 15 nt, Vaccinia virus
uaagaggaugaucug

SEQ ID NO: 4053153 - RNA, 16 nt, Vaccinia virus
uaagaugcaaacauua

SEQ ID NO: 4053154 - RNA, 20 nt, Vaccinia virus
uaagaugcaaacauuaugua

SEQ ID NO: 4053155 - RNA, 14 nt, Vaccinia virus
uaagcaagaaagau

SEQ ID NO: 4053156 - RNA, 20 nt, Vaccinia virus
uaagcaaguacauggaugau

SEQ ID NO: 4053157 - RNA, 19 nt, Vaccinia virus
uaagcgcuauacaaaucau

SEQ ID NO: 4053158 - RNA, 18 nt, Vaccinia virus
uaagcuuuuuaaaaucau

SEQ ID NO: 4053159 - RNA, 14 nt, Vaccinia virus
uaaggaguugaaau

SEQ ID NO: 4053160 - RNA, 18 nt, Vaccinia virus
uaagguagaaucucuauu

SEQ ID NO: 4053161 - RNA, 18 nt, Vaccinia virus
uaaguacaucaucuggaa

SEQ ID NO: 4053162 - RNA, 20 nt, Vaccinia virus
uaagucuuacaauguucgaa

SEQ ID NO: 4053163 - RNA, 16 nt, Vaccinia virus
uaauaaaauguuacaa

SEQ ID NO: 4053164 - RNA, 22 nt, Vaccinia virus
uaauaaccuacgcguauuauca

SEQ ID NO: 4053165 - RNA, 15 nt, Vaccinia virus
uaauaacuugaaaga

SEQ ID NO: 4053166 - RNA, 17 nt, Vaccinia virus
uaauaagugguauucca

SEQ ID NO: 4053167 - RNA, 20 nt, Vaccinia virus
uaauaauuuaguucauggaa

SEQ ID NO: 4053168 - RNA, 17 nt, Vaccinia virus
uaauacacacaaaguau

SEQ ID NO: 4053169 - RNA, 16 nt, Vaccinia virus
uaauacauauuauuca

SEQ ID NO: 4053170 - RNA, 14 nt, Vaccinia virus
uaauacauuuugaa

SEQ ID NO: 4053171 - RNA, 16 nt, Vaccinia virus
uaauacauuuugaacu

SEQ ID NO: 4053172 - RNA, 22 nt, Vaccinia virus
uaauacuuauucauauuuuagu

SEQ ID NO: 4053173 - RNA, 13 nt, Vaccinia virus
uaauagaacucuu

SEQ ID NO: 4053174 - RNA, 16 nt, Vaccinia virus
uaauagaaugaagaau

SEQ ID NO: 4053175 - RNA, 19 nt, Vaccinia virus
uaauagcguuaacuaucaa

SEQ ID NO: 4053176 - RNA, 17 nt, Vaccinia virus
uaauagcuccauaaacu

SEQ ID NO: 4053177 - RNA, 22 nt, Vaccinia virus
uaauagguuugaucguugucau

SEQ ID NO: 4053178 - RNA, 17 nt, Vaccinia virus
uaauaguuuaucauacu

SEQ ID NO: 4053179 - RNA, 13 nt, Vaccinia virus
uaauauaauauua

SEQ ID NO: 4053180 - RNA, 13 nt, Vaccinia virus
uaauauagaagau

SEQ ID NO: 4053181 - RNA, 22 nt, Vaccinia virus
uaauaucagaggaguuauuuac

SEQ ID NO: 4053182 - RNA, 15 nt, Vaccinia virus
uaauauccaaucuua

SEQ ID NO: 4053183 - RNA, 21 nt, Vaccinia virus
uaauauccucaauaacguuau

SEQ ID NO: 4053184 - RNA, 14 nt, Vaccinia virus
uaauaucuaacaaa

SEQ ID NO: 4053185 - RNA, 16 nt, Vaccinia virus
uaauaugacucaugau

SEQ ID NO: 4053186 - RNA, 13 nt, Vaccinia virus
uaauaugaguaau

SEQ ID NO: 4053187 - RNA, 19 nt, Vaccinia virus
uaauauuaaaaauaagaau

SEQ ID NO: 4053188 - RNA, 19 nt, Vaccinia virus
uaauauucguauuuugcau

SEQ ID NO: 4053189 - RNA, 22 nt, Vaccinia virus
uaauauuggcagcguuguuuau

SEQ ID NO: 4053190 - RNA, 13 nt, Vaccinia virus
uaauauuguugau

SEQ ID NO: 4053191 - RNA, 13 nt, Vaccinia virus
uaauauuuugcau

SEQ ID NO: 4053192 - RNA, 23 nt, Vaccinia virus
uaaucaaaauugucuaugauguc

SEQ ID NO: 4053193 - RNA, 18 nt, Vaccinia virus
uaaucagaaaacuuauaa

SEQ ID NO: 4053194 - RNA, 16 nt, Vaccinia virus
uaaucauauaaaucau

SEQ ID NO: 4053195 - RNA, 18 nt, Vaccinia virus
uaauccacuauauauucu

SEQ ID NO: 4053196 - RNA, 21 nt, Vaccinia virus
uaauccagaauguacacuauu

SEQ ID NO: 4053197 - RNA, 16 nt, Vaccinia virus
uaauccagucuuuaau

SEQ ID NO: 4053198 - RNA, 17 nt, Vaccinia virus
uaauccaucaacaaugu

SEQ ID NO: 4053199 - RNA, 22 nt, Vaccinia virus
uaaucccgcauuuauacauauu

SEQ ID NO: 4053200 - RNA, 14 nt, Vaccinia virus
uaauccuagaugau

SEQ ID NO: 4053201 - RNA, 22 nt, Vaccinia virus
uaauccuauucuugaucucauc

SEQ ID NO: 4053202 - RNA, 15 nt, Vaccinia virus
uaauccuguguuuau

SEQ ID NO: 4053203 - RNA, 19 nt, Vaccinia virus
uaaucggagaauguuuccc

SEQ ID NO: 4053204 - RNA, 20 nt, Vaccinia virus
uaaucguaagcgcuauacaa

SEQ ID NO: 4053205 - RNA, 20 nt, Vaccinia virus
uaaucguguauaacaucuuu

SEQ ID NO: 4053206 - RNA, 17 nt, Vaccinia virus
uaaucguuauuaucauc

SEQ ID NO: 4053207 - RNA, 21 nt, Vaccinia virus
uaaucuaaaauaguucuguaa

SEQ ID NO: 4053208 - RNA, 19 nt, Vaccinia virus
uaaucuauaggcaacgaug

SEQ ID NO: 4053209 - RNA, 15 nt, Vaccinia virus
uaaucuuuaauguaa

SEQ ID NO: 4053210 - RNA, 12 nt, Vaccinia virus
uaaucuuuucug

SEQ ID NO: 4053211 - RNA, 13 nt, Vaccinia virus
uaaugaacucauu

SEQ ID NO: 4053212 - RNA, 15 nt, Vaccinia virus
uaaugauagaauuau

SEQ ID NO: 4053213 - RNA, 21 nt, Vaccinia virus
uaaugauugcccauagaguau

SEQ ID NO: 4053214 - RNA, 22 nt, Vaccinia virus
uaaugcaggguguauauuauua

SEQ ID NO: 4053215 - RNA, 17 nt, Vaccinia virus
uaaugcuuaaacuauca

SEQ ID NO: 4053216 - RNA, 19 nt, Vaccinia virus
uaauuacaaguauuauuga

SEQ ID NO: 4053217 - RNA, 14 nt, Vaccinia virus
uaauuacuaaaucu

SEQ ID NO: 4053218 - RNA, 23 nt, Vaccinia virus
uaauuagagacuuuauaacagau

SEQ ID NO: 4053219 - RNA, 14 nt, Vaccinia virus
uaauuaucuaaaua

SEQ ID NO: 4053220 - RNA, 13 nt, Vaccinia virus
uaauuauuuccag

SEQ ID NO: 4053221 - RNA, 17 nt, Vaccinia virus
uaauuccuuuuuaaauu

SEQ ID NO: 4053222 - RNA, 22 nt, Vaccinia virus
uaauucuuaucaauaacauauu

SEQ ID NO: 4053223 - RNA, 17 nt, Vaccinia virus
uaauucuucuacugcau

SEQ ID NO: 4053224 - RNA, 16 nt, Vaccinia virus
uaauugaacaaaguau

SEQ ID NO: 4053225 - RNA, 15 nt, Vaccinia virus
uaauugaguaaauga

SEQ ID NO: 4053226 - RNA, 14 nt, Vaccinia virus
uaauugcuuuucua

SEQ ID NO: 4053227 - RNA, 16 nt, Vaccinia virus
uaauugggugaagaau

SEQ ID NO: 4053228 - RNA, 21 nt, Vaccinia virus
uaauuuacaaaaauuuaaaau

SEQ ID NO: 4053229 - RNA, 12 nt, Vaccinia virus
uaauuuacuacu

SEQ ID NO: 4053230 - RNA, 16 nt, Vaccinia virus
uaauuuauaauauacu

SEQ ID NO: 4053231 - RNA, 21 nt, Vaccinia virus
uacaaaaauauuuuuauucuc

SEQ ID NO: 4053232 - RNA, 13 nt, Vaccinia virus
uacaaaagcaauu

SEQ ID NO: 4053233 - RNA, 18 nt, Vaccinia virus
uacaaaauaauagauaua

SEQ ID NO: 4053234 - RNA, 17 nt, Vaccinia virus
uacaaaauguugauaau

SEQ ID NO: 4053235 - RNA, 22 nt, Vaccinia virus
uacaaacgauuauuagaucuuu

SEQ ID NO: 4053236 - RNA, 21 nt, Vaccinia virus
uacaaacuauagaaauuauuu

SEQ ID NO: 4053237 - RNA, 17 nt, Vaccinia virus
uacaaauauguacauua

SEQ ID NO: 4053238 - RNA, 15 nt, Vaccinia virus
uacaaauauucacaa

SEQ ID NO: 4053239 - RNA, 23 nt, Vaccinia virus
uacaaaugacacugauaaaguag

SEQ ID NO: 4053240 - RNA, 17 nt, Vaccinia virus
uacaaauuuuaagaaau

SEQ ID NO: 4053241 - RNA, 18 nt, Vaccinia virus
uacaacagugauaugugu

SEQ ID NO: 4053242 - RNA, 20 nt, Vaccinia virus
uacaacagugauauguguaa

SEQ ID NO: 4053243 - RNA, 18 nt, Vaccinia virus
uacaacuggucauagaaa

SEQ ID NO: 4053244 - RNA, 18 nt, Vaccinia virus
uacaauauauucucauag

SEQ ID NO: 4053245 - RNA, 21 nt, Vaccinia virus
uacaaucaaaccuauaacauu

SEQ ID NO: 4053246 - RNA, 20 nt, Vaccinia virus
uacaaucguucgaacucguc

SEQ ID NO: 4053247 - RNA, 17 nt, Vaccinia virus
uacaauuaucauuuuga

SEQ ID NO: 4053248 - RNA, 24 nt, Vaccinia virus
uacaauugguuaugauaucaugua

SEQ ID NO: 4053249 - RNA, 14 nt, Vaccinia virus
uacaccggaucuau

SEQ ID NO: 4053250 - RNA, 16 nt, Vaccinia virus
uacacgugcuucggau

SEQ ID NO: 4053251 - RNA, 15 nt, Vaccinia virus
uacacucuauuucaa

SEQ ID NO: 4053252 - RNA, 16 nt, Vaccinia virus
uacagaaacaaugauu

SEQ ID NO: 4053253 - RNA, 14 nt, Vaccinia virus
uacagauacagaua

SEQ ID NO: 4053254 - RNA, 13 nt, Vaccinia virus
gauguguauacau

SEQ ID NO: 4053255 - RNA, 16 nt, Vaccinia virus
gauguguuuagaaaau

SEQ ID NO: 4053256 - RNA, 16 nt, Vaccinia virus
gauguuaaacaaauaa

SEQ ID NO: 4053257 - RNA, 20 nt, Vaccinia virus
gauguugauuaggucuuuua

SEQ ID NO: 4053258 - RNA, 19 nt, Vaccinia virus
gauguuuaaugauacgaua

SEQ ID NO: 4053259 - RNA, 21 nt, Vaccinia virus
gauuaaaaauaaaguuaucau

SEQ ID NO: 4053260 - RNA, 21 nt, Vaccinia virus
gauuaauaguuuuauuugaag

SEQ ID NO: 4053261 - RNA, 15 nt, Vaccinia virus
gauuacaagaaauau

SEQ ID NO: 4053262 - RNA, 22 nt, Vaccinia virus
gauuaccucuaguuucagaauu

SEQ ID NO: 4053263 - RNA, 22 nt, Vaccinia virus
gauuaguauauuccuuauucac

SEQ ID NO: 4053264 - RNA, 20 nt, Vaccinia virus
gauuauaaaguggaagagua

SEQ ID NO: 4053265 - RNA, 20 nt, Vaccinia virus
gauuauaauccuuauacauc

SEQ ID NO: 4053266 - RNA, 14 nt, Vaccinia virus
gauuauaugauaua

SEQ ID NO: 4053267 - RNA, 15 nt, Vaccinia virus
gauuaucguuuucau

SEQ ID NO: 4053268 - RNA, 15 nt, Vaccinia virus
gauuauuuuuauuau

SEQ ID NO: 4053269 - RNA, 20 nt, Vaccinia virus
gauucaacaaugucgagaua

SEQ ID NO: 4053270 - RNA, 23 nt, Vaccinia virus
gauucaggaaucguuuauucgau

SEQ ID NO: 4053271 - RNA, 14 nt, Vaccinia virus
gauucaucaacauu

SEQ ID NO: 4053272 - RNA, 20 nt, Vaccinia virus
gauucauuuuauuuguuaaa

SEQ ID NO: 4053273 - RNA, 19 nt, Vaccinia virus
gauuccacggaagaacuac

SEQ ID NO: 4053274 - RNA, 18 nt, Vaccinia virus
gauuccagccacuuggga

SEQ ID NO: 4053275 - RNA, 21 nt, Vaccinia virus
gauucgcaaacuauucuaaua

SEQ ID NO: 4053276 - RNA, 23 nt, Vaccinia virus
gauucguccuuaaccaacugauu

SEQ ID NO: 4053277 - RNA, 16 nt, Vaccinia virus
gauucuaggaacaguu

SEQ ID NO: 4053278 - RNA, 13 nt, Vaccinia virus
gauucuaucuuua

SEQ ID NO: 4053279 - RNA, 18 nt, Vaccinia virus
gauucucuacucuagaua

SEQ ID NO: 4053280 - RNA, 19 nt, Vaccinia virus
gauucugauaacauaaaaa

SEQ ID NO: 4053281 - RNA, 22 nt, Vaccinia virus
gauucugauaacauaaaaauau

SEQ ID NO: 4053282 - RNA, 21 nt, Vaccinia virus
gauugaaauuauauucuuuuu

SEQ ID NO: 4053283 - RNA, 20 nt, Vaccinia virus
gauugaggaagcacauaugu

SEQ ID NO: 4053284 - RNA, 21 nt, Vaccinia virus
gauuguauauuuuauuuuaua

SEQ ID NO: 4053285 - RNA, 19 nt, Vaccinia virus
gauugugcaucuacugaua

SEQ ID NO: 4053286 - RNA, 16 nt, Vaccinia virus
gauuguugccguaaau

SEQ ID NO: 4053287 - RNA, 21 nt, Vaccinia virus
gauuuauuugauaaucauguu

SEQ ID NO: 4053288 - RNA, 22 nt, Vaccinia virus
gauuucauuaucgguguauuuu

SEQ ID NO: 4053289 - RNA, 13 nt, Vaccinia virus
gauuuugauuuug

SEQ ID NO: 4053290 - RNA, 22 nt, Vaccinia virus
gauuuuuuuaucccauguuuca

SEQ ID NO: 4053291 - RNA, 19 nt, Vaccinia virus
gcaaaaauauauuagacaa

SEQ ID NO: 4053292 - RNA, 14 nt, Vaccinia virus
gcaaaaauauucua

SEQ ID NO: 4053293 - RNA, 12 nt, Vaccinia virus
gcaaaauaauua

SEQ ID NO: 4053294 - RNA, 16 nt, Vaccinia virus
gcaaaauaguaaugau

SEQ ID NO: 4053295 - RNA, 16 nt, Vaccinia virus
gcaaacuuaacagcuc

SEQ ID NO: 4053296 - RNA, 18 nt, Vaccinia virus
gcaaagauguuuaaugau

SEQ ID NO: 4053297 - RNA, 19 nt, Vaccinia virus
gcaaaucacucaauaucua

SEQ ID NO: 4053298 - RNA, 16 nt, Vaccinia virus
guuuaacaaaguuauu

SEQ ID NO: 4053299 - RNA, 17 nt, Vaccinia virus
guuuaauaauaauucau

SEQ ID NO: 4053300 - RNA, 14 nt, Vaccinia virus
guuuaauauugcac

SEQ ID NO: 4053301 - RNA, 14 nt, Vaccinia virus
guuuaauucuucau

SEQ ID NO: 4053302 - RNA, 17 nt, Vaccinia virus
guuuacaacacuuuucu

SEQ ID NO: 4053303 - RNA, 19 nt, Vaccinia virus
guuuaccacaauguauaau

SEQ ID NO: 4053304 - RNA, 15 nt, Vaccinia virus
guuuaucaauaacua

SEQ ID NO: 4053305 - RNA, 17 nt, Vaccinia virus
guuuauguacuaugcca

SEQ ID NO: 4053306 - RNA, 19 nt, Vaccinia virus
guuuauuuagauacagaug

SEQ ID NO: 4053307 - RNA, 17 nt, Vaccinia virus
guuucaaaaauauucau

SEQ ID NO: 4053308 - RNA, 21 nt, Vaccinia virus
guuucauggaacaauaaaaga

SEQ ID NO: 4053309 - RNA, 17 nt, Vaccinia virus
guuucgauauaaucauc

SEQ ID NO: 4053310 - RNA, 14 nt, Vaccinia virus
guuucuacuaacuu

SEQ ID NO: 4053311 - RNA, 18 nt, Vaccinia virus
guuucuggauuauuuuua

SEQ ID NO: 4053312 - RNA, 21 nt, Vaccinia virus
guuuggagacuaauucuuucu

SEQ ID NO: 4053313 - RNA, 15 nt, Vaccinia virus
guuuuauaacgaagu

SEQ ID NO: 4053314 - RNA, 14 nt, Vaccinia virus
guuuucaucuuuua

SEQ ID NO: 4053315 - RNA, 14 nt, Vaccinia virus
guuuucucuauucu

SEQ ID NO: 4053316 - RNA, 17 nt, Vaccinia virus
uaaaaaaaaugacuugu

SEQ ID NO: 4053317 - RNA, 14 nt, Vaccinia virus
uaaaaaaauuauuu

SEQ ID NO: 4053318 - RNA, 17 nt, Vaccinia virus
uaaaaaguuuuaacaug

SEQ ID NO: 4053319 - RNA, 15 nt, Vaccinia virus
uaaaaauaaacauug

SEQ ID NO: 4053320 - RNA, 17 nt, Vaccinia virus
uaaaaauaguauuauca

SEQ ID NO: 4053321 - RNA, 15 nt, Vaccinia virus
uaaaaauucacacau

SEQ ID NO: 4053322 - RNA, 14 nt, Vaccinia virus
uaaaacaaacuugu

SEQ ID NO: 4053323 - RNA, 14 nt, Vaccinia virus
uaaaacagauuucu

SEQ ID NO: 4053324 - RNA, 16 nt, Vaccinia virus
uaaaacauuaaauguc

SEQ ID NO: 4053325 - RNA, 16 nt, Vaccinia virus
uaaaaccaacuaauau

SEQ ID NO: 4053326 - RNA, 15 nt, Vaccinia virus
uaaaacgauaaaaga

SEQ ID NO: 4053327 - RNA, 20 nt, Vaccinia virus
uaaaacugaaccuacuuuau

SEQ ID NO: 4053328 - RNA, 19 nt, Vaccinia virus
uaaaacugcauauuauaca

SEQ ID NO: 4053329 - RNA, 21 nt, Vaccinia virus
uaaaacuuccucauuaagauu

SEQ ID NO: 4053330 - RNA, 17 nt, Vaccinia virus
uaaaacuuuauuaucca

SEQ ID NO: 4053331 - RNA, 19 nt, Vaccinia virus
uaaaagacaaauauaugug

SEQ ID NO: 4053332 - RNA, 14 nt, Vaccinia virus
uaaaagauggauau

SEQ ID NO: 4053333 - RNA, 17 nt, Vaccinia virus
uaaaaguaucaaaucuu

SEQ ID NO: 4053334 - RNA, 14 nt, Vaccinia virus
uaaaaguuaaugag

SEQ ID NO: 4053335 - RNA, 14 nt, Vaccinia virus
uaaaauaaucucuu

SEQ ID NO: 4053336 - RNA, 23 nt, Vaccinia virus
uaaaauacuuuccgaauaagucu

SEQ ID NO: 4053337 - RNA, 17 nt, Vaccinia virus
uaaaaucagcagacuuu

SEQ ID NO: 4053338 - RNA, 21 nt, Vaccinia virus
uaaaaucagcagacuuuugaa

SEQ ID NO: 4053339 - RNA, 18 nt, Vaccinia virus
uaaaauuaaauaguagua

SEQ ID NO: 4053340 - RNA, 14 nt, Vaccinia virus
uaaaauuguagcau

SEQ ID NO: 4053341 - RNA, 18 nt, Vaccinia virus
uaaacaauuucacaaaug

SEQ ID NO: 4053342 - RNA, 22 nt, Vaccinia virus
uaaacaguuuccacuuugguaa

SEQ ID NO: 4053343 - RNA, 16 nt, Vaccinia virus
uaaacaugaauuuauu

SEQ ID NO: 4053344 - RNA, 13 nt, Vaccinia virus
uaaacauuccaca

SEQ ID NO: 4053345 - RNA, 17 nt, Vaccinia virus
uaaacauugauuaaauu

SEQ ID NO: 4053346 - RNA, 19 nt, Vaccinia virus
uaaaccauguugugaaaga

SEQ ID NO: 4053347 - RNA, 22 nt, Vaccinia virus
uaaacguuguuuacucauauag

SEQ ID NO: 4053348 - RNA, 16 nt, Vaccinia virus
uaaacucagauaauag

SEQ ID NO: 4053349 - RNA, 20 nt, Vaccinia virus
uaaacugcgccaaauugugg

SEQ ID NO: 4053350 - RNA, 23 nt, Vaccinia virus
uaaacuguuuguauaauaucucu

SEQ ID NO: 4053351 - RNA, 14 nt, Vaccinia virus
uaaacuuuaacaau

SEQ ID NO: 4053352 - RNA, 14 nt, Vaccinia virus
uaaagaagacgcua

SEQ ID NO: 4053353 - RNA, 19 nt, Vaccinia virus
uaaagauacaaauaugucu

SEQ ID NO: 4053354 - RNA, 15 nt, Vaccinia virus
uaaagauauaaauga

SEQ ID NO: 4053355 - RNA, 12 nt, Vaccinia virus
uaaagauauucu

SEQ ID NO: 4053356 - RNA, 15 nt, Vaccinia virus
uaaagccguaauuga

SEQ ID NO: 4053357 - RNA, 16 nt, Vaccinia virus
uaaaggaugaguacau

SEQ ID NO: 4053358 - RNA, 14 nt, Vaccinia virus
uaaaguauuuggaa

SEQ ID NO: 4053359 - RNA, 15 nt, Vaccinia virus
uaaauaauuauuuca

SEQ ID NO: 4053360 - RNA, 16 nt, Vaccinia virus
uaaauagagaagguau

SEQ ID NO: 4053361 - RNA, 20 nt, Vaccinia virus
uaaauaucauaaucuaaaau

SEQ ID NO: 4053362 - RNA, 20 nt, Vaccinia virus
uaaauauuuuaaaauuuaua

SEQ ID NO: 4053363 - RNA, 22 nt, Vaccinia virus
uaaauauuuuucuaccuuuuca

SEQ ID NO: 4053364 - RNA, 14 nt, Vaccinia virus
uaaaucacauaucu

SEQ ID NO: 4053365 - RNA, 18 nt, Vaccinia virus
uaaaucagaauguuacag

SEQ ID NO: 4053366 - RNA, 20 nt, Vaccinia virus
uaaaucaugacguaaaugua

SEQ ID NO: 4053367 - RNA, 15 nt, Vaccinia virus
uaaaucauuaucuac

SEQ ID NO: 4053368 - RNA, 17 nt, Vaccinia virus
uaaauccaucucagaau

SEQ ID NO: 4053369 - RNA, 15 nt, Vaccinia virus
uaaauccgagaauau

SEQ ID NO: 4053370 - RNA, 23 nt, Vaccinia virus
uaaauccucuauuuauugacauu

SEQ ID NO: 4053371 - RNA, 15 nt, Vaccinia virus
uaaauccuuguuuga

SEQ ID NO: 4053372 - RNA, 23 nt, Vaccinia virus
uaaaucuaaaauugauggaugag

SEQ ID NO: 4053373 - RNA, 20 nt, Vaccinia virus
uaaaucuaacauugauuuua

SEQ ID NO: 4053374 - RNA, 15 nt, Vaccinia virus
uaaaucuccuucaug

SEQ ID NO: 4053375 - RNA, 20 nt, Vaccinia virus
uaaaugauuucgaucugucu

SEQ ID NO: 4053376 - RNA, 14 nt, Vaccinia virus
uaaaugauuuucug

SEQ ID NO: 4053377 - RNA, 19 nt, Vaccinia virus
uaaaugcaauaacaaagau

SEQ ID NO: 4053378 - RNA, 18 nt, Vaccinia virus
uaaaugcgugacuauaaa

SEQ ID NO: 4053379 - RNA, 14 nt, Vaccinia virus
uaaauguaaauuca

SEQ ID NO: 4053380 - RNA, 17 nt, Vaccinia virus
uaaauguuuaaacauca

SEQ ID NO: 4053381 - RNA, 15 nt, Vaccinia virus
uaaauguuuaacguu

SEQ ID NO: 4053382 - RNA, 20 nt, Vaccinia virus
uaaauguuuucucuguaaua

SEQ ID NO: 4053383 - RNA, 18 nt, Vaccinia virus
uaaauuacacauuuccaa

SEQ ID NO: 4053384 - RNA, 18 nt, Vaccinia virus
uaaauuauauauggauuu

SEQ ID NO: 4053385 - RNA, 17 nt, Vaccinia virus
uaaauucaaccaugaau

SEQ ID NO: 4053386 - RNA, 12 nt, Vaccinia virus
uaaauucaagau

SEQ ID NO: 4053387 - RNA, 13 nt, Vaccinia virus
uaaauucauauaa

SEQ ID NO: 4053388 - RNA, 16 nt, Vaccinia virus
uaaauuccuuaauauu

SEQ ID NO: 4053389 - RNA, 12 nt, Vaccinia virus
uaaauuguguag

SEQ ID NO: 4053390 - RNA, 19 nt, Vaccinia virus
uaaauuuagugagaauaau

SEQ ID NO: 4053391 - RNA, 17 nt, Vaccinia virus
uaaauuuaucaauaaau

SEQ ID NO: 4053392 - RNA, 14 nt, Vaccinia virus
uaaauuuaucuauu

SEQ ID NO: 4053393 - RNA, 11 nt, Vaccinia virus
uaaauuucaau

SEQ ID NO: 4053394 - RNA, 14 nt, Vaccinia virus
uaaauuuuaaacau

SEQ ID NO: 4053395 - RNA, 19 nt, Vaccinia virus
uaacaaaaauuaugaaaua

SEQ ID NO: 4053396 - RNA, 20 nt, Vaccinia virus
uaacaaaaucaggaaaaaag

SEQ ID NO: 4053397 - RNA, 16 nt, Vaccinia virus
uaacaaauuaaagaua

SEQ ID NO: 4053398 - RNA, 14 nt, Vaccinia virus
uaacaaauuuccua

SEQ ID NO: 4053399 - RNA, 18 nt, Vaccinia virus
uaacaaauuuccuaaaua

SEQ ID NO: 4053400 - RNA, 14 nt, Vaccinia virus
uaacaauuaauuag

SEQ ID NO: 4053401 - RNA, 16 nt, Vaccinia virus
uaacaauugucuguaa

SEQ ID NO: 4053402 - RNA, 18 nt, Vaccinia virus
uaacaauuuauuuuguau

SEQ ID NO: 4053403 - RNA, 14 nt, Vaccinia virus
uaacacacaugucu

SEQ ID NO: 4053404 - RNA, 22 nt, Vaccinia virus
uaacacguuuuuuagaucucau

SEQ ID NO: 4053405 - RNA, 21 nt, Vaccinia virus
uaacacucgcuccauauucca

SEQ ID NO: 4053406 - RNA, 18 nt, Vaccinia virus
uaacagauaaaaagacuu

SEQ ID NO: 4053407 - RNA, 16 nt, Vaccinia virus
uaacagauacauaaac

SEQ ID NO: 4053408 - RNA, 20 nt, Vaccinia virus
uaacaggggaaugaacagca

SEQ ID NO: 4053409 - RNA, 17 nt, Vaccinia virus
uaacaguuuuacuauau

SEQ ID NO: 4053410 - RNA, 15 nt, Vaccinia virus
uaacauaaaaacuua

SEQ ID NO: 4053411 - RNA, 23 nt, Vaccinia virus
uaacaucuggccuguucauaaau

SEQ ID NO: 4053412 - RNA, 20 nt, Vaccinia virus
uaacaugcgguucaaaauag

SEQ ID NO: 4053413 - RNA, 17 nt, Vaccinia virus
uaacauggauacagaua

SEQ ID NO: 4053414 - RNA, 18 nt, Vaccinia virus
uaacauguuacagaauau

SEQ ID NO: 4053415 - RNA, 16 nt, Vaccinia virus
uaacauugacugaaua

SEQ ID NO: 4053416 - RNA, 17 nt, Vaccinia virus
uaacauugaguaaaucc

SEQ ID NO: 4053417 - RNA, 15 nt, Vaccinia virus
uaacauuuauuauca

SEQ ID NO: 4053418 - RNA, 20 nt, Vaccinia virus
uaaccauauauccaauaaag

SEQ ID NO: 4053419 - RNA, 17 nt, Vaccinia virus
uaaccaugaaagaaaga

SEQ ID NO: 4053420 - RNA, 15 nt, Vaccinia virus
uaaccuuaucauuau

SEQ ID NO: 4053421 - RNA, 23 nt, Vaccinia virus
uaaccuuggcugucucauucaau

SEQ ID NO: 4053422 - RNA, 23 nt, Vaccinia virus
uaacgaacgaggugugaauguac

SEQ ID NO: 4053423 - RNA, 18 nt, Vaccinia virus
uaacgaauuauauagucu

SEQ ID NO: 4053424 - RNA, 15 nt, Vaccinia virus
uaacgaggacuuauu

SEQ ID NO: 4053425 - RNA, 15 nt, Vaccinia virus
agaaccaaaugauua

SEQ ID NO: 4053426 - RNA, 16 nt, Vaccinia virus
agaaccaguaacauau

SEQ ID NO: 4053427 - RNA, 17 nt, Vaccinia virus
agaacgaugucaaaaua

SEQ ID NO: 4053428 - RNA, 20 nt, Vaccinia virus
agaacgaugucaaaauauga

SEQ ID NO: 4053429 - RNA, 22 nt, Vaccinia virus
agaacgaugucaaaauaugagu

SEQ ID NO: 4053430 - RNA, 19 nt, Vaccinia virus
agaacgguagaaacuauac

SEQ ID NO: 4053431 - RNA, 13 nt, Vaccinia virus
agaacguaaauua

SEQ ID NO: 4053432 - RNA, 13 nt, Vaccinia virus
agaacuaacacaa

SEQ ID NO: 4053433 - RNA, 18 nt, Vaccinia virus
agaacucuuuaaacgaua

SEQ ID NO: 4053434 - RNA, 12 nt, Vaccinia virus
agaacucuuuuc

SEQ ID NO: 4053435 - RNA, 22 nt, Vaccinia virus
agaacugauugcaguguucauc

SEQ ID NO: 4053436 - RNA, 24 nt, Vaccinia virus
agaacugccauauguuggagauac

SEQ ID NO: 4053437 - RNA, 21 nt, Vaccinia virus
agaacuguuuuagaagucaag

SEQ ID NO: 4053438 - RNA, 18 nt, Vaccinia virus
agaacuuacgauacaucu

SEQ ID NO: 4053439 - RNA, 22 nt, Vaccinia virus
agaacuuaugaccgugauaaaa

SEQ ID NO: 4053440 - RNA, 23 nt, Vaccinia virus
agaagaauucaagucaggaacua

SEQ ID NO: 4053441 - RNA, 21 nt, Vaccinia virus
agaagagucauuaaaauaugc

SEQ ID NO: 4053442 - RNA, 19 nt, Vaccinia virus
agaaguaacgccauauuac

SEQ ID NO: 4053443 - RNA, 16 nt, Vaccinia virus
agaagucgucaagcau

SEQ ID NO: 4053444 - RNA, 17 nt, Vaccinia virus
agaaguuauagaaugua

SEQ ID NO: 4053445 - RNA, 12 nt, Vaccinia virus
agaaguuauuau

SEQ ID NO: 4053446 - RNA, 15 nt, Vaccinia virus
agaaguuguaaauga

SEQ ID NO: 4053447 - RNA, 14 nt, Vaccinia virus
agaaguuuuauccu

SEQ ID NO: 4053448 - RNA, 18 nt, Vaccinia virus
agaaguuuucccaaaaaa

SEQ ID NO: 4053449 - RNA, 21 nt, Vaccinia virus
agaauaaaaugcuaaugucaa

SEQ ID NO: 4053450 - RNA, 16 nt, Vaccinia virus
agaauaagaucaagau

SEQ ID NO: 4053451 - RNA, 14 nt, Vaccinia virus
agaauaauaugacu

SEQ ID NO: 4053452 - RNA, 15 nt, Vaccinia virus
agaauacgccaagga

SEQ ID NO: 4053453 - RNA, 16 nt, Vaccinia virus
agaauacugaucuucu

SEQ ID NO: 4053454 - RNA, 23 nt, Vaccinia virus
agaauauaaauuauauauggauu

SEQ ID NO: 4053455 - RNA, 21 nt, Vaccinia virus
agaauauacucaauagaauuu

SEQ ID NO: 4053456 - RNA, 12 nt, Vaccinia virus
agaauauacucu

SEQ ID NO: 4053457 - RNA, 13 nt, Vaccinia virus
agaauauauguuu

SEQ ID NO: 4053458 - RNA, 17 nt, Vaccinia virus
agaauauccucuagaga

SEQ ID NO: 4053459 - RNA, 18 nt, Vaccinia virus
agaauauguauaucaauu

SEQ ID NO: 4053460 - RNA, 21 nt, Vaccinia virus
agaauaugucucuuaacuauu

SEQ ID NO: 4053461 - RNA, 18 nt, Vaccinia virus
agaaucagaaucauacaa

SEQ ID NO: 4053462 - RNA, 23 nt, Vaccinia virus
agaaucagcgucguuuaacacaa

SEQ ID NO: 4053463 - RNA, 18 nt, Vaccinia virus
agaaucauacaaugaauu

SEQ ID NO: 4053464 - RNA, 20 nt, Vaccinia virus
agaaucauugcuguaaacaa

SEQ ID NO: 4053465 - RNA, 18 nt, Vaccinia virus
agaauccacaacagacga

SEQ ID NO: 4053466 - RNA, 19 nt, Vaccinia virus
agaauccaucaguuguuaa

SEQ ID NO: 4053467 - RNA, 21 nt, Vaccinia virus
agaauccuaacuauucaucca

SEQ ID NO: 4053468 - RNA, 15 nt, Vaccinia virus
agaaucguaauggau

SEQ ID NO: 4053469 - RNA, 16 nt, Vaccinia virus
agaaugcauacugucu

SEQ ID NO: 4053470 - RNA, 17 nt, Vaccinia virus
agaaugcuucagaauua

SEQ ID NO: 4053471 - RNA, 21 nt, Vaccinia virus
agaauggaaaggaaacuaucu

SEQ ID NO: 4053472 - RNA, 18 nt, Vaccinia virus
agaauguuccuaauguau

SEQ ID NO: 4053473 - RNA, 13 nt, Vaccinia virus
agaauguuuacca

SEQ ID NO: 4053474 - RNA, 15 nt, Vaccinia virus
agaauuaacuaguau

SEQ ID NO: 4053475 - RNA, 19 nt, Vaccinia virus
agaauuaaugggaacuauu

SEQ ID NO: 4053476 - RNA, 15 nt, Vaccinia virus
agaauucaacuauau

SEQ ID NO: 4053477 - RNA, 13 nt, Vaccinia virus
agaauuguaacuu

SEQ ID NO: 4053478 - RNA, 21 nt, Vaccinia virus
agaauuuaccagauaucuucu

SEQ ID NO: 4053479 - RNA, 21 nt, Vaccinia virus
agaauuucuacauaauuauau

SEQ ID NO: 4053480 - RNA, 15 nt, Vaccinia virus
agaauuuucauggau

SEQ ID NO: 4053481 - RNA, 22 nt, Vaccinia virus
agaauuuuuauaaauuuuucca

SEQ ID NO: 4053482 - RNA, 22 nt, Vaccinia virus
agaauuuuuucguguuccaaac

SEQ ID NO: 4053483 - RNA, 17 nt, Vaccinia virus
agacaaacgcugauaga

SEQ ID NO: 4053484 - RNA, 18 nt, Vaccinia virus
agacaaugcuaauauauu

SEQ ID NO: 4053485 - RNA, 17 nt, Vaccinia virus
agacaauugacaaaauu

SEQ ID NO: 4053486 - RNA, 11 nt, Vaccinia virus
agacacaucug

SEQ ID NO: 4053487 - RNA, 22 nt, Vaccinia virus
agacacaucugccauagauuua

SEQ ID NO: 4053488 - RNA, 20 nt, Vaccinia virus
agacacuaacucuguuuuau

SEQ ID NO: 4053489 - RNA, 22 nt, Vaccinia virus
agacaugauaauauuaaagaua

SEQ ID NO: 4053490 - RNA, 14 nt, Vaccinia virus
agacauuaauagaa

SEQ ID NO: 4053491 - RNA, 19 nt, Vaccinia virus
agaccgucuacaaaaaacu

SEQ ID NO: 4053492 - RNA, 22 nt, Vaccinia virus
agacgacucgagccuuuauuau

SEQ ID NO: 4053493 - RNA, 17 nt, Vaccinia virus
agacgccugauauguag

SEQ ID NO: 4053494 - RNA, 23 nt, Vaccinia virus
agacgcuauggcacgaaauaucu

SEQ ID NO: 4053495 - RNA, 19 nt, Vaccinia virus
agacggagucauaacuauu

SEQ ID NO: 4053496 - RNA, 18 nt, Vaccinia virus
agacggauaagaaauaua

SEQ ID NO: 4053497 - RNA, 23 nt, Vaccinia virus
agacgucaauaucugauuauuau

SEQ ID NO: 4053498 - RNA, 13 nt, Vaccinia virus
agacguuguacaa

SEQ ID NO: 4053499 - RNA, 17 nt, Vaccinia virus
agacuacaauauauucu

SEQ ID NO: 4053500 - RNA, 17 nt, Vaccinia virus
agacuacgaaacugaua

SEQ ID NO: 4053501 - RNA, 18 nt, Vaccinia virus
agacuacguagacuguuu

SEQ ID NO: 4053502 - RNA, 20 nt, Vaccinia virus
agacuaggugcuauggaugg

SEQ ID NO: 4053503 - RNA, 14 nt, Vaccinia virus
agacuccugguaau

SEQ ID NO: 4053504 - RNA, 20 nt, Vaccinia virus
agacuuuauaauuucaucua

SEQ ID NO: 4053505 - RNA, 19 nt, Vaccinia virus
agacuuugccacaacagaa

SEQ ID NO: 4053506 - RNA, 13 nt, Vaccinia virus
agacuuuguagaa

SEQ ID NO: 4053507 - RNA, 13 nt, Vaccinia virus
agagaaauauauu

SEQ ID NO: 4053508 - RNA, 20 nt, Vaccinia virus
agagaggcugcugaaaauaa

SEQ ID NO: 4053509 - RNA, 22 nt, Vaccinia virus
agagcuaccgaaggagauacua

SEQ ID NO: 4053510 - RNA, 22 nt, Vaccinia virus
agagcuacuaacguauaauucu

SEQ ID NO: 4053511 - RNA, 12 nt, Vaccinia virus
agaggaaauauc

SEQ ID NO: 4053512 - RNA, 13 nt, Vaccinia virus
agaggaagaagau

SEQ ID NO: 4053513 - RNA, 12 nt, Vaccinia virus
agaggagaagua

SEQ ID NO: 4053514 - RNA, 16 nt, Vaccinia virus
agaggaguuauuuacu

SEQ ID NO: 4053515 - RNA, 17 nt, Vaccinia virus
agaggcauaaucaaugu

SEQ ID NO: 4053516 - RNA, 14 nt, Vaccinia virus
agaggccaucugga

SEQ ID NO: 4053517 - RNA, 22 nt, Vaccinia virus
agagguucccaauuccaaagau

SEQ ID NO: 4053518 - RNA, 21 nt, Vaccinia virus
agaguaaccccauauaaugua

SEQ ID NO: 4053519 - RNA, 20 nt, Vaccinia virus
agaguaguaucauuaaaucu

SEQ ID NO: 4053520 - RNA, 20 nt, Vaccinia virus
agaguuaucaagagaaaauu

SEQ ID NO: 4053521 - RNA, 19 nt, Vaccinia virus
agaguuuuauucucauuau

SEQ ID NO: 4053522 - RNA, 20 nt, Vaccinia virus
agcgagaaauaaucauaaau

SEQ ID NO: 4053523 - RNA, 22 nt, Vaccinia virus
agcgcuuaaucucaaaauaugu

SEQ ID NO: 4053524 - RNA, 13 nt, Vaccinia virus
agcggaugaaaaa

SEQ ID NO: 4053525 - RNA, 22 nt, Vaccinia virus
agcguagaaguuguaaaugaca

SEQ ID NO: 4053526 - RNA, 23 nt, Vaccinia virus
agcguauaucucuauuaaaugcg

SEQ ID NO: 4053527 - RNA, 15 nt, Vaccinia virus
agcuaaaaaugccac

SEQ ID NO: 4053528 - RNA, 21 nt, Vaccinia virus
agcuaaugaugcggauauugu

SEQ ID NO: 4053529 - RNA, 19 nt, Vaccinia virus
agcuauaauaauaaaugua

SEQ ID NO: 4053530 - RNA, 22 nt, Vaccinia virus
agcuauagcauuguuauguauu

SEQ ID NO: 4053531 - RNA, 16 nt, Vaccinia virus
agcuaucgucucugga

SEQ ID NO: 4053532 - RNA, 21 nt, Vaccinia virus
agcuauguuaucaugaaaugu

SEQ ID NO: 4053533 - RNA, 14 nt, Vaccinia virus
agcuauuaaacugu

SEQ ID NO: 4053534 - RNA, 16 nt, Vaccinia virus
agcuauuuaaaugggu

SEQ ID NO: 4053535 - RNA, 18 nt, Vaccinia virus
agcucaauauaaaugcgu

SEQ ID NO: 4053536 - RNA, 19 nt, Vaccinia virus
agcucauaugauuucagua

SEQ ID NO: 4053537 - RNA, 14 nt, Vaccinia virus
agcucaucuaaaaa

SEQ ID NO: 4053538 - RNA, 16 nt, Vaccinia virus
agcucuuaguauggga

SEQ ID NO: 4053539 - RNA, 21 nt, Vaccinia virus
agcuggauaucaguagaugca

SEQ ID NO: 4053540 - RNA, 18 nt, Vaccinia virus
agcuguacaccauagcac

SEQ ID NO: 4053541 - RNA, 18 nt, Vaccinia virus
agcugugguguaaucuua

SEQ ID NO: 4053542 - RNA, 21 nt, Vaccinia virus
agcuguucaagaauauacaag

SEQ ID NO: 4053543 - RNA, 17 nt, Vaccinia virus
agcuuacaauaaacucc

SEQ ID NO: 4053544 - RNA, 18 nt, Vaccinia virus
agcuuccagauuuaaaaa

SEQ ID NO: 4053545 - RNA, 15 nt, Vaccinia virus
aggaaauaaaucaua

SEQ ID NO: 4053546 - RNA, 22 nt, Vaccinia virus
aggaaauauccucacaacuuaa

SEQ ID NO: 4053547 - RNA, 15 nt, Vaccinia virus
aggaaauuaugagaa

SEQ ID NO: 4053548 - RNA, 22 nt, Vaccinia virus
aggaaauuaugagaaugagauu

SEQ ID NO: 4053549 - RNA, 14 nt, Vaccinia virus
aggaacauaaacaa

SEQ ID NO: 4053550 - RNA, 23 nt, Vaccinia virus
aggaacauuaucaauuuuuacau

SEQ ID NO: 4053551 - RNA, 16 nt, Vaccinia virus
aggaaguauaucugag

SEQ ID NO: 4053552 - RNA, 18 nt, Vaccinia virus
aggaauaaaauaugaaau

SEQ ID NO: 4053553 - RNA, 13 nt, Vaccinia virus
aggaauaucugau

SEQ ID NO: 4053554 - RNA, 22 nt, Vaccinia virus
aggaaucuauuaaagauuguuu

SEQ ID NO: 4053555 - RNA, 15 nt, Vaccinia virus
aggacguaacuauaa

SEQ ID NO: 4053556 - RNA, 23 nt, Vaccinia virus
aggacuauuguuacaaaaguuaa

SEQ ID NO: 4053557 - RNA, 22 nt, Vaccinia virus
aggacugaguaccgauaucacu

SEQ ID NO: 4053558 - RNA, 19 nt, Vaccinia virus
aggacuuuguagaaauauu

SEQ ID NO: 4053559 - RNA, 17 nt, Vaccinia virus
aggagaaggaaaaugaa

SEQ ID NO: 4053560 - RNA, 14 nt, Vaccinia virus
aggagauauugaaa

SEQ ID NO: 4053561 - RNA, 23 nt, Vaccinia virus
aggagauuuaguauuuagcagug

SEQ ID NO: 4053562 - RNA, 14 nt, Vaccinia virus
aggagcauacagua

SEQ ID NO: 4053563 - RNA, 14 nt, Vaccinia virus
aggauacuuuguaa

SEQ ID NO: 4053564 - RNA, 14 nt, Vaccinia virus
aggauagcaaaaua

SEQ ID NO: 4053565 - RNA, 19 nt, Vaccinia virus
aggauauaaguagauguuc

SEQ ID NO: 4053566 - RNA, 22 nt, Vaccinia virus
aggauauuuguucgacuuugug

SEQ ID NO: 4053567 - RNA, 21 nt, Vaccinia virus
aggaucuacguucauauguau

SEQ ID NO: 4053568 - RNA, 16 nt, Vaccinia virus
aggaugacucucaaau

SEQ ID NO: 4053569 - RNA, 18 nt, Vaccinia virus
aggaugcauuaucauuau

SEQ ID NO: 4053570 - RNA, 22 nt, Vaccinia virus
aggauggguuccauaacuaaau

SEQ ID NO: 4053571 - RNA, 15 nt, Vaccinia virus
aggauugauggugaa

SEQ ID NO: 4053572 - RNA, 17 nt, Vaccinia virus
aggauuguauaaauuac

SEQ ID NO: 4053573 - RNA, 23 nt, Vaccinia virus
aggauuuaaacaaaaaaguuauc

SEQ ID NO: 4053574 - RNA, 20 nt, Vaccinia virus
aggcaauagcgacauaaaca

SEQ ID NO: 4053575 - RNA, 20 nt, Vaccinia virus
aggcaauguauauuuaucca

SEQ ID NO: 4053576 - RNA, 14 nt, Vaccinia virus
aggcauaaaaugua

SEQ ID NO: 4053577 - RNA, 17 nt, Vaccinia virus
aggcauguugauggaaa

SEQ ID NO: 4053578 - RNA, 17 nt, Vaccinia virus
aggccaaaacaaaauuu

SEQ ID NO: 4053579 - RNA, 15 nt, Vaccinia virus
aggccaaagaaauga

SEQ ID NO: 4053580 - RNA, 14 nt, Vaccinia virus
aggcgucaaagaua

SEQ ID NO: 4053581 - RNA, 17 nt, Vaccinia virus
aggcucaguauguaaac

SEQ ID NO: 4053582 - RNA, 12 nt, Vaccinia virus
agggaaaaugaa

SEQ ID NO: 4053583 - RNA, 12 nt, Vaccinia virus
agggaauuauug

SEQ ID NO: 4053584 - RNA, 16 nt, Vaccinia virus
agggauuuuauaugau

SEQ ID NO: 4053585 - RNA, 16 nt, Vaccinia virus
agggcuaaaugucuag

SEQ ID NO: 4053586 - RNA, 15 nt, Vaccinia virus
aggggaaaaauuaua

SEQ ID NO: 4053587 - RNA, 20 nt, Vaccinia virus
aggggaacccaucaaagaua

SEQ ID NO: 4053588 - RNA, 16 nt, Vaccinia virus
aggggaugaaucauug

SEQ ID NO: 4053589 - RNA, 18 nt, Vaccinia virus
aggggauuggcauuuaac

SEQ ID NO: 4053590 - RNA, 21 nt, Vaccinia virus
aggguauauccaucacuaaaa

SEQ ID NO: 4053591 - RNA, 14 nt, Vaccinia virus
agguaaauguaaau

SEQ ID NO: 4053592 - RNA, 20 nt, Vaccinia virus
agguacuauaauauuaaaaa

SEQ ID NO: 4053593 - RNA, 18 nt, Vaccinia virus
agguauacacaaaaagaa

SEQ ID NO: 4053594 - RNA, 16 nt, Vaccinia virus
agguauauuuauucca

SEQ ID NO: 4053595 - RNA, 19 nt, Vaccinia virus
agguauguaccacauacug

SEQ ID NO: 4053596 - RNA, 13 nt, Vaccinia virus
aggucgcaaaaaa

SEQ ID NO: 4053597 - RNA, 17 nt, Vaccinia virus
agguguguuuuuuacca

SEQ ID NO: 4053598 - RNA, 17 nt, Vaccinia virus
agguuucauauuuauca

SEQ ID NO: 4053599 - RNA, 16 nt, Vaccinia virus
aguaaaaauaacuaga

SEQ ID NO: 4053600 - RNA, 14 nt, Vaccinia virus
aguaaaaucuauca

SEQ ID NO: 4053601 - RNA, 20 nt, Vaccinia virus
aguaaagauuucaaagaugu

SEQ ID NO: 4053602 - RNA, 14 nt, Vaccinia virus
aguaaaguaaacaa

SEQ ID NO: 4053603 - RNA, 17 nt, Vaccinia virus
aguaaaugaaaaaaaac

SEQ ID NO: 4053604 - RNA, 14 nt, Vaccinia virus
aguaaauucaagau

SEQ ID NO: 4053605 - RNA, 19 nt, Vaccinia virus
aguaacgcguggaaaaagc

SEQ ID NO: 4053606 - RNA, 19 nt, Vaccinia virus
aguaacuauugacuuaaua

SEQ ID NO: 4053607 - RNA, 18 nt, Vaccinia virus
aguaaguaucuuauguau

SEQ ID NO: 4053608 - RNA, 15 nt, Vaccinia virus
aguaauaaaucaacu

SEQ ID NO: 4053609 - RNA, 18 nt, Vaccinia virus
aguaauggcggaaaacuu

SEQ ID NO: 4053610 - RNA, 20 nt, Vaccinia virus
aguaauggguuauuguggau

SEQ ID NO: 4053611 - RNA, 16 nt, Vaccinia virus
aguaaugguauguauu

SEQ ID NO: 4053612 - RNA, 15 nt, Vaccinia virus
aguaauuacauagau

SEQ ID NO: 4053613 - RNA, 19 nt, Vaccinia virus
aguaauuauaagaaauaua

SEQ ID NO: 4053614 - RNA, 18 nt, Vaccinia virus
aguaauucagacacuucu

SEQ ID NO: 4053615 - RNA, 15 nt, Vaccinia virus
aguaauuuuuuauca

SEQ ID NO: 4053616 - RNA, 20 nt, Vaccinia virus
aguacacuccguuuaauaaa

SEQ ID NO: 4053617 - RNA, 18 nt, Vaccinia virus
aguacagaauuaauuaga

SEQ ID NO: 4053618 - RNA, 16 nt, Vaccinia virus
aguacaucuacuauau

SEQ ID NO: 4053619 - RNA, 15 nt, Vaccinia virus
aguacaucuaucacc

SEQ ID NO: 4053620 - RNA, 13 nt, Vaccinia virus
aguacggauuaaa

SEQ ID NO: 4053621 - RNA, 21 nt, Vaccinia virus
aguacugcuuuuuucgaaaug

SEQ ID NO: 4053622 - RNA, 17 nt, Vaccinia virus
aguagaaauuaucaaau

SEQ ID NO: 4053623 - RNA, 18 nt, Vaccinia virus
aguagaaauuccguugga

SEQ ID NO: 4053624 - RNA, 19 nt, Vaccinia virus
aguagccagacaaaugguc

SEQ ID NO: 4053625 - RNA, 18 nt, Vaccinia virus
aguaggauauauuaaagu

SEQ ID NO: 4053626 - RNA, 13 nt, Vaccinia virus
aguauaaaaauua

SEQ ID NO: 4053627 - RNA, 18 nt, Vaccinia virus
aguauaaaacauuaaaug

SEQ ID NO: 4053628 - RNA, 19 nt, Vaccinia virus
aguauaaacacgaauacua

SEQ ID NO: 4053629 - RNA, 21 nt, Vaccinia virus
aguauacacgcuaaaauaacu

SEQ ID NO: 4053630 - RNA, 17 nt, Vaccinia virus
aguauaccaaacauagu

SEQ ID NO: 4053631 - RNA, 13 nt, Vaccinia virus
aguaucaaacucu

SEQ ID NO: 4053632 - RNA, 15 nt, Vaccinia virus
aguaucaaaucuucu

SEQ ID NO: 4053633 - RNA, 20 nt, Vaccinia virus
aguaucaacaaucaacuaau

SEQ ID NO: 4053634 - RNA, 17 nt, Vaccinia virus
aguaugaagaaaaaugu

SEQ ID NO: 4053635 - RNA, 21 nt, Vaccinia virus
aguaugaguaagauaguguuu

SEQ ID NO: 4053636 - RNA, 16 nt, Vaccinia virus
aguauggagacauuga

SEQ ID NO: 4053637 - RNA, 17 nt, Vaccinia virus
aguauggagacauugau

SEQ ID NO: 4053638 - RNA, 23 nt, Vaccinia virus
aguauguuaguggacuugucaaa

SEQ ID NO: 4053639 - RNA, 18 nt, Vaccinia virus
aguauuaaauauuaauaa

SEQ ID NO: 4053640 - RNA, 22 nt, Vaccinia virus
aguauuaucaacguaacuauau

SEQ ID NO: 4053641 - RNA, 14 nt, Vaccinia virus
auauagaugucaau

SEQ ID NO: 4053642 - RNA, 15 nt, Vaccinia virus
auauagguuacuaga

SEQ ID NO: 4053643 - RNA, 14 nt, Vaccinia virus
auauaguaaugaag

SEQ ID NO: 4053644 - RNA, 18 nt, Vaccinia virus
auauagugaaacaaaaua

SEQ ID NO: 4053645 - RNA, 23 nt, Vaccinia virus
auauaguguugcuaucucuugcg

SEQ ID NO: 4053646 - RNA, 13 nt, Vaccinia virus
auauaguuauaga

SEQ ID NO: 4053647 - RNA, 13 nt, Vaccinia virus
auauauaaugaau

SEQ ID NO: 4053648 - RNA, 16 nt, Vaccinia virus
auauauaguauuaaug

SEQ ID NO: 4053649 - RNA, 13 nt, Vaccinia virus
auauaucaaacau

SEQ ID NO: 4053650 - RNA, 21 nt, Vaccinia virus
auauaucuacuucuuccacug

SEQ ID NO: 4053651 - RNA, 12 nt, Vaccinia virus
auauaugcauua

SEQ ID NO: 4053652 - RNA, 16 nt, Vaccinia virus
auauauggauaaugcu

SEQ ID NO: 4053653 - RNA, 18 nt, Vaccinia virus
auauauguucgcuauugu

SEQ ID NO: 4053654 - RNA, 16 nt, Vaccinia virus
auauauuaaaaaaugu

SEQ ID NO: 4053655 - RNA, 13 nt, Vaccinia virus
auauauuaaacaa

SEQ ID NO: 4053656 - RNA, 16 nt, Vaccinia virus
auauauuaagaaguuc

SEQ ID NO: 4053657 - RNA, 13 nt, Vaccinia virus
auauauuagaaau

SEQ ID NO: 4053658 - RNA, 22 nt, Vaccinia virus
auauauugcaaaucacucaaua

SEQ ID NO: 4053659 - RNA, 22 nt, Vaccinia virus
auauauugcuuacuagauguug

SEQ ID NO: 4053660 - RNA, 18 nt, Vaccinia virus
auauauuguagauaagaa

SEQ ID NO: 4053661 - RNA, 21 nt, Vaccinia virus
auauauuguuucauaauugcu

SEQ ID NO: 4053662 - RNA, 15 nt, Vaccinia virus
auauauuuauuuuca

SEQ ID NO: 4053663 - RNA, 18 nt, Vaccinia virus
auauauuucuuagcuaga

SEQ ID NO: 4053664 - RNA, 21 nt, Vaccinia virus
auauauuuuccaugaaaucaa

SEQ ID NO: 4053665 - RNA, 12 nt, Vaccinia virus
auaucaauuagu

SEQ ID NO: 4053666 - RNA, 17 nt, Vaccinia virus
auaucacauuguauaua

SEQ ID NO: 4053667 - RNA, 18 nt, Vaccinia virus
auaucagacagcauggug

SEQ ID NO: 4053668 - RNA, 20 nt, Vaccinia virus
auaucagccgcacuagcauc

SEQ ID NO: 4053669 - RNA, 14 nt, Vaccinia virus
auaucauacaugau

SEQ ID NO: 4053670 - RNA, 14 nt, Vaccinia virus
auaucaucaaacaa

SEQ ID NO: 4053671 - RNA, 16 nt, Vaccinia virus
auaucaucuacauaau

SEQ ID NO: 4053672 - RNA, 22 nt, Vaccinia virus
auaucaucuuuucacuaaauaa

SEQ ID NO: 4053673 - RNA, 17 nt, Vaccinia virus
auaucaugaagagaugu

SEQ ID NO: 4053674 - RNA, 23 nt, Vaccinia virus
auaucauuaggauuuaacuccuu

SEQ ID NO: 4053675 - RNA, 13 nt, Vaccinia virus
auauccaaaauuu

SEQ ID NO: 4053676 - RNA, 17 nt, Vaccinia virus
auauccgcuauuacaag

SEQ ID NO: 4053677 - RNA, 19 nt, Vaccinia virus
auauccguuaaguuuguau

SEQ ID NO: 4053678 - RNA, 22 nt, Vaccinia virus
auauccuuuagaguauuucuca

SEQ ID NO: 4053679 - RNA, 19 nt, Vaccinia virus
auauccuuugcauucuauu

SEQ ID NO: 4053680 - RNA, 19 nt, Vaccinia virus
auaucgagaucuuuuguau

SEQ ID NO: 4053681 - RNA, 17 nt, Vaccinia virus
auaucggaauaaguaga

SEQ ID NO: 4053682 - RNA, 17 nt, Vaccinia virus
auaucggucuuauucuu

SEQ ID NO: 4053683 - RNA, 16 nt, Vaccinia virus
auaucuaauuucugua

SEQ ID NO: 4053684 - RNA, 16 nt, Vaccinia virus
auaucuacuagaaaga

SEQ ID NO: 4053685 - RNA, 19 nt, Vaccinia virus
auaucuagacuuucuguua

SEQ ID NO: 4053686 - RNA, 19 nt, Vaccinia virus
auaucuagcaaaaauucua

SEQ ID NO: 4053687 - RNA, 21 nt, Vaccinia virus
auaucugaaacaaagaauugu

SEQ ID NO: 4053688 - RNA, 16 nt, Vaccinia virus
auaucugaguaugaug

SEQ ID NO: 4053689 - RNA, 21 nt, Vaccinia virus
auaucugaugagaucaauaga

SEQ ID NO: 4053690 - RNA, 19 nt, Vaccinia virus
auaucuggaaagaaaucua

SEQ ID NO: 4053691 - RNA, 22 nt, Vaccinia virus
auaucuuaaauaacucauuuau

SEQ ID NO: 4053692 - RNA, 13 nt, Vaccinia virus
auaucuuauucca

SEQ ID NO: 4053693 - RNA, 15 nt, Vaccinia virus
auaucuuguucuaug

SEQ ID NO: 4053694 - RNA, 23 nt, Vaccinia virus
auaucuuguuuagaaaaaugcua

SEQ ID NO: 4053695 - RNA, 21 nt, Vaccinia virus
auaucuuugguguaaaguuaa

SEQ ID NO: 4053696 - RNA, 17 nt, Vaccinia virus
auaucuuuuugaauugu

SEQ ID NO: 4053697 - RNA, 21 nt, Vaccinia virus
auaugaaaaacaugucucucu

SEQ ID NO: 4053698 - RNA, 19 nt, Vaccinia virus
auaugaacagacauuguau

SEQ ID NO: 4053699 - RNA, 23 nt, Vaccinia virus
auaugacgacuucaaucaaacaa

SEQ ID NO: 4053700 - RNA, 19 nt, Vaccinia virus
auaugacggacauuccauu

SEQ ID NO: 4053701 - RNA, 16 nt, Vaccinia virus
auaugagaaugaauau

SEQ ID NO: 4053702 - RNA, 13 nt, Vaccinia virus
auaugaugaaugg

SEQ ID NO: 4053703 - RNA, 17 nt, Vaccinia virus
auaugcaaagucuaaau

SEQ ID NO: 4053704 - RNA, 22 nt, Vaccinia virus
auaugcaaauagagcaauuacu

SEQ ID NO: 4053705 - RNA, 19 nt, Vaccinia virus
auaugccagaacuauuuuu

SEQ ID NO: 4053706 - RNA, 23 nt, Vaccinia virus
auaugccgugggaugaugucaaa

SEQ ID NO: 4053707 - RNA, 17 nt, Vaccinia virus
auaugccuccagaaguu

SEQ ID NO: 4053708 - RNA, 21 nt, Vaccinia virus
auaugcucauauauuuauaga

SEQ ID NO: 4053709 - RNA, 19 nt, Vaccinia virus
auaugcuuuuauuuuugga

SEQ ID NO: 4053710 - RNA, 22 nt, Vaccinia virus
auauguauucgucuuucugaau

SEQ ID NO: 4053711 - RNA, 13 nt, Vaccinia virus
auauguauuuccu

SEQ ID NO: 4053712 - RNA, 17 nt, Vaccinia virus
auauguauuuucuuucc

SEQ ID NO: 4053713 - RNA, 17 nt, Vaccinia virus
auaugucuguacaaaug

SEQ ID NO: 4053714 - RNA, 23 nt, Vaccinia virus
auauguguuuacaguaguaauga

SEQ ID NO: 4053715 - RNA, 21 nt, Vaccinia virus
auauguuuuaauauuuacaag

SEQ ID NO: 4053716 - RNA, 20 nt, Vaccinia virus
auauuaaaaauucacacauu

SEQ ID NO: 4053717 - RNA, 23 nt, Vaccinia virus
auauuaacgcguuuuaugaauga

SEQ ID NO: 4053718 - RNA, 22 nt, Vaccinia virus
auauuaauacacauaaugaagu

SEQ ID NO: 4053719 - RNA, 20 nt, Vaccinia virus
auauuacaaacuauagaaau

SEQ ID NO: 4053720 - RNA, 15 nt, Vaccinia virus
auauuacaaauacuu

SEQ ID NO: 4053721 - RNA, 18 nt, Vaccinia virus
auauuaccaguuguggaa

SEQ ID NO: 4053722 - RNA, 19 nt, Vaccinia virus
auauuacuaaacacacauu

SEQ ID NO: 4053723 - RNA, 18 nt, Vaccinia virus
auauuacuaauugauaga

SEQ ID NO: 4053724 - RNA, 20 nt, Vaccinia virus
auauuacuauuggcaauugu

SEQ ID NO: 4053725 - RNA, 13 nt, Vaccinia virus
auauuagaauuua

SEQ ID NO: 4053726 - RNA, 13 nt, Vaccinia virus
auauuagauuuac

SEQ ID NO: 4053727 - RNA, 21 nt, Vaccinia virus
auauuaggcacagucaaacau

SEQ ID NO: 4053728 - RNA, 22 nt, Vaccinia virus
auauuaggcacagucaaacauu

SEQ ID NO: 4053729 - RNA, 17 nt, Vaccinia virus
auauuaguauguuauau

SEQ ID NO: 4053730 - RNA, 18 nt, Vaccinia virus
auauuagugaugaauuga

SEQ ID NO: 4053731 - RNA, 15 nt, Vaccinia virus
auauuauacaaaaua

SEQ ID NO: 4053732 - RNA, 18 nt, Vaccinia virus
auauuaucaccuauugcc

SEQ ID NO: 4053733 - RNA, 16 nt, Vaccinia virus
auauuaucguuuguaa

SEQ ID NO: 4053734 - RNA, 15 nt, Vaccinia virus
auauuauuaaucauu

SEQ ID NO: 4053735 - RNA, 13 nt, Vaccinia virus
auauuauuacaca

SEQ ID NO: 4053736 - RNA, 20 nt, Vaccinia virus
auauuauuacacauaaacau

SEQ ID NO: 4053737 - RNA, 14 nt, Vaccinia virus
auauuauuaugaag

SEQ ID NO: 4053738 - RNA, 20 nt, Vaccinia virus
auauuauuuuuauguuuuau

SEQ ID NO: 4053739 - RNA, 17 nt, Vaccinia virus
auauucaacauguuuaa

SEQ ID NO: 4053740 - RNA, 20 nt, Vaccinia virus
auauucaguaaccaaauaca

SEQ ID NO: 4053741 - RNA, 16 nt, Vaccinia virus
auauucaguuuauaga

SEQ ID NO: 4053742 - RNA, 17 nt, Vaccinia virus
auauuccaagaucaaaa

SEQ ID NO: 4053743 - RNA, 18 nt, Vaccinia virus
auauuccaagaucaaaag

SEQ ID NO: 4053744 - RNA, 21 nt, Vaccinia virus
auauuccgguuugcaaaacaa

SEQ ID NO: 4053745 - RNA, 20 nt, Vaccinia virus
auauucgaaauuagaaagua

SEQ ID NO: 4053746 - RNA, 19 nt, Vaccinia virus
auauucuaacgauaauaga

SEQ ID NO: 4053747 - RNA, 21 nt, Vaccinia virus
auauucugccguguuuaaaga

SEQ ID NO: 4053748 - RNA, 14 nt, Vaccinia virus
auauucuguucuau

SEQ ID NO: 4053749 - RNA, 11 nt, Vaccinia virus
auauucuuucu

SEQ ID NO: 4053750 - RNA, 21 nt, Vaccinia virus
auauuguacgauguaauacua

SEQ ID NO: 4053751 - RNA, 19 nt, Vaccinia virus
auauuguacgguagaauug

SEQ ID NO: 4053752 - RNA, 20 nt, Vaccinia virus
auauuguacgguagaauuga

SEQ ID NO: 4053753 - RNA, 19 nt, Vaccinia virus
auauuguucuuaauagaca

SEQ ID NO: 4053754 - RNA, 18 nt, Vaccinia virus
auauuuacaguuacuaaa

SEQ ID NO: 4053755 - RNA, 16 nt, Vaccinia virus
auauuucuauuucuau

SEQ ID NO: 4053756 - RNA, 12 nt, Vaccinia virus
auauuucugaag

SEQ ID NO: 4053757 - RNA, 14 nt, Vaccinia virus
auauuucuggaaug

SEQ ID NO: 4053758 - RNA, 13 nt, Vaccinia virus
auauuugaaaauc

SEQ ID NO: 4053759 - RNA, 17 nt, Vaccinia virus
auauuugcacacauaau

SEQ ID NO: 4053760 - RNA, 19 nt, Vaccinia virus
auauuugugaaaaauauua

SEQ ID NO: 4053761 - RNA, 22 nt, Vaccinia virus
auauuuguuauuuuuucuguaa

SEQ ID NO: 4053762 - RNA, 12 nt, Vaccinia virus
auauuuuaauga

SEQ ID NO: 4053763 - RNA, 14 nt, Vaccinia virus
auauuuugcagcca

SEQ ID NO: 4053764 - RNA, 18 nt, Vaccinia virus
auauuuuuuuaguaaugu

SEQ ID NO: 4053765 - RNA, 12 nt, Vaccinia virus
aucaaaaaauua

SEQ ID NO: 4053766 - RNA, 13 nt, Vaccinia virus
aucaaaaaauuac

SEQ ID NO: 4053767 - RNA, 13 nt, Vaccinia virus
aucaaaaaguaag

SEQ ID NO: 4053768 - RNA, 14 nt, Vaccinia virus
aucaaaagaaaucu

SEQ ID NO: 4053769 - RNA, 21 nt, Vaccinia virus
aucaaaauagcaaaguaacga

SEQ ID NO: 4053770 - RNA, 22 nt, Vaccinia virus
aucaaacaaaaaagcucaauaa

SEQ ID NO: 4053771 - RNA, 17 nt, Vaccinia virus
aucaaacaggagacuau

SEQ ID NO: 4053772 - RNA, 19 nt, Vaccinia virus
aucaaagauuaauacauua

SEQ ID NO: 4053773 - RNA, 13 nt, Vaccinia virus
aucaaauacuuca

SEQ ID NO: 4053774 - RNA, 18 nt, Vaccinia virus
aucaaaucauugauacau

SEQ ID NO: 4053775 - RNA, 23 nt, Vaccinia virus
aucaaaucucuaucaucacauau

SEQ ID NO: 4053776 - RNA, 14 nt, Vaccinia virus
aucaacagaaauau

SEQ ID NO: 4053777 - RNA, 16 nt, Vaccinia virus
aucaacagauagcuug

SEQ ID NO: 4053778 - RNA, 16 nt, Vaccinia virus
aucaacaucuuaaaaa

SEQ ID NO: 4053779 - RNA, 20 nt, Vaccinia virus
aucaacggauaaucugaagu

SEQ ID NO: 4053780 - RNA, 14 nt, Vaccinia virus
aucaagaaacauuu

SEQ ID NO: 4053781 - RNA, 19 nt, Vaccinia virus
aucaaggacaguuaaaacu

SEQ ID NO: 4053782 - RNA, 23 nt, Vaccinia virus
aucaaguuggccauuaucgauau

SEQ ID NO: 4053783 - RNA, 22 nt, Vaccinia virus
aucaauaacgcaaucaugauuu

SEQ ID NO: 4053784 - RNA, 20 nt, Vaccinia virus
aucaauaagcauuaugauuu

SEQ ID NO: 4053785 - RNA, 21 nt, Vaccinia virus
aucaauaccaaagaaggaaga

SEQ ID NO: 4053786 - RNA, 12 nt, Vaccinia virus
aucaauagcuua

SEQ ID NO: 4053787 - RNA, 15 nt, Vaccinia virus
aucaauauuauucau

SEQ ID NO: 4053788 - RNA, 20 nt, Vaccinia virus
aucaaucuagcauuucuagc

SEQ ID NO: 4053789 - RNA, 17 nt, Vaccinia virus
aucaaugaguaagacuu

SEQ ID NO: 4053790 - RNA, 18 nt, Vaccinia virus
aucaauuaaauaauuaau

SEQ ID NO: 4053791 - RNA, 17 nt, Vaccinia virus
aucaauuuaucauauau

SEQ ID NO: 4053792 - RNA, 12 nt, Vaccinia virus
aucaauuucaaa

SEQ ID NO: 4053793 - RNA, 15 nt, Vaccinia virus
aucacaaagaaagcu

SEQ ID NO: 4053794 - RNA, 22 nt, Vaccinia virus
aucacaacaucguuuuugauau

SEQ ID NO: 4053795 - RNA, 21 nt, Vaccinia virus
aucacaacaucuauaaaagua

SEQ ID NO: 4053796 - RNA, 19 nt, Vaccinia virus
aucacaagaaguuagaaag

SEQ ID NO: 4053797 - RNA, 21 nt, Vaccinia virus
aucacgaguuuguaaagcuau

SEQ ID NO: 4053798 - RNA, 19 nt, Vaccinia virus
aucacuaugaaacaaaugu

SEQ ID NO: 4053799 - RNA, 13 nt, Vaccinia virus
aucacuucaauaa

SEQ ID NO: 4053800 - RNA, 18 nt, Vaccinia virus
aucagaauaaaucaauau

SEQ ID NO: 4053801 - RNA, 17 nt, Vaccinia virus
aucagacguuguaaauu

SEQ ID NO: 4053802 - RNA, 13 nt, Vaccinia virus
aucagauuaaaau

SEQ ID NO: 4053803 - RNA, 17 nt, Vaccinia virus
aucaggaauccaaagag

SEQ ID NO: 4053804 - RNA, 15 nt, Vaccinia virus
aucagguaaaacaau

SEQ ID NO: 4053805 - RNA, 12 nt, Vaccinia virus
aucaguaucuuc

SEQ ID NO: 4053806 - RNA, 17 nt, Vaccinia virus
aucaguuuuguauucca

SEQ ID NO: 4053807 - RNA, 16 nt, Vaccinia virus
aucauaauaugagaug

SEQ ID NO: 4053808 - RNA, 13 nt, Vaccinia virus
aucauaauauuaa

SEQ ID NO: 4053809 - RNA, 15 nt, Vaccinia virus
aucauaauuaaauua

SEQ ID NO: 4053810 - RNA, 13 nt, Vaccinia virus
aucauaauuacau

SEQ ID NO: 4053811 - RNA, 14 nt, Vaccinia virus
aucauaccuccauc

SEQ ID NO: 4053812 - RNA, 15 nt, Vaccinia virus
aucauacucauauaa

SEQ ID NO: 4053813 - RNA, 11 nt, Vaccinia virus
aucauacuuac

SEQ ID NO: 4053814 - RNA, 22 nt, Vaccinia virus
aucauaguuuuuacacauagau

SEQ ID NO: 4053815 - RNA, 21 nt, Vaccinia virus
aucauauaucugaagauauac

SEQ ID NO: 4053816 - RNA, 14 nt, Vaccinia virus
aucauauucaacau

SEQ ID NO: 4053817 - RNA, 20 nt, Vaccinia virus
aucauauucaucaucaauau

SEQ ID NO: 4053818 - RNA, 16 nt, Vaccinia virus
ccacugucuaaaugua

SEQ ID NO: 4053819 - RNA, 21 nt, Vaccinia virus
ccagaacauugaugagacaau

SEQ ID NO: 4053820 - RNA, 17 nt, Vaccinia virus
ccagaaugaaaaacucu

SEQ ID NO: 4053821 - RNA, 13 nt, Vaccinia virus
ccagauaauaaca

SEQ ID NO: 4053822 - RNA, 20 nt, Vaccinia virus
ccagaugaaugggugucaca

SEQ ID NO: 4053823 - RNA, 15 nt, Vaccinia virus
ccaguacaucuauca

SEQ ID NO: 4053824 - RNA, 12 nt, Vaccinia virus
ccaguauaacac

SEQ ID NO: 4053825 - RNA, 23 nt, Vaccinia virus
ccaguauggaagaggauuuucua

SEQ ID NO: 4053826 - RNA, 14 nt, Vaccinia virus
ccaguauucucgga

SEQ ID NO: 4053827 - RNA, 19 nt, Vaccinia virus
ccagucuuugguaucgaua

SEQ ID NO: 4053828 - RNA, 13 nt, Vaccinia virus
ccauaauaguuua

SEQ ID NO: 4053829 - RNA, 21 nt, Vaccinia virus
ccauaauggcgcuaucuuuca

SEQ ID NO: 4053830 - RNA, 15 nt, Vaccinia virus
ccauaauuuucucuc

SEQ ID NO: 4053831 - RNA, 14 nt, Vaccinia virus
ccauaucaacaucu

SEQ ID NO: 4053832 - RNA, 22 nt, Vaccinia virus
ccauauguuuggagcaaauauc

SEQ ID NO: 4053833 - RNA, 14 nt, Vaccinia virus
ccaucuaacaaaaa

SEQ ID NO: 4053834 - RNA, 15 nt, Vaccinia virus
ccaucucuauguuuc

SEQ ID NO: 4053835 - RNA, 17 nt, Vaccinia virus
ccaugcacguaaacauu

SEQ ID NO: 4053836 - RNA, 15 nt, Vaccinia virus
ccauuaaucacugau

SEQ ID NO: 4053837 - RNA, 17 nt, Vaccinia virus
ccauuagguuaaaugau

SEQ ID NO: 4053838 - RNA, 17 nt, Vaccinia virus
ccauuuuaacaguuucu

SEQ ID NO: 4053839 - RNA, 21 nt, Vaccinia virus
ccauuuuaugcgauguuuaua

SEQ ID NO: 4053840 - RNA, 14 nt, Vaccinia virus
cccaaauaucuuua

SEQ ID NO: 4053841 - RNA, 15 nt, Vaccinia virus
cccaacugcaaguga

SEQ ID NO: 4053842 - RNA, 15 nt, Vaccinia virus
cccacguuuaaacau

SEQ ID NO: 4053843 - RNA, 14 nt, Vaccinia virus
ccccauauaauuuu

SEQ ID NO: 4053844 - RNA, 22 nt, Vaccinia virus
cccgagagaugcgauacaaaag

SEQ ID NO: 4053845 - RNA, 19 nt, Vaccinia virus
ccgaaagaacugauugcag

SEQ ID NO: 4053846 - RNA, 18 nt, Vaccinia virus
ccgacucauuauuuccca

SEQ ID NO: 4053847 - RNA, 16 nt, Vaccinia virus
ccgaggaaacgaaaga

SEQ ID NO: 4053848 - RNA, 20 nt, Vaccinia virus
ccgaucuaaaaaaaacuauc

SEQ ID NO: 4053849 - RNA, 18 nt, Vaccinia virus
ccgaugauguaagucuua

SEQ ID NO: 4053850 - RNA, 21 nt, Vaccinia virus
ccgguucuuaauauuguauug

SEQ ID NO: 4053851 - RNA, 19 nt, Vaccinia virus
ccguaauguaaguaguuua

SEQ ID NO: 4053852 - RNA, 13 nt, Vaccinia virus
ccguuaaaguaug

SEQ ID NO: 4053853 - RNA, 14 nt, Vaccinia virus
ccguuaaugaaaaa

SEQ ID NO: 4053854 - RNA, 15 nt, Vaccinia virus
ccguuuaauuuccua

SEQ ID NO: 4053855 - RNA, 18 nt, Vaccinia virus
ccuaaauaaauaugugua

SEQ ID NO: 4053856 - RNA, 21 nt, Vaccinia virus
ccuaacgaugauauguuuuca

SEQ ID NO: 4053857 - RNA, 13 nt, Vaccinia virus
ccuaauauaacag

SEQ ID NO: 4053858 - RNA, 17 nt, Vaccinia virus
ccuagucauauguuuaa

SEQ ID NO: 4053859 - RNA, 16 nt, Vaccinia virus
ccuauacuauguuaua

SEQ ID NO: 4053860 - RNA, 14 nt, Vaccinia virus
ccuaucauguauuu

SEQ ID NO: 4053861 - RNA, 17 nt, Vaccinia virus
ccuaugauguguuuaga

SEQ ID NO: 4053862 - RNA, 12 nt, Vaccinia virus
ccucaaauguag

SEQ ID NO: 4053863 - RNA, 15 nt, Vaccinia virus
ccucagguagguuua

SEQ ID NO: 4053864 - RNA, 15 nt, Vaccinia virus
ccuccuacagauuuu

SEQ ID NO: 4053865 - RNA, 18 nt, Vaccinia virus
ccugauuaguauuuucua

SEQ ID NO: 4053866 - RNA, 21 nt, Vaccinia virus
ccugguagacggaauguuuua

SEQ ID NO: 4053867 - RNA, 18 nt, Vaccinia virus
ccuguaguuuuaacugga

SEQ ID NO: 4053868 - RNA, 16 nt, Vaccinia virus
ccuugagaauauccau

SEQ ID NO: 4053869 - RNA, 15 nt, Vaccinia virus
ccuugauuauguuuu

SEQ ID NO: 4053870 - RNA, 14 nt, Vaccinia virus
ccuuguuauccauu

SEQ ID NO: 4053871 - RNA, 18 nt, Vaccinia virus
ccuuucuccuguaaagaa

SEQ ID NO: 4053872 - RNA, 21 nt, Vaccinia virus
ccuuuggugaauccaucucua

SEQ ID NO: 4053873 - RNA, 21 nt, Vaccinia virus
ccuuuguuauuuauuuuauuc

SEQ ID NO: 4053874 - RNA, 19 nt, Vaccinia virus
ccuuuuccucagacaucua

SEQ ID NO: 4053875 - RNA, 18 nt, Vaccinia virus
cgaaaaauauaguuccau

SEQ ID NO: 4053876 - RNA, 15 nt, Vaccinia virus
cgaaaaaugaugaag

SEQ ID NO: 4053877 - RNA, 21 nt, Vaccinia virus
cgaaacauccaucgauacaua

SEQ ID NO: 4053878 - RNA, 19 nt, Vaccinia virus
cgaacaauaucuuauucca

SEQ ID NO: 4053879 - RNA, 19 nt, Vaccinia virus
cgaagaugcuauccaucag

SEQ ID NO: 4053880 - RNA, 19 nt, Vaccinia virus
cgaauaauucuaauaaacu

SEQ ID NO: 4053881 - RNA, 18 nt, Vaccinia virus
cgaauauaucaaaacuac

SEQ ID NO: 4053882 - RNA, 21 nt, Vaccinia virus
cgaauauuagguaaagauauu

SEQ ID NO: 4053883 - RNA, 19 nt, Vaccinia virus
cgaaugccaauguuaauuu

SEQ ID NO: 4053884 - RNA, 21 nt, Vaccinia virus
cgaaugccauagaauaaauau

SEQ ID NO: 4053885 - RNA, 21 nt, Vaccinia virus
cgaauuauuucuuuguuuaua

SEQ ID NO: 4053886 - RNA, 15 nt, Vaccinia virus
cgacaucaagaccca

SEQ ID NO: 4053887 - RNA, 23 nt, Vaccinia virus
cgacuaguucccgcauuaaauaa

SEQ ID NO: 4053888 - RNA, 14 nt, Vaccinia virus
cgacuaucguguuu

SEQ ID NO: 4053889 - RNA, 16 nt, Vaccinia virus
cgacucauuauuuccc

SEQ ID NO: 4053890 - RNA, 14 nt, Vaccinia virus
cgacucgacauuug

SEQ ID NO: 4053891 - RNA, 17 nt, Vaccinia virus
cgacucuacuaguucca

SEQ ID NO: 4053892 - RNA, 21 nt, Vaccinia virus
cgacuuauuuaacucuuuagu

SEQ ID NO: 4053893 - RNA, 16 nt, Vaccinia virus
cgacuuuguuaaugac

SEQ ID NO: 4053894 - RNA, 21 nt, Vaccinia virus
cgagaauguugggauccagag

SEQ ID NO: 4053895 - RNA, 20 nt, Vaccinia virus
cgagagacuuuguagaaaca

SEQ ID NO: 4053896 - RNA, 20 nt, Vaccinia virus
cgaggaugaacucacuucuc

SEQ ID NO: 4053897 - RNA, 18 nt, Vaccinia virus
cgagucaaagcauaauac

SEQ ID NO: 4053898 - RNA, 14 nt, Vaccinia virus
cgaguuuaauaacc

SEQ ID NO: 4053899 - RNA, 16 nt, Vaccinia virus
cgauaauuauaaggcu

SEQ ID NO: 4053900 - RNA, 13 nt, Vaccinia virus
cgauacuagauuu

SEQ ID NO: 4053901 - RNA, 15 nt, Vaccinia virus
cgauagcaauuuguu

SEQ ID NO: 4053902 - RNA, 12 nt, Vaccinia virus
cgauauacuuau

SEQ ID NO: 4053903 - RNA, 15 nt, Vaccinia virus
cgauauguuaucuac

SEQ ID NO: 4053904 - RNA, 19 nt, Vaccinia virus
cgaucaaagaauuaaugau

SEQ ID NO: 4053905 - RNA, 15 nt, Vaccinia virus
cgaucaaaugauauc

SEQ ID NO: 4053906 - RNA, 18 nt, Vaccinia virus
cgauccacaaucaaagaa

SEQ ID NO: 4053907 - RNA, 17 nt, Vaccinia virus
cgaugaguguagaugcu

SEQ ID NO: 4053908 - RNA, 18 nt, Vaccinia virus
cgaugauauguuaaauau

SEQ ID NO: 4053909 - RNA, 15 nt, Vaccinia virus
cgaugauuauauguu

SEQ ID NO: 4053910 - RNA, 15 nt, Vaccinia virus
cgauuaaacuuuaau

SEQ ID NO: 4053911 - RNA, 13 nt, Vaccinia virus
cgauuagauggac

SEQ ID NO: 4053912 - RNA, 13 nt, Vaccinia virus
cgauuuaugugac

SEQ ID NO: 4053913 - RNA, 15 nt, Vaccinia virus
cgauuuuaucaucuu

SEQ ID NO: 4053914 - RNA, 17 nt, Vaccinia virus
cgcauguuuuaaugcau

SEQ ID NO: 4053915 - RNA, 12 nt, Vaccinia virus
cgcauuaaugag

SEQ ID NO: 4053916 - RNA, 18 nt, Vaccinia virus
cgcauuccaaucuuaaac

SEQ ID NO: 4053917 - RNA, 11 nt, Vaccinia virus
cgccauaauac

SEQ ID NO: 4053918 - RNA, 14 nt, Vaccinia virus
cgcccuuguauguu

SEQ ID NO: 4053919 - RNA, 19 nt, Vaccinia virus
cgccuuuauuuccacauua

SEQ ID NO: 4053920 - RNA, 24 nt, Vaccinia virus
cgcguuuugacgacguguacaaaa

SEQ ID NO: 4053921 - RNA, 20 nt, Vaccinia virus
cgcuacaauuauagaacgaa

SEQ ID NO: 4053922 - RNA, 13 nt, Vaccinia virus
cggaaaguauuuc

SEQ ID NO: 4053923 - RNA, 13 nt, Vaccinia virus
cggaacaauaaac

SEQ ID NO: 4053924 - RNA, 20 nt, Vaccinia virus
cggaauugccaacucucaaa

SEQ ID NO: 4053925 - RNA, 22 nt, Vaccinia virus
cggacuuauauagcuuauucca

SEQ ID NO: 4053926 - RNA, 14 nt, Vaccinia virus
cggacuuuaaacag

SEQ ID NO: 4053927 - RNA, 22 nt, Vaccinia virus
cggaguaaguguugagcucccu

SEQ ID NO: 4053928 - RNA, 14 nt, Vaccinia virus
cggauaaaaguuuu

SEQ ID NO: 4053929 - RNA, 16 nt, Vaccinia virus
cggauagcaguauuuc

SEQ ID NO: 4053930 - RNA, 23 nt, Vaccinia virus
cggauaguauucaagucaaagaa

SEQ ID NO: 4053931 - RNA, 13 nt, Vaccinia virus
cggauaguuuaag

SEQ ID NO: 4053932 - RNA, 15 nt, Vaccinia virus
cggauggaugauaua

SEQ ID NO: 4053933 - RNA, 16 nt, Vaccinia virus
cgggaauuaauguccu

SEQ ID NO: 4053934 - RNA, 17 nt, Vaccinia virus
cgggauaaaauaauaca

SEQ ID NO: 4053935 - RNA, 20 nt, Vaccinia virus
cggggaucguguucuacaua

SEQ ID NO: 4053936 - RNA, 18 nt, Vaccinia virus
cggguaccuucacaucuc

SEQ ID NO: 4053937 - RNA, 15 nt, Vaccinia virus
cgguguauuguauuu

SEQ ID NO: 4053938 - RNA, 21 nt, Vaccinia virus
cgguuaauguuguauuucauu

SEQ ID NO: 4053939 - RNA, 23 nt, Vaccinia virus
cgguucgguaacgucuguggaug

SEQ ID NO: 4053940 - RNA, 22 nt, Vaccinia virus
uuguacaucuugacauuuucuu

SEQ ID NO: 4053941 - RNA, 21 nt, Vaccinia virus
uuguacgaauccaauuuuuca

SEQ ID NO: 4053942 - RNA, 16 nt, Vaccinia virus
uuguacgguacguuau

SEQ ID NO: 4053943 - RNA, 18 nt, Vaccinia virus
uuguaucaugacauucaa

SEQ ID NO: 4053944 - RNA, 18 nt, Vaccinia virus
uuguauccauacuguaug

SEQ ID NO: 4053945 - RNA, 17 nt, Vaccinia virus
uugucaaauauugcucg

SEQ ID NO: 4053946 - RNA, 12 nt, Vaccinia virus
uugucuagauaa

SEQ ID NO: 4053947 - RNA, 22 nt, Vaccinia virus
uugugaucggauaguauucaag

SEQ ID NO: 4053948 - RNA, 15 nt, Vaccinia virus
uugugauucuagaau

SEQ ID NO: 4053949 - RNA, 20 nt, Vaccinia virus
uuguuaggaaucuauucaaa

SEQ ID NO: 4053950 - RNA, 16 nt, Vaccinia virus
uuguucagcuguagaa

SEQ ID NO: 4053951 - RNA, 12 nt, Vaccinia virus
uuguucucuuag

SEQ ID NO: 4053952 - RNA, 22 nt, Vaccinia virus
uuguugauggaucugugaugca

SEQ ID NO: 4053953 - RNA, 20 nt, Vaccinia virus
uuguuuaaccacugcaugau

SEQ ID NO: 4053954 - RNA, 22 nt, Vaccinia virus
uuguuugguuagcauuauuaaa

SEQ ID NO: 4053955 - RNA, 18 nt, Vaccinia virus
uuuaaaaaaaaaauacuu

SEQ ID NO: 4053956 - RNA, 23 nt, Vaccinia virus
uuuaaaaaaaaaauacuuauucu

SEQ ID NO: 4053957 - RNA, 19 nt, Vaccinia virus
uuuaaacaaaaaaguuauc

SEQ ID NO: 4053958 - RNA, 19 nt, Vaccinia virus
uuuaaacagagaaaucagu

SEQ ID NO: 4053959 - RNA, 17 nt, Vaccinia virus
uuuaaaguaaacuucgu

SEQ ID NO: 4053960 - RNA, 23 nt, Vaccinia virus
uuuaaauauuauauaaacauuug

SEQ ID NO: 4053961 - RNA, 17 nt, Vaccinia virus
uuuaacuagucuucucu

SEQ ID NO: 4053962 - RNA, 17 nt, Vaccinia virus
uuuaacuuugaaauugu

SEQ ID NO: 4053963 - RNA, 11 nt, Vaccinia virus
uuuaacuuuuc

SEQ ID NO: 4053964 - RNA, 23 nt, Vaccinia virus
uuuaaggaggcuuccuuuucuaa

SEQ ID NO: 4053965 - RNA, 13 nt, Vaccinia virus
uuuaauaaacuga

SEQ ID NO: 4053966 - RNA, 23 nt, Vaccinia virus
uuuaauaugaaaaaaauaaacau

SEQ ID NO: 4053967 - RNA, 13 nt, Vaccinia virus
uuuaauauuucga

SEQ ID NO: 4053968 - RNA, 18 nt, Vaccinia virus
uuuaaucccuuuuucaga

SEQ ID NO: 4053969 - RNA, 22 nt, Vaccinia virus
uuuaaugauacgauacuagauu

SEQ ID NO: 4053970 - RNA, 18 nt, Vaccinia virus
uuuacacaugguuauuuu

SEQ ID NO: 4053971 - RNA, 16 nt, Vaccinia virus
uuuacagaucuaguau

SEQ ID NO: 4053972 - RNA, 13 nt, Vaccinia virus
uuuacaguuucug

SEQ ID NO: 4053973 - RNA, 12 nt, Vaccinia virus
uuuaccacaaag

SEQ ID NO: 4053974 - RNA, 19 nt, Vaccinia virus
uuuacccacuauaaaauaa

SEQ ID NO: 4053975 - RNA, 22 nt, Vaccinia virus
uuccuguuccguuaacaucucu

SEQ ID NO: 4053976 - RNA, 14 nt, Vaccinia virus
uuccuucuuauucu

SEQ ID NO: 4053977 - RNA, 13 nt, Vaccinia virus
uucgaaaauacua

SEQ ID NO: 4053978 - RNA, 19 nt, Vaccinia virus
uucguaggcacacaaucua

SEQ ID NO: 4053979 - RNA, 19 nt, Vaccinia virus
uucgucuucccaaaauguu

SEQ ID NO: 4053980 - RNA, 12 nt, Vaccinia virus
uucuaaaauagu

SEQ ID NO: 4053981 - RNA, 21 nt, Vaccinia virus
uucuacaauuacguaaugaag

SEQ ID NO: 4053982 - RNA, 15 nt, Vaccinia virus
uucuacuacuucauu

SEQ ID NO: 4053983 - RNA, 23 nt, Vaccinia virus
uucuagaaaacgaaaacauccua

SEQ ID NO: 4053984 - RNA, 20 nt, Vaccinia virus
uucuagaacuauaaaaacag

SEQ ID NO: 4053985 - RNA, 19 nt, Vaccinia virus
uucuagaauaaguuucaua

SEQ ID NO: 4053986 - RNA, 23 nt, Vaccinia virus
uucuagcucccggauugaaaaca

SEQ ID NO: 4053987 - RNA, 23 nt, Vaccinia virus
uucuauaagguuucuuaaucagu

SEQ ID NO: 4053988 - RNA, 16 nt, Vaccinia virus
uucuauaauaaacuuu

SEQ ID NO: 4053989 - RNA, 21 nt, Vaccinia virus
uucuauccaaggacaaggaug

SEQ ID NO: 4053990 - RNA, 22 nt, Vaccinia virus
uucuaugaaaggagagaaugua

SEQ ID NO: 4053991 - RNA, 23 nt, Vaccinia virus
uucuaugaaaggagagaauguau

SEQ ID NO: 4053992 - RNA, 17 nt, Vaccinia virus
uucuauggcguacaaag

SEQ ID NO: 4053993 - RNA, 14 nt, Vaccinia virus
uucuauuucgaauu

SEQ ID NO: 4053994 - RNA, 20 nt, Vaccinia virus
uucucaucuauguaaucaua

SEQ ID NO: 4053995 - RNA, 14 nt, Vaccinia virus
uucuccuggaugau

SEQ ID NO: 4053996 - RNA, 15 nt, Vaccinia virus
uucucgaaaaaauua

SEQ ID NO: 4053997 - RNA, 18 nt, Vaccinia virus
uucucguauacucugccc

SEQ ID NO: 4053998 - RNA, 16 nt, Vaccinia virus
uucucucaacaucuuc

SEQ ID NO: 4053999 - RNA, 14 nt, Vaccinia virus
uucucugaauauag

SEQ ID NO: 4054000 - RNA, 13 nt, Vaccinia virus
uucugaauuauuu

SEQ ID NO: 4054001 - RNA, 22 nt, Vaccinia virus
uucugacaauauuuaguuuauu

SEQ ID NO: 4054002 - RNA, 18 nt, Vaccinia virus
uucugcauuacaaagaag

SEQ ID NO: 4054003 - RNA, 19 nt, Vaccinia virus
uucuggaacauuaaaugua

SEQ ID NO: 4054004 - RNA, 12 nt, Vaccinia virus
uucuuaagaaau

SEQ ID NO: 4054005 - RNA, 13 nt, Vaccinia virus
uucuuaauaaucg

SEQ ID NO: 4054006 - RNA, 12 nt, Vaccinia virus
uucuuacaauua

SEQ ID NO: 4054007 - RNA, 16 nt, Vaccinia virus
uucuuaugaaacuugg

SEQ ID NO: 4054008 - RNA, 16 nt, Vaccinia virus
uucuucagaauaauag

SEQ ID NO: 4054009 - RNA, 22 nt, Vaccinia virus
uucuugacugucgcuaauaucu

SEQ ID NO: 4054010 - RNA, 23 nt, Vaccinia virus
uucuugauagagaugagaugcuc

SEQ ID NO: 4054011 - RNA, 20 nt, Vaccinia virus
uucuuggauccuaacaauga

SEQ ID NO: 4054012 - RNA, 13 nt, Vaccinia virus
uucuuguguaauu

SEQ ID NO: 4054013 - RNA, 13 nt, Vaccinia virus
uucuuuuaucaua

SEQ ID NO: 4054014 - RNA, 15 nt, Vaccinia virus
uugaaaacuauuucu

SEQ ID NO: 4054015 - RNA, 20 nt, Vaccinia virus
uugaaacuaaacuuauuuag

SEQ ID NO: 4054016 - RNA, 14 nt, Vaccinia virus
uugaaacuaugucu

SEQ ID NO: 4054017 - RNA, 12 nt, Vaccinia virus
uugaaacuuuuu

SEQ ID NO: 4054018 - RNA, 13 nt, Vaccinia virus
uugaaauguguaa

SEQ ID NO: 4054019 - RNA, 14 nt, Vaccinia virus
uugaacauuauuga

SEQ ID NO: 4054020 - RNA, 15 nt, Vaccinia virus
uugaaccauguaugc

SEQ ID NO: 4054021 - RNA, 18 nt, Vaccinia virus
uugaaccggaagaauuga

SEQ ID NO: 4054022 - RNA, 13 nt, Vaccinia virus
uugaaugucauga

SEQ ID NO: 4054023 - RNA, 23 nt, Vaccinia virus
uugacgcacccgcgucuguuuuu

SEQ ID NO: 4054024 - RNA, 23 nt, Vaccinia virus
uugaggcagcaaauacugaacca

SEQ ID NO: 4054025 - RNA, 23 nt, Vaccinia virus
uugauaauaucuauauaugaucu

SEQ ID NO: 4054026 - RNA, 17 nt, Vaccinia virus
uugauaauuacgcguau

SEQ ID NO: 4054027 - RNA, 17 nt, Vaccinia virus
uugauaggaucuauaau

SEQ ID NO: 4054028 - RNA, 22 nt, Vaccinia virus
uugauaggaucuauaauguagu

SEQ ID NO: 4054029 - RNA, 20 nt, Vaccinia virus
uugauaguauaccaacuaua

SEQ ID NO: 4054030 - RNA, 21 nt, Vaccinia virus
uugauauaucaguuaaugcgu

SEQ ID NO: 4054031 - RNA, 16 nt, Vaccinia virus
uugauaucacauauuu

SEQ ID NO: 4054032 - RNA, 17 nt, Vaccinia virus
uugauaucuuuagauau

SEQ ID NO: 4054033 - RNA, 18 nt, Vaccinia virus
uugaugaaguucgaugau

SEQ ID NO: 4054034 - RNA, 14 nt, Vaccinia virus
uugaugaauuauua

SEQ ID NO: 4054035 - RNA, 13 nt, Vaccinia virus
uugauuacucuuu

SEQ ID NO: 4054036 - RNA, 22 nt, Vaccinia virus
uugauucaaucuaucuagcaau

SEQ ID NO: 4054037 - RNA, 18 nt, Vaccinia virus
uugauuuuaaaauuaaaa

SEQ ID NO: 4054038 - RNA, 13 nt, Vaccinia virus
uugcaauugguaa

SEQ ID NO: 4054039 - RNA, 13 nt, Vaccinia virus
uugcaucaguucu

SEQ ID NO: 4054040 - RNA, 14 nt, Vaccinia virus
uugcaucuacauca

SEQ ID NO: 4054041 - RNA, 14 nt, Vaccinia virus
uugccauuaguuuu

SEQ ID NO: 4054042 - RNA, 13 nt, Vaccinia virus
uugccguaaaucc

SEQ ID NO: 4054043 - RNA, 16 nt, Vaccinia virus
uugcgauauacauaaa

SEQ ID NO: 4054044 - RNA, 12 nt, Vaccinia virus
uugcguauacau

SEQ ID NO: 4054045 - RNA, 15 nt, Vaccinia virus
uugcuggauucacaa

SEQ ID NO: 4054046 - RNA, 22 nt, Vaccinia virus
uugcugucgaagaggcaaaaga

SEQ ID NO: 4054047 - RNA, 15 nt, Vaccinia virus
uuggaacuaguauuu

SEQ ID NO: 4054048 - RNA, 18 nt, Vaccinia virus
uuggacaaaucuggaaaa

SEQ ID NO: 4054049 - RNA, 23 nt, Vaccinia virus
uuggaccaccgacuguaacauug

SEQ ID NO: 4054050 - RNA, 14 nt, Vaccinia virus
uuggcaaaaacgga

SEQ ID NO: 4054051 - RNA, 13 nt, Vaccinia virus
uuggcaauuaaaa

SEQ ID NO: 4054052 - RNA, 18 nt, Vaccinia virus
uuggcacgaacaaaagga

SEQ ID NO: 4054053 - RNA, 18 nt, Vaccinia virus
uuggcaguacucauuaau

SEQ ID NO: 4054054 - RNA, 21 nt, Vaccinia virus
uugguaauauggauacuaauu

SEQ ID NO: 4054055 - RNA, 21 nt, Vaccinia virus
uugguauuacuauauaguaua

SEQ ID NO: 4054056 - RNA, 15 nt, Vaccinia virus
uuggucgauguaaaa

SEQ ID NO: 4054057 - RNA, 22 nt, Vaccinia virus
uugguuguggaucuucuacaau

SEQ ID NO: 4054058 - RNA, 14 nt, Vaccinia virus
uuguaaauuauuuu

SEQ ID NO: 4054059 - RNA, 14 nt, Vaccinia virus
uuguaacuaguuuu

SEQ ID NO: 4054060 - RNA, 15 nt, Vaccinia virus
uuguaauaucuuaaa

SEQ ID NO: 4054061 - RNA, 15 nt, Vaccinia virus
uuguaauuaaauuuu

SEQ ID NO: 4054062 - RNA, 23 nt, Vaccinia virus
ggugccgcagcaagcauacagac

SEQ ID NO: 4054063 - RNA, 22 nt, Vaccinia virus
gguggcugauuaggcuguaguc

SEQ ID NO: 4054064 - RNA, 17 nt, Vaccinia virus
gguguaggaguacauac

SEQ ID NO: 4054065 - RNA, 20 nt, Vaccinia virus
gguuaauguuguauuucauu

SEQ ID NO: 4054066 - RNA, 22 nt, Vaccinia virus
gguugccgcaaauagauagaac

SEQ ID NO: 4054067 - RNA, 16 nt, Vaccinia virus
gguuuuauuuuauccu

SEQ ID NO: 4054068 - RNA, 20 nt, Vaccinia virus
guaaaaaaaccuauaaugau

SEQ ID NO: 4054069 - RNA, 14 nt, Vaccinia virus
guaaaaaaauuaga

SEQ ID NO: 4054070 - RNA, 15 nt, Vaccinia virus
guaaaaaauauguua

SEQ ID NO: 4054071 - RNA, 13 nt, Vaccinia virus
guaaaaaauguac

SEQ ID NO: 4054072 - RNA, 15 nt, Vaccinia virus
guaaaacauaaagga

SEQ ID NO: 4054073 - RNA, 17 nt, Vaccinia virus
guaaaagucaaauuaga

SEQ ID NO: 4054074 - RNA, 21 nt, Vaccinia virus
guaaaauguugaugauaucua

SEQ ID NO: 4054075 - RNA, 12 nt, Vaccinia virus
guaaacauauca

SEQ ID NO: 4054076 - RNA, 22 nt, Vaccinia virus
guaaaccgauaguguauaaaga

SEQ ID NO: 4054077 - RNA, 18 nt, Vaccinia virus
guaaaccgauuaaacguc

SEQ ID NO: 4054078 - RNA, 12 nt, Vaccinia virus
guaaagaaggag

SEQ ID NO: 4054079 - RNA, 15 nt, Vaccinia virus
guaaagauauuucuc

SEQ ID NO: 4054080 - RNA, 13 nt, Vaccinia virus
guaaauacauuga

SEQ ID NO: 4054081 - RNA, 22 nt, Vaccinia virus
guaaauauucuaaauuaaccaa

SEQ ID NO: 4054082 - RNA, 15 nt, Vaccinia virus
guaaaucacauaucu

SEQ ID NO: 4054083 - RNA, 14 nt, Vaccinia virus
guaaauuaguucau

SEQ ID NO: 4054084 - RNA, 16 nt, Vaccinia virus
guaacacaauaaagga

SEQ ID NO: 4054085 - RNA, 19 nt, Vaccinia virus
guaacauccucaugauuua

SEQ ID NO: 4054086 - RNA, 18 nt, Vaccinia virus
guaaccaaauacauauua

SEQ ID NO: 4054087 - RNA, 22 nt, Vaccinia virus
guaaccagaauuguaaaauuag

SEQ ID NO: 4054088 - RNA, 15 nt, Vaccinia virus
guaaccgaaucuucc

SEQ ID NO: 4054089 - RNA, 20 nt, Vaccinia virus
guaacgcguggaaaaagcuc

SEQ ID NO: 4054090 - RNA, 17 nt, Vaccinia virus
guaacuguaaauuucuc

SEQ ID NO: 4054091 - RNA, 23 nt, Vaccinia virus
guaagaacucucuucauuacuau

SEQ ID NO: 4054092 - RNA, 22 nt, Vaccinia virus
guaaguaucuuauguauauguu

SEQ ID NO: 4054093 - RNA, 17 nt, Vaccinia virus
guaaguuuaaaaaagac

SEQ ID NO: 4054094 - RNA, 18 nt, Vaccinia virus
guaauaaauaugauuuug

SEQ ID NO: 4054095 - RNA, 20 nt, Vaccinia virus
guaauaaucuugauuguaca

SEQ ID NO: 4054096 - RNA, 16 nt, Vaccinia virus
guaauaucuuaaauaa

SEQ ID NO: 4054097 - RNA, 18 nt, Vaccinia virus
guaauauggaauaguguu

SEQ ID NO: 4054098 - RNA, 15 nt, Vaccinia virus
guaauauucuaaaac

SEQ ID NO: 4054099 - RNA, 10 nt, Vaccinia virus
guaauguuua

SEQ ID NO: 4054100 - RNA, 17 nt, Vaccinia virus
guaauuaaaauaaaaag

SEQ ID NO: 4054101 - RNA, 13 nt, Vaccinia virus
guaauuaaauguu

SEQ ID NO: 4054102 - RNA, 15 nt, Vaccinia virus
guaauuaauuaugau

SEQ ID NO: 4054103 - RNA, 13 nt, Vaccinia virus
guaauuacuuauc

SEQ ID NO: 4054104 - RNA, 19 nt, Vaccinia virus
guaauucgcgugauaaaau

SEQ ID NO: 4054105 - RNA, 20 nt, Vaccinia virus
guacacaauaucauaaacaa

SEQ ID NO: 4054106 - RNA, 17 nt, Vaccinia virus
guacauuaauaaaugaa

SEQ ID NO: 4054107 - RNA, 17 nt, Vaccinia virus
guacauuauuacauaga

SEQ ID NO: 4054108 - RNA, 20 nt, Vaccinia virus
guacauucugcaauauuguu

SEQ ID NO: 4054109 - RNA, 22 nt, Vaccinia virus
guacauuuuccagauuaacaga

SEQ ID NO: 4054110 - RNA, 13 nt, Vaccinia virus
guaccaucuuauu

SEQ ID NO: 4054111 - RNA, 23 nt, Vaccinia virus
guacccuggauacgaaauaaauu

SEQ ID NO: 4054112 - RNA, 15 nt, Vaccinia virus
guacgguaccuuugu

SEQ ID NO: 4054113 - RNA, 22 nt, Vaccinia virus
guacgugucaaagguauaugau

SEQ ID NO: 4054114 - RNA, 22 nt, Vaccinia virus
guacuaaauucgauaucuuuuu

SEQ ID NO: 4054115 - RNA, 13 nt, Vaccinia virus
guacuauguguua

SEQ ID NO: 4054116 - RNA, 13 nt, Vaccinia virus
guacuuaaugaag

SEQ ID NO: 4054117 - RNA, 23 nt, Vaccinia virus
guacuuguauguguuauaaauau

SEQ ID NO: 4054118 - RNA, 17 nt, Vaccinia virus
guacuuugaugauuuuu

SEQ ID NO: 4054119 - RNA, 17 nt, Vaccinia virus
guagaaaauauauucua

SEQ ID NO: 4054120 - RNA, 22 nt, Vaccinia virus
guagaacaacgauuuaaucaua

SEQ ID NO: 4054121 - RNA, 16 nt, Vaccinia virus
guagaaucauauugcu

SEQ ID NO: 4054122 - RNA, 19 nt, Vaccinia virus
guagacuuacuaaagucaa

SEQ ID NO: 4054123 - RNA, 13 nt, Vaccinia virus
guagauaaucauu

SEQ ID NO: 4054124 - RNA, 18 nt, Vaccinia virus
guagaucacguuaaauca

SEQ ID NO: 4054125 - RNA, 21 nt, Vaccinia virus
guagaucuuaucuauccagau

SEQ ID NO: 4054126 - RNA, 20 nt, Vaccinia virus
guagcaagauuuuuaaacaa

SEQ ID NO: 4054127 - RNA, 20 nt, Vaccinia virus
guagugcaggcuuaaagcaa

SEQ ID NO: 4054128 - RNA, 16 nt, Vaccinia virus
guauaaaaauuaaaca

SEQ ID NO: 4054129 - RNA, 19 nt, Vaccinia virus
guauaaauuuuagaaauaa

SEQ ID NO: 4054130 - RNA, 19 nt, Vaccinia virus
guauaacacacaugucuua

SEQ ID NO: 4054131 - RNA, 17 nt, Vaccinia virus
guauaauauuuaaacaa

SEQ ID NO: 4054132 - RNA, 16 nt, Vaccinia virus
guauacacaaaaagaa

SEQ ID NO: 4054133 - RNA, 19 nt, Vaccinia virus
guauacaccaacaguauga

SEQ ID NO: 4054134 - RNA, 16 nt, Vaccinia virus
guauacgcagaaaaga

SEQ ID NO: 4054135 - RNA, 14 nt, Vaccinia virus
guauacucuauucg

SEQ ID NO: 4054136 - RNA, 13 nt, Vaccinia virus
guauacucugccc

SEQ ID NO: 4054137 - RNA, 18 nt, Vaccinia virus
guauauauuguuucucuc

SEQ ID NO: 4054138 - RNA, 17 nt, Vaccinia virus
guauauguaagauguuu

SEQ ID NO: 4054139 - RNA, 15 nt, Vaccinia virus
guaucauuuaaacau

SEQ ID NO: 4054140 - RNA, 14 nt, Vaccinia virus
guauccacaaauag

SEQ ID NO: 4054141 - RNA, 19 nt, Vaccinia virus
guaucgacgguaaauggaa

SEQ ID NO: 4054142 - RNA, 22 nt, Vaccinia virus
guaucgcgauuaguguauacac

SEQ ID NO: 4054143 - RNA, 19 nt, Vaccinia virus
guaucuaauauagauuuua

SEQ ID NO: 4054144 - RNA, 20 nt, Vaccinia virus
guaucuaauuuccugauuua

SEQ ID NO: 4054145 - RNA, 22 nt, Vaccinia virus
guaucucuaccuaugauuaaau

SEQ ID NO: 4054146 - RNA, 18 nt, Vaccinia virus
guaugaccguuaacuaca

SEQ ID NO: 4054147 - RNA, 15 nt, Vaccinia virus
guaugcaauauauca

SEQ ID NO: 4054148 - RNA, 18 nt, Vaccinia virus
guaugccauuuacuuaau

SEQ ID NO: 4054149 - RNA, 17 nt, Vaccinia virus
guauguauuacgaagaa

SEQ ID NO: 4054150 - RNA, 18 nt, Vaccinia virus
guaugucccaauauuaau

SEQ ID NO: 4054151 - RNA, 13 nt, Vaccinia virus
guauguuugugaa

SEQ ID NO: 4054152 - RNA, 14 nt, Vaccinia virus
guauuaguaggaaa

SEQ ID NO: 4054153 - RNA, 14 nt, Vaccinia virus
guauuaugaugaau

SEQ ID NO: 4054154 - RNA, 14 nt, Vaccinia virus
guauucaacaugcu

SEQ ID NO: 4054155 - RNA, 20 nt, Vaccinia virus
guauucaguagccaauccua

SEQ ID NO: 4054156 - RNA, 23 nt, Vaccinia virus
guauucucagaguugacgaauau

SEQ ID NO: 4054157 - RNA, 13 nt, Vaccinia virus
guauugguaauau

SEQ ID NO: 4054158 - RNA, 13 nt, Vaccinia virus
guauuguauauac

SEQ ID NO: 4054159 - RNA, 16 nt, Vaccinia virus
guauuucauuacccaa

SEQ ID NO: 4054160 - RNA, 21 nt, Vaccinia virus
guauuucucuacaauauuaau

SEQ ID NO: 4054161 - RNA, 20 nt, Vaccinia virus
guauuugagaaauauguaua

SEQ ID NO: 4054162 - RNA, 13 nt, Vaccinia virus
guauuugauuuug

SEQ ID NO: 4054163 - RNA, 22 nt, Vaccinia virus
gucaaagguauaugauaaacua

SEQ ID NO: 4054164 - RNA, 16 nt, Vaccinia virus
gucaaaugucuauucu

SEQ ID NO: 4054165 - RNA, 23 nt, Vaccinia virus
gucaaauuccaaauuuuuuucau

SEQ ID NO: 4054166 - RNA, 22 nt, Vaccinia virus
gucaacaaguuggaugauauua

SEQ ID NO: 4054167 - RNA, 14 nt, Vaccinia virus
gucaaucaaagaga

SEQ ID NO: 4054168 - RNA, 19 nt, Vaccinia virus
gucaauuacaaauaaagcg

SEQ ID NO: 4054169 - RNA, 15 nt, Vaccinia virus
gucaauugauucuua

SEQ ID NO: 4054170 - RNA, 19 nt, Vaccinia virus
gucacauacacuagugaua

SEQ ID NO: 4054171 - RNA, 19 nt, Vaccinia virus
gucacuacguaauaaaagu

SEQ ID NO: 4054172 - RNA, 18 nt, Vaccinia virus
gucagcggcaucuaaauu

SEQ ID NO: 4054173 - RNA, 16 nt, Vaccinia virus
gucaguaguauacauc

SEQ ID NO: 4054174 - RNA, 14 nt, Vaccinia virus
gucauagaugaaau

SEQ ID NO: 4054175 - RNA, 23 nt, Vaccinia virus
gucauauagucgagcaagagaau

SEQ ID NO: 4054176 - RNA, 15 nt, Vaccinia virus
gucauuuguauuuua

SEQ ID NO: 4054177 - RNA, 18 nt, Vaccinia virus
guccaauaugaucaugug

SEQ ID NO: 4054178 - RNA, 13 nt, Vaccinia virus
guccaauauuuua

SEQ ID NO: 4054179 - RNA, 23 nt, Vaccinia virus
guccauuuaaaguacagauuuua

SEQ ID NO: 4054180 - RNA, 13 nt, Vaccinia virus
guccauuuucugu

SEQ ID NO: 4054181 - RNA, 15 nt, Vaccinia virus
guccgaauguauggc

SEQ ID NO: 4054182 - RNA, 13 nt, Vaccinia virus
guccgcuuuagua

SEQ ID NO: 4054183 - RNA, 13 nt, Vaccinia virus
guccuuaauaucu

SEQ ID NO: 4054184 - RNA, 18 nt, Vaccinia virus
gucgacguuucucaaagu

SEQ ID NO: 4054185 - RNA, 22 nt, Vaccinia virus
gucgagaacguuaaaauaaucg

SEQ ID NO: 4054186 - RNA, 21 nt, Vaccinia virus
gucgcuauaauucauauuaau

SEQ ID NO: 4054187 - RNA, 23 nt, Vaccinia virus
gucgcuucgcgaauuuagaaaau

SEQ ID NO: 4054188 - RNA, 13 nt, Vaccinia virus
gcaucugauuuuu

SEQ ID NO: 4054189 - RNA, 21 nt, Vaccinia virus
gcaucuuauuagaauauuaac

SEQ ID NO: 4054190 - RNA, 13 nt, Vaccinia virus
gcaucuuguuaac

SEQ ID NO: 4054191 - RNA, 19 nt, Vaccinia virus
gcaugcgugguagauguuu

SEQ ID NO: 4054192 - RNA, 19 nt, Vaccinia virus
gcauucuaccguuguuaaa

SEQ ID NO: 4054193 - RNA, 19 nt, Vaccinia virus
gcauugauaaugucuauau

SEQ ID NO: 4054194 - RNA, 18 nt, Vaccinia virus
gccaaaaugauagauauu

SEQ ID NO: 4054195 - RNA, 12 nt, Vaccinia virus
gccaaaguuaua

SEQ ID NO: 4054196 - RNA, 19 nt, Vaccinia virus
gccaaauguucaauaucua

SEQ ID NO: 4054197 - RNA, 21 nt, Vaccinia virus
gccaacucucaaaaugcugau

SEQ ID NO: 4054198 - RNA, 23 nt, Vaccinia virus
gccaauugauaguagauaaugag

SEQ ID NO: 4054199 - RNA, 16 nt, Vaccinia virus
gccacauuuaguuaac

SEQ ID NO: 4054200 - RNA, 13 nt, Vaccinia virus
gccacgcuacuaa

SEQ ID NO: 4054201 - RNA, 14 nt, Vaccinia virus
gccagaucuucuuc

SEQ ID NO: 4054202 - RNA, 19 nt, Vaccinia virus
gccaguccuccuacagauu

SEQ ID NO: 4054203 - RNA, 16 nt, Vaccinia virus
gccauggacuaagaua

SEQ ID NO: 4054204 - RNA, 19 nt, Vaccinia virus
gccauuaguuuucaugaaa

SEQ ID NO: 4054205 - RNA, 22 nt, Vaccinia virus
gccccaggaucuccaacaaauu

SEQ ID NO: 4054206 - RNA, 13 nt, Vaccinia virus
gccucuagauauc

SEQ ID NO: 4054207 - RNA, 14 nt, Vaccinia virus
gccuguucauaaau

SEQ ID NO: 4054208 - RNA, 17 nt, Vaccinia virus
gccuuauauagcacuuu

SEQ ID NO: 4054209 - RNA, 17 nt, Vaccinia virus
gcgaaccgauuaaacau

SEQ ID NO: 4054210 - RNA, 20 nt, Vaccinia virus
gcgaacugaaggaaucaggu

SEQ ID NO: 4054211 - RNA, 17 nt, Vaccinia virus
gcgaguguuacaacauc

SEQ ID NO: 4054212 - RNA, 20 nt, Vaccinia virus
gcgauaaacggaauaauaau

SEQ ID NO: 4054213 - RNA, 22 nt, Vaccinia virus
gcgauagugagagugauaauau

SEQ ID NO: 4054214 - RNA, 20 nt, Vaccinia virus
gcgauauacauaaacugauc

SEQ ID NO: 4054215 - RNA, 13 nt, Vaccinia virus
gcgccaaauugug

SEQ ID NO: 4054216 - RNA, 13 nt, Vaccinia virus
gcgcuauaguauu

SEQ ID NO: 4054217 - RNA, 13 nt, Vaccinia virus
gcggacauuuucu

SEQ ID NO: 4054218 - RNA, 15 nt, Vaccinia virus
gcggcuauagaaaag

SEQ ID NO: 4054219 - RNA, 22 nt, Vaccinia virus
gcgguuaaaauaguuuauaaca

SEQ ID NO: 4054220 - RNA, 23 nt, Vaccinia virus
gcguguuuuaaauccuuaauaua

SEQ ID NO: 4054221 - RNA, 13 nt, Vaccinia virus
gcguuaauguuug

SEQ ID NO: 4054222 - RNA, 19 nt, Vaccinia virus
gcguuuuaugaaugaugau

SEQ ID NO: 4054223 - RNA, 13 nt, Vaccinia virus
gcuaaaauaccua

SEQ ID NO: 4054224 - RNA, 22 nt, Vaccinia virus
gcuaaagcuaucuauacuauca

SEQ ID NO: 4054225 - RNA, 18 nt, Vaccinia virus
gcuaaaucguauauguua

SEQ ID NO: 4054226 - RNA, 22 nt, Vaccinia virus
gcuaacacguaauuauaauaau

SEQ ID NO: 4054227 - RNA, 20 nt, Vaccinia virus
gcuaacauacgagacauguu

SEQ ID NO: 4054228 - RNA, 21 nt, Vaccinia virus
gcuaacgaugagauucaucgu

SEQ ID NO: 4054229 - RNA, 17 nt, Vaccinia virus
gcuaaguaauaaaucaa

SEQ ID NO: 4054230 - RNA, 14 nt, Vaccinia virus
gcuaauauauugau

SEQ ID NO: 4054231 - RNA, 15 nt, Vaccinia virus
gcuacaaaauauguu

SEQ ID NO: 4054232 - RNA, 17 nt, Vaccinia virus
gcuacauaauccagcua

SEQ ID NO: 4054233 - RNA, 18 nt, Vaccinia virus
gcuacugcugauaaugau

SEQ ID NO: 4054234 - RNA, 16 nt, Vaccinia virus
gcuagaauuagaaaag

SEQ ID NO: 4054235 - RNA, 17 nt, Vaccinia virus
gcuaguacucuuaagag

SEQ ID NO: 4054236 - RNA, 16 nt, Vaccinia virus
gcuauaauauauucua

SEQ ID NO: 4054237 - RNA, 20 nt, Vaccinia virus
gcuauguauauauauuucuu

SEQ ID NO: 4054238 - RNA, 17 nt, Vaccinia virus
gcuauguuuaauacuua

SEQ ID NO: 4054239 - RNA, 22 nt, Vaccinia virus
gcuauuaaucauccaaagucaa

SEQ ID NO: 4054240 - RNA, 13 nt, Vaccinia virus
gcuauuacuuauu

SEQ ID NO: 4054241 - RNA, 18 nt, Vaccinia virus
gcuauuagagguaaugau

SEQ ID NO: 4054242 - RNA, 14 nt, Vaccinia virus
gcucaguaaaugua

SEQ ID NO: 4054243 - RNA, 17 nt, Vaccinia virus
gcucaguaauggauauu

SEQ ID NO: 4054244 - RNA, 15 nt, Vaccinia virus
gcuccucucucaggc

SEQ ID NO: 4054245 - RNA, 20 nt, Vaccinia virus
gcucgcaucaaucuagcauu

SEQ ID NO: 4054246 - RNA, 21 nt, Vaccinia virus
gcucuuuguccauuauuucua

SEQ ID NO: 4054247 - RNA, 12 nt, Vaccinia virus
gcugaaaugaga

SEQ ID NO: 4054248 - RNA, 23 nt, Vaccinia virus
gcugaucuucaucuauaaaucaa

SEQ ID NO: 4054249 - RNA, 17 nt, Vaccinia virus
gcugguaaaguaaauca

SEQ ID NO: 4054250 - RNA, 21 nt, Vaccinia virus
gcuguagaaccagcugcucca

SEQ ID NO: 4054251 - RNA, 15 nt, Vaccinia virus
gcuguugaaucuuua

SEQ ID NO: 4054252 - RNA, 13 nt, Vaccinia virus
gcuuacuacuaac

SEQ ID NO: 4054253 - RNA, 17 nt, Vaccinia virus
gcuucagcggauccugu

SEQ ID NO: 4054254 - RNA, 22 nt, Vaccinia virus
gcuuccaggcuaucaaauggau

SEQ ID NO: 4054255 - RNA, 21 nt, Vaccinia virus
gcuucuaucuuguuuagauuu

SEQ ID NO: 4054256 - RNA, 14 nt, Vaccinia virus
gcuugaaaauggac

SEQ ID NO: 4054257 - RNA, 14 nt, Vaccinia virus
gcuugauauuaaag

SEQ ID NO: 4054258 - RNA, 22 nt, Vaccinia virus
ggaaaacuuuaauaacaaagaa

SEQ ID NO: 4054259 - RNA, 23 nt, Vaccinia virus
ggaaaagaauuuaccagauaucu

SEQ ID NO: 4054260 - RNA, 23 nt, Vaccinia virus
ggaaacaucucuucuaguuucac

SEQ ID NO: 4054261 - RNA, 11 nt, Vaccinia virus
ggaaacuauaa

SEQ ID NO: 4054262 - RNA, 17 nt, Vaccinia virus
ggaaacuuuuguuuugu

SEQ ID NO: 4054263 - RNA, 15 nt, Vaccinia virus
ggaacauuaaaugua

SEQ ID NO: 4054264 - RNA, 20 nt, Vaccinia virus
ggaaguagaaucauaaagaa

SEQ ID NO: 4054265 - RNA, 15 nt, Vaccinia virus
ggaauaaacaugucu

SEQ ID NO: 4054266 - RNA, 11 nt, Vaccinia virus
ggaauauacaa

SEQ ID NO: 4054267 - RNA, 19 nt, Vaccinia virus
ggaaucgauuuuguaauau

SEQ ID NO: 4054268 - RNA, 17 nt, Vaccinia virus
ggaaugacauacauacu

SEQ ID NO: 4054269 - RNA, 16 nt, Vaccinia virus
ggacagcuauauucuc

SEQ ID NO: 4054270 - RNA, 17 nt, Vaccinia virus
ggacuauuugacuuugu

SEQ ID NO: 4054271 - RNA, 22 nt, Vaccinia virus
ggagaguauccucuaugaagaa

SEQ ID NO: 4054272 - RNA, 19 nt, Vaccinia virus
ggagaucauuaaauguuuc

SEQ ID NO: 4054273 - RNA, 19 nt, Vaccinia virus
ggaguaaguagucuauuaa

SEQ ID NO: 4054274 - RNA, 16 nt, Vaccinia virus
ggaguaucuauuuuaa

SEQ ID NO: 4054275 - RNA, 15 nt, Vaccinia virus
ggauaaaaucuuuug

SEQ ID NO: 4054276 - RNA, 19 nt, Vaccinia virus
ggauaaucagaauauacac

SEQ ID NO: 4054277 - RNA, 14 nt, Vaccinia virus
ggauaaugauagaa

SEQ ID NO: 4054278 - RNA, 11 nt, Vaccinia virus
ggauacaaaaa

SEQ ID NO: 4054279 - RNA, 14 nt, Vaccinia virus
ggauagagaaauau

SEQ ID NO: 4054280 - RNA, 15 nt, Vaccinia virus
ggauaugucuagaac

SEQ ID NO: 4054281 - RNA, 14 nt, Vaccinia virus
ggaucauccuuuaa

SEQ ID NO: 4054282 - RNA, 22 nt, Vaccinia virus
ggaucgcaagaauuuauuucua

SEQ ID NO: 4054283 - RNA, 18 nt, Vaccinia virus
ggaugaagcauauuacuc

SEQ ID NO: 4054284 - RNA, 18 nt, Vaccinia virus
gaaaacuagauacaaaau

SEQ ID NO: 4054285 - RNA, 18 nt, Vaccinia virus
gaaaagcuuaaaauagcu

SEQ ID NO: 4054286 - RNA, 14 nt, Vaccinia virus
gaaaauaaauacaa

SEQ ID NO: 4054287 - RNA, 22 nt, Vaccinia virus
gaaaauaaauccaaaauaacua

SEQ ID NO: 4054288 - RNA, 17 nt, Vaccinia virus
gaaaauaaucuaguaaa

SEQ ID NO: 4054289 - RNA, 16 nt, Vaccinia virus
gaaaauacguucuauu

SEQ ID NO: 4054290 - RNA, 17 nt, Vaccinia virus
gaaaauacuaaaucaga

SEQ ID NO: 4054291 - RNA, 19 nt, Vaccinia virus
gaaaaugaugguacauaua

SEQ ID NO: 4054292 - RNA, 21 nt, Vaccinia virus
gaaaaugcagaaaugauuuug

SEQ ID NO: 4054293 - RNA, 22 nt, Vaccinia virus
gaaaauguacuucgaugagauu

SEQ ID NO: 4054294 - RNA, 21 nt, Vaccinia virus
gaaaauuagaucugauaauau

SEQ ID NO: 4054295 - RNA, 17 nt, Vaccinia virus
gaaaauuauguaaaaca

SEQ ID NO: 4054296 - RNA, 14 nt, Vaccinia virus
gaaacaauguuucu

SEQ ID NO: 4054297 - RNA, 14 nt, Vaccinia virus
gaaacacuagcauu

SEQ ID NO: 4054298 - RNA, 20 nt, Vaccinia virus
gaaaccacugucuaaaugua

SEQ ID NO: 4054299 - RNA, 14 nt, Vaccinia virus
gaaacuaucuuuuu

SEQ ID NO: 4054300 - RNA, 20 nt, Vaccinia virus
gaaacuuuuuagaauaucua

SEQ ID NO: 4054301 - RNA, 11 nt, Vaccinia virus
gaaagaauaaa

SEQ ID NO: 4054302 - RNA, 14 nt, Vaccinia virus
gaaagauguuauuu

SEQ ID NO: 4054303 - RNA, 21 nt, Vaccinia virus
gaaagauucuauaauaaugaa

SEQ ID NO: 4054304 - RNA, 13 nt, Vaccinia virus
gaaaggaauuaau

SEQ ID NO: 4054305 - RNA, 22 nt, Vaccinia virus
gaaaggagagaauguauucauu

SEQ ID NO: 4054306 - RNA, 16 nt, Vaccinia virus
gaaaggcgguauaugu

SEQ ID NO: 4054307 - RNA, 18 nt, Vaccinia virus
gaaaguauagcuaaugau

SEQ ID NO: 4054308 - RNA, 23 nt, Vaccinia virus
gaaaguauuuuuguguuaaaaca

SEQ ID NO: 4054309 - RNA, 14 nt, Vaccinia virus
gaaauaaaucagac

SEQ ID NO: 4054310 - RNA, 23 nt, Vaccinia virus
gaaauaccauaaauauauuucua

SEQ ID NO: 4054311 - RNA, 18 nt, Vaccinia virus
gaaauacuaaaaaaugua

SEQ ID NO: 4054312 - RNA, 16 nt, Vaccinia virus
gaaauagauccuucaa

SEQ ID NO: 4054313 - RNA, 14 nt, Vaccinia virus
gaaauauaccgaua

SEQ ID NO: 4054314 - RNA, 15 nt, Vaccinia virus
gaaauauauacuuca

SEQ ID NO: 4054315 - RNA, 17 nt, Vaccinia virus
gaaauauaugagaugua

SEQ ID NO: 4054316 - RNA, 13 nt, Vaccinia virus
gaaauauauuaag

SEQ ID NO: 4054317 - RNA, 13 nt, Vaccinia virus
gaaauauauuguu

SEQ ID NO: 4054318 - RNA, 16 nt, Vaccinia virus
gaaauauauuguuaaa

SEQ ID NO: 4054319 - RNA, 13 nt, Vaccinia virus
gaaauauucuguu

SEQ ID NO: 4054320 - RNA, 18 nt, Vaccinia virus
gaaaucaaaucucuauca

SEQ ID NO: 4054321 - RNA, 15 nt, Vaccinia virus
gaaaucauauaugau

SEQ ID NO: 4054322 - RNA, 21 nt, Vaccinia virus
gaaaucauuuuuuuaaaacug

SEQ ID NO: 4054323 - RNA, 15 nt, Vaccinia virus
gaaaucuguaaucua

SEQ ID NO: 4054324 - RNA, 19 nt, Vaccinia virus
gaaaugacuccaugaaaac

SEQ ID NO: 4054325 - RNA, 21 nt, Vaccinia virus
gaaauggaagaguuaaugaau

SEQ ID NO: 4054326 - RNA, 19 nt, Vaccinia virus
gaaauggagagagacuguu

SEQ ID NO: 4054327 - RNA, 14 nt, Vaccinia virus
gaaauggauaauau

SEQ ID NO: 4054328 - RNA, 20 nt, Vaccinia virus
gaaauguuauauauaaaaga

SEQ ID NO: 4054329 - RNA, 11 nt, Vaccinia virus
gaaauuagaaa

SEQ ID NO: 4054330 - RNA, 17 nt, Vaccinia virus
gaaauuagaaaguaaug

SEQ ID NO: 4054331 - RNA, 18 nt, Vaccinia virus
gaaauuugaaagaacuac

SEQ ID NO: 4054332 - RNA, 17 nt, Vaccinia virus
gaacaauaaaagagaau

SEQ ID NO: 4054333 - RNA, 15 nt, Vaccinia virus
gaacaauuacagaca

SEQ ID NO: 4054334 - RNA, 20 nt, Vaccinia virus
gaacacauaaccaauuuaua

SEQ ID NO: 4054335 - RNA, 16 nt, Vaccinia virus
gaacacauuaaacaaa

SEQ ID NO: 4054336 - RNA, 19 nt, Vaccinia virus
gaacacauuaaacaaaaau

SEQ ID NO: 4054337 - RNA, 14 nt, Vaccinia virus
gaacagauaguuua

SEQ ID NO: 4054338 - RNA, 14 nt, Vaccinia virus
gaacagaugauaua

SEQ ID NO: 4054339 - RNA, 14 nt, Vaccinia virus
gaacaucuuccaua

SEQ ID NO: 4054340 - RNA, 19 nt, Vaccinia virus
gaacaucuuccauauccua

SEQ ID NO: 4054341 - RNA, 19 nt, Vaccinia virus
gaacauucuccgauaucua

SEQ ID NO: 4054342 - RNA, 23 nt, Vaccinia virus
gaacauuucugcauuacaaagaa

SEQ ID NO: 4054343 - RNA, 22 nt, Vaccinia virus
gaaccaauacaacguaaaauau

SEQ ID NO: 4054344 - RNA, 17 nt, Vaccinia virus
gaaccaguaacauauga

SEQ ID NO: 4054345 - RNA, 21 nt, Vaccinia virus
gaaccaguaccagaucuuaau

SEQ ID NO: 4054346 - RNA, 18 nt, Vaccinia virus
gaaccuucuacauauaau

SEQ ID NO: 4054347 - RNA, 16 nt, Vaccinia virus
gaacgauaaacaaauu

SEQ ID NO: 4054348 - RNA, 19 nt, Vaccinia virus
gaacguaaauuaguucaua

SEQ ID NO: 4054349 - RNA, 17 nt, Vaccinia virus
gaacguauaguuugaua

SEQ ID NO: 4054350 - RNA, 12 nt, Vaccinia virus
gaacuaauacau

SEQ ID NO: 4054351 - RNA, 18 nt, Vaccinia virus
gaacuaauccacauauga

SEQ ID NO: 4054352 - RNA, 19 nt, Vaccinia virus
gaacuaauccacauaugau

SEQ ID NO: 4054353 - RNA, 23 nt, Vaccinia virus
gaacuauaaaaacagauaaugau

SEQ ID NO: 4054354 - RNA, 13 nt, Vaccinia virus
gaacuauauuaag

SEQ ID NO: 4054355 - RNA, 22 nt, Vaccinia virus
gaacucuaaucaaaaucuuaau

SEQ ID NO: 4054356 - RNA, 21 nt, Vaccinia virus
gaacuuacugacaaaguuaag

SEQ ID NO: 4054357 - RNA, 14 nt, Vaccinia virus
gaagaagaaaacaa

SEQ ID NO: 4054358 - RNA, 15 nt, Vaccinia virus
gaagaagaaaacaaa

SEQ ID NO: 4054359 - RNA, 13 nt, Vaccinia virus
gaagaagaugcua

SEQ ID NO: 4054360 - RNA, 22 nt, Vaccinia virus
gaagaaggacaacaucuacuuu

SEQ ID NO: 4054361 - RNA, 15 nt, Vaccinia virus
gaagacacauuauuu

SEQ ID NO: 4054362 - RNA, 17 nt, Vaccinia virus
gaagagacggugugaga

SEQ ID NO: 4054363 - RNA, 22 nt, Vaccinia virus
gaagaugauuuugcuagagaua

SEQ ID NO: 4054364 - RNA, 12 nt, Vaccinia virus
gaaggacaacau

SEQ ID NO: 4054365 - RNA, 18 nt, Vaccinia virus
gaaggaggaacaguuuua

SEQ ID NO: 4054366 - RNA, 15 nt, Vaccinia virus
gaaggcauaucguga

SEQ ID NO: 4054367 - RNA, 12 nt, Vaccinia virus
gaaguaaugaag

SEQ ID NO: 4054368 - RNA, 14 nt, Vaccinia virus
gaaguaaugaagaa

SEQ ID NO: 4054369 - RNA, 23 nt, Vaccinia virus
gaaguauaucugaguaugaugau

SEQ ID NO: 4054370 - RNA, 19 nt, Vaccinia virus
gaagucguguacguaauau

SEQ ID NO: 4054371 - RNA, 15 nt, Vaccinia virus
gaaguuauagaaugu

SEQ ID NO: 4054372 - RNA, 20 nt, Vaccinia virus
gaauaaaguuggaaguuuaa

SEQ ID NO: 4054373 - RNA, 22 nt, Vaccinia virus
gaauaauaugacucaugaucua

SEQ ID NO: 4054374 - RNA, 19 nt, Vaccinia virus
gaauaauccuauaucacuu

SEQ ID NO: 4054375 - RNA, 22 nt, Vaccinia virus
gaauacgacgaccauaucaauu

SEQ ID NO: 4054376 - RNA, 14 nt, Vaccinia virus
gaauagacuuucug

SEQ ID NO: 4054377 - RNA, 16 nt, Vaccinia virus
gaauagugguauauaa

SEQ ID NO: 4054378 - RNA, 17 nt, Vaccinia virus
gaauauaaauuauauau

SEQ ID NO: 4054379 - RNA, 21 nt, Vaccinia virus
gaauauacugauuagaaauaa

SEQ ID NO: 4054380 - RNA, 13 nt, Vaccinia virus
gaauauaguuaua

SEQ ID NO: 4054381 - RNA, 16 nt, Vaccinia virus
gaauauauaaaagacg

SEQ ID NO: 4054382 - RNA, 22 nt, Vaccinia virus
gaauauauagguaauacauaua

SEQ ID NO: 4054383 - RNA, 12 nt, Vaccinia virus
gaauauauuaau

SEQ ID NO: 4054384 - RNA, 14 nt, Vaccinia virus
gaauaucauauuac

SEQ ID NO: 4054385 - RNA, 17 nt, Vaccinia virus
gaauauggggaaaauau

SEQ ID NO: 4054386 - RNA, 21 nt, Vaccinia virus
gaauauggggaaaauauucua

SEQ ID NO: 4054387 - RNA, 14 nt, Vaccinia virus
gaauauguauauca

SEQ ID NO: 4054388 - RNA, 22 nt, Vaccinia virus
gaauaugugcuaaaaucacuga

SEQ ID NO: 4054389 - RNA, 21 nt, Vaccinia virus
gaauauguuauaauagagaua

SEQ ID NO: 4054390 - RNA, 14 nt, Vaccinia virus
gaauauuaaacaau

SEQ ID NO: 4054391 - RNA, 17 nt, Vaccinia virus
gaauauuaaacaauuau

SEQ ID NO: 4054392 - RNA, 21 nt, Vaccinia virus
gaauauuccucuaacagauau

SEQ ID NO: 4054393 - RNA, 18 nt, Vaccinia virus
gaaucacguguuaaacaa

SEQ ID NO: 4054394 - RNA, 19 nt, Vaccinia virus
gaaucagugaauaaauuca

SEQ ID NO: 4054395 - RNA, 14 nt, Vaccinia virus
gaaucauacaauga

SEQ ID NO: 4054396 - RNA, 20 nt, Vaccinia virus
gaaucauuuaucauaacuac

SEQ ID NO: 4054397 - RNA, 20 nt, Vaccinia virus
gaauccaucucuauguuuca

SEQ ID NO: 4054398 - RNA, 15 nt, Vaccinia virus
gaaucccuacauauu

SEQ ID NO: 4054399 - RNA, 18 nt, Vaccinia virus
gaaucccuacauauuuua

SEQ ID NO: 4054400 - RNA, 15 nt, Vaccinia virus
gaauccuauacucug

SEQ ID NO: 4054401 - RNA, 12 nt, Vaccinia virus
gaaucuauuuua

SEQ ID NO: 4054402 - RNA, 13 nt, Vaccinia virus
gaaugaagagaag

SEQ ID NO: 4054403 - RNA, 23 nt, Vaccinia virus
gaaugacaucgcauuuauaucuu

SEQ ID NO: 4054404 - RNA, 22 nt, Vaccinia virus
gaaugcggugccauucaugaaa

SEQ ID NO: 4054405 - RNA, 19 nt, Vaccinia virus
gaaugcuguuaugugcaua

SEQ ID NO: 4054406 - RNA, 14 nt, Vaccinia virus
aucuauauauguau

SEQ ID NO: 4054407 - RNA, 16 nt, Vaccinia virus
aucuauauauguauuu

SEQ ID NO: 4054408 - RNA, 12 nt, Vaccinia virus
aucuauauuaac

SEQ ID NO: 4054409 - RNA, 17 nt, Vaccinia virus
aucuaucaaacaaaauu

SEQ ID NO: 4054410 - RNA, 18 nt, Vaccinia virus
aucuauccgcgacaaauu

SEQ ID NO: 4054411 - RNA, 14 nt, Vaccinia virus
aucuaucuuaaaaa

SEQ ID NO: 4054412 - RNA, 17 nt, Vaccinia virus
aucuaucuuaucgaaug

SEQ ID NO: 4054413 - RNA, 21 nt, Vaccinia virus
aucuauuaaacagaaauggug

SEQ ID NO: 4054414 - RNA, 21 nt, Vaccinia virus
aucuauuaaacgaauaaaaga

SEQ ID NO: 4054415 - RNA, 17 nt, Vaccinia virus
aucuauucauaaaacau

SEQ ID NO: 4054416 - RNA, 18 nt, Vaccinia virus
aucuauugacuauaacuc

SEQ ID NO: 4054417 - RNA, 21 nt, Vaccinia virus
aucucaaaauagguacucugu

SEQ ID NO: 4054418 - RNA, 15 nt, Vaccinia virus
aucucaacaaaauuc

SEQ ID NO: 4054419 - RNA, 19 nt, Vaccinia virus
aucucauuaagcuaauaga

SEQ ID NO: 4054420 - RNA, 17 nt, Vaccinia virus
aucucauucaaauccau

SEQ ID NO: 4054421 - RNA, 16 nt, Vaccinia virus
aucuccaguauuuaca

SEQ ID NO: 4054422 - RNA, 19 nt, Vaccinia virus
aucuccaucgaugauacau

SEQ ID NO: 4054423 - RNA, 15 nt, Vaccinia virus
aucucgaugaaaaua

SEQ ID NO: 4054424 - RNA, 14 nt, Vaccinia virus
aucucuuuagaaug

SEQ ID NO: 4054425 - RNA, 16 nt, Vaccinia virus
aucugaaaauaaauaa

SEQ ID NO: 4054426 - RNA, 16 nt, Vaccinia virus
aucugaaacauacgau

SEQ ID NO: 4054427 - RNA, 19 nt, Vaccinia virus
aucugaauaaaacaucgau

SEQ ID NO: 4054428 - RNA, 23 nt, Vaccinia virus
aucugacucauggauucauuaau

SEQ ID NO: 4054429 - RNA, 21 nt, Vaccinia virus
aucugauaagauaucuucuca

SEQ ID NO: 4054430 - RNA, 21 nt, Vaccinia virus
aucugauagaaagaauaagaa

SEQ ID NO: 4054431 - RNA, 19 nt, Vaccinia virus
aucugaucuguucauauac

SEQ ID NO: 4054432 - RNA, 15 nt, Vaccinia virus
aucugaugagaucaa

SEQ ID NO: 4054433 - RNA, 21 nt, Vaccinia virus
aucugaugagaucaauagaca

SEQ ID NO: 4054434 - RNA, 17 nt, Vaccinia virus
aucugcuauaauuaaga

SEQ ID NO: 4054435 - RNA, 12 nt, Vaccinia virus
aucuggaaaauc

SEQ ID NO: 4054436 - RNA, 14 nt, Vaccinia virus
aucuggcucucucu

SEQ ID NO: 4054437 - RNA, 18 nt, Vaccinia virus
aucugguagcaaagaaau

SEQ ID NO: 4054438 - RNA, 12 nt, Vaccinia virus
aucuguauucuc

SEQ ID NO: 4054439 - RNA, 22 nt, Vaccinia virus
aucuguggaaaauaauacucug

SEQ ID NO: 4054440 - RNA, 19 nt, Vaccinia virus
aucuuauauacacauaauu

SEQ ID NO: 4054441 - RNA, 23 nt, Vaccinia virus
aucuuauauacacauaauuauuc

SEQ ID NO: 4054442 - RNA, 19 nt, Vaccinia virus
aucuuauguauauguuugu

SEQ ID NO: 4054443 - RNA, 20 nt, Vaccinia virus
aucuuauguuuuuaagagau

SEQ ID NO: 4054444 - RNA, 17 nt, Vaccinia virus
aucuucauagaauacua

SEQ ID NO: 4054445 - RNA, 14 nt, Vaccinia virus
aucuucaugccuuu

SEQ ID NO: 4054446 - RNA, 16 nt, Vaccinia virus
aucuucgguaucuuga

SEQ ID NO: 4054447 - RNA, 14 nt, Vaccinia virus
aucuucguuaaaaa

SEQ ID NO: 4054448 - RNA, 20 nt, Vaccinia virus
aucuucucuccuguuaauaa

SEQ ID NO: 4054449 - RNA, 23 nt, Vaccinia virus
aucuucucuccuguuaauaacuc

SEQ ID NO: 4054450 - RNA, 15 nt, Vaccinia virus
aucuucuuaaucucu

SEQ ID NO: 4054451 - RNA, 18 nt, Vaccinia virus
aucuucuuauaagauugu

SEQ ID NO: 4054452 - RNA, 19 nt, Vaccinia virus
aucuugacugucuaucucu

SEQ ID NO: 4054453 - RNA, 22 nt, Vaccinia virus
aucuuggcuccauacuguacca

SEQ ID NO: 4054454 - RNA, 15 nt, Vaccinia virus
aucuuguuuagaaaa

SEQ ID NO: 4054455 - RNA, 18 nt, Vaccinia virus
aucuuuaauaucuagauu

SEQ ID NO: 4054456 - RNA, 17 nt, Vaccinia virus
aucuuuacgaauuacuu

SEQ ID NO: 4054457 - RNA, 12 nt, Vaccinia virus
aucuuugaaaau

SEQ ID NO: 4054458 - RNA, 24 nt, Vaccinia virus
aucuuuguuggaucagucucuaag

SEQ ID NO: 4054459 - RNA, 22 nt, Vaccinia virus
aucuuuuagaaaaguuaaacau

SEQ ID NO: 4054460 - RNA, 13 nt, Vaccinia virus
aucuuuuguucua

SEQ ID NO: 4054461 - RNA, 21 nt, Vaccinia virus
aucuuuuuauuaguaggcauc

SEQ ID NO: 4054462 - RNA, 21 nt, Vaccinia virus
augaaaaauuuuccacaucuc

SEQ ID NO: 4054463 - RNA, 20 nt, Vaccinia virus
augaaaacuuuaaauacuua

SEQ ID NO: 4054464 - RNA, 21 nt, Vaccinia virus
augaaaacuuuaaauacuuaa

SEQ ID NO: 4054465 - RNA, 20 nt, Vaccinia virus
augaaaauuauaaugaauau

SEQ ID NO: 4054466 - RNA, 14 nt, Vaccinia virus
augaaacauuuaau

SEQ ID NO: 4054467 - RNA, 16 nt, Vaccinia virus
augaaagaaagaagac

SEQ ID NO: 4054468 - RNA, 19 nt, Vaccinia virus
augaaaggagagaauguau

SEQ ID NO: 4054469 - RNA, 13 nt, Vaccinia virus
augaauaaagaaa

SEQ ID NO: 4054470 - RNA, 14 nt, Vaccinia virus
augaauaaagaaaa

SEQ ID NO: 4054471 - RNA, 14 nt, Vaccinia virus
augaauaaguacua

SEQ ID NO: 4054472 - RNA, 14 nt, Vaccinia virus
augaauaaguguga

SEQ ID NO: 4054473 - RNA, 23 nt, Vaccinia virus
augaaucacguguuaaacaaugg

SEQ ID NO: 4054474 - RNA, 21 nt, Vaccinia virus
augaauccaucguacaagcca

SEQ ID NO: 4054475 - RNA, 15 nt, Vaccinia virus
augaauguuuucaau

SEQ ID NO: 4054476 - RNA, 16 nt, Vaccinia virus
augaauuaauuaaugu

SEQ ID NO: 4054477 - RNA, 18 nt, Vaccinia virus
augaauuuuuaaaaucau

SEQ ID NO: 4054478 - RNA, 13 nt, Vaccinia virus
augacaaacauuu

SEQ ID NO: 4054479 - RNA, 17 nt, Vaccinia virus
augacaacucaaacauc

SEQ ID NO: 4054480 - RNA, 14 nt, Vaccinia virus
augacacuguguau

SEQ ID NO: 4054481 - RNA, 17 nt, Vaccinia virus
augacauucucugacau

SEQ ID NO: 4054482 - RNA, 17 nt, Vaccinia virus
augacgagcgucauauu

SEQ ID NO: 4054483 - RNA, 14 nt, Vaccinia virus
augacguaaaugua

SEQ ID NO: 4054484 - RNA, 20 nt, Vaccinia virus
augacguaaccaagaaguuu

SEQ ID NO: 4054485 - RNA, 19 nt, Vaccinia virus
augacuaucuauauauacc

SEQ ID NO: 4054486 - RNA, 20 nt, Vaccinia virus
augacuuaguucuuaaucca

SEQ ID NO: 4054487 - RNA, 15 nt, Vaccinia virus
augagaacauaguau

SEQ ID NO: 4054488 - RNA, 19 nt, Vaccinia virus
augagagugauaucauauu

SEQ ID NO: 4054489 - RNA, 15 nt, Vaccinia virus
augagcaaguagaaa

SEQ ID NO: 4054490 - RNA, 17 nt, Vaccinia virus
augagcauuaguauuuc

SEQ ID NO: 4054491 - RNA, 15 nt, Vaccinia virus
augagguguacagcg

SEQ ID NO: 4054492 - RNA, 18 nt, Vaccinia virus
augaguaaaaucaaacac

SEQ ID NO: 4054493 - RNA, 11 nt, Vaccinia virus
augaguauuuu

SEQ ID NO: 4054494 - RNA, 15 nt, Vaccinia virus
augauaaacuaacua

SEQ ID NO: 4054495 - RNA, 22 nt, Vaccinia virus
augauaauuuacacaguaacca

SEQ ID NO: 4054496 - RNA, 19 nt, Vaccinia virus
augauauaggggucuucau

SEQ ID NO: 4054497 - RNA, 16 nt, Vaccinia virus
augauauguuaaauau

SEQ ID NO: 4054498 - RNA, 16 nt, Vaccinia virus
augauauuagaacugc

SEQ ID NO: 4054499 - RNA, 23 nt, Vaccinia virus
augaucaagaaggaaaucaaauc

SEQ ID NO: 4054500 - RNA, 19 nt, Vaccinia virus
augaucaggaaaguuuauu

SEQ ID NO: 4054501 - RNA, 20 nt, Vaccinia virus
augaucaucuauuguuauau

SEQ ID NO: 4054502 - RNA, 18 nt, Vaccinia virus
augaucaugugagaauac

SEQ ID NO: 4054503 - RNA, 16 nt, Vaccinia virus
augauccuauucuaaa

SEQ ID NO: 4054504 - RNA, 22 nt, Vaccinia virus
augauggguguacaaucaagau

SEQ ID NO: 4054505 - RNA, 16 nt, Vaccinia virus
augaugguacauauau

SEQ ID NO: 4054506 - RNA, 20 nt, Vaccinia virus
augaugugagagagaaauac

SEQ ID NO: 4054507 - RNA, 14 nt, Vaccinia virus
augauuaucaaaug

SEQ ID NO: 4054508 - RNA, 23 nt, Vaccinia virus
augauucauuuuuuaaguauuug

SEQ ID NO: 4054509 - RNA, 21 nt, Vaccinia virus
augauucuaaccuagaauuac

SEQ ID NO: 4054510 - RNA, 16 nt, Vaccinia virus
augauugauuagaaaa

SEQ ID NO: 4054511 - RNA, 17 nt, Vaccinia virus
augauuuacaaaugguu

SEQ ID NO: 4054512 - RNA, 15 nt, Vaccinia virus
augauuuagaaauga

SEQ ID NO: 4054513 - RNA, 21 nt, Vaccinia virus
augauuuuccuucuaaaguaa

SEQ ID NO: 4054514 - RNA, 15 nt, Vaccinia virus
augcaauaacaaaga

SEQ ID NO: 4054515 - RNA, 15 nt, Vaccinia virus
augcaaucaacaagu

SEQ ID NO: 4054516 - RNA, 14 nt, Vaccinia virus
augcaaucaaugau

SEQ ID NO: 4054517 - RNA, 18 nt, Vaccinia virus
augcacaaagaagaauuc

SEQ ID NO: 4054518 - RNA, 16 nt, Vaccinia virus
augcaccugaaacauc

SEQ ID NO: 4054519 - RNA, 18 nt, Vaccinia virus
augcagauuuauugaaaa

SEQ ID NO: 4054520 - RNA, 15 nt, Vaccinia virus
augcauaaucgauau

SEQ ID NO: 4054521 - RNA, 13 nt, Vaccinia virus
augcaucaaacag

SEQ ID NO: 4054522 - RNA, 16 nt, Vaccinia virus
augcaucuauuucauc

SEQ ID NO: 4054523 - RNA, 19 nt, Vaccinia virus
augcauucguuuaaagaua

SEQ ID NO: 4054524 - RNA, 17 nt, Vaccinia virus
augcauuuuuauauaca

SEQ ID NO: 4054525 - RNA, 15 nt, Vaccinia virus
augccggagaguaaa

SEQ ID NO: 4054526 - RNA, 18 nt, Vaccinia virus
augccucagguucaucga

SEQ ID NO: 4054527 - RNA, 18 nt, Vaccinia virus
augccuuaggauauguaa

SEQ ID NO: 4054528 - RNA, 18 nt, Vaccinia virus
augcgauucaaaaaagaa

SEQ ID NO: 4054529 - RNA, 20 nt, Vaccinia virus
augcguccauguugucuauu

SEQ ID NO: 4054530 - RNA, 13 nt, Vaccinia virus
augcuaaagcaaa

SEQ ID NO: 4054531 - RNA, 22 nt, Vaccinia virus
augcuaguuaauaguaaaugaa

SEQ ID NO: 4054532 - RNA, 12 nt, Vaccinia virus
augcuauguuua

SEQ ID NO: 4054533 - RNA, 19 nt, Vaccinia virus
caaaacaacauauacacau

SEQ ID NO: 4054534 - RNA, 20 nt, Vaccinia virus
caaaaccaacacuuaucaau

SEQ ID NO: 4054535 - RNA, 23 nt, Vaccinia virus
caaaacgaggauaguugauuuau

SEQ ID NO: 4054536 - RNA, 19 nt, Vaccinia virus
caaaacguccucuauacau

SEQ ID NO: 4054537 - RNA, 16 nt, Vaccinia virus
caaaacucaaauguua

SEQ ID NO: 4054538 - RNA, 17 nt, Vaccinia virus
caaaaguaagcauuucc

SEQ ID NO: 4054539 - RNA, 15 nt, Vaccinia virus
caaaauacaauuguu

SEQ ID NO: 4054540 - RNA, 19 nt, Vaccinia virus
caaaauacauaauuuugua

SEQ ID NO: 4054541 - RNA, 21 nt, Vaccinia virus
caaaauacucaggaagauauu

SEQ ID NO: 4054542 - RNA, 17 nt, Vaccinia virus
caaaauagguacucugu

SEQ ID NO: 4054543 - RNA, 16 nt, Vaccinia virus
caaaauauguaacaau

SEQ ID NO: 4054544 - RNA, 12 nt, Vaccinia virus
caaaaugauaua

SEQ ID NO: 4054545 - RNA, 15 nt, Vaccinia virus
caaaauggcaauuau

SEQ ID NO: 4054546 - RNA, 14 nt, Vaccinia virus
caaacaacugaaaa

SEQ ID NO: 4054547 - RNA, 13 nt, Vaccinia virus
caaacaauguaua

SEQ ID NO: 4054548 - RNA, 21 nt, Vaccinia virus
caaacaauguuugacugaaua

SEQ ID NO: 4054549 - RNA, 15 nt, Vaccinia virus
caaacaugacauuuu

SEQ ID NO: 4054550 - RNA, 20 nt, Vaccinia virus
caaacucagaaccaaaugau

SEQ ID NO: 4054551 - RNA, 16 nt, Vaccinia virus
caaacucuauuuuaaa

SEQ ID NO: 4054552 - RNA, 18 nt, Vaccinia virus
caaacugcaaauguagua

SEQ ID NO: 4054553 - RNA, 23 nt, Vaccinia virus
caaacugcguuaauguauucucu

SEQ ID NO: 4054554 - RNA, 14 nt, Vaccinia virus
caaacuuuacucuu

SEQ ID NO: 4054555 - RNA, 11 nt, Vaccinia virus
caaagaaagag

SEQ ID NO: 4054556 - RNA, 16 nt, Vaccinia virus
caaagaauuaaugaua

SEQ ID NO: 4054557 - RNA, 15 nt, Vaccinia virus
caaagagaaaacaaa

SEQ ID NO: 4054558 - RNA, 14 nt, Vaccinia virus
caaagcaaccagaa

SEQ ID NO: 4054559 - RNA, 15 nt, Vaccinia virus
caaagcaucgauuug

SEQ ID NO: 4054560 - RNA, 21 nt, Vaccinia virus
caaaggagaugauuuaucuau

SEQ ID NO: 4054561 - RNA, 15 nt, Vaccinia virus
caaaggaugaaagaa

SEQ ID NO: 4054562 - RNA, 18 nt, Vaccinia virus
caaagguacuauuucuac

SEQ ID NO: 4054563 - RNA, 16 nt, Vaccinia virus
caaagucaucaaucau

SEQ ID NO: 4054564 - RNA, 16 nt, Vaccinia virus
caaaguuaguacagaa

SEQ ID NO: 4054565 - RNA, 14 nt, Vaccinia virus
caaauaauaaacua

SEQ ID NO: 4054566 - RNA, 19 nt, Vaccinia virus
caaauagagauaaaacaag

SEQ ID NO: 4054567 - RNA, 15 nt, Vaccinia virus
caaauaggagauauu

SEQ ID NO: 4054568 - RNA, 14 nt, Vaccinia virus
caaauauacuaacg

SEQ ID NO: 4054569 - RNA, 21 nt, Vaccinia virus
caaauaucggcauuuauguuu

SEQ ID NO: 4054570 - RNA, 14 nt, Vaccinia virus
caaaucacugaaaa

SEQ ID NO: 4054571 - RNA, 17 nt, Vaccinia virus
caaaucuauauaccaua

SEQ ID NO: 4054572 - RNA, 20 nt, Vaccinia virus
caaauggucaaugauaugau

SEQ ID NO: 4054573 - RNA, 22 nt, Vaccinia virus
caaauguuaaacauuaauugau

SEQ ID NO: 4054574 - RNA, 19 nt, Vaccinia virus
caaauuaagcauuuuggaa

SEQ ID NO: 4054575 - RNA, 14 nt, Vaccinia virus
caaauuccaaauuu

SEQ ID NO: 4054576 - RNA, 18 nt, Vaccinia virus
caaauuuaccacuagaac

SEQ ID NO: 4054577 - RNA, 16 nt, Vaccinia virus
caaauuuuucaugaau

SEQ ID NO: 4054578 - RNA, 23 nt, Vaccinia virus
caaauuuuuucuuuaauauuuua

SEQ ID NO: 4054579 - RNA, 19 nt, Vaccinia virus
caaauuuuuuuuacaaaca

SEQ ID NO: 4054580 - RNA, 15 nt, Vaccinia virus
caacaaaaaaugaau

SEQ ID NO: 4054581 - RNA, 22 nt, Vaccinia virus
caacaaaaagaugcuauguaua

SEQ ID NO: 4054582 - RNA, 15 nt, Vaccinia virus
caacaaauauaaaau

SEQ ID NO: 4054583 - RNA, 14 nt, Vaccinia virus
caacaaauuuggaa

SEQ ID NO: 4054584 - RNA, 15 nt, Vaccinia virus
caacaacauauaauu

SEQ ID NO: 4054585 - RNA, 22 nt, Vaccinia virus
caacaacgaaccaaaaugaauu

SEQ ID NO: 4054586 - RNA, 23 nt, Vaccinia virus
caacaaguguguagauaucuuua

SEQ ID NO: 4054587 - RNA, 16 nt, Vaccinia virus
caacaaguuggaugau

SEQ ID NO: 4054588 - RNA, 20 nt, Vaccinia virus
caacaguuacuccaauuaca

SEQ ID NO: 4054589 - RNA, 18 nt, Vaccinia virus
caacauaauauuaaacac

SEQ ID NO: 4054590 - RNA, 23 nt, Vaccinia virus
caaccagguaggcaguuuuauuu

SEQ ID NO: 4054591 - RNA, 23 nt, Vaccinia virus
caaccauuaacggaugaaaauaa

SEQ ID NO: 4054592 - RNA, 16 nt, Vaccinia virus
caaccuacacuauuau

SEQ ID NO: 4054593 - RNA, 23 nt, Vaccinia virus
caacgauaaaaauaauauuguuu

SEQ ID NO: 4054594 - RNA, 13 nt, Vaccinia virus
caacgauauucua

SEQ ID NO: 4054595 - RNA, 20 nt, Vaccinia virus
caacuaguuuucaucaaugu

SEQ ID NO: 4054596 - RNA, 23 nt, Vaccinia virus
caacuauaucgacauauuucauu

SEQ ID NO: 4054597 - RNA, 19 nt, Vaccinia virus
caacuauccucguuuuguu

SEQ ID NO: 4054598 - RNA, 15 nt, Vaccinia virus
caacucuaaucacuu

SEQ ID NO: 4054599 - RNA, 15 nt, Vaccinia virus
caacuuaaacaaaau

SEQ ID NO: 4054600 - RNA, 13 nt, Vaccinia virus
caacuuauccauu

SEQ ID NO: 4054601 - RNA, 20 nt, Vaccinia virus
caacuuauccauuuauacau

SEQ ID NO: 4054602 - RNA, 17 nt, Vaccinia virus
caacuugacaaaucuua

SEQ ID NO: 4054603 - RNA, 17 nt, Vaccinia virus
caacuuuaggaucucua

SEQ ID NO: 4054604 - RNA, 16 nt, Vaccinia virus
caacuuuauuagauaa

SEQ ID NO: 4054605 - RNA, 18 nt, Vaccinia virus
caagaacaacuagaacag

SEQ ID NO: 4054606 - RNA, 22 nt, Vaccinia virus
caagaauauacaaguauuauuu

SEQ ID NO: 4054607 - RNA, 13 nt, Vaccinia virus
caagaccaaacac

SEQ ID NO: 4054608 - RNA, 17 nt, Vaccinia virus
caagacggauaagaaau

SEQ ID NO: 4054609 - RNA, 21 nt, Vaccinia virus
caagagaaugaaauauauaca

SEQ ID NO: 4054610 - RNA, 16 nt, Vaccinia virus
caagagauauauugga

SEQ ID NO: 4054611 - RNA, 15 nt, Vaccinia virus
caagauauauacacu

SEQ ID NO: 4054612 - RNA, 23 nt, Vaccinia virus
caagauccucucuuaaaugaauc

SEQ ID NO: 4054613 - RNA, 18 nt, Vaccinia virus
caagaucgauagacacug

SEQ ID NO: 4054614 - RNA, 16 nt, Vaccinia virus
caagauuuuuaaacaa

SEQ ID NO: 4054615 - RNA, 20 nt, Vaccinia virus
caagcaaaaacaaaaaacuu

SEQ ID NO: 4054616 - RNA, 23 nt, Vaccinia virus
caagcuucguuguagaaacacug

SEQ ID NO: 4054617 - RNA, 17 nt, Vaccinia virus
caaggaacuaaauagau

SEQ ID NO: 4054618 - RNA, 15 nt, Vaccinia virus
caaggauacacucuc

SEQ ID NO: 4054619 - RNA, 22 nt, Vaccinia virus
caaggcuuugauaucuaaauau

SEQ ID NO: 4054620 - RNA, 14 nt, Vaccinia virus
caagguuagaugua

SEQ ID NO: 4054621 - RNA, 14 nt, Vaccinia virus
caaguauccaucau

SEQ ID NO: 4054622 - RNA, 19 nt, Vaccinia virus
caaguaucuuguuccuaau

SEQ ID NO: 4054623 - RNA, 16 nt, Vaccinia virus
caaguaugacauugua

SEQ ID NO: 4054624 - RNA, 16 nt, Vaccinia virus
caagucccaaauggag

SEQ ID NO: 4054625 - RNA, 23 nt, Vaccinia virus
caagucuucaguucuaucuucua

SEQ ID NO: 4054626 - RNA, 19 nt, Vaccinia virus
caagugacaacaaaaaaug

SEQ ID NO: 4054627 - RNA, 17 nt, Vaccinia virus
caaguggcugcuauuuc

SEQ ID NO: 4054628 - RNA, 17 nt, Vaccinia virus
caauaaaacauuuccua

SEQ ID NO: 4054629 - RNA, 15 nt, Vaccinia virus
caauaaauccgaugu

SEQ ID NO: 4054630 - RNA, 19 nt, Vaccinia virus
caauaaaugcauuaguuua

SEQ ID NO: 4054631 - RNA, 15 nt, Vaccinia virus
caauaacauaacucu

SEQ ID NO: 4054632 - RNA, 20 nt, Vaccinia virus
caauaagucuauaucgaugu

SEQ ID NO: 4054633 - RNA, 16 nt, Vaccinia virus
caauacaacguaaaau

SEQ ID NO: 4054634 - RNA, 18 nt, Vaccinia virus
caauacgccaauaaugau

SEQ ID NO: 4054635 - RNA, 16 nt, Vaccinia virus
caauacggccauccag

SEQ ID NO: 4054636 - RNA, 15 nt, Vaccinia virus
caauacuaauucaaa

SEQ ID NO: 4054637 - RNA, 13 nt, Vaccinia virus
caauagaaucugu

SEQ ID NO: 4054638 - RNA, 18 nt, Vaccinia virus
caauagaugauagaauau

SEQ ID NO: 4054639 - RNA, 21 nt, Vaccinia virus
caauagcuuaacggauacuug

SEQ ID NO: 4054640 - RNA, 23 nt, Vaccinia virus
caauaguaguguaguuaauguaa

SEQ ID NO: 4054641 - RNA, 15 nt, Vaccinia virus
caauaguugauuuuu

SEQ ID NO: 4054642 - RNA, 23 nt, Vaccinia virus
caauauagucuguguuccauaau

SEQ ID NO: 4054643 - RNA, 15 nt, Vaccinia virus
caauauauauacagu

SEQ ID NO: 4054644 - RNA, 16 nt, Vaccinia virus
caauauauguaaucau

SEQ ID NO: 4054645 - RNA, 12 nt, Vaccinia virus
caauaugauauc

SEQ ID NO: 4054646 - RNA, 22 nt, Vaccinia virus
caauaugaucacaaagaaagcu

SEQ ID NO: 4054647 - RNA, 21 nt, Vaccinia virus
caauaugucuguacaaauguu

SEQ ID NO: 4054648 - RNA, 19 nt, Vaccinia virus
caauauugaaaauacuaau

SEQ ID NO: 4054649 - RNA, 23 nt, Vaccinia virus
caauauuguuaucguaauuggaa

SEQ ID NO: 4054650 - RNA, 15 nt, Vaccinia virus
caauauuuuucguuu

SEQ ID NO: 4054651 - RNA, 15 nt, Vaccinia virus
caaucaaacaaaaaa

SEQ ID NO: 4054652 - RNA, 23 nt, Vaccinia virus
caaucaaugauagacuagaagaa

SEQ ID NO: 4054653 - RNA, 22 nt, Vaccinia virus
caaucauuccucauaagaugau

SEQ ID NO: 4054654 - RNA, 19 nt, Vaccinia virus
caauccuucagauaaucug

SEQ ID NO: 4054655 - RNA, 16 nt, Vaccinia virus
caaucgaugugucaaa

SEQ ID NO: 4054656 - RNA, 21 nt, Vaccinia virus
caaucggauuaauaucucuau

SEQ ID NO: 4054657 - RNA, 14 nt, Vaccinia virus
caaugaaugauaug

SEQ ID NO: 4054658 - RNA, 14 nt, Vaccinia virus
caaugaauuaacuu

SEQ ID NO: 4054659 - RNA, 19 nt, Vaccinia virus
caaugacauggaaauaucu

SEQ ID NO: 4054660 - RNA, 13 nt, Vaccinia virus
caaugauaaugau

SEQ ID NO: 4054661 - RNA, 10 nt, Vaccinia virus
caaugauaua

SEQ ID NO: 4054662 - RNA, 21 nt, Vaccinia virus
caaugauauauuuuccaugaa

SEQ ID NO: 4054663 - RNA, 22 nt, Vaccinia virus
caaugauugaagcauucuuucc

SEQ ID NO: 4054664 - RNA, 17 nt, Vaccinia virus
caaugcucaguaaaugu

SEQ ID NO: 4054665 - RNA, 18 nt, Vaccinia virus
caauggauacugcaucug

SEQ ID NO: 4054666 - RNA, 15 nt, Vaccinia virus
caaugggucguugga

SEQ ID NO: 4054667 - RNA, 21 nt, Vaccinia virus
caauguagaaauuagaaagau

SEQ ID NO: 4054668 - RNA, 18 nt, Vaccinia virus
caaugucgaauaacugua

SEQ ID NO: 4054669 - RNA, 22 nt, Vaccinia virus
caaugucuauaguucucaucuu

SEQ ID NO: 4054670 - RNA, 20 nt, Vaccinia virus
caauguggagauuuaaucug

SEQ ID NO: 4054671 - RNA, 14 nt, Vaccinia virus
caauguuagaguau

SEQ ID NO: 4054672 - RNA, 11 nt, Vaccinia virus
caauuaaaugu

SEQ ID NO: 4054673 - RNA, 12 nt, Vaccinia virus
caauuaaaugua

SEQ ID NO: 4054674 - RNA, 11 nt, Vaccinia virus
caauuaaugau

SEQ ID NO: 4054675 - RNA, 18 nt, Vaccinia virus
caauuaguuaauaaugau

SEQ ID NO: 4054676 - RNA, 17 nt, Vaccinia virus
caauuauaauauacgau

SEQ ID NO: 4054677 - RNA, 22 nt, Vaccinia virus
caauuauacguuuuuauauaau

SEQ ID NO: 4054678 - RNA, 17 nt, Vaccinia virus
caauuaucauuuugauu

SEQ ID NO: 4054679 - RNA, 13 nt, Vaccinia virus
caauucaucucua

SEQ ID NO: 4054680 - RNA, 21 nt, Vaccinia virus
caauucauuccuauaaguuua

SEQ ID NO: 4054681 - RNA, 22 nt, Vaccinia virus
caauugguuaugauaucaugua

SEQ ID NO: 4054682 - RNA, 21 nt, Vaccinia virus
caauuguauuauugauacaau

SEQ ID NO: 4054683 - RNA, 19 nt, Vaccinia virus
caauuguuugauauauaau

SEQ ID NO: 4054684 - RNA, 19 nt, Vaccinia virus
caauuuauacggauuucua

SEQ ID NO: 4054685 - RNA, 18 nt, Vaccinia virus
caauuuguauuauccaau

SEQ ID NO: 4054686 - RNA, 17 nt, Vaccinia virus
caauuuuaaaucaucuu

SEQ ID NO: 4054687 - RNA, 19 nt, Vaccinia virus
caauuuugauguauaacaa

SEQ ID NO: 4054688 - RNA, 21 nt, Vaccinia virus
cacaaagaauuuuagacacua

SEQ ID NO: 4054689 - RNA, 23 nt, Vaccinia virus
cacaaauaguaaaugagagaucu

SEQ ID NO: 4054690 - RNA, 15 nt, Vaccinia virus
cacaaccaaauacuu

SEQ ID NO: 4054691 - RNA, 13 nt, Vaccinia virus
cacagaaauacua

SEQ ID NO: 4054692 - RNA, 18 nt, Vaccinia virus
cacauccaucaauuguaa

SEQ ID NO: 4054693 - RNA, 19 nt, Vaccinia virus
cacauccuuuauuaauaau

SEQ ID NO: 4054694 - RNA, 14 nt, Vaccinia virus
cacaugauccauuu

SEQ ID NO: 4054695 - RNA, 23 nt, Vaccinia virus
cacaugauccauuuauaguuaua

SEQ ID NO: 4054696 - RNA, 19 nt, Vaccinia virus
caccauauagaucaaucau

SEQ ID NO: 4054697 - RNA, 18 nt, Vaccinia virus
caccaucuucauaauaaa

SEQ ID NO: 4054698 - RNA, 13 nt, Vaccinia virus
caccgaugaugga

SEQ ID NO: 4054699 - RNA, 16 nt, Vaccinia virus
caccggaauacuauuc

SEQ ID NO: 4054700 - RNA, 15 nt, Vaccinia virus
caccguaguguauau

SEQ ID NO: 4054701 - RNA, 18 nt, Vaccinia virus
caccuaccuuaaucaugu

SEQ ID NO: 4054702 - RNA, 20 nt, Vaccinia virus
caccuauagcaucaauaauu

SEQ ID NO: 4054703 - RNA, 14 nt, Vaccinia virus
caccucauacauau

SEQ ID NO: 4054704 - RNA, 15 nt, Vaccinia virus
caccuccuauaucaa

SEQ ID NO: 4054705 - RNA, 16 nt, Vaccinia virus
cacgaaaaaugaugaa

SEQ ID NO: 4054706 - RNA, 22 nt, Vaccinia virus
cacgaacgaaaccuacugugac

SEQ ID NO: 4054707 - RNA, 18 nt, Vaccinia virus
cacgguaauaaaauguua

SEQ ID NO: 4054708 - RNA, 15 nt, Vaccinia virus
cacguuuauuucaua

SEQ ID NO: 4054709 - RNA, 15 nt, Vaccinia virus
cacuaacgugauuau

SEQ ID NO: 4054710 - RNA, 12 nt, Vaccinia virus
cacuacaucuuu

SEQ ID NO: 4054711 - RNA, 14 nt, Vaccinia virus
cacuagaaaccacg

SEQ ID NO: 4054712 - RNA, 22 nt, Vaccinia virus
cacuauacauuuugaaacuaug

SEQ ID NO: 4054713 - RNA, 16 nt, Vaccinia virus
cacuauguuagcauuu

SEQ ID NO: 4054714 - RNA, 12 nt, Vaccinia virus
cacucucugcca

SEQ ID NO: 4054715 - RNA, 13 nt, Vaccinia virus
cacucugucauau

SEQ ID NO: 4054716 - RNA, 21 nt, Vaccinia virus
cacugucuggcaauaaaugau

SEQ ID NO: 4054717 - RNA, 13 nt, Vaccinia virus
cacuuauuucaug

SEQ ID NO: 4054718 - RNA, 14 nt, Vaccinia virus
cacuuguaguucuu

SEQ ID NO: 4054719 - RNA, 13 nt, Vaccinia virus
cagaaaagauauu

SEQ ID NO: 4054720 - RNA, 15 nt, Vaccinia virus
cagaaacuguaaaga

SEQ ID NO: 4054721 - RNA, 18 nt, Vaccinia virus
cagaaaugacuccaugaa

SEQ ID NO: 4054722 - RNA, 15 nt, Vaccinia virus
cagaaauuauauacg

SEQ ID NO: 4054723 - RNA, 22 nt, Vaccinia virus
cagaaauugguauaaauguugu

SEQ ID NO: 4054724 - RNA, 12 nt, Vaccinia virus
cagaacuauuag

SEQ ID NO: 4054725 - RNA, 18 nt, Vaccinia virus
cagaagaauaugaugauu

SEQ ID NO: 4054726 - RNA, 15 nt, Vaccinia virus
cagaaggaaacuucu

SEQ ID NO: 4054727 - RNA, 18 nt, Vaccinia virus
cagaaggcgguaauagaa

SEQ ID NO: 4054728 - RNA, 14 nt, Vaccinia virus
cagaaguaaugaag

SEQ ID NO: 4054729 - RNA, 21 nt, Vaccinia virus
cagaagugugaauaugaucuu

SEQ ID NO: 4054730 - RNA, 13 nt, Vaccinia virus
cagaauaaaucaa

SEQ ID NO: 4054731 - RNA, 22 nt, Vaccinia virus
cagaauagagccaaaaugguaa

SEQ ID NO: 4054732 - RNA, 19 nt, Vaccinia virus
cagaaucauacaaugaauu

SEQ ID NO: 4054733 - RNA, 16 nt, Vaccinia virus
cagaauucuaaaugau

SEQ ID NO: 4054734 - RNA, 21 nt, Vaccinia virus
cagaauucuaaaugaugauau

SEQ ID NO: 4054735 - RNA, 18 nt, Vaccinia virus
cagaauuucuacauaauu

SEQ ID NO: 4054736 - RNA, 21 nt, Vaccinia virus
cagacauugucugacugaaua

SEQ ID NO: 4054737 - RNA, 13 nt, Vaccinia virus
cagacuguuuaug

SEQ ID NO: 4054738 - RNA, 15 nt, Vaccinia virus
cagagaggccaucug

SEQ ID NO: 4054739 - RNA, 18 nt, Vaccinia virus
cagagcucaucuaaaaaa

SEQ ID NO: 4054740 - RNA, 15 nt, Vaccinia virus
cagaggaguuauuua

SEQ ID NO: 4054741 - RNA, 17 nt, Vaccinia virus
cagaggauaacuauuua

SEQ ID NO: 4054742 - RNA, 15 nt, Vaccinia virus
cagagguuguauuua

SEQ ID NO: 4054743 - RNA, 14 nt, Vaccinia virus
cagauaauaacaga

SEQ ID NO: 4054744 - RNA, 20 nt, Vaccinia virus
cagauacaguuaauaucuau

SEQ ID NO: 4054745 - RNA, 20 nt, Vaccinia virus
cagauacgaugaugauguag

SEQ ID NO: 4054746 - RNA, 18 nt, Vaccinia virus
cagauagauaaagucuug

SEQ ID NO: 4054747 - RNA, 23 nt, Vaccinia virus
cagauuacgagccagaucuucuu

SEQ ID NO: 4054748 - RNA, 18 nt, Vaccinia virus
cagauuuuugaaugaaug

SEQ ID NO: 4054749 - RNA, 16 nt, Vaccinia virus
cagcgaacuugauauu

SEQ ID NO: 4054750 - RNA, 19 nt, Vaccinia virus
cagcuauguuaucaugaaa

SEQ ID NO: 4054751 - RNA, 17 nt, Vaccinia virus
caggauaaggaauugua

SEQ ID NO: 4054752 - RNA, 23 nt, Vaccinia virus
cagggaacggcuaaaaguauuuu

SEQ ID NO: 4054753 - RNA, 16 nt, Vaccinia virus
cagguauacuguucag

SEQ ID NO: 4054754 - RNA, 12 nt, Vaccinia virus
caguaaauguuc

SEQ ID NO: 4054755 - RNA, 19 nt, Vaccinia virus
caguaaccaaauacauauu

SEQ ID NO: 4054756 - RNA, 18 nt, Vaccinia virus
caguaaguacaucaucug

SEQ ID NO: 4054757 - RNA, 14 nt, Vaccinia virus
caguaguaaugaag

SEQ ID NO: 4054758 - RNA, 13 nt, Vaccinia virus
caguaguauacau

SEQ ID NO: 4054759 - RNA, 14 nt, Vaccinia virus
caguaguucauuau

SEQ ID NO: 4054760 - RNA, 22 nt, Vaccinia virus
caguaguugcgggaacaauauu

SEQ ID NO: 4054761 - RNA, 14 nt, Vaccinia virus
caguauaccaaaca

SEQ ID NO: 4054762 - RNA, 15 nt, Vaccinia virus
caguauaccaaacau

SEQ ID NO: 4054763 - RNA, 21 nt, Vaccinia virus
caguaucgaaaaaugcugaag

SEQ ID NO: 4054764 - RNA, 15 nt, Vaccinia virus
caguauuauuaauau

SEQ ID NO: 4054765 - RNA, 18 nt, Vaccinia virus
cagucaagucaaugauau

SEQ ID NO: 4054766 - RNA, 11 nt, Vaccinia virus
cagucaugaaa

SEQ ID NO: 4054767 - RNA, 15 nt, Vaccinia virus
cagucauuccaucau

SEQ ID NO: 4054768 - RNA, 19 nt, Vaccinia virus
cagucuugaaacagcaucu

SEQ ID NO: 4054769 - RNA, 18 nt, Vaccinia virus
cagugacggauauacaaa

SEQ ID NO: 4054770 - RNA, 17 nt, Vaccinia virus
cagugacuguaucacac

SEQ ID NO: 4054771 - RNA, 22 nt, Vaccinia virus
cagugguuuuauuuuauccuug

SEQ ID NO: 4054772 - RNA, 20 nt, Vaccinia virus
caguugaauggauucguccu

SEQ ID NO: 4054773 - RNA, 19 nt, Vaccinia virus
caguuucaucgauaaagga

SEQ ID NO: 4054774 - RNA, 18 nt, Vaccinia virus
caguuucuagugacaaaa

SEQ ID NO: 4054775 - RNA, 15 nt, Vaccinia virus
caguuuuaguauuuu

SEQ ID NO: 4054776 - RNA, 21 nt, Vaccinia virus
cauaaaaauaaaaauauaauu

SEQ ID NO: 4054777 - RNA, 14 nt, Vaccinia virus
cauaaaacaucauu

SEQ ID NO: 4054778 - RNA, 18 nt, Vaccinia virus
cauaaaacucauuguuua

SEQ ID NO: 4054779 - RNA, 14 nt, Vaccinia virus
cauaaaauuuaaga

SEQ ID NO: 4054780 - RNA, 12 nt, Vaccinia virus
cauaaacaaauu

SEQ ID NO: 4054781 - RNA, 16 nt, Vaccinia virus
cauaaacaauauaaau

SEQ ID NO: 4054782 - RNA, 12 nt, Vaccinia virus
cauaaacauguc

SEQ ID NO: 4054783 - RNA, 14 nt, Vaccinia virus
cauaaacugauacg

SEQ ID NO: 4054784 - RNA, 18 nt, Vaccinia virus
cauaaaggaauauacaaa

SEQ ID NO: 4054785 - RNA, 15 nt, Vaccinia virus
cauaaauaaaaacuu

SEQ ID NO: 4054786 - RNA, 22 nt, Vaccinia virus
cauaaauaauaaauacaauaau

SEQ ID NO: 4054787 - RNA, 16 nt, Vaccinia virus
cauaaauuauuucauu

SEQ ID NO: 4054788 - RNA, 20 nt, Vaccinia virus
cauaacaccacgaacauguc

SEQ ID NO: 4054789 - RNA, 16 nt, Vaccinia virus
cauaacuguauaaaau

SEQ ID NO: 4054790 - RNA, 17 nt, Vaccinia virus
cauaacuucguuguccu

SEQ ID NO: 4054791 - RNA, 19 nt, Vaccinia virus
cauaacuugagagcaucca

SEQ ID NO: 4054792 - RNA, 19 nt, Vaccinia virus
cauaauacuaucuauguua

SEQ ID NO: 4054793 - RNA, 15 nt, Vaccinia virus
cauaauacucaauac

SEQ ID NO: 4054794 - RNA, 13 nt, Vaccinia virus
cauaauauauaca

SEQ ID NO: 4054795 - RNA, 13 nt, Vaccinia virus
cauaauaucuuua

SEQ ID NO: 4054796 - RNA, 15 nt, Vaccinia virus
cauaauauuaaacac

SEQ ID NO: 4054797 - RNA, 20 nt, Vaccinia virus
cauaaucaucacugucauca

SEQ ID NO: 4054798 - RNA, 20 nt, Vaccinia virus
cauaaugucuagcagcaucu

SEQ ID NO: 4054799 - RNA, 20 nt, Vaccinia virus
cauaauuaaauuaucgacau

SEQ ID NO: 4054800 - RNA, 15 nt, Vaccinia virus
cauaauuacauuuag

SEQ ID NO: 4054801 - RNA, 18 nt, Vaccinia virus
cauaauuauucuaucaau

SEQ ID NO: 4054802 - RNA, 21 nt, Vaccinia virus
cauaauuguuagcuguuuuca

SEQ ID NO: 4054803 - RNA, 15 nt, Vaccinia virus
cauacacuacaguaa

SEQ ID NO: 4054804 - RNA, 21 nt, Vaccinia virus
cauacgugccagcuauguuua

SEQ ID NO: 4054805 - RNA, 12 nt, Vaccinia virus
cauacuacuuau

SEQ ID NO: 4054806 - RNA, 20 nt, Vaccinia virus
cauacuaggagccaucauuu

SEQ ID NO: 4054807 - RNA, 14 nt, Vaccinia virus
cauacuauuguuua

SEQ ID NO: 4054808 - RNA, 21 nt, Vaccinia virus
cauagauauuaauuaucacau

SEQ ID NO: 4054809 - RNA, 16 nt, Vaccinia virus
cauagaugauauugua

SEQ ID NO: 4054810 - RNA, 20 nt, Vaccinia virus
cauagcauaguuuuucauaa

SEQ ID NO: 4054811 - RNA, 20 nt, Vaccinia virus
cauagguagagauacuuuca

SEQ ID NO: 4054812 - RNA, 18 nt, Vaccinia virus
cauaguggacaacauuaa

SEQ ID NO: 4054813 - RNA, 16 nt, Vaccinia virus
cauaguuuguaucaau

SEQ ID NO: 4054814 - RNA, 15 nt, Vaccinia virus
cauauaaaaaaugau

SEQ ID NO: 4054815 - RNA, 18 nt, Vaccinia virus
cauauagauauuuucuuu

SEQ ID NO: 4054816 - RNA, 14 nt, Vaccinia virus
cauauauuacguaa

SEQ ID NO: 4054817 - RNA, 17 nt, Vaccinia virus
cauauauuagaaauaca

SEQ ID NO: 4054818 - RNA, 20 nt, Vaccinia virus
cauaucgucuagauuuuguu

SEQ ID NO: 4054819 - RNA, 19 nt, Vaccinia virus
cauaucuauaggaaaggau

SEQ ID NO: 4054820 - RNA, 13 nt, Vaccinia virus
cauauuacauaau

SEQ ID NO: 4054821 - RNA, 19 nt, Vaccinia virus
cauauuauuuuuauguuuu

SEQ ID NO: 4054822 - RNA, 16 nt, Vaccinia virus
cauauucuaugaauuu

SEQ ID NO: 4054823 - RNA, 14 nt, Vaccinia virus
cauauugacgaugu

SEQ ID NO: 4054824 - RNA, 15 nt, Vaccinia virus
cauauugaucauuua

SEQ ID NO: 4054825 - RNA, 23 nt, Vaccinia virus
cauauuuucugguaguguuucua

SEQ ID NO: 4054826 - RNA, 19 nt, Vaccinia virus
caucaaaugguacaaaaaa

SEQ ID NO: 4054827 - RNA, 21 nt, Vaccinia virus
caucaaccuuccgacuaaaga

SEQ ID NO: 4054828 - RNA, 15 nt, Vaccinia virus
caucaaucaucauuu

SEQ ID NO: 4054829 - RNA, 18 nt, Vaccinia virus
caucagaaaugacuccau

SEQ ID NO: 4054830 - RNA, 21 nt, Vaccinia virus
caucagacguuccggaaagag

SEQ ID NO: 4054831 - RNA, 17 nt, Vaccinia virus
caucagcugaaaaacua

SEQ ID NO: 4054832 - RNA, 18 nt, Vaccinia virus
caucaguaucuucagaca

SEQ ID NO: 4054833 - RNA, 21 nt, Vaccinia virus
caucauacgaaaauagauucu

SEQ ID NO: 4054834 - RNA, 21 nt, Vaccinia virus
caucaucaaaagacuuaugau

SEQ ID NO: 4054835 - RNA, 17 nt, Vaccinia virus
cauccaagucaauaucu

SEQ ID NO: 4054836 - RNA, 24 nt, Vaccinia virus
cauccaugagauugaaugccauuu

SEQ ID NO: 4054837 - RNA, 19 nt, Vaccinia virus
cauccauuuuaugcgaugu

SEQ ID NO: 4054838 - RNA, 17 nt, Vaccinia virus
cauccuacuaugcaauu

SEQ ID NO: 4054839 - RNA, 16 nt, Vaccinia virus
cauccuuuauuaauaa

SEQ ID NO: 4054840 - RNA, 21 nt, Vaccinia virus
caucgauuuuuagauuucauu

SEQ ID NO: 4054841 - RNA, 21 nt, Vaccinia virus
caucgguacggguauucauuu

SEQ ID NO: 4054842 - RNA, 20 nt, Vaccinia virus
caucgucgucuacuauucua

SEQ ID NO: 4054843 - RNA, 19 nt, Vaccinia virus
caucuaacuauaugauauc

SEQ ID NO: 4054844 - RNA, 12 nt, Vaccinia virus
caucuacauaau

SEQ ID NO: 4054845 - RNA, 15 nt, Vaccinia virus
caucuacauaaucua

SEQ ID NO: 4054846 - RNA, 18 nt, Vaccinia virus
caucuauagaaacauauu

SEQ ID NO: 4054847 - RNA, 18 nt, Vaccinia virus
caucuauaggugaugcug

SEQ ID NO: 4054848 - RNA, 18 nt, Vaccinia virus
caucuaucaaacaaaauu

SEQ ID NO: 4054849 - RNA, 12 nt, Vaccinia virus
caucuaucaucu

SEQ ID NO: 4054850 - RNA, 13 nt, Vaccinia virus
caucuaucaucuc

SEQ ID NO: 4054851 - RNA, 23 nt, Vaccinia virus
caucuaucaucuccacacaguca

SEQ ID NO: 4054852 - RNA, 18 nt, Vaccinia virus
caucuauuaaguuuuuuu

SEQ ID NO: 4054853 - RNA, 20 nt, Vaccinia virus
caucuauuguuauauaacaa

SEQ ID NO: 4054854 - RNA, 17 nt, Vaccinia virus
caucugauaauuuagau

SEQ ID NO: 4054855 - RNA, 24 nt, Vaccinia virus
caucugccauaauccuauucuuga

SEQ ID NO: 4054856 - RNA, 12 nt, Vaccinia virus
caucugucauau

SEQ ID NO: 4054857 - RNA, 18 nt, Vaccinia virus
caucuucgucuauuucua

SEQ ID NO: 4054858 - RNA, 20 nt, Vaccinia virus
caucuuggacggaaucgauu

SEQ ID NO: 4054859 - RNA, 23 nt, Vaccinia virus
caugaaaccacugucuaaaugua

SEQ ID NO: 4054860 - RNA, 17 nt, Vaccinia virus
caugaaaugaugauaua

SEQ ID NO: 4054861 - RNA, 18 nt, Vaccinia virus
caugaacacgaugauaua

SEQ ID NO: 4054862 - RNA, 16 nt, Vaccinia virus
caugaaucuaaaagaa

SEQ ID NO: 4054863 - RNA, 17 nt, Vaccinia virus
caugagauugaaugcca

SEQ ID NO: 4054864 - RNA, 19 nt, Vaccinia virus
caugaucaagagugauuua

SEQ ID NO: 4054865 - RNA, 15 nt, Vaccinia virus
caugauuaguauuuu

SEQ ID NO: 4054866 - RNA, 20 nt, Vaccinia virus
caugauuucauuaucggugu

SEQ ID NO: 4054867 - RNA, 17 nt, Vaccinia virus
cauggauuuuauauaga

SEQ ID NO: 4054868 - RNA, 18 nt, Vaccinia virus
caugggucauagaauuua

SEQ ID NO: 4054869 - RNA, 16 nt, Vaccinia virus
caugggugacauaauu

SEQ ID NO: 4054870 - RNA, 20 nt, Vaccinia virus
cauggucuagauguaaaaaa

SEQ ID NO: 4054871 - RNA, 18 nt, Vaccinia virus
cauggugauuuauggaua

SEQ ID NO: 4054872 - RNA, 22 nt, Vaccinia virus
caugucugauauuuugauguau

SEQ ID NO: 4054873 - RNA, 21 nt, Vaccinia virus
cauguucauuggcuguggaau

SEQ ID NO: 4054874 - RNA, 18 nt, Vaccinia virus
cauguuugcucucugaau

SEQ ID NO: 4054875 - RNA, 17 nt, Vaccinia virus
cauguuuuaaugcauuc

SEQ ID NO: 4054876 - RNA, 22 nt, Vaccinia virus
cauuaaacccucgaucaugaau

SEQ ID NO: 4054877 - RNA, 15 nt, Vaccinia virus
cauuaaauguuucau

SEQ ID NO: 4054878 - RNA, 14 nt, Vaccinia virus
cauuaacuauuuuu

SEQ ID NO: 4054879 - RNA, 21 nt, Vaccinia virus
cauuaaggcguugaugcaauu

SEQ ID NO: 4054880 - RNA, 16 nt, Vaccinia virus
cauuaauagaaugaag

SEQ ID NO: 4054881 - RNA, 16 nt, Vaccinia virus
cauuaaucuauuagaa

SEQ ID NO: 4054882 - RNA, 13 nt, Vaccinia virus
cauuaauuucuga

SEQ ID NO: 4054883 - RNA, 16 nt, Vaccinia virus
cauuaauuucugauau

SEQ ID NO: 4054884 - RNA, 22 nt, Vaccinia virus
cauuagccacguucacuguaaa

SEQ ID NO: 4054885 - RNA, 19 nt, Vaccinia virus
cauuaggaaauguuucuga

SEQ ID NO: 4054886 - RNA, 18 nt, Vaccinia virus
cauuagguuaaaugauuu

SEQ ID NO: 4054887 - RNA, 21 nt, Vaccinia virus
cauuauaugggguuacucuaa

SEQ ID NO: 4054888 - RNA, 15 nt, Vaccinia virus
cauuaucaaaaagaa

SEQ ID NO: 4054889 - RNA, 14 nt, Vaccinia virus
cauuauucuauuuc

SEQ ID NO: 4054890 - RNA, 11 nt, Vaccinia virus
cauuauuggaa

SEQ ID NO: 4054891 - RNA, 23 nt, Vaccinia virus
cauuauuuaccgaacaggcauuu

SEQ ID NO: 4054892 - RNA, 19 nt, Vaccinia virus
acagauagaucauuuugaa

SEQ ID NO: 4054893 - RNA, 16 nt, Vaccinia virus
acagaugccagauuac

SEQ ID NO: 4054894 - RNA, 20 nt, Vaccinia virus
acagcacuguggaugugaca

SEQ ID NO: 4054895 - RNA, 20 nt, Vaccinia virus
acaggaccguauuagaaugu

SEQ ID NO: 4054896 - RNA, 19 nt, Vaccinia virus
acaguaguaauuaaugaaa

SEQ ID NO: 4054897 - RNA, 21 nt, Vaccinia virus
acagucugcggacuuuaaaca

SEQ ID NO: 4054898 - RNA, 15 nt, Vaccinia virus
acauaaaaaaaaugu

SEQ ID NO: 4054899 - RNA, 15 nt, Vaccinia virus
acauaaauaauucua

SEQ ID NO: 4054900 - RNA, 18 nt, Vaccinia virus
acauagaguuaagagaga

SEQ ID NO: 4054901 - RNA, 24 nt, Vaccinia virus
acauagaugugguaauaucugacu

SEQ ID NO: 4054902 - RNA, 20 nt, Vaccinia virus
acauaguguuuuauauucca

SEQ ID NO: 4054903 - RNA, 20 nt, Vaccinia virus
acauaguugaauaaauccuc

SEQ ID NO: 4054904 - RNA, 16 nt, Vaccinia virus
acauauauuauuacau

SEQ ID NO: 4054905 - RNA, 15 nt, Vaccinia virus
acauaucuaacaaug

SEQ ID NO: 4054906 - RNA, 19 nt, Vaccinia virus
acauaugguuucuaaaucu

SEQ ID NO: 4054907 - RNA, 15 nt, Vaccinia virus
acauauuaaaaauuc

SEQ ID NO: 4054908 - RNA, 22 nt, Vaccinia virus
acauauuauucaaaauaugauu

SEQ ID NO: 4054909 - RNA, 16 nt, Vaccinia virus
acauauuuuaaugaac

SEQ ID NO: 4054910 - RNA, 14 nt, Vaccinia virus
acaucaaaauaaua

SEQ ID NO: 4054911 - RNA, 14 nt, Vaccinia virus
acaucaaaugaugu

SEQ ID NO: 4054912 - RNA, 19 nt, Vaccinia virus
acauccuuccaagaagaag

SEQ ID NO: 4054913 - RNA, 18 nt, Vaccinia virus
acauccuucuauguugac

SEQ ID NO: 4054914 - RNA, 20 nt, Vaccinia virus
acaucggcugccaaaguuau

SEQ ID NO: 4054915 - RNA, 17 nt, Vaccinia virus
acaucuauauacuauau

SEQ ID NO: 4054916 - RNA, 13 nt, Vaccinia virus
acaucucucauaa

SEQ ID NO: 4054917 - RNA, 21 nt, Vaccinia virus
acaucucuggaaauagaauuc

SEQ ID NO: 4054918 - RNA, 19 nt, Vaccinia virus
acaucugcguuaucaauaa

SEQ ID NO: 4054919 - RNA, 22 nt, Vaccinia virus
acaucuguuugagaauuaagau

SEQ ID NO: 4054920 - RNA, 15 nt, Vaccinia virus
acaucuuuccuacau

SEQ ID NO: 4054921 - RNA, 16 nt, Vaccinia virus
acaugacauuuuccuu

SEQ ID NO: 4054922 - RNA, 18 nt, Vaccinia virus
acaugagagaaacaauau

SEQ ID NO: 4054923 - RNA, 14 nt, Vaccinia virus
acaugcagaagaac

SEQ ID NO: 4054924 - RNA, 18 nt, Vaccinia virus
acaugcgguucaaaauag

SEQ ID NO: 4054925 - RNA, 18 nt, Vaccinia virus
acaugcuacaaaauaugu

SEQ ID NO: 4054926 - RNA, 13 nt, Vaccinia virus
acaugcuguauac

SEQ ID NO: 4054927 - RNA, 23 nt, Vaccinia virus
acaugguuaaaguacauguacaa

SEQ ID NO: 4054928 - RNA, 18 nt, Vaccinia virus
acaugguucuccaugaau

SEQ ID NO: 4054929 - RNA, 11 nt, Vaccinia virus
acauguaacug

SEQ ID NO: 4054930 - RNA, 22 nt, Vaccinia virus
acauguauacuugacaaaaauu

SEQ ID NO: 4054931 - RNA, 18 nt, Vaccinia virus
acaugucaucgaaauggu

SEQ ID NO: 4054932 - RNA, 17 nt, Vaccinia virus
acaugucucucucaaau

SEQ ID NO: 4054933 - RNA, 17 nt, Vaccinia virus
acauguguuuuagaaua

SEQ ID NO: 4054934 - RNA, 13 nt, Vaccinia virus
acauguuaguaga

SEQ ID NO: 4054935 - RNA, 21 nt, Vaccinia virus
acauguuccagaugucauaau

SEQ ID NO: 4054936 - RNA, 16 nt, Vaccinia virus
acauuaaaaauuucca

SEQ ID NO: 4054937 - RNA, 22 nt, Vaccinia virus
acauuagcagauuaguaugaag

SEQ ID NO: 4054938 - RNA, 13 nt, Vaccinia virus
acauuauaauaau

SEQ ID NO: 4054939 - RNA, 22 nt, Vaccinia virus
acauuaugccguuaucauuaau

SEQ ID NO: 4054940 - RNA, 16 nt, Vaccinia virus
acauucagaaagacga

SEQ ID NO: 4054941 - RNA, 12 nt, Vaccinia virus
acauucaucaau

SEQ ID NO: 4054942 - RNA, 14 nt, Vaccinia virus
acauuccuaugaug

SEQ ID NO: 4054943 - RNA, 22 nt, Vaccinia virus
acauucgauggucuaucuauca

SEQ ID NO: 4054944 - RNA, 14 nt, Vaccinia virus
acauucuuaaacaa

SEQ ID NO: 4054945 - RNA, 14 nt, Vaccinia virus
aaaaaaagaauaua

SEQ ID NO: 4054946 - RNA, 13 nt, Vaccinia virus
aaaaaaauaaaua

SEQ ID NO: 4054947 - RNA, 13 nt, Vaccinia virus
aaaaaagaacuaa

SEQ ID NO: 4054948 - RNA, 12 nt, Vaccinia virus
aaaaaauauauu

SEQ ID NO: 4054949 - RNA, 16 nt, Vaccinia virus
aaaaacucuaacaugu

SEQ ID NO: 4054950 - RNA, 16 nt, Vaccinia virus
aaaaagaaagaauaua

SEQ ID NO: 4054951 - RNA, 22 nt, Vaccinia virus
aaaaagauuaccguaugauaug

SEQ ID NO: 4054952 - RNA, 19 nt, Vaccinia virus
aaaaagauuucagaaucua

SEQ ID NO: 4054953 - RNA, 15 nt, Vaccinia virus
aaaaagauuuuguua

SEQ ID NO: 4054954 - RNA, 19 nt, Vaccinia virus
aaaaagccccaauuuacaa

SEQ ID NO: 4054955 - RNA, 15 nt, Vaccinia virus
aaaaaguuuuaacau

SEQ ID NO: 4054956 - RNA, 12 nt, Vaccinia virus
aaaaauaaacaa

SEQ ID NO: 4054957 - RNA, 21 nt, Vaccinia virus
aaaaaucugauagaaagaaua

SEQ ID NO: 4054958 - RNA, 14 nt, Vaccinia virus
aaaaaucuuuguuc

SEQ ID NO: 4054959 - RNA, 14 nt, Vaccinia virus
aaaaaugaugaauu

SEQ ID NO: 4054960 - RNA, 22 nt, Vaccinia virus
aaaaauuuuaagcgaugauaug

SEQ ID NO: 4054961 - RNA, 22 nt, Vaccinia virus
aaaacaaauuuguacaugaaga

SEQ ID NO: 4054962 - RNA, 23 nt, Vaccinia virus
aaaacagaauaugagaaugaaua

SEQ ID NO: 4054963 - RNA, 11 nt, Vaccinia virus
aaaacagauga

SEQ ID NO: 4054964 - RNA, 11 nt, Vaccinia virus
aaaacauaaua

SEQ ID NO: 4054965 - RNA, 16 nt, Vaccinia virus
aaaacauucaaauguu

SEQ ID NO: 4054966 - RNA, 21 nt, Vaccinia virus
aaaaccaguauuuguagcaag

SEQ ID NO: 4054967 - RNA, 16 nt, Vaccinia virus
aaaaccguuaaaaugu

SEQ ID NO: 4054968 - RNA, 18 nt, Vaccinia virus
aaaacuaucaaugauaug

SEQ ID NO: 4054969 - RNA, 17 nt, Vaccinia virus
aaaacucuaagaacuua

SEQ ID NO: 4054970 - RNA, 16 nt, Vaccinia virus
aaaacugaaaauauau

SEQ ID NO: 4054971 - RNA, 19 nt, Vaccinia virus
aaaacugguuaaaacagua

SEQ ID NO: 4054972 - RNA, 22 nt, Vaccinia virus
aaaacugguuuaacuaauaaua

SEQ ID NO: 4054973 - RNA, 18 nt, Vaccinia virus
aaaacuugauaauuaaua

SEQ ID NO: 4054974 - RNA, 22 nt, Vaccinia virus
aaaagcuauuaucaaauacugu

SEQ ID NO: 4054975 - RNA, 13 nt, Vaccinia virus
aaaagcuuaaaau

SEQ ID NO: 4054976 - RNA, 23 nt, Vaccinia virus
aaaaggaauuuaccagugauuau

SEQ ID NO: 4054977 - RNA, 17 nt, Vaccinia virus
aaaaggucauaacaagu

SEQ ID NO: 4054978 - RNA, 12 nt, Vaccinia virus
aaaaguaaauga

SEQ ID NO: 4054979 - RNA, 16 nt, Vaccinia virus
aaaaguccucgaauua

SEQ ID NO: 4054980 - RNA, 13 nt, Vaccinia virus
aaaaguuaaaacu

SEQ ID NO: 4054981 - RNA, 22 nt, Vaccinia virus
aaaaguuguagaacguaaauua

SEQ ID NO: 4054982 - RNA, 15 nt, Vaccinia virus
aaaauaaaaugagua

SEQ ID NO: 4054983 - RNA, 20 nt, Vaccinia virus
aaaauaaacacauagaaaua

SEQ ID NO: 4054984 - RNA, 13 nt, Vaccinia virus
aaaauaauaauua

SEQ ID NO: 4054985 - RNA, 15 nt, Vaccinia virus
aaaauaauaugauua

SEQ ID NO: 4054986 - RNA, 10 nt, Vaccinia virus
aaaauacuua

SEQ ID NO: 4054987 - RNA, 19 nt, Vaccinia virus
aaaauauaaugauauacaa

SEQ ID NO: 4054988 - RNA, 14 nt, Vaccinia virus
aaaauauaauguac

SEQ ID NO: 4054989 - RNA, 13 nt, Vaccinia virus
aaaauauaauuua

SEQ ID NO: 4054990 - RNA, 13 nt, Vaccinia virus
aaaauauguagaa

SEQ ID NO: 4054991 - RNA, 18 nt, Vaccinia virus
aaaauauuuauuagaaca

SEQ ID NO: 4054992 - RNA, 22 nt, Vaccinia virus
aaaauauuuuuauucucuuucu

SEQ ID NO: 4054993 - RNA, 22 nt, Vaccinia virus
aaaaucgucuucacaaagaaug

SEQ ID NO: 4054994 - RNA, 21 nt, Vaccinia virus
aaaaucguguuuguguaguuu

SEQ ID NO: 4054995 - RNA, 22 nt, Vaccinia virus
aaaaucuuuguucuaaaaacug

SEQ ID NO: 4054996 - RNA, 16 nt, Vaccinia virus
aaaaugcagaaaugau

SEQ ID NO: 4054997 - RNA, 19 nt, Vaccinia virus
aaaaugcauguacagaauc

SEQ ID NO: 4054998 - RNA, 19 nt, Vaccinia virus
aaaaugcgauguugauuua

SEQ ID NO: 4054999 - RNA, 15 nt, Vaccinia virus
aaaaugcuagaauua

SEQ ID NO: 4055000 - RNA, 21 nt, Vaccinia virus
aaaaugcuccgcauaacucua

SEQ ID NO: 4055001 - RNA, 15 nt, Vaccinia virus
aaaauggacguagaa

SEQ ID NO: 4055002 - RNA, 18 nt, Vaccinia virus
aaaauggugcuauuagaa

SEQ ID NO: 4055003 - RNA, 16 nt, Vaccinia virus
aaaaugugauauagaa

SEQ ID NO: 4055004 - RNA, 17 nt, Vaccinia virus
aaaauuccgcuacuaau

SEQ ID NO: 4055005 - RNA, 15 nt, Vaccinia virus
aaaauucgacaauga

SEQ ID NO: 4055006 - RNA, 20 nt, Vaccinia virus
aaaauucuuaaaauaauuua

SEQ ID NO: 4055007 - RNA, 13 nt, Vaccinia virus
aaaauugcauuug

SEQ ID NO: 4055008 - RNA, 19 nt, Vaccinia virus
aaaauuguaacaacaaugu

SEQ ID NO: 4055009 - RNA, 19 nt, Vaccinia virus
aaaauuguugaucauauag

SEQ ID NO: 4055010 - RNA, 15 nt, Vaccinia virus
aaaauuuaaagaaug

SEQ ID NO: 4055011 - RNA, 14 nt, Vaccinia virus
aaaauuuagaauga

SEQ ID NO: 4055012 - RNA, 15 nt, Vaccinia virus
aaacaaaauuuuacu

SEQ ID NO: 4055013 - RNA, 11 nt, Vaccinia virus
aaacaaacauc

SEQ ID NO: 4055014 - RNA, 12 nt, Vaccinia virus
aaacaacugaaa

SEQ ID NO: 4055015 - RNA, 22 nt, Vaccinia virus
aaacaagugauacguaagaaua

SEQ ID NO: 4055016 - RNA, 14 nt, Vaccinia virus
aaacaauacucuau

SEQ ID NO: 4055017 - RNA, 15 nt, Vaccinia virus
aaacaauguauacaa

SEQ ID NO: 4055018 - RNA, 12 nt, Vaccinia virus
aaacaauguuuc

SEQ ID NO: 4055019 - RNA, 20 nt, Vaccinia virus
aaacacugauucagaaaugg

SEQ ID NO: 4055020 - RNA, 22 nt, Vaccinia virus
aaacacuguuguuagagauuuu

SEQ ID NO: 4055021 - RNA, 16 nt, Vaccinia virus
aaacagaugguagaac

SEQ ID NO: 4055022 - RNA, 12 nt, Vaccinia virus
aaacauggagac

SEQ ID NO: 4055023 - RNA, 15 nt, Vaccinia virus
aaacauugauuaaau

SEQ ID NO: 4055024 - RNA, 18 nt, Vaccinia virus
aaacauuuuauuucuaga

SEQ ID NO: 4055025 - RNA, 20 nt, Vaccinia virus
aaaccaucggagaaggaaua

SEQ ID NO: 4055026 - RNA, 20 nt, Vaccinia virus
aaaccgaugauuauauguuc

SEQ ID NO: 4055027 - RNA, 19 nt, Vaccinia virus
aaacgaguacuuuaaagaa

SEQ ID NO: 4055028 - RNA, 17 nt, Vaccinia virus
aaacgauuaaacaauau

SEQ ID NO: 4055029 - RNA, 16 nt, Vaccinia virus
aaacuaaacuuauuua

SEQ ID NO: 4055030 - RNA, 20 nt, Vaccinia virus
aaacuaacauuguuaauuga

SEQ ID NO: 4055031 - RNA, 18 nt, Vaccinia virus
aaacuacgucaagacucu

SEQ ID NO: 4055032 - RNA, 14 nt, Vaccinia virus
aaacuacuggaaua

SEQ ID NO: 4055033 - RNA, 12 nt, Vaccinia virus
aaacuagcaaac

SEQ ID NO: 4055034 - RNA, 23 nt, Vaccinia virus
aaacuaugucaaaaauuguagaa

SEQ ID NO: 4055035 - RNA, 15 nt, Vaccinia virus
aauacuuaaaaugua

SEQ ID NO: 4055036 - RNA, 15 nt, Vaccinia virus
aauacuuuacgcuau

SEQ ID NO: 4055037 - RNA, 21 nt, Vaccinia virus
aauacuuuuuuuauuaaauga

SEQ ID NO: 4055038 - RNA, 17 nt, Vaccinia virus
aauagaaaaaacaugug

SEQ ID NO: 4055039 - RNA, 20 nt, Vaccinia virus
aauagaaucuauuuuaauga

SEQ ID NO: 4055040 - RNA, 11 nt, Vaccinia virus
aauagaaucug

SEQ ID NO: 4055041 - RNA, 14 nt, Vaccinia virus
aauagauaucauga

SEQ ID NO: 4055042 - RNA, 14 nt, Vaccinia virus
aauagaugaauaua

SEQ ID NO: 4055043 - RNA, 18 nt, Vaccinia virus
aauagauguauuugauau

SEQ ID NO: 4055044 - RNA, 22 nt, Vaccinia virus
aauagcaccuagacaaguugcu

SEQ ID NO: 4055045 - RNA, 18 nt, Vaccinia virus
aauagcuuuacuucuaua

SEQ ID NO: 4055046 - RNA, 18 nt, Vaccinia virus
aauaggaguuagaauaau

SEQ ID NO: 4055047 - RNA, 21 nt, Vaccinia virus
aauaguacgacuuuaaaucca

SEQ ID NO: 4055048 - RNA, 18 nt, Vaccinia virus
aauagucuuguaaagaua

SEQ ID NO: 4055049 - RNA, 20 nt, Vaccinia virus
aauagugucauuaggaguua

SEQ ID NO: 4055050 - RNA, 15 nt, Vaccinia virus
aauaguguuagauaa

SEQ ID NO: 4055051 - RNA, 14 nt, Vaccinia virus
aauaguguucuaaa

SEQ ID NO: 4055052 - RNA, 19 nt, Vaccinia virus
aauaguuacauacaaacug

SEQ ID NO: 4055053 - RNA, 14 nt, Vaccinia virus
aauaguuuaucaua

SEQ ID NO: 4055054 - RNA, 19 nt, Vaccinia virus
aauaguuuguuuuggaaau

SEQ ID NO: 4055055 - RNA, 17 nt, Vaccinia virus
aauauaaaaaaaugauu

SEQ ID NO: 4055056 - RNA, 12 nt, Vaccinia virus
aauauaaaacua

SEQ ID NO: 4055057 - RNA, 15 nt, Vaccinia virus
aauauaacaguaucu

SEQ ID NO: 4055058 - RNA, 18 nt, Vaccinia virus
aauauaaugauauacaau

SEQ ID NO: 4055059 - RNA, 21 nt, Vaccinia virus
aauauacagacucuaucgugu

SEQ ID NO: 4055060 - RNA, 12 nt, Vaccinia virus
aauauacucuau

SEQ ID NO: 4055061 - RNA, 12 nt, Vaccinia virus
aauauagaauau

SEQ ID NO: 4055062 - RNA, 20 nt, Vaccinia virus
aauauagcaucgauccauga

SEQ ID NO: 4055063 - RNA, 21 nt, Vaccinia virus
aauauagguauauuuauucca

SEQ ID NO: 4055064 - RNA, 15 nt, Vaccinia virus
aauauauugaucaua

SEQ ID NO: 4055065 - RNA, 12 nt, Vaccinia virus
aauaucauuaag

SEQ ID NO: 4055066 - RNA, 23 nt, Vaccinia virus
aauauccacuauugcaacuauaa

SEQ ID NO: 4055067 - RNA, 18 nt, Vaccinia virus
aauauccagaguguuuca

SEQ ID NO: 4055068 - RNA, 21 nt, Vaccinia virus
aauaucuaggacaauaguuuc

SEQ ID NO: 4055069 - RNA, 20 nt, Vaccinia virus
aauaucucaauaguuucaua

SEQ ID NO: 4055070 - RNA, 15 nt, Vaccinia virus
aauaucuguuccuca

SEQ ID NO: 4055071 - RNA, 14 nt, Vaccinia virus
aauaucuuaaauaa

SEQ ID NO: 4055072 - RNA, 17 nt, Vaccinia virus
aauaucuuuacgaauua

SEQ ID NO: 4055073 - RNA, 19 nt, Vaccinia virus
aauaucuuuauucauucca

SEQ ID NO: 4055074 - RNA, 14 nt, Vaccinia virus
aauaugauagaaau

SEQ ID NO: 4055075 - RNA, 20 nt, Vaccinia virus
aauaugauuagaaguuauau

SEQ ID NO: 4055076 - RNA, 22 nt, Vaccinia virus
aauaugcuaguuaauaguaaau

SEQ ID NO: 4055077 - RNA, 20 nt, Vaccinia virus
aauaugcucaugaacauuag

SEQ ID NO: 4055078 - RNA, 19 nt, Vaccinia virus
aauaugguaauuuagagaa

SEQ ID NO: 4055079 - RNA, 21 nt, Vaccinia virus
aauaugguauggguucugaua

SEQ ID NO: 4055080 - RNA, 22 nt, Vaccinia virus
aauauguucucgucuaagagau

SEQ ID NO: 4055081 - RNA, 13 nt, Vaccinia virus
aauauuaaaacuu

SEQ ID NO: 4055082 - RNA, 19 nt, Vaccinia virus
aauauuauauaaacauuug

SEQ ID NO: 4055083 - RNA, 20 nt, Vaccinia virus
aauauucacaagaugaauuc

SEQ ID NO: 4055084 - RNA, 14 nt, Vaccinia virus
aauauucuaaauua

SEQ ID NO: 4055085 - RNA, 23 nt, Vaccinia virus
aauauuguaacaauuuauuuugu

SEQ ID NO: 4055086 - RNA, 15 nt, Vaccinia virus
aauauuguagcauua

SEQ ID NO: 4055087 - RNA, 23 nt, Vaccinia virus
aauauuguuuuucacuuuuuaua

SEQ ID NO: 4055088 - RNA, 14 nt, Vaccinia virus
aauauuuaguauua

SEQ ID NO: 4055089 - RNA, 21 nt, Vaccinia virus
aauauuuaguuuauucauaau

SEQ ID NO: 4055090 - RNA, 14 nt, Vaccinia virus
aauauuuuuaguuu

SEQ ID NO: 4055091 - RNA, 13 nt, Vaccinia virus
aauauuuuuauuu

SEQ ID NO: 4055092 - RNA, 14 nt, Vaccinia virus
aauauuuuuccauu

SEQ ID NO: 4055093 - RNA, 13 nt, Vaccinia virus
aauauuuuucuau

SEQ ID NO: 4055094 - RNA, 16 nt, Vaccinia virus
aauauuuuuuagagaa

SEQ ID NO: 4055095 - RNA, 19 nt, Vaccinia virus
aaucaaggaacuaaauaga

SEQ ID NO: 4055096 - RNA, 19 nt, Vaccinia virus
aaucaagggaaaaucugaa

SEQ ID NO: 4055097 - RNA, 18 nt, Vaccinia virus
aaucaaugauagacuaga

SEQ ID NO: 4055098 - RNA, 19 nt, Vaccinia virus
aaucaauguacauacaucg

SEQ ID NO: 4055099 - RNA, 20 nt, Vaccinia virus
aaucaccaaauuuuacaaaa

SEQ ID NO: 4055100 - RNA, 20 nt, Vaccinia virus
aaucaccgcaagaacacacg

SEQ ID NO: 4055101 - RNA, 19 nt, Vaccinia virus
aaucacuacaauaauuaca

SEQ ID NO: 4055102 - RNA, 15 nt, Vaccinia virus
aaucacuauagaaaa

SEQ ID NO: 4055103 - RNA, 21 nt, Vaccinia virus
aaucacugcgauuguauuauc

SEQ ID NO: 4055104 - RNA, 14 nt, Vaccinia virus
aaucagaaaugaug

SEQ ID NO: 4055105 - RNA, 23 nt, Vaccinia virus
aaucagacugggaggaucacugu

SEQ ID NO: 4055106 - RNA, 15 nt, Vaccinia virus
aaucaguuuaggaaa

SEQ ID NO: 4055107 - RNA, 14 nt, Vaccinia virus
aaucauagaacugc

SEQ ID NO: 4055108 - RNA, 12 nt, Vaccinia virus
aaucaucacugu

SEQ ID NO: 4055109 - RNA, 18 nt, Vaccinia virus
aaucauccauaaauuaua

SEQ ID NO: 4055110 - RNA, 12 nt, Vaccinia virus
aaucauguacau

SEQ ID NO: 4055111 - RNA, 15 nt, Vaccinia virus
aaucauuaaaugauu

SEQ ID NO: 4055112 - RNA, 17 nt, Vaccinia virus
aaucauugggaaacauu

SEQ ID NO: 4055113 - RNA, 22 nt, Vaccinia virus
aaucauuucgacauuaauuccu

SEQ ID NO: 4055114 - RNA, 15 nt, Vaccinia virus
aauccaaaaaaugaa

SEQ ID NO: 4055115 - RNA, 15 nt, Vaccinia virus
aauccaaacaucacu

SEQ ID NO: 4055116 - RNA, 18 nt, Vaccinia virus
aauccaguaauaucaugu

SEQ ID NO: 4055117 - RNA, 20 nt, Vaccinia virus
aauccagucuuuaaugaauu

SEQ ID NO: 4055118 - RNA, 21 nt, Vaccinia virus
aauccaucuguauuaaagaua

SEQ ID NO: 4055119 - RNA, 15 nt, Vaccinia virus
aauccauucuaauga

SEQ ID NO: 4055120 - RNA, 20 nt, Vaccinia virus
aauccauucucucaaucacu

SEQ ID NO: 4055121 - RNA, 15 nt, Vaccinia virus
aauccuguuucuacu

SEQ ID NO: 4055122 - RNA, 21 nt, Vaccinia virus
aaucgauaaaaccaugaaaua

SEQ ID NO: 4055123 - RNA, 15 nt, Vaccinia virus
aaucguauaucuucu

SEQ ID NO: 4055124 - RNA, 23 nt, Vaccinia virus
aaucgucuauaauaaugaauauu

SEQ ID NO: 4055125 - RNA, 22 nt, Vaccinia virus
aaucuaauaacuugaaagagau

SEQ ID NO: 4055126 - RNA, 17 nt, Vaccinia virus
aaucuaccuauagaaaa

SEQ ID NO: 4055127 - RNA, 18 nt, Vaccinia virus
aaucuagauuccaaucau

SEQ ID NO: 4055128 - RNA, 18 nt, Vaccinia virus
aaucuaggaauuacauaa

SEQ ID NO: 4055129 - RNA, 19 nt, Vaccinia virus
aaucuaguacgcgaaauaa

SEQ ID NO: 4055130 - RNA, 23 nt, Vaccinia virus
aaucuaguuguggaaauacuucc

SEQ ID NO: 4055131 - RNA, 19 nt, Vaccinia virus
aaucuauccgcgacaaauu

SEQ ID NO: 4055132 - RNA, 19 nt, Vaccinia virus
aaucucguuacauguuauu

SEQ ID NO: 4055133 - RNA, 19 nt, Vaccinia virus
aaucucuaucaucacauau

SEQ ID NO: 4055134 - RNA, 14 nt, Vaccinia virus
aaucugaaaaugaa

SEQ ID NO: 4055135 - RNA, 23 nt, Vaccinia virus
aaucugagauuuuacguaucuau

SEQ ID NO: 4055136 - RNA, 11 nt, Vaccinia virus
aaucuggaaaa

SEQ ID NO: 4055137 - RNA, 21 nt, Vaccinia virus
aaucuuaaacauauagggaau

SEQ ID NO: 4055138 - RNA, 17 nt, Vaccinia virus
aaucuuaauaucuucgu

SEQ ID NO: 4055139 - RNA, 15 nt, Vaccinia virus
aaucuuggaaauuau

SEQ ID NO: 4055140 - RNA, 20 nt, Vaccinia virus
aaucuuggcauauugaucau

SEQ ID NO: 4055141 - RNA, 14 nt, Vaccinia virus
aaucuuuaauguaa

SEQ ID NO: 4055142 - RNA, 16 nt, Vaccinia virus
aaucuuugucaaauau

SEQ ID NO: 4055143 - RNA, 14 nt, Vaccinia virus
aaucuuuugugaaa

SEQ ID NO: 4055144 - RNA, 23 nt, Vaccinia virus
aaucuuuuuauuaguaggcaucu

SEQ ID NO: 4055145 - RNA, 12 nt, Vaccinia virus
aaugaaaauaua

SEQ ID NO: 4055146 - RNA, 23 nt, Vaccinia virus
aaugaaaauauaaauaguuuuua

SEQ ID NO: 4055147 - RNA, 12 nt, Vaccinia virus
aaugaaauucuu

SEQ ID NO: 4055148 - RNA, 23 nt, Vaccinia virus
aaugaacaucgggaauauagaau

SEQ ID NO: 4055149 - RNA, 21 nt, Vaccinia virus
aaugaagauaucauugauuga

SEQ ID NO: 4055150 - RNA, 19 nt, Vaccinia virus
aaugaagaucuauuuccag

SEQ ID NO: 4055151 - RNA, 13 nt, Vaccinia virus
aaugaauacagug

SEQ ID NO: 4055152 - RNA, 13 nt, Vaccinia virus
aaugaauauagau

SEQ ID NO: 4055153 - RNA, 17 nt, Vaccinia virus
aaugaaucccaaacauu

SEQ ID NO: 4055154 - RNA, 12 nt, Vaccinia virus
aaugaauguuua

SEQ ID NO: 4055155 - RNA, 23 nt, Vaccinia virus
aaugaauuaauuaagauauuguu

SEQ ID NO: 4055156 - RNA, 16 nt, Vaccinia virus
aaugaauuauuuacaa

SEQ ID NO: 4055157 - RNA, 22 nt, Vaccinia virus
aaugacaauaaaauuaucauga

SEQ ID NO: 4055158 - RNA, 21 nt, Vaccinia virus
aaugacaucuaugauuuuacu

SEQ ID NO: 4055159 - RNA, 18 nt, Vaccinia virus
aaugagagcaaaaauaua

SEQ ID NO: 4055160 - RNA, 22 nt, Vaccinia virus
aaugagauuauuaaguauuuau

SEQ ID NO: 4055161 - RNA, 21 nt, Vaccinia virus
aaugaggucgcaaaaaaacug

SEQ ID NO: 4055162 - RNA, 21 nt, Vaccinia virus
aaugaguaauuaauugucuua

SEQ ID NO: 4055163 - RNA, 13 nt, Vaccinia virus
aaugauaacuaga

SEQ ID NO: 4055164 - RNA, 13 nt, Vaccinia virus
aaugauaaugaua

SEQ ID NO: 4055165 - RNA, 15 nt, Vaccinia virus
aaugauaaugauaca

SEQ ID NO: 4055166 - RNA, 14 nt, Vaccinia virus
aaugauacagaaaa

SEQ ID NO: 4055167 - RNA, 21 nt, Vaccinia virus
aaugauauccgcgaacgauau

SEQ ID NO: 4055168 - RNA, 17 nt, Vaccinia virus
aaugauaucuuagaaua

SEQ ID NO: 4055169 - RNA, 19 nt, Vaccinia virus
aaugaucauccagauaaua

SEQ ID NO: 4055170 - RNA, 19 nt, Vaccinia virus
aaugaucucaauuagaaua

SEQ ID NO: 4055171 - RNA, 15 nt, Vaccinia virus
aaugaugaaaggaua

SEQ ID NO: 4055172 - RNA, 21 nt, Vaccinia virus
aaugaugaugaugaaauggau

SEQ ID NO: 4055173 - RNA, 16 nt, Vaccinia virus
aaugaugucaggaaau

SEQ ID NO: 4055174 - RNA, 21 nt, Vaccinia virus
aaugauuuagaaaugaaguua

SEQ ID NO: 4055175 - RNA, 14 nt, Vaccinia virus
aaugcaaauuacuu

SEQ ID NO: 4055176 - RNA, 23 nt, Vaccinia virus
aaugcacuguucaagaauuuaua

SEQ ID NO: 4055177 - RNA, 21 nt, Vaccinia virus
aaugcagauuuauugaaaaug

SEQ ID NO: 4055178 - RNA, 13 nt, Vaccinia virus
aaugcauuuuaua

SEQ ID NO: 4055179 - RNA, 23 nt, Vaccinia virus
aaugccuuacucgguguauauaa

SEQ ID NO: 4055180 - RNA, 15 nt, Vaccinia virus
aaugcuaauauuaaa

SEQ ID NO: 4055181 - RNA, 13 nt, Vaccinia virus
aauggaaauacuu

SEQ ID NO: 4055182 - RNA, 14 nt, Vaccinia virus
aauggaugucauga

SEQ ID NO: 4055183 - RNA, 13 nt, Vaccinia virus
aauggcaaaugua

SEQ ID NO: 4055184 - RNA, 14 nt, Vaccinia virus
aauggcugaauggc

SEQ ID NO: 4055185 - RNA, 18 nt, Vaccinia virus
aauggcuguuuguauaau

SEQ ID NO: 4055186 - RNA, 14 nt, Vaccinia virus
aaugggagcuuaaa

SEQ ID NO: 4055187 - RNA, 14 nt, Vaccinia virus
aaugguuucgaaga

SEQ ID NO: 4055188 - RNA, 12 nt, Vaccinia virus
aauguaaagaua

SEQ ID NO: 4055189 - RNA, 16 nt, Vaccinia virus
aauguaaagguuuaua

SEQ ID NO: 4055190 - RNA, 15 nt, Vaccinia virus
aauguacucaugaaa

SEQ ID NO: 4055191 - RNA, 21 nt, Vaccinia virus
aauguacuucgaugagauuga

SEQ ID NO: 4055192 - RNA, 22 nt, Vaccinia virus
aauguagaaauugaaaauaaua

SEQ ID NO: 4055193 - RNA, 14 nt, Vaccinia virus
aauguaguaaauau

SEQ ID NO: 4055194 - RNA, 12 nt, Vaccinia virus
aauguauaacag

SEQ ID NO: 4055195 - RNA, 21 nt, Vaccinia virus
aauguaugaacaucauggaau

SEQ ID NO: 4055196 - RNA, 15 nt, Vaccinia virus
aaugucaaguuuauu

SEQ ID NO: 4055197 - RNA, 15 nt, Vaccinia virus
aauguccaagucuug

SEQ ID NO: 4055198 - RNA, 14 nt, Vaccinia virus
aauguccacaaaug

SEQ ID NO: 4055199 - RNA, 18 nt, Vaccinia virus
aauguuaucgaugaugua

SEQ ID NO: 4055200 - RNA, 15 nt, Vaccinia virus
aauguuauuacuugu

SEQ ID NO: 4055201 - RNA, 12 nt, Vaccinia virus
aauguucaauau

SEQ ID NO: 4055202 - RNA, 15 nt, Vaccinia virus
aauguucugucuugu

SEQ ID NO: 4055203 - RNA, 20 nt, Vaccinia virus
aauguucuuaacuacauuca

SEQ ID NO: 4055204 - RNA, 20 nt, Vaccinia virus
aauguuuaaacaucaaacau

SEQ ID NO: 4055205 - RNA, 21 nt, Vaccinia virus
aauguuucgaugaaauagaua

SEQ ID NO: 4055206 - RNA, 16 nt, Vaccinia virus
aauuaacaauaucaau

SEQ ID NO: 4055207 - RNA, 23 nt, Vaccinia virus
aauuaaggagauagcuucaucua

SEQ ID NO: 4055208 - RNA, 13 nt, Vaccinia virus
aauuaauaaugau

SEQ ID NO: 4055209 - RNA, 15 nt, Vaccinia virus
aauuaauauguauga

SEQ ID NO: 4055210 - RNA, 15 nt, Vaccinia virus
aauuacagacagcaa

SEQ ID NO: 4055211 - RNA, 21 nt, Vaccinia virus
aauuacagaguuuucagaaga

SEQ ID NO: 4055212 - RNA, 15 nt, Vaccinia virus
aauuacccauggaga

SEQ ID NO: 4055213 - RNA, 20 nt, Vaccinia virus
aauuagucuauuauccaaga

SEQ ID NO: 4055214 - RNA, 17 nt, Vaccinia virus
aauuagugaucaguuua

SEQ ID NO: 4055215 - RNA, 12 nt, Vaccinia virus
aauuauauaaau

SEQ ID NO: 4055216 - RNA, 12 nt, Vaccinia virus
aauuauauuguc

SEQ ID NO: 4055217 - RNA, 15 nt, Vaccinia virus
aauuaucaaauacuu

SEQ ID NO: 4055218 - RNA, 12 nt, Vaccinia virus
aauuaucaaaug

SEQ ID NO: 4055219 - RNA, 22 nt, Vaccinia virus
aauuaucguuccugguauauag

SEQ ID NO: 4055220 - RNA, 22 nt, Vaccinia virus
aauuaugaaaaaguaaaugaug

SEQ ID NO: 4055221 - RNA, 19 nt, Vaccinia virus
aauuauuagcaaaaauaua

SEQ ID NO: 4055222 - RNA, 16 nt, Vaccinia virus
aauuauuauuaaauau

SEQ ID NO: 4055223 - RNA, 15 nt, Vaccinia virus
aauuauuauuacuga

SEQ ID NO: 4055224 - RNA, 21 nt, Vaccinia virus
aauuauucacaauaucaguau

SEQ ID NO: 4055225 - RNA, 23 nt, Vaccinia virus
aauuauucauucuagaacuauaa

SEQ ID NO: 4055226 - RNA, 22 nt, Vaccinia virus
aauuauuccucucaucacuaau

SEQ ID NO: 4055227 - RNA, 13 nt, Vaccinia virus
aauuauuuaacuu

SEQ ID NO: 4055228 - RNA, 19 nt, Vaccinia virus
aauuauuuuuucuuaguaa

SEQ ID NO: 4055229 - RNA, 17 nt, Vaccinia virus
aauucaaauagauguuc

SEQ ID NO: 4055230 - RNA, 19 nt, Vaccinia virus
aauucaucguuacggagau

SEQ ID NO: 4055231 - RNA, 16 nt, Vaccinia virus
aauucaucucuagaua

SEQ ID NO: 4055232 - RNA, 17 nt, Vaccinia virus
aauucaucuucuauaua

SEQ ID NO: 4055233 - RNA, 14 nt, Vaccinia virus
aauuccauaucuuu

SEQ ID NO: 4055234 - RNA, 20 nt, Vaccinia virus
aauuccauaucuuuuagaaa

SEQ ID NO: 4055235 - RNA, 19 nt, Vaccinia virus
aauuccggauacaugaaca

SEQ ID NO: 4055236 - RNA, 15 nt, Vaccinia virus
aauucgagaaagaua

SEQ ID NO: 4055237 - RNA, 21 nt, Vaccinia virus
aauucgaggaagauguaaaga

SEQ ID NO: 4055238 - RNA, 17 nt, Vaccinia virus
aauucuaugaugaaaca

SEQ ID NO: 4055239 - RNA, 15 nt, Vaccinia virus
aauucuauucuagua

SEQ ID NO: 4055240 - RNA, 15 nt, Vaccinia virus
aauugaguaaaugaa

SEQ ID NO: 4055241 - RNA, 13 nt, Vaccinia virus
aauugccaaagau

SEQ ID NO: 4055242 - RNA, 14 nt, Vaccinia virus
aauugcuuuucuaa

SEQ ID NO: 4055243 - RNA, 20 nt, Vaccinia virus
aauugguaacucauucuaua

SEQ ID NO: 4055244 - RNA, 16 nt, Vaccinia virus
aauuguauuauuuccc

SEQ ID NO: 4055245 - RNA, 15 nt, Vaccinia virus
aauugucacuuuguu

SEQ ID NO: 4055246 - RNA, 18 nt, Vaccinia virus
aauugucuacuaacauua

SEQ ID NO: 4055247 - RNA, 13 nt, Vaccinia virus
aauugucuagaua

SEQ ID NO: 4055248 - RNA, 15 nt, Vaccinia virus
aauugucuuucucuu

SEQ ID NO: 4055249 - RNA, 22 nt, Vaccinia virus
aauuguuuuuguacauaauaga

SEQ ID NO: 4055250 - RNA, 19 nt, Vaccinia virus
aauuuaaaguguaaauaua

SEQ ID NO: 4055251 - RNA, 17 nt, Vaccinia virus
aauuuacaaaacuggua

SEQ ID NO: 4055252 - RNA, 15 nt, Vaccinia virus
aauuuacauguucau

SEQ ID NO: 4055253 - RNA, 12 nt, Vaccinia virus
aauuuagaauga

SEQ ID NO: 4055254 - RNA, 12 nt, Vaccinia virus
aauuuaucaugg

SEQ ID NO: 4055255 - RNA, 14 nt, Vaccinia virus
aauuuauuaaauac

SEQ ID NO: 4055256 - RNA, 17 nt, Vaccinia virus
aauuuauuguaacagua

SEQ ID NO: 4055257 - RNA, 17 nt, Vaccinia virus
aauuuauuucagaaauu

SEQ ID NO: 4055258 - RNA, 12 nt, Vaccinia virus
aauuuauuucua

SEQ ID NO: 4055259 - RNA, 12 nt, Vaccinia virus
aauuucaaaaua

SEQ ID NO: 4055260 - RNA, 15 nt, Vaccinia virus
aauuucauccauuua

SEQ ID NO: 4055261 - RNA, 14 nt, Vaccinia virus
aauuuccaucucua

SEQ ID NO: 4055262 - RNA, 15 nt, Vaccinia virus
aauuucgaaaauaua

SEQ ID NO: 4055263 - RNA, 19 nt, Vaccinia virus
aauuucgaagcuagcgaua

SEQ ID NO: 4055264 - RNA, 20 nt, Vaccinia virus
aauuucuagaacaucaucuc

SEQ ID NO: 4055265 - RNA, 17 nt, Vaccinia virus
aauuucugguuagauaa

SEQ ID NO: 4055266 - RNA, 13 nt, Vaccinia virus
aauuugacuacau

SEQ ID NO: 4055267 - RNA, 15 nt, Vaccinia virus
aauuugauaaagaua

SEQ ID NO: 4055268 - RNA, 20 nt, Vaccinia virus
aauuugggaggcuuaaagug

SEQ ID NO: 4055269 - RNA, 23 nt, Vaccinia virus
aauuuguauguuugggagaauua

SEQ ID NO: 4055270 - RNA, 19 nt, Vaccinia virus
aauuuguccacguucuuua

SEQ ID NO: 4055271 - RNA, 13 nt, Vaccinia virus
aauuuuaagaaau

SEQ ID NO: 4055272 - RNA, 21 nt, Vaccinia virus
aauuuuaagauuuuaaaugua

SEQ ID NO: 4055273 - RNA, 17 nt, Vaccinia virus
aauuuuaauuaauguaa

SEQ ID NO: 4055274 - RNA, 13 nt, Vaccinia virus
aauuuuuuaaaaa

SEQ ID NO: 4055275 - RNA, 17 nt, Vaccinia virus
aauuuuuucguguucca

SEQ ID NO: 4055276 - RNA, 15 nt, Vaccinia virus
acaaaaaaaagaaua

SEQ ID NO: 4055277 - RNA, 17 nt, Vaccinia virus
acaaaaaagcucaauaa

SEQ ID NO: 4055278 - RNA, 14 nt, Vaccinia virus
acaaaaaaugaauu

SEQ ID NO: 4055279 - RNA, 21 nt, Vaccinia virus
acaaaaaaugaauuaauaaua

SEQ ID NO: 4055280 - RNA, 16 nt, Vaccinia virus
acaaaaagaaagaaua

SEQ ID NO: 4055281 - RNA, 15 nt, Vaccinia virus
acaaaacagaaauau

SEQ ID NO: 4055282 - RNA, 16 nt, Vaccinia virus
acaaaagguauuacaa

SEQ ID NO: 4055283 - RNA, 22 nt, Vaccinia virus
acaaaauaauaauggaaguacu

SEQ ID NO: 4055284 - RNA, 13 nt, Vaccinia virus
acaaaauaaugua

SEQ ID NO: 4055285 - RNA, 13 nt, Vaccinia virus
acaaaaucuaaac

SEQ ID NO: 4055286 - RNA, 20 nt, Vaccinia virus
acaaaauuuggguuuaauuu

SEQ ID NO: 4055287 - RNA, 16 nt, Vaccinia virus
acaaacaccauccuug

SEQ ID NO: 4055288 - RNA, 17 nt, Vaccinia virus
acaaacagucuaaacaa

SEQ ID NO: 4055289 - RNA, 21 nt, Vaccinia virus
acaaauauaugcaaaauaaua

SEQ ID NO: 4055290 - RNA, 13 nt, Vaccinia virus
acaaauguagaag

SEQ ID NO: 4055291 - RNA, 23 nt, Vaccinia virus
acaacaacgaaccaaaaugaauu

SEQ ID NO: 4055292 - RNA, 17 nt, Vaccinia virus
acaacauacuauuguuu

SEQ ID NO: 4055293 - RNA, 22 nt, Vaccinia virus
acaacaucacgcucgauaauca

SEQ ID NO: 4055294 - RNA, 20 nt, Vaccinia virus
acaacauccuccagagaaga

SEQ ID NO: 4055295 - RNA, 14 nt, Vaccinia virus
acaacauuaauaca

SEQ ID NO: 4055296 - RNA, 17 nt, Vaccinia virus
acaaccgcuacauaauc

SEQ ID NO: 4055297 - RNA, 17 nt, Vaccinia virus
acaacuaccaauuguuu

SEQ ID NO: 4055298 - RNA, 15 nt, Vaccinia virus
acaacuguuguaaau

SEQ ID NO: 4055299 - RNA, 20 nt, Vaccinia virus
acaacuuaaucugaugaaua

SEQ ID NO: 4055300 - RNA, 21 nt, Vaccinia virus
acaacuuuuaaauacaaauau

SEQ ID NO: 4055301 - RNA, 21 nt, Vaccinia virus
acaagaaucauccaaguggau

SEQ ID NO: 4055302 - RNA, 15 nt, Vaccinia virus
acaagaucaugaaca

SEQ ID NO: 4055303 - RNA, 17 nt, Vaccinia virus
acaagauuccuuuucua

SEQ ID NO: 4055304 - RNA, 21 nt, Vaccinia virus
acaagauuuuuagcguauuau

SEQ ID NO: 4055305 - RNA, 17 nt, Vaccinia virus
acaagcccgucaauaau

SEQ ID NO: 4055306 - RNA, 14 nt, Vaccinia virus
acaagucuaauaau

SEQ ID NO: 4055307 - RNA, 22 nt, Vaccinia virus
acaagugaaauguugucauuau

SEQ ID NO: 4055308 - RNA, 21 nt, Vaccinia virus
acaauacagaagauagcaaag

SEQ ID NO: 4055309 - RNA, 15 nt, Vaccinia virus
acaauagauagucua

SEQ ID NO: 4055310 - RNA, 17 nt, Vaccinia virus
acaauagcgcuuaaucu

SEQ ID NO: 4055311 - RNA, 18 nt, Vaccinia virus
acaauaggaaaucuaucu

SEQ ID NO: 4055312 - RNA, 15 nt, Vaccinia virus
acaauaucaauaaau

SEQ ID NO: 4055313 - RNA, 15 nt, Vaccinia virus
acaauauuaguaugu

SEQ ID NO: 4055314 - RNA, 20 nt, Vaccinia virus
acaauauuaucaucuugaau

SEQ ID NO: 4055315 - RNA, 21 nt, Vaccinia virus
acaaucaagaagauagcuucu

SEQ ID NO: 4055316 - RNA, 17 nt, Vaccinia virus
acaaucagauauaucua

SEQ ID NO: 4055317 - RNA, 19 nt, Vaccinia virus
acaaucauccggauauucu

SEQ ID NO: 4055318 - RNA, 16 nt, Vaccinia virus
acaauccaaaaaauga

SEQ ID NO: 4055319 - RNA, 21 nt, Vaccinia virus
acaaucuacucacauaugcau

SEQ ID NO: 4055320 - RNA, 22 nt, Vaccinia virus
acaaucuaguuuugagaacauc

SEQ ID NO: 4055321 - RNA, 20 nt, Vaccinia virus
acaaucucagauaugggaaa

SEQ ID NO: 4055322 - RNA, 17 nt, Vaccinia virus
acaaucuguauuucauu

SEQ ID NO: 4055323 - RNA, 19 nt, Vaccinia virus
acaaucuuaaugucuguau

SEQ ID NO: 4055324 - RNA, 15 nt, Vaccinia virus
acaaugaaaauggau

SEQ ID NO: 4055325 - RNA, 18 nt, Vaccinia virus
acaaugcuaauauauucu

SEQ ID NO: 4055326 - RNA, 15 nt, Vaccinia virus
acaauguauacaaau

SEQ ID NO: 4055327 - RNA, 19 nt, Vaccinia virus
acaauguauacaaauguac

SEQ ID NO: 4055328 - RNA, 17 nt, Vaccinia virus
acaauguuuccauccau

SEQ ID NO: 4055329 - RNA, 15 nt, Vaccinia virus
acaauuacacuacau

SEQ ID NO: 4055330 - RNA, 13 nt, Vaccinia virus
acaauuacguaau

SEQ ID NO: 4055331 - RNA, 19 nt, Vaccinia virus
acaauuagacguaaguucu

SEQ ID NO: 4055332 - RNA, 16 nt, Vaccinia virus
acaauuauuauauaau

SEQ ID NO: 4055333 - RNA, 14 nt, Vaccinia virus
acaauucauuucca

SEQ ID NO: 4055334 - RNA, 18 nt, Vaccinia virus
acaauuuacauguucauu

SEQ ID NO: 4055335 - RNA, 14 nt, Vaccinia virus
acaauuuuaacaga

SEQ ID NO: 4055336 - RNA, 16 nt, Vaccinia virus
acacaaggcauuguuu

SEQ ID NO: 4055337 - RNA, 13 nt, Vaccinia virus
acacauauacgaa

SEQ ID NO: 4055338 - RNA, 17 nt, Vaccinia virus
acacauuaggauacaga

SEQ ID NO: 4055339 - RNA, 15 nt, Vaccinia virus
acacauuuucaaaua

SEQ ID NO: 4055340 - RNA, 21 nt, Vaccinia virus
acaccaucuucauaauaaaua

SEQ ID NO: 4055341 - RNA, 18 nt, Vaccinia virus
acacccucagcuauaucu

SEQ ID NO: 4055342 - RNA, 16 nt, Vaccinia virus
acacgauuuaauccau

SEQ ID NO: 4055343 - RNA, 19 nt, Vaccinia virus
acacguguagaauaucuac

SEQ ID NO: 4055344 - RNA, 22 nt, Vaccinia virus
acacguguccacauccuuuauu

SEQ ID NO: 4055345 - RNA, 17 nt, Vaccinia virus
acacuaaaauuaaacau

SEQ ID NO: 4055346 - RNA, 12 nt, Vaccinia virus
acacuaagaugc

SEQ ID NO: 4055347 - RNA, 12 nt, Vaccinia virus
acacuaauuaaa

SEQ ID NO: 4055348 - RNA, 14 nt, Vaccinia virus
acacuaucugaucu

SEQ ID NO: 4055349 - RNA, 21 nt, Vaccinia virus
acacuauugaacgauuuaucu

SEQ ID NO: 4055350 - RNA, 20 nt, Vaccinia virus
acacucauaaauaaaaauga

SEQ ID NO: 4055351 - RNA, 17 nt, Vaccinia virus
acacucgacacaauauu

SEQ ID NO: 4055352 - RNA, 12 nt, Vaccinia virus
acacucucaaua

SEQ ID NO: 4055353 - RNA, 16 nt, Vaccinia virus
acacuguguauuguuu

SEQ ID NO: 4055354 - RNA, 18 nt, Vaccinia virus
acacuuuggauacaaaau

SEQ ID NO: 4055355 - RNA, 20 nt, Vaccinia virus
acacuuuguccguaaaacau

SEQ ID NO: 4055356 - RNA, 17 nt, Vaccinia virus
acagaaacuagaggaga

SEQ ID NO: 4055357 - RNA, 22 nt, Vaccinia virus
acagaaacuguaaagaacagug

SEQ ID NO: 4055358 - RNA, 19 nt, Vaccinia virus
acagaacuuaacaauaaau

SEQ ID NO: 4055359 - RNA, 14 nt, Vaccinia virus
acagaaguuuugaa

SEQ ID NO: 4055360 - RNA, 17 nt, Vaccinia virus
acagaauaaacaaaaua

SEQ ID NO: 4055361 - RNA, 18 nt, Vaccinia virus
acagaauguagauaauca

SEQ ID NO: 4055362 - RNA, 14 nt, Vaccinia virus
acagacuucaaagu

SEQ ID NO: 4055363 - RNA, 18 nt, Vaccinia virus
acagagccaucuguaaaa

SEQ ID NO: 4055364 - RNA, 19 nt, Vaccinia virus
acagaggaacgucauauau

SEQ ID NO: 4055365 - RNA, 15 nt, Vaccinia virus
acagauguauuggau

SEQ ID NO: 4055366 - RNA, 18 nt, Vaccinia virus
acagauguuacaaaugua

SEQ ID NO: 4055367 - RNA, 13 nt, Vaccinia virus
acagauuaauagu

SEQ ID NO: 4055368 - RNA, 20 nt, Vaccinia virus
acagcaacacauucaauauu

SEQ ID NO: 4055369 - RNA, 16 nt, Vaccinia virus
acagcaguaguuuaac

SEQ ID NO: 4055370 - RNA, 14 nt, Vaccinia virus
acagccucauauau

SEQ ID NO: 4055371 - RNA, 20 nt, Vaccinia virus
acagcuaucaaaauauguag

SEQ ID NO: 4055372 - RNA, 20 nt, Vaccinia virus
acagguagaauuuauaaaca

SEQ ID NO: 4055373 - RNA, 18 nt, Vaccinia virus
acaguaaccaaaaugaaa

SEQ ID NO: 4055374 - RNA, 15 nt, Vaccinia virus
acaguaguaaugaag

SEQ ID NO: 4055375 - RNA, 17 nt, Vaccinia virus
acaguaucauuuaaaca

SEQ ID NO: 4055376 - RNA, 21 nt, Vaccinia virus
acagucgaacaaucuuaaugu

SEQ ID NO: 4055377 - RNA, 21 nt, Vaccinia virus
acagugauacccgcaauuauu

SEQ ID NO: 4055378 - RNA, 22 nt, Vaccinia virus
acagugcaaccucuauuggaua

SEQ ID NO: 4055379 - RNA, 21 nt, Vaccinia virus
acaguuacgguuguacauuau

SEQ ID NO: 4055380 - RNA, 21 nt, Vaccinia virus
acaguuacuccaauuacaaca

SEQ ID NO: 4055381 - RNA, 11 nt, Vaccinia virus
acauaaauguc

SEQ ID NO: 4055382 - RNA, 17 nt, Vaccinia virus
acauaacagguagaauu

SEQ ID NO: 4055383 - RNA, 20 nt, Vaccinia virus
acauaagaugucuaugaaua

SEQ ID NO: 4055384 - RNA, 17 nt, Vaccinia virus
acauaauucaucuauua

SEQ ID NO: 4055385 - RNA, 18 nt, Vaccinia virus
acauacgagaaaguggau

SEQ ID NO: 4055386 - RNA, 21 nt, Vaccinia virus
acauauaaaucuaaaauugau

SEQ ID NO: 4055387 - RNA, 22 nt, Vaccinia virus
acauauaccgccuuucaaaauu

SEQ ID NO: 4055388 - RNA, 22 nt, Vaccinia virus
acauauaucugauaguauucca

SEQ ID NO: 4055389 - RNA, 17 nt, Vaccinia virus
acauaugacaaacauug

SEQ ID NO: 4055390 - RNA, 18 nt, Vaccinia virus
acauauggaauauaucua

SEQ ID NO: 4055391 - RNA, 23 nt, Vaccinia virus
acauauggaauauaucuauaauu

SEQ ID NO: 4055392 - RNA, 20 nt, Vaccinia virus
acauaugguuucuaaaucua

SEQ ID NO: 4055393 - RNA, 17 nt, Vaccinia virus
acauauuuauauaauua

SEQ ID NO: 4055394 - RNA, 14 nt, Vaccinia virus
acauauuucauuug

SEQ ID NO: 4055395 - RNA, 19 nt, Vaccinia virus
acaucagauguagcgaaga

SEQ ID NO: 4055396 - RNA, 14 nt, Vaccinia virus
acauccgaaaaagu

SEQ ID NO: 4055397 - RNA, 18 nt, Vaccinia virus
acauccgaaaaaguugac

SEQ ID NO: 4055398 - RNA, 18 nt, Vaccinia virus
acauccuucucuucccuc

SEQ ID NO: 4055399 - RNA, 14 nt, Vaccinia virus
acaucgaaaaugaa

SEQ ID NO: 4055400 - RNA, 23 nt, Vaccinia virus
acaucgguacggguauucauuua

SEQ ID NO: 4055401 - RNA, 23 nt, Vaccinia virus
acaucggugagugauaugccuau

SEQ ID NO: 4055402 - RNA, 22 nt, Vaccinia virus
acaucguauaucgucuuuguua

SEQ ID NO: 4055403 - RNA, 14 nt, Vaccinia virus
acaucguuuaauaa

SEQ ID NO: 4055404 - RNA, 19 nt, Vaccinia virus
acaucuaaagaaaaaugau

SEQ ID NO: 4055405 - RNA, 12 nt, Vaccinia virus
aaaaaaucuuca

SEQ ID NO: 4055406 - RNA, 11 nt, Vaccinia virus
aaaaaaugaua

SEQ ID NO: 4055407 - RNA, 18 nt, Vaccinia virus
aaaaacauaauagcuccc

SEQ ID NO: 4055408 - RNA, 14 nt, Vaccinia virus
aaaaacaugucucu

SEQ ID NO: 4055409 - RNA, 20 nt, Vaccinia virus
aaaaacauuaacaagaauca

SEQ ID NO: 4055410 - RNA, 14 nt, Vaccinia virus
aaaaacuaauauua

SEQ ID NO: 4055411 - RNA, 13 nt, Vaccinia virus
aaaaacugauauu

SEQ ID NO: 4055412 - RNA, 19 nt, Vaccinia virus
aaaaacugcguuguaucau

SEQ ID NO: 4055413 - RNA, 14 nt, Vaccinia virus
aaaaagaugauaua

SEQ ID NO: 4055414 - RNA, 21 nt, Vaccinia virus
aaaaagauuaccguaugauau

SEQ ID NO: 4055415 - RNA, 23 nt, Vaccinia virus
aaaaaguauacguccuguggugu

SEQ ID NO: 4055416 - RNA, 16 nt, Vaccinia virus
aaaaaguuuucccaua

SEQ ID NO: 4055417 - RNA, 17 nt, Vaccinia virus
aaaaauacuuaaaaugu

SEQ ID NO: 4055418 - RNA, 12 nt, Vaccinia virus
aaaaauacuuac

SEQ ID NO: 4055419 - RNA, 17 nt, Vaccinia virus
aaaaaugaaaauaaaua

SEQ ID NO: 4055420 - RNA, 12 nt, Vaccinia virus
aaaaauggaugu

SEQ ID NO: 4055421 - RNA, 21 nt, Vaccinia virus
aaaaauguaaaauauuuuucu

SEQ ID NO: 4055422 - RNA, 21 nt, Vaccinia virus
aaaaauuauacuguaacacaa

SEQ ID NO: 4055423 - RNA, 12 nt, Vaccinia virus
aaaaauuauccu

SEQ ID NO: 4055424 - RNA, 14 nt, Vaccinia virus
aaaaauuuaaagaa

SEQ ID NO: 4055425 - RNA, 17 nt, Vaccinia virus
aaaaauuuaaagaaugu

SEQ ID NO: 4055426 - RNA, 20 nt, Vaccinia virus
aaaaauuuaaagaauguaua

SEQ ID NO: 4055427 - RNA, 22 nt, Vaccinia virus
aaaacaaggacgcguuaauaaa

SEQ ID NO: 4055428 - RNA, 13 nt, Vaccinia virus
aaaacaauaaaua

SEQ ID NO: 4055429 - RNA, 15 nt, Vaccinia virus
aaaacaauacaguga

SEQ ID NO: 4055430 - RNA, 17 nt, Vaccinia virus
aaaacauuauaauaaua

SEQ ID NO: 4055431 - RNA, 16 nt, Vaccinia virus
aaaaccucaucgaaga

SEQ ID NO: 4055432 - RNA, 15 nt, Vaccinia virus
aaaacgauauuagaa

SEQ ID NO: 4055433 - RNA, 15 nt, Vaccinia virus
aaaacgauuaaacaa

SEQ ID NO: 4055434 - RNA, 22 nt, Vaccinia virus
aaaacuauuacuaggagaauua

SEQ ID NO: 4055435 - RNA, 15 nt, Vaccinia virus
aaaacugcugugaau

SEQ ID NO: 4055436 - RNA, 22 nt, Vaccinia virus
aaaacuguccaaauagauguac

SEQ ID NO: 4055437 - RNA, 19 nt, Vaccinia virus
aaaacuuaacucaacuguu

SEQ ID NO: 4055438 - RNA, 18 nt, Vaccinia virus
aaaacuuccucauuaaga

SEQ ID NO: 4055439 - RNA, 21 nt, Vaccinia virus
aaaacuugucuguauauguaa

SEQ ID NO: 4055440 - RNA, 18 nt, Vaccinia virus
aaaagaauguauauacau

SEQ ID NO: 4055441 - RNA, 21 nt, Vaccinia virus
cauuauuacuaccaucauuau

SEQ ID NO: 4055442 - RNA, 16 nt, Vaccinia virus
cauucauguacuaaca

SEQ ID NO: 4055443 - RNA, 12 nt, Vaccinia virus
cauuccaaagau

SEQ ID NO: 4055444 - RNA, 15 nt, Vaccinia virus
cauuccuuauacaau

SEQ ID NO: 4055445 - RNA, 14 nt, Vaccinia virus
cauucuaaugaugu

SEQ ID NO: 4055446 - RNA, 14 nt, Vaccinia virus
cauucuaucucaaa

SEQ ID NO: 4055447 - RNA, 12 nt, Vaccinia virus
cauucuauuuuu

SEQ ID NO: 4055448 - RNA, 21 nt, Vaccinia virus
cauucuccgauaucuaauuuc

SEQ ID NO: 4055449 - RNA, 18 nt, Vaccinia virus
cauucuugguuguggaua

SEQ ID NO: 4055450 - RNA, 19 nt, Vaccinia virus
cauugacggauaaaacaaa

SEQ ID NO: 4055451 - RNA, 12 nt, Vaccinia virus
cauuuaaaguua

SEQ ID NO: 4055452 - RNA, 15 nt, Vaccinia virus
cauuuacaacucuau

SEQ ID NO: 4055453 - RNA, 19 nt, Vaccinia virus
cauuuacuuuuucauaauu

SEQ ID NO: 4055454 - RNA, 19 nt, Vaccinia virus
cauuuauaaagacaaacaa

SEQ ID NO: 4055455 - RNA, 13 nt, Vaccinia virus
cauuuauacauau

SEQ ID NO: 4055456 - RNA, 12 nt, Vaccinia virus
cauuuaucacaa

SEQ ID NO: 4055457 - RNA, 17 nt, Vaccinia virus
cauuuaucauauauaau

SEQ ID NO: 4055458 - RNA, 20 nt, Vaccinia virus
cauuucugcauuacaaagaa

SEQ ID NO: 4055459 - RNA, 21 nt, Vaccinia virus
cauuuuauggaaacuauaauu

SEQ ID NO: 4055460 - RNA, 19 nt, Vaccinia virus
cauuuuccagaugauaugu

SEQ ID NO: 4055461 - RNA, 16 nt, Vaccinia virus
cauuuucuuacaauua

SEQ ID NO: 4055462 - RNA, 18 nt, Vaccinia virus
cauuuuggaaacauaaaa

SEQ ID NO: 4055463 - RNA, 12 nt, Vaccinia virus
cauuuuuaggau

SEQ ID NO: 4055464 - RNA, 11 nt, Vaccinia virus
ccaaacaaaau

SEQ ID NO: 4055465 - RNA, 16 nt, Vaccinia virus
ccaaacugcauucgug

SEQ ID NO: 4055466 - RNA, 13 nt, Vaccinia virus
ccaaaucugguaa

SEQ ID NO: 4055467 - RNA, 22 nt, Vaccinia virus
ccaaauuaucaucauuaaacau

SEQ ID NO: 4055468 - RNA, 14 nt, Vaccinia virus
ccaacaguaugaaa

SEQ ID NO: 4055469 - RNA, 13 nt, Vaccinia virus
ccaaccuuuguug

SEQ ID NO: 4055470 - RNA, 17 nt, Vaccinia virus
ccaacucauuuaaauau

SEQ ID NO: 4055471 - RNA, 15 nt, Vaccinia virus
ccaacucuuuaauaa

SEQ ID NO: 4055472 - RNA, 22 nt, Vaccinia virus
ccaagauccucucuuaaaugaa

SEQ ID NO: 4055473 - RNA, 15 nt, Vaccinia virus
ccaagugcuuaaaua

SEQ ID NO: 4055474 - RNA, 16 nt, Vaccinia virus
ccaagugcuuaaauau

SEQ ID NO: 4055475 - RNA, 18 nt, Vaccinia virus
ccaauaaacuauuucuaa

SEQ ID NO: 4055476 - RNA, 17 nt, Vaccinia virus
ccaauaauccaucaucu

SEQ ID NO: 4055477 - RNA, 22 nt, Vaccinia virus
ccaauaauguauagacaauuau

SEQ ID NO: 4055478 - RNA, 12 nt, Vaccinia virus
ccaauacauguu

SEQ ID NO: 4055479 - RNA, 20 nt, Vaccinia virus
ccaauauaguaguuaaauua

SEQ ID NO: 4055480 - RNA, 16 nt, Vaccinia virus
ccaauauuuuauauaa

SEQ ID NO: 4055481 - RNA, 18 nt, Vaccinia virus
ccaaucaccuuauaugau

SEQ ID NO: 4055482 - RNA, 17 nt, Vaccinia virus
ccaaucauugauaucuu

SEQ ID NO: 4055483 - RNA, 12 nt, Vaccinia virus
ccaauuaaaugu

SEQ ID NO: 4055484 - RNA, 20 nt, Vaccinia virus
ccaauucgguuauaaaugaa

SEQ ID NO: 4055485 - RNA, 16 nt, Vaccinia virus
ccaauuucaaggacaa

SEQ ID NO: 4055486 - RNA, 17 nt, Vaccinia virus
ccaauuuggauauagca

SEQ ID NO: 4055487 - RNA, 12 nt, Vaccinia virus
ccacaaaacaga

SEQ ID NO: 4055488 - RNA, 22 nt, Vaccinia virus
ccaccaauagaaguuuucccaa

SEQ ID NO: 4055489 - RNA, 20 nt, Vaccinia virus
ccaccagugguuuuauuuua

SEQ ID NO: 4055490 - RNA, 15 nt, Vaccinia virus
ccaccucucuggaag

SEQ ID NO: 4055491 - RNA, 24 nt, Vaccinia virus
ccacuaauucucauuaaaugguua

SEQ ID NO: 4055492 - RNA, 14 nt, Vaccinia virus
ccacuauaaaauaa

SEQ ID NO: 4055493 - RNA, 17 nt, Vaccinia virus
ccacugucacuggaaag

SEQ ID NO: 4055494 - RNA, 16 nt, Vaccinia virus
ccacuucggauccaua

SEQ ID NO: 4055495 - RNA, 14 nt, Vaccinia virus
ccacuuuugcuuua

SEQ ID NO: 4055496 - RNA, 15 nt, Vaccinia virus
ccagauauauaucuu

SEQ ID NO: 4055497 - RNA, 17 nt, Vaccinia virus
ccagaucaaaacaaaau

SEQ ID NO: 4055498 - RNA, 23 nt, Vaccinia virus
ccagaucuauugacuauaacucc

SEQ ID NO: 4055499 - RNA, 20 nt, Vaccinia virus
ccagggaaauuaaagaagaa

SEQ ID NO: 4055500 - RNA, 23 nt, Vaccinia virus
ccaguacucgggucuaacaucuc

SEQ ID NO: 4055501 - RNA, 20 nt, Vaccinia virus
ccagugcuauaucucccugu

SEQ ID NO: 4055502 - RNA, 14 nt, Vaccinia virus
ccaguuuaucccua

SEQ ID NO: 4055503 - RNA, 15 nt, Vaccinia virus
ccauaagcaaacuga

SEQ ID NO: 4055504 - RNA, 18 nt, Vaccinia virus
ccauaauccuauucuuga

SEQ ID NO: 4055505 - RNA, 14 nt, Vaccinia virus
ccauacauacaucu

SEQ ID NO: 4055506 - RNA, 13 nt, Vaccinia virus
ccauagaggaugu

SEQ ID NO: 4055507 - RNA, 23 nt, Vaccinia virus
ccauauuuuguuauuauauuaau

SEQ ID NO: 4055508 - RNA, 21 nt, Vaccinia virus
ccauccaagucaauaucuuua

SEQ ID NO: 4055509 - RNA, 21 nt, Vaccinia virus
ccaucgcuucuaucuuguuua

SEQ ID NO: 4055510 - RNA, 18 nt, Vaccinia virus
ccaucuaucaaacaaaau

SEQ ID NO: 4055511 - RNA, 17 nt, Vaccinia virus
ccaucugguucaggaaa

SEQ ID NO: 4055512 - RNA, 23 nt, Vaccinia virus
ccaucugguucaggaaagacagc

SEQ ID NO: 4055513 - RNA, 22 nt, Vaccinia virus
ccaucugucauauuuagauuuu

SEQ ID NO: 4055514 - RNA, 22 nt, Vaccinia virus
ccaugcaaacuaucuaaaugua

SEQ ID NO: 4055515 - RNA, 13 nt, Vaccinia virus
ccaugcagcauuu

SEQ ID NO: 4055516 - RNA, 17 nt, Vaccinia virus
ccaugcagcauuuccua

SEQ ID NO: 4055517 - RNA, 17 nt, Vaccinia virus
ccauggauggaaacauu

SEQ ID NO: 4055518 - RNA, 15 nt, Vaccinia virus
ccauuaagugacauu

SEQ ID NO: 4055519 - RNA, 18 nt, Vaccinia virus
ccauuaucuauaucaucu

SEQ ID NO: 4055520 - RNA, 16 nt, Vaccinia virus
ccauucuaauacuuua

SEQ ID NO: 4055521 - RNA, 13 nt, Vaccinia virus
ccauuuaaaguua

SEQ ID NO: 4055522 - RNA, 19 nt, Vaccinia virus
ccccaggaucuccaacaaa

SEQ ID NO: 4055523 - RNA, 17 nt, Vaccinia virus
cccgcuucuauuuacuc

SEQ ID NO: 4055524 - RNA, 23 nt, Vaccinia virus
cccguauagaaguucaaagguua

SEQ ID NO: 4055525 - RNA, 12 nt, Vaccinia virus
ccgauuaaacau

SEQ ID NO: 4055526 - RNA, 20 nt, Vaccinia virus
ccgcaauaacaugguaacug

SEQ ID NO: 4055527 - RNA, 12 nt, Vaccinia virus
ccggaacaaaaa

SEQ ID NO: 4055528 - RNA, 20 nt, Vaccinia virus
ccggacgacauauuaaucuu

SEQ ID NO: 4055529 - RNA, 16 nt, Vaccinia virus
ccggaguuagaaagca

SEQ ID NO: 4055530 - RNA, 19 nt, Vaccinia virus
ccgguuugcaaaacaaaaa

SEQ ID NO: 4055531 - RNA, 21 nt, Vaccinia virus
ccguguucguuugaaugccac

SEQ ID NO: 4055532 - RNA, 11 nt, Vaccinia virus
ccguguuuaug

SEQ ID NO: 4055533 - RNA, 20 nt, Vaccinia virus
ccguuauauaaucuacaaaa

SEQ ID NO: 4055534 - RNA, 20 nt, Vaccinia virus
ccguuuuaucgguuaccaua

SEQ ID NO: 4055535 - RNA, 20 nt, Vaccinia virus
ccuaauucucucaucuauca

SEQ ID NO: 4055536 - RNA, 16 nt, Vaccinia virus
ccuacacccgaagaga

SEQ ID NO: 4055537 - RNA, 20 nt, Vaccinia virus
ccuacacuauuauaugauua

SEQ ID NO: 4055538 - RNA, 14 nt, Vaccinia virus
ccuagagaauuaau

SEQ ID NO: 4055539 - RNA, 21 nt, Vaccinia virus
ccuaguacggcggauuuacua

SEQ ID NO: 4055540 - RNA, 17 nt, Vaccinia virus
ccuauaaacaugaauuu

SEQ ID NO: 4055541 - RNA, 12 nt, Vaccinia virus
ccuaucucugac

SEQ ID NO: 4055542 - RNA, 20 nt, Vaccinia virus
ccucaaacucgauauauuua

SEQ ID NO: 4055543 - RNA, 12 nt, Vaccinia virus
ccucaucuucua

SEQ ID NO: 4055544 - RNA, 21 nt, Vaccinia virus
ccuccaccgaugauggaguaa

SEQ ID NO: 4055545 - RNA, 14 nt, Vaccinia virus
ccucuucaauuaga

SEQ ID NO: 4055546 - RNA, 13 nt, Vaccinia virus
ccugaccauccau

SEQ ID NO: 4055547 - RNA, 17 nt, Vaccinia virus
ccugccauuuuagagau

SEQ ID NO: 4055548 - RNA, 17 nt, Vaccinia virus
ccuggaguauggaauac

SEQ ID NO: 4055549 - RNA, 23 nt, Vaccinia virus
ccugguaagauaucuuuauauuc

SEQ ID NO: 4055550 - RNA, 14 nt, Vaccinia virus
ccuguucaaauuua

SEQ ID NO: 4055551 - RNA, 14 nt, Vaccinia virus
ccuuaauauaauag

SEQ ID NO: 4055552 - RNA, 22 nt, Vaccinia virus
ccuuauagaggauguuaaacaa

SEQ ID NO: 4055553 - RNA, 15 nt, Vaccinia virus
ccuucguuguuucua

SEQ ID NO: 4055554 - RNA, 15 nt, Vaccinia virus
ccuuuaaauccucua

SEQ ID NO: 4055555 - RNA, 12 nt, Vaccinia virus
ccuuuauuucca

SEQ ID NO: 4055556 - RNA, 17 nt, Vaccinia virus
ccuuuuccuuaucuuca

SEQ ID NO: 4055557 - RNA, 12 nt, Vaccinia virus
cgaaaauauauu

SEQ ID NO: 4055558 - RNA, 17 nt, Vaccinia virus
cgaaaauugcuauuuca

SEQ ID NO: 4055559 - RNA, 14 nt, Vaccinia virus
cgaacguggaaggu

SEQ ID NO: 4055560 - RNA, 23 nt, Vaccinia virus
cgaagaaaaaaauggaaauacuu

SEQ ID NO: 4055561 - RNA, 17 nt, Vaccinia virus
cgaagaagagaaagaca

SEQ ID NO: 4055562 - RNA, 17 nt, Vaccinia virus
cgaauauaaaucauauu

SEQ ID NO: 4055563 - RNA, 11 nt, Vaccinia virus
cgaaugauaua

SEQ ID NO: 4055564 - RNA, 13 nt, Vaccinia virus
cgacaagauaucg

SEQ ID NO: 4055565 - RNA, 18 nt, Vaccinia virus
cgacaucaaaugguacaa

SEQ ID NO: 4055566 - RNA, 17 nt, Vaccinia virus
auuuuaucuuuuagagg

SEQ ID NO: 4055567 - RNA, 17 nt, Vaccinia virus
auuuuauuucaaaauua

SEQ ID NO: 4055568 - RNA, 20 nt, Vaccinia virus
auuuucaagagauaguuuuc

SEQ ID NO: 4055569 - RNA, 13 nt, Vaccinia virus
auuuucauucacu

SEQ ID NO: 4055570 - RNA, 22 nt, Vaccinia virus
auuuucggguuuaaauucuuua

SEQ ID NO: 4055571 - RNA, 15 nt, Vaccinia virus
auuuucuuuauaaaa

SEQ ID NO: 4055572 - RNA, 23 nt, Vaccinia virus
auuuugaaaggcgguauauguau

SEQ ID NO: 4055573 - RNA, 16 nt, Vaccinia virus
auuuuggaaaaaauug

SEQ ID NO: 4055574 - RNA, 18 nt, Vaccinia virus
auuuuggugaaauuauua

SEQ ID NO: 4055575 - RNA, 15 nt, Vaccinia virus
auuuugguguaaauc

SEQ ID NO: 4055576 - RNA, 22 nt, Vaccinia virus
auuuuguaguuaauuuaucaca

SEQ ID NO: 4055577 - RNA, 17 nt, Vaccinia virus
auuuugugcaaauagau

SEQ ID NO: 4055578 - RNA, 20 nt, Vaccinia virus
auuuuuaacagcaacacauu

SEQ ID NO: 4055579 - RNA, 20 nt, Vaccinia virus
auuuuuagaaaguauccauc

SEQ ID NO: 4055580 - RNA, 19 nt, Vaccinia virus
auuuuuauucagcauuacu

SEQ ID NO: 4055581 - RNA, 15 nt, Vaccinia virus
auuuuucuucauuua

SEQ ID NO: 4055582 - RNA, 18 nt, Vaccinia virus
auuuuugcaucauuuacg

SEQ ID NO: 4055583 - RNA, 14 nt, Vaccinia virus
auuuuuuacaauuu

SEQ ID NO: 4055584 - RNA, 21 nt, Vaccinia virus
caaaaaaaugugcacaguuuc

SEQ ID NO: 4055585 - RNA, 21 nt, Vaccinia virus
caaaaaacuuuacgauagacu

SEQ ID NO: 4055586 - RNA, 14 nt, Vaccinia virus
caaaaaauuacuuu

SEQ ID NO: 4055587 - RNA, 16 nt, Vaccinia virus
caaaaauauuaaaccu

SEQ ID NO: 4055588 - RNA, 15 nt, Vaccinia virus
caaaacucaaauguu

SEQ ID NO: 4055589 - RNA, 15 nt, Vaccinia virus
caaaagacuauacau

SEQ ID NO: 4055590 - RNA, 21 nt, Vaccinia virus
caaaaggaagaaggacaacau

SEQ ID NO: 4055591 - RNA, 15 nt, Vaccinia virus
caaaagguagcuaau

SEQ ID NO: 4055592 - RNA, 22 nt, Vaccinia virus
caaaaguaguucaacauaauau

SEQ ID NO: 4055593 - RNA, 16 nt, Vaccinia virus
caaaaguuaauuucua

SEQ ID NO: 4055594 - RNA, 14 nt, Vaccinia virus
caaaauccaaauuu

SEQ ID NO: 4055595 - RNA, 21 nt, Vaccinia virus
caaaaugauagauauuuuuuu

SEQ ID NO: 4055596 - RNA, 22 nt, Vaccinia virus
caaaauucagauucuaucuuua

SEQ ID NO: 4055597 - RNA, 23 nt, Vaccinia virus
caaaauugucuaugaugucaucu

SEQ ID NO: 4055598 - RNA, 22 nt, Vaccinia virus
caaaauuuuacuuuuaguucuu

SEQ ID NO: 4055599 - RNA, 16 nt, Vaccinia virus
caaacaauuuuaacag

SEQ ID NO: 4055600 - RNA, 22 nt, Vaccinia virus
caaacagcaaggguucgucaaa

SEQ ID NO: 4055601 - RNA, 20 nt, Vaccinia virus
caaacaguuugguauuagaa

SEQ ID NO: 4055602 - RNA, 15 nt, Vaccinia virus
caaacauacaucuau

SEQ ID NO: 4055603 - RNA, 22 nt, Vaccinia virus
caaacauacaucuauaaauuug

SEQ ID NO: 4055604 - RNA, 21 nt, Vaccinia virus
caaacccuugaucuccucuau

SEQ ID NO: 4055605 - RNA, 19 nt, Vaccinia virus
caaacuuccauggaaaaac

SEQ ID NO: 4055606 - RNA, 23 nt, Vaccinia virus
caaacuuugaagaauuuauauaa

SEQ ID NO: 4055607 - RNA, 18 nt, Vaccinia virus
caaacuuuuucacagagc

SEQ ID NO: 4055608 - RNA, 22 nt, Vaccinia virus
caaagaacagaauaaacaaaau

SEQ ID NO: 4055609 - RNA, 18 nt, Vaccinia virus
caaagaauuaaugauagu

SEQ ID NO: 4055610 - RNA, 18 nt, Vaccinia virus
caaagagaccaaugaauu

SEQ ID NO: 4055611 - RNA, 13 nt, Vaccinia virus
caaagauauggaa

SEQ ID NO: 4055612 - RNA, 22 nt, Vaccinia virus
caaagauucuuccuccaaacag

SEQ ID NO: 4055613 - RNA, 19 nt, Vaccinia virus
caaagauuuaaauccuaau

SEQ ID NO: 4055614 - RNA, 13 nt, Vaccinia virus
caaaguuguuaaa

SEQ ID NO: 4055615 - RNA, 16 nt, Vaccinia virus
caaauaaguauuauca

SEQ ID NO: 4055616 - RNA, 17 nt, Vaccinia virus
caaauagagcaauuacu

SEQ ID NO: 4055617 - RNA, 20 nt, Vaccinia virus
caaauauaucaauaguagua

SEQ ID NO: 4055618 - RNA, 21 nt, Vaccinia virus
caaauauaugcaaaauaauau

SEQ ID NO: 4055619 - RNA, 13 nt, Vaccinia virus
caaauaugauaug

SEQ ID NO: 4055620 - RNA, 14 nt, Vaccinia virus
caaaucaacucaua

SEQ ID NO: 4055621 - RNA, 17 nt, Vaccinia virus
caaaucauugauacauu

SEQ ID NO: 4055622 - RNA, 15 nt, Vaccinia virus
caaauccauuaaugu

SEQ ID NO: 4055623 - RNA, 15 nt, Vaccinia virus
caaaucuaacuucua

SEQ ID NO: 4055624 - RNA, 13 nt, Vaccinia virus
caaaucuggaaaa

SEQ ID NO: 4055625 - RNA, 18 nt, Vaccinia virus
caaaucuucuuauaagau

SEQ ID NO: 4055626 - RNA, 18 nt, Vaccinia virus
caaaugaaaaaaauacuu

SEQ ID NO: 4055627 - RNA, 22 nt, Vaccinia virus
caaaugaaacaggacauuauca

SEQ ID NO: 4055628 - RNA, 15 nt, Vaccinia virus
caaauggauaauuua

SEQ ID NO: 4055629 - RNA, 14 nt, Vaccinia virus
caaauguagaagau

SEQ ID NO: 4055630 - RNA, 14 nt, Vaccinia virus
caaauguuaaacau

SEQ ID NO: 4055631 - RNA, 19 nt, Vaccinia virus
caaauuauuucuucugaau

SEQ ID NO: 4055632 - RNA, 23 nt, Vaccinia virus
caaauucuuggauauaugauaua

SEQ ID NO: 4055633 - RNA, 20 nt, Vaccinia virus
caaauuuauuccauauuuua

SEQ ID NO: 4055634 - RNA, 14 nt, Vaccinia virus
caaauuuuacuaca

SEQ ID NO: 4055635 - RNA, 18 nt, Vaccinia virus
caacaaaauucagauucu

SEQ ID NO: 4055636 - RNA, 20 nt, Vaccinia virus
caacaaagaaauuuuugguu

SEQ ID NO: 4055637 - RNA, 20 nt, Vaccinia virus
caacaaguguguagauaucu

SEQ ID NO: 4055638 - RNA, 19 nt, Vaccinia virus
caacaaguuggaugauauu

SEQ ID NO: 4055639 - RNA, 22 nt, Vaccinia virus
caacaauuuuguauuauucuga

SEQ ID NO: 4055640 - RNA, 12 nt, Vaccinia virus
caacagaaaaag

SEQ ID NO: 4055641 - RNA, 18 nt, Vaccinia virus
caacaggucauauucuca

SEQ ID NO: 4055642 - RNA, 20 nt, Vaccinia virus
caacaucacgcucgauaauc

SEQ ID NO: 4055643 - RNA, 19 nt, Vaccinia virus
caacauccuccagagaaga

SEQ ID NO: 4055644 - RNA, 22 nt, Vaccinia virus
caacaucuuaagcguagaaguu

SEQ ID NO: 4055645 - RNA, 19 nt, Vaccinia virus
caacgaaucccuacauauu

SEQ ID NO: 4055646 - RNA, 21 nt, Vaccinia virus
caacuaauguaugauauaauu

SEQ ID NO: 4055647 - RNA, 22 nt, Vaccinia virus
caacuacggcguccgcuuuagu

SEQ ID NO: 4055648 - RNA, 16 nt, Vaccinia virus
caacucuaaucacuuu

SEQ ID NO: 4055649 - RNA, 12 nt, Vaccinia virus
caacucucaaaa

SEQ ID NO: 4055650 - RNA, 15 nt, Vaccinia virus
caacugaaaaaguua

SEQ ID NO: 4055651 - RNA, 13 nt, Vaccinia virus
caacuguuguaaa

SEQ ID NO: 4055652 - RNA, 12 nt, Vaccinia virus
caacuuaaacaa

SEQ ID NO: 4055653 - RNA, 19 nt, Vaccinia virus
caacuucuccuuauugauu

SEQ ID NO: 4055654 - RNA, 17 nt, Vaccinia virus
caagaacuacaaaaguu

SEQ ID NO: 4055655 - RNA, 13 nt, Vaccinia virus
caagaaugauauc

SEQ ID NO: 4055656 - RNA, 17 nt, Vaccinia virus
caagaucuuugauauac

SEQ ID NO: 4055657 - RNA, 18 nt, Vaccinia virus
caagauucguagaagcau

SEQ ID NO: 4055658 - RNA, 20 nt, Vaccinia virus
caaggaaacuaauaccucua

SEQ ID NO: 4055659 - RNA, 20 nt, Vaccinia virus
caaguaggauuuuuccaaag

SEQ ID NO: 4055660 - RNA, 17 nt, Vaccinia virus
caaguaguaauagugau

SEQ ID NO: 4055661 - RNA, 13 nt, Vaccinia virus
caaguauaaugac

SEQ ID NO: 4055662 - RNA, 15 nt, Vaccinia virus
caagucauaaaucau

SEQ ID NO: 4055663 - RNA, 23 nt, Vaccinia virus
caaguuaucgucuguauuaaugu

SEQ ID NO: 4055664 - RNA, 21 nt, Vaccinia virus
caaguucuauaguuucuggau

SEQ ID NO: 4055665 - RNA, 15 nt, Vaccinia virus
caauaaaaaaaauug

SEQ ID NO: 4055666 - RNA, 19 nt, Vaccinia virus
caauaaaauuaucaugaca

SEQ ID NO: 4055667 - RNA, 17 nt, Vaccinia virus
caauaaacaaaauacuc

SEQ ID NO: 4055668 - RNA, 21 nt, Vaccinia virus
caauaacuaauggcaaaugua

SEQ ID NO: 4055669 - RNA, 15 nt, Vaccinia virus
caauaagcuuuagau

SEQ ID NO: 4055670 - RNA, 13 nt, Vaccinia virus
caauaaguaguau

SEQ ID NO: 4055671 - RNA, 20 nt, Vaccinia virus
caauaaugccgguauuggca

SEQ ID NO: 4055672 - RNA, 20 nt, Vaccinia virus
caauacauguuuuauaaaau

SEQ ID NO: 4055673 - RNA, 23 nt, Vaccinia virus
caauacuaauucaaauuguuaaa

SEQ ID NO: 4055674 - RNA, 22 nt, Vaccinia virus
caauacugcgacuuuguuaaug

SEQ ID NO: 4055675 - RNA, 14 nt, Vaccinia virus
caauagauagucua

SEQ ID NO: 4055676 - RNA, 21 nt, Vaccinia virus
caauauagagauuagaggagg

SEQ ID NO: 4055677 - RNA, 16 nt, Vaccinia virus
caauauagcaacagua

SEQ ID NO: 4055678 - RNA, 19 nt, Vaccinia virus
caauauauacgaguauaau

SEQ ID NO: 4055679 - RNA, 13 nt, Vaccinia virus
caauauaucaucu

SEQ ID NO: 4055680 - RNA, 18 nt, Vaccinia virus
caauauauguaaucauug

SEQ ID NO: 4055681 - RNA, 14 nt, Vaccinia virus
caauauauuuuuuu

SEQ ID NO: 4055682 - RNA, 14 nt, Vaccinia virus
caauaucaguaucu

SEQ ID NO: 4055683 - RNA, 17 nt, Vaccinia virus
caauaugugaaucauuu

SEQ ID NO: 4055684 - RNA, 14 nt, Vaccinia virus
caauauuaucaucu

SEQ ID NO: 4055685 - RNA, 18 nt, Vaccinia virus
caaucaaaccuauaacau

SEQ ID NO: 4055686 - RNA, 22 nt, Vaccinia virus
caaucacgcauaaaaauaucuu

SEQ ID NO: 4055687 - RNA, 20 nt, Vaccinia virus
caaucauuuauugacaauaa

SEQ ID NO: 4055688 - RNA, 19 nt, Vaccinia virus
caaucguuccaugaugggu

SEQ ID NO: 4055689 - RNA, 16 nt, Vaccinia virus
cauaauauuaaacacu

SEQ ID NO: 4055690 - RNA, 15 nt, Vaccinia virus
cauaauccucaucug

SEQ ID NO: 4055691 - RNA, 24 nt, Vaccinia virus
cauaaucuaaaauaguucuguaau

SEQ ID NO: 4055692 - RNA, 20 nt, Vaccinia virus
cauaaugcagauuuauugaa

SEQ ID NO: 4055693 - RNA, 20 nt, Vaccinia virus
cauaauguaaagauauucua

SEQ ID NO: 4055694 - RNA, 17 nt, Vaccinia virus
cauacagcucaucgauu

SEQ ID NO: 4055695 - RNA, 18 nt, Vaccinia virus
cauacaucgccgucaucu

SEQ ID NO: 4055696 - RNA, 21 nt, Vaccinia virus
cauacaugaaaugaucucuau

SEQ ID NO: 4055697 - RNA, 20 nt, Vaccinia virus
cauacauucggacagacaca

SEQ ID NO: 4055698 - RNA, 18 nt, Vaccinia virus
cauacauuuguaaaagua

SEQ ID NO: 4055699 - RNA, 17 nt, Vaccinia virus
cauacccuccuguauau

SEQ ID NO: 4055700 - RNA, 16 nt, Vaccinia virus
cauaccgcaaauggaa

SEQ ID NO: 4055701 - RNA, 16 nt, Vaccinia virus
cauacuaauagaugua

SEQ ID NO: 4055702 - RNA, 14 nt, Vaccinia virus
cauacuacuauuau

SEQ ID NO: 4055703 - RNA, 17 nt, Vaccinia virus
cauagaaaguuaaaagu

SEQ ID NO: 4055704 - RNA, 15 nt, Vaccinia virus
cauagaauaaauauc

SEQ ID NO: 4055705 - RNA, 14 nt, Vaccinia virus
cauagacuuuaucu

SEQ ID NO: 4055706 - RNA, 22 nt, Vaccinia virus
cauagauccaguagauccuaau

SEQ ID NO: 4055707 - RNA, 15 nt, Vaccinia virus
cauagaugaaauacu

SEQ ID NO: 4055708 - RNA, 15 nt, Vaccinia virus
cauaggauacucuau

SEQ ID NO: 4055709 - RNA, 16 nt, Vaccinia virus
cauagucuucaauaau

SEQ ID NO: 4055710 - RNA, 19 nt, Vaccinia virus
cauaguggacaacauuaau

SEQ ID NO: 4055711 - RNA, 20 nt, Vaccinia virus
cauaguuuguaucaauaaua

SEQ ID NO: 4055712 - RNA, 18 nt, Vaccinia virus
cauaguuuuuacacauag

SEQ ID NO: 4055713 - RNA, 20 nt, Vaccinia virus
cauauaauagacauaaugac

SEQ ID NO: 4055714 - RNA, 16 nt, Vaccinia virus
cauauagaucaaucau

SEQ ID NO: 4055715 - RNA, 22 nt, Vaccinia virus
cauauaguauucuuguauucua

SEQ ID NO: 4055716 - RNA, 16 nt, Vaccinia virus
cauauaguuaaucuau

SEQ ID NO: 4055717 - RNA, 22 nt, Vaccinia virus
cauauaugguauugguccauua

SEQ ID NO: 4055718 - RNA, 18 nt, Vaccinia virus
cauaucaauuuguacauc

SEQ ID NO: 4055719 - RNA, 18 nt, Vaccinia virus
cauaucauacaugauauu

SEQ ID NO: 4055720 - RNA, 21 nt, Vaccinia virus
cauaugguacgauguuguaaa

SEQ ID NO: 4055721 - RNA, 14 nt, Vaccinia virus
cauaugguacguaa

SEQ ID NO: 4055722 - RNA, 20 nt, Vaccinia virus
cauauguuuuaauauuuaca

SEQ ID NO: 4055723 - RNA, 18 nt, Vaccinia virus
cauauuacaaaaucgauu

SEQ ID NO: 4055724 - RNA, 14 nt, Vaccinia virus
cauauuacauaaua

SEQ ID NO: 4055725 - RNA, 14 nt, Vaccinia virus
cauauuauacagua

SEQ ID NO: 4055726 - RNA, 14 nt, Vaccinia virus
cauauucuacucuu

SEQ ID NO: 4055727 - RNA, 13 nt, Vaccinia virus
cauauucucauaa

SEQ ID NO: 4055728 - RNA, 14 nt, Vaccinia virus
cauauuuauggauu

SEQ ID NO: 4055729 - RNA, 20 nt, Vaccinia virus
cauauuugaacuuaacuuca

SEQ ID NO: 4055730 - RNA, 15 nt, Vaccinia virus
cauauuuuaaugaac

SEQ ID NO: 4055731 - RNA, 14 nt, Vaccinia virus
cauauuuucaguaa

SEQ ID NO: 4055732 - RNA, 17 nt, Vaccinia virus
aguuccgagauaauuuc

SEQ ID NO: 4055733 - RNA, 19 nt, Vaccinia virus
aguucuggcaauguuucau

SEQ ID NO: 4055734 - RNA, 16 nt, Vaccinia virus
aguucuuaauacuucg

SEQ ID NO: 4055735 - RNA, 19 nt, Vaccinia virus
aguucuuacacauaucacu

SEQ ID NO: 4055736 - RNA, 13 nt, Vaccinia virus
aguucuuuucuag

SEQ ID NO: 4055737 - RNA, 17 nt, Vaccinia virus
aguugaagauucuaaug

SEQ ID NO: 4055738 - RNA, 21 nt, Vaccinia virus
aguugggauaguauuuuucua

SEQ ID NO: 4055739 - RNA, 20 nt, Vaccinia virus
aguuguauacuaucagaauc

SEQ ID NO: 4055740 - RNA, 17 nt, Vaccinia virus
aggaucuacauccucga

SEQ ID NO: 4055741 - RNA, 14 nt, Vaccinia virus
aggaucuagcaaag

SEQ ID NO: 4055742 - RNA, 19 nt, Vaccinia virus
aggaucuagcaaaggaaau

SEQ ID NO: 4055743 - RNA, 13 nt, Vaccinia virus
aggaugaauuuga

SEQ ID NO: 4055744 - RNA, 19 nt, Vaccinia virus
aggaugaguacauuucaca

SEQ ID NO: 4055745 - RNA, 19 nt, Vaccinia virus
aggauggaauuaucaucaa

SEQ ID NO: 4055746 - RNA, 18 nt, Vaccinia virus
aggauguaauuaaauguu

SEQ ID NO: 4055747 - RNA, 21 nt, Vaccinia virus
aggauuaaaaauaaaguuauc

SEQ ID NO: 4055748 - RNA, 21 nt, Vaccinia virus
aggauuaguuuccgaacuaau

SEQ ID NO: 4055749 - RNA, 12 nt, Vaccinia virus
aggauucuuaau

SEQ ID NO: 4055750 - RNA, 15 nt, Vaccinia virus
aggcacaaugaauga

SEQ ID NO: 4055751 - RNA, 18 nt, Vaccinia virus
aggcaguccagaaauauu

SEQ ID NO: 4055752 - RNA, 21 nt, Vaccinia virus
aggcauaaaaauaaaaauaua

SEQ ID NO: 4055753 - RNA, 21 nt, Vaccinia virus
aggcauguugauggaaaaauu

SEQ ID NO: 4055754 - RNA, 14 nt, Vaccinia virus
aggcauuaacuaga

SEQ ID NO: 4055755 - RNA, 19 nt, Vaccinia virus
aggcuuugauaucuaaaua

SEQ ID NO: 4055756 - RNA, 18 nt, Vaccinia virus
guuuaucgccuacaucau

SEQ ID NO: 4055757 - RNA, 12 nt, Vaccinia virus
guuuaucuuuuu

SEQ ID NO: 4055758 - RNA, 17 nt, Vaccinia virus
guuuauggaucuauuca

SEQ ID NO: 4055759 - RNA, 15 nt, Vaccinia virus
guuuccaaaaaaugu

SEQ ID NO: 4055760 - RNA, 23 nt, Vaccinia virus
guuuccacaucaaccaaguaaug

SEQ ID NO: 4055761 - RNA, 18 nt, Vaccinia virus
guuuccaguuauaaaaca

SEQ ID NO: 4055762 - RNA, 23 nt, Vaccinia virus
guuucccaaugaaaugguacaau

SEQ ID NO: 4055763 - RNA, 14 nt, Vaccinia virus
guuucguaauaucu

SEQ ID NO: 4055764 - RNA, 15 nt, Vaccinia virus
guuucucaucuuuua

SEQ ID NO: 4055765 - RNA, 21 nt, Vaccinia virus
guuucuuagcuugugauuuuu

SEQ ID NO: 4055766 - RNA, 20 nt, Vaccinia virus
guuugaaaaucgucuuuuau

SEQ ID NO: 4055767 - RNA, 15 nt, Vaccinia virus
guuugauaaauguag

SEQ ID NO: 4055768 - RNA, 15 nt, Vaccinia virus
guuuguaaaauaucu

SEQ ID NO: 4055769 - RNA, 23 nt, Vaccinia virus
guuuguuucggccugaaguuggu

SEQ ID NO: 4055770 - RNA, 14 nt, Vaccinia virus
guuuguuuuggaaa

SEQ ID NO: 4055771 - RNA, 20 nt, Vaccinia virus
guuuuacguuauuaaucauc

SEQ ID NO: 4055772 - RNA, 19 nt, Vaccinia virus
guuuuauuuuaucuuuuac

SEQ ID NO: 4055773 - RNA, 21 nt, Vaccinia virus
guuuucccauagaacaucagu

SEQ ID NO: 4055774 - RNA, 17 nt, Vaccinia virus
guuuucuacaauaacua

SEQ ID NO: 4055775 - RNA, 23 nt, Vaccinia virus
guuuuguuuucucuuugguaacu

SEQ ID NO: 4055776 - RNA, 23 nt, Vaccinia virus
guuuuuuaauuccauaucuuuua

SEQ ID NO: 4055777 - RNA, 16 nt, Vaccinia virus
guuuuuuuacuuucua

SEQ ID NO: 4055778 - RNA, 18 nt, Vaccinia virus
uaaaaaaacauuauucua

SEQ ID NO: 4055779 - RNA, 18 nt, Vaccinia virus
uaaaaaaccuccuucaug

SEQ ID NO: 4055780 - RNA, 14 nt, Vaccinia virus
uaaaaaauauccuu

SEQ ID NO: 4055781 - RNA, 21 nt, Vaccinia virus
uaacgcaccuauaaagacuuu

SEQ ID NO: 4055782 - RNA, 15 nt, Vaccinia virus
uaacgcauuaaugag

SEQ ID NO: 4055783 - RNA, 17 nt, Vaccinia virus
uaacgguacucuagaau

SEQ ID NO: 4055784 - RNA, 15 nt, Vaccinia virus
uaacguuaaacauua

SEQ ID NO: 4055785 - RNA, 18 nt, Vaccinia virus
uaacguucuaacaucauu

SEQ ID NO: 4055786 - RNA, 19 nt, Vaccinia virus
uaacuaaaaauguaaaaua

SEQ ID NO: 4055787 - RNA, 12 nt, Vaccinia virus
uaacuaaauguc

SEQ ID NO: 4055788 - RNA, 18 nt, Vaccinia virus
uaacuacugauaacaaaa

SEQ ID NO: 4055789 - RNA, 21 nt, Vaccinia virus
uaacuagcuuaaacagaugag

SEQ ID NO: 4055790 - RNA, 16 nt, Vaccinia virus
uaacuagucuucucug

SEQ ID NO: 4055791 - RNA, 19 nt, Vaccinia virus
uaacuauauaccuauuaau

SEQ ID NO: 4055792 - RNA, 13 nt, Vaccinia virus
uaacuauauucca

SEQ ID NO: 4055793 - RNA, 14 nt, Vaccinia virus
uaacuauauucuua

SEQ ID NO: 4055794 - RNA, 21 nt, Vaccinia virus
uaacuauuuuuuauuacuuua

SEQ ID NO: 4055795 - RNA, 16 nt, Vaccinia virus
uaacucauuuuuugaa

SEQ ID NO: 4055796 - RNA, 22 nt, Vaccinia virus
uaacuccaggccguuuguuucc

SEQ ID NO: 4055797 - RNA, 19 nt, Vaccinia virus
uaacucgguaucuacuuua

SEQ ID NO: 4055798 - RNA, 18 nt, Vaccinia virus
uaacugacuuaauaguag

SEQ ID NO: 4055799 - RNA, 16 nt, Vaccinia virus
uaacugcuuuucugga

SEQ ID NO: 4055800 - RNA, 14 nt, Vaccinia virus
uaacuuaauuuauu

SEQ ID NO: 4055801 - RNA, 15 nt, Vaccinia virus
uaacuucugauuuua

SEQ ID NO: 4055802 - RNA, 23 nt, Vaccinia virus
uaacuugcgggguuaauuucaca

SEQ ID NO: 4055803 - RNA, 16 nt, Vaccinia virus
uaacuuuuguucuaug

SEQ ID NO: 4055804 - RNA, 22 nt, Vaccinia virus
uaagaacaugucuucuauucua

SEQ ID NO: 4055805 - RNA, 22 nt, Vaccinia virus
uaagaauaauuuugaagcauug

SEQ ID NO: 4055806 - RNA, 15 nt, Vaccinia virus
uaagaguaacagcug

SEQ ID NO: 4055807 - RNA, 16 nt, Vaccinia virus
uaagaguaacagcugc

SEQ ID NO: 4055808 - RNA, 17 nt, Vaccinia virus
uaagauauccauaucau

SEQ ID NO: 4055809 - RNA, 21 nt, Vaccinia virus
uaagauaucuacuagaaagau

SEQ ID NO: 4055810 - RNA, 23 nt, Vaccinia virus
uaagaucuggguauuucuuuucu

SEQ ID NO: 4055811 - RNA, 14 nt, Vaccinia virus
uaagaugucauaau

SEQ ID NO: 4055812 - RNA, 14 nt, Vaccinia virus
uaagccaaacucau

SEQ ID NO: 4055813 - RNA, 22 nt, Vaccinia virus
uaaggacauuggauauguggaa

SEQ ID NO: 4055814 - RNA, 18 nt, Vaccinia virus
uaaguaauaacuauguuu

SEQ ID NO: 4055815 - RNA, 23 nt, Vaccinia virus
uaaguaguuaugagggaaaagau

SEQ ID NO: 4055816 - RNA, 21 nt, Vaccinia virus
uaaguauuuauaaaacucaua

SEQ ID NO: 4055817 - RNA, 17 nt, Vaccinia virus
uaagucccgaugaaaua

SEQ ID NO: 4055818 - RNA, 18 nt, Vaccinia virus
uaagucucucuccauaac

SEQ ID NO: 4055819 - RNA, 12 nt, Vaccinia virus
uaaguguuuaua

SEQ ID NO: 4055820 - RNA, 20 nt, Vaccinia virus
uaaguucauuaucugaaaua

SEQ ID NO: 4055821 - RNA, 13 nt, Vaccinia virus
uaaguuggaugaa

SEQ ID NO: 4055822 - RNA, 14 nt, Vaccinia virus
uaauaaaaacauua

SEQ ID NO: 4055823 - RNA, 21 nt, Vaccinia virus
uaauaaaaguggaagucauuu

SEQ ID NO: 4055824 - RNA, 18 nt, Vaccinia virus
uaauaaacauuccacauu

SEQ ID NO: 4055825 - RNA, 14 nt, Vaccinia virus
uaauaaaggaugug

SEQ ID NO: 4055826 - RNA, 15 nt, Vaccinia virus
uaauaaaucaaaaua

SEQ ID NO: 4055827 - RNA, 19 nt, Vaccinia virus
uaauaaauugguaaauccu

SEQ ID NO: 4055828 - RNA, 20 nt, Vaccinia virus
uaauaaauuuucucuugaaa

SEQ ID NO: 4055829 - RNA, 13 nt, Vaccinia virus
uaauaacaaguau

SEQ ID NO: 4055830 - RNA, 15 nt, Vaccinia virus
uaauaacaguuauau

SEQ ID NO: 4055831 - RNA, 21 nt, Vaccinia virus
uaauaacaugcgguucaaaau

SEQ ID NO: 4055832 - RNA, 20 nt, Vaccinia virus
uaauaaccugacuaauuuga

SEQ ID NO: 4055833 - RNA, 18 nt, Vaccinia virus
uaauaacgaguacauucu

SEQ ID NO: 4055834 - RNA, 21 nt, Vaccinia virus
uaauaacuagcuuaaacagau

SEQ ID NO: 4055835 - RNA, 19 nt, Vaccinia virus
uaauaauauuuugaaucuu

SEQ ID NO: 4055836 - RNA, 14 nt, Vaccinia virus
uaauaaucaauaau

SEQ ID NO: 4055837 - RNA, 22 nt, Vaccinia virus
uaauaaucaauaauauaucuua

SEQ ID NO: 4055838 - RNA, 15 nt, Vaccinia virus
uaauaauucauggaa

SEQ ID NO: 4055839 - RNA, 15 nt, Vaccinia virus
uaauaauuuaacaau

SEQ ID NO: 4055840 - RNA, 12 nt, Vaccinia virus
uaauacagacga

SEQ ID NO: 4055841 - RNA, 21 nt, Vaccinia virus
uaauacauccccauuccagua

SEQ ID NO: 4055842 - RNA, 19 nt, Vaccinia virus
uaauacaucucuggaaaua

SEQ ID NO: 4055843 - RNA, 24 nt, Vaccinia virus
uaauaccaauugcggacuuacuau

SEQ ID NO: 4055844 - RNA, 15 nt, Vaccinia virus
uaauacuaucuggau

SEQ ID NO: 4055845 - RNA, 14 nt, Vaccinia virus
uaauacuguuuucu

SEQ ID NO: 4055846 - RNA, 19 nt, Vaccinia virus
uaauagacuauauaaaccg

SEQ ID NO: 4055847 - RNA, 16 nt, Vaccinia virus
uaauagauauaucucu

SEQ ID NO: 4055848 - RNA, 20 nt, Vaccinia virus
uaauagaucaacagaaauau

SEQ ID NO: 4055849 - RNA, 24 nt, Vaccinia virus
uaauaguuuccaccgaaagacuau

SEQ ID NO: 4055850 - RNA, 16 nt, Vaccinia virus
uaauauaaaagaauau

SEQ ID NO: 4055851 - RNA, 22 nt, Vaccinia virus
uaauauaaccaccgauaaaucu

SEQ ID NO: 4055852 - RNA, 18 nt, Vaccinia virus
uaauaucccacauuauca

SEQ ID NO: 4055853 - RNA, 20 nt, Vaccinia virus
uaauaucccacauuaucauc

SEQ ID NO: 4055854 - RNA, 15 nt, Vaccinia virus
uaauaucuaaauauu

SEQ ID NO: 4055855 - RNA, 14 nt, Vaccinia virus
uaauaugaguaaaa

SEQ ID NO: 4055856 - RNA, 17 nt, Vaccinia virus
uaauaugauuagaaguu

SEQ ID NO: 4055857 - RNA, 19 nt, Vaccinia virus
uaauauuaaagauaaagcg

SEQ ID NO: 4055858 - RNA, 11 nt, Vaccinia virus
uaauauuugcu

SEQ ID NO: 4055859 - RNA, 19 nt, Vaccinia virus
uaauauuuugcaucauuca

SEQ ID NO: 4055860 - RNA, 22 nt, Vaccinia virus
uaaucaaaaucuuaauaucuuc

SEQ ID NO: 4055861 - RNA, 17 nt, Vaccinia virus
uaaucaauacaaaacau

SEQ ID NO: 4055862 - RNA, 22 nt, Vaccinia virus
uaaucauaaauuauuucauuau

SEQ ID NO: 4055863 - RNA, 23 nt, Vaccinia virus
uaaucauauuuagacugauguau

SEQ ID NO: 4055864 - RNA, 18 nt, Vaccinia virus
uaauccaaugauacuuuu

SEQ ID NO: 4055865 - RNA, 18 nt, Vaccinia virus
uaauccuuuuuauuuauu

SEQ ID NO: 4055866 - RNA, 14 nt, Vaccinia virus
uaaucgauuuugca

SEQ ID NO: 4055867 - RNA, 17 nt, Vaccinia virus
uaaucggagaauguuuc

SEQ ID NO: 4055868 - RNA, 15 nt, Vaccinia virus
uaaucguuauuauca

SEQ ID NO: 4055869 - RNA, 19 nt, Vaccinia virus
uaaucuacaaaacaaucau

SEQ ID NO: 4055870 - RNA, 23 nt, Vaccinia virus
uaaucuauuuuaccucuucugau

SEQ ID NO: 4055871 - RNA, 16 nt, Vaccinia virus
uaaugaacgaauuaug

SEQ ID NO: 4055872 - RNA, 17 nt, Vaccinia virus
uaaugacaauaauuaug

SEQ ID NO: 4055873 - RNA, 23 nt, Vaccinia virus
uaaugacaucuaugauuuuacug

SEQ ID NO: 4055874 - RNA, 15 nt, Vaccinia virus
uaaugauauaucuug

SEQ ID NO: 4055875 - RNA, 22 nt, Vaccinia virus
uaaugauguauguuuaaacacu

SEQ ID NO: 4055876 - RNA, 17 nt, Vaccinia virus
uaaugcaggguguauau

SEQ ID NO: 4055877 - RNA, 14 nt, Vaccinia virus
uaaugcuacagaua

SEQ ID NO: 4055878 - RNA, 15 nt, Vaccinia virus
uaauggaguuguaaa

SEQ ID NO: 4055879 - RNA, 14 nt, Vaccinia virus
uaauguaaaaucau

SEQ ID NO: 4055880 - RNA, 21 nt, Vaccinia virus
uaauguaaucucuaaauucau

SEQ ID NO: 4055881 - RNA, 23 nt, Vaccinia virus
uaauguagaagaucauacagaca

SEQ ID NO: 4055882 - RNA, 21 nt, Vaccinia virus
uaauguauucucuuacaaaua

SEQ ID NO: 4055883 - RNA, 19 nt, Vaccinia virus
uaauguuuaauuuaucaaa

SEQ ID NO: 4055884 - RNA, 18 nt, Vaccinia virus
uuagaucucauaugugcu

SEQ ID NO: 4055885 - RNA, 15 nt, Vaccinia virus
uuagaugaauuauua

SEQ ID NO: 4055886 - RNA, 13 nt, Vaccinia virus
uuagauuauucuc

SEQ ID NO: 4055887 - RNA, 23 nt, Vaccinia virus
uuagcaucagucuccacacuauu

SEQ ID NO: 4055888 - RNA, 14 nt, Vaccinia virus
uuagccauuuaauu

SEQ ID NO: 4055889 - RNA, 20 nt, Vaccinia virus
uuaguaaaaaauuuauuucu

SEQ ID NO: 4055890 - RNA, 18 nt, Vaccinia virus
uuaguaauauaucucaga

SEQ ID NO: 4055891 - RNA, 20 nt, Vaccinia virus
uuaguauaacgugaauguau

SEQ ID NO: 4055892 - RNA, 15 nt, Vaccinia virus
uuaguauaauuauug

SEQ ID NO: 4055893 - RNA, 22 nt, Vaccinia virus
uuaguauaucaaauacaucuau

SEQ ID NO: 4055894 - RNA, 19 nt, Vaccinia virus
uuaguauauuccuuauuca

SEQ ID NO: 4055895 - RNA, 19 nt, Vaccinia virus
uuaguaucuagcucuguaa

SEQ ID NO: 4055896 - RNA, 15 nt, Vaccinia virus
uuagucagauuauua

SEQ ID NO: 4055897 - RNA, 18 nt, Vaccinia virus
uuagucgugguaagaaag

SEQ ID NO: 4055898 - RNA, 12 nt, Vaccinia virus
uuaguuaacaua

SEQ ID NO: 4055899 - RNA, 15 nt, Vaccinia virus
uuauaaaaauguucu

SEQ ID NO: 4055900 - RNA, 13 nt, Vaccinia virus
uuauaagauaucc

SEQ ID NO: 4055901 - RNA, 12 nt, Vaccinia virus
guaacauaaaaa

SEQ ID NO: 4055902 - RNA, 15 nt, Vaccinia virus
guaacgcguggaaaa

SEQ ID NO: 4055903 - RNA, 21 nt, Vaccinia virus
guaacuggaucuuuauuuuuc

SEQ ID NO: 4055904 - RNA, 11 nt, Vaccinia virus
guaaguuuauu

SEQ ID NO: 4055905 - RNA, 15 nt, Vaccinia virus
guaauaaauaugauu

SEQ ID NO: 4055906 - RNA, 18 nt, Vaccinia virus
guaauaacagugcuauca

SEQ ID NO: 4055907 - RNA, 17 nt, Vaccinia virus
guaauaagaauaaaaug

SEQ ID NO: 4055908 - RNA, 20 nt, Vaccinia virus
guaauaucaugucuaaugau

SEQ ID NO: 4055909 - RNA, 22 nt, Vaccinia virus
guaauaucugacuuauuuccua

SEQ ID NO: 4055910 - RNA, 14 nt, Vaccinia virus
guaauauucaucau

SEQ ID NO: 4055911 - RNA, 16 nt, Vaccinia virus
guaaucauagaugaau

SEQ ID NO: 4055912 - RNA, 22 nt, Vaccinia virus
guaaugaacagacuauuuauca

SEQ ID NO: 4055913 - RNA, 13 nt, Vaccinia virus
guaauuaaugaaa

SEQ ID NO: 4055914 - RNA, 18 nt, Vaccinia virus
guaauuauaguauaaugu

SEQ ID NO: 4055915 - RNA, 23 nt, Vaccinia virus
guaauugacaucuauauauccuu

SEQ ID NO: 4055916 - RNA, 17 nt, Vaccinia virus
guaauuguauuauuucc

SEQ ID NO: 4055917 - RNA, 21 nt, Vaccinia virus
guacaaaaaaauaaaacuaga

SEQ ID NO: 4055918 - RNA, 19 nt, Vaccinia virus
guacaaaaaauaucauguu

SEQ ID NO: 4055919 - RNA, 17 nt, Vaccinia virus
guacaaauguuaaacau

SEQ ID NO: 4055920 - RNA, 15 nt, Vaccinia virus
guacaacauacuguu

SEQ ID NO: 4055921 - RNA, 17 nt, Vaccinia virus
guacaauaaauagcuuu

SEQ ID NO: 4055922 - RNA, 22 nt, Vaccinia virus
guacaaugauaaugauacagua

SEQ ID NO: 4055923 - RNA, 16 nt, Vaccinia virus
guacacaacacaauga

SEQ ID NO: 4055924 - RNA, 22 nt, Vaccinia virus
guacacagcauguuauaacuaa

SEQ ID NO: 4055925 - RNA, 18 nt, Vaccinia virus
guacaggacguaacuaua

SEQ ID NO: 4055926 - RNA, 16 nt, Vaccinia virus
guacauaaguuguaca

SEQ ID NO: 4055927 - RNA, 12 nt, Vaccinia virus
guacauaauaga

SEQ ID NO: 4055928 - RNA, 15 nt, Vaccinia virus
guacaucuugacauu

SEQ ID NO: 4055929 - RNA, 18 nt, Vaccinia virus
guacauuaauaaaugaaa

SEQ ID NO: 4055930 - RNA, 22 nt, Vaccinia virus
guaccagcauuuguaauaaucc

SEQ ID NO: 4055931 - RNA, 21 nt, Vaccinia virus
guaccgauucuagauacaaga

SEQ ID NO: 4055932 - RNA, 19 nt, Vaccinia virus
guacggcgagcuauuuaau

SEQ ID NO: 4055933 - RNA, 20 nt, Vaccinia virus
guacgggcgcuguaauuaau

SEQ ID NO: 4055934 - RNA, 13 nt, Vaccinia virus
guacuauaauauu

SEQ ID NO: 4055935 - RNA, 20 nt, Vaccinia virus
guacuccucccauaauacuu

SEQ ID NO: 4055936 - RNA, 14 nt, Vaccinia virus
guacucuuaagaga

SEQ ID NO: 4055937 - RNA, 18 nt, Vaccinia virus
guacuguaaaaacaaauu

SEQ ID NO: 4055938 - RNA, 18 nt, Vaccinia virus
guagacauagauauucua

SEQ ID NO: 4055939 - RNA, 22 nt, Vaccinia virus
guagauaagaaugugauaagau

SEQ ID NO: 4055940 - RNA, 14 nt, Vaccinia virus
guagauacauggcu

SEQ ID NO: 4055941 - RNA, 12 nt, Vaccinia virus
guagauauugcu

SEQ ID NO: 4055942 - RNA, 15 nt, Vaccinia virus
guagaugugauuuuu

SEQ ID NO: 4055943 - RNA, 14 nt, Vaccinia virus
guagcguauuucuc

SEQ ID NO: 4055944 - RNA, 15 nt, Vaccinia virus
guaggauauauuaaa

SEQ ID NO: 4055945 - RNA, 13 nt, Vaccinia virus
guaguaacucuaa

SEQ ID NO: 4055946 - RNA, 13 nt, Vaccinia virus
guagugguuauau

SEQ ID NO: 4055947 - RNA, 13 nt, Vaccinia virus
guauaaaaauuaa

SEQ ID NO: 4055948 - RNA, 18 nt, Vaccinia virus
guauaacauucuuaaaca

SEQ ID NO: 4055949 - RNA, 19 nt, Vaccinia virus
guauaacauucuuaaacaa

SEQ ID NO: 4055950 - RNA, 18 nt, Vaccinia virus
guauaauaacuaaauguc

SEQ ID NO: 4055951 - RNA, 20 nt, Vaccinia virus
guauaauucuuuauaacuga

SEQ ID NO: 4055952 - RNA, 19 nt, Vaccinia virus
guauaauuuuuauguuuua

SEQ ID NO: 4055953 - RNA, 14 nt, Vaccinia virus
guauauaguuuaua

SEQ ID NO: 4055954 - RNA, 22 nt, Vaccinia virus
guauaucaacaucuaccuuauu

SEQ ID NO: 4055955 - RNA, 13 nt, Vaccinia virus
guauauuauucau

SEQ ID NO: 4055956 - RNA, 19 nt, Vaccinia virus
guauauucuagguacuuau

SEQ ID NO: 4055957 - RNA, 19 nt, Vaccinia virus
guaucaaaaaauuacuuuu

SEQ ID NO: 4055958 - RNA, 22 nt, Vaccinia virus
guaucaaucaagaggauggaau

SEQ ID NO: 4055959 - RNA, 16 nt, Vaccinia virus
guaucauaauauuaau

SEQ ID NO: 4055960 - RNA, 23 nt, Vaccinia virus
guauccacuuuaauaauaucaua

SEQ ID NO: 4055961 - RNA, 19 nt, Vaccinia virus
guauccagguagacauaga

SEQ ID NO: 4055962 - RNA, 17 nt, Vaccinia virus
guauccuugauuauguu

SEQ ID NO: 4055963 - RNA, 23 nt, Vaccinia virus
guaucgauacgcauuuucaaaau

SEQ ID NO: 4055964 - RNA, 19 nt, Vaccinia virus
guaucgcauuaauacuguu

SEQ ID NO: 4055965 - RNA, 17 nt, Vaccinia virus
guaucugaaguacuauu

SEQ ID NO: 4055966 - RNA, 15 nt, Vaccinia virus
guaucuuauauacac

SEQ ID NO: 4055967 - RNA, 17 nt, Vaccinia virus
guaugaauaaucuucau

SEQ ID NO: 4055968 - RNA, 17 nt, Vaccinia virus
guaugaggcaacauugu

SEQ ID NO: 4055969 - RNA, 18 nt, Vaccinia virus
guauggagacauucauug

SEQ ID NO: 4055970 - RNA, 13 nt, Vaccinia virus
guaugucaugaau

SEQ ID NO: 4055971 - RNA, 21 nt, Vaccinia virus
guaugugugugugguauagau

SEQ ID NO: 4055972 - RNA, 14 nt, Vaccinia virus
guauuaauaauauc

SEQ ID NO: 4055973 - RNA, 16 nt, Vaccinia virus
guauuacuauaauagg

SEQ ID NO: 4055974 - RNA, 14 nt, Vaccinia virus
guauucaauuacua

SEQ ID NO: 4055975 - RNA, 21 nt, Vaccinia virus
guauucacuauaucaguuuua

SEQ ID NO: 4055976 - RNA, 12 nt, Vaccinia virus
guauugauaaau

SEQ ID NO: 4055977 - RNA, 15 nt, Vaccinia virus
guauuggauaaagga

SEQ ID NO: 4055978 - RNA, 12 nt, Vaccinia virus
guauuuggaaag

SEQ ID NO: 4055979 - RNA, 22 nt, Vaccinia virus
guauuuuuguuagaguauauaa

SEQ ID NO: 4055980 - RNA, 22 nt, Vaccinia virus
guauuuuuuauggcaaacuuua

SEQ ID NO: 4055981 - RNA, 14 nt, Vaccinia virus
gucaauauucuguu

SEQ ID NO: 4055982 - RNA, 15 nt, Vaccinia virus
gucaaucuuauucaa

SEQ ID NO: 4055983 - RNA, 18 nt, Vaccinia virus
gucaaugauaugauuuuu

SEQ ID NO: 4055984 - RNA, 13 nt, Vaccinia virus
gucaaugauuuca

SEQ ID NO: 4055985 - RNA, 17 nt, Vaccinia virus
gucaauuuuaaaugaug

SEQ ID NO: 4055986 - RNA, 22 nt, Vaccinia virus
gucacugucuggcaauaaauga

SEQ ID NO: 4055987 - RNA, 14 nt, Vaccinia virus
gucagaauucucuc

SEQ ID NO: 4055988 - RNA, 17 nt, Vaccinia virus
ugagaguagauaucauu

SEQ ID NO: 4055989 - RNA, 13 nt, Vaccinia virus
ugagauaagaaca

SEQ ID NO: 4055990 - RNA, 14 nt, Vaccinia virus
ugagauauauacac

SEQ ID NO: 4055991 - RNA, 14 nt, Vaccinia virus
ugaggauaaugcua

SEQ ID NO: 4055992 - RNA, 17 nt, Vaccinia virus
ugaguauaucagaucau

SEQ ID NO: 4055993 - RNA, 13 nt, Vaccinia virus
aaaaaagcaaugu

SEQ ID NO: 4055994 - RNA, 11 nt, Vaccinia virus
aaaaacuauac

SEQ ID NO: 4055995 - RNA, 19 nt, Vaccinia virus
aaaaacuguuuaacaaggu

SEQ ID NO: 4055996 - RNA, 14 nt, Vaccinia virus
aaaaagaaugagua

SEQ ID NO: 4055997 - RNA, 19 nt, Vaccinia virus
aaaaagcucuauauuacaa

SEQ ID NO: 4055998 - RNA, 23 nt, Vaccinia virus
aaaaaugcuagaauuagaaaagu

SEQ ID NO: 4055999 - RNA, 15 nt, Vaccinia virus
aaaaauguuaauuua

SEQ ID NO: 4056000 - RNA, 20 nt, Vaccinia virus
aaaaauuagaucaaagaaua

SEQ ID NO: 4056001 - RNA, 14 nt, Vaccinia virus
aaaaauuauacugu

SEQ ID NO: 4056002 - RNA, 22 nt, Vaccinia virus
aaaaauuauccuaucauguauu

SEQ ID NO: 4056003 - RNA, 13 nt, Vaccinia virus
aaaaauucccauu

SEQ ID NO: 4056004 - RNA, 20 nt, Vaccinia virus
aaaaauugaauugaugauau

SEQ ID NO: 4056005 - RNA, 21 nt, Vaccinia virus
aaaaauuuuaagcgaugauau

SEQ ID NO: 4056006 - RNA, 14 nt, Vaccinia virus
aaaacaaugaacua

SEQ ID NO: 4056007 - RNA, 15 nt, Vaccinia virus
aaaacacaaauaugg

SEQ ID NO: 4056008 - RNA, 16 nt, Vaccinia virus
aaaacagauaaugaua

SEQ ID NO: 4056009 - RNA, 21 nt, Vaccinia virus
aaaacauaaaggaauauacaa

SEQ ID NO: 4056010 - RNA, 13 nt, Vaccinia virus
aaaacauaaucaa

SEQ ID NO: 4056011 - RNA, 17 nt, Vaccinia virus
aaaacauauauaauaaa

SEQ ID NO: 4056012 - RNA, 20 nt, Vaccinia virus
aaaacauuauaauaauauaa

SEQ ID NO: 4056013 - RNA, 21 nt, Vaccinia virus
aaaacauuauucuauuucgaa

SEQ ID NO: 4056014 - RNA, 22 nt, Vaccinia virus
aaaacgaggagcggauaaugau

SEQ ID NO: 4056015 - RNA, 13 nt, Vaccinia virus
aaaacucaaaugu

SEQ ID NO: 4056016 - RNA, 17 nt, Vaccinia virus
aaaacugguuaaaacag

SEQ ID NO: 4056017 - RNA, 22 nt, Vaccinia virus
aaaacugguuaaaacaguaugu

SEQ ID NO: 4056018 - RNA, 16 nt, Vaccinia virus
aaaacuuuaauaacaa

SEQ ID NO: 4056019 - RNA, 14 nt, Vaccinia virus
aaaagaaaauuugu

SEQ ID NO: 4056020 - RNA, 11 nt, Vaccinia virus
aaaagaaagua

SEQ ID NO: 4056021 - RNA, 18 nt, Vaccinia virus
aaaagaacuaacguccau

SEQ ID NO: 4056022 - RNA, 20 nt, Vaccinia virus
aaaagaauguaucaagaaua

SEQ ID NO: 4056023 - RNA, 21 nt, Vaccinia virus
aaaagacgcuuguuaauaagu

SEQ ID NO: 4056024 - RNA, 14 nt, Vaccinia virus
aaaagacuauacau

SEQ ID NO: 4056025 - RNA, 14 nt, Vaccinia virus
aaaagauaaaugua

SEQ ID NO: 4056026 - RNA, 16 nt, Vaccinia virus
aaaagauacguacugu

SEQ ID NO: 4056027 - RNA, 17 nt, Vaccinia virus
aaaagauucgguuuuau

SEQ ID NO: 4056028 - RNA, 22 nt, Vaccinia virus
aaaagauucgguuuuauacugu

SEQ ID NO: 4056029 - RNA, 10 nt, Vaccinia virus
aaaagucaac

SEQ ID NO: 4056030 - RNA, 13 nt, Vaccinia virus
aaaauaaaguuau

SEQ ID NO: 4056031 - RNA, 19 nt, Vaccinia virus
aaaauaaucauacaaucua

SEQ ID NO: 4056032 - RNA, 13 nt, Vaccinia virus
aaaauacauaaag

SEQ ID NO: 4056033 - RNA, 16 nt, Vaccinia virus
aaaauacuauagacca

SEQ ID NO: 4056034 - RNA, 15 nt, Vaccinia virus
aaaauagaaaaaaca

SEQ ID NO: 4056035 - RNA, 16 nt, Vaccinia virus
aaaauagcgcugaaaa

SEQ ID NO: 4056036 - RNA, 13 nt, Vaccinia virus
aaaauauaaauua

SEQ ID NO: 4056037 - RNA, 14 nt, Vaccinia virus
aaaauauaaugaua

SEQ ID NO: 4056038 - RNA, 17 nt, Vaccinia virus
aaaauauauaaugaaua

SEQ ID NO: 4056039 - RNA, 22 nt, Vaccinia virus
aaaauauggaauuguauuuucu

SEQ ID NO: 4056040 - RNA, 16 nt, Vaccinia virus
aaaauauguauaacgu

SEQ ID NO: 4056041 - RNA, 13 nt, Vaccinia virus
aaaauauuaucua

SEQ ID NO: 4056042 - RNA, 16 nt, Vaccinia virus
aaaauauuuauuagaa

SEQ ID NO: 4056043 - RNA, 16 nt, Vaccinia virus
aaaaucauugggauuu

SEQ ID NO: 4056044 - RNA, 15 nt, Vaccinia virus
aaaaucgauaaacug

SEQ ID NO: 4056045 - RNA, 16 nt, Vaccinia virus
aaaaucugauagaaag

SEQ ID NO: 4056046 - RNA, 22 nt, Vaccinia virus
aaaaugguguauuggaccuggu

SEQ ID NO: 4056047 - RNA, 18 nt, Vaccinia virus
aaaaugugggagaaucua

SEQ ID NO: 4056048 - RNA, 19 nt, Vaccinia virus
aaaaugugucaagaaucua

SEQ ID NO: 4056049 - RNA, 17 nt, Vaccinia virus
aaaauguugaugauauc

SEQ ID NO: 4056050 - RNA, 13 nt, Vaccinia virus
aaaauuauguaaa

SEQ ID NO: 4056051 - RNA, 22 nt, Vaccinia virus
aaaauuauuaaacaauacucua

SEQ ID NO: 4056052 - RNA, 13 nt, Vaccinia virus
aaaauuguagaac

SEQ ID NO: 4056053 - RNA, 16 nt, Vaccinia virus
aaaauuuaagagaaug

SEQ ID NO: 4056054 - RNA, 12 nt, Vaccinia virus
aaacaaaaaugc

SEQ ID NO: 4056055 - RNA, 14 nt, Vaccinia virus
aaacaaagaauugu

SEQ ID NO: 4056056 - RNA, 12 nt, Vaccinia virus
aaacaacucuuc

SEQ ID NO: 4056057 - RNA, 17 nt, Vaccinia virus
aaacaauacagugauug

SEQ ID NO: 4056058 - RNA, 22 nt, Vaccinia virus
aaacacgucgaagguuaacauc

SEQ ID NO: 4056059 - RNA, 13 nt, Vaccinia virus
aaacacuguuguu

SEQ ID NO: 4056060 - RNA, 20 nt, Vaccinia virus
aaacagacgacaacauguaa

SEQ ID NO: 4056061 - RNA, 23 nt, Vaccinia virus
aaacagauauaguuuuucuggaa

SEQ ID NO: 4056062 - RNA, 22 nt, Vaccinia virus
aaacagucagcuggucuaaaau

SEQ ID NO: 4056063 - RNA, 19 nt, Vaccinia virus
aaacaguuacuguuaguau

SEQ ID NO: 4056064 - RNA, 14 nt, Vaccinia virus
aaacauauucuaug

SEQ ID NO: 4056065 - RNA, 18 nt, Vaccinia virus
aaacaugaugagauguuu

SEQ ID NO: 4056066 - RNA, 22 nt, Vaccinia virus
aaacauucuuuauuaaguguuu

SEQ ID NO: 4056067 - RNA, 15 nt, Vaccinia virus
aaacauuuugcagaa

SEQ ID NO: 4056068 - RNA, 21 nt, Vaccinia virus
aaaccaaaucuugauuacaaa

SEQ ID NO: 4056069 - RNA, 17 nt, Vaccinia virus
aacucuugcuacaaaau

SEQ ID NO: 4056070 - RNA, 19 nt, Vaccinia virus
aacugcuuuucuggauggc

SEQ ID NO: 4056071 - RNA, 17 nt, Vaccinia virus
aacuguguuucagguau

SEQ ID NO: 4056072 - RNA, 18 nt, Vaccinia virus
aacuuaaaagaauuacuu

SEQ ID NO: 4056073 - RNA, 17 nt, Vaccinia virus
aacuuaaacaaaauaca

SEQ ID NO: 4056074 - RNA, 19 nt, Vaccinia virus
aacuuagacggcaaguugu

SEQ ID NO: 4056075 - RNA, 15 nt, Vaccinia virus
aacuuauucuugaua

SEQ ID NO: 4056076 - RNA, 17 nt, Vaccinia virus
aacuucgugaauaaugu

SEQ ID NO: 4056077 - RNA, 19 nt, Vaccinia virus
aacuucuaaucuuguaaua

SEQ ID NO: 4056078 - RNA, 16 nt, Vaccinia virus
aacuucuagucuagaa

SEQ ID NO: 4056079 - RNA, 16 nt, Vaccinia virus
aacuuggggagaauga

SEQ ID NO: 4056080 - RNA, 19 nt, Vaccinia virus
aacuuguguucuaaaugga

SEQ ID NO: 4056081 - RNA, 13 nt, Vaccinia virus
aacuuuaaauacu

SEQ ID NO: 4056082 - RNA, 14 nt, Vaccinia virus
aacuuuaaauacuu

SEQ ID NO: 4056083 - RNA, 19 nt, Vaccinia virus
aacuuuauccauaucucua

SEQ ID NO: 4056084 - RNA, 23 nt, Vaccinia virus
aacuuuauccauaucucuagaua

SEQ ID NO: 4056085 - RNA, 12 nt, Vaccinia virus
aacuuucuagaa

SEQ ID NO: 4056086 - RNA, 14 nt, Vaccinia virus
aacuuuuaaauaca

SEQ ID NO: 4056087 - RNA, 16 nt, Vaccinia virus
aacuuuuagaaauaua

SEQ ID NO: 4056088 - RNA, 21 nt, Vaccinia virus
aacuuuuguuuuguuucugau

SEQ ID NO: 4056089 - RNA, 23 nt, Vaccinia virus
aagaaauacuaaaaaauguagaa

SEQ ID NO: 4056090 - RNA, 15 nt, Vaccinia virus
aagaaauuaauaaag

SEQ ID NO: 4056091 - RNA, 15 nt, Vaccinia virus
aagaacaauguccaa

SEQ ID NO: 4056092 - RNA, 12 nt, Vaccinia virus
aagaagaaguua

SEQ ID NO: 4056093 - RNA, 11 nt, Vaccinia virus
aagaagagaau

SEQ ID NO: 4056094 - RNA, 23 nt, Vaccinia virus
aagaaguagcuaauguuguaaac

SEQ ID NO: 4056095 - RNA, 17 nt, Vaccinia virus
aagaaguuccaugaugu

SEQ ID NO: 4056096 - RNA, 22 nt, Vaccinia virus
aagaauaauccuauaucacuuc

SEQ ID NO: 4056097 - RNA, 14 nt, Vaccinia virus
aagaauauagaaau

SEQ ID NO: 4056098 - RNA, 13 nt, Vaccinia virus
aagaauugugcau

SEQ ID NO: 4056099 - RNA, 14 nt, Vaccinia virus
aagaauuuggaaau

SEQ ID NO: 4056100 - RNA, 13 nt, Vaccinia virus
aagaccaauaaua

SEQ ID NO: 4056101 - RNA, 16 nt, Vaccinia virus
aagacgauacuguuuc

SEQ ID NO: 4056102 - RNA, 18 nt, Vaccinia virus
aagacugcugaauguauc

SEQ ID NO: 4056103 - RNA, 19 nt, Vaccinia virus
aagacuuuguguugugcau

SEQ ID NO: 4056104 - RNA, 18 nt, Vaccinia virus
aagagaauugucaaaauu

SEQ ID NO: 4056105 - RNA, 19 nt, Vaccinia virus
aagagcuacgugagacuua

SEQ ID NO: 4056106 - RNA, 15 nt, Vaccinia virus
aagaguauacagaag

SEQ ID NO: 4056107 - RNA, 14 nt, Vaccinia virus
aagauaaaguuuau

SEQ ID NO: 4056108 - RNA, 14 nt, Vaccinia virus
aagauaauuaucca

SEQ ID NO: 4056109 - RNA, 23 nt, Vaccinia virus
aagauaggggaguaguugaaauc

SEQ ID NO: 4056110 - RNA, 13 nt, Vaccinia virus
aagauauagcacc

SEQ ID NO: 4056111 - RNA, 20 nt, Vaccinia virus
aagauaucuacuagaaagau

SEQ ID NO: 4056112 - RNA, 18 nt, Vaccinia virus
aagauaucuauacuuacu

SEQ ID NO: 4056113 - RNA, 17 nt, Vaccinia virus
aagauaugcuacaagau

SEQ ID NO: 4056114 - RNA, 15 nt, Vaccinia virus
aagaucauacagaca

SEQ ID NO: 4056115 - RNA, 14 nt, Vaccinia virus
aagaugaaaugauu

SEQ ID NO: 4056116 - RNA, 14 nt, Vaccinia virus
aagauguuagaaaa

SEQ ID NO: 4056117 - RNA, 16 nt, Vaccinia virus
aagauuacuacacuug

SEQ ID NO: 4056118 - RNA, 17 nt, Vaccinia virus
aagauuguacagaaauc

SEQ ID NO: 4056119 - RNA, 22 nt, Vaccinia virus
aagauuuuuagcguauuauccu

SEQ ID NO: 4056120 - RNA, 12 nt, Vaccinia virus
aagcaaaugaug

SEQ ID NO: 4056121 - RNA, 14 nt, Vaccinia virus
aagcaagaaagaua

SEQ ID NO: 4056122 - RNA, 14 nt, Vaccinia virus
aagcaauaaauaca

SEQ ID NO: 4056123 - RNA, 16 nt, Vaccinia virus
aagcaauaaauacaga

SEQ ID NO: 4056124 - RNA, 19 nt, Vaccinia virus
aagcaugacggcaugauaa

SEQ ID NO: 4056125 - RNA, 22 nt, Vaccinia virus
aagcuacuuguuuaacaaaguu

SEQ ID NO: 4056126 - RNA, 14 nt, Vaccinia virus
aagcugacaaaauu

SEQ ID NO: 4056127 - RNA, 17 nt, Vaccinia virus
aagcuguucaaaauaua

SEQ ID NO: 4056128 - RNA, 14 nt, Vaccinia virus
aagcuugacuacau

SEQ ID NO: 4056129 - RNA, 16 nt, Vaccinia virus
aaggaauuaauuauuc

SEQ ID NO: 4056130 - RNA, 21 nt, Vaccinia virus
aaggacauuggauauguggaa

SEQ ID NO: 4056131 - RNA, 20 nt, Vaccinia virus
aaggacauuguaaauuuuau

SEQ ID NO: 4056132 - RNA, 23 nt, Vaccinia virus
aaggaggaucuuuacccauccaa

SEQ ID NO: 4056133 - RNA, 16 nt, Vaccinia virus
aaggauauacaaagca

SEQ ID NO: 4056134 - RNA, 15 nt, Vaccinia virus
aaggauaugauaugu

SEQ ID NO: 4056135 - RNA, 15 nt, Vaccinia virus
aaggaucuguacacg

SEQ ID NO: 4056136 - RNA, 23 nt, Vaccinia virus
aaggaugcaaacuuacagaaaca

SEQ ID NO: 4056137 - RNA, 12 nt, Vaccinia virus
aaggucagaaaa

SEQ ID NO: 4056138 - RNA, 18 nt, Vaccinia virus
aaggugucgauuaccauu

SEQ ID NO: 4056139 - RNA, 12 nt, Vaccinia virus
aagguucuuaua

SEQ ID NO: 4056140 - RNA, 11 nt, Vaccinia virus
aaguaaauacu

SEQ ID NO: 4056141 - RNA, 16 nt, Vaccinia virus
aaguaaguauguugaa

SEQ ID NO: 4056142 - RNA, 15 nt, Vaccinia virus
aaguacgauguuauu

SEQ ID NO: 4056143 - RNA, 16 nt, Vaccinia virus
aaguacuugauacaua

SEQ ID NO: 4056144 - RNA, 16 nt, Vaccinia virus
aaguaucaaaucgaua

SEQ ID NO: 4056145 - RNA, 18 nt, Vaccinia virus
aaguauccauuuagcaaa

SEQ ID NO: 4056146 - RNA, 22 nt, Vaccinia virus
aaguaucuaguuagcaauuuuc

SEQ ID NO: 4056147 - RNA, 18 nt, Vaccinia virus
aaguaugauacaauacuu

SEQ ID NO: 4056148 - RNA, 18 nt, Vaccinia virus
aaguauuguuuugauaac

SEQ ID NO: 4056149 - RNA, 14 nt, Vaccinia virus
aaguauuuauaaaa

SEQ ID NO: 4056150 - RNA, 20 nt, Vaccinia virus
aaguauuugaacauguagau

SEQ ID NO: 4056151 - RNA, 16 nt, Vaccinia virus
aagucacuaacugaua

SEQ ID NO: 4056152 - RNA, 19 nt, Vaccinia virus
aagucauacuagaauaaag

SEQ ID NO: 4056153 - RNA, 20 nt, Vaccinia virus
aagucccucauagaaugaua

SEQ ID NO: 4056154 - RNA, 20 nt, Vaccinia virus
aaguccuaguuguauacuga

SEQ ID NO: 4056155 - RNA, 21 nt, Vaccinia virus
aagucucguucguaaauaaua

SEQ ID NO: 4056156 - RNA, 19 nt, Vaccinia virus
aagucugauauucagaaag

SEQ ID NO: 4056157 - RNA, 16 nt, Vaccinia virus
aagucuuacaauguuc

SEQ ID NO: 4056158 - RNA, 22 nt, Vaccinia virus
aagugaacaauaauuaauucuu

SEQ ID NO: 4056159 - RNA, 19 nt, Vaccinia virus
aaguggacauauagaugca

SEQ ID NO: 4056160 - RNA, 17 nt, Vaccinia virus
aaguuaaaauaucaugg

SEQ ID NO: 4056161 - RNA, 22 nt, Vaccinia virus
aaguuacaaacaacuaggaaau

SEQ ID NO: 4056162 - RNA, 15 nt, Vaccinia virus
aaguucaccaaacaa

SEQ ID NO: 4056163 - RNA, 18 nt, Vaccinia virus
aaguucauaacagauaca

SEQ ID NO: 4056164 - RNA, 22 nt, Vaccinia virus
aaguuccagaaaauguagaauu

SEQ ID NO: 4056165 - RNA, 16 nt, Vaccinia virus
aaguugaccaauucau

SEQ ID NO: 4056166 - RNA, 13 nt, Vaccinia virus
aaguuguuaaaaa

SEQ ID NO: 4056167 - RNA, 19 nt, Vaccinia virus
aaguuuauucgcuaccaua

SEQ ID NO: 4056168 - RNA, 17 nt, Vaccinia virus
aaguuucguacaaauac

SEQ ID NO: 4056169 - RNA, 15 nt, Vaccinia virus
aaguuucuauuucuu

SEQ ID NO: 4056170 - RNA, 16 nt, Vaccinia virus
aaguuucucaugauaa

SEQ ID NO: 4056171 - RNA, 17 nt, Vaccinia virus
aaguuuggagaaaugga

SEQ ID NO: 4056172 - RNA, 19 nt, Vaccinia virus
aaguuuggcagcuagcaga

SEQ ID NO: 4056173 - RNA, 22 nt, Vaccinia virus
aaguuuuauagagauagacgaa

SEQ ID NO: 4056174 - RNA, 16 nt, Vaccinia virus
aaguuuuuauucucuu

SEQ ID NO: 4056175 - RNA, 13 nt, Vaccinia virus
aauaaaacuguau

SEQ ID NO: 4056176 - RNA, 21 nt, Vaccinia virus
aauaaaaucacuaguaucaau

SEQ ID NO: 4056177 - RNA, 19 nt, Vaccinia virus
aauaaacucagaacaauau

SEQ ID NO: 4056178 - RNA, 15 nt, Vaccinia virus
aauaaauaacaaugg

SEQ ID NO: 4056179 - RNA, 20 nt, Vaccinia virus
aauaaaugcgauacagacau

SEQ ID NO: 4056180 - RNA, 16 nt, Vaccinia virus
aauaaaugcuugauau

SEQ ID NO: 4056181 - RNA, 20 nt, Vaccinia virus
aauaaauguccacuauacau

SEQ ID NO: 4056182 - RNA, 17 nt, Vaccinia virus
aauaaauuuuuccaaga

SEQ ID NO: 4056183 - RNA, 17 nt, Vaccinia virus
aauaacauaggauuaaa

SEQ ID NO: 4056184 - RNA, 19 nt, Vaccinia virus
aauaacauaggauuaaaaa

SEQ ID NO: 4056185 - RNA, 15 nt, Vaccinia virus
aauaacaucagaaaa

SEQ ID NO: 4056186 - RNA, 18 nt, Vaccinia virus
aauaacauuuauuaucau

SEQ ID NO: 4056187 - RNA, 23 nt, Vaccinia virus
aauaaccguuagacauaaaauug

SEQ ID NO: 4056188 - RNA, 19 nt, Vaccinia virus
aauaacuacaguuugaaaa

SEQ ID NO: 4056189 - RNA, 21 nt, Vaccinia virus
aauaacuagcuuaaacagaug

SEQ ID NO: 4056190 - RNA, 23 nt, Vaccinia virus
aauaacucauuuauauauuaaaa

SEQ ID NO: 4056191 - RNA, 23 nt, Vaccinia virus
aauaacucucgugcuucagaaaa

SEQ ID NO: 4056192 - RNA, 23 nt, Vaccinia virus
aauaagaacuauaaaaaaaauaa

SEQ ID NO: 4056193 - RNA, 21 nt, Vaccinia virus
aauuuccccauugauagaaaa

SEQ ID NO: 4056194 - RNA, 23 nt, Vaccinia virus
aauuucuaaaggagcaaauguua

SEQ ID NO: 4056195 - RNA, 20 nt, Vaccinia virus
aauuucuuagucauagacaa

SEQ ID NO: 4056196 - RNA, 17 nt, Vaccinia virus
aauuucuuuauucucua

SEQ ID NO: 4056197 - RNA, 12 nt, Vaccinia virus
aauuugaauauc

SEQ ID NO: 4056198 - RNA, 19 nt, Vaccinia virus
aauuugauccauguucaua

SEQ ID NO: 4056199 - RNA, 16 nt, Vaccinia virus
aauuuguucaaaauaa

SEQ ID NO: 4056200 - RNA, 21 nt, Vaccinia virus
aauuuuauucuagaauugaua

SEQ ID NO: 4056201 - RNA, 20 nt, Vaccinia virus
aauuuuuaacgauuuacugu

SEQ ID NO: 4056202 - RNA, 20 nt, Vaccinia virus
aauuuuuauuaaugauacaa

SEQ ID NO: 4056203 - RNA, 14 nt, Vaccinia virus
aauuuuuauuucuc

SEQ ID NO: 4056204 - RNA, 12 nt, Vaccinia virus
aauuuuucuuaa

SEQ ID NO: 4056205 - RNA, 14 nt, Vaccinia virus
aauuuuuuuuauga

SEQ ID NO: 4056206 - RNA, 17 nt, Vaccinia virus
aauuuuuuuucuagaua

SEQ ID NO: 4056207 - RNA, 15 nt, Vaccinia virus
acaaaaaagaacuaa

SEQ ID NO: 4056208 - RNA, 15 nt, Vaccinia virus
acaaaagcaauuauu

SEQ ID NO: 4056209 - RNA, 12 nt, Vaccinia virus
acaaaagguauu

SEQ ID NO: 4056210 - RNA, 16 nt, Vaccinia virus
acaaaauacuauauau

SEQ ID NO: 4056211 - RNA, 15 nt, Vaccinia virus
acaaaaucaaauaau

SEQ ID NO: 4056212 - RNA, 22 nt, Vaccinia virus
acaaaauccaaacauuacaaau

SEQ ID NO: 4056213 - RNA, 17 nt, Vaccinia virus
acaaaaucuagacucua

SEQ ID NO: 4056214 - RNA, 17 nt, Vaccinia virus
acaaacaacuaggaaau

SEQ ID NO: 4056215 - RNA, 22 nt, Vaccinia virus
acaaacauuuuuguugguguaa

SEQ ID NO: 4056216 - RNA, 16 nt, Vaccinia virus
acaaacuauagaaauu

SEQ ID NO: 4056217 - RNA, 17 nt, Vaccinia virus
acaaacuguaaguaugu

SEQ ID NO: 4056218 - RNA, 19 nt, Vaccinia virus
acaaacuuuuccuuuucca

SEQ ID NO: 4056219 - RNA, 17 nt, Vaccinia virus
acaaagauggcugaaau

SEQ ID NO: 4056220 - RNA, 16 nt, Vaccinia virus
acaaagcacucaauaa

SEQ ID NO: 4056221 - RNA, 17 nt, Vaccinia virus
acaaauauacuuuauca

SEQ ID NO: 4056222 - RNA, 23 nt, Vaccinia virus
acaaauauuuaacucaugaugaa

SEQ ID NO: 4056223 - RNA, 15 nt, Vaccinia virus
acaaaucuauaacau

SEQ ID NO: 4056224 - RNA, 19 nt, Vaccinia virus
acaaaugcgccaaaguuau

SEQ ID NO: 4056225 - RNA, 18 nt, Vaccinia virus
acaaauggauguuaaugu

SEQ ID NO: 4056226 - RNA, 18 nt, Vaccinia virus
acaacacgggauaaauua

SEQ ID NO: 4056227 - RNA, 16 nt, Vaccinia virus
acaaccgcuacauaau

SEQ ID NO: 4056228 - RNA, 22 nt, Vaccinia virus
acaacgucaucgcuucaucuau

SEQ ID NO: 4056229 - RNA, 14 nt, Vaccinia virus
acaacuaaacagua

SEQ ID NO: 4056230 - RNA, 23 nt, Vaccinia virus
acaagacauuuuuuguccuauau

SEQ ID NO: 4056231 - RNA, 17 nt, Vaccinia virus
acaagagauagaggagg

SEQ ID NO: 4056232 - RNA, 22 nt, Vaccinia virus
acaagaguggaaacucacauau

SEQ ID NO: 4056233 - RNA, 15 nt, Vaccinia virus
acaagaucuuuguuu

SEQ ID NO: 4056234 - RNA, 20 nt, Vaccinia virus
acaagauuuccaaucuuuga

SEQ ID NO: 4056235 - RNA, 13 nt, Vaccinia virus
acaagucuaauaa

SEQ ID NO: 4056236 - RNA, 22 nt, Vaccinia virus
acaaguuauacgucauuucauc

SEQ ID NO: 4056237 - RNA, 15 nt, Vaccinia virus
acaaguuuucauauu

SEQ ID NO: 4056238 - RNA, 16 nt, Vaccinia virus
acaauaaaaaaaauug

SEQ ID NO: 4056239 - RNA, 14 nt, Vaccinia virus
acaauaaaaauagu

SEQ ID NO: 4056240 - RNA, 16 nt, Vaccinia virus
acaauaaugagaaugu

SEQ ID NO: 4056241 - RNA, 20 nt, Vaccinia virus
acaauaauucagauaaugua

SEQ ID NO: 4056242 - RNA, 18 nt, Vaccinia virus
acaauacgauaaacauug

SEQ ID NO: 4056243 - RNA, 20 nt, Vaccinia virus
acaauacugcgacuuuguua

SEQ ID NO: 4056244 - RNA, 21 nt, Vaccinia virus
acaauacugcgacuuuguuaa

SEQ ID NO: 4056245 - RNA, 18 nt, Vaccinia virus
acaauaucaguaucuucu

SEQ ID NO: 4056246 - RNA, 22 nt, Vaccinia virus
acaauaucauaaacaaacuaau

SEQ ID NO: 4056247 - RNA, 15 nt, Vaccinia virus
acaauauggaaaaac

SEQ ID NO: 4056248 - RNA, 23 nt, Vaccinia virus
acaauauuuaguuuauucauaau

SEQ ID NO: 4056249 - RNA, 12 nt, Vaccinia virus
acaauauuuccg

SEQ ID NO: 4056250 - RNA, 15 nt, Vaccinia virus
acaaucgauaauaua

SEQ ID NO: 4056251 - RNA, 18 nt, Vaccinia virus
acaaucugucgaaaaagu

SEQ ID NO: 4056252 - RNA, 19 nt, Vaccinia virus
acaaugaaccguaauauau

SEQ ID NO: 4056253 - RNA, 15 nt, Vaccinia virus
acaaugauaaugaua

SEQ ID NO: 4056254 - RNA, 19 nt, Vaccinia virus
acaauggccgucuauguau

SEQ ID NO: 4056255 - RNA, 18 nt, Vaccinia virus
acaauggucgauuauaga

SEQ ID NO: 4056256 - RNA, 23 nt, Vaccinia virus
acaauggucgauuauagaaaugc

SEQ ID NO: 4056257 - RNA, 15 nt, Vaccinia virus
acaauguauaauaua

SEQ ID NO: 4056258 - RNA, 18 nt, Vaccinia virus
acaauguuucuuacauau

SEQ ID NO: 4056259 - RNA, 20 nt, Vaccinia virus
acaauguuugucauauguau

SEQ ID NO: 4056260 - RNA, 13 nt, Vaccinia virus
acaauuacaaaug

SEQ ID NO: 4056261 - RNA, 19 nt, Vaccinia virus
acaauuaucauuuugauua

SEQ ID NO: 4056262 - RNA, 16 nt, Vaccinia virus
acaauugucuguaaac

SEQ ID NO: 4056263 - RNA, 16 nt, Vaccinia virus
acaauuucuauuuccu

SEQ ID NO: 4056264 - RNA, 17 nt, Vaccinia virus
acaauuuguauuaucca

SEQ ID NO: 4056265 - RNA, 22 nt, Vaccinia virus
acaauuuguauuuuuuaaucua

SEQ ID NO: 4056266 - RNA, 14 nt, Vaccinia virus
acaauuuuguauua

SEQ ID NO: 4056267 - RNA, 19 nt, Vaccinia virus
acaauuuuugccuugaauu

SEQ ID NO: 4056268 - RNA, 19 nt, Vaccinia virus
acaauuuuuuuauaauaau

SEQ ID NO: 4056269 - RNA, 16 nt, Vaccinia virus
acacaaccagcaauaa

SEQ ID NO: 4056270 - RNA, 12 nt, Vaccinia virus
acacaagaucug

SEQ ID NO: 4056271 - RNA, 21 nt, Vaccinia virus
acacacuuaccuucaacagua

SEQ ID NO: 4056272 - RNA, 13 nt, Vaccinia virus
acacauauccacg

SEQ ID NO: 4056273 - RNA, 12 nt, Vaccinia virus
acacaugaugaa

SEQ ID NO: 4056274 - RNA, 16 nt, Vaccinia virus
acaccagcuuuuauca

SEQ ID NO: 4056275 - RNA, 16 nt, Vaccinia virus
acaccgccucuagaua

SEQ ID NO: 4056276 - RNA, 15 nt, Vaccinia virus
acaccuauaagauua

SEQ ID NO: 4056277 - RNA, 21 nt, Vaccinia virus
acacgaaagaaucaaaagaau

SEQ ID NO: 4056278 - RNA, 18 nt, Vaccinia virus
acacgggauaaauuauuu

SEQ ID NO: 4056279 - RNA, 17 nt, Vaccinia virus
acacuaauauuaugaug

SEQ ID NO: 4056280 - RNA, 16 nt, Vaccinia virus
acacuacugaaaaaag

SEQ ID NO: 4056281 - RNA, 12 nt, Vaccinia virus
acacuauugaac

SEQ ID NO: 4056282 - RNA, 23 nt, Vaccinia virus
acacuccguuuaauaaacugagu

SEQ ID NO: 4056283 - RNA, 18 nt, Vaccinia virus
acacugcgaucugaauaa

SEQ ID NO: 4056284 - RNA, 16 nt, Vaccinia virus
acacugguaacuauau

SEQ ID NO: 4056285 - RNA, 23 nt, Vaccinia virus
acacuguucacauccuuccaaga

SEQ ID NO: 4056286 - RNA, 22 nt, Vaccinia virus
acacuucuauaguaucuauaua

SEQ ID NO: 4056287 - RNA, 15 nt, Vaccinia virus
acagaaacuguaaag

SEQ ID NO: 4056288 - RNA, 17 nt, Vaccinia virus
acagaaauauaugagau

SEQ ID NO: 4056289 - RNA, 19 nt, Vaccinia virus
acagaaauauaugagaugu

SEQ ID NO: 4056290 - RNA, 22 nt, Vaccinia virus
acagaauaaacaaaauaaugua

SEQ ID NO: 4056291 - RNA, 17 nt, Vaccinia virus
acagaauauaaauuaua

SEQ ID NO: 4056292 - RNA, 13 nt, Vaccinia virus
acagauaaugaua

SEQ ID NO: 4056293 - RNA, 18 nt, Vaccinia virus
acagaucuaguauaauua

SEQ ID NO: 4056294 - RNA, 13 nt, Vaccinia virus
acagaugauauau

SEQ ID NO: 4056295 - RNA, 18 nt, Vaccinia virus
acagauggauuaaaucgu

SEQ ID NO: 4056296 - RNA, 15 nt, Vaccinia virus
acagauguaaauaua

SEQ ID NO: 4056297 - RNA, 21 nt, Vaccinia virus
acagauguaaauauauuuaca

SEQ ID NO: 4056298 - RNA, 15 nt, Vaccinia virus
acaggaaagaaguau

SEQ ID NO: 4056299 - RNA, 20 nt, Vaccinia virus
acaggcgaugguaaaaagac

SEQ ID NO: 4056300 - RNA, 15 nt, Vaccinia virus
acagguucucaauau

SEQ ID NO: 4056301 - RNA, 20 nt, Vaccinia virus
acagguuuaaacuaauacua

SEQ ID NO: 4056302 - RNA, 19 nt, Vaccinia virus
acaguaauguccaaaucua

SEQ ID NO: 4056303 - RNA, 20 nt, Vaccinia virus
acaguuaacgaaagcaaaga

SEQ ID NO: 4056304 - RNA, 13 nt, Vaccinia virus
acaguuugaaaaa

SEQ ID NO: 4056305 - RNA, 12 nt, Vaccinia virus
acaguuuuacua

SEQ ID NO: 4056306 - RNA, 13 nt, Vaccinia virus
acauaaacaaauu

SEQ ID NO: 4056307 - RNA, 21 nt, Vaccinia virus
acauaaacggcuuuuaaacag

SEQ ID NO: 4056308 - RNA, 15 nt, Vaccinia virus
acauaaauaugcaaa

SEQ ID NO: 4056309 - RNA, 21 nt, Vaccinia virus
acauaacuacguaucucaaua

SEQ ID NO: 4056310 - RNA, 14 nt, Vaccinia virus
acauaaguauaaag

SEQ ID NO: 4056311 - RNA, 20 nt, Vaccinia virus
acauaaguauauaauaaaua

SEQ ID NO: 4056312 - RNA, 21 nt, Vaccinia virus
acauaauccagcuagugaaua

SEQ ID NO: 4056313 - RNA, 22 nt, Vaccinia virus
acauaaucguagauucauguua

SEQ ID NO: 4056314 - RNA, 17 nt, Vaccinia virus
acauaauuauucuauca

SEQ ID NO: 4056315 - RNA, 16 nt, Vaccinia virus
acauaccguuagauaa

SEQ ID NO: 4056316 - RNA, 22 nt, Vaccinia virus
acauaguuugggaaaagaaauc

SEQ ID NO: 4056317 - RNA, 13 nt, Vaccinia virus
acauauaaaugua

SEQ ID NO: 4056318 - RNA, 13 nt, Vaccinia virus
acauauaaauguc

SEQ ID NO: 4056319 - RNA, 23 nt, Vaccinia virus
acauauagaugcagaaguaauga

SEQ ID NO: 4056320 - RNA, 17 nt, Vaccinia virus
acauaucgguguuucca

SEQ ID NO: 4056321 - RNA, 17 nt, Vaccinia virus
acauaucuaaaugaaua

SEQ ID NO: 4056322 - RNA, 16 nt, Vaccinia virus
acauaucuaacaaugg

SEQ ID NO: 4056323 - RNA, 21 nt, Vaccinia virus
acauaugaaccuucuacauau

SEQ ID NO: 4056324 - RNA, 22 nt, Vaccinia virus
acauaugcaucuauauaaucuu

SEQ ID NO: 4056325 - RNA, 15 nt, Vaccinia virus
acauauuauacagua

SEQ ID NO: 4056326 - RNA, 16 nt, Vaccinia virus
acauauucuaugaauu

SEQ ID NO: 4056327 - RNA, 15 nt, Vaccinia virus
acauauuuauauaau

SEQ ID NO: 4056328 - RNA, 22 nt, Vaccinia virus
acauauuuuagaacagaaauac

SEQ ID NO: 4056329 - RNA, 14 nt, Vaccinia virus
acaucaaaaaauua

SEQ ID NO: 4056330 - RNA, 16 nt, Vaccinia virus
acaucacgcucgauaa

SEQ ID NO: 4056331 - RNA, 18 nt, Vaccinia virus
acaucaugaaaugaugau

SEQ ID NO: 4056332 - RNA, 17 nt, Vaccinia virus
acaucccgguuaaacau

SEQ ID NO: 4056333 - RNA, 20 nt, Vaccinia virus
acauccgaaauacaaaaugu

SEQ ID NO: 4056334 - RNA, 21 nt, Vaccinia virus
acauccgccuuguauaugaug

SEQ ID NO: 4056335 - RNA, 14 nt, Vaccinia virus
acaucgacucauaa

SEQ ID NO: 4056336 - RNA, 14 nt, Vaccinia virus
acaucgucuagauc

SEQ ID NO: 4056337 - RNA, 23 nt, Vaccinia virus
acaucuaaaaaauccuuaaugau

SEQ ID NO: 4056338 - RNA, 14 nt, Vaccinia virus
acaucuaaaaaugu

SEQ ID NO: 4056339 - RNA, 18 nt, Vaccinia virus
acaucuaccuuauuuccc

SEQ ID NO: 4056340 - RNA, 20 nt, Vaccinia virus
acaucuacuuuaucuauuca

SEQ ID NO: 4056341 - RNA, 15 nt, Vaccinia virus
acaugauauucaugu

SEQ ID NO: 4056342 - RNA, 19 nt, Vaccinia virus
acaugcuccaauugaaugu

SEQ ID NO: 4056343 - RNA, 21 nt, Vaccinia virus
acauggaaauagguuuuguuc

SEQ ID NO: 4056344 - RNA, 18 nt, Vaccinia virus
acauggaauaaauuauua

SEQ ID NO: 4056345 - RNA, 13 nt, Vaccinia virus
acauuaaauguau

SEQ ID NO: 4056346 - RNA, 21 nt, Vaccinia virus
acauuaacucucucauuuucu

SEQ ID NO: 4056347 - RNA, 14 nt, Vaccinia virus
acauuaauagaaug

SEQ ID NO: 4056348 - RNA, 19 nt, Vaccinia virus
acauuagccggacaaauau

SEQ ID NO: 4056349 - RNA, 20 nt, Vaccinia virus
acauuagccggacaaauaua

SEQ ID NO: 4056350 - RNA, 20 nt, Vaccinia virus
acauuaucaaaaagaacgau

SEQ ID NO: 4056351 - RNA, 18 nt, Vaccinia virus
acauuaugagaauaugac

SEQ ID NO: 4056352 - RNA, 17 nt, Vaccinia virus
acauuauuaaucagaau

SEQ ID NO: 4056353 - RNA, 21 nt, Vaccinia virus
acauucuuaaccauauaucca

SEQ ID NO: 4056354 - RNA, 22 nt, Vaccinia virus
acauugaucuauuauuuaauga

SEQ ID NO: 4056355 - RNA, 23 nt, Vaccinia virus
acauuggcgccguuuaauuuccu

SEQ ID NO: 4056356 - RNA, 21 nt, Vaccinia virus
acauuguuacgucuccaauaa

SEQ ID NO: 4056357 - RNA, 23 nt, Vaccinia virus
acauuguuacgucuccaauaaau

SEQ ID NO: 4056358 - RNA, 17 nt, Vaccinia virus
acauuguuuauggugau

SEQ ID NO: 4056359 - RNA, 14 nt, Vaccinia virus
acauuuaugauaug

SEQ ID NO: 4056360 - RNA, 17 nt, Vaccinia virus
acauuuccgaaugaaug

SEQ ID NO: 4056361 - RNA, 16 nt, Vaccinia virus
acauuucucaaaugaa

SEQ ID NO: 4056362 - RNA, 14 nt, Vaccinia virus
acauuuuauuucua

SEQ ID NO: 4056363 - RNA, 21 nt, Vaccinia virus
acauuuucacaaauacuacaa

SEQ ID NO: 4056364 - RNA, 20 nt, Vaccinia virus
acauuuuccauuauuaauaa

SEQ ID NO: 4056365 - RNA, 14 nt, Vaccinia virus
acauuuuccauuua

SEQ ID NO: 4056366 - RNA, 17 nt, Vaccinia virus
accaaagacuuugaaau

SEQ ID NO: 4056367 - RNA, 18 nt, Vaccinia virus
accaauaaaaauaaacua

SEQ ID NO: 4056368 - RNA, 14 nt, Vaccinia virus
accaauaaacuauu

SEQ ID NO: 4056369 - RNA, 22 nt, Vaccinia virus
accaauaucgauuacuaugaau

SEQ ID NO: 4056370 - RNA, 23 nt, Vaccinia virus
accaauaucgauuacuaugaaua

SEQ ID NO: 4056371 - RNA, 19 nt, Vaccinia virus
accaauuguuuuuguacau

SEQ ID NO: 4056372 - RNA, 13 nt, Vaccinia virus
accacaacauuuc

SEQ ID NO: 4056373 - RNA, 12 nt, Vaccinia virus
accacaauaauc

SEQ ID NO: 4056374 - RNA, 13 nt, Vaccinia virus
accacuagcaaaa

SEQ ID NO: 4056375 - RNA, 18 nt, Vaccinia virus
accacucgaaaaaguaau

SEQ ID NO: 4056376 - RNA, 20 nt, Vaccinia virus
accagaagguguuguaacuu

SEQ ID NO: 4056377 - RNA, 16 nt, Vaccinia virus
accagccuacauuuug

SEQ ID NO: 4056378 - RNA, 14 nt, Vaccinia virus
accagcuccaugac

SEQ ID NO: 4056379 - RNA, 18 nt, Vaccinia virus
accaguaccagaucuuaa

SEQ ID NO: 4056380 - RNA, 22 nt, Vaccinia virus
accagucucgcguucaagauua

SEQ ID NO: 4056381 - RNA, 16 nt, Vaccinia virus
accaucuaucaaacaa

SEQ ID NO: 4056382 - RNA, 19 nt, Vaccinia virus
accaugaaauugagaagau

SEQ ID NO: 4056383 - RNA, 21 nt, Vaccinia virus
accaugaaauugagaagauca

SEQ ID NO: 4056384 - RNA, 14 nt, Vaccinia virus
accauuaaaaauug

SEQ ID NO: 4056385 - RNA, 16 nt, Vaccinia virus
accauuaauaggaaaa

SEQ ID NO: 4056386 - RNA, 16 nt, Vaccinia virus
accauuagauaaucua

SEQ ID NO: 4056387 - RNA, 24 nt, Vaccinia virus
accauuauucgccuguaucagaua

SEQ ID NO: 4056388 - RNA, 17 nt, Vaccinia virus
accauuuuaaaaucauu

SEQ ID NO: 4056389 - RNA, 23 nt, Vaccinia virus
accauuuuuuuuaaaaaaaauag

SEQ ID NO: 4056390 - RNA, 19 nt, Vaccinia virus
acccaaagagaccaaugaa

SEQ ID NO: 4056391 - RNA, 18 nt, Vaccinia virus
acccagaucucuuuuucu

SEQ ID NO: 4056392 - RNA, 15 nt, Vaccinia virus
acccaguuaguuuua

SEQ ID NO: 4056393 - RNA, 19 nt, Vaccinia virus
acccauuagguuaaaugau

SEQ ID NO: 4056394 - RNA, 21 nt, Vaccinia virus
accccauauaauguagacaug

SEQ ID NO: 4056395 - RNA, 14 nt, Vaccinia virus
acccgcaauuauua

SEQ ID NO: 4056396 - RNA, 17 nt, Vaccinia virus
acccuuccagauaaugu

SEQ ID NO: 4056397 - RNA, 21 nt, Vaccinia virus
accgacgauaauauaaacauc

SEQ ID NO: 4056398 - RNA, 21 nt, Vaccinia virus
accgaucaaagaauuaaugau

SEQ ID NO: 4056399 - RNA, 23 nt, Vaccinia virus
accggcuguggaguuauaugaau

SEQ ID NO: 4056400 - RNA, 15 nt, Vaccinia virus
accggucauauuaau

SEQ ID NO: 4056401 - RNA, 21 nt, Vaccinia virus
accguauccauaaacaauauu

SEQ ID NO: 4056402 - RNA, 21 nt, Vaccinia virus
accgucgaguuacuuaaaugc

SEQ ID NO: 4056403 - RNA, 16 nt, Vaccinia virus
accguuguuaaauacu

SEQ ID NO: 4056404 - RNA, 17 nt, Vaccinia virus
accuaagcaagaaagau

SEQ ID NO: 4056405 - RNA, 14 nt, Vaccinia virus
accuaagggauuuu

SEQ ID NO: 4056406 - RNA, 21 nt, Vaccinia virus
accuaaucccgcauuuauaca

SEQ ID NO: 4056407 - RNA, 22 nt, Vaccinia virus
accuaucaaggaacaaauauug

SEQ ID NO: 4056408 - RNA, 15 nt, Vaccinia virus
accuaugauaaagga

SEQ ID NO: 4056409 - RNA, 15 nt, Vaccinia virus
accuauuaauaauua

SEQ ID NO: 4056410 - RNA, 22 nt, Vaccinia virus
accucagacugguagagaauga

SEQ ID NO: 4056411 - RNA, 17 nt, Vaccinia virus
accucuaucaucuacau

SEQ ID NO: 4056412 - RNA, 16 nt, Vaccinia virus
accucuccaaaaagaa

SEQ ID NO: 4056413 - RNA, 22 nt, Vaccinia virus
accucuuauuggucagaaauau

SEQ ID NO: 4056414 - RNA, 23 nt, Vaccinia virus
accucuuauuggucagaaauauu

SEQ ID NO: 4056415 - RNA, 15 nt, Vaccinia virus
accugauuagaauuc

SEQ ID NO: 4056416 - RNA, 20 nt, Vaccinia virus
acgaaaguauagcuaaugau

SEQ ID NO: 4056417 - RNA, 14 nt, Vaccinia virus
acgaaauauuagaa

SEQ ID NO: 4056418 - RNA, 20 nt, Vaccinia virus
acgaaauugcaaaauaugcu

SEQ ID NO: 4056419 - RNA, 20 nt, Vaccinia virus
acgacacuggaaaaugcgau

SEQ ID NO: 4056420 - RNA, 19 nt, Vaccinia virus
acgacucuccauacgauga

SEQ ID NO: 4056421 - RNA, 22 nt, Vaccinia virus
acgagauuauuauuaacaaagu

SEQ ID NO: 4056422 - RNA, 19 nt, Vaccinia virus
acgauaaaagaugcauaua

SEQ ID NO: 4056423 - RNA, 19 nt, Vaccinia virus
acgauaccaucuucuggaa

SEQ ID NO: 4056424 - RNA, 17 nt, Vaccinia virus
acgauacuaugcauauu

SEQ ID NO: 4056425 - RNA, 21 nt, Vaccinia virus
acgauauuaucgacuaugaau

SEQ ID NO: 4056426 - RNA, 18 nt, Vaccinia virus
acgauauuuguuggauuc

SEQ ID NO: 4056427 - RNA, 21 nt, Vaccinia virus
acgaugauauuaaaauuauuu

SEQ ID NO: 4056428 - RNA, 19 nt, Vaccinia virus
acgauggcaagaaauggau

SEQ ID NO: 4056429 - RNA, 17 nt, Vaccinia virus
acgauuaccaauacuuu

SEQ ID NO: 4056430 - RNA, 15 nt, Vaccinia virus
acgauucaggaaucg

SEQ ID NO: 4056431 - RNA, 18 nt, Vaccinia virus
acgauuucugaauuauuu

SEQ ID NO: 4056432 - RNA, 22 nt, Vaccinia virus
acgcaauagucagacuguaguu

SEQ ID NO: 4056433 - RNA, 23 nt, Vaccinia virus
acgcacuagagaguuuaucagaa

SEQ ID NO: 4056434 - RNA, 14 nt, Vaccinia virus
acgcauaauuauua

SEQ ID NO: 4056435 - RNA, 17 nt, Vaccinia virus
acgccaauacauguuuu

SEQ ID NO: 4056436 - RNA, 16 nt, Vaccinia virus
acgccgaucucugaau

SEQ ID NO: 4056437 - RNA, 15 nt, Vaccinia virus
acgccgucuuuaucu

SEQ ID NO: 4056438 - RNA, 13 nt, Vaccinia virus
acgcgucuguuuu

SEQ ID NO: 4056439 - RNA, 21 nt, Vaccinia virus
acgcguuuuaugaaugaugau

SEQ ID NO: 4056440 - RNA, 22 nt, Vaccinia virus
caugauccuauucuaaauggau

SEQ ID NO: 4056441 - RNA, 19 nt, Vaccinia virus
caugauggucauguuuauu

SEQ ID NO: 4056442 - RNA, 19 nt, Vaccinia virus
caugauucacguuauauaa

SEQ ID NO: 4056443 - RNA, 17 nt, Vaccinia virus
caugauuccguauucug

SEQ ID NO: 4056444 - RNA, 20 nt, Vaccinia virus
caugcaaagcucuaaaucca

SEQ ID NO: 4056445 - RNA, 18 nt, Vaccinia virus
caugcucuauuuugucau

SEQ ID NO: 4056446 - RNA, 21 nt, Vaccinia virus
cauggaaaagauaaaguuuua

SEQ ID NO: 4056447 - RNA, 15 nt, Vaccinia virus
cauggacauacuaau

SEQ ID NO: 4056448 - RNA, 15 nt, Vaccinia virus
caugggacuauauaa

SEQ ID NO: 4056449 - RNA, 15 nt, Vaccinia virus
cauggucuagaugua

SEQ ID NO: 4056450 - RNA, 14 nt, Vaccinia virus
cauggugauacuug

SEQ ID NO: 4056451 - RNA, 20 nt, Vaccinia virus
cauguaacacucgacacaau

SEQ ID NO: 4056452 - RNA, 13 nt, Vaccinia virus
cauguauccacuu

SEQ ID NO: 4056453 - RNA, 15 nt, Vaccinia virus
caugucaacaaaaau

SEQ ID NO: 4056454 - RNA, 20 nt, Vaccinia virus
caugugaauauaauaauaca

SEQ ID NO: 4056455 - RNA, 16 nt, Vaccinia virus
cauguucgaaaaagug

SEQ ID NO: 4056456 - RNA, 14 nt, Vaccinia virus
cauuaaauguauuu

SEQ ID NO: 4056457 - RNA, 22 nt, Vaccinia virus
cauuaacgauaucuugcaaaau

SEQ ID NO: 4056458 - RNA, 23 nt, Vaccinia virus
cauuaaguucacuagaauaucca

SEQ ID NO: 4056459 - RNA, 15 nt, Vaccinia virus
cauuaauacaguaag

SEQ ID NO: 4056460 - RNA, 16 nt, Vaccinia virus
cauuaauggcaauaac

SEQ ID NO: 4056461 - RNA, 18 nt, Vaccinia virus
cauuacaaagaagaacug

SEQ ID NO: 4056462 - RNA, 17 nt, Vaccinia virus
cauuacuaauacucaau

SEQ ID NO: 4056463 - RNA, 23 nt, Vaccinia virus
cauuaguuaaugaaaauaacucu

SEQ ID NO: 4056464 - RNA, 17 nt, Vaccinia virus
cauuaucuauaucaucu

SEQ ID NO: 4056465 - RNA, 14 nt, Vaccinia virus
cauuaucuuuguuu

SEQ ID NO: 4056466 - RNA, 18 nt, Vaccinia virus
cauuauucuauuucgaau

SEQ ID NO: 4056467 - RNA, 18 nt, Vaccinia virus
cauuauuuuuauauuuuc

SEQ ID NO: 4056468 - RNA, 17 nt, Vaccinia virus
cauucaaccauucauaa

SEQ ID NO: 4056469 - RNA, 13 nt, Vaccinia virus
cauucacaaaaag

SEQ ID NO: 4056470 - RNA, 20 nt, Vaccinia virus
cauuccaagucacugugugu

SEQ ID NO: 4056471 - RNA, 19 nt, Vaccinia virus
cauucuaauauauguauuu

SEQ ID NO: 4056472 - RNA, 20 nt, Vaccinia virus
cauucuacguccuauggaug

SEQ ID NO: 4056473 - RNA, 23 nt, Vaccinia virus
cauucuauuaaugucuacucuau

SEQ ID NO: 4056474 - RNA, 17 nt, Vaccinia virus
cauucuucccauggaug

SEQ ID NO: 4056475 - RNA, 22 nt, Vaccinia virus
cauucuucggauccaaaugcug

SEQ ID NO: 4056476 - RNA, 21 nt, Vaccinia virus
cauugauaaagaaguuauaga

SEQ ID NO: 4056477 - RNA, 17 nt, Vaccinia virus
cauugauaucuuuagau

SEQ ID NO: 4056478 - RNA, 20 nt, Vaccinia virus
cauugauugccauaauaauu

SEQ ID NO: 4056479 - RNA, 13 nt, Vaccinia virus
cauuguaaagccc

SEQ ID NO: 4056480 - RNA, 22 nt, Vaccinia virus
cauuguccagauugaacauaca

SEQ ID NO: 4056481 - RNA, 14 nt, Vaccinia virus
cauugucuuauaga

SEQ ID NO: 4056482 - RNA, 15 nt, Vaccinia virus
cauuguuauguauuu

SEQ ID NO: 4056483 - RNA, 16 nt, Vaccinia virus
cauuguuuguauucuc

SEQ ID NO: 4056484 - RNA, 14 nt, Vaccinia virus
cauuuaaaugaauc

SEQ ID NO: 4056485 - RNA, 14 nt, Vaccinia virus
cauuuauacacaau

SEQ ID NO: 4056486 - RNA, 14 nt, Vaccinia virus
cauuuauaucauuu

SEQ ID NO: 4056487 - RNA, 18 nt, Vaccinia virus
cauuuauaucauuuguuu

SEQ ID NO: 4056488 - RNA, 17 nt, Vaccinia virus
cauuuauaucuuuagcu

SEQ ID NO: 4056489 - RNA, 16 nt, Vaccinia virus
cauuuaucacaaaaaa

SEQ ID NO: 4056490 - RNA, 21 nt, Vaccinia virus
cauuuaucacaaaaaaaacuu

SEQ ID NO: 4056491 - RNA, 22 nt, Vaccinia virus
cauuuauuggagacguaacaau

SEQ ID NO: 4056492 - RNA, 21 nt, Vaccinia virus
cauuuccaaaucuaacuucua

SEQ ID NO: 4056493 - RNA, 14 nt, Vaccinia virus
cauuuccuacauau

SEQ ID NO: 4056494 - RNA, 23 nt, Vaccinia virus
cauuucuaauacaugacaauaaa

SEQ ID NO: 4056495 - RNA, 10 nt, Vaccinia virus
cauuugagaa

SEQ ID NO: 4056496 - RNA, 18 nt, Vaccinia virus
cauuuggucuauacaaau

SEQ ID NO: 4056497 - RNA, 13 nt, Vaccinia virus
cauuuuacauuau

SEQ ID NO: 4056498 - RNA, 19 nt, Vaccinia virus
cauuuuauaaauauauaau

SEQ ID NO: 4056499 - RNA, 16 nt, Vaccinia virus
cauuuuauuguggaau

SEQ ID NO: 4056500 - RNA, 13 nt, Vaccinia virus
cauuuuauuucua

SEQ ID NO: 4056501 - RNA, 17 nt, Vaccinia virus
cauuuucacaaauacua

SEQ ID NO: 4056502 - RNA, 20 nt, Vaccinia virus
cauuuucccaaauaucuuua

SEQ ID NO: 4056503 - RNA, 19 nt, Vaccinia virus
cauuuucucuuucucucuu

SEQ ID NO: 4056504 - RNA, 17 nt, Vaccinia virus
cauuuuuuaaguauuug

SEQ ID NO: 4056505 - RNA, 12 nt, Vaccinia virus
ccaaaaaaauuc

SEQ ID NO: 4056506 - RNA, 23 nt, Vaccinia virus
ccaaaaaguguuuggcaauaaag

SEQ ID NO: 4056507 - RNA, 15 nt, Vaccinia virus
ccaaaaauauccaua

SEQ ID NO: 4056508 - RNA, 23 nt, Vaccinia virus
ccaaaaauuuuuaaaguauaucu

SEQ ID NO: 4056509 - RNA, 12 nt, Vaccinia virus
ccaaaacaaaau

SEQ ID NO: 4056510 - RNA, 11 nt, Vaccinia virus
ccaaaaugaau

SEQ ID NO: 4056511 - RNA, 21 nt, Vaccinia virus
ccaaacucagaaccaaaugau

SEQ ID NO: 4056512 - RNA, 15 nt, Vaccinia virus
ccaaaggauguuuaa

SEQ ID NO: 4056513 - RNA, 19 nt, Vaccinia virus
ccaaaugcugucugcgaaa

SEQ ID NO: 4056514 - RNA, 14 nt, Vaccinia virus
ccaacaauuguuua

SEQ ID NO: 4056515 - RNA, 22 nt, Vaccinia virus
ccaaccgaauggaguaaaauaa

SEQ ID NO: 4056516 - RNA, 21 nt, Vaccinia virus
ccaacggcggacguaguucua

SEQ ID NO: 4056517 - RNA, 16 nt, Vaccinia virus
ccaacucuuuaauaaa

SEQ ID NO: 4056518 - RNA, 20 nt, Vaccinia virus
ccaagaaaauagaaauucgu

SEQ ID NO: 4056519 - RNA, 14 nt, Vaccinia virus
ccaagauaucuaua

SEQ ID NO: 4056520 - RNA, 21 nt, Vaccinia virus
ccaagucauaucuagaaugaa

SEQ ID NO: 4056521 - RNA, 15 nt, Vaccinia virus
ccaaguuaaauuuua

SEQ ID NO: 4056522 - RNA, 15 nt, Vaccinia virus
ccaauacauguuuua

SEQ ID NO: 4056523 - RNA, 17 nt, Vaccinia virus
ccaaucuaagaaauuua

SEQ ID NO: 4056524 - RNA, 14 nt, Vaccinia virus
ccaaugaaauggua

SEQ ID NO: 4056525 - RNA, 15 nt, Vaccinia virus
ccaaugcuucucugu

SEQ ID NO: 4056526 - RNA, 14 nt, Vaccinia virus
ccaauuguuugaua

SEQ ID NO: 4056527 - RNA, 14 nt, Vaccinia virus
ccacaauacgcaug

SEQ ID NO: 4056528 - RNA, 18 nt, Vaccinia virus
ccacaauuagguauuuua

SEQ ID NO: 4056529 - RNA, 16 nt, Vaccinia virus
ccacguuuaaacauuc

SEQ ID NO: 4056530 - RNA, 17 nt, Vaccinia virus
ccacugaugagauguua

SEQ ID NO: 4056531 - RNA, 16 nt, Vaccinia virus
ccacuuugguaaaauc

SEQ ID NO: 4056532 - RNA, 15 nt, Vaccinia virus
ccagaacuauuuuua

SEQ ID NO: 4056533 - RNA, 19 nt, Vaccinia virus
ccagaguguucgaaugcca

SEQ ID NO: 4056534 - RNA, 22 nt, Vaccinia virus
ccagauggaguggaagacacug

SEQ ID NO: 4056535 - RNA, 17 nt, Vaccinia virus
ccagcguguccccagga

SEQ ID NO: 4056536 - RNA, 22 nt, Vaccinia virus
ccaguaaaugacgcguuuccua

SEQ ID NO: 4056537 - RNA, 12 nt, Vaccinia virus
ccaguauucucg

SEQ ID NO: 4056538 - RNA, 14 nt, Vaccinia virus
ccagugcauuucua

SEQ ID NO: 4056539 - RNA, 19 nt, Vaccinia virus
ccauagcuaucaagucuuu

SEQ ID NO: 4056540 - RNA, 17 nt, Vaccinia virus
ccauauauccaauaaag

SEQ ID NO: 4056541 - RNA, 20 nt, Vaccinia virus
ccaucagaauguuucccuga

SEQ ID NO: 4056542 - RNA, 15 nt, Vaccinia virus
ccaucauccaagaaa

SEQ ID NO: 4056543 - RNA, 14 nt, Vaccinia virus
ccaucauuucucaa

SEQ ID NO: 4056544 - RNA, 19 nt, Vaccinia virus
ccaucuaauaaauaucaua

SEQ ID NO: 4056545 - RNA, 15 nt, Vaccinia virus
ccaugaaagaaagaa

SEQ ID NO: 4056546 - RNA, 18 nt, Vaccinia virus
ccaugauggucauguuua

SEQ ID NO: 4056547 - RNA, 22 nt, Vaccinia virus
ccaugucugaaacgagacgcua

SEQ ID NO: 4056548 - RNA, 12 nt, Vaccinia virus
ccauuuaaauau

SEQ ID NO: 4056549 - RNA, 22 nt, Vaccinia virus
ccauuuaucauggaaaagaauu

SEQ ID NO: 4056550 - RNA, 16 nt, Vaccinia virus
ccauuuuaaaaucauu

SEQ ID NO: 4056551 - RNA, 14 nt, Vaccinia virus
cccaagauuucauc

SEQ ID NO: 4056552 - RNA, 20 nt, Vaccinia virus
cccaaucuuguuauaaacac

SEQ ID NO: 4056553 - RNA, 20 nt, Vaccinia virus
ccgaauuuguuuuguuuauu

SEQ ID NO: 4056554 - RNA, 19 nt, Vaccinia virus
ccgauaaacuccaauaaaa

SEQ ID NO: 4056555 - RNA, 20 nt, Vaccinia virus
ccgauauagauauuaaacaa

SEQ ID NO: 4056556 - RNA, 14 nt, Vaccinia virus
ccgaucaacaaaag

SEQ ID NO: 4056557 - RNA, 22 nt, Vaccinia virus
ccgccuuaaauguaucuuuacu

SEQ ID NO: 4056558 - RNA, 19 nt, Vaccinia virus
ccguacaacauacuguuua

SEQ ID NO: 4056559 - RNA, 19 nt, Vaccinia virus
ccgucaagagaguuaucug

SEQ ID NO: 4056560 - RNA, 15 nt, Vaccinia virus
ccgucacauacacua

SEQ ID NO: 4056561 - RNA, 16 nt, Vaccinia virus
ccuaaagccguaauug

SEQ ID NO: 4056562 - RNA, 14 nt, Vaccinia virus
ccuaaagguaaaug

SEQ ID NO: 4056563 - RNA, 14 nt, Vaccinia virus
ccuaaauuuuguug

SEQ ID NO: 4056564 - RNA, 20 nt, Vaccinia virus
uaaauguaucgugucucauu

SEQ ID NO: 4056565 - RNA, 23 nt, Vaccinia virus
uaaauguauuuuuuaugauauac

SEQ ID NO: 4056566 - RNA, 18 nt, Vaccinia virus
uaaauguccacuauacau

SEQ ID NO: 4056567 - RNA, 20 nt, Vaccinia virus
uaaauguggcuacaaacuuu

SEQ ID NO: 4056568 - RNA, 22 nt, Vaccinia virus
uaaauguuuugauuucaauuua

SEQ ID NO: 4056569 - RNA, 11 nt, Vaccinia virus
uaaauuagaag

SEQ ID NO: 4056570 - RNA, 20 nt, Vaccinia virus
uaaauuauuuaauaaaguau

SEQ ID NO: 4056571 - RNA, 15 nt, Vaccinia virus
uaaauuuauaauguu

SEQ ID NO: 4056572 - RNA, 13 nt, Vaccinia virus
uaaauuuauucuc

SEQ ID NO: 4056573 - RNA, 16 nt, Vaccinia virus
uaaauuuuacaaaucu

SEQ ID NO: 4056574 - RNA, 17 nt, Vaccinia virus
uaacaaaaauuaugaaa

SEQ ID NO: 4056575 - RNA, 18 nt, Vaccinia virus
uaacaaaaauuaugaaau

SEQ ID NO: 4056576 - RNA, 19 nt, Vaccinia virus
uaacaaaauccaaacauua

SEQ ID NO: 4056577 - RNA, 20 nt, Vaccinia virus
uaacaaagauauuaccaguu

SEQ ID NO: 4056578 - RNA, 16 nt, Vaccinia virus
uaacaacgacuuauaa

SEQ ID NO: 4056579 - RNA, 13 nt, Vaccinia virus
uaacaacuuauac

SEQ ID NO: 4056580 - RNA, 17 nt, Vaccinia virus
uaacaauaucaauaaau

SEQ ID NO: 4056581 - RNA, 15 nt, Vaccinia virus
uaacaauuucuauaa

SEQ ID NO: 4056582 - RNA, 12 nt, Vaccinia virus
uaacacaaccaa

SEQ ID NO: 4056583 - RNA, 20 nt, Vaccinia virus
uaacacuacucacaauagaa

SEQ ID NO: 4056584 - RNA, 23 nt, Vaccinia virus
uaacagccuguucaaauuuauau

SEQ ID NO: 4056585 - RNA, 15 nt, Vaccinia virus
uaacagcuuccguaa

SEQ ID NO: 4056586 - RNA, 16 nt, Vaccinia virus
uaacaguaacuuguau

SEQ ID NO: 4056587 - RNA, 16 nt, Vaccinia virus
uaacaguauuauuaau

SEQ ID NO: 4056588 - RNA, 19 nt, Vaccinia virus
uaacaguccgguucuuaau

SEQ ID NO: 4056589 - RNA, 15 nt, Vaccinia virus
uaacagucgaacaau

SEQ ID NO: 4056590 - RNA, 17 nt, Vaccinia virus
uaacauaaaaacucauu

SEQ ID NO: 4056591 - RNA, 18 nt, Vaccinia virus
uaacauaaaaauaucauu

SEQ ID NO: 4056592 - RNA, 18 nt, Vaccinia virus
uaacaucagaaaauguaa

SEQ ID NO: 4056593 - RNA, 16 nt, Vaccinia virus
uaacaucuugauuaau

SEQ ID NO: 4056594 - RNA, 20 nt, Vaccinia virus
uaacaucuuuguaaacagau

SEQ ID NO: 4056595 - RNA, 22 nt, Vaccinia virus
uaacaucuuuguaaacagauau

SEQ ID NO: 4056596 - RNA, 21 nt, Vaccinia virus
uaacaugacauuuauucauca

SEQ ID NO: 4056597 - RNA, 22 nt, Vaccinia virus
uaacaugacauuuauucaucau

SEQ ID NO: 4056598 - RNA, 23 nt, Vaccinia virus
uaacauuguuaauugaaaaggga

SEQ ID NO: 4056599 - RNA, 17 nt, Vaccinia virus
uaaccaccucucuggaa

SEQ ID NO: 4056600 - RNA, 18 nt, Vaccinia virus
uaacccauuauaaaacuu

SEQ ID NO: 4056601 - RNA, 16 nt, Vaccinia virus
uaacgaggaagaaauu

SEQ ID NO: 4056602 - RNA, 16 nt, Vaccinia virus
uaacgaugaaaaccag

SEQ ID NO: 4056603 - RNA, 14 nt, Vaccinia virus
uaacgcaacuauau

SEQ ID NO: 4056604 - RNA, 18 nt, Vaccinia virus
uaacgccgaucucugaau

SEQ ID NO: 4056605 - RNA, 22 nt, Vaccinia virus
uaacgccuauacuauguuauau

SEQ ID NO: 4056606 - RNA, 20 nt, Vaccinia virus
uaacguauucgauacauuuu

SEQ ID NO: 4056607 - RNA, 13 nt, Vaccinia virus
uaacgucauuaaa

SEQ ID NO: 4056608 - RNA, 16 nt, Vaccinia virus
uaacuauuuagcaaaa

SEQ ID NO: 4056609 - RNA, 18 nt, Vaccinia virus
uaacucaaagacaucaua

SEQ ID NO: 4056610 - RNA, 21 nt, Vaccinia virus
uaacucucucauuuucuuuaa

SEQ ID NO: 4056611 - RNA, 19 nt, Vaccinia virus
uaacucucuggaugcuaug

SEQ ID NO: 4056612 - RNA, 15 nt, Vaccinia virus
uaacuuggaaaagau

SEQ ID NO: 4056613 - RNA, 20 nt, Vaccinia virus
uaagaaauuuagcaacgaua

SEQ ID NO: 4056614 - RNA, 14 nt, Vaccinia virus
uaagaaugugauaa

SEQ ID NO: 4056615 - RNA, 18 nt, Vaccinia virus
uaagagacgggaaaauag

SEQ ID NO: 4056616 - RNA, 15 nt, Vaccinia virus
uaagauuaucaaaau

SEQ ID NO: 4056617 - RNA, 20 nt, Vaccinia virus
uaagauuaucaaaaucuugu

SEQ ID NO: 4056618 - RNA, 12 nt, Vaccinia virus
uaagcauugucu

SEQ ID NO: 4056619 - RNA, 15 nt, Vaccinia virus
uaagcuguucaaaau

SEQ ID NO: 4056620 - RNA, 18 nt, Vaccinia virus
uaaguacccuuauauuca

SEQ ID NO: 4056621 - RNA, 23 nt, Vaccinia virus
uaaguagagauucggguacugua

SEQ ID NO: 4056622 - RNA, 18 nt, Vaccinia virus
uaaguaguuuaucaacau

SEQ ID NO: 4056623 - RNA, 12 nt, Vaccinia virus
uaaguauccauu

SEQ ID NO: 4056624 - RNA, 17 nt, Vaccinia virus
uaaguaugaugucuaug

SEQ ID NO: 4056625 - RNA, 19 nt, Vaccinia virus
uaaguauucacaaacggga

SEQ ID NO: 4056626 - RNA, 22 nt, Vaccinia virus
uaaguauuuggcuagucaagau

SEQ ID NO: 4056627 - RNA, 14 nt, Vaccinia virus
uaagucuauuugaa

SEQ ID NO: 4056628 - RNA, 16 nt, Vaccinia virus
uaagucuguggaggau

SEQ ID NO: 4056629 - RNA, 22 nt, Vaccinia virus
uaaguguagcaaauaaaaucua

SEQ ID NO: 4056630 - RNA, 21 nt, Vaccinia virus
uaaguuacagcgacacgguau

SEQ ID NO: 4056631 - RNA, 13 nt, Vaccinia virus
uaaguucuuuaua

SEQ ID NO: 4056632 - RNA, 20 nt, Vaccinia virus
uaaguuuauaaauuccacaa

SEQ ID NO: 4056633 - RNA, 22 nt, Vaccinia virus
uaauaaacauuccacauucaga

SEQ ID NO: 4056634 - RNA, 13 nt, Vaccinia virus
uaauaaagacuuc

SEQ ID NO: 4056635 - RNA, 23 nt, Vaccinia virus
uaauaaaggugguaguauuguca

SEQ ID NO: 4056636 - RNA, 12 nt, Vaccinia virus
uaauaaauuaga

SEQ ID NO: 4056637 - RNA, 16 nt, Vaccinia virus
uaauaaauugguaaau

SEQ ID NO: 4056638 - RNA, 13 nt, Vaccinia virus
uaauaagaauaaa

SEQ ID NO: 4056639 - RNA, 14 nt, Vaccinia virus
uaauaagaauaaag

SEQ ID NO: 4056640 - RNA, 13 nt, Vaccinia virus
uaauaagauaaau

SEQ ID NO: 4056641 - RNA, 15 nt, Vaccinia virus
uaauaauaauucauc

SEQ ID NO: 4056642 - RNA, 19 nt, Vaccinia virus
uaauaaugauucaacaaug

SEQ ID NO: 4056643 - RNA, 14 nt, Vaccinia virus
uaauaauuauauca

SEQ ID NO: 4056644 - RNA, 12 nt, Vaccinia virus
uaauaauuguau

SEQ ID NO: 4056645 - RNA, 14 nt, Vaccinia virus
uaauacacacaaag

SEQ ID NO: 4056646 - RNA, 15 nt, Vaccinia virus
uaauacacacaaagu

SEQ ID NO: 4056647 - RNA, 20 nt, Vaccinia virus
uaauacagcaucuaacuuga

SEQ ID NO: 4056648 - RNA, 21 nt, Vaccinia virus
uaauagcaacauaugaagaac

SEQ ID NO: 4056649 - RNA, 23 nt, Vaccinia virus
uaauagcagaaagcuauaacuug

SEQ ID NO: 4056650 - RNA, 15 nt, Vaccinia virus
uaauagcaucucguu

SEQ ID NO: 4056651 - RNA, 15 nt, Vaccinia virus
uaauagcgucuacau

SEQ ID NO: 4056652 - RNA, 20 nt, Vaccinia virus
uaauagcguuaacuaucaaa

SEQ ID NO: 4056653 - RNA, 19 nt, Vaccinia virus
uaauagcuccauaaacuga

SEQ ID NO: 4056654 - RNA, 20 nt, Vaccinia virus
uaauagcuccauaaacugau

SEQ ID NO: 4056655 - RNA, 21 nt, Vaccinia virus
uaauagcuccccuguuuucau

SEQ ID NO: 4056656 - RNA, 22 nt, Vaccinia virus
uaauaggagcuagaagaacuuc

SEQ ID NO: 4056657 - RNA, 13 nt, Vaccinia virus
uaauaguaaauga

SEQ ID NO: 4056658 - RNA, 13 nt, Vaccinia virus
uaauaguaggaac

SEQ ID NO: 4056659 - RNA, 14 nt, Vaccinia virus
uaauaguauccauu

SEQ ID NO: 4056660 - RNA, 17 nt, Vaccinia virus
uaauaguguacuacaaa

SEQ ID NO: 4056661 - RNA, 22 nt, Vaccinia virus
uaauauaaaaaaacauuauucu

SEQ ID NO: 4056662 - RNA, 21 nt, Vaccinia virus
uaauauaaaagaauauguaua

SEQ ID NO: 4056663 - RNA, 14 nt, Vaccinia virus
uaauauaaacaucu

SEQ ID NO: 4056664 - RNA, 16 nt, Vaccinia virus
uaauauaaacaucuug

SEQ ID NO: 4056665 - RNA, 18 nt, Vaccinia virus
uaauauacaauuaucauu

SEQ ID NO: 4056666 - RNA, 22 nt, Vaccinia virus
uaauauagggcugacgucguau

SEQ ID NO: 4056667 - RNA, 16 nt, Vaccinia virus
uaauauauaaacucuu

SEQ ID NO: 4056668 - RNA, 15 nt, Vaccinia virus
uaauauaucaaacau

SEQ ID NO: 4056669 - RNA, 18 nt, Vaccinia virus
uaauauauugaucauaau

SEQ ID NO: 4056670 - RNA, 22 nt, Vaccinia virus
uaauaucaaacgguaacacauc

SEQ ID NO: 4056671 - RNA, 21 nt, Vaccinia virus
uaauaucagaccguacauaca

SEQ ID NO: 4056672 - RNA, 22 nt, Vaccinia virus
uaauaucagaccguacauacau

SEQ ID NO: 4056673 - RNA, 13 nt, Vaccinia virus
uaauaucauauag

SEQ ID NO: 4056674 - RNA, 17 nt, Vaccinia virus
uaauauccaaucuuauu

SEQ ID NO: 4056675 - RNA, 19 nt, Vaccinia virus
uaauaucuauauuuccagc

SEQ ID NO: 4056676 - RNA, 15 nt, Vaccinia virus
uaauaucuucuggaa

SEQ ID NO: 4056677 - RNA, 15 nt, Vaccinia virus
uaauauugauacaua

SEQ ID NO: 4056678 - RNA, 20 nt, Vaccinia virus
uaaucaaaauugucuaugau

SEQ ID NO: 4056679 - RNA, 22 nt, Vaccinia virus
uaaucaaauuugguguuguuaa

SEQ ID NO: 4056680 - RNA, 15 nt, Vaccinia virus
uaaucaaggauacac

SEQ ID NO: 4056681 - RNA, 17 nt, Vaccinia virus
uaaucagauucuuauau

SEQ ID NO: 4056682 - RNA, 23 nt, Vaccinia virus
uaaucauauaggcauugauuuuu

SEQ ID NO: 4056683 - RNA, 19 nt, Vaccinia virus
uaaucaugaaaucaaggau

SEQ ID NO: 4056684 - RNA, 16 nt, Vaccinia virus
uaaucauuguccagau

SEQ ID NO: 4056685 - RNA, 15 nt, Vaccinia virus
uaauccuaagaaaac

SEQ ID NO: 4056686 - RNA, 17 nt, Vaccinia virus
uaauccuaagaaaacuc

SEQ ID NO: 4056687 - RNA, 23 nt, Vaccinia virus
uaauccugaauauauugauuuuc

SEQ ID NO: 4056688 - RNA, 18 nt, Vaccinia virus
uaaucuaguagaaaagau

SEQ ID NO: 4056689 - RNA, 17 nt, Vaccinia virus
uaaucucuccagaguau

SEQ ID NO: 4056690 - RNA, 17 nt, Vaccinia virus
uaaucuuguaauauuca

SEQ ID NO: 4056691 - RNA, 15 nt, Vaccinia virus
uaaucuuuguuggau

SEQ ID NO: 4056692 - RNA, 13 nt, Vaccinia virus
uaaugauaaauuu

SEQ ID NO: 4056693 - RNA, 18 nt, Vaccinia virus
uaauggauauucugaaua

SEQ ID NO: 4056694 - RNA, 15 nt, Vaccinia virus
uaauggaucuucuag

SEQ ID NO: 4056695 - RNA, 20 nt, Vaccinia virus
uaaugggucguauugguauu

SEQ ID NO: 4056696 - RNA, 21 nt, Vaccinia virus
uaauguuauauguaacauuga

SEQ ID NO: 4056697 - RNA, 14 nt, Vaccinia virus
uaauuauauuuaca

SEQ ID NO: 4056698 - RNA, 17 nt, Vaccinia virus
uaauucagauacuacag

SEQ ID NO: 4056699 - RNA, 20 nt, Vaccinia virus
uaauucuuuauaacugaacu

SEQ ID NO: 4056700 - RNA, 16 nt, Vaccinia virus
uaauugaguaaaugaa

SEQ ID NO: 4056701 - RNA, 20 nt, Vaccinia virus
uaauuguuauuuuauucaua

SEQ ID NO: 4056702 - RNA, 20 nt, Vaccinia virus
uaauuucuguaaauucauga

SEQ ID NO: 4056703 - RNA, 22 nt, Vaccinia virus
uaauuugaccugauuacauuuu

SEQ ID NO: 4056704 - RNA, 16 nt, Vaccinia virus
uaauuugaguaagaau

SEQ ID NO: 4056705 - RNA, 22 nt, Vaccinia virus
uaauuugauaauaaaucaaaau

SEQ ID NO: 4056706 - RNA, 18 nt, Vaccinia virus
uaauuugguauauacaua

SEQ ID NO: 4056707 - RNA, 16 nt, Vaccinia virus
uaauuuuagaagcuau

SEQ ID NO: 4056708 - RNA, 17 nt, Vaccinia virus
uaauuuuuuuauuacau

SEQ ID NO: 4056709 - RNA, 14 nt, Vaccinia virus
uacaaaaucaucug

SEQ ID NO: 4056710 - RNA, 23 nt, Vaccinia virus
uacaaaauguugauaauccuuga

SEQ ID NO: 4056711 - RNA, 22 nt, Vaccinia virus
uacaaacuuuuccuuuuccaca

SEQ ID NO: 4056712 - RNA, 20 nt, Vaccinia virus
uacaaauguagaagauauca

SEQ ID NO: 4056713 - RNA, 16 nt, Vaccinia virus
uacaacauuccaaaga

SEQ ID NO: 4056714 - RNA, 17 nt, Vaccinia virus
uacaagaaauauuucca

SEQ ID NO: 4056715 - RNA, 13 nt, Vaccinia virus
uacaagaguggaa

SEQ ID NO: 4056716 - RNA, 20 nt, Vaccinia virus
uacaagcucgguuuuaacuu

SEQ ID NO: 4056717 - RNA, 13 nt, Vaccinia virus
uacaauauuuccg

SEQ ID NO: 4056718 - RNA, 21 nt, Vaccinia virus
uacaauccuucguuaucucug

SEQ ID NO: 4056719 - RNA, 16 nt, Vaccinia virus
uacaaucuguauuuca

SEQ ID NO: 4056720 - RNA, 19 nt, Vaccinia virus
uacacaucuaucaagugau

SEQ ID NO: 4056721 - RNA, 23 nt, Vaccinia virus
uacaccaucaauagauaaaacga

SEQ ID NO: 4056722 - RNA, 16 nt, Vaccinia virus
uacaccgcuauguuua

SEQ ID NO: 4056723 - RNA, 13 nt, Vaccinia virus
uacacgaaugauu

SEQ ID NO: 4056724 - RNA, 16 nt, Vaccinia virus
uacacguaccagcauu

SEQ ID NO: 4056725 - RNA, 19 nt, Vaccinia virus
uacagaaggcaaacgcuau

SEQ ID NO: 4056726 - RNA, 18 nt, Vaccinia virus
uacagauguuacaaaugu

SEQ ID NO: 4056727 - RNA, 22 nt, Vaccinia virus
uacagauguuacaaauguagaa

SEQ ID NO: 4056728 - RNA, 19 nt, Vaccinia virus
uacagauugcacuauacau

SEQ ID NO: 4056729 - RNA, 21 nt, Vaccinia virus
uacaguuucuguaaugaugga

SEQ ID NO: 4056730 - RNA, 14 nt, Vaccinia virus
uacauaaaacauca

SEQ ID NO: 4056731 - RNA, 14 nt, Vaccinia virus
uacauaacaucuuu

SEQ ID NO: 4056732 - RNA, 16 nt, Vaccinia virus
uacauaauucuucugu

SEQ ID NO: 4056733 - RNA, 23 nt, Vaccinia virus
uacauacagguacgaaauacgua

SEQ ID NO: 4056734 - RNA, 21 nt, Vaccinia virus
uacauagcaucuucacaaauu

SEQ ID NO: 4056735 - RNA, 14 nt, Vaccinia virus
uacaucaagagagc

SEQ ID NO: 4056736 - RNA, 21 nt, Vaccinia virus
uacaucaugccauuaagaaac

SEQ ID NO: 4056737 - RNA, 19 nt, Vaccinia virus
uacaucccgguuaaacauu

SEQ ID NO: 4056738 - RNA, 19 nt, Vaccinia virus
uacaucgguaucuagaucu

SEQ ID NO: 4056739 - RNA, 21 nt, Vaccinia virus
uacaucgucucaucuguuuaa

SEQ ID NO: 4056740 - RNA, 20 nt, Vaccinia virus
uacaucuacuauauuaacau

SEQ ID NO: 4056741 - RNA, 23 nt, Vaccinia virus
uacauucucauuaauuaaccauu

SEQ ID NO: 4056742 - RNA, 17 nt, Vaccinia virus
uacauugaauauaaaau

SEQ ID NO: 4056743 - RNA, 13 nt, Vaccinia virus
uacauuguauaaa

SEQ ID NO: 4056744 - RNA, 14 nt, Vaccinia virus
uacauuguuucaua

SEQ ID NO: 4056745 - RNA, 14 nt, Vaccinia virus
uacauuucucaaau

SEQ ID NO: 4056746 - RNA, 23 nt, Vaccinia virus
uaccaaacuuucagaagaaaugg

SEQ ID NO: 4056747 - RNA, 13 nt, Vaccinia virus
uaccaaauauuag

SEQ ID NO: 4056748 - RNA, 17 nt, Vaccinia virus
uaccaauacucaagacu

SEQ ID NO: 4056749 - RNA, 22 nt, Vaccinia virus
uaccaauaugucuguacaaaug

SEQ ID NO: 4056750 - RNA, 23 nt, Vaccinia virus
uaccaauaugucuguacaaaugu

SEQ ID NO: 4056751 - RNA, 22 nt, Vaccinia virus
uaccacgcaauuauauaaugua

SEQ ID NO: 4056752 - RNA, 20 nt, Vaccinia virus
uaccacguaaaacuuaaaau

SEQ ID NO: 4056753 - RNA, 18 nt, Vaccinia virus
uaccacuuauuacuccau

SEQ ID NO: 4056754 - RNA, 21 nt, Vaccinia virus
uaccagcauuaguaacagcuu

SEQ ID NO: 4056755 - RNA, 20 nt, Vaccinia virus
uaccauagaagauguuagaa

SEQ ID NO: 4056756 - RNA, 19 nt, Vaccinia virus
uaccauuaaagaauucuua

SEQ ID NO: 4056757 - RNA, 21 nt, Vaccinia virus
uaccauuaauuguuuacugua

SEQ ID NO: 4056758 - RNA, 18 nt, Vaccinia virus
uaccauuagauaaucuag

SEQ ID NO: 4056759 - RNA, 15 nt, Vaccinia virus
uaccauuucauugau

SEQ ID NO: 4056760 - RNA, 17 nt, Vaccinia virus
uaccauuuuaaaaucau

SEQ ID NO: 4056761 - RNA, 16 nt, Vaccinia virus
uacccaaaucugaaaa

SEQ ID NO: 4056762 - RNA, 15 nt, Vaccinia virus
uacccaccuguaaua

SEQ ID NO: 4056763 - RNA, 16 nt, Vaccinia virus
uaccgaacaggcauuu

SEQ ID NO: 4056764 - RNA, 21 nt, Vaccinia virus
uaccgauuuaucaucauacac

SEQ ID NO: 4056765 - RNA, 21 nt, Vaccinia virus
uaccucucggcgaaauaguua

SEQ ID NO: 4056766 - RNA, 15 nt, Vaccinia virus
uaccucucuuaaaau

SEQ ID NO: 4056767 - RNA, 13 nt, Vaccinia virus
uaccuuaaucaug

SEQ ID NO: 4056768 - RNA, 16 nt, Vaccinia virus
uacgaacaauaucuua

SEQ ID NO: 4056769 - RNA, 14 nt, Vaccinia virus
uacgagaaaaucaa

SEQ ID NO: 4056770 - RNA, 15 nt, Vaccinia virus
uacgauuuucuucuu

SEQ ID NO: 4056771 - RNA, 18 nt, Vaccinia virus
uacgauuuucuucuuuga

SEQ ID NO: 4056772 - RNA, 22 nt, Vaccinia virus
uacgcaauaugaucacaaagaa

SEQ ID NO: 4056773 - RNA, 19 nt, Vaccinia virus
uacgcauguuuuaaugcau

SEQ ID NO: 4056774 - RNA, 23 nt, Vaccinia virus
uacgcauuuucaaaauacauguc

SEQ ID NO: 4056775 - RNA, 21 nt, Vaccinia virus
uacgcuauuaaucuuuaaaau

SEQ ID NO: 4056776 - RNA, 14 nt, Vaccinia virus
uacggaaagaacca

SEQ ID NO: 4056777 - RNA, 20 nt, Vaccinia virus
uacgguuccaccgacucauu

SEQ ID NO: 4056778 - RNA, 17 nt, Vaccinia virus
uacguaauaaaaguaau

SEQ ID NO: 4056779 - RNA, 23 nt, Vaccinia virus
uacguauaacuuucuucugcaaa

SEQ ID NO: 4056780 - RNA, 15 nt, Vaccinia virus
uacguauauuuagau

SEQ ID NO: 4056781 - RNA, 15 nt, Vaccinia virus
uacgucaucaaaaau

SEQ ID NO: 4056782 - RNA, 21 nt, Vaccinia virus
uacguucggagacaauaaagc

SEQ ID NO: 4056783 - RNA, 13 nt, Vaccinia virus
uacuaaaaaaugu

SEQ ID NO: 4056784 - RNA, 15 nt, Vaccinia virus
uacuaaagaaacugu

SEQ ID NO: 4056785 - RNA, 16 nt, Vaccinia virus
uacuaaagucaucaau

SEQ ID NO: 4056786 - RNA, 19 nt, Vaccinia virus
uacuaaauucgauaucuuu

SEQ ID NO: 4056787 - RNA, 18 nt, Vaccinia virus
uacuaacguauaauucuu

SEQ ID NO: 4056788 - RNA, 18 nt, Vaccinia virus
uacuaaugacaauaauua

SEQ ID NO: 4056789 - RNA, 19 nt, Vaccinia virus
uacuaaugguaucaagaag

SEQ ID NO: 4056790 - RNA, 18 nt, Vaccinia virus
uacuaauuacaaaccugu

SEQ ID NO: 4056791 - RNA, 23 nt, Vaccinia virus
uacuaccugcuguuguuuauuca

SEQ ID NO: 4056792 - RNA, 15 nt, Vaccinia virus
uacuacuauuauuga

SEQ ID NO: 4056793 - RNA, 23 nt, Vaccinia virus
uacuacuggucuuucucaaccau

SEQ ID NO: 4056794 - RNA, 16 nt, Vaccinia virus
uacuaguuuucuaagu

SEQ ID NO: 4056795 - RNA, 22 nt, Vaccinia virus
uacuauauuaacaucuaaacau

SEQ ID NO: 4056796 - RNA, 14 nt, Vaccinia virus
uacuaucaauauua

SEQ ID NO: 4056797 - RNA, 17 nt, Vaccinia virus
uacuaugccaaaugaau

SEQ ID NO: 4056798 - RNA, 14 nt, Vaccinia virus
uacucaaauagcac

SEQ ID NO: 4056799 - RNA, 15 nt, Vaccinia virus
uacucagaggauuac

SEQ ID NO: 4056800 - RNA, 19 nt, Vaccinia virus
uacucggccgacauaaugu

SEQ ID NO: 4056801 - RNA, 16 nt, Vaccinia virus
uacucguuaguuugga

SEQ ID NO: 4056802 - RNA, 17 nt, Vaccinia virus
uacucuauaaaauacua

SEQ ID NO: 4056803 - RNA, 23 nt, Vaccinia virus
uacucuaugaauggauacuugua

SEQ ID NO: 4056804 - RNA, 22 nt, Vaccinia virus
uacucuucaaaguuucugaaau

SEQ ID NO: 4056805 - RNA, 20 nt, Vaccinia virus
uacucuuggucuaauacuga

SEQ ID NO: 4056806 - RNA, 18 nt, Vaccinia virus
uacugagccaacaaauau

SEQ ID NO: 4056807 - RNA, 24 nt, Vaccinia virus
uacugauaaagaagaagaucauac

SEQ ID NO: 4056808 - RNA, 24 nt, Vaccinia virus
uacugauaauguagaagaucauac

SEQ ID NO: 4056809 - RNA, 13 nt, Vaccinia virus
uacugcaauaaaa

SEQ ID NO: 4056810 - RNA, 14 nt, Vaccinia virus
uauccauuggaaaa

SEQ ID NO: 4056811 - RNA, 17 nt, Vaccinia virus
uauccuaucauguauuu

SEQ ID NO: 4056812 - RNA, 22 nt, Vaccinia virus
uauccucagacucugauuugaa

SEQ ID NO: 4056813 - RNA, 16 nt, Vaccinia virus
uauccucguucuaauu

SEQ ID NO: 4056814 - RNA, 15 nt, Vaccinia virus
uauccugcucugaua

SEQ ID NO: 4056815 - RNA, 20 nt, Vaccinia virus
uauccuugauuauguuuuau

SEQ ID NO: 4056816 - RNA, 19 nt, Vaccinia virus
uauccuuuaccaccaaaua

SEQ ID NO: 4056817 - RNA, 18 nt, Vaccinia virus
uaucgauuucuacauaua

SEQ ID NO: 4056818 - RNA, 18 nt, Vaccinia virus
uaucgcuaaaauuuucau

SEQ ID NO: 4056819 - RNA, 13 nt, Vaccinia virus
uaucgugucucau

SEQ ID NO: 4056820 - RNA, 12 nt, Vaccinia virus
uaucguuuucau

SEQ ID NO: 4056821 - RNA, 15 nt, Vaccinia virus
uaucuaaaaaucuua

SEQ ID NO: 4056822 - RNA, 17 nt, Vaccinia virus
uaucuaacaaauuuccu

SEQ ID NO: 4056823 - RNA, 14 nt, Vaccinia virus
uaucuaacaucuug

SEQ ID NO: 4056824 - RNA, 18 nt, Vaccinia virus
uaucuaauuucuguauau

SEQ ID NO: 4056825 - RNA, 13 nt, Vaccinia virus
uaucuacacaugu

SEQ ID NO: 4056826 - RNA, 14 nt, Vaccinia virus
uaucuaccagagau

SEQ ID NO: 4056827 - RNA, 18 nt, Vaccinia virus
uaucuacgauccaucaaa

SEQ ID NO: 4056828 - RNA, 22 nt, Vaccinia virus
uaucuacgauuuuuacaaaagu

SEQ ID NO: 4056829 - RNA, 14 nt, Vaccinia virus
uaucuacuagauag

SEQ ID NO: 4056830 - RNA, 20 nt, Vaccinia virus
uaucuagauaacaacgacuu

SEQ ID NO: 4056831 - RNA, 17 nt, Vaccinia virus
uaucuauauguuuugau

SEQ ID NO: 4056832 - RNA, 15 nt, Vaccinia virus
uaucuauguuaucau

SEQ ID NO: 4056833 - RNA, 22 nt, Vaccinia virus
uaucucaucgcaguauauauca

SEQ ID NO: 4056834 - RNA, 18 nt, Vaccinia virus
uaucucauucaaauccau

SEQ ID NO: 4056835 - RNA, 19 nt, Vaccinia virus
uaucuccaguauuuacauu

SEQ ID NO: 4056836 - RNA, 23 nt, Vaccinia virus
uaucucgcauccauauguuugga

SEQ ID NO: 4056837 - RNA, 18 nt, Vaccinia virus
uaucucuauuaaaugcgu

SEQ ID NO: 4056838 - RNA, 10 nt, Vaccinia virus
uaucucuuuc

SEQ ID NO: 4056839 - RNA, 24 nt, Vaccinia virus
uaucugaguaugaugauuuacaaa

SEQ ID NO: 4056840 - RNA, 16 nt, Vaccinia virus
uaucugcggaagagac

SEQ ID NO: 4056841 - RNA, 14 nt, Vaccinia virus
uaucuguuaccaua

SEQ ID NO: 4056842 - RNA, 18 nt, Vaccinia virus
uaucuuaaauaacucauu

SEQ ID NO: 4056843 - RNA, 20 nt, Vaccinia virus
uaucuuauauacacauaauu

SEQ ID NO: 4056844 - RNA, 18 nt, Vaccinia virus
uaucuucauagaauacua

SEQ ID NO: 4056845 - RNA, 12 nt, Vaccinia virus
uaucuucucaaa

SEQ ID NO: 4056846 - RNA, 20 nt, Vaccinia virus
uaucuuuaguaguguuuccc

SEQ ID NO: 4056847 - RNA, 15 nt, Vaccinia virus
uaugaagauaaacac

SEQ ID NO: 4056848 - RNA, 16 nt, Vaccinia virus
uaugaagauaaacacu

SEQ ID NO: 4056849 - RNA, 18 nt, Vaccinia virus
uaugaccgguuuaauguu

SEQ ID NO: 4056850 - RNA, 19 nt, Vaccinia virus
uaugacgcaguaacauaua

SEQ ID NO: 4056851 - RNA, 15 nt, Vaccinia virus
uaugacuaaagcuau

SEQ ID NO: 4056852 - RNA, 18 nt, Vaccinia virus
uaugagaucgucguacau

SEQ ID NO: 4056853 - RNA, 14 nt, Vaccinia virus
uaugaguucuucuu

SEQ ID NO: 4056854 - RNA, 18 nt, Vaccinia virus
uaugauagaaauuagcaa

SEQ ID NO: 4056855 - RNA, 17 nt, Vaccinia virus
uaugauaguuuuaacau

SEQ ID NO: 4056856 - RNA, 14 nt, Vaccinia virus
uaugauauauacac

SEQ ID NO: 4056857 - RNA, 16 nt, Vaccinia virus
uaugaucuugauuuau

SEQ ID NO: 4056858 - RNA, 15 nt, Vaccinia virus
uaugaugcaaagaug

SEQ ID NO: 4056859 - RNA, 18 nt, Vaccinia virus
uaugcaaccguaucaaaa

SEQ ID NO: 4056860 - RNA, 15 nt, Vaccinia virus
uaugcgagacauaua

SEQ ID NO: 4056861 - RNA, 14 nt, Vaccinia virus
uaugcgcaauauca

SEQ ID NO: 4056862 - RNA, 16 nt, Vaccinia virus
uaugcgggaauuaaug

SEQ ID NO: 4056863 - RNA, 13 nt, Vaccinia virus
uauggaaaacuaa

SEQ ID NO: 4056864 - RNA, 13 nt, Vaccinia virus
uauggaaucugua

SEQ ID NO: 4056865 - RNA, 23 nt, Vaccinia virus
uauggacgacgguaagaaugaag

SEQ ID NO: 4056866 - RNA, 14 nt, Vaccinia virus
uauggagcaaacau

SEQ ID NO: 4056867 - RNA, 22 nt, Vaccinia virus
uauggagcgaguguuacaacau

SEQ ID NO: 4056868 - RNA, 21 nt, Vaccinia virus
uauggauuuuuuuaaaaagga

SEQ ID NO: 4056869 - RNA, 15 nt, Vaccinia virus
uaugguauucuucua

SEQ ID NO: 4056870 - RNA, 16 nt, Vaccinia virus
uauguaaaacaaacuu

SEQ ID NO: 4056871 - RNA, 22 nt, Vaccinia virus
uauguaaaacaaacuuguaauu

SEQ ID NO: 4056872 - RNA, 19 nt, Vaccinia virus
uauguaccgcguuaucauc

SEQ ID NO: 4056873 - RNA, 17 nt, Vaccinia virus
uaugucaaaaauuguag

SEQ ID NO: 4056874 - RNA, 22 nt, Vaccinia virus
uaugucauaaacuguaaaugau

SEQ ID NO: 4056875 - RNA, 21 nt, Vaccinia virus
uauguccauuaaaguuaaauu

SEQ ID NO: 4056876 - RNA, 21 nt, Vaccinia virus
uaugucguccgguaguauaau

SEQ ID NO: 4056877 - RNA, 20 nt, Vaccinia virus
uaugucgucuacuggaugaa

SEQ ID NO: 4056878 - RNA, 18 nt, Vaccinia virus
uaugucuguacaaauguu

SEQ ID NO: 4056879 - RNA, 15 nt, Vaccinia virus
uauguugacauguau

SEQ ID NO: 4056880 - RNA, 18 nt, Vaccinia virus
uauguuuuaugaauagau

SEQ ID NO: 4056881 - RNA, 19 nt, Vaccinia virus
uauguuuuuacagagacuu

SEQ ID NO: 4056882 - RNA, 19 nt, Vaccinia virus
uauuaaaacuaucaaugau

SEQ ID NO: 4056883 - RNA, 12 nt, Vaccinia virus
uauuaaaacuga

SEQ ID NO: 4056884 - RNA, 13 nt, Vaccinia virus
uauuaaaacugac

SEQ ID NO: 4056885 - RNA, 18 nt, Vaccinia virus
uauuaaaauuauuucuaa

SEQ ID NO: 4056886 - RNA, 16 nt, Vaccinia virus
uauuaaaauucuuaaa

SEQ ID NO: 4056887 - RNA, 17 nt, Vaccinia virus
uauuaaaggaacuaaag

SEQ ID NO: 4056888 - RNA, 20 nt, Vaccinia virus
uauuaaaucucgauaauauc

SEQ ID NO: 4056889 - RNA, 17 nt, Vaccinia virus
uauuaacgaguuccauu

SEQ ID NO: 4056890 - RNA, 23 nt, Vaccinia virus
uauuaacgcguuuuaugaaugau

SEQ ID NO: 4056891 - RNA, 21 nt, Vaccinia virus
uauuaacgguaauacauuuau

SEQ ID NO: 4056892 - RNA, 19 nt, Vaccinia virus
uauuaagaaguuccaugau

SEQ ID NO: 4056893 - RNA, 23 nt, Vaccinia virus
uauuaauaacaguuauauaucua

SEQ ID NO: 4056894 - RNA, 15 nt, Vaccinia virus
uauuaauaauuacuu

SEQ ID NO: 4056895 - RNA, 20 nt, Vaccinia virus
uauuaauacaugucuuagau

SEQ ID NO: 4056896 - RNA, 15 nt, Vaccinia virus
uauuaaugaugaaag

SEQ ID NO: 4056897 - RNA, 13 nt, Vaccinia virus
uauuaauguauua

SEQ ID NO: 4056898 - RNA, 18 nt, Vaccinia virus
uauuaauguauuauuaua

SEQ ID NO: 4056899 - RNA, 12 nt, Vaccinia virus
uauuaauuaaac

SEQ ID NO: 4056900 - RNA, 23 nt, Vaccinia virus
uauuacaaaauauuuugagacuc

SEQ ID NO: 4056901 - RNA, 15 nt, Vaccinia virus
uauuacaaccaaugu

SEQ ID NO: 4056902 - RNA, 18 nt, Vaccinia virus
uauuacagaaguuuugaa

SEQ ID NO: 4056903 - RNA, 19 nt, Vaccinia virus
uauuacauaauauauacag

SEQ ID NO: 4056904 - RNA, 19 nt, Vaccinia virus
uauuacguggagaaaucau

SEQ ID NO: 4056905 - RNA, 15 nt, Vaccinia virus
uauuacguuagcauu

SEQ ID NO: 4056906 - RNA, 12 nt, Vaccinia virus
uauuacuuuagu

SEQ ID NO: 4056907 - RNA, 22 nt, Vaccinia virus
uauuagaauuggaauaccaaau

SEQ ID NO: 4056908 - RNA, 17 nt, Vaccinia virus
uauuagauuuuguauua

SEQ ID NO: 4056909 - RNA, 19 nt, Vaccinia virus
uauuagcgaauauaucaaa

SEQ ID NO: 4056910 - RNA, 14 nt, Vaccinia virus
uauuagucaauggu

SEQ ID NO: 4056911 - RNA, 14 nt, Vaccinia virus
uauuauaaacucuc

SEQ ID NO: 4056912 - RNA, 20 nt, Vaccinia virus
uauuauaaagccuuuaucua

SEQ ID NO: 4056913 - RNA, 11 nt, Vaccinia virus
uauuauacaug

SEQ ID NO: 4056914 - RNA, 21 nt, Vaccinia virus
uauuaucaggaacauuaucaa

SEQ ID NO: 4056915 - RNA, 12 nt, Vaccinia virus
uauuaucaugau

SEQ ID NO: 4056916 - RNA, 18 nt, Vaccinia virus
uauuauccgaagacagau

SEQ ID NO: 4056917 - RNA, 15 nt, Vaccinia virus
uauuaucucaacaaa

SEQ ID NO: 4056918 - RNA, 21 nt, Vaccinia virus
uauuaugaugaacuuuaucua

SEQ ID NO: 4056919 - RNA, 18 nt, Vaccinia virus
uauuauggaaaucaacau

SEQ ID NO: 4056920 - RNA, 16 nt, Vaccinia virus
uauuauguuuaucaca

SEQ ID NO: 4056921 - RNA, 23 nt, Vaccinia virus
uauuauuaaacguaguuaugaua

SEQ ID NO: 4056922 - RNA, 14 nt, Vaccinia virus
uauuauuaaucauu

SEQ ID NO: 4056923 - RNA, 23 nt, Vaccinia virus
uauuauuaggaucuacguucaua

SEQ ID NO: 4056924 - RNA, 22 nt, Vaccinia virus
uauuauugauacaauuauuaua

SEQ ID NO: 4056925 - RNA, 17 nt, Vaccinia virus
uauucaagcaaaaacaa

SEQ ID NO: 4056926 - RNA, 15 nt, Vaccinia virus
uauucacaaauauga

SEQ ID NO: 4056927 - RNA, 16 nt, Vaccinia virus
uauucagauuaucaug

SEQ ID NO: 4056928 - RNA, 14 nt, Vaccinia virus
uauucauaauaaga

SEQ ID NO: 4056929 - RNA, 20 nt, Vaccinia virus
uauucauuaggauuaucaaa

SEQ ID NO: 4056930 - RNA, 16 nt, Vaccinia virus
uauuccaaucauugau

SEQ ID NO: 4056931 - RNA, 17 nt, Vaccinia virus
uauuccuaguuuggauu

SEQ ID NO: 4056932 - RNA, 19 nt, Vaccinia virus
uauucgacuugguguuuga

SEQ ID NO: 4056933 - RNA, 16 nt, Vaccinia virus
uauucggcauuucuaa

SEQ ID NO: 4056934 - RNA, 12 nt, Vaccinia virus
uagccuguuuua

SEQ ID NO: 4056935 - RNA, 17 nt, Vaccinia virus
uagcgaacauauaucug

SEQ ID NO: 4056936 - RNA, 21 nt, Vaccinia virus
uagcgaagaagagaaagacag

SEQ ID NO: 4056937 - RNA, 16 nt, Vaccinia virus
uagcggguauccccgu

SEQ ID NO: 4056938 - RNA, 18 nt, Vaccinia virus
uagcguacaaaauuaucg

SEQ ID NO: 4056939 - RNA, 21 nt, Vaccinia virus
uagcuauucguaacaaaacua

SEQ ID NO: 4056940 - RNA, 18 nt, Vaccinia virus
uagcuccccuguuuucau

SEQ ID NO: 4056941 - RNA, 13 nt, Vaccinia virus
uagcuguuuucau

SEQ ID NO: 4056942 - RNA, 23 nt, Vaccinia virus
uagcuuuguuagacuagauacua

SEQ ID NO: 4056943 - RNA, 21 nt, Vaccinia virus
uaggaaauuucaugcaacgaa

SEQ ID NO: 4056944 - RNA, 15 nt, Vaccinia virus
uaggaccacuagcaa

SEQ ID NO: 4056945 - RNA, 21 nt, Vaccinia virus
uaggaccacuagcaaaagaua

SEQ ID NO: 4056946 - RNA, 14 nt, Vaccinia virus
uaggagaauuauuu

SEQ ID NO: 4056947 - RNA, 18 nt, Vaccinia virus
uaggagacgcccaaaaua

SEQ ID NO: 4056948 - RNA, 14 nt, Vaccinia virus
uaggaguaauagaa

SEQ ID NO: 4056949 - RNA, 14 nt, Vaccinia virus
uaggaguaucuauu

SEQ ID NO: 4056950 - RNA, 15 nt, Vaccinia virus
uaggauaauacaucc

SEQ ID NO: 4056951 - RNA, 17 nt, Vaccinia virus
uaggauacucuaugaau

SEQ ID NO: 4056952 - RNA, 18 nt, Vaccinia virus
uaggcacagucaaacauu

SEQ ID NO: 4056953 - RNA, 22 nt, Vaccinia virus
uaggcuuccaaaaauuuuucau

SEQ ID NO: 4056954 - RNA, 20 nt, Vaccinia virus
uagguaugaucguuaagaau

SEQ ID NO: 4056955 - RNA, 16 nt, Vaccinia virus
uagguauguccucugc

SEQ ID NO: 4056956 - RNA, 20 nt, Vaccinia virus
uaggucuuguguuagaugau

SEQ ID NO: 4056957 - RNA, 21 nt, Vaccinia virus
uaggugccaccaauaaacuau

SEQ ID NO: 4056958 - RNA, 20 nt, Vaccinia virus
uaguaaaauaaucauacaau

SEQ ID NO: 4056959 - RNA, 21 nt, Vaccinia virus
uaguaauuauaaaaccaagga

SEQ ID NO: 4056960 - RNA, 13 nt, Vaccinia virus
uaguagauacaua

SEQ ID NO: 4056961 - RNA, 17 nt, Vaccinia virus
uaguauaacacacaugu

SEQ ID NO: 4056962 - RNA, 15 nt, Vaccinia virus
uaguauaucaaagau

SEQ ID NO: 4056963 - RNA, 18 nt, Vaccinia virus
uaguauaugaacaaacgu

SEQ ID NO: 4056964 - RNA, 18 nt, Vaccinia virus
uaguauaugauaauauua

SEQ ID NO: 4056965 - RNA, 19 nt, Vaccinia virus
uaguaugucgauauacuua

SEQ ID NO: 4056966 - RNA, 23 nt, Vaccinia virus
uaguauuuaacaagagaagagau

SEQ ID NO: 4056967 - RNA, 20 nt, Vaccinia virus
uagucaucacauuaacuauu

SEQ ID NO: 4056968 - RNA, 19 nt, Vaccinia virus
uagucgguuaauguuguau

SEQ ID NO: 4056969 - RNA, 19 nt, Vaccinia virus
uagucuaguaucuaaacau

SEQ ID NO: 4056970 - RNA, 13 nt, Vaccinia virus
uagucucuguaau

SEQ ID NO: 4056971 - RNA, 14 nt, Vaccinia virus
uagucuucaauaau

SEQ ID NO: 4056972 - RNA, 18 nt, Vaccinia virus
uagugaucaguuuaugua

SEQ ID NO: 4056973 - RNA, 16 nt, Vaccinia virus
uagugaugaauaucug

SEQ ID NO: 4056974 - RNA, 13 nt, Vaccinia virus
uaguggacaacau

SEQ ID NO: 4056975 - RNA, 18 nt, Vaccinia virus
uaguggacuugucaaauc

SEQ ID NO: 4056976 - RNA, 15 nt, Vaccinia virus
uaguuaaugaaacau

SEQ ID NO: 4056977 - RNA, 22 nt, Vaccinia virus
uaguuauggcacucuuauuaua

SEQ ID NO: 4056978 - RNA, 23 nt, Vaccinia virus
uaguuauuagugauaaaauagua

SEQ ID NO: 4056979 - RNA, 14 nt, Vaccinia virus
uaguucauacacca

SEQ ID NO: 4056980 - RNA, 18 nt, Vaccinia virus
uaguucguguacuaguca

SEQ ID NO: 4056981 - RNA, 19 nt, Vaccinia virus
uaguucucuuuuguagaac

SEQ ID NO: 4056982 - RNA, 20 nt, Vaccinia virus
uaguuguucagcuguagaac

SEQ ID NO: 4056983 - RNA, 17 nt, Vaccinia virus
uaguuguuuaauuuauu

SEQ ID NO: 4056984 - RNA, 13 nt, Vaccinia virus
uaguuuacagaua

SEQ ID NO: 4056985 - RNA, 14 nt, Vaccinia virus
uaguuuauaucuuu

SEQ ID NO: 4056986 - RNA, 16 nt, Vaccinia virus
uaguuuaucauacuua

SEQ ID NO: 4056987 - RNA, 14 nt, Vaccinia virus
uaguuuauuauaua

SEQ ID NO: 4056988 - RNA, 17 nt, Vaccinia virus
uaguuuauuccaaucau

SEQ ID NO: 4056989 - RNA, 19 nt, Vaccinia virus
uaguuuccuuaacaaaucu

SEQ ID NO: 4056990 - RNA, 18 nt, Vaccinia virus
uaguuucuauaucuacau

SEQ ID NO: 4056991 - RNA, 15 nt, Vaccinia virus
uaguuuguuucugga

SEQ ID NO: 4056992 - RNA, 15 nt, Vaccinia virus
uaguuuuacuaucau

SEQ ID NO: 4056993 - RNA, 19 nt, Vaccinia virus
uaguuuucaucagauaaga

SEQ ID NO: 4056994 - RNA, 20 nt, Vaccinia virus
uaguuuuuauagauucuuua

SEQ ID NO: 4056995 - RNA, 13 nt, Vaccinia virus
uaguuuuucugga

SEQ ID NO: 4056996 - RNA, 13 nt, Vaccinia virus
uauaaaaaacuaa

SEQ ID NO: 4056997 - RNA, 13 nt, Vaccinia virus
uauaaaaacuuuu

SEQ ID NO: 4056998 - RNA, 13 nt, Vaccinia virus
uauaaaaauacuu

SEQ ID NO: 4056999 - RNA, 19 nt, Vaccinia virus
uauaaaacgauuaaacaau

SEQ ID NO: 4057000 - RNA, 19 nt, Vaccinia virus
uauaaaacuacuacaauga

SEQ ID NO: 4057001 - RNA, 14 nt, Vaccinia virus
uauaaaacuuauga

SEQ ID NO: 4057002 - RNA, 16 nt, Vaccinia virus
uauaaaacuugucugu

SEQ ID NO: 4057003 - RNA, 19 nt, Vaccinia virus
uauaaaacuugucuguaua

SEQ ID NO: 4057004 - RNA, 14 nt, Vaccinia virus
uauaaaauauauug

SEQ ID NO: 4057005 - RNA, 21 nt, Vaccinia virus
uauaaacaugaauuuauuucu

SEQ ID NO: 4057006 - RNA, 22 nt, Vaccinia virus
uauaaaccgcuauugaaacuga

SEQ ID NO: 4057007 - RNA, 20 nt, Vaccinia virus
uauaaacguauacuguagau

SEQ ID NO: 4057008 - RNA, 17 nt, Vaccinia virus
uauaaacucgcuuaaua

SEQ ID NO: 4057009 - RNA, 16 nt, Vaccinia virus
uauaaacucucaacau

SEQ ID NO: 4057010 - RNA, 23 nt, Vaccinia virus
uauaaacuuuauccauaucucua

SEQ ID NO: 4057011 - RNA, 16 nt, Vaccinia virus
uauaaagauugugcaa

SEQ ID NO: 4057012 - RNA, 21 nt, Vaccinia virus
uauaaaguccgcacuacuguu

SEQ ID NO: 4057013 - RNA, 21 nt, Vaccinia virus
uauaaagucugucaaaucauc

SEQ ID NO: 4057014 - RNA, 14 nt, Vaccinia virus
uauaaaguguaugu

SEQ ID NO: 4057015 - RNA, 18 nt, Vaccinia virus
uauaaauauauaaugggu

SEQ ID NO: 4057016 - RNA, 14 nt, Vaccinia virus
uauaaauucucgag

SEQ ID NO: 4057017 - RNA, 12 nt, Vaccinia virus
uauaacaaccaa

SEQ ID NO: 4057018 - RNA, 21 nt, Vaccinia virus
uauaacagagccaucuguaaa

SEQ ID NO: 4057019 - RNA, 19 nt, Vaccinia virus
uauaaccaccgauaaaucu

SEQ ID NO: 4057020 - RNA, 14 nt, Vaccinia virus
uauaaccuuaacuu

SEQ ID NO: 4057021 - RNA, 20 nt, Vaccinia virus
uauaacuucugguaaauauu

SEQ ID NO: 4057022 - RNA, 19 nt, Vaccinia virus
uauaagaauuuuuauacau

SEQ ID NO: 4057023 - RNA, 20 nt, Vaccinia virus
uauaagaauuuuuauacauu

SEQ ID NO: 4057024 - RNA, 17 nt, Vaccinia virus
uauaagauuaucaaaau

SEQ ID NO: 4057025 - RNA, 19 nt, Vaccinia virus
uacaguaguaauuaaugaa

SEQ ID NO: 4057026 - RNA, 22 nt, Vaccinia virus
uacauacaucuccaaaacuauc

SEQ ID NO: 4057027 - RNA, 22 nt, Vaccinia virus
uacauauaccgccuuucaaaau

SEQ ID NO: 4057028 - RNA, 20 nt, Vaccinia virus
uacaucaucgaacuucugau

SEQ ID NO: 4057029 - RNA, 17 nt, Vaccinia virus
uacaucggauacgacau

SEQ ID NO: 4057030 - RNA, 16 nt, Vaccinia virus
uacaucgucuagaucu

SEQ ID NO: 4057031 - RNA, 14 nt, Vaccinia virus
uacaucuacuauau

SEQ ID NO: 4057032 - RNA, 17 nt, Vaccinia virus
uacaucuuccuucuuau

SEQ ID NO: 4057033 - RNA, 15 nt, Vaccinia virus
uacaugacaauaaag

SEQ ID NO: 4057034 - RNA, 17 nt, Vaccinia virus
uacauggacucauuaaa

SEQ ID NO: 4057035 - RNA, 20 nt, Vaccinia virus
uacauguaaugauuuaaaau

SEQ ID NO: 4057036 - RNA, 19 nt, Vaccinia virus
uacauguuucccaauuugu

SEQ ID NO: 4057037 - RNA, 13 nt, Vaccinia virus
uacauguuuucau

SEQ ID NO: 4057038 - RNA, 17 nt, Vaccinia virus
uacauucuuuuugcugu

SEQ ID NO: 4057039 - RNA, 17 nt, Vaccinia virus
uacauuguauaaaaagc

SEQ ID NO: 4057040 - RNA, 15 nt, Vaccinia virus
uacauuuucuuacaa

SEQ ID NO: 4057041 - RNA, 22 nt, Vaccinia virus
uaccaacaugucugauauuuug

SEQ ID NO: 4057042 - RNA, 21 nt, Vaccinia virus
uaccacaauaaaaaaaauuga

SEQ ID NO: 4057043 - RNA, 21 nt, Vaccinia virus
uaccacuuuccaacuuaucau

SEQ ID NO: 4057044 - RNA, 20 nt, Vaccinia virus
uaccagauauuauacaaaau

SEQ ID NO: 4057045 - RNA, 14 nt, Vaccinia virus
uaccagaucuuaau

SEQ ID NO: 4057046 - RNA, 17 nt, Vaccinia virus
uaccaucaacuacugua

SEQ ID NO: 4057047 - RNA, 16 nt, Vaccinia virus
uaccauuaaucacuga

SEQ ID NO: 4057048 - RNA, 18 nt, Vaccinia virus
uacccaaucucucucaaa

SEQ ID NO: 4057049 - RNA, 12 nt, Vaccinia virus
uaccgaaaauaa

SEQ ID NO: 4057050 - RNA, 16 nt, Vaccinia virus
uaccgaagaauuaaau

SEQ ID NO: 4057051 - RNA, 15 nt, Vaccinia virus
uaccgauuuaucauc

SEQ ID NO: 4057052 - RNA, 21 nt, Vaccinia virus
uaccuaucuucgauauaaaau

SEQ ID NO: 4057053 - RNA, 11 nt, Vaccinia virus
uaccuguuuuu

SEQ ID NO: 4057054 - RNA, 13 nt, Vaccinia virus
uaccuguuuuuau

SEQ ID NO: 4057055 - RNA, 18 nt, Vaccinia virus
uacgaaccgggaaagaga

SEQ ID NO: 4057056 - RNA, 21 nt, Vaccinia virus
uacgaauaucguucucuaaau

SEQ ID NO: 4057057 - RNA, 14 nt, Vaccinia virus
uacgauucaggaau

SEQ ID NO: 4057058 - RNA, 22 nt, Vaccinia virus
uacgcaaauaccgaucaacaaa

SEQ ID NO: 4057059 - RNA, 16 nt, Vaccinia virus
uacgcaauguuacaca

SEQ ID NO: 4057060 - RNA, 14 nt, Vaccinia virus
uacgccaaggaaag

SEQ ID NO: 4057061 - RNA, 14 nt, Vaccinia virus
uacgcuauuaaaau

SEQ ID NO: 4057062 - RNA, 18 nt, Vaccinia virus
uacgcuccuuaucaaaau

SEQ ID NO: 4057063 - RNA, 15 nt, Vaccinia virus
uacggaagaagaaaa

SEQ ID NO: 4057064 - RNA, 20 nt, Vaccinia virus
uacguaauagaacgugucau

SEQ ID NO: 4057065 - RNA, 13 nt, Vaccinia virus
uacguauccucga

SEQ ID NO: 4057066 - RNA, 16 nt, Vaccinia virus
uacgucuauacagaua

SEQ ID NO: 4057067 - RNA, 23 nt, Vaccinia virus
ucaacguaacuauauuccaaauu

SEQ ID NO: 4057068 - RNA, 13 nt, Vaccinia virus
ucaacuucaucau

SEQ ID NO: 4057069 - RNA, 16 nt, Vaccinia virus
ucaaguaaagauuuca

SEQ ID NO: 4057070 - RNA, 14 nt, Vaccinia virus
ucaagucaauuauc

SEQ ID NO: 4057071 - RNA, 17 nt, Vaccinia virus
ucaaguuaugaaaauag

SEQ ID NO: 4057072 - RNA, 15 nt, Vaccinia virus
ucaauaauauaucuu

SEQ ID NO: 4057073 - RNA, 16 nt, Vaccinia virus
ucaauaaucaaccauc

SEQ ID NO: 4057074 - RNA, 14 nt, Vaccinia virus
ucaauaauucuauu

SEQ ID NO: 4057075 - RNA, 12 nt, Vaccinia virus
ucaauacaaaaa

SEQ ID NO: 4057076 - RNA, 12 nt, Vaccinia virus
ucaauagaagau

SEQ ID NO: 4057077 - RNA, 15 nt, Vaccinia virus
ucaauagacauccaa

SEQ ID NO: 4057078 - RNA, 21 nt, Vaccinia virus
ucaauagcaguuuauuaucca

SEQ ID NO: 4057079 - RNA, 19 nt, Vaccinia virus
ucaauagcugagucuauau

SEQ ID NO: 4057080 - RNA, 13 nt, Vaccinia virus
ucaauagguagua

SEQ ID NO: 4057081 - RNA, 14 nt, Vaccinia virus
ucaauauagaucuu

SEQ ID NO: 4057082 - RNA, 14 nt, Vaccinia virus
ucaauaucaucaaa

SEQ ID NO: 4057083 - RNA, 16 nt, Vaccinia virus
ucaauauugaaaauac

SEQ ID NO: 4057084 - RNA, 18 nt, Vaccinia virus
ucaaucaaggaacuaaau

SEQ ID NO: 4057085 - RNA, 20 nt, Vaccinia virus
ucaaucauccuaaagaguau

SEQ ID NO: 4057086 - RNA, 20 nt, Vaccinia virus
ucaaucggauacagacacuc

SEQ ID NO: 4057087 - RNA, 22 nt, Vaccinia virus
ucaauuacacuauuugucuuaa

SEQ ID NO: 4057088 - RNA, 15 nt, Vaccinia virus
ucacaaauacuacaa

SEQ ID NO: 4057089 - RNA, 17 nt, Vaccinia virus
ucacaaguaugaagaaa

SEQ ID NO: 4057090 - RNA, 18 nt, Vaccinia virus
ucacaauacgauuuagau

SEQ ID NO: 4057091 - RNA, 18 nt, Vaccinia virus
ucacacuacugaaaaaag

SEQ ID NO: 4057092 - RNA, 23 nt, Vaccinia virus
ucacauauaaaauuuuaauuaau

SEQ ID NO: 4057093 - RNA, 17 nt, Vaccinia virus
ucacauccuuuauuuua

SEQ ID NO: 4057094 - RNA, 17 nt, Vaccinia virus
ucacaugucuaaacuuc

SEQ ID NO: 4057095 - RNA, 18 nt, Vaccinia virus
ucaccaauaagauaauag

SEQ ID NO: 4057096 - RNA, 21 nt, Vaccinia virus
ucacuaacugauaccaugaaa

SEQ ID NO: 4057097 - RNA, 15 nt, Vaccinia virus
ucacucaauaucuag

SEQ ID NO: 4057098 - RNA, 22 nt, Vaccinia virus
ucacucucauaauguaaagaua

SEQ ID NO: 4057099 - RNA, 20 nt, Vaccinia virus
ucacugauuaauuauuugcc

SEQ ID NO: 4057100 - RNA, 19 nt, Vaccinia virus
ucacuguauaaaaagaaug

SEQ ID NO: 4057101 - RNA, 23 nt, Vaccinia virus
ucagaaaggauagagcaauaagu

SEQ ID NO: 4057102 - RNA, 15 nt, Vaccinia virus
ucagaacugaugcaa

SEQ ID NO: 4057103 - RNA, 16 nt, Vaccinia virus
ucagaauauacaccua

SEQ ID NO: 4057104 - RNA, 23 nt, Vaccinia virus
ucagaauauacaccuaacguuuu

SEQ ID NO: 4057105 - RNA, 22 nt, Vaccinia virus
ucagaauuuucauggauguaga

SEQ ID NO: 4057106 - RNA, 14 nt, Vaccinia virus
ucagagagauuucg

SEQ ID NO: 4057107 - RNA, 21 nt, Vaccinia virus
ucagagauuauugucuuauau

SEQ ID NO: 4057108 - RNA, 12 nt, Vaccinia virus
ucagaguucagu

SEQ ID NO: 4057109 - RNA, 19 nt, Vaccinia virus
ucagaguucagugaagaag

SEQ ID NO: 4057110 - RNA, 15 nt, Vaccinia virus
ucagauaaucugaaa

SEQ ID NO: 4057111 - RNA, 13 nt, Vaccinia virus
ucagauauuugcg

SEQ ID NO: 4057112 - RNA, 17 nt, Vaccinia virus
ucagauuucaauucacg

SEQ ID NO: 4057113 - RNA, 21 nt, Vaccinia virus
ucagcaucugguacaauaaau

SEQ ID NO: 4057114 - RNA, 16 nt, Vaccinia virus
ucaggugccccgacuc

SEQ ID NO: 4057115 - RNA, 15 nt, Vaccinia virus
ucaguaucuucagac

SEQ ID NO: 4057116 - RNA, 18 nt, Vaccinia virus
ucagucuucgaagcaugu

SEQ ID NO: 4057117 - RNA, 20 nt, Vaccinia virus
ucaguguccaucauuucauu

SEQ ID NO: 4057118 - RNA, 18 nt, Vaccinia virus
ucaguguggguacaaaua

SEQ ID NO: 4057119 - RNA, 21 nt, Vaccinia virus
ucauaaaauauuuuuauucuc

SEQ ID NO: 4057120 - RNA, 13 nt, Vaccinia virus
ucauaaagaacag

SEQ ID NO: 4057121 - RNA, 22 nt, Vaccinia virus
ucauaacuugagagcauccagu

SEQ ID NO: 4057122 - RNA, 14 nt, Vaccinia virus
ucauaaguguauau

SEQ ID NO: 4057123 - RNA, 17 nt, Vaccinia virus
ucauaauugcuuuucua

SEQ ID NO: 4057124 - RNA, 17 nt, Vaccinia virus
ucauacuagaauaaagc

SEQ ID NO: 4057125 - RNA, 18 nt, Vaccinia virus
ucauagccgcucuuagag

SEQ ID NO: 4057126 - RNA, 12 nt, Vaccinia virus
ucauaguuuuua

SEQ ID NO: 4057127 - RNA, 18 nt, Vaccinia virus
ucauauacaacucuuuaa

SEQ ID NO: 4057128 - RNA, 13 nt, Vaccinia virus
ucauauacuauuu

SEQ ID NO: 4057129 - RNA, 21 nt, Vaccinia virus
ucauauauauacugagaaguu

SEQ ID NO: 4057130 - RNA, 17 nt, Vaccinia virus
ucauaucacauaguguu

SEQ ID NO: 4057131 - RNA, 18 nt, Vaccinia virus
ucauaugugguauucacu

SEQ ID NO: 4057132 - RNA, 17 nt, Vaccinia virus
ucauauguuguuguaau

SEQ ID NO: 4057133 - RNA, 14 nt, Vaccinia virus
ucauauuaaugggu

SEQ ID NO: 4057134 - RNA, 15 nt, Vaccinia virus
ucauauuauagauuu

SEQ ID NO: 4057135 - RNA, 14 nt, Vaccinia virus
ucauauuuagauuu

SEQ ID NO: 4057136 - RNA, 18 nt, Vaccinia virus
ucaucaaacaacugaaaa

SEQ ID NO: 4057137 - RNA, 14 nt, Vaccinia virus
ucaucaauguagug

SEQ ID NO: 4057138 - RNA, 20 nt, Vaccinia virus
ucaucaccagcacaacaucu

SEQ ID NO: 4057139 - RNA, 20 nt, Vaccinia virus
ucaucaccuaucuugugcau

SEQ ID NO: 4057140 - RNA, 22 nt, Vaccinia virus
ucauccgauaaacuccaauaaa

SEQ ID NO: 4057141 - RNA, 23 nt, Vaccinia virus
ucauccguggauauuugauuuuu

SEQ ID NO: 4057142 - RNA, 16 nt, Vaccinia virus
ucauccguuguuauau

SEQ ID NO: 4057143 - RNA, 20 nt, Vaccinia virus
ucauccguuuccuuaugaag

SEQ ID NO: 4057144 - RNA, 23 nt, Vaccinia virus
ucaucgaacuucugaucauuaau

SEQ ID NO: 4057145 - RNA, 16 nt, Vaccinia virus
ucaucgauaguauaau

SEQ ID NO: 4057146 - RNA, 20 nt, Vaccinia virus
ucaucggacuuugugcauau

SEQ ID NO: 4057147 - RNA, 15 nt, Vaccinia virus
ucaucgugacauaag

SEQ ID NO: 4057148 - RNA, 17 nt, Vaccinia virus
ucaucuacucauagaaa

SEQ ID NO: 4057149 - RNA, 12 nt, Vaccinia virus
ucaucuguuuua

SEQ ID NO: 4057150 - RNA, 13 nt, Vaccinia virus
ucaucuucauagg

SEQ ID NO: 4057151 - RNA, 20 nt, Vaccinia virus
ucaucuuuuaccaacacaaa

SEQ ID NO: 4057152 - RNA, 22 nt, Vaccinia virus
ucaugaugaaguugagaaugau

SEQ ID NO: 4057153 - RNA, 22 nt, Vaccinia virus
ucaugucugguaauucauauag

SEQ ID NO: 4057154 - RNA, 15 nt, Vaccinia virus
ucauguguagaugcu

SEQ ID NO: 4057155 - RNA, 17 nt, Vaccinia virus
ucauguguucaaaguau

SEQ ID NO: 4057156 - RNA, 16 nt, Vaccinia virus
ucauguuuauuucuag

SEQ ID NO: 4057157 - RNA, 15 nt, Vaccinia virus
ucauuaaaauaugug

SEQ ID NO: 4057158 - RNA, 22 nt, Vaccinia virus
ucauuaaauguuucaucagaaa

SEQ ID NO: 4057159 - RNA, 18 nt, Vaccinia virus
ucauuacagaaacuguaa

SEQ ID NO: 4057160 - RNA, 15 nt, Vaccinia virus
ucauuacuacuguaa

SEQ ID NO: 4057161 - RNA, 17 nt, Vaccinia virus
ucauuauuauguugaua

SEQ ID NO: 4057162 - RNA, 16 nt, Vaccinia virus
ucauucucuagaagau

SEQ ID NO: 4057163 - RNA, 15 nt, Vaccinia virus
ucauugauugagaag

SEQ ID NO: 4057164 - RNA, 14 nt, Vaccinia virus
ucauuggaaaauau

SEQ ID NO: 4057165 - RNA, 16 nt, Vaccinia virus
ucauuguaaauuuaua

SEQ ID NO: 4057166 - RNA, 20 nt, Vaccinia virus
ucauuuaacacuauacucau

SEQ ID NO: 4057167 - RNA, 20 nt, Vaccinia virus
ucauuuacuaaggaguaaaa

SEQ ID NO: 4057168 - RNA, 12 nt, Vaccinia virus
ucauuuagaaug

SEQ ID NO: 4057169 - RNA, 19 nt, Vaccinia virus
ucauuucuccaaagaauau

SEQ ID NO: 4057170 - RNA, 15 nt, Vaccinia virus
ucauuuggagaguau

SEQ ID NO: 4057171 - RNA, 13 nt, Vaccinia virus
ucauuuguuucca

SEQ ID NO: 4057172 - RNA, 15 nt, Vaccinia virus
ucauuuuauaauugu

SEQ ID NO: 4057173 - RNA, 18 nt, Vaccinia virus
ucauuuucuauuuaaaau

SEQ ID NO: 4057174 - RNA, 17 nt, Vaccinia virus
uccaaauugcgacacua

SEQ ID NO: 4057175 - RNA, 15 nt, Vaccinia virus
uccaaguucuauagu

SEQ ID NO: 4057176 - RNA, 21 nt, Vaccinia virus
uccaauacuaauucaaauugu

SEQ ID NO: 4057177 - RNA, 13 nt, Vaccinia virus
uccaauagauguc

SEQ ID NO: 4057178 - RNA, 13 nt, Vaccinia virus
uccaauguauuua

SEQ ID NO: 4057179 - RNA, 14 nt, Vaccinia virus
uccaauuaaaugua

SEQ ID NO: 4057180 - RNA, 14 nt, Vaccinia virus
uccaauuacaaaaa

SEQ ID NO: 4057181 - RNA, 15 nt, Vaccinia virus
uccaauuacaaaaac

SEQ ID NO: 4057182 - RNA, 15 nt, Vaccinia virus
uccaauuuuauucua

SEQ ID NO: 4057183 - RNA, 16 nt, Vaccinia virus
uccacaaauaguaaau

SEQ ID NO: 4057184 - RNA, 16 nt, Vaccinia virus
uccacauuaauacagc

SEQ ID NO: 4057185 - RNA, 23 nt, Vaccinia virus
uccacgauaaaauccuccuauca

SEQ ID NO: 4057186 - RNA, 23 nt, Vaccinia virus
uccacucucgauaaaucuacuca

SEQ ID NO: 4057187 - RNA, 14 nt, Vaccinia virus
uccagauaauaacc

SEQ ID NO: 4057188 - RNA, 17 nt, Vaccinia virus
uccagaugcgagagaau

SEQ ID NO: 4057189 - RNA, 20 nt, Vaccinia virus
uccagccguagaauaucuaa

SEQ ID NO: 4057190 - RNA, 15 nt, Vaccinia virus
uccauaauuuucucu

SEQ ID NO: 4057191 - RNA, 17 nt, Vaccinia virus
uccauaauuuucucucg

SEQ ID NO: 4057192 - RNA, 19 nt, Vaccinia virus
uccauaguacauaguuguu

SEQ ID NO: 4057193 - RNA, 17 nt, Vaccinia virus
uccaucauuucauuaau

SEQ ID NO: 4057194 - RNA, 19 nt, Vaccinia virus
uccaucgaugauacaugua

SEQ ID NO: 4057195 - RNA, 18 nt, Vaccinia virus
uccaucguugcaauaaua

SEQ ID NO: 4057196 - RNA, 17 nt, Vaccinia virus
uccaugauaaauuauuu

SEQ ID NO: 4057197 - RNA, 18 nt, Vaccinia virus
uccaugauacaacuuugc

SEQ ID NO: 4057198 - RNA, 21 nt, Vaccinia virus
uccaugcagcauuuccuacau

SEQ ID NO: 4057199 - RNA, 16 nt, Vaccinia virus
uccauguccaauauga

SEQ ID NO: 4057200 - RNA, 20 nt, Vaccinia virus
uccauguugucuauuuccaa

SEQ ID NO: 4057201 - RNA, 14 nt, Vaccinia virus
ucuccccaaacauu

SEQ ID NO: 4057202 - RNA, 16 nt, Vaccinia virus
ucuccuuuuguagaca

SEQ ID NO: 4057203 - RNA, 15 nt, Vaccinia virus
ucucuauguuucagu

SEQ ID NO: 4057204 - RNA, 22 nt, Vaccinia virus
ucucucaaucacuacaucuuua

SEQ ID NO: 4057205 - RNA, 21 nt, Vaccinia virus
ucucugauguuuguuuucgau

SEQ ID NO: 4057206 - RNA, 22 nt, Vaccinia virus
ucucuguuuaaugaauuacuaa

SEQ ID NO: 4057207 - RNA, 22 nt, Vaccinia virus
ucucuuuuguagaacuuaacuu

SEQ ID NO: 4057208 - RNA, 19 nt, Vaccinia virus
ucugaaaauccacuaacaa

SEQ ID NO: 4057209 - RNA, 12 nt, Vaccinia virus
ucugaauuauuu

SEQ ID NO: 4057210 - RNA, 19 nt, Vaccinia virus
ucugaauuauuucauauau

SEQ ID NO: 4057211 - RNA, 21 nt, Vaccinia virus
ucugacauaagaugucuauga

SEQ ID NO: 4057212 - RNA, 20 nt, Vaccinia virus
ucugauaauccagucuuuaa

SEQ ID NO: 4057213 - RNA, 17 nt, Vaccinia virus
ucugaucuuaacuccuc

SEQ ID NO: 4057214 - RNA, 18 nt, Vaccinia virus
ucugcuccuuuuucuauu

SEQ ID NO: 4057215 - RNA, 15 nt, Vaccinia virus
ucuguaaauaguuuu

SEQ ID NO: 4057216 - RNA, 12 nt, Vaccinia virus
ucuguacaaaau

SEQ ID NO: 4057217 - RNA, 22 nt, Vaccinia virus
ucugucauauguauaaaugaag

SEQ ID NO: 4057218 - RNA, 15 nt, Vaccinia virus
ucugucauauuuaga

SEQ ID NO: 4057219 - RNA, 15 nt, Vaccinia virus
ucugugguggaugau

SEQ ID NO: 4057220 - RNA, 19 nt, Vaccinia virus
ucuguuccccucuaucauc

SEQ ID NO: 4057221 - RNA, 14 nt, Vaccinia virus
ucuuaaauuucaua

SEQ ID NO: 4057222 - RNA, 22 nt, Vaccinia virus
ucuuacacauucgcucauacau

SEQ ID NO: 4057223 - RNA, 17 nt, Vaccinia virus
ucuuauaauuguaacau

SEQ ID NO: 4057224 - RNA, 14 nt, Vaccinia virus
ucuuauagauguau

SEQ ID NO: 4057225 - RNA, 15 nt, Vaccinia virus
ucuuauauacacagu

SEQ ID NO: 4057226 - RNA, 18 nt, Vaccinia virus
ucuuaugcauguuucaua

SEQ ID NO: 4057227 - RNA, 22 nt, Vaccinia virus
ucuucaaaguuucugaaauaag

SEQ ID NO: 4057228 - RNA, 20 nt, Vaccinia virus
ucuucaguucuaucuucuaa

SEQ ID NO: 4057229 - RNA, 14 nt, Vaccinia virus
ucuuccuacuaucu

SEQ ID NO: 4057230 - RNA, 16 nt, Vaccinia virus
ucuucggauauucuaa

SEQ ID NO: 4057231 - RNA, 19 nt, Vaccinia virus
ucuucguacgauccaaauu

SEQ ID NO: 4057232 - RNA, 13 nt, Vaccinia virus
ucuucuacaucuu

SEQ ID NO: 4057233 - RNA, 16 nt, Vaccinia virus
ucuucuacuauugcaa

SEQ ID NO: 4057234 - RNA, 14 nt, Vaccinia virus
ucuucuauuucuaa

SEQ ID NO: 4057235 - RNA, 13 nt, Vaccinia virus
ucuucucaaaaga

SEQ ID NO: 4057236 - RNA, 23 nt, Vaccinia virus
ucuucucguaggcgaaugauucc

SEQ ID NO: 4057237 - RNA, 14 nt, Vaccinia virus
ucuucuuauuuaga

SEQ ID NO: 4057238 - RNA, 14 nt, Vaccinia virus
ucuucuucuacauu

SEQ ID NO: 4057239 - RNA, 22 nt, Vaccinia virus
ucuugaggguuguguuaaauug

SEQ ID NO: 4057240 - RNA, 17 nt, Vaccinia virus
ucuugauacuauccagu

SEQ ID NO: 4057241 - RNA, 23 nt, Vaccinia virus
ucuugauuaccuggcucauugau

SEQ ID NO: 4057242 - RNA, 15 nt, Vaccinia virus
ucuuguaucauauau

SEQ ID NO: 4057243 - RNA, 15 nt, Vaccinia virus
ucuuguucaauggau

SEQ ID NO: 4057244 - RNA, 21 nt, Vaccinia virus
ucuuuaaacgauauucuugaa

SEQ ID NO: 4057245 - RNA, 15 nt, Vaccinia virus
ucuuuaacaaauucu

SEQ ID NO: 4057246 - RNA, 15 nt, Vaccinia virus
ucuuuaauacagaug

SEQ ID NO: 4057247 - RNA, 17 nt, Vaccinia virus
ucuuuaauagugucauu

SEQ ID NO: 4057248 - RNA, 21 nt, Vaccinia virus
ucuuuacaguuucuguaauga

SEQ ID NO: 4057249 - RNA, 22 nt, Vaccinia virus
ucuuuacaguuucuguaaugau

SEQ ID NO: 4057250 - RNA, 23 nt, Vaccinia virus
ucuuuaugacaucgccuacaaau

SEQ ID NO: 4057251 - RNA, 14 nt, Vaccinia virus
ucuuucaggaaagc

SEQ ID NO: 4057252 - RNA, 14 nt, Vaccinia virus
ucuuucguacaucu

SEQ ID NO: 4057253 - RNA, 17 nt, Vaccinia virus
ucuuucuaauacuauau

SEQ ID NO: 4057254 - RNA, 20 nt, Vaccinia virus
ucuuugaccaacgauuuaga

SEQ ID NO: 4057255 - RNA, 20 nt, Vaccinia virus
ucuuuggcucuucuaucaac

SEQ ID NO: 4057256 - RNA, 20 nt, Vaccinia virus
ucuuuguccauuauuucuau

SEQ ID NO: 4057257 - RNA, 20 nt, Vaccinia virus
ucuuuguugaacguuucaaa

SEQ ID NO: 4057258 - RNA, 19 nt, Vaccinia virus
ucuuuuucuacgucaaaau

SEQ ID NO: 4057259 - RNA, 14 nt, Vaccinia virus
ucuuuuuuacacau

SEQ ID NO: 4057260 - RNA, 15 nt, Vaccinia virus
ugaaaaaaauacuua

SEQ ID NO: 4057261 - RNA, 21 nt, Vaccinia virus
ugaaaacuaaaugguauacac

SEQ ID NO: 4057262 - RNA, 20 nt, Vaccinia virus
ugaaaaguucuaugaaaaac

SEQ ID NO: 4057263 - RNA, 22 nt, Vaccinia virus
ugaaaauggacguagaacaaga

SEQ ID NO: 4057264 - RNA, 14 nt, Vaccinia virus
ugaaacgaacacua

SEQ ID NO: 4057265 - RNA, 21 nt, Vaccinia virus
ugaaacgugucacaacuuauc

SEQ ID NO: 4057266 - RNA, 21 nt, Vaccinia virus
ugaaauagcguucgucaacau

SEQ ID NO: 4057267 - RNA, 19 nt, Vaccinia virus
ugaaaucaguggaguagua

SEQ ID NO: 4057268 - RNA, 20 nt, Vaccinia virus
ugaaaugauucucucaacau

SEQ ID NO: 4057269 - RNA, 13 nt, Vaccinia virus
ugaaauuaaucau

SEQ ID NO: 4057270 - RNA, 19 nt, Vaccinia virus
ugaacacacgaugaaaaug

SEQ ID NO: 4057271 - RNA, 13 nt, Vaccinia virus
ugaaccaaacauu

SEQ ID NO: 4057272 - RNA, 14 nt, Vaccinia virus
ugaacuuuaucuag

SEQ ID NO: 4057273 - RNA, 15 nt, Vaccinia virus
ugaagaaaguaauua

SEQ ID NO: 4057274 - RNA, 11 nt, Vaccinia virus
ugaagaaauga

SEQ ID NO: 4057275 - RNA, 21 nt, Vaccinia virus
ugaagaauuuauauaaaucau

SEQ ID NO: 4057276 - RNA, 21 nt, Vaccinia virus
ugaagauggauucauccuuaa

SEQ ID NO: 4057277 - RNA, 15 nt, Vaccinia virus
ugaagcauuggaagc

SEQ ID NO: 4057278 - RNA, 20 nt, Vaccinia virus
ugaagcauuggaagcaacua

SEQ ID NO: 4057279 - RNA, 22 nt, Vaccinia virus
ugaagcugguaaaguaaaucau

SEQ ID NO: 4057280 - RNA, 19 nt, Vaccinia virus
ugaauaaucagauuuaccc

SEQ ID NO: 4057281 - RNA, 12 nt, Vaccinia virus
ugaauaauguac

SEQ ID NO: 4057282 - RNA, 13 nt, Vaccinia virus
ugaauaauguacu

SEQ ID NO: 4057283 - RNA, 22 nt, Vaccinia virus
ugaauagcaaaaucuuuacuau

SEQ ID NO: 4057284 - RNA, 17 nt, Vaccinia virus
ugaauauaaaauaacua

SEQ ID NO: 4057285 - RNA, 16 nt, Vaccinia virus
ugaauauccagaugga

SEQ ID NO: 4057286 - RNA, 15 nt, Vaccinia virus
ugaauaucuacaaau

SEQ ID NO: 4057287 - RNA, 23 nt, Vaccinia virus
ugaauaucugcaauauauauuca

SEQ ID NO: 4057288 - RNA, 14 nt, Vaccinia virus
ugaauauuaaacaa

SEQ ID NO: 4057289 - RNA, 14 nt, Vaccinia virus
ugaaucaaauguaa

SEQ ID NO: 4057290 - RNA, 17 nt, Vaccinia virus
ugaaucuaaacuagugg

SEQ ID NO: 4057291 - RNA, 22 nt, Vaccinia virus
ugaaugaaggauuugaaucauc

SEQ ID NO: 4057292 - RNA, 21 nt, Vaccinia virus
ugaaugggaauuucuauguca

SEQ ID NO: 4057293 - RNA, 14 nt, Vaccinia virus
ugaauguauucacu

SEQ ID NO: 4057294 - RNA, 17 nt, Vaccinia virus
ugaauguucucaagaac

SEQ ID NO: 4057295 - RNA, 13 nt, Vaccinia virus
ugaauguuuucaa

SEQ ID NO: 4057296 - RNA, 16 nt, Vaccinia virus
ugaauucucauuuugc

SEQ ID NO: 4057297 - RNA, 18 nt, Vaccinia virus
ugaauucucauuuugcau

SEQ ID NO: 4057298 - RNA, 19 nt, Vaccinia virus
ugaauugaugaguuguaca

SEQ ID NO: 4057299 - RNA, 19 nt, Vaccinia virus
ugaauuuauaucuaagaua

SEQ ID NO: 4057300 - RNA, 13 nt, Vaccinia virus
ugacaauacugua

SEQ ID NO: 4057301 - RNA, 21 nt, Vaccinia virus
ugacaauauuauuaugaagac

SEQ ID NO: 4057302 - RNA, 16 nt, Vaccinia virus
ugacagcacagggagc

SEQ ID NO: 4057303 - RNA, 17 nt, Vaccinia virus
ugacauaauuacauaua

SEQ ID NO: 4057304 - RNA, 17 nt, Vaccinia virus
ugacaucauacuagaua

SEQ ID NO: 4057305 - RNA, 16 nt, Vaccinia virus
ugacaucgccuacaaa

SEQ ID NO: 4057306 - RNA, 15 nt, Vaccinia virus
ugacauuuuccuugu

SEQ ID NO: 4057307 - RNA, 14 nt, Vaccinia virus
ugacauuuuggauu

SEQ ID NO: 4057308 - RNA, 19 nt, Vaccinia virus
ugacauuuuggauucuguu

SEQ ID NO: 4057309 - RNA, 13 nt, Vaccinia virus
ugaccaacucauc

SEQ ID NO: 4057310 - RNA, 12 nt, Vaccinia virus
ugacgaagagac

SEQ ID NO: 4057311 - RNA, 21 nt, Vaccinia virus
ugacgacaauaacaaaaucac

SEQ ID NO: 4057312 - RNA, 16 nt, Vaccinia virus
ugacgacgaugauuga

SEQ ID NO: 4057313 - RNA, 23 nt, Vaccinia virus
ugacgaugaaaaugaugguacau

SEQ ID NO: 4057314 - RNA, 20 nt, Vaccinia virus
ugacgcauuuaauagagaua

SEQ ID NO: 4057315 - RNA, 21 nt, Vaccinia virus
ugacgcguuuccuacauaaca

SEQ ID NO: 4057316 - RNA, 13 nt, Vaccinia virus
ugacgcuguaaaa

SEQ ID NO: 4057317 - RNA, 19 nt, Vaccinia virus
ugacucgcaacaauuguag

SEQ ID NO: 4057318 - RNA, 16 nt, Vaccinia virus
ugacuggaguguauau

SEQ ID NO: 4057319 - RNA, 11 nt, Vaccinia virus
ugacuuucaaa

SEQ ID NO: 4057320 - RNA, 23 nt, Vaccinia virus
ugagaauccgcuacauauuauug

SEQ ID NO: 4057321 - RNA, 16 nt, Vaccinia virus
ugagacgauguaucca

SEQ ID NO: 4057322 - RNA, 23 nt, Vaccinia virus
ugagauuuguuuuguuaaacaau

SEQ ID NO: 4057323 - RNA, 17 nt, Vaccinia virus
ugagcaaagauuguucu

SEQ ID NO: 4057324 - RNA, 15 nt, Vaccinia virus
ugagcaauucccaag

SEQ ID NO: 4057325 - RNA, 20 nt, Vaccinia virus
uggaauccaauuguuugaua

SEQ ID NO: 4057326 - RNA, 21 nt, Vaccinia virus
uggaauucaguuggaauauug

SEQ ID NO: 4057327 - RNA, 14 nt, Vaccinia virus
uggacaacauuaau

SEQ ID NO: 4057328 - RNA, 19 nt, Vaccinia virus
uggacgacgguaagaauga

SEQ ID NO: 4057329 - RNA, 20 nt, Vaccinia virus
uggaggaauuuauagaugcu

SEQ ID NO: 4057330 - RNA, 16 nt, Vaccinia virus
uggaguaccaguuuca

SEQ ID NO: 4057331 - RNA, 14 nt, Vaccinia virus
cuauaguuaauuga

SEQ ID NO: 4057332 - RNA, 17 nt, Vaccinia virus
cuauaguuuuauugcuu

SEQ ID NO: 4057333 - RNA, 20 nt, Vaccinia virus
cuauauauaccuuuccagua

SEQ ID NO: 4057334 - RNA, 16 nt, Vaccinia virus
cuauaucaaugccuuu

SEQ ID NO: 4057335 - RNA, 20 nt, Vaccinia virus
cuauauuuguuccuguagau

SEQ ID NO: 4057336 - RNA, 19 nt, Vaccinia virus
cuaucaaaauauguagaaa

SEQ ID NO: 4057337 - RNA, 23 nt, Vaccinia virus
cuaucgaaaauugcuauuucaga

SEQ ID NO: 4057338 - RNA, 21 nt, Vaccinia virus
cuaucgaugauagcacuguua

SEQ ID NO: 4057339 - RNA, 19 nt, Vaccinia virus
cuaucuaugcgguagauag

SEQ ID NO: 4057340 - RNA, 14 nt, Vaccinia virus
cuaucucuguaaac

SEQ ID NO: 4057341 - RNA, 17 nt, Vaccinia virus
cuaugacuucaucaucu

SEQ ID NO: 4057342 - RNA, 15 nt, Vaccinia virus
cuaugguacaaguug

SEQ ID NO: 4057343 - RNA, 17 nt, Vaccinia virus
cuaugucucuuauuaga

SEQ ID NO: 4057344 - RNA, 17 nt, Vaccinia virus
cuauguuccucguuucc

SEQ ID NO: 4057345 - RNA, 14 nt, Vaccinia virus
cuauguuguuuaug

SEQ ID NO: 4057346 - RNA, 21 nt, Vaccinia virus
cuauguuuccccuauaaucuu

SEQ ID NO: 4057347 - RNA, 16 nt, Vaccinia virus
cuauuaagaguaacag

SEQ ID NO: 4057348 - RNA, 15 nt, Vaccinia virus
cuauuaauaauuacu

SEQ ID NO: 4057349 - RNA, 17 nt, Vaccinia virus
cuauuagaauuuacaaa

SEQ ID NO: 4057350 - RNA, 16 nt, Vaccinia virus
cuauuaucaaauacug

SEQ ID NO: 4057351 - RNA, 16 nt, Vaccinia virus
gaaccaauuacugaua

SEQ ID NO: 4057352 - RNA, 17 nt, Vaccinia virus
gaaccagauaguuuaua

SEQ ID NO: 4057353 - RNA, 18 nt, Vaccinia virus
gaaccaguaacauaugau

SEQ ID NO: 4057354 - RNA, 15 nt, Vaccinia virus
gaaccauuacaaaua

SEQ ID NO: 4057355 - RNA, 14 nt, Vaccinia virus
gaacgauaaacaaa

SEQ ID NO: 4057356 - RNA, 17 nt, Vaccinia virus
gaacgaugucaaaauau

SEQ ID NO: 4057357 - RNA, 13 nt, Vaccinia virus
gaacgccauaaua

SEQ ID NO: 4057358 - RNA, 17 nt, Vaccinia virus
gaacguaaauuaguuca

SEQ ID NO: 4057359 - RNA, 13 nt, Vaccinia virus
gaacuaagagaaa

SEQ ID NO: 4057360 - RNA, 13 nt, Vaccinia virus
gaacuaauaugau

SEQ ID NO: 4057361 - RNA, 17 nt, Vaccinia virus
gaacuagauauauuaau

SEQ ID NO: 4057362 - RNA, 19 nt, Vaccinia virus
gaacuauaaaacuacuaca

SEQ ID NO: 4057363 - RNA, 14 nt, Vaccinia virus
gaacucauguagca

SEQ ID NO: 4057364 - RNA, 16 nt, Vaccinia virus
gaacucgauacuaucg

SEQ ID NO: 4057365 - RNA, 16 nt, Vaccinia virus
gaacucuuugauuuug

SEQ ID NO: 4057366 - RNA, 18 nt, Vaccinia virus
gaacuggaccguauaucu

SEQ ID NO: 4057367 - RNA, 18 nt, Vaccinia virus
gaagaacgguagaaacua

SEQ ID NO: 4057368 - RNA, 22 nt, Vaccinia virus
gaagaacguguauuaaauagaa

SEQ ID NO: 4057369 - RNA, 23 nt, Vaccinia virus
gaagaauggaaaccuuuaaucua

SEQ ID NO: 4057370 - RNA, 17 nt, Vaccinia virus
gaagaauuaauaaacaa

SEQ ID NO: 4057371 - RNA, 14 nt, Vaccinia virus
gaagaauuucuguu

SEQ ID NO: 4057372 - RNA, 14 nt, Vaccinia virus
gaagacuccuggua

SEQ ID NO: 4057373 - RNA, 22 nt, Vaccinia virus
gaagagacgccucguuccaagu

SEQ ID NO: 4057374 - RNA, 15 nt, Vaccinia virus
gaagagauguuauau

SEQ ID NO: 4057375 - RNA, 22 nt, Vaccinia virus
gaagagauuccugacuuugcau

SEQ ID NO: 4057376 - RNA, 16 nt, Vaccinia virus
gaagaugcgcauucca

SEQ ID NO: 4057377 - RNA, 16 nt, Vaccinia virus
gaagauguuagaaaaa

SEQ ID NO: 4057378 - RNA, 20 nt, Vaccinia virus
gaagauuuaacuagauuaua

SEQ ID NO: 4057379 - RNA, 13 nt, Vaccinia virus
gaaggaauucuuu

SEQ ID NO: 4057380 - RNA, 18 nt, Vaccinia virus
gaaggagacggauacugu

SEQ ID NO: 4057381 - RNA, 21 nt, Vaccinia virus
gaaggauuggucuuaaaagau

SEQ ID NO: 4057382 - RNA, 16 nt, Vaccinia virus
gaaguggauauacaua

SEQ ID NO: 4057383 - RNA, 19 nt, Vaccinia virus
gcuauugaaacugacggau

SEQ ID NO: 4057384 - RNA, 14 nt, Vaccinia virus
gcuauuuugacaua

SEQ ID NO: 4057385 - RNA, 16 nt, Vaccinia virus
gcucaaacaaaaugug

SEQ ID NO: 4057386 - RNA, 19 nt, Vaccinia virus
gcucuaccgcaguuagcca

SEQ ID NO: 4057387 - RNA, 16 nt, Vaccinia virus
gcugaaugaucuuuuu

SEQ ID NO: 4057388 - RNA, 23 nt, Vaccinia virus
gcugaauguaucuuccacaucaa

SEQ ID NO: 4057389 - RNA, 21 nt, Vaccinia virus
gcugagaauaucuuuauucau

SEQ ID NO: 4057390 - RNA, 16 nt, Vaccinia virus
gcugaggguguuagaa

SEQ ID NO: 4057391 - RNA, 15 nt, Vaccinia virus
gcugcagcauauaac

SEQ ID NO: 4057392 - RNA, 14 nt, Vaccinia virus
gcugguaaaguaaa

SEQ ID NO: 4057393 - RNA, 12 nt, Vaccinia virus
gcuguaaacaag

SEQ ID NO: 4057394 - RNA, 19 nt, Vaccinia virus
gcuguggaguuauaugaau

SEQ ID NO: 4057395 - RNA, 12 nt, Vaccinia virus
gcuguucaaaau

SEQ ID NO: 4057396 - RNA, 19 nt, Vaccinia virus
gcuguuccucuguaaauaa

SEQ ID NO: 4057397 - RNA, 16 nt, Vaccinia virus
gcuuagaaauaaacga

SEQ ID NO: 4057398 - RNA, 20 nt, Vaccinia virus
gcuuagcuaauccugauauu

SEQ ID NO: 4057399 - RNA, 23 nt, Vaccinia virus
gcuucaaucgcgcguuagaaauu

SEQ ID NO: 4057400 - RNA, 22 nt, Vaccinia virus
gcuuccagauacagugauuuug

SEQ ID NO: 4057401 - RNA, 18 nt, Vaccinia virus
gcuucuaucuuguuuaga

SEQ ID NO: 4057402 - RNA, 23 nt, Vaccinia virus
gcuucuuaaaucagaauguuaca

SEQ ID NO: 4057403 - RNA, 18 nt, Vaccinia virus
gcuugauaauuagauaua

SEQ ID NO: 4057404 - RNA, 14 nt, Vaccinia virus
gcuuuucucuuuua

SEQ ID NO: 4057405 - RNA, 15 nt, Vaccinia virus
gcuuuucucuuuuaa

SEQ ID NO: 4057406 - RNA, 22 nt, Vaccinia virus
gcuuuugcgaucaauaaaugga

SEQ ID NO: 4057407 - RNA, 11 nt, Vaccinia virus
ggaaaaagcuc

SEQ ID NO: 4057408 - RNA, 19 nt, Vaccinia virus
ggaaaaaguguugaagaua

SEQ ID NO: 4057409 - RNA, 12 nt, Vaccinia virus
ggaaaaaugaug

SEQ ID NO: 4057410 - RNA, 21 nt, Vaccinia virus
ggaaaaauuauaauguuuccu

SEQ ID NO: 4057411 - RNA, 16 nt, Vaccinia virus
ggaaacuuucuagaac

SEQ ID NO: 4057412 - RNA, 17 nt, Vaccinia virus
ggaaaguucaaaaaguc

SEQ ID NO: 4057413 - RNA, 18 nt, Vaccinia virus
ggaaauuuaugaagaugu

SEQ ID NO: 4057414 - RNA, 16 nt, Vaccinia virus
ggaaccucgagaaugu

SEQ ID NO: 4057415 - RNA, 18 nt, Vaccinia virus
ggaacgugauaguuucuc

SEQ ID NO: 4057416 - RNA, 14 nt, Vaccinia virus
ggaagaguaggaag

SEQ ID NO: 4057417 - RNA, 18 nt, Vaccinia virus
ggaauaaauuauuaucca

SEQ ID NO: 4057418 - RNA, 14 nt, Vaccinia virus
ggaauuguauuuuc

SEQ ID NO: 4057419 - RNA, 23 nt, Vaccinia virus
ggagaauacaaagcguacagaua

SEQ ID NO: 4057420 - RNA, 12 nt, Vaccinia virus
ggagaauguuuc

SEQ ID NO: 4057421 - RNA, 22 nt, Vaccinia virus
ggagauuauagcaauaugugua

SEQ ID NO: 4057422 - RNA, 15 nt, Vaccinia virus
ggaguaaauauacaa

SEQ ID NO: 4057423 - RNA, 14 nt, Vaccinia virus
ggaguuauaugaau

SEQ ID NO: 4057424 - RNA, 16 nt, Vaccinia virus
ggauaaccuagaaaau

SEQ ID NO: 4057425 - RNA, 18 nt, Vaccinia virus
ggauaccaguuuggaaac

SEQ ID NO: 4057426 - RNA, 16 nt, Vaccinia virus
ggaucuaguauuauug

SEQ ID NO: 4057427 - RNA, 16 nt, Vaccinia virus
ggaucuccuauuucuu

SEQ ID NO: 4057428 - RNA, 19 nt, Vaccinia virus
ggaucugacucggacucug

SEQ ID NO: 4057429 - RNA, 22 nt, Vaccinia virus
ggaugaccauauauuuauuuuc

SEQ ID NO: 4057430 - RNA, 13 nt, Vaccinia virus
ggaugccacugcu

SEQ ID NO: 4057431 - RNA, 22 nt, Vaccinia virus
ggaugucaucaauguagaaaau

SEQ ID NO: 4057432 - RNA, 13 nt, Vaccinia virus
ggauuaacagguu

SEQ ID NO: 4057433 - RNA, 19 nt, Vaccinia virus
cuauuaucuccguuauaga

SEQ ID NO: 4057434 - RNA, 23 nt, Vaccinia virus
cuauuauguuaacggaaaguauu

SEQ ID NO: 4057435 - RNA, 18 nt, Vaccinia virus
cuauugauugaguacugu

SEQ ID NO: 4057436 - RNA, 16 nt, Vaccinia virus
cuauuggcaauuguag

SEQ ID NO: 4057437 - RNA, 14 nt, Vaccinia virus
cuauuucguccaua

SEQ ID NO: 4057438 - RNA, 16 nt, Vaccinia virus
cuauuuguauaauaau

SEQ ID NO: 4057439 - RNA, 13 nt, Vaccinia virus
cuauuuuaauagg

SEQ ID NO: 4057440 - RNA, 15 nt, Vaccinia virus
cuauuuuaucauuuu

SEQ ID NO: 4057441 - RNA, 19 nt, Vaccinia virus
cuauuuucgcuccaaaugu

SEQ ID NO: 4057442 - RNA, 15 nt, Vaccinia virus
cuauuuuuacaguac

SEQ ID NO: 4057443 - RNA, 19 nt, Vaccinia virus
cucaaucacuacaucuuua

SEQ ID NO: 4057444 - RNA, 15 nt, Vaccinia virus
cucaauuaguuuauu

SEQ ID NO: 4057445 - RNA, 17 nt, Vaccinia virus
cucacauccuuuauuuu

SEQ ID NO: 4057446 - RNA, 11 nt, Vaccinia virus
cucacauuuca

SEQ ID NO: 4057447 - RNA, 22 nt, Vaccinia virus
cucagauucaguuucucaucuu

SEQ ID NO: 4057448 - RNA, 21 nt, Vaccinia virus
cucagucaauauauuaagaag

SEQ ID NO: 4057449 - RNA, 21 nt, Vaccinia virus
cucauaagaugauaaaaagug

SEQ ID NO: 4057450 - RNA, 20 nt, Vaccinia virus
cucauagaccuguaguuuua

SEQ ID NO: 4057451 - RNA, 18 nt, Vaccinia virus
cucauauaacuucuagau

SEQ ID NO: 4057452 - RNA, 14 nt, Vaccinia virus
cucauuaaaaauuu

SEQ ID NO: 4057453 - RNA, 16 nt, Vaccinia virus
cucauuaaaacuucua

SEQ ID NO: 4057454 - RNA, 21 nt, Vaccinia virus
cucauuacauaguugauaaaa

SEQ ID NO: 4057455 - RNA, 15 nt, Vaccinia virus
cucauuuucucuuuc

SEQ ID NO: 4057456 - RNA, 16 nt, Vaccinia virus
cuccaaguucuauagu

SEQ ID NO: 4057457 - RNA, 14 nt, Vaccinia virus
cuccaaucaugugu

SEQ ID NO: 4057458 - RNA, 18 nt, Vaccinia virus
cuccacaguuuuuaauuu

SEQ ID NO: 4057459 - RNA, 23 nt, Vaccinia virus
cucccauggaaugacccaauaag

SEQ ID NO: 4057460 - RNA, 12 nt, Vaccinia virus
cucccuuuagau

SEQ ID NO: 4057461 - RNA, 20 nt, Vaccinia virus
cuccuacaggaauaucuuua

SEQ ID NO: 4057462 - RNA, 15 nt, Vaccinia virus
cuccucauauggauc

SEQ ID NO: 4057463 - RNA, 17 nt, Vaccinia virus
cucguaagauaaaguuu

SEQ ID NO: 4057464 - RNA, 12 nt, Vaccinia virus
cucguucaucua

SEQ ID NO: 4057465 - RNA, 11 nt, Vaccinia virus
cucuaaaugag

SEQ ID NO: 4057466 - RNA, 12 nt, Vaccinia virus
cucuaaaugagu

SEQ ID NO: 4057467 - RNA, 21 nt, Vaccinia virus
cucuaaaugagucuacugcua

SEQ ID NO: 4057468 - RNA, 22 nt, Vaccinia virus
cucuagguaacaaacaaacucu

SEQ ID NO: 4057469 - RNA, 15 nt, Vaccinia virus
cucuauaaaaaugaa

SEQ ID NO: 4057470 - RNA, 14 nt, Vaccinia virus
cucuauauuacaaa

SEQ ID NO: 4057471 - RNA, 17 nt, Vaccinia virus
cucuauucgaaaacucu

SEQ ID NO: 4057472 - RNA, 18 nt, Vaccinia virus
cucuauuucuuaaugaau

SEQ ID NO: 4057473 - RNA, 22 nt, Vaccinia virus
cucucgaaagacguuguacaau

SEQ ID NO: 4057474 - RNA, 14 nt, Vaccinia virus
cucugaaucucugu

SEQ ID NO: 4057475 - RNA, 19 nt, Vaccinia virus
cucugauagcaguuucaau

SEQ ID NO: 4057476 - RNA, 17 nt, Vaccinia virus
cucuuccgucaccaaaa

SEQ ID NO: 4057477 - RNA, 18 nt, Vaccinia virus
cucuuuaacgaaauuaaa

SEQ ID NO: 4057478 - RNA, 17 nt, Vaccinia virus
cucuuucgcuauuucua

SEQ ID NO: 4057479 - RNA, 13 nt, Vaccinia virus
cucuuucuccuuc

SEQ ID NO: 4057480 - RNA, 14 nt, Vaccinia virus
cucuuucuccuuuc

SEQ ID NO: 4057481 - RNA, 15 nt, Vaccinia virus
cugaaaaagauauca

SEQ ID NO: 4057482 - RNA, 20 nt, Vaccinia virus
cugaaaaagauaucagagaa

SEQ ID NO: 4057483 - RNA, 16 nt, Vaccinia virus
cugaaaagaaaguauc

SEQ ID NO: 4057484 - RNA, 17 nt, Vaccinia virus
cugaaacaguaugauuu

SEQ ID NO: 4057485 - RNA, 16 nt, Vaccinia virus
cugaaauaauuagaac

SEQ ID NO: 4057486 - RNA, 23 nt, Vaccinia virus
cugaacacgauguuuauggaguu

SEQ ID NO: 4057487 - RNA, 19 nt, Vaccinia virus
cugaacuugaggucaagga

SEQ ID NO: 4057488 - RNA, 21 nt, Vaccinia virus
cugaagauuguugaaauugua

SEQ ID NO: 4057489 - RNA, 14 nt, Vaccinia virus
cugaauaaaacauc

SEQ ID NO: 4057490 - RNA, 16 nt, Vaccinia virus
cugaauauauugauuu

SEQ ID NO: 4057491 - RNA, 14 nt, Vaccinia virus
cugacauucagaaa

SEQ ID NO: 4057492 - RNA, 18 nt, Vaccinia virus
cugacuagcaaauccagc

SEQ ID NO: 4057493 - RNA, 15 nt, Vaccinia virus
cugacucauggauuc

SEQ ID NO: 4057494 - RNA, 21 nt, Vaccinia virus
cugauaagauaucuucucaaa

SEQ ID NO: 4057495 - RNA, 17 nt, Vaccinia virus
cugauagcaguuucaau

SEQ ID NO: 4057496 - RNA, 20 nt, Vaccinia virus
cugauaucauuaaugauaua

SEQ ID NO: 4057497 - RNA, 13 nt, Vaccinia virus
cugaugaaacauu

SEQ ID NO: 4057498 - RNA, 14 nt, Vaccinia virus
cugaugaaacauuu

SEQ ID NO: 4057499 - RNA, 17 nt, Vaccinia virus
cugauuauuuacuauaa

SEQ ID NO: 4057500 - RNA, 20 nt, Vaccinia virus
cugauuuauguuuuaaauau

SEQ ID NO: 4057501 - RNA, 14 nt, Vaccinia virus
cugcaauauauauu

SEQ ID NO: 4057502 - RNA, 15 nt, Vaccinia virus
cugcagcauuuugag

SEQ ID NO: 4057503 - RNA, 18 nt, Vaccinia virus
cugcgacggagcauuuuc

SEQ ID NO: 4057504 - RNA, 21 nt, Vaccinia virus
cugcggauauaaagucaucgu

SEQ ID NO: 4057505 - RNA, 23 nt, Vaccinia virus
cugcuggaaaauaaaucacugac

SEQ ID NO: 4057506 - RNA, 19 nt, Vaccinia virus
cuggaauuaguuagauaua

SEQ ID NO: 4057507 - RNA, 17 nt, Vaccinia virus
cuggaggagauggauua

SEQ ID NO: 4057508 - RNA, 13 nt, Vaccinia virus
cuggauauguuuu

SEQ ID NO: 4057509 - RNA, 14 nt, Vaccinia virus
cuggcauuaucuau

SEQ ID NO: 4057510 - RNA, 18 nt, Vaccinia virus
cuggggauggucuauaca

SEQ ID NO: 4057511 - RNA, 17 nt, Vaccinia virus
cugggguaaaguaagua

SEQ ID NO: 4057512 - RNA, 22 nt, Vaccinia virus
cugguagagaaugauauagaaa

SEQ ID NO: 4057513 - RNA, 18 nt, Vaccinia virus
cuggucuaaaauuuccau

SEQ ID NO: 4057514 - RNA, 20 nt, Vaccinia virus
cuggugauuggguagaagua

SEQ ID NO: 4057515 - RNA, 15 nt, Vaccinia virus
cuguaaagaacagug

SEQ ID NO: 4057516 - RNA, 15 nt, Vaccinia virus
cuguaaguauguuua

SEQ ID NO: 4057517 - RNA, 17 nt, Vaccinia virus
cuguacaccauagcacu

SEQ ID NO: 4057518 - RNA, 17 nt, Vaccinia virus
cuguaccaaagucauca

SEQ ID NO: 4057519 - RNA, 19 nt, Vaccinia virus
cuguagaaugcgaaggaag

SEQ ID NO: 4057520 - RNA, 17 nt, Vaccinia virus
cuguauguacaacagug

SEQ ID NO: 4057521 - RNA, 14 nt, Vaccinia virus
cugucaauaagaca

SEQ ID NO: 4057522 - RNA, 13 nt, Vaccinia virus
cugucuaaaugua

SEQ ID NO: 4057523 - RNA, 12 nt, Vaccinia virus
cugucugcuggc

SEQ ID NO: 4057524 - RNA, 19 nt, Vaccinia virus
cuguguaaagaaaugguaa

SEQ ID NO: 4057525 - RNA, 13 nt, Vaccinia virus
cuguuauuuugaa

SEQ ID NO: 4057526 - RNA, 15 nt, Vaccinia virus
cuguucauaaauaaa

SEQ ID NO: 4057527 - RNA, 16 nt, Vaccinia virus
cuguucuccguguggu

SEQ ID NO: 4057528 - RNA, 15 nt, Vaccinia virus
cuguugaaguacuua

SEQ ID NO: 4057529 - RNA, 23 nt, Vaccinia virus
cuguuguauaugaucauuuugau

SEQ ID NO: 4057530 - RNA, 18 nt, Vaccinia virus
cuguuuuaacaucuuuuu

SEQ ID NO: 4057531 - RNA, 18 nt, Vaccinia virus
cuguuuucucaucacuua

SEQ ID NO: 4057532 - RNA, 17 nt, Vaccinia virus
cuuaaaaacuauaccau

SEQ ID NO: 4057533 - RNA, 20 nt, Vaccinia virus
cuuaaaauuuaaaaugauau

SEQ ID NO: 4057534 - RNA, 15 nt, Vaccinia virus
cuuaaauauuucuac

SEQ ID NO: 4057535 - RNA, 20 nt, Vaccinia virus
cuuaaauguaucuuuacuag

SEQ ID NO: 4057536 - RNA, 14 nt, Vaccinia virus
cuuaacaaaaauua

SEQ ID NO: 4057537 - RNA, 19 nt, Vaccinia virus
cuuaacaguuccacaaauu

SEQ ID NO: 4057538 - RNA, 19 nt, Vaccinia virus
cuuaacaugagacauaaau

SEQ ID NO: 4057539 - RNA, 23 nt, Vaccinia virus
cuuaacgaaagaaguuguaucau

SEQ ID NO: 4057540 - RNA, 15 nt, Vaccinia virus
cuuaacuuguaauaa

SEQ ID NO: 4057541 - RNA, 17 nt, Vaccinia virus
cuuaacuuguaauaauu

SEQ ID NO: 4057542 - RNA, 18 nt, Vaccinia virus
cuuaauacagauugcacu

SEQ ID NO: 4057543 - RNA, 14 nt, Vaccinia virus
cuuaauuauaacga

SEQ ID NO: 4057544 - RNA, 16 nt, Vaccinia virus
cuuacaaauauucaca

SEQ ID NO: 4057545 - RNA, 12 nt, Vaccinia virus
cuuacaauaaac

SEQ ID NO: 4057546 - RNA, 21 nt, Vaccinia virus
cuuacaauccguguuauuuua

SEQ ID NO: 4057547 - RNA, 16 nt, Vaccinia virus
cuuaccuucaacagua

SEQ ID NO: 4057548 - RNA, 21 nt, Vaccinia virus
cuuauaaaacuauauuuggaa

SEQ ID NO: 4057549 - RNA, 22 nt, Vaccinia virus
cuuauauaccgccucaaacucu

SEQ ID NO: 4057550 - RNA, 13 nt, Vaccinia virus
cuuaucaauaaca

SEQ ID NO: 4057551 - RNA, 13 nt, Vaccinia virus
cuuaucgacaucu

SEQ ID NO: 4057552 - RNA, 16 nt, Vaccinia virus
cuuauguaugugcauu

SEQ ID NO: 4057553 - RNA, 18 nt, Vaccinia virus
cuuauuccauuaucugaa

SEQ ID NO: 4057554 - RNA, 22 nt, Vaccinia virus
cuuauucuuuguauuuuggcau

SEQ ID NO: 4057555 - RNA, 22 nt, Vaccinia virus
cuuauugaguggaaaguucaaa

SEQ ID NO: 4057556 - RNA, 22 nt, Vaccinia virus
cuuauuggucagaaauauugua

SEQ ID NO: 4057557 - RNA, 19 nt, Vaccinia virus
cuucagacaacaucucaga

SEQ ID NO: 4057558 - RNA, 23 nt, Vaccinia virus
cuucagacagccaaucaaaaaga

SEQ ID NO: 4057559 - RNA, 21 nt, Vaccinia virus
cuucaucggcuuuaacaauug

SEQ ID NO: 4057560 - RNA, 20 nt, Vaccinia virus
caaaaauuuuuuauuucagc

SEQ ID NO: 4057561 - RNA, 22 nt, Vaccinia virus
caaaacguaaucauagaugaau

SEQ ID NO: 4057562 - RNA, 15 nt, Vaccinia virus
caaaacuauuucaga

SEQ ID NO: 4057563 - RNA, 15 nt, Vaccinia virus
caaaacugaaaauau

SEQ ID NO: 4057564 - RNA, 22 nt, Vaccinia virus
caaaagacuaugggaauauauu

SEQ ID NO: 4057565 - RNA, 23 nt, Vaccinia virus
caaaaggacguagacaauacuuu

SEQ ID NO: 4057566 - RNA, 14 nt, Vaccinia virus
caaaaguccaugau

SEQ ID NO: 4057567 - RNA, 16 nt, Vaccinia virus
caaaaguccaugauca

SEQ ID NO: 4057568 - RNA, 14 nt, Vaccinia virus
caaaauacauaauu

SEQ ID NO: 4057569 - RNA, 19 nt, Vaccinia virus
caaaauauguuucaaucau

SEQ ID NO: 4057570 - RNA, 15 nt, Vaccinia virus
caauuucauaaugag

SEQ ID NO: 4057571 - RNA, 23 nt, Vaccinia virus
caauuugcuucagcggauccugu

SEQ ID NO: 4057572 - RNA, 18 nt, Vaccinia virus
caauuuuaacagauguau

SEQ ID NO: 4057573 - RNA, 21 nt, Vaccinia virus
caauuuuacccucaaucaugu

SEQ ID NO: 4057574 - RNA, 21 nt, Vaccinia virus
caauuuuguauuauucugaau

SEQ ID NO: 4057575 - RNA, 22 nt, Vaccinia virus
caauuuuuagcaccauuaucuu

SEQ ID NO: 4057576 - RNA, 21 nt, Vaccinia virus
caauuuuucagauuuuugaau

SEQ ID NO: 4057577 - RNA, 14 nt, Vaccinia virus
caauuuuuuguucu

SEQ ID NO: 4057578 - RNA, 14 nt, Vaccinia virus
cacaacaauaacag

SEQ ID NO: 4057579 - RNA, 19 nt, Vaccinia virus
cacaacacaaugacuuaua

SEQ ID NO: 4057580 - RNA, 22 nt, Vaccinia virus
cacaagccauuguugucugaaa

SEQ ID NO: 4057581 - RNA, 17 nt, Vaccinia virus
cacacauuuaugauaug

SEQ ID NO: 4057582 - RNA, 20 nt, Vaccinia virus
cacacgaggacuauguuugg

SEQ ID NO: 4057583 - RNA, 17 nt, Vaccinia virus
cacagauagaucauuuu

SEQ ID NO: 4057584 - RNA, 15 nt, Vaccinia virus
cacauaauuauucua

SEQ ID NO: 4057585 - RNA, 15 nt, Vaccinia virus
cacauacaaaacuag

SEQ ID NO: 4057586 - RNA, 12 nt, Vaccinia virus
cacauagaauaa

SEQ ID NO: 4057587 - RNA, 20 nt, Vaccinia virus
cacauauggaauauaucuau

SEQ ID NO: 4057588 - RNA, 16 nt, Vaccinia virus
cacauauuuuaaugaa

SEQ ID NO: 4057589 - RNA, 12 nt, Vaccinia virus
cacauuaaacaa

SEQ ID NO: 4057590 - RNA, 20 nt, Vaccinia virus
caccagaauagcuauggauu

SEQ ID NO: 4057591 - RNA, 15 nt, Vaccinia virus
cacgaaauaucucau

SEQ ID NO: 4057592 - RNA, 15 nt, Vaccinia virus
cacgagaacuauuaa

SEQ ID NO: 4057593 - RNA, 21 nt, Vaccinia virus
cacguaaccauucuaaacaau

SEQ ID NO: 4057594 - RNA, 16 nt, Vaccinia virus
cacguaccagcauuug

SEQ ID NO: 4057595 - RNA, 14 nt, Vaccinia virus
cacguuuaaacauu

SEQ ID NO: 4057596 - RNA, 13 nt, Vaccinia virus
cacguuugaacag

SEQ ID NO: 4057597 - RNA, 20 nt, Vaccinia virus
cacuaauaucgauauacaaa

SEQ ID NO: 4057598 - RNA, 13 nt, Vaccinia virus
cacuagaugauuu

SEQ ID NO: 4057599 - RNA, 14 nt, Vaccinia virus
cacuauaugcaguu

SEQ ID NO: 4057600 - RNA, 14 nt, Vaccinia virus
cacuauucauguaa

SEQ ID NO: 4057601 - RNA, 15 nt, Vaccinia virus
cacucucgaaaucac

SEQ ID NO: 4057602 - RNA, 13 nt, Vaccinia virus
cacugcagcauuu

SEQ ID NO: 4057603 - RNA, 23 nt, Vaccinia virus
cacugggguaaaguaaguauuua

SEQ ID NO: 4057604 - RNA, 19 nt, Vaccinia virus
cacuggugucagacugugc

SEQ ID NO: 4057605 - RNA, 19 nt, Vaccinia virus
cacuuaaugguauaaugau

SEQ ID NO: 4057606 - RNA, 16 nt, Vaccinia virus
cacuucuauaguaucu

SEQ ID NO: 4057607 - RNA, 18 nt, Vaccinia virus
cacuuuuuuauaaagaug

SEQ ID NO: 4057608 - RNA, 18 nt, Vaccinia virus
cagaaacuguaaagaaca

SEQ ID NO: 4057609 - RNA, 21 nt, Vaccinia virus
cagaaauauaugagauguagu

SEQ ID NO: 4057610 - RNA, 12 nt, Vaccinia virus
cagaaaugauuu

SEQ ID NO: 4057611 - RNA, 22 nt, Vaccinia virus
cagaaauggaagaguuaaugaa

SEQ ID NO: 4057612 - RNA, 21 nt, Vaccinia virus
cagaacgaauuaugauagaaa

SEQ ID NO: 4057613 - RNA, 14 nt, Vaccinia virus
cagaagauaaugaa

SEQ ID NO: 4057614 - RNA, 14 nt, Vaccinia virus
cagaagcaauaaau

SEQ ID NO: 4057615 - RNA, 15 nt, Vaccinia virus
cagaauagagccaaa

SEQ ID NO: 4057616 - RNA, 22 nt, Vaccinia virus
cagaauagccgauauagauauu

SEQ ID NO: 4057617 - RNA, 18 nt, Vaccinia virus
cagaauauauaagacaca

SEQ ID NO: 4057618 - RNA, 15 nt, Vaccinia virus
cagaauguacacuau

SEQ ID NO: 4057619 - RNA, 13 nt, Vaccinia virus
cagaauguuacag

SEQ ID NO: 4057620 - RNA, 14 nt, Vaccinia virus
cagacaaugcuuua

SEQ ID NO: 4057621 - RNA, 14 nt, Vaccinia virus
cagaccucucuuaa

SEQ ID NO: 4057622 - RNA, 17 nt, Vaccinia virus
cagagccaucuguaaaa

SEQ ID NO: 4057623 - RNA, 16 nt, Vaccinia virus
cagaggaugaaauaga

SEQ ID NO: 4057624 - RNA, 15 nt, Vaccinia virus
cagaggauugauggu

SEQ ID NO: 4057625 - RNA, 19 nt, Vaccinia virus
cagagguuaauauagaagc

SEQ ID NO: 4057626 - RNA, 14 nt, Vaccinia virus
cagaguuuagauua

SEQ ID NO: 4057627 - RNA, 22 nt, Vaccinia virus
cagauaaucugaaaaugaaauu

SEQ ID NO: 4057628 - RNA, 15 nt, Vaccinia virus
cagauacagauacag

SEQ ID NO: 4057629 - RNA, 16 nt, Vaccinia virus
cagauacaguuaauau

SEQ ID NO: 4057630 - RNA, 18 nt, Vaccinia virus
cagauauggucaaaucaa

SEQ ID NO: 4057631 - RNA, 15 nt, Vaccinia virus
cagauauuuuaguuu

SEQ ID NO: 4057632 - RNA, 13 nt, Vaccinia virus
cagaugucauuau

SEQ ID NO: 4057633 - RNA, 18 nt, Vaccinia virus
cagauuuaacaauuucua

SEQ ID NO: 4057634 - RNA, 13 nt, Vaccinia virus
cagcauguauguu

SEQ ID NO: 4057635 - RNA, 21 nt, Vaccinia virus
cagccuuaauuuuuucaugau

SEQ ID NO: 4057636 - RNA, 17 nt, Vaccinia virus
cagcggcuauuaauaau

SEQ ID NO: 4057637 - RNA, 16 nt, Vaccinia virus
cagcgugaauaaugua

SEQ ID NO: 4057638 - RNA, 20 nt, Vaccinia virus
cagcuaucgcuuacgcauuu

SEQ ID NO: 4057639 - RNA, 16 nt, Vaccinia virus
caggaauaugacuauu

SEQ ID NO: 4057640 - RNA, 17 nt, Vaccinia virus
caggauacuaugcuauu

SEQ ID NO: 4057641 - RNA, 19 nt, Vaccinia virus
caggaucuccaacaaauuu

SEQ ID NO: 4057642 - RNA, 21 nt, Vaccinia virus
caggauuccuauucauuuuga

SEQ ID NO: 4057643 - RNA, 16 nt, Vaccinia virus
cagguaggcaguuuua

SEQ ID NO: 4057644 - RNA, 15 nt, Vaccinia virus
cagguuauccagaag

SEQ ID NO: 4057645 - RNA, 17 nt, Vaccinia virus
caguacacgaaugauuu

SEQ ID NO: 4057646 - RNA, 15 nt, Vaccinia virus
caguauauaucauuu

SEQ ID NO: 4057647 - RNA, 23 nt, Vaccinia virus
caguauugggacaacuuaaucug

SEQ ID NO: 4057648 - RNA, 18 nt, Vaccinia virus
caguccgguucuuaauau

SEQ ID NO: 4057649 - RNA, 17 nt, Vaccinia virus
cagucuccaguuaauau

SEQ ID NO: 4057650 - RNA, 16 nt, Vaccinia virus
cagugacggauauaca

SEQ ID NO: 4057651 - RNA, 19 nt, Vaccinia virus
cagugguuucauguuuaua

SEQ ID NO: 4057652 - RNA, 23 nt, Vaccinia virus
caguguaaagaacgaauguugua

SEQ ID NO: 4057653 - RNA, 19 nt, Vaccinia virus
caguuaaagaaaaauacuc

SEQ ID NO: 4057654 - RNA, 15 nt, Vaccinia virus
caguuaauauauuua

SEQ ID NO: 4057655 - RNA, 20 nt, Vaccinia virus
caguuaccaaagagaaaaca

SEQ ID NO: 4057656 - RNA, 16 nt, Vaccinia virus
caguuagcuacucuag

SEQ ID NO: 4057657 - RNA, 23 nt, Vaccinia virus
caguuuuuaauuucuuugguaau

SEQ ID NO: 4057658 - RNA, 16 nt, Vaccinia virus
cauaaaaaaauauauu

SEQ ID NO: 4057659 - RNA, 17 nt, Vaccinia virus
cauaaaaacuuauacau

SEQ ID NO: 4057660 - RNA, 12 nt, Vaccinia virus
cauaaaacauca

SEQ ID NO: 4057661 - RNA, 21 nt, Vaccinia virus
cauaaaacugaugagauauau

SEQ ID NO: 4057662 - RNA, 21 nt, Vaccinia virus
cauaaacgauugcugcuguuc

SEQ ID NO: 4057663 - RNA, 20 nt, Vaccinia virus
cauaaacuuucuagacaucu

SEQ ID NO: 4057664 - RNA, 12 nt, Vaccinia virus
cauaacauaauu

SEQ ID NO: 4057665 - RNA, 15 nt, Vaccinia virus
cauaacauauuuuga

SEQ ID NO: 4057666 - RNA, 19 nt, Vaccinia virus
cauaacgaaaauaucacag

SEQ ID NO: 4057667 - RNA, 22 nt, Vaccinia virus
cauaauacucccacaaauacug

SEQ ID NO: 4057668 - RNA, 15 nt, Vaccinia virus
cauaauuaauacaau

SEQ ID NO: 4057669 - RNA, 16 nt, Vaccinia virus
cauacacuacaguaag

SEQ ID NO: 4057670 - RNA, 22 nt, Vaccinia virus
cauaccgucccaaaacauggau

SEQ ID NO: 4057671 - RNA, 13 nt, Vaccinia virus
cauacuauguuuu

SEQ ID NO: 4057672 - RNA, 20 nt, Vaccinia virus
cauacucguuaguuuggaau

SEQ ID NO: 4057673 - RNA, 18 nt, Vaccinia virus
cauagaccuguaguuuua

SEQ ID NO: 4057674 - RNA, 22 nt, Vaccinia virus
cauagcaugcgacuaugauauc

SEQ ID NO: 4057675 - RNA, 14 nt, Vaccinia virus
cauagccaauggau

SEQ ID NO: 4057676 - RNA, 13 nt, Vaccinia virus
cauagcuauuuua

SEQ ID NO: 4057677 - RNA, 16 nt, Vaccinia virus
cauagggcuaaauguc

SEQ ID NO: 4057678 - RNA, 16 nt, Vaccinia virus
cauaguaaauucuguu

SEQ ID NO: 4057679 - RNA, 20 nt, Vaccinia virus
cauaguagugagaucgacgu

SEQ ID NO: 4057680 - RNA, 17 nt, Vaccinia virus
cauaguccucguguggu

SEQ ID NO: 4057681 - RNA, 21 nt, Vaccinia virus
cauaguguuuuauauuccaaa

SEQ ID NO: 4057682 - RNA, 17 nt, Vaccinia virus
cauaguuuuucauaauu

SEQ ID NO: 4057683 - RNA, 12 nt, Vaccinia virus
cauauaaaugua

SEQ ID NO: 4057684 - RNA, 12 nt, Vaccinia virus
cauauaaauguc

SEQ ID NO: 4057685 - RNA, 22 nt, Vaccinia virus
cauauaauuauacuaucgauga

SEQ ID NO: 4057686 - RNA, 17 nt, Vaccinia virus
cauauacuauuacuuau

SEQ ID NO: 4057687 - RNA, 19 nt, Vaccinia virus
cauauacuauuuauaagau

SEQ ID NO: 4057688 - RNA, 23 nt, Vaccinia virus
cauauacugaugauaauaaugaa

SEQ ID NO: 4057689 - RNA, 20 nt, Vaccinia virus
cauauauuaaaacuaccaau

SEQ ID NO: 4057690 - RNA, 15 nt, Vaccinia virus
cauauauuuuuggau

SEQ ID NO: 4057691 - RNA, 23 nt, Vaccinia virus
cauaugaugaacuaauaaaggaa

SEQ ID NO: 4057692 - RNA, 16 nt, Vaccinia virus
cauaugauguuuguuu

SEQ ID NO: 4057693 - RNA, 16 nt, Vaccinia virus
cauauguuuaaacgac

SEQ ID NO: 4057694 - RNA, 11 nt, Vaccinia virus
acauuaaacag

SEQ ID NO: 4057695 - RNA, 18 nt, Vaccinia virus
acauuaauacuuuaauga

SEQ ID NO: 4057696 - RNA, 21 nt, Vaccinia virus
acauuaauuccuuuuuaaauu

SEQ ID NO: 4057697 - RNA, 20 nt, Vaccinia virus
acauuauuaaauuaugaagu

SEQ ID NO: 4057698 - RNA, 15 nt, Vaccinia virus
acauuauuacauaga

SEQ ID NO: 4057699 - RNA, 17 nt, Vaccinia virus
acauuauucuauuucga

SEQ ID NO: 4057700 - RNA, 13 nt, Vaccinia virus
acauucagaaaga

SEQ ID NO: 4057701 - RNA, 14 nt, Vaccinia virus
acauucuaggaaug

SEQ ID NO: 4057702 - RNA, 13 nt, Vaccinia virus
acauugagaaugu

SEQ ID NO: 4057703 - RNA, 19 nt, Vaccinia virus
acauugaugagacaauaau

SEQ ID NO: 4057704 - RNA, 19 nt, Vaccinia virus
acauugcuuuaaaauggac

SEQ ID NO: 4057705 - RNA, 15 nt, Vaccinia virus
acauuguaugaugau

SEQ ID NO: 4057706 - RNA, 14 nt, Vaccinia virus
acauuguuaauuga

SEQ ID NO: 4057707 - RNA, 12 nt, Vaccinia virus
acauuuacauau

SEQ ID NO: 4057708 - RNA, 17 nt, Vaccinia virus
acauuuacauauuucga

SEQ ID NO: 4057709 - RNA, 13 nt, Vaccinia virus
acauuuauaucca

SEQ ID NO: 4057710 - RNA, 20 nt, Vaccinia virus
acauuuuggcaaauugauua

SEQ ID NO: 4057711 - RNA, 17 nt, Vaccinia virus
accaaaaacucauauaa

SEQ ID NO: 4057712 - RNA, 20 nt, Vaccinia virus
accaaaaugaaaauacuuua

SEQ ID NO: 4057713 - RNA, 13 nt, Vaccinia virus
accaaacauucuu

SEQ ID NO: 4057714 - RNA, 13 nt, Vaccinia virus
accaaauuuuaca

SEQ ID NO: 4057715 - RNA, 19 nt, Vaccinia virus
accaacgggucaugugaca

SEQ ID NO: 4057716 - RNA, 20 nt, Vaccinia virus
accaacguauagagguauau

SEQ ID NO: 4057717 - RNA, 15 nt, Vaccinia virus
accaaggacuuugua

SEQ ID NO: 4057718 - RNA, 16 nt, Vaccinia virus
accaauacuuuuguua

SEQ ID NO: 4057719 - RNA, 22 nt, Vaccinia virus
accaauaugucuguacaaaugu

SEQ ID NO: 4057720 - RNA, 18 nt, Vaccinia virus
accacacgacaaugaaca

SEQ ID NO: 4057721 - RNA, 17 nt, Vaccinia virus
accaccaaauaaaauuc

SEQ ID NO: 4057722 - RNA, 19 nt, Vaccinia virus
accacgaaacaauauauau

SEQ ID NO: 4057723 - RNA, 19 nt, Vaccinia virus
accacugucuaaauguaau

SEQ ID NO: 4057724 - RNA, 18 nt, Vaccinia virus
accacuuauuacuccauc

SEQ ID NO: 4057725 - RNA, 15 nt, Vaccinia virus
accagaugucauuau

SEQ ID NO: 4057726 - RNA, 17 nt, Vaccinia virus
accaggguuuauuucau

SEQ ID NO: 4057727 - RNA, 16 nt, Vaccinia virus
accagucuaggaauaa

SEQ ID NO: 4057728 - RNA, 21 nt, Vaccinia virus
accauauauuuggcaugguuu

SEQ ID NO: 4057729 - RNA, 15 nt, Vaccinia virus
accaucccacucuag

SEQ ID NO: 4057730 - RNA, 21 nt, Vaccinia virus
accauccuuuaaaaaaaauga

SEQ ID NO: 4057731 - RNA, 16 nt, Vaccinia virus
acccauggaaaaauag

SEQ ID NO: 4057732 - RNA, 20 nt, Vaccinia virus
accgauaucacuucagaaau

SEQ ID NO: 4057733 - RNA, 19 nt, Vaccinia virus
accgcuagaucuguaauug

SEQ ID NO: 4057734 - RNA, 20 nt, Vaccinia virus
accggaagaauuaauaaaca

SEQ ID NO: 4057735 - RNA, 17 nt, Vaccinia virus
accggcaagaaagugaa

SEQ ID NO: 4057736 - RNA, 16 nt, Vaccinia virus
accguuugauauacca

SEQ ID NO: 4057737 - RNA, 13 nt, Vaccinia virus
accucaaaaauuu

SEQ ID NO: 4057738 - RNA, 13 nt, Vaccinia virus
accucgagaaugu

SEQ ID NO: 4057739 - RNA, 21 nt, Vaccinia virus
accugccauaaauaaaugcuu

SEQ ID NO: 4057740 - RNA, 17 nt, Vaccinia virus
accuuuaacuucuggaa

SEQ ID NO: 4057741 - RNA, 15 nt, Vaccinia virus
acgaaagaaaaagaa

SEQ ID NO: 4057742 - RNA, 14 nt, Vaccinia virus
acgaauauaaauca

SEQ ID NO: 4057743 - RNA, 23 nt, Vaccinia virus
acgaauaucguucucuaaauguc

SEQ ID NO: 4057744 - RNA, 14 nt, Vaccinia virus
acgaaucaagugau

SEQ ID NO: 4057745 - RNA, 18 nt, Vaccinia virus
acgaauuaggagaacuua

SEQ ID NO: 4057746 - RNA, 15 nt, Vaccinia virus
acgacguuuacaucg

SEQ ID NO: 4057747 - RNA, 14 nt, Vaccinia virus
acgacuaaacauuu

SEQ ID NO: 4057748 - RNA, 18 nt, Vaccinia virus
acgacucuugagacuuua

SEQ ID NO: 4057749 - RNA, 16 nt, Vaccinia virus
acgacuuauaauuaau

SEQ ID NO: 4057750 - RNA, 11 nt, Vaccinia virus
acgauaaaaga

SEQ ID NO: 4057751 - RNA, 14 nt, Vaccinia virus
acgauaaugucuuu

SEQ ID NO: 4057752 - RNA, 15 nt, Vaccinia virus
acgauacaucuguuu

SEQ ID NO: 4057753 - RNA, 17 nt, Vaccinia virus
acgauauauaguaauga

SEQ ID NO: 4057754 - RNA, 14 nt, Vaccinia virus
acgauauauuguuu

SEQ ID NO: 4057755 - RNA, 20 nt, Vaccinia virus
acgauccaaacaauguuucu

SEQ ID NO: 4057756 - RNA, 22 nt, Vaccinia virus
acgaucuuguuguuuauuuuca

SEQ ID NO: 4057757 - RNA, 20 nt, Vaccinia virus
acgaugaugauuuaugaauu

SEQ ID NO: 4057758 - RNA, 18 nt, Vaccinia virus
acgauguaguuagauaga

SEQ ID NO: 4057759 - RNA, 16 nt, Vaccinia virus
acgauuauuauaaaau

SEQ ID NO: 4057760 - RNA, 19 nt, Vaccinia virus
acgauuuccaugucuacau

SEQ ID NO: 4057761 - RNA, 22 nt, Vaccinia virus
acgauuuccaugucuacauuau

SEQ ID NO: 4057762 - RNA, 15 nt, Vaccinia virus
acgauuuguuuaauu

SEQ ID NO: 4057763 - RNA, 15 nt, Vaccinia virus
acgcaacaaaugauu

SEQ ID NO: 4057764 - RNA, 12 nt, Vaccinia virus
acgcaaugguuu

SEQ ID NO: 4057765 - RNA, 16 nt, Vaccinia virus
acgcaccucaaaugua

SEQ ID NO: 4057766 - RNA, 23 nt, Vaccinia virus
acgcagaaauugguauaaauguu

SEQ ID NO: 4057767 - RNA, 14 nt, Vaccinia virus
acgcagauagcuau

SEQ ID NO: 4057768 - RNA, 16 nt, Vaccinia virus
acgcaguuuuucuuau

SEQ ID NO: 4057769 - RNA, 15 nt, Vaccinia virus
acgcgucuuuaacuc

SEQ ID NO: 4057770 - RNA, 14 nt, Vaccinia virus
acggagacaaaauu

SEQ ID NO: 4057771 - RNA, 22 nt, Vaccinia virus
acggagucauaacuauuuuacc

SEQ ID NO: 4057772 - RNA, 17 nt, Vaccinia virus
acggccauugcugccac

SEQ ID NO: 4057773 - RNA, 18 nt, Vaccinia virus
acgggcgcuguaauuaau

SEQ ID NO: 4057774 - RNA, 15 nt, Vaccinia virus
acgguaacuaaaugu

SEQ ID NO: 4057775 - RNA, 14 nt, Vaccinia virus
acggugaauacaau

SEQ ID NO: 4057776 - RNA, 19 nt, Vaccinia virus
acggugagaagacaauauu

SEQ ID NO: 4057777 - RNA, 18 nt, Vaccinia virus
acguaaauacaaaacaga

SEQ ID NO: 4057778 - RNA, 16 nt, Vaccinia virus
acguaaccaagaaguu

SEQ ID NO: 4057779 - RNA, 21 nt, Vaccinia virus
acguaacuauauuccaaauua

SEQ ID NO: 4057780 - RNA, 13 nt, Vaccinia virus
acguaaugaagau

SEQ ID NO: 4057781 - RNA, 16 nt, Vaccinia virus
acguaguuauguagag

SEQ ID NO: 4057782 - RNA, 19 nt, Vaccinia virus
acguauauuuagauguuuu

SEQ ID NO: 4057783 - RNA, 19 nt, Vaccinia virus
acgucugauauucgaaaau

SEQ ID NO: 4057784 - RNA, 22 nt, Vaccinia virus
acgucuuucacuaauugacuau

SEQ ID NO: 4057785 - RNA, 15 nt, Vaccinia virus
acgugcaaggcauuu

SEQ ID NO: 4057786 - RNA, 13 nt, Vaccinia virus
acguuaauacaaa

SEQ ID NO: 4057787 - RNA, 17 nt, Vaccinia virus
acguuacuacguucaga

SEQ ID NO: 4057788 - RNA, 19 nt, Vaccinia virus
acguucuacuauagaauua

SEQ ID NO: 4057789 - RNA, 20 nt, Vaccinia virus
acguucuacuauagaauuaa

SEQ ID NO: 4057790 - RNA, 14 nt, Vaccinia virus
acguucuuuaauuu

SEQ ID NO: 4057791 - RNA, 23 nt, Vaccinia virus
acguuucauuuuuugucuauaau

SEQ ID NO: 4057792 - RNA, 22 nt, Vaccinia virus
acguuugguaauggcaauguau

SEQ ID NO: 4057793 - RNA, 19 nt, Vaccinia virus
acguuuuucgaaaaaauua

SEQ ID NO: 4057794 - RNA, 17 nt, Vaccinia virus
acuaaaaaauguagaaa

SEQ ID NO: 4057795 - RNA, 12 nt, Vaccinia virus
acuaaaagacau

SEQ ID NO: 4057796 - RNA, 17 nt, Vaccinia virus
acuaaacacacauuauu

SEQ ID NO: 4057797 - RNA, 18 nt, Vaccinia virus
acuaaacacauuauuaau

SEQ ID NO: 4057798 - RNA, 17 nt, Vaccinia virus
acuaaauacauuaucau

SEQ ID NO: 4057799 - RNA, 21 nt, Vaccinia virus
acuaaauauucauaacuaauu

SEQ ID NO: 4057800 - RNA, 14 nt, Vaccinia virus
acuaaauccgagaa

SEQ ID NO: 4057801 - RNA, 14 nt, Vaccinia virus
acuaaauuaacaau

SEQ ID NO: 4057802 - RNA, 14 nt, Vaccinia virus
acuaaauugaacac

SEQ ID NO: 4057803 - RNA, 23 nt, Vaccinia virus
acuaacauacggcaaauauuuug

SEQ ID NO: 4057804 - RNA, 18 nt, Vaccinia virus
acuaacgauaacgugaaa

SEQ ID NO: 4057805 - RNA, 16 nt, Vaccinia virus
acuaggagaauuauuu

SEQ ID NO: 4057806 - RNA, 18 nt, Vaccinia virus
acuagucgcguuaauagu

SEQ ID NO: 4057807 - RNA, 22 nt, Vaccinia virus
acuauaaaaaaaauaauaauua

SEQ ID NO: 4057808 - RNA, 18 nt, Vaccinia virus
acuauaauauaaucuaga

SEQ ID NO: 4057809 - RNA, 14 nt, Vaccinia virus
acuauagacauaau

SEQ ID NO: 4057810 - RNA, 14 nt, Vaccinia virus
acuauaucaguuuu

SEQ ID NO: 4057811 - RNA, 15 nt, Vaccinia virus
acuauauuauguuuu

SEQ ID NO: 4057812 - RNA, 17 nt, Vaccinia virus
acuauauuguacuuuac

SEQ ID NO: 4057813 - RNA, 21 nt, Vaccinia virus
acuaucaaucgauaacaagau

SEQ ID NO: 4057814 - RNA, 20 nt, Vaccinia virus
acuaucuaaauguaauuaau

SEQ ID NO: 4057815 - RNA, 22 nt, Vaccinia virus
acuaucugauaagauaucuucu

SEQ ID NO: 4057816 - RNA, 19 nt, Vaccinia virus
acuaucuuuuuaggaaugu

SEQ ID NO: 4057817 - RNA, 15 nt, Vaccinia virus
acuaugcuauuugca

SEQ ID NO: 4057818 - RNA, 22 nt, Vaccinia virus
acuauggacgcaugauaagaau

SEQ ID NO: 4057819 - RNA, 23 nt, Vaccinia virus
acuaugucaguaguauacaucau

SEQ ID NO: 4057820 - RNA, 19 nt, Vaccinia virus
acuauguguuaaaaaauuc

SEQ ID NO: 4057821 - RNA, 19 nt, Vaccinia virus
acuauguuugguauacugu

SEQ ID NO: 4057822 - RNA, 16 nt, Vaccinia virus
acuauuacuaugaauc

SEQ ID NO: 4057823 - RNA, 19 nt, Vaccinia virus
acuauuagaauuaaguaga

SEQ ID NO: 4057824 - RNA, 15 nt, Vaccinia virus
acuauuauaacaaga

SEQ ID NO: 4057825 - RNA, 15 nt, Vaccinia virus
acuauuauuauugaa

SEQ ID NO: 4057826 - RNA, 16 nt, Vaccinia virus
acuauuauuuguuaua

SEQ ID NO: 4057827 - RNA, 19 nt, Vaccinia virus
acuauugaagccauugaaa

SEQ ID NO: 4057828 - RNA, 12 nt, Vaccinia virus
acuauugccauc

SEQ ID NO: 4057829 - RNA, 12 nt, Vaccinia virus
acuauuugucua

SEQ ID NO: 4057830 - RNA, 15 nt, Vaccinia virus
acuauuuuauaccuu

SEQ ID NO: 4057831 - RNA, 17 nt, Vaccinia virus
acucagauuauucuuaa

SEQ ID NO: 4057832 - RNA, 18 nt, Vaccinia virus
acucaggaagauauuuua

SEQ ID NO: 4057833 - RNA, 13 nt, Vaccinia virus
acucauaaaauac

SEQ ID NO: 4057834 - RNA, 16 nt, Vaccinia virus
acucauaaaauacaag

SEQ ID NO: 4057835 - RNA, 22 nt, Vaccinia virus
acucauaaaauacaagagaaug

SEQ ID NO: 4057836 - RNA, 12 nt, Vaccinia virus
acucaugaugaa

SEQ ID NO: 4057837 - RNA, 15 nt, Vaccinia virus
acucauuaaaacuuc

SEQ ID NO: 4057838 - RNA, 16 nt, Vaccinia virus
acucauuuaacagaug

SEQ ID NO: 4057839 - RNA, 18 nt, Vaccinia virus
acuccauccguaaaaaug

SEQ ID NO: 4057840 - RNA, 14 nt, Vaccinia virus
acucccacaaauac

SEQ ID NO: 4057841 - RNA, 16 nt, Vaccinia virus
acuccggauagagaaa

SEQ ID NO: 4057842 - RNA, 18 nt, Vaccinia virus
acuccgguugaugaugau

SEQ ID NO: 4057843 - RNA, 15 nt, Vaccinia virus
acucuacuaguucca

SEQ ID NO: 4057844 - RNA, 22 nt, Vaccinia virus
acucucuucuauaaaaauggau

SEQ ID NO: 4057845 - RNA, 20 nt, Vaccinia virus
acucugggucauauuauaga

SEQ ID NO: 4057846 - RNA, 20 nt, Vaccinia virus
acucuguagacuuuaauaga

SEQ ID NO: 4057847 - RNA, 20 nt, Vaccinia virus
acugacuucuaacaaacauc

SEQ ID NO: 4057848 - RNA, 12 nt, Vaccinia virus
acugagaaguua

SEQ ID NO: 4057849 - RNA, 14 nt, Vaccinia virus
acugaguaaaugug

SEQ ID NO: 4057850 - RNA, 13 nt, Vaccinia virus
acugauacuaucg

SEQ ID NO: 4057851 - RNA, 18 nt, Vaccinia virus
acugauucagaaauggau

SEQ ID NO: 4057852 - RNA, 21 nt, Vaccinia virus
acugauucuggacauagcuuu

SEQ ID NO: 4057853 - RNA, 20 nt, Vaccinia virus
acugcagagggaaaaugcua

SEQ ID NO: 4057854 - RNA, 20 nt, Vaccinia virus
acugccgaguuuaaaacuuc

SEQ ID NO: 4057855 - RNA, 15 nt, Vaccinia virus
acugcgaucugaaua

SEQ ID NO: 4057856 - RNA, 19 nt, Vaccinia virus
acugcgauuguauuauccg

SEQ ID NO: 4057857 - RNA, 17 nt, Vaccinia virus
acugcugugaauacagc

SEQ ID NO: 4057858 - RNA, 24 nt, Vaccinia virus
acugguaauccacauaguuguaaa

SEQ ID NO: 4057859 - RNA, 23 nt, Vaccinia virus
acuguagaugguucuuuaauagu

SEQ ID NO: 4057860 - RNA, 18 nt, Vaccinia virus
acuguauccucaaacauc

SEQ ID NO: 4057861 - RNA, 12 nt, Vaccinia virus
acugucuaaaug

SEQ ID NO: 4057862 - RNA, 13 nt, Vaccinia virus
acugucuauacaa

SEQ ID NO: 4057863 - RNA, 21 nt, Vaccinia virus
acugucucauacacuacagua

SEQ ID NO: 4057864 - RNA, 17 nt, Vaccinia virus
acuguuaucuaaugaau

SEQ ID NO: 4057865 - RNA, 13 nt, Vaccinia virus
acuguucaggaau

SEQ ID NO: 4057866 - RNA, 18 nt, Vaccinia virus
acuguucccgucaauaga

SEQ ID NO: 4057867 - RNA, 16 nt, Vaccinia virus
acuuaagacuuaaaac

SEQ ID NO: 4057868 - RNA, 14 nt, Vaccinia virus
acuuaaguuguaaa

SEQ ID NO: 4057869 - RNA, 14 nt, Vaccinia virus
acuuagauuaaauu

SEQ ID NO: 4057870 - RNA, 15 nt, Vaccinia virus
acuuaguacuaauaa

SEQ ID NO: 4057871 - RNA, 20 nt, Vaccinia virus
acuuaguauacaaaaaaaug

SEQ ID NO: 4057872 - RNA, 14 nt, Vaccinia virus
acuuauuaaugaau

SEQ ID NO: 4057873 - RNA, 15 nt, Vaccinia virus
acuucaaaaacgaua

SEQ ID NO: 4057874 - RNA, 16 nt, Vaccinia virus
acuucaaucaaacaaa

SEQ ID NO: 4057875 - RNA, 23 nt, Vaccinia virus
acuucacauuuuaaauaaauguc

SEQ ID NO: 4057876 - RNA, 21 nt, Vaccinia virus
acuucagguuucuuagcuugu

SEQ ID NO: 4057877 - RNA, 23 nt, Vaccinia virus
acuucauccguuuccuuaugaag

SEQ ID NO: 4057878 - RNA, 15 nt, Vaccinia virus
acuuccguuuaaaaa

SEQ ID NO: 4057879 - RNA, 23 nt, Vaccinia virus
acuucuaaugagcaaguagaaaa

SEQ ID NO: 4057880 - RNA, 23 nt, Vaccinia virus
acuucuagcgcugauuuaacuaa

SEQ ID NO: 4057881 - RNA, 13 nt, Vaccinia virus
acuucucuaaaug

SEQ ID NO: 4057882 - RNA, 15 nt, Vaccinia virus
acuucucuaucaaug

SEQ ID NO: 4057883 - RNA, 17 nt, Vaccinia virus
acuucugcaucuauaug

SEQ ID NO: 4057884 - RNA, 20 nt, Vaccinia virus
acuucuuccaguucuggaua

SEQ ID NO: 4057885 - RNA, 23 nt, Vaccinia virus
acuugaaauaaucggagaauguu

SEQ ID NO: 4057886 - RNA, 14 nt, Vaccinia virus
acuugauaauuaau

SEQ ID NO: 4057887 - RNA, 21 nt, Vaccinia virus
acuuggaaaagauaacuauug

SEQ ID NO: 4057888 - RNA, 15 nt, Vaccinia virus
acuuggaaacaucuc

SEQ ID NO: 4057889 - RNA, 14 nt, Vaccinia virus
acuuguauaauaag

SEQ ID NO: 4057890 - RNA, 14 nt, Vaccinia virus
acuuuaaauacuua

SEQ ID NO: 4057891 - RNA, 19 nt, Vaccinia virus
acuuuaacguauaaaugac

SEQ ID NO: 4057892 - RNA, 23 nt, Vaccinia virus
acuuuaagcuaaaauauuuucua

SEQ ID NO: 4057893 - RNA, 16 nt, Vaccinia virus
acuuuaauaacaaaga

SEQ ID NO: 4057894 - RNA, 13 nt, Vaccinia virus
acuuuaucuaaau

SEQ ID NO: 4057895 - RNA, 13 nt, Vaccinia virus
acuuucagucugu

SEQ ID NO: 4057896 - RNA, 20 nt, Vaccinia virus
acuuuguaacuaguuuuaua

SEQ ID NO: 4057897 - RNA, 13 nt, Vaccinia virus
acuuuguuaauga

SEQ ID NO: 4057898 - RNA, 20 nt, Vaccinia virus
acuuuuacagaucuaguaua

SEQ ID NO: 4057899 - RNA, 17 nt, Vaccinia virus
acuuuuauaauuauaga

SEQ ID NO: 4057900 - RNA, 15 nt, Vaccinia virus
acuuuuuauacuaau

SEQ ID NO: 4057901 - RNA, 20 nt, Vaccinia virus
acuuuuucaucuuuacauau

SEQ ID NO: 4057902 - RNA, 22 nt, Vaccinia virus
acuuuuuuacccacuauaaaau

SEQ ID NO: 4057903 - RNA, 22 nt, Vaccinia virus
agaaaaaaauauuaucgauauu

SEQ ID NO: 4057904 - RNA, 13 nt, Vaccinia virus
agaaaacagacuu

SEQ ID NO: 4057905 - RNA, 20 nt, Vaccinia virus
agaaaacuagauacaaaauu

SEQ ID NO: 4057906 - RNA, 20 nt, Vaccinia virus
agaaaacucguuauuaacua

SEQ ID NO: 4057907 - RNA, 14 nt, Vaccinia virus
agaaaagagaaauu

SEQ ID NO: 4057908 - RNA, 21 nt, Vaccinia virus
agaaaauaacagauauuacaa

SEQ ID NO: 4057909 - RNA, 19 nt, Vaccinia virus
aucuacgccuuuaaauccu

SEQ ID NO: 4057910 - RNA, 18 nt, Vaccinia virus
aucuacguucauauguau

SEQ ID NO: 4057911 - RNA, 23 nt, Vaccinia virus
aucuagaaacacuuggauauugu

SEQ ID NO: 4057912 - RNA, 15 nt, Vaccinia virus
aucuagcaaaaauuc

SEQ ID NO: 4057913 - RNA, 13 nt, Vaccinia virus
aucuagccauuau

SEQ ID NO: 4057914 - RNA, 17 nt, Vaccinia virus
aucuaggaauuacauaa

SEQ ID NO: 4057915 - RNA, 17 nt, Vaccinia virus
aucuaggaguaauuaag

SEQ ID NO: 4057916 - RNA, 19 nt, Vaccinia virus
aucuauaauucuagcuaau

SEQ ID NO: 4057917 - RNA, 21 nt, Vaccinia virus
aucuauaauuugugaguuuuc

SEQ ID NO: 4057918 - RNA, 19 nt, Vaccinia virus
aucuauacugcagaauaga

SEQ ID NO: 4057919 - RNA, 21 nt, Vaccinia virus
aucuauaugaccgauaagaga

SEQ ID NO: 4057920 - RNA, 19 nt, Vaccinia virus
aucuauauugcuacauaau

SEQ ID NO: 4057921 - RNA, 18 nt, Vaccinia virus
aucuauccauaugcaucu

SEQ ID NO: 4057922 - RNA, 17 nt, Vaccinia virus
aucuaugcuuacuguau

SEQ ID NO: 4057923 - RNA, 16 nt, Vaccinia virus
aucuaugguauuaaga

SEQ ID NO: 4057924 - RNA, 13 nt, Vaccinia virus
aucuauguagaau

SEQ ID NO: 4057925 - RNA, 14 nt, Vaccinia virus
aucuauguagaauc

SEQ ID NO: 4057926 - RNA, 20 nt, Vaccinia virus
aucuauuaaacagaaauggu

SEQ ID NO: 4057927 - RNA, 13 nt, Vaccinia virus
aucuauuagaaaa

SEQ ID NO: 4057928 - RNA, 23 nt, Vaccinia virus
aucuauuagaagcugacaaaauu

SEQ ID NO: 4057929 - RNA, 19 nt, Vaccinia virus
aucuauuugauaauuacgc

SEQ ID NO: 4057930 - RNA, 14 nt, Vaccinia virus
aucuauuuuaaaua

SEQ ID NO: 4057931 - RNA, 15 nt, Vaccinia virus
aucuauuuuaaauac

SEQ ID NO: 4057932 - RNA, 12 nt, Vaccinia virus
aucucaaaauag

SEQ ID NO: 4057933 - RNA, 14 nt, Vaccinia virus
aucucaacaaaauu

SEQ ID NO: 4057934 - RNA, 17 nt, Vaccinia virus
aucucagugcaaagauu

SEQ ID NO: 4057935 - RNA, 22 nt, Vaccinia virus
aucuccacacagucaaauccgu

SEQ ID NO: 4057936 - RNA, 16 nt, Vaccinia virus
aucucccauaaucuug

SEQ ID NO: 4057937 - RNA, 13 nt, Vaccinia virus
aucuccucuauuu

SEQ ID NO: 4057938 - RNA, 22 nt, Vaccinia virus
aucucuaacgagugaucaaauc

SEQ ID NO: 4057939 - RNA, 18 nt, Vaccinia virus
aucucuauaauaucuagu

SEQ ID NO: 4057940 - RNA, 22 nt, Vaccinia virus
aucucuauaauaucuaguuuuu

SEQ ID NO: 4057941 - RNA, 21 nt, Vaccinia virus
aucucuauccaaggauguaau

SEQ ID NO: 4057942 - RNA, 17 nt, Vaccinia virus
aucucuccgaccauucc

SEQ ID NO: 4057943 - RNA, 14 nt, Vaccinia virus
aucucuuaacaaaa

SEQ ID NO: 4057944 - RNA, 16 nt, Vaccinia virus
aucucuuaacaaaaau

SEQ ID NO: 4057945 - RNA, 18 nt, Vaccinia virus
aucucuuaauccaaauau

SEQ ID NO: 4057946 - RNA, 21 nt, Vaccinia virus
aucugacucggacucuguaau

SEQ ID NO: 4057947 - RNA, 23 nt, Vaccinia virus
aucugagauucuauaaucgcuuu

SEQ ID NO: 4057948 - RNA, 19 nt, Vaccinia virus
aucugauaacuuuaaacau

SEQ ID NO: 4057949 - RNA, 18 nt, Vaccinia virus
aucugauaauauuaaaaa

SEQ ID NO: 4057950 - RNA, 18 nt, Vaccinia virus
aucugauaauuuagauaa

SEQ ID NO: 4057951 - RNA, 17 nt, Vaccinia virus
aucuggauuucagauau

SEQ ID NO: 4057952 - RNA, 16 nt, Vaccinia virus
aucugggaauaaaaua

SEQ ID NO: 4057953 - RNA, 15 nt, Vaccinia virus
aucuguaaaaguugu

SEQ ID NO: 4057954 - RNA, 23 nt, Vaccinia virus
augcaucuuaacacucucugcca

SEQ ID NO: 4057955 - RNA, 17 nt, Vaccinia virus
augccggacaauagcac

SEQ ID NO: 4057956 - RNA, 23 nt, Vaccinia virus
augccuauaaaguaauaaucuuc

SEQ ID NO: 4057957 - RNA, 13 nt, Vaccinia virus
augcgaaggaagu

SEQ ID NO: 4057958 - RNA, 23 nt, Vaccinia virus
augcgauaguagaguaaacauuu

SEQ ID NO: 4057959 - RNA, 22 nt, Vaccinia virus
augcgccggcagucacaucugu

SEQ ID NO: 4057960 - RNA, 22 nt, Vaccinia virus
augcuauccaucagaauguuuc

SEQ ID NO: 4057961 - RNA, 13 nt, Vaccinia virus
augcugugauaua

SEQ ID NO: 4057962 - RNA, 15 nt, Vaccinia virus
augcuucagaauuag

SEQ ID NO: 4057963 - RNA, 19 nt, Vaccinia virus
auggaaaaguucaacauga

SEQ ID NO: 4057964 - RNA, 13 nt, Vaccinia virus
auggaaaggaaau

SEQ ID NO: 4057965 - RNA, 15 nt, Vaccinia virus
auggaagaaacagaa

SEQ ID NO: 4057966 - RNA, 21 nt, Vaccinia virus
auggaauuaucaucaaaaaac

SEQ ID NO: 4057967 - RNA, 15 nt, Vaccinia virus
auggaauuggagaaa

SEQ ID NO: 4057968 - RNA, 19 nt, Vaccinia virus
auggacgaauuaggagaac

SEQ ID NO: 4057969 - RNA, 16 nt, Vaccinia virus
auggagagauuuaacu

SEQ ID NO: 4057970 - RNA, 16 nt, Vaccinia virus
auggaguacuauuuua

SEQ ID NO: 4057971 - RNA, 17 nt, Vaccinia virus
auggagucauuucugau

SEQ ID NO: 4057972 - RNA, 14 nt, Vaccinia virus
auggaguuguaaau

SEQ ID NO: 4057973 - RNA, 18 nt, Vaccinia virus
auggaucaccguguuuau

SEQ ID NO: 4057974 - RNA, 16 nt, Vaccinia virus
auggaucuauucaaga

SEQ ID NO: 4057975 - RNA, 18 nt, Vaccinia virus
auggaugagaacacguau

SEQ ID NO: 4057976 - RNA, 12 nt, Vaccinia virus
auggaugauaua

SEQ ID NO: 4057977 - RNA, 14 nt, Vaccinia virus
auggaugcagaaua

SEQ ID NO: 4057978 - RNA, 17 nt, Vaccinia virus
auggaugucaucaaugu

SEQ ID NO: 4057979 - RNA, 21 nt, Vaccinia virus
auggaugucaucaauguagaa

SEQ ID NO: 4057980 - RNA, 20 nt, Vaccinia virus
auggauuaucggaaauacuu

SEQ ID NO: 4057981 - RNA, 23 nt, Vaccinia virus
auggauuuuuuuaaaaaggaaau

SEQ ID NO: 4057982 - RNA, 16 nt, Vaccinia virus
auggcguacaaaggaa

SEQ ID NO: 4057983 - RNA, 17 nt, Vaccinia virus
augguaaaauuaaauag

SEQ ID NO: 4057984 - RNA, 17 nt, Vaccinia virus
augguagcaauaugcua

SEQ ID NO: 4057985 - RNA, 14 nt, Vaccinia virus
auggucuauacaau

SEQ ID NO: 4057986 - RNA, 11 nt, Vaccinia virus
auggucucaca

SEQ ID NO: 4057987 - RNA, 15 nt, Vaccinia virus
auggugaaauuauug

SEQ ID NO: 4057988 - RNA, 14 nt, Vaccinia virus
augguuacauuuau

SEQ ID NO: 4057989 - RNA, 15 nt, Vaccinia virus
augguucaaagacua

SEQ ID NO: 4057990 - RNA, 19 nt, Vaccinia virus
augguuuacccuagaauac

SEQ ID NO: 4057991 - RNA, 20 nt, Vaccinia virus
aguuaauggagaaauacuua

SEQ ID NO: 4057992 - RNA, 13 nt, Vaccinia virus
aguuacuuaaaug

SEQ ID NO: 4057993 - RNA, 19 nt, Vaccinia virus
aguuaugagucaauuggua

SEQ ID NO: 4057994 - RNA, 13 nt, Vaccinia virus
aguuauuaaugau

SEQ ID NO: 4057995 - RNA, 16 nt, Vaccinia virus
aguuauuggauuaaaa

SEQ ID NO: 4057996 - RNA, 19 nt, Vaccinia virus
aguucauauuuauuagaua

SEQ ID NO: 4057997 - RNA, 17 nt, Vaccinia virus
aguucauuauaaauucu

SEQ ID NO: 4057998 - RNA, 12 nt, Vaccinia virus
aguucuggaaua

SEQ ID NO: 4057999 - RNA, 15 nt, Vaccinia virus
aguugaguuuauccu

SEQ ID NO: 4058000 - RNA, 14 nt, Vaccinia virus
aguuguaucaucua

SEQ ID NO: 4058001 - RNA, 23 nt, Vaccinia virus
aguuguggaaauacuuccaucaa

SEQ ID NO: 4058002 - RNA, 18 nt, Vaccinia virus
aguuguuccuagauaugu

SEQ ID NO: 4058003 - RNA, 20 nt, Vaccinia virus
aguuuaauauccucagucau

SEQ ID NO: 4058004 - RNA, 12 nt, Vaccinia virus
aguuuauaucaa

SEQ ID NO: 4058005 - RNA, 19 nt, Vaccinia virus
aguuuaucccuauauucaa

SEQ ID NO: 4058006 - RNA, 18 nt, Vaccinia virus
aguuucacaugaauuugu

SEQ ID NO: 4058007 - RNA, 19 nt, Vaccinia virus
aguuucauaucguaacuga

SEQ ID NO: 4058008 - RNA, 20 nt, Vaccinia virus
aguuucaucgauaaaggaua

SEQ ID NO: 4058009 - RNA, 12 nt, Vaccinia virus
aguuucuagaua

SEQ ID NO: 4058010 - RNA, 17 nt, Vaccinia virus
aguuugagguuuuagau

SEQ ID NO: 4058011 - RNA, 20 nt, Vaccinia virus
aguuugccuucuuuaguaga

SEQ ID NO: 4058012 - RNA, 17 nt, Vaccinia virus
aguuuggagaaauggag

SEQ ID NO: 4058013 - RNA, 20 nt, Vaccinia virus
aguuuggcaauuaaaaauua

SEQ ID NO: 4058014 - RNA, 16 nt, Vaccinia virus
aguuuguuuucauuau

SEQ ID NO: 4058015 - RNA, 15 nt, Vaccinia virus
aguuuuauaacgaag

SEQ ID NO: 4058016 - RNA, 17 nt, Vaccinia virus
aguuuuccguuagaaaa

SEQ ID NO: 4058017 - RNA, 16 nt, Vaccinia virus
aguuuucuuucaaaau

SEQ ID NO: 4058018 - RNA, 19 nt, Vaccinia virus
aguuuuggccauuauuaga

SEQ ID NO: 4058019 - RNA, 18 nt, Vaccinia virus
auaaaaaauauucuucau

SEQ ID NO: 4058020 - RNA, 18 nt, Vaccinia virus
auaaaaacauuaacaaga

SEQ ID NO: 4058021 - RNA, 18 nt, Vaccinia virus
auaaaaaguaauauucau

SEQ ID NO: 4058022 - RNA, 14 nt, Vaccinia virus
auaaaaauaauauu

SEQ ID NO: 4058023 - RNA, 14 nt, Vaccinia virus
auaaaaauacuuau

SEQ ID NO: 4058024 - RNA, 20 nt, Vaccinia virus
auaaaacguggaaagaaucu

SEQ ID NO: 4058025 - RNA, 20 nt, Vaccinia virus
auaaaacuugucuguauaug

SEQ ID NO: 4058026 - RNA, 20 nt, Vaccinia virus
auaaaagucuauuuguuuau

SEQ ID NO: 4058027 - RNA, 21 nt, Vaccinia virus
auaaaaguuguaaaguaaaua

SEQ ID NO: 4058028 - RNA, 14 nt, Vaccinia virus
auaaaauaaaauga

SEQ ID NO: 4058029 - RNA, 14 nt, Vaccinia virus
auaaaauaauacau

SEQ ID NO: 4058030 - RNA, 20 nt, Vaccinia virus
auaaaaucauuugagaaauu

SEQ ID NO: 4058031 - RNA, 13 nt, Vaccinia virus
auaaaaucuauau

SEQ ID NO: 4058032 - RNA, 13 nt, Vaccinia virus
auaaaauguugau

SEQ ID NO: 4058033 - RNA, 15 nt, Vaccinia virus
auaaaauuaauaaua

SEQ ID NO: 4058034 - RNA, 17 nt, Vaccinia virus
auaaaauuaaugagauu

SEQ ID NO: 4058035 - RNA, 21 nt, Vaccinia virus
auaaacagucuccuaauauaa

SEQ ID NO: 4058036 - RNA, 22 nt, Vaccinia virus
auaaacauaaguauauaauaaa

SEQ ID NO: 4058037 - RNA, 14 nt, Vaccinia virus
auaaacauaauaaa

SEQ ID NO: 4058038 - RNA, 20 nt, Vaccinia virus
auaaacauuuguguuuguau

SEQ ID NO: 4058039 - RNA, 14 nt, Vaccinia virus
auaaacuaacacaa

SEQ ID NO: 4058040 - RNA, 20 nt, Vaccinia virus
auaaacuaggauuuaaacaa

SEQ ID NO: 4058041 - RNA, 21 nt, Vaccinia virus
auaaacuccguguuuaugaug

SEQ ID NO: 4058042 - RNA, 19 nt, Vaccinia virus
auaaacugcgccaaauugu

SEQ ID NO: 4058043 - RNA, 13 nt, Vaccinia virus
auaaacuguaaau

SEQ ID NO: 4058044 - RNA, 18 nt, Vaccinia virus
auaaagauaguguagcgu

SEQ ID NO: 4058045 - RNA, 19 nt, Vaccinia virus
auaaaggaauaaaauauga

SEQ ID NO: 4058046 - RNA, 16 nt, Vaccinia virus
auaaauacaauaauua

SEQ ID NO: 4058047 - RNA, 16 nt, Vaccinia virus
auaaauaguucaacau

SEQ ID NO: 4058048 - RNA, 17 nt, Vaccinia virus
auaaauaucaucaauau

SEQ ID NO: 4058049 - RNA, 16 nt, Vaccinia virus
auaaaucaaaauaugg

SEQ ID NO: 4058050 - RNA, 14 nt, Vaccinia virus
auaaaucuaucuuu

SEQ ID NO: 4058051 - RNA, 22 nt, Vaccinia virus
auaaaugcgauacagacauuaa

SEQ ID NO: 4058052 - RNA, 12 nt, Vaccinia virus
auaaaugggaac

SEQ ID NO: 4058053 - RNA, 22 nt, Vaccinia virus
auaaaugguuucgaagaucuuc

SEQ ID NO: 4058054 - RNA, 21 nt, Vaccinia virus
auaaaugucacgccauaacua

SEQ ID NO: 4058055 - RNA, 13 nt, Vaccinia virus
auaaauguuguaa

SEQ ID NO: 4058056 - RNA, 19 nt, Vaccinia virus
auaaauuagucauacguaa

SEQ ID NO: 4058057 - RNA, 17 nt, Vaccinia virus
auaaauuauaaaaaaag

SEQ ID NO: 4058058 - RNA, 23 nt, Vaccinia virus
auaaauuugucauuuaugauaua

SEQ ID NO: 4058059 - RNA, 24 nt, Vaccinia virus
auaacagaguaccaucaacacauu

SEQ ID NO: 4058060 - RNA, 15 nt, Vaccinia virus
auaacaggaguuuuc

SEQ ID NO: 4058061 - RNA, 17 nt, Vaccinia virus
auaacaggcuaaaaugu

SEQ ID NO: 4058062 - RNA, 20 nt, Vaccinia virus
auaacaucagaaaauguaaa

SEQ ID NO: 4058063 - RNA, 15 nt, Vaccinia virus
auaacauguuaauuu

SEQ ID NO: 4058064 - RNA, 19 nt, Vaccinia virus
auaacauguuaauuuccga

SEQ ID NO: 4058065 - RNA, 19 nt, Vaccinia virus
auaacauucuuaaacaaua

SEQ ID NO: 4058066 - RNA, 14 nt, Vaccinia virus
auaacauuguuuau

SEQ ID NO: 4058067 - RNA, 20 nt, Vaccinia virus
auaaccggcaagaaagugaa

SEQ ID NO: 4058068 - RNA, 18 nt, Vaccinia virus
auaaccggcgcugucaug

SEQ ID NO: 4058069 - RNA, 17 nt, Vaccinia virus
auaaccuccugaaaaug

SEQ ID NO: 4058070 - RNA, 17 nt, Vaccinia virus
auaacgaaaauaucaca

SEQ ID NO: 4058071 - RNA, 21 nt, Vaccinia virus
auaacgaguacauucugcaau

SEQ ID NO: 4058072 - RNA, 14 nt, Vaccinia virus
auaacgauauauau

SEQ ID NO: 4058073 - RNA, 20 nt, Vaccinia virus
auaacgauggcaagaaaugg

SEQ ID NO: 4058074 - RNA, 15 nt, Vaccinia virus
auaacgugaaauaua

SEQ ID NO: 4058075 - RNA, 16 nt, Vaccinia virus
auaacguuagccacca

SEQ ID NO: 4058076 - RNA, 19 nt, Vaccinia virus
auaacguuuuuauuuguaa

SEQ ID NO: 4058077 - RNA, 15 nt, Vaccinia virus
auaacuaaacuacua

SEQ ID NO: 4058078 - RNA, 15 nt, Vaccinia virus
auaacuacauauucu

SEQ ID NO: 4058079 - RNA, 21 nt, Vaccinia virus
auaacuauugauguuacacca

SEQ ID NO: 4058080 - RNA, 18 nt, Vaccinia virus
auaacucguuuuucuuaa

SEQ ID NO: 4058081 - RNA, 22 nt, Vaccinia virus
auaacuuuuuaccucauaugaa

SEQ ID NO: 4058082 - RNA, 14 nt, Vaccinia virus
auaacuuuuucaau

SEQ ID NO: 4058083 - RNA, 13 nt, Vaccinia virus
auaagaacuauau

SEQ ID NO: 4058084 - RNA, 22 nt, Vaccinia virus
auaagaaugacuccuauguuuc

SEQ ID NO: 4058085 - RNA, 15 nt, Vaccinia virus
auaaguguugucaaa

SEQ ID NO: 4058086 - RNA, 17 nt, Vaccinia virus
auaauaaaaguuaucca

SEQ ID NO: 4058087 - RNA, 13 nt, Vaccinia virus
auaauaaauacuu

SEQ ID NO: 4058088 - RNA, 14 nt, Vaccinia virus
auaauaacaucgau

SEQ ID NO: 4058089 - RNA, 15 nt, Vaccinia virus
auaauaacaucgauu

SEQ ID NO: 4058090 - RNA, 14 nt, Vaccinia virus
auaauaauauauau

SEQ ID NO: 4058091 - RNA, 11 nt, Vaccinia virus
auaauacuuug

SEQ ID NO: 4058092 - RNA, 14 nt, Vaccinia virus
auaauagacauaau

SEQ ID NO: 4058093 - RNA, 17 nt, Vaccinia virus
auaauagagugugguau

SEQ ID NO: 4058094 - RNA, 17 nt, Vaccinia virus
auaauagcaacauauga

SEQ ID NO: 4058095 - RNA, 20 nt, Vaccinia virus
auaauagguggaacguauau

SEQ ID NO: 4058096 - RNA, 13 nt, Vaccinia virus
auaauauaaacau

SEQ ID NO: 4058097 - RNA, 20 nt, Vaccinia virus
auaauauagagguguuuuau

SEQ ID NO: 4058098 - RNA, 23 nt, Vaccinia virus
auaauaucagaccguacauacau

SEQ ID NO: 4058099 - RNA, 14 nt, Vaccinia virus
auaauaucagaugu

SEQ ID NO: 4058100 - RNA, 17 nt, Vaccinia virus
auaauauccgaauauau

SEQ ID NO: 4058101 - RNA, 16 nt, Vaccinia virus
auaauccagaauguac

SEQ ID NO: 4058102 - RNA, 14 nt, Vaccinia virus
auaauccagauuuu

SEQ ID NO: 4058103 - RNA, 21 nt, Vaccinia virus
auaaucccauucuaauacuuu

SEQ ID NO: 4058104 - RNA, 21 nt, Vaccinia virus
auaauccuaucuaagauguug

SEQ ID NO: 4058105 - RNA, 17 nt, Vaccinia virus
auaauccuuauacaucu

SEQ ID NO: 4058106 - RNA, 19 nt, Vaccinia virus
auaaucugguggauacucu

SEQ ID NO: 4058107 - RNA, 19 nt, Vaccinia virus
auaaugacuguagauauua

SEQ ID NO: 4058108 - RNA, 16 nt, Vaccinia virus
auaaugaguuagauua

SEQ ID NO: 4058109 - RNA, 15 nt, Vaccinia virus
auaaugauacaguac

SEQ ID NO: 4058110 - RNA, 17 nt, Vaccinia virus
auaaugauagacaagau

SEQ ID NO: 4058111 - RNA, 17 nt, Vaccinia virus
auaaugaugaccuauau

SEQ ID NO: 4058112 - RNA, 18 nt, Vaccinia virus
auaauggaucuucuagua

SEQ ID NO: 4058113 - RNA, 18 nt, Vaccinia virus
auaauguaaaaucaugau

SEQ ID NO: 4058114 - RNA, 16 nt, Vaccinia virus
auaauguuaccguguu

SEQ ID NO: 4058115 - RNA, 15 nt, Vaccinia virus
auaauuauagaucag

SEQ ID NO: 4058116 - RNA, 13 nt, Vaccinia virus
auaauuauuucca

SEQ ID NO: 4058117 - RNA, 19 nt, Vaccinia virus
auaauugagauugauguaa

SEQ ID NO: 4058118 - RNA, 21 nt, Vaccinia virus
acaucuauauugcuacauaau

SEQ ID NO: 4058119 - RNA, 10 nt, Vaccinia virus
acaucuaucu

SEQ ID NO: 4058120 - RNA, 14 nt, Vaccinia virus
acaucucgcaauaa

SEQ ID NO: 4058121 - RNA, 13 nt, Vaccinia virus
acaucuguuugag

SEQ ID NO: 4058122 - RNA, 15 nt, Vaccinia virus
acaucuugauacuuu

SEQ ID NO: 4058123 - RNA, 14 nt, Vaccinia virus
acauggaacucaug

SEQ ID NO: 4058124 - RNA, 14 nt, Vaccinia virus
acaugggaaaugau

SEQ ID NO: 4058125 - RNA, 13 nt, Vaccinia virus
acauguaauacau

SEQ ID NO: 4058126 - RNA, 23 nt, Vaccinia virus
acauguaucgacgguaaauggaa

SEQ ID NO: 4058127 - RNA, 15 nt, Vaccinia virus
acaugugucauuuau

SEQ ID NO: 4058128 - RNA, 17 nt, Vaccinia virus
acgcuagcgacucuguu

SEQ ID NO: 4058129 - RNA, 17 nt, Vaccinia virus
acgcugaaguaauuaau

SEQ ID NO: 4058130 - RNA, 16 nt, Vaccinia virus
acggaaaaaugcaugu

SEQ ID NO: 4058131 - RNA, 18 nt, Vaccinia virus
acggagccccaggaucuc

SEQ ID NO: 4058132 - RNA, 22 nt, Vaccinia virus
acgggaaaggaauuaauuauuc

SEQ ID NO: 4058133 - RNA, 18 nt, Vaccinia virus
acguaaugaaguuaauga

SEQ ID NO: 4058134 - RNA, 15 nt, Vaccinia virus
acguagaaaacggau

SEQ ID NO: 4058135 - RNA, 23 nt, Vaccinia virus
acguaucaccaacggaaauggua

SEQ ID NO: 4058136 - RNA, 15 nt, Vaccinia virus
acgucaucaaaaaua

SEQ ID NO: 4058137 - RNA, 22 nt, Vaccinia virus
acgucauccuuuccgaaagaua

SEQ ID NO: 4058138 - RNA, 13 nt, Vaccinia virus
acgucauuucauc

SEQ ID NO: 4058139 - RNA, 21 nt, Vaccinia virus
acgugauggauauauuaaagu

SEQ ID NO: 4058140 - RNA, 14 nt, Vaccinia virus
acgugauuuuauca

SEQ ID NO: 4058141 - RNA, 13 nt, Vaccinia virus
acguuaaacauua

SEQ ID NO: 4058142 - RNA, 18 nt, Vaccinia virus
acguucacuaauaaauug

SEQ ID NO: 4058143 - RNA, 15 nt, Vaccinia virus
acguucauagaauuu

SEQ ID NO: 4058144 - RNA, 19 nt, Vaccinia virus
acguucggagacaauaaag

SEQ ID NO: 4058145 - RNA, 22 nt, Vaccinia virus
acguugauggacagaugauaca

SEQ ID NO: 4058146 - RNA, 21 nt, Vaccinia virus
acguuguaaaacauaaaggaa

SEQ ID NO: 4058147 - RNA, 15 nt, Vaccinia virus
acguuuaauaauaau

SEQ ID NO: 4058148 - RNA, 22 nt, Vaccinia virus
acguuuagccgccuuuaauaga

SEQ ID NO: 4058149 - RNA, 19 nt, Vaccinia virus
acguuucugucaacaaugu

SEQ ID NO: 4058150 - RNA, 13 nt, Vaccinia virus
acuaaacacauua

SEQ ID NO: 4058151 - RNA, 13 nt, Vaccinia virus
acuaaauacauua

SEQ ID NO: 4058152 - RNA, 20 nt, Vaccinia virus
acuaaauuaacaauaucaau

SEQ ID NO: 4058153 - RNA, 16 nt, Vaccinia virus
acuaacaauaacuaga

SEQ ID NO: 4058154 - RNA, 16 nt, Vaccinia virus
acuaacgaaauuaaua

SEQ ID NO: 4058155 - RNA, 14 nt, Vaccinia virus
acuaauaaacauuc

SEQ ID NO: 4058156 - RNA, 14 nt, Vaccinia virus
acuaauaauaauua

SEQ ID NO: 4058157 - RNA, 16 nt, Vaccinia virus
acuaauacaucugaaa

SEQ ID NO: 4058158 - RNA, 17 nt, Vaccinia virus
acuaaugacaauaauua

SEQ ID NO: 4058159 - RNA, 19 nt, Vaccinia virus
acuaaugcaucuauuucau

SEQ ID NO: 4058160 - RNA, 20 nt, Vaccinia virus
acuaaugcaucuauuucauc

SEQ ID NO: 4058161 - RNA, 14 nt, Vaccinia virus
acuaauguuaauug

SEQ ID NO: 4058162 - RNA, 18 nt, Vaccinia virus
acuaauuuuuauuaauga

SEQ ID NO: 4058163 - RNA, 14 nt, Vaccinia virus
acuacaauauuuca

SEQ ID NO: 4058164 - RNA, 15 nt, Vaccinia virus
acuacaauauuucau

SEQ ID NO: 4058165 - RNA, 16 nt, Vaccinia virus
acuacaucuuuaagau

SEQ ID NO: 4058166 - RNA, 18 nt, Vaccinia virus
acuaccucagacugguag

SEQ ID NO: 4058167 - RNA, 13 nt, Vaccinia virus
acuaccuuaauaa

SEQ ID NO: 4058168 - RNA, 15 nt, Vaccinia virus
acuacguugaagauc

SEQ ID NO: 4058169 - RNA, 22 nt, Vaccinia virus
acuacuaggagggaaaaugaag

SEQ ID NO: 4058170 - RNA, 12 nt, Vaccinia virus
acuacuggaaua

SEQ ID NO: 4058171 - RNA, 19 nt, Vaccinia virus
acuagaaagggaaaaauua

SEQ ID NO: 4058172 - RNA, 13 nt, Vaccinia virus
acuagaagagaau

SEQ ID NO: 4058173 - RNA, 14 nt, Vaccinia virus
acuagaauaaagca

SEQ ID NO: 4058174 - RNA, 23 nt, Vaccinia virus
acuagaguaguauauugucacau

SEQ ID NO: 4058175 - RNA, 23 nt, Vaccinia virus
acuagauaaacuaucaguaaguu

SEQ ID NO: 4058176 - RNA, 16 nt, Vaccinia virus
acuaguauauguggaa

SEQ ID NO: 4058177 - RNA, 18 nt, Vaccinia virus
acuauaaaauaaaaugag

SEQ ID NO: 4058178 - RNA, 18 nt, Vaccinia virus
acuauaaauggagaaugu

SEQ ID NO: 4058179 - RNA, 23 nt, Vaccinia virus
acuauagaccaaacugcaaaugu

SEQ ID NO: 4058180 - RNA, 20 nt, Vaccinia virus
acuauaguacaccuagagaa

SEQ ID NO: 4058181 - RNA, 14 nt, Vaccinia virus
acuauauguuccag

SEQ ID NO: 4058182 - RNA, 23 nt, Vaccinia virus
acuaucagaaucaguuacauguu

SEQ ID NO: 4058183 - RNA, 15 nt, Vaccinia virus
acuaucauaauuaaa

SEQ ID NO: 4058184 - RNA, 19 nt, Vaccinia virus
acuaucgcaucaaaaggau

SEQ ID NO: 4058185 - RNA, 14 nt, Vaccinia virus
acuaucuaaaugua

SEQ ID NO: 4058186 - RNA, 23 nt, Vaccinia virus
acuaugaauccgaugaucucacu

SEQ ID NO: 4058187 - RNA, 16 nt, Vaccinia virus
acuaugccaaaugaau

SEQ ID NO: 4058188 - RNA, 20 nt, Vaccinia virus
acuaugccaagcguaugcug

SEQ ID NO: 4058189 - RNA, 18 nt, Vaccinia virus
acuaugcgauuauuuuca

SEQ ID NO: 4058190 - RNA, 16 nt, Vaccinia virus
acuauggcaauaauug

SEQ ID NO: 4058191 - RNA, 16 nt, Vaccinia virus
acuaugucaaaaauug

SEQ ID NO: 4058192 - RNA, 18 nt, Vaccinia virus
acuauguuuuuuauuaga

SEQ ID NO: 4058193 - RNA, 20 nt, Vaccinia virus
acuauuauacucuguauuag

SEQ ID NO: 4058194 - RNA, 15 nt, Vaccinia virus
acuauucauggaaau

SEQ ID NO: 4058195 - RNA, 22 nt, Vaccinia virus
acuauuccuagcaucagcaaaa

SEQ ID NO: 4058196 - RNA, 17 nt, Vaccinia virus
acuauugacuuaauagg

SEQ ID NO: 4058197 - RNA, 16 nt, Vaccinia virus
acuauuuggauagaca

SEQ ID NO: 4058198 - RNA, 18 nt, Vaccinia virus
acuauuugucuuaauaga

SEQ ID NO: 4058199 - RNA, 20 nt, Vaccinia virus
acuauuuuaaauagcauaga

SEQ ID NO: 4058200 - RNA, 16 nt, Vaccinia virus
acucacgcaauuauua

SEQ ID NO: 4058201 - RNA, 17 nt, Vaccinia virus
acucauaaauaaaaaug

SEQ ID NO: 4058202 - RNA, 16 nt, Vaccinia virus
acuccaauuaucuuua

SEQ ID NO: 4058203 - RNA, 14 nt, Vaccinia virus
acuccguagagaaa

SEQ ID NO: 4058204 - RNA, 12 nt, Vaccinia virus
acucuaaaauau

SEQ ID NO: 4058205 - RNA, 23 nt, Vaccinia virus
acucuacacguguccacauccuu

SEQ ID NO: 4058206 - RNA, 16 nt, Vaccinia virus
acucuacguaucucgu

SEQ ID NO: 4058207 - RNA, 22 nt, Vaccinia virus
acucuaucauggcaauaacaca

SEQ ID NO: 4058208 - RNA, 16 nt, Vaccinia virus
acucuauucuucaaga

SEQ ID NO: 4058209 - RNA, 20 nt, Vaccinia virus
acucucuacccuaaacuuua

SEQ ID NO: 4058210 - RNA, 23 nt, Vaccinia virus
acucuuacaacgccaucaugaau

SEQ ID NO: 4058211 - RNA, 14 nt, Vaccinia virus
acugaaucauauau

SEQ ID NO: 4058212 - RNA, 14 nt, Vaccinia virus
acugacuuaauagu

SEQ ID NO: 4058213 - RNA, 15 nt, Vaccinia virus
acugauaccaugaaa

SEQ ID NO: 4058214 - RNA, 18 nt, Vaccinia virus
acugauuaauuauuugcc

SEQ ID NO: 4058215 - RNA, 13 nt, Vaccinia virus
acugauuagaaau

SEQ ID NO: 4058216 - RNA, 15 nt, Vaccinia virus
acugauucagaaaug

SEQ ID NO: 4058217 - RNA, 16 nt, Vaccinia virus
acugcaauaaaacauu

SEQ ID NO: 4058218 - RNA, 21 nt, Vaccinia virus
acugcagcaaaggcaauaagu

SEQ ID NO: 4058219 - RNA, 17 nt, Vaccinia virus
acugcauccuucuaaga

SEQ ID NO: 4058220 - RNA, 13 nt, Vaccinia virus
acugcugugaaua

SEQ ID NO: 4058221 - RNA, 18 nt, Vaccinia virus
acugcuuuaggugcugaa

SEQ ID NO: 4058222 - RNA, 19 nt, Vaccinia virus
acuggucauagaaaaugau

SEQ ID NO: 4058223 - RNA, 20 nt, Vaccinia virus
acuggucauagaaaaugauu

SEQ ID NO: 4058224 - RNA, 20 nt, Vaccinia virus
acugguguauauaauuauuu

SEQ ID NO: 4058225 - RNA, 16 nt, Vaccinia virus
acugguuaaaauccuc

SEQ ID NO: 4058226 - RNA, 22 nt, Vaccinia virus
acuguacaaggaauugaugaag

SEQ ID NO: 4058227 - RNA, 19 nt, Vaccinia virus
acuguacccacuaugaaua

SEQ ID NO: 4058228 - RNA, 19 nt, Vaccinia virus
acuguagauauuauauaga

SEQ ID NO: 4058229 - RNA, 22 nt, Vaccinia virus
acuguaucgauuucuacauaua

SEQ ID NO: 4058230 - RNA, 16 nt, Vaccinia virus
acuguccaaaaugaug

SEQ ID NO: 4058231 - RNA, 14 nt, Vaccinia virus
acugucuaaaugua

SEQ ID NO: 4058232 - RNA, 15 nt, Vaccinia virus
acuguggauguaaua

SEQ ID NO: 4058233 - RNA, 20 nt, Vaccinia virus
acuguggaugugacagacug

SEQ ID NO: 4058234 - RNA, 19 nt, Vaccinia virus
acuguuauuacuacugaag

SEQ ID NO: 4058235 - RNA, 13 nt, Vaccinia virus
acuguucaagaau

SEQ ID NO: 4058236 - RNA, 22 nt, Vaccinia virus
acuguugaaguacuuaaugaag

SEQ ID NO: 4058237 - RNA, 15 nt, Vaccinia virus
acuguuuauuaauga

SEQ ID NO: 4058238 - RNA, 20 nt, Vaccinia virus
acuguuuuccugaaggaaau

SEQ ID NO: 4058239 - RNA, 14 nt, Vaccinia virus
acuuaaaaaaugaa

SEQ ID NO: 4058240 - RNA, 16 nt, Vaccinia virus
acuuaaugaaaaaugu

SEQ ID NO: 4058241 - RNA, 16 nt, Vaccinia virus
acuuacugacaaaguu

SEQ ID NO: 4058242 - RNA, 16 nt, Vaccinia virus
acuuagauuaaauucu

SEQ ID NO: 4058243 - RNA, 19 nt, Vaccinia virus
acuucaaaguuguuaaaaa

SEQ ID NO: 4058244 - RNA, 23 nt, Vaccinia virus
acuucaaaguuguuaaaaaauua

SEQ ID NO: 4058245 - RNA, 18 nt, Vaccinia virus
acuucagaugauggugca

SEQ ID NO: 4058246 - RNA, 17 nt, Vaccinia virus
acuuccaauaaaauuac

SEQ ID NO: 4058247 - RNA, 23 nt, Vaccinia virus
acuuccucauuaagauugucaug

SEQ ID NO: 4058248 - RNA, 16 nt, Vaccinia virus
acuucguuuaucuugg

SEQ ID NO: 4058249 - RNA, 18 nt, Vaccinia virus
acuucuuggaaugauacu

SEQ ID NO: 4058250 - RNA, 22 nt, Vaccinia virus
acuugaaauaaucggagaaugu

SEQ ID NO: 4058251 - RNA, 13 nt, Vaccinia virus
acuuguuaauagu

SEQ ID NO: 4058252 - RNA, 22 nt, Vaccinia virus
agcaauuagugccguauacuuu

SEQ ID NO: 4058253 - RNA, 18 nt, Vaccinia virus
agcaauuaugaaacaaua

SEQ ID NO: 4058254 - RNA, 16 nt, Vaccinia virus
agcacaucaaaugaug

SEQ ID NO: 4058255 - RNA, 23 nt, Vaccinia virus
agcacgaucgugguuaacaauau

SEQ ID NO: 4058256 - RNA, 18 nt, Vaccinia virus
agcacguggaaaaaaagu

SEQ ID NO: 4058257 - RNA, 21 nt, Vaccinia virus
agcacuacgcaauaugaucac

SEQ ID NO: 4058258 - RNA, 21 nt, Vaccinia virus
agcacucguuauuaauacaag

SEQ ID NO: 4058259 - RNA, 16 nt, Vaccinia virus
agcagacuagaaauaa

SEQ ID NO: 4058260 - RNA, 22 nt, Vaccinia virus
agcagauuagacgauaugacau

SEQ ID NO: 4058261 - RNA, 16 nt, Vaccinia virus
agcauauuagaaucua

SEQ ID NO: 4058262 - RNA, 21 nt, Vaccinia virus
agcauauuccuaaauacaucu

SEQ ID NO: 4058263 - RNA, 19 nt, Vaccinia virus
agcauauuguaauaucuua

SEQ ID NO: 4058264 - RNA, 17 nt, Vaccinia virus
agcaucaauaauuguuu

SEQ ID NO: 4058265 - RNA, 18 nt, Vaccinia virus
agcaucauaaaaaugagu

SEQ ID NO: 4058266 - RNA, 14 nt, Vaccinia virus
agcaucuaacuuga

SEQ ID NO: 4058267 - RNA, 22 nt, Vaccinia virus
agcaucuugaauagaaacgaua

SEQ ID NO: 4058268 - RNA, 11 nt, Vaccinia virus
agcauguagaa

SEQ ID NO: 4058269 - RNA, 13 nt, Vaccinia virus
agcauuaauacag

SEQ ID NO: 4058270 - RNA, 19 nt, Vaccinia virus
agcauucacagauucuauu

SEQ ID NO: 4058271 - RNA, 14 nt, Vaccinia virus
agcauugaaaauac

SEQ ID NO: 4058272 - RNA, 21 nt, Vaccinia virus
agccaagacgaacaaaaucaa

SEQ ID NO: 4058273 - RNA, 16 nt, Vaccinia virus
agccaauccuaacucu

SEQ ID NO: 4058274 - RNA, 21 nt, Vaccinia virus
agccauucuucccauggaugu

SEQ ID NO: 4058275 - RNA, 18 nt, Vaccinia virus
agcgcauaauaaauuaua

SEQ ID NO: 4058276 - RNA, 14 nt, Vaccinia virus
agcggauaaugaua

SEQ ID NO: 4058277 - RNA, 19 nt, Vaccinia virus
agcggauaaugauagaauu

SEQ ID NO: 4058278 - RNA, 14 nt, Vaccinia virus
agcggcaucuaaau

SEQ ID NO: 4058279 - RNA, 14 nt, Vaccinia virus
agcgguguuauuau

SEQ ID NO: 4058280 - RNA, 21 nt, Vaccinia virus
agcguacagauacgaugauga

SEQ ID NO: 4058281 - RNA, 15 nt, Vaccinia virus
agcuaagucuauuau

SEQ ID NO: 4058282 - RNA, 15 nt, Vaccinia virus
agcuaauaccaauuu

SEQ ID NO: 4058283 - RNA, 23 nt, Vaccinia virus
agcuaauauaaaaauauauuaau

SEQ ID NO: 4058284 - RNA, 14 nt, Vaccinia virus
agcuacucuagauu

SEQ ID NO: 4058285 - RNA, 16 nt, Vaccinia virus
agcuaucaaaauaugu

SEQ ID NO: 4058286 - RNA, 22 nt, Vaccinia virus
agcuaugaacuuguuuaaugac

SEQ ID NO: 4058287 - RNA, 21 nt, Vaccinia virus
agcuaugcgauuggauaagaa

SEQ ID NO: 4058288 - RNA, 20 nt, Vaccinia virus
agcuauuaucaaauacugua

SEQ ID NO: 4058289 - RNA, 17 nt, Vaccinia virus
agcuauugcauaauaca

SEQ ID NO: 4058290 - RNA, 15 nt, Vaccinia virus
agcuccaucaguuuu

SEQ ID NO: 4058291 - RNA, 23 nt, Vaccinia virus
agcuccuaauggagauuuucuau

SEQ ID NO: 4058292 - RNA, 15 nt, Vaccinia virus
agcuccugguauaug

SEQ ID NO: 4058293 - RNA, 17 nt, Vaccinia virus
agcucucguauucaguu

SEQ ID NO: 4058294 - RNA, 21 nt, Vaccinia virus
agcucucguauucaguuucau

SEQ ID NO: 4058295 - RNA, 16 nt, Vaccinia virus
agcucuuugaaguuuu

SEQ ID NO: 4058296 - RNA, 14 nt, Vaccinia virus
agcuggucuaaaau

SEQ ID NO: 4058297 - RNA, 19 nt, Vaccinia virus
agcugugaguauuaaugau

SEQ ID NO: 4058298 - RNA, 14 nt, Vaccinia virus
agcuuaaacuacua

SEQ ID NO: 4058299 - RNA, 19 nt, Vaccinia virus
agcuucaucuauaucuaga

SEQ ID NO: 4058300 - RNA, 22 nt, Vaccinia virus
agcuucgcugguaguuuaauau

SEQ ID NO: 4058301 - RNA, 15 nt, Vaccinia virus
agcuucguauacucu

SEQ ID NO: 4058302 - RNA, 19 nt, Vaccinia virus
agcuuucacucauaugaca

SEQ ID NO: 4058303 - RNA, 20 nt, Vaccinia virus
agcuuucacuuaaacuguau

SEQ ID NO: 4058304 - RNA, 20 nt, Vaccinia virus
agcuuucauaguuagauaca

SEQ ID NO: 4058305 - RNA, 13 nt, Vaccinia virus
aggaaaaaagaua

SEQ ID NO: 4058306 - RNA, 12 nt, Vaccinia virus
aggaaaaguauu

SEQ ID NO: 4058307 - RNA, 14 nt, Vaccinia virus
aggaaauaucaauu

SEQ ID NO: 4058308 - RNA, 18 nt, Vaccinia virus
aggaaauuaugagaauga

SEQ ID NO: 4058309 - RNA, 13 nt, Vaccinia virus
aggaacaaauauu

SEQ ID NO: 4058310 - RNA, 18 nt, Vaccinia virus
aggaacuggauauuacaa

SEQ ID NO: 4058311 - RNA, 17 nt, Vaccinia virus
aggaagaauaucauauu

SEQ ID NO: 4058312 - RNA, 19 nt, Vaccinia virus
aggaaugauugccuucauc

SEQ ID NO: 4058313 - RNA, 21 nt, Vaccinia virus
aggaauuacauagaugauauu

SEQ ID NO: 4058314 - RNA, 20 nt, Vaccinia virus
aggacaaagugaaacaauca

SEQ ID NO: 4058315 - RNA, 17 nt, Vaccinia virus
aggacaccacuaucuga

SEQ ID NO: 4058316 - RNA, 14 nt, Vaccinia virus
aggacguaauacau

SEQ ID NO: 4058317 - RNA, 13 nt, Vaccinia virus
aggacuauuagaa

SEQ ID NO: 4058318 - RNA, 13 nt, Vaccinia virus
aggacuuaacaau

SEQ ID NO: 4058319 - RNA, 20 nt, Vaccinia virus
aggacuuucuucaaagaaaa

SEQ ID NO: 4058320 - RNA, 14 nt, Vaccinia virus
aggagaacaaagaa

SEQ ID NO: 4058321 - RNA, 22 nt, Vaccinia virus
aggagaugauagucauuugacu

SEQ ID NO: 4058322 - RNA, 14 nt, Vaccinia virus
aggagauuaaagga

SEQ ID NO: 4058323 - RNA, 18 nt, Vaccinia virus
aggagauuuagaaauguu

SEQ ID NO: 4058324 - RNA, 16 nt, Vaccinia virus
aggagcauacaguaag

SEQ ID NO: 4058325 - RNA, 17 nt, Vaccinia virus
aggagccgaaaacauug

SEQ ID NO: 4058326 - RNA, 17 nt, Vaccinia virus
aggagucgccaaaugua

SEQ ID NO: 4058327 - RNA, 19 nt, Vaccinia virus
aggauaaaauauuauccaa

SEQ ID NO: 4058328 - RNA, 13 nt, Vaccinia virus
aggauaaaguaaa

SEQ ID NO: 4058329 - RNA, 12 nt, Vaccinia virus
aggauaauacau

SEQ ID NO: 4058330 - RNA, 21 nt, Vaccinia virus
aggauacacucucaauauacu

SEQ ID NO: 4058331 - RNA, 18 nt, Vaccinia virus
aggauaccgaagaauuaa

SEQ ID NO: 4058332 - RNA, 15 nt, Vaccinia virus
aggauagagcaauaa

SEQ ID NO: 4058333 - RNA, 17 nt, Vaccinia virus
aggauauauuaaagucu

SEQ ID NO: 4058334 - RNA, 14 nt, Vaccinia virus
aggauaucucaaaa

SEQ ID NO: 4058335 - RNA, 20 nt, Vaccinia virus
aggauaugauaaaaaauaua

SEQ ID NO: 4058336 - RNA, 18 nt, Vaccinia virus
aggaucuagcaaaggaaa

SEQ ID NO: 4058337 - RNA, 17 nt, Vaccinia virus
aggauuauaaucucauu

SEQ ID NO: 4058338 - RNA, 20 nt, Vaccinia virus
aggauucgauuuugauguau

SEQ ID NO: 4058339 - RNA, 23 nt, Vaccinia virus
aggauugauuacuauaaauggag

SEQ ID NO: 4058340 - RNA, 18 nt, Vaccinia virus
aggauuggucuuaaaaga

SEQ ID NO: 4058341 - RNA, 13 nt, Vaccinia virus
aggauuuucuaga

SEQ ID NO: 4058342 - RNA, 22 nt, Vaccinia virus
aggcaacaaguauacaauuuug

SEQ ID NO: 4058343 - RNA, 17 nt, Vaccinia virus
aggcacauaauaucuuu

SEQ ID NO: 4058344 - RNA, 18 nt, Vaccinia virus
aggccaaagaaaugagua

SEQ ID NO: 4058345 - RNA, 20 nt, Vaccinia virus
aggcguaucugauacaggcg

SEQ ID NO: 4058346 - RNA, 16 nt, Vaccinia virus
agggaagcaaaugaug

SEQ ID NO: 4058347 - RNA, 23 nt, Vaccinia virus
agggauaggaguaggaaugccac

SEQ ID NO: 4058348 - RNA, 22 nt, Vaccinia virus
aggggaaaaauuauaauguuuc

SEQ ID NO: 4058349 - RNA, 24 nt, Vaccinia virus
aggguccauuuucuguaaauagaa

SEQ ID NO: 4058350 - RNA, 20 nt, Vaccinia virus
agguaaaguaggacauaaua

SEQ ID NO: 4058351 - RNA, 17 nt, Vaccinia virus
agguaacauaaaaacug

SEQ ID NO: 4058352 - RNA, 14 nt, Vaccinia virus
agguacuaggaaaa

SEQ ID NO: 4058353 - RNA, 16 nt, Vaccinia virus
agguaguaaaaaauaa

SEQ ID NO: 4058354 - RNA, 13 nt, Vaccinia virus
agguauuuauuca

SEQ ID NO: 4058355 - RNA, 20 nt, Vaccinia virus
aggugaugcugguucuggag

SEQ ID NO: 4058356 - RNA, 17 nt, Vaccinia virus
agguggcuaccgacaau

SEQ ID NO: 4058357 - RNA, 21 nt, Vaccinia virus
agguuacguauagucuauaug

SEQ ID NO: 4058358 - RNA, 22 nt, Vaccinia virus
aguaaaacuuucuaguuaucau

SEQ ID NO: 4058359 - RNA, 15 nt, Vaccinia virus
aguaaagaaaagaua

SEQ ID NO: 4058360 - RNA, 18 nt, Vaccinia virus
aguaaaugaaaaaaaacu

SEQ ID NO: 4058361 - RNA, 22 nt, Vaccinia virus
aguaaccccauauaauguagac

SEQ ID NO: 4058362 - RNA, 15 nt, Vaccinia virus
aguaacgcaauacaa

SEQ ID NO: 4058363 - RNA, 21 nt, Vaccinia virus
aguaacuauguaaaugauaac

SEQ ID NO: 4058364 - RNA, 14 nt, Vaccinia virus
aguaagaauaagac

SEQ ID NO: 4058365 - RNA, 14 nt, Vaccinia virus
aguaagcauuuccu

SEQ ID NO: 4058366 - RNA, 19 nt, Vaccinia virus
aguaaguacaucaucugga

SEQ ID NO: 4058367 - RNA, 13 nt, Vaccinia virus
aguaaguaucuua

SEQ ID NO: 4058368 - RNA, 19 nt, Vaccinia virus
aguaagugcaacaucugga

SEQ ID NO: 4058369 - RNA, 17 nt, Vaccinia virus
aguaagugucauuuaac

SEQ ID NO: 4058370 - RNA, 22 nt, Vaccinia virus
aguaauaaaacaaaaaaaagaa

SEQ ID NO: 4058371 - RNA, 17 nt, Vaccinia virus
aguaaucauauaaaugu

SEQ ID NO: 4058372 - RNA, 24 nt, Vaccinia virus
aguaaugaagaaaaguauuaccuc

SEQ ID NO: 4058373 - RNA, 11 nt, Vaccinia virus
aguaauguuua

SEQ ID NO: 4058374 - RNA, 17 nt, Vaccinia virus
aguaauuuguucaaaau

SEQ ID NO: 4058375 - RNA, 14 nt, Vaccinia virus
aguuuucaucaaug

SEQ ID NO: 4058376 - RNA, 19 nt, Vaccinia virus
aguuuuguucauuaauagu

SEQ ID NO: 4058377 - RNA, 16 nt, Vaccinia virus
auaaaaaaagcaaugu

SEQ ID NO: 4058378 - RNA, 11 nt, Vaccinia virus
auaaaaaauua

SEQ ID NO: 4058379 - RNA, 16 nt, Vaccinia virus
auaaaaacgaggauau

SEQ ID NO: 4058380 - RNA, 16 nt, Vaccinia virus
auaaaaauaacaauua

SEQ ID NO: 4058381 - RNA, 22 nt, Vaccinia virus
auaaaaauaguaucaacaauca

SEQ ID NO: 4058382 - RNA, 20 nt, Vaccinia virus
auaaaaauguuuuuguuuaa

SEQ ID NO: 4058383 - RNA, 16 nt, Vaccinia virus
auaaaaauuauguuuu

SEQ ID NO: 4058384 - RNA, 15 nt, Vaccinia virus
auaaaacuuuauuau

SEQ ID NO: 4058385 - RNA, 14 nt, Vaccinia virus
auaaaagaauaugu

SEQ ID NO: 4058386 - RNA, 14 nt, Vaccinia virus
auaaaauggauaac

SEQ ID NO: 4058387 - RNA, 22 nt, Vaccinia virus
auaaaauuuaagagaaugauua

SEQ ID NO: 4058388 - RNA, 14 nt, Vaccinia virus
auaaacacauagaa

SEQ ID NO: 4058389 - RNA, 14 nt, Vaccinia virus
auaaacaucaacau

SEQ ID NO: 4058390 - RNA, 17 nt, Vaccinia virus
auaaacauuguuuguau

SEQ ID NO: 4058391 - RNA, 12 nt, Vaccinia virus
auaaacuagaga

SEQ ID NO: 4058392 - RNA, 21 nt, Vaccinia virus
auaaacucacauuucaaauau

SEQ ID NO: 4058393 - RNA, 17 nt, Vaccinia virus
auaaacuccguguuuau

SEQ ID NO: 4058394 - RNA, 19 nt, Vaccinia virus
auaaacuuuauccauaucu

SEQ ID NO: 4058395 - RNA, 15 nt, Vaccinia virus
auaaagaaaauaugg

SEQ ID NO: 4058396 - RNA, 21 nt, Vaccinia virus
auaaagaaguuauagaaugua

SEQ ID NO: 4058397 - RNA, 14 nt, Vaccinia virus
auaaagaaugaaug

SEQ ID NO: 4058398 - RNA, 17 nt, Vaccinia virus
auaaagacaaacaaugg

SEQ ID NO: 4058399 - RNA, 19 nt, Vaccinia virus
auaaagaccgaauacauaa

SEQ ID NO: 4058400 - RNA, 16 nt, Vaccinia virus
auaaagauauaaauga

SEQ ID NO: 4058401 - RNA, 13 nt, Vaccinia virus
auaaagauauaca

SEQ ID NO: 4058402 - RNA, 23 nt, Vaccinia virus
auaaagaugacgaugaaaaugau

SEQ ID NO: 4058403 - RNA, 16 nt, Vaccinia virus
auaaaggcagaaaugc

SEQ ID NO: 4058404 - RNA, 16 nt, Vaccinia virus
auaaaguuuauacaag

SEQ ID NO: 4058405 - RNA, 13 nt, Vaccinia virus
auaaauaaugaau

SEQ ID NO: 4058406 - RNA, 23 nt, Vaccinia virus
auaaauaaugaucguaaugaaca

SEQ ID NO: 4058407 - RNA, 13 nt, Vaccinia virus
auaaauauacaau

SEQ ID NO: 4058408 - RNA, 18 nt, Vaccinia virus
auaaauauuuuuauucag

SEQ ID NO: 4058409 - RNA, 20 nt, Vaccinia virus
auaaaucauauaaaaaauga

SEQ ID NO: 4058410 - RNA, 17 nt, Vaccinia virus
auaaauccgaugucuug

SEQ ID NO: 4058411 - RNA, 19 nt, Vaccinia virus
auaaaugauucaaccauga

SEQ ID NO: 4058412 - RNA, 13 nt, Vaccinia virus
auaaauggaaaug

SEQ ID NO: 4058413 - RNA, 18 nt, Vaccinia virus
auaaauggagaucuaaau

SEQ ID NO: 4058414 - RNA, 18 nt, Vaccinia virus
auaaauugguaaauccua

SEQ ID NO: 4058415 - RNA, 19 nt, Vaccinia virus
auaacaaaauccaaacauu

SEQ ID NO: 4058416 - RNA, 23 nt, Vaccinia virus
auaacaagagauuuauuguguau

SEQ ID NO: 4058417 - RNA, 21 nt, Vaccinia virus
auaacaaguuuccuguaaauu

SEQ ID NO: 4058418 - RNA, 18 nt, Vaccinia virus
auaacacaaaaugugaac

SEQ ID NO: 4058419 - RNA, 22 nt, Vaccinia virus
auaacagcuuagauuuaacguu

SEQ ID NO: 4058420 - RNA, 14 nt, Vaccinia virus
auaacaguaucuga

SEQ ID NO: 4058421 - RNA, 20 nt, Vaccinia virus
auaacaugaacgauaaacaa

SEQ ID NO: 4058422 - RNA, 16 nt, Vaccinia virus
auaacauuaauaucaa

SEQ ID NO: 4058423 - RNA, 22 nt, Vaccinia virus
auaacauucuaggaauguuguu

SEQ ID NO: 4058424 - RNA, 17 nt, Vaccinia virus
auaacauucuuaaacaa

SEQ ID NO: 4058425 - RNA, 15 nt, Vaccinia virus
auaacauuguuuaug

SEQ ID NO: 4058426 - RNA, 24 nt, Vaccinia virus
auaacauuuauuaucaugaugaca

SEQ ID NO: 4058427 - RNA, 17 nt, Vaccinia virus
auaaccuagaaaauaua

SEQ ID NO: 4058428 - RNA, 23 nt, Vaccinia virus
auaaccuucuaccgaacacuaac

SEQ ID NO: 4058429 - RNA, 16 nt, Vaccinia virus
auaaccuuuuccuuau

SEQ ID NO: 4058430 - RNA, 19 nt, Vaccinia virus
auaacguaaccagaauugu

SEQ ID NO: 4058431 - RNA, 14 nt, Vaccinia virus
auaacuaaaaaugu

SEQ ID NO: 4058432 - RNA, 13 nt, Vaccinia virus
auaacuaaauguc

SEQ ID NO: 4058433 - RNA, 17 nt, Vaccinia virus
auaacuaucagaguuac

SEQ ID NO: 4058434 - RNA, 21 nt, Vaccinia virus
auaacucauuuuuugaauaua

SEQ ID NO: 4058435 - RNA, 15 nt, Vaccinia virus
auaacuguuuaaaaa

SEQ ID NO: 4058436 - RNA, 18 nt, Vaccinia virus
auaacuucuagauguaga

SEQ ID NO: 4058437 - RNA, 14 nt, Vaccinia virus
auaacuuuaguaaa

SEQ ID NO: 4058438 - RNA, 17 nt, Vaccinia virus
auaacuuuuucaauauc

SEQ ID NO: 4058439 - RNA, 16 nt, Vaccinia virus
auaagaagagaaaggu

SEQ ID NO: 4058440 - RNA, 22 nt, Vaccinia virus
auaagacuuuacuuuucuaaau

SEQ ID NO: 4058441 - RNA, 15 nt, Vaccinia virus
auaagaugcaaacau

SEQ ID NO: 4058442 - RNA, 14 nt, Vaccinia virus
auaagauuaucaaa

SEQ ID NO: 4058443 - RNA, 19 nt, Vaccinia virus
auaagcuuugaauguuaua

SEQ ID NO: 4058444 - RNA, 22 nt, Vaccinia virus
auaagguacuuuuucucauaau

SEQ ID NO: 4058445 - RNA, 15 nt, Vaccinia virus
auaaguaaaugaaaa

SEQ ID NO: 4058446 - RNA, 19 nt, Vaccinia virus
auaaguaguaauaaugauu

SEQ ID NO: 4058447 - RNA, 15 nt, Vaccinia virus
auaaguauuaucaaa

SEQ ID NO: 4058448 - RNA, 15 nt, Vaccinia virus
auaauaaauugguaa

SEQ ID NO: 4058449 - RNA, 16 nt, Vaccinia virus
auaauaaauuuuucca

SEQ ID NO: 4058450 - RNA, 20 nt, Vaccinia virus
auaauaacaaguaugacauu

SEQ ID NO: 4058451 - RNA, 14 nt, Vaccinia virus
auaauaaucaaaau

SEQ ID NO: 4058452 - RNA, 13 nt, Vaccinia virus
auaauaaugaaua

SEQ ID NO: 4058453 - RNA, 23 nt, Vaccinia virus
auaauacauccuacuaugcaauu

SEQ ID NO: 4058454 - RNA, 16 nt, Vaccinia virus
auaauacauuuaaauu

SEQ ID NO: 4058455 - RNA, 15 nt, Vaccinia virus
auaauagcaacauau

SEQ ID NO: 4058456 - RNA, 17 nt, Vaccinia virus
auaauagggagaaauga

SEQ ID NO: 4058457 - RNA, 20 nt, Vaccinia virus
auaauagguuugaucguugu

SEQ ID NO: 4058458 - RNA, 13 nt, Vaccinia virus
auaauauaaucua

SEQ ID NO: 4058459 - RNA, 17 nt, Vaccinia virus
auaauaugacucaugau

SEQ ID NO: 4058460 - RNA, 15 nt, Vaccinia virus
auaauauuagauuua

SEQ ID NO: 4058461 - RNA, 16 nt, Vaccinia virus
auaaucaauaauauau

SEQ ID NO: 4058462 - RNA, 21 nt, Vaccinia virus
auaaucaccauacuagaguuu

SEQ ID NO: 4058463 - RNA, 16 nt, Vaccinia virus
auaaucagaauauaca

SEQ ID NO: 4058464 - RNA, 19 nt, Vaccinia virus
auaauccggauguugugua

SEQ ID NO: 4058465 - RNA, 21 nt, Vaccinia virus
auaaucguuuaccacuuaaau

SEQ ID NO: 4058466 - RNA, 23 nt, Vaccinia virus
auaaucuaguaaaacuuucuagu

SEQ ID NO: 4058467 - RNA, 21 nt, Vaccinia virus
auaaucuugauuguacaccca

SEQ ID NO: 4058468 - RNA, 18 nt, Vaccinia virus
auaaugacaauaaaauua

SEQ ID NO: 4058469 - RNA, 14 nt, Vaccinia virus
auaaugauagaaua

SEQ ID NO: 4058470 - RNA, 15 nt, Vaccinia virus
auaaugauagaauua

SEQ ID NO: 4058471 - RNA, 13 nt, Vaccinia virus
auaaugauagaca

SEQ ID NO: 4058472 - RNA, 15 nt, Vaccinia virus
auaauggcuguuugu

SEQ ID NO: 4058473 - RNA, 21 nt, Vaccinia virus
auaaugguucaggauauagau

SEQ ID NO: 4058474 - RNA, 20 nt, Vaccinia virus
auaauguuaccauacauuau

SEQ ID NO: 4058475 - RNA, 18 nt, Vaccinia virus
auaauuauaucacaacau

SEQ ID NO: 4058476 - RNA, 20 nt, Vaccinia virus
auaauuauuucaauauacua

SEQ ID NO: 4058477 - RNA, 13 nt, Vaccinia virus
auaauuuaacaau

SEQ ID NO: 4058478 - RNA, 21 nt, Vaccinia virus
auaauuuaacauuuuggcaaa

SEQ ID NO: 4058479 - RNA, 13 nt, Vaccinia virus
auaauuucuguaa

SEQ ID NO: 4058480 - RNA, 16 nt, Vaccinia virus
auaauuuuuauguuuu

SEQ ID NO: 4058481 - RNA, 18 nt, Vaccinia virus
auacaaaauguuugacau

SEQ ID NO: 4058482 - RNA, 18 nt, Vaccinia virus
auacaaauccauuaaugu

SEQ ID NO: 4058483 - RNA, 17 nt, Vaccinia virus
auacaagaacaacuaga

SEQ ID NO: 4058484 - RNA, 16 nt, Vaccinia virus
auacaagaguggaaac

SEQ ID NO: 4058485 - RNA, 17 nt, Vaccinia virus
auacaaguguagaugau

SEQ ID NO: 4058486 - RNA, 20 nt, Vaccinia virus
auacaaugcucaguaaaugu

SEQ ID NO: 4058487 - RNA, 18 nt, Vaccinia virus
auacaauggaauacuuca

SEQ ID NO: 4058488 - RNA, 14 nt, Vaccinia virus
auacacaucaaaau

SEQ ID NO: 4058489 - RNA, 22 nt, Vaccinia virus
auacacgauuuaauccaucugu

SEQ ID NO: 4058490 - RNA, 14 nt, Vaccinia virus
auacagaagauuua

SEQ ID NO: 4058491 - RNA, 18 nt, Vaccinia virus
auacagacaauugacaaa

SEQ ID NO: 4058492 - RNA, 18 nt, Vaccinia virus
auacagacgauaacuuga

SEQ ID NO: 4058493 - RNA, 20 nt, Vaccinia virus
auacagcguuacauuauuau

SEQ ID NO: 4058494 - RNA, 16 nt, Vaccinia virus
auacauaaagaaaugu

SEQ ID NO: 4058495 - RNA, 19 nt, Vaccinia virus
auacauaauucuucuguua

SEQ ID NO: 4058496 - RNA, 12 nt, Vaccinia virus
auacauauuuua

SEQ ID NO: 4058497 - RNA, 24 nt, Vaccinia virus
auacaucaagagagcagaaauuac

SEQ ID NO: 4058498 - RNA, 20 nt, Vaccinia virus
auacauccguagaaauauga

SEQ ID NO: 4058499 - RNA, 21 nt, Vaccinia virus
auauauucgcauauauuccca

SEQ ID NO: 4058500 - RNA, 12 nt, Vaccinia virus
auauauuguuaa

SEQ ID NO: 4058501 - RNA, 13 nt, Vaccinia virus
auauauuguuuca

SEQ ID NO: 4058502 - RNA, 16 nt, Vaccinia virus
auauauuuuucuagau

SEQ ID NO: 4058503 - RNA, 19 nt, Vaccinia virus
auaucacauaguguuuuau

SEQ ID NO: 4058504 - RNA, 17 nt, Vaccinia virus
auaucaguguccaucau

SEQ ID NO: 4058505 - RNA, 15 nt, Vaccinia virus
auaucaugaaauaua

SEQ ID NO: 4058506 - RNA, 20 nt, Vaccinia virus
auaucauuaggauuuaacuc

SEQ ID NO: 4058507 - RNA, 22 nt, Vaccinia virus
auauccaaaauuuuguaugaag

SEQ ID NO: 4058508 - RNA, 20 nt, Vaccinia virus
auauccagauggaguggaag

SEQ ID NO: 4058509 - RNA, 23 nt, Vaccinia virus
auauccucacaacuuaaugaaga

SEQ ID NO: 4058510 - RNA, 14 nt, Vaccinia virus
auaucgauguuuaa

SEQ ID NO: 4058511 - RNA, 16 nt, Vaccinia virus
auaucuaaaugaauac

SEQ ID NO: 4058512 - RNA, 21 nt, Vaccinia virus
auaucuaauggauaaacugaa

SEQ ID NO: 4058513 - RNA, 15 nt, Vaccinia virus
auaucuaauuucugu

SEQ ID NO: 4058514 - RNA, 13 nt, Vaccinia virus
auaucuagaauga

SEQ ID NO: 4058515 - RNA, 15 nt, Vaccinia virus
auaucuauaggaaag

SEQ ID NO: 4058516 - RNA, 15 nt, Vaccinia virus
auaucuauaugauug

SEQ ID NO: 4058517 - RNA, 18 nt, Vaccinia virus
auaucugaguaugaugau

SEQ ID NO: 4058518 - RNA, 13 nt, Vaccinia virus
auaucuuaaauaa

SEQ ID NO: 4058519 - RNA, 17 nt, Vaccinia virus
auaugaaaaacaugucu

SEQ ID NO: 4058520 - RNA, 18 nt, Vaccinia virus
auaugaaccugacaugau

SEQ ID NO: 4058521 - RNA, 19 nt, Vaccinia virus
auaugauccaugcauagau

SEQ ID NO: 4058522 - RNA, 20 nt, Vaccinia virus
auaugauguuucuguuuuca

SEQ ID NO: 4058523 - RNA, 21 nt, Vaccinia virus
auaugauuucagauacuauau

SEQ ID NO: 4058524 - RNA, 23 nt, Vaccinia virus
auaugcccgguaguugcgauaua

SEQ ID NO: 4058525 - RNA, 17 nt, Vaccinia virus
auauggauauucauaga

SEQ ID NO: 4058526 - RNA, 21 nt, Vaccinia virus
auauggcgcgcguucaacauu

SEQ ID NO: 4058527 - RNA, 22 nt, Vaccinia virus
auaugguuucuaaaucuaucaa

SEQ ID NO: 4058528 - RNA, 23 nt, Vaccinia virus
auaugguuuuuggccaaaaugau

SEQ ID NO: 4058529 - RNA, 18 nt, Vaccinia virus
auauguagcaaacaugau

SEQ ID NO: 4058530 - RNA, 15 nt, Vaccinia virus
auauguaucaaagau

SEQ ID NO: 4058531 - RNA, 23 nt, Vaccinia virus
auauguggaaaugucauagaaag

SEQ ID NO: 4058532 - RNA, 21 nt, Vaccinia virus
auauuaaaaaaugucacuauu

SEQ ID NO: 4058533 - RNA, 19 nt, Vaccinia virus
auauuaaaaauaagaauga

SEQ ID NO: 4058534 - RNA, 20 nt, Vaccinia virus
auauuaacgaguuccauuua

SEQ ID NO: 4058535 - RNA, 11 nt, Vaccinia virus
auauuaauaga

SEQ ID NO: 4058536 - RNA, 15 nt, Vaccinia virus
auauuaauaggagau

SEQ ID NO: 4058537 - RNA, 15 nt, Vaccinia virus
auauuaaugucguau

SEQ ID NO: 4058538 - RNA, 14 nt, Vaccinia virus
auauuaguacagaa

SEQ ID NO: 4058539 - RNA, 12 nt, Vaccinia virus
auauuauacaaa

SEQ ID NO: 4058540 - RNA, 16 nt, Vaccinia virus
auauuauauaaacauu

SEQ ID NO: 4058541 - RNA, 13 nt, Vaccinia virus
auauuaucaaaau

SEQ ID NO: 4058542 - RNA, 22 nt, Vaccinia virus
auauuaucgugccgaaauucgu

SEQ ID NO: 4058543 - RNA, 19 nt, Vaccinia virus
auauuaucucaacaaaauu

SEQ ID NO: 4058544 - RNA, 20 nt, Vaccinia virus
auauuaucuuuuuagacacg

SEQ ID NO: 4058545 - RNA, 22 nt, Vaccinia virus
auauuauuauuuuucuugguaa

SEQ ID NO: 4058546 - RNA, 15 nt, Vaccinia virus
auauucaacauguuu

SEQ ID NO: 4058547 - RNA, 15 nt, Vaccinia virus
auauucauagauuga

SEQ ID NO: 4058548 - RNA, 18 nt, Vaccinia virus
auauuccaguucauauuu

SEQ ID NO: 4058549 - RNA, 15 nt, Vaccinia virus
auauucccaaacaua

SEQ ID NO: 4058550 - RNA, 15 nt, Vaccinia virus
auauuccuugaauaa

SEQ ID NO: 4058551 - RNA, 14 nt, Vaccinia virus
auauucuaugaauu

SEQ ID NO: 4058552 - RNA, 14 nt, Vaccinia virus
auauucuaugacug

SEQ ID NO: 4058553 - RNA, 13 nt, Vaccinia virus
auauucuaugaug

SEQ ID NO: 4058554 - RNA, 17 nt, Vaccinia virus
auauucuguaguuguau

SEQ ID NO: 4058555 - RNA, 16 nt, Vaccinia virus
auauucuguuguguca

SEQ ID NO: 4058556 - RNA, 24 nt, Vaccinia virus
auauucuuaaaagguuucauauuu

SEQ ID NO: 4058557 - RNA, 22 nt, Vaccinia virus
auauugauaauauuuuaauaga

SEQ ID NO: 4058558 - RNA, 20 nt, Vaccinia virus
auauugauaucuuuuugaau

SEQ ID NO: 4058559 - RNA, 20 nt, Vaccinia virus
auauugaugugucuguuuau

SEQ ID NO: 4058560 - RNA, 18 nt, Vaccinia virus
auauugcaccagaauuaa

SEQ ID NO: 4058561 - RNA, 15 nt, Vaccinia virus
auauugguuguuaaa

SEQ ID NO: 4058562 - RNA, 14 nt, Vaccinia virus
auauuguagaauac

SEQ ID NO: 4058563 - RNA, 16 nt, Vaccinia virus
auauugucacaugucu

SEQ ID NO: 4058564 - RNA, 14 nt, Vaccinia virus
auauuguuacacca

SEQ ID NO: 4058565 - RNA, 17 nt, Vaccinia virus
auauuguucuuaauaga

SEQ ID NO: 4058566 - RNA, 22 nt, Vaccinia virus
auauuuaagugauauaaaacua

SEQ ID NO: 4058567 - RNA, 15 nt, Vaccinia virus
auauuuacaguuacu

SEQ ID NO: 4058568 - RNA, 17 nt, Vaccinia virus
auauuuacauauuuacu

SEQ ID NO: 4058569 - RNA, 15 nt, Vaccinia virus
auauuuagaaauuga

SEQ ID NO: 4058570 - RNA, 21 nt, Vaccinia virus
auauuuauacccgcuaugaag

SEQ ID NO: 4058571 - RNA, 13 nt, Vaccinia virus
auauuucauauac

SEQ ID NO: 4058572 - RNA, 15 nt, Vaccinia virus
auauuucauauacua

SEQ ID NO: 4058573 - RNA, 18 nt, Vaccinia virus
auauuucuauuucuauuu

SEQ ID NO: 4058574 - RNA, 19 nt, Vaccinia virus
auauuucuccacuacauau

SEQ ID NO: 4058575 - RNA, 21 nt, Vaccinia virus
auauuuggaaucagacacaga

SEQ ID NO: 4058576 - RNA, 22 nt, Vaccinia virus
auauuuggcuaaacuauauaau

SEQ ID NO: 4058577 - RNA, 16 nt, Vaccinia virus
auauuuguuaaugccu

SEQ ID NO: 4058578 - RNA, 21 nt, Vaccinia virus
auauuuuucguuuacaaaauc

SEQ ID NO: 4058579 - RNA, 23 nt, Vaccinia virus
aucaaaacauauagauagacgag

SEQ ID NO: 4058580 - RNA, 19 nt, Vaccinia virus
aucaaaaucguauaaaguu

SEQ ID NO: 4058581 - RNA, 14 nt, Vaccinia virus
aucaaacauuuaau

SEQ ID NO: 4058582 - RNA, 19 nt, Vaccinia virus
aucaaacauuuaauuacau

SEQ ID NO: 4058583 - RNA, 20 nt, Vaccinia virus
aucaaacgcugaaguaauua

SEQ ID NO: 4058584 - RNA, 23 nt, Vaccinia virus
aucaaacucuaaugaccacaucu

SEQ ID NO: 4058585 - RNA, 20 nt, Vaccinia virus
aucaaacuguauagguaugu

SEQ ID NO: 4058586 - RNA, 20 nt, Vaccinia virus
aucaaaugguaaauacugua

SEQ ID NO: 4058587 - RNA, 19 nt, Vaccinia virus
aucaacagaaucaguauau

SEQ ID NO: 4058588 - RNA, 19 nt, Vaccinia virus
aucaaccaccgaugaugcg

SEQ ID NO: 4058589 - RNA, 20 nt, Vaccinia virus
aucaacgaguucaaauauga

SEQ ID NO: 4058590 - RNA, 19 nt, Vaccinia virus
aucaacggagauauaaaug

SEQ ID NO: 4058591 - RNA, 23 nt, Vaccinia virus
aucaacuaccuaaggaauauuca

SEQ ID NO: 4058592 - RNA, 18 nt, Vaccinia virus
aucaacuuuauuagauaa

SEQ ID NO: 4058593 - RNA, 14 nt, Vaccinia virus
aucaagaucauaau

SEQ ID NO: 4058594 - RNA, 14 nt, Vaccinia virus
aucaaguagaaauu

SEQ ID NO: 4058595 - RNA, 13 nt, Vaccinia virus
aucaauaaauagu

SEQ ID NO: 4058596 - RNA, 14 nt, Vaccinia virus
aucaauaacaaugu

SEQ ID NO: 4058597 - RNA, 20 nt, Vaccinia virus
aucaauaauauaucuuauau

SEQ ID NO: 4058598 - RNA, 13 nt, Vaccinia virus
aucaauaaugacg

SEQ ID NO: 4058599 - RNA, 15 nt, Vaccinia virus
aucaauaucucaauu

SEQ ID NO: 4058600 - RNA, 16 nt, Vaccinia virus
aucaaucauauuacau

SEQ ID NO: 4058601 - RNA, 19 nt, Vaccinia virus
aucaaucgguguguagaaa

SEQ ID NO: 4058602 - RNA, 12 nt, Vaccinia virus
aucaauguacau

SEQ ID NO: 4058603 - RNA, 13 nt, Vaccinia virus
aucaauguagaaa

SEQ ID NO: 4058604 - RNA, 13 nt, Vaccinia virus
aucaauuaaauaa

SEQ ID NO: 4058605 - RNA, 23 nt, Vaccinia virus
aucaauucuucuacauuaaaaau

SEQ ID NO: 4058606 - RNA, 17 nt, Vaccinia virus
aucacagcaguaguuua

SEQ ID NO: 4058607 - RNA, 22 nt, Vaccinia virus
aucacagcuaucuugaagccau

SEQ ID NO: 4058608 - RNA, 16 nt, Vaccinia virus
aucacaggagcaaugu

SEQ ID NO: 4058609 - RNA, 19 nt, Vaccinia virus
aucacauaucuaacaaugg

SEQ ID NO: 4058610 - RNA, 16 nt, Vaccinia virus
aucacauaugcaaaga

SEQ ID NO: 4058611 - RNA, 17 nt, Vaccinia virus
aucaccacuuucauauu

SEQ ID NO: 4058612 - RNA, 21 nt, Vaccinia virus
aucaccuauugccagguacau

SEQ ID NO: 4058613 - RNA, 14 nt, Vaccinia virus
aucacgucauauau

SEQ ID NO: 4058614 - RNA, 13 nt, Vaccinia virus
aucacuaaaauaa

SEQ ID NO: 4058615 - RNA, 13 nt, Vaccinia virus
aucacuaacaaua

SEQ ID NO: 4058616 - RNA, 16 nt, Vaccinia virus
aucacuacaauaauua

SEQ ID NO: 4058617 - RNA, 20 nt, Vaccinia virus
aucacucuucgaaaagaaac

SEQ ID NO: 4058618 - RNA, 23 nt, Vaccinia virus
aucacugccgaguuuaaaacuuc

SEQ ID NO: 4058619 - RNA, 15 nt, Vaccinia virus
aucacuguuguacau

SEQ ID NO: 4058620 - RNA, 21 nt, Vaccinia virus
aucagaaucauacaaugaauu

SEQ ID NO: 4058621 - RNA, 22 nt, Vaccinia virus
aucagagccaauaauaauagau

SEQ ID NO: 4058622 - RNA, 17 nt, Vaccinia virus
cucaucguauauuuuga

SEQ ID NO: 4058623 - RNA, 15 nt, Vaccinia virus
cucauuaaaacuucu

SEQ ID NO: 4058624 - RNA, 13 nt, Vaccinia virus
cucauuacauagu

SEQ ID NO: 4058625 - RNA, 14 nt, Vaccinia virus
cucauuauuuccca

SEQ ID NO: 4058626 - RNA, 19 nt, Vaccinia virus
cuccacaguuuuuaauuuc

SEQ ID NO: 4058627 - RNA, 17 nt, Vaccinia virus
cuccaccuucauauuua

SEQ ID NO: 4058628 - RNA, 23 nt, Vaccinia virus
cucccggagauguuucauaauag

SEQ ID NO: 4058629 - RNA, 22 nt, Vaccinia virus
cucccggauauuuuuuacaauu

SEQ ID NO: 4058630 - RNA, 20 nt, Vaccinia virus
cuccuaauauaacaguaucu

SEQ ID NO: 4058631 - RNA, 21 nt, Vaccinia virus
cuccuagguuucucuauaaac

SEQ ID NO: 4058632 - RNA, 14 nt, Vaccinia virus
cuccuguagauaug

SEQ ID NO: 4058633 - RNA, 14 nt, Vaccinia virus
cuccuuucaaacuu

SEQ ID NO: 4058634 - RNA, 20 nt, Vaccinia virus
cucgauacauuaacucucuc

SEQ ID NO: 4058635 - RNA, 19 nt, Vaccinia virus
cucgaugggacauuucaac

SEQ ID NO: 4058636 - RNA, 19 nt, Vaccinia virus
cucggauuugaagaaauca

SEQ ID NO: 4058637 - RNA, 15 nt, Vaccinia virus
cucguuuaaacagaa

SEQ ID NO: 4058638 - RNA, 22 nt, Vaccinia virus
cucuaagaacuuauuaaugaau

SEQ ID NO: 4058639 - RNA, 16 nt, Vaccinia virus
cucuaaguuaacacau

SEQ ID NO: 4058640 - RNA, 11 nt, Vaccinia virus
cucuagaaaaa

SEQ ID NO: 4058641 - RNA, 15 nt, Vaccinia virus
cucuauaaaauacua

SEQ ID NO: 4058642 - RNA, 13 nt, Vaccinia virus
cucuauagauaau

SEQ ID NO: 4058643 - RNA, 20 nt, Vaccinia virus
cucuaugacuucaucaucug

SEQ ID NO: 4058644 - RNA, 17 nt, Vaccinia virus
cucucaucuacaaaaac

SEQ ID NO: 4058645 - RNA, 13 nt, Vaccinia virus
cucucaucuuuua

SEQ ID NO: 4058646 - RNA, 14 nt, Vaccinia virus
cucucauugauuuu

SEQ ID NO: 4058647 - RNA, 18 nt, Vaccinia virus
cucucucacuacacuuuu

SEQ ID NO: 4058648 - RNA, 15 nt, Vaccinia virus
cucucucugccaaaa

SEQ ID NO: 4058649 - RNA, 16 nt, Vaccinia virus
cucuguaauaguuucc

SEQ ID NO: 4058650 - RNA, 15 nt, Vaccinia virus
cucuuaauuauaacg

SEQ ID NO: 4058651 - RNA, 11 nt, Vaccinia virus
cucuuucugaa

SEQ ID NO: 4058652 - RNA, 19 nt, Vaccinia virus
cucuuugacauauuuugag

SEQ ID NO: 4058653 - RNA, 18 nt, Vaccinia virus
cugaaauaaccacaucug

SEQ ID NO: 4058654 - RNA, 23 nt, Vaccinia virus
cugaaauacgauucuauauaucu

SEQ ID NO: 4058655 - RNA, 13 nt, Vaccinia virus
cugaaguuucaua

SEQ ID NO: 4058656 - RNA, 19 nt, Vaccinia virus
cugaauguaucuuccacau

SEQ ID NO: 4058657 - RNA, 23 nt, Vaccinia virus
cugaaugucgaaccuaucuagua

SEQ ID NO: 4058658 - RNA, 19 nt, Vaccinia virus
cugaauuauuauuacugaa

SEQ ID NO: 4058659 - RNA, 17 nt, Vaccinia virus
cugacugaauacauccu

SEQ ID NO: 4058660 - RNA, 14 nt, Vaccinia virus
cugauaagauaucu

SEQ ID NO: 4058661 - RNA, 22 nt, Vaccinia virus
cugauacaaucucuuaucaugu

SEQ ID NO: 4058662 - RNA, 17 nt, Vaccinia virus
cugauagaaagaauaag

SEQ ID NO: 4058663 - RNA, 15 nt, Vaccinia virus
cugauauauugcaaa

SEQ ID NO: 4058664 - RNA, 18 nt, Vaccinia virus
cugaugcauguauuugcu

SEQ ID NO: 4058665 - RNA, 17 nt, Vaccinia virus
cugauggagucuccuuc

SEQ ID NO: 4058666 - RNA, 20 nt, Vaccinia virus
cugauuaaugagaucuucua

SEQ ID NO: 4058667 - RNA, 18 nt, Vaccinia virus
cugcagcauuuugaggau

SEQ ID NO: 4058668 - RNA, 19 nt, Vaccinia virus
cugcagccauuuuuaugau

SEQ ID NO: 4058669 - RNA, 20 nt, Vaccinia virus
cugccauuaauaucucuauu

SEQ ID NO: 4058670 - RNA, 17 nt, Vaccinia virus
cugccauuuuagagauu

SEQ ID NO: 4058671 - RNA, 16 nt, Vaccinia virus
cugcuaauaaauaaug

SEQ ID NO: 4058672 - RNA, 15 nt, Vaccinia virus
cugcuagaacaucca

SEQ ID NO: 4058673 - RNA, 14 nt, Vaccinia virus
cugcuauaauuaag

SEQ ID NO: 4058674 - RNA, 17 nt, Vaccinia virus
cugcuauaauuaagaua

SEQ ID NO: 4058675 - RNA, 16 nt, Vaccinia virus
cugcuauauggauauu

SEQ ID NO: 4058676 - RNA, 12 nt, Vaccinia virus
cugcugaaaaua

SEQ ID NO: 4058677 - RNA, 22 nt, Vaccinia virus
cugcuggaaaauaaaucacuga

SEQ ID NO: 4058678 - RNA, 16 nt, Vaccinia virus
cugcuuagacuuccaa

SEQ ID NO: 4058679 - RNA, 17 nt, Vaccinia virus
cuggaaguggauauaca

SEQ ID NO: 4058680 - RNA, 20 nt, Vaccinia virus
cuggaauagaaucuauuuua

SEQ ID NO: 4058681 - RNA, 16 nt, Vaccinia virus
cuggaggagauggauu

SEQ ID NO: 4058682 - RNA, 15 nt, Vaccinia virus
cuggaggaguaagaa

SEQ ID NO: 4058683 - RNA, 13 nt, Vaccinia virus
cuggaucuggaaa

SEQ ID NO: 4058684 - RNA, 18 nt, Vaccinia virus
cuggcaggcacaugcaug

SEQ ID NO: 4058685 - RNA, 19 nt, Vaccinia virus
cuggcuauuucaaaauaaa

SEQ ID NO: 4058686 - RNA, 19 nt, Vaccinia virus
cugggccauguagaauaaa

SEQ ID NO: 4058687 - RNA, 22 nt, Vaccinia virus
cugguaacuauauucuuagaaa

SEQ ID NO: 4058688 - RNA, 22 nt, Vaccinia virus
cugguaauccacauaguuguaa

SEQ ID NO: 4058689 - RNA, 18 nt, Vaccinia virus
cugguacaggaguucagu

SEQ ID NO: 4058690 - RNA, 18 nt, Vaccinia virus
cugguauuuauauaugca

SEQ ID NO: 4058691 - RNA, 22 nt, Vaccinia virus
cuggucuaaaauuuccaucucu

SEQ ID NO: 4058692 - RNA, 14 nt, Vaccinia virus
cugguuuagauauu

SEQ ID NO: 4058693 - RNA, 22 nt, Vaccinia virus
cuguaaaaacaaauuuguacau

SEQ ID NO: 4058694 - RNA, 20 nt, Vaccinia virus
cuguaaacuaaguagagauu

SEQ ID NO: 4058695 - RNA, 16 nt, Vaccinia virus
cuguaaaggaaucauu

SEQ ID NO: 4058696 - RNA, 11 nt, Vaccinia virus
cuguaaaugau

SEQ ID NO: 4058697 - RNA, 22 nt, Vaccinia virus
cuguaauaaaggugguaguauu

SEQ ID NO: 4058698 - RNA, 13 nt, Vaccinia virus
cuguaaugaugga

SEQ ID NO: 4058699 - RNA, 21 nt, Vaccinia virus
cuguagauaaacuaggauuua

SEQ ID NO: 4058700 - RNA, 11 nt, Vaccinia virus
cuguauauacu

SEQ ID NO: 4058701 - RNA, 19 nt, Vaccinia virus
cuguauauacuuagauaua

SEQ ID NO: 4058702 - RNA, 17 nt, Vaccinia virus
cuguaucccgucaacga

SEQ ID NO: 4058703 - RNA, 18 nt, Vaccinia virus
cuguauccucaaacaucc

SEQ ID NO: 4058704 - RNA, 23 nt, Vaccinia virus
cuguauuaaagauauuguuacac

SEQ ID NO: 4058705 - RNA, 20 nt, Vaccinia virus
cugucuauaaugacaauaaa

SEQ ID NO: 4058706 - RNA, 19 nt, Vaccinia virus
cugucuucaaugaacucau

SEQ ID NO: 4058707 - RNA, 18 nt, Vaccinia virus
cugucuuucgauguucau

SEQ ID NO: 4058708 - RNA, 11 nt, Vaccinia virus
cuguggaauaa

SEQ ID NO: 4058709 - RNA, 14 nt, Vaccinia virus
cuguucaacaaacu

SEQ ID NO: 4058710 - RNA, 14 nt, Vaccinia virus
cuguucaucguuua

SEQ ID NO: 4058711 - RNA, 20 nt, Vaccinia virus
cuguuggaaccggcugugga

SEQ ID NO: 4058712 - RNA, 14 nt, Vaccinia virus
cuguuguacauaca

SEQ ID NO: 4058713 - RNA, 20 nt, Vaccinia virus
cuguuuaucuauacuauuaa

SEQ ID NO: 4058714 - RNA, 15 nt, Vaccinia virus
cuguuucuacuaacu

SEQ ID NO: 4058715 - RNA, 20 nt, Vaccinia virus
cuuaaaagauauuaauggag

SEQ ID NO: 4058716 - RNA, 12 nt, Vaccinia virus
cuuaaaauguaa

SEQ ID NO: 4058717 - RNA, 15 nt, Vaccinia virus
cuuaaacagaugaga

SEQ ID NO: 4058718 - RNA, 14 nt, Vaccinia virus
cuuaaauguuuucu

SEQ ID NO: 4058719 - RNA, 14 nt, Vaccinia virus
cuuaacaaaaauug

SEQ ID NO: 4058720 - RNA, 19 nt, Vaccinia virus
cuuaacuuacaaaauguaa

SEQ ID NO: 4058721 - RNA, 13 nt, Vaccinia virus
cuuaacuuuuucu

SEQ ID NO: 4058722 - RNA, 20 nt, Vaccinia virus
cuuaagaaaauuauuacuag

SEQ ID NO: 4058723 - RNA, 20 nt, Vaccinia virus
cuuaauacaccguuaacaau

SEQ ID NO: 4058724 - RNA, 23 nt, Vaccinia virus
cuuaauccuucuagaauuagaau

SEQ ID NO: 4058725 - RNA, 13 nt, Vaccinia virus
cuuaaugcauuuu

SEQ ID NO: 4058726 - RNA, 19 nt, Vaccinia virus
cuuaauuucagaagaaaac

SEQ ID NO: 4058727 - RNA, 13 nt, Vaccinia virus
cuuacaaaguuuu

SEQ ID NO: 4058728 - RNA, 15 nt, Vaccinia virus
cuuacauaaaugucu

SEQ ID NO: 4058729 - RNA, 13 nt, Vaccinia virus
cuuaccccuugau

SEQ ID NO: 4058730 - RNA, 18 nt, Vaccinia virus
cuuaccuucaacaguaua

SEQ ID NO: 4058731 - RNA, 18 nt, Vaccinia virus
cuuacuaucuuuuucuca

SEQ ID NO: 4058732 - RNA, 19 nt, Vaccinia virus
cuuagaaggaguguuuucu

SEQ ID NO: 4058733 - RNA, 16 nt, Vaccinia virus
cuuaguaaacagucca

SEQ ID NO: 4058734 - RNA, 13 nt, Vaccinia virus
cuuaguaacucua

SEQ ID NO: 4058735 - RNA, 13 nt, Vaccinia virus
cuuaguauacaaa

SEQ ID NO: 4058736 - RNA, 19 nt, Vaccinia virus
cuuauaauuaauguccaag

SEQ ID NO: 4058737 - RNA, 19 nt, Vaccinia virus
cuuaucgaagugacacucu

SEQ ID NO: 4058738 - RNA, 22 nt, Vaccinia virus
cuuaugaaacuuggaaacaucu

SEQ ID NO: 4058739 - RNA, 15 nt, Vaccinia virus
cuuaugaggaaugau

SEQ ID NO: 4058740 - RNA, 22 nt, Vaccinia virus
cuuaugauauaaggaaacagcu

SEQ ID NO: 4058741 - RNA, 17 nt, Vaccinia virus
cuuauuccacaauacga

SEQ ID NO: 4058742 - RNA, 15 nt, Vaccinia virus
cuucaagagaugucu

SEQ ID NO: 4058743 - RNA, 15 nt, Vaccinia virus
cuucaauaaaaugag

SEQ ID NO: 4058744 - RNA, 22 nt, Vaccinia virus
cuucacagauagaucauuuuga

SEQ ID NO: 4058745 - RNA, 19 nt, Vaccinia virus
cuucagaaauuaucgaugu

SEQ ID NO: 4058746 - RNA, 12 nt, Vaccinia virus
cuucagaauaau

SEQ ID NO: 4058747 - RNA, 19 nt, Vaccinia virus
cuucagcggauccuguauu

SEQ ID NO: 4058748 - RNA, 14 nt, Vaccinia virus
cuucaucaucuguu

SEQ ID NO: 4058749 - RNA, 20 nt, Vaccinia virus
cuucaugaacauaaucaguu

SEQ ID NO: 4058750 - RNA, 18 nt, Vaccinia virus
cuucauucguaaaucuuu

SEQ ID NO: 4058751 - RNA, 12 nt, Vaccinia virus
cuucauuucuaa

SEQ ID NO: 4058752 - RNA, 14 nt, Vaccinia virus
cuuccaacauaaua

SEQ ID NO: 4058753 - RNA, 20 nt, Vaccinia virus
cuuccagauaauguucucuu

SEQ ID NO: 4058754 - RNA, 15 nt, Vaccinia virus
cuuccaguucuggau

SEQ ID NO: 4058755 - RNA, 17 nt, Vaccinia virus
cuuccgucgaugucuac

SEQ ID NO: 4058756 - RNA, 14 nt, Vaccinia virus
cuucgauagauauu

SEQ ID NO: 4058757 - RNA, 14 nt, Vaccinia virus
cuucguuuaaauaa

SEQ ID NO: 4058758 - RNA, 17 nt, Vaccinia virus
cuucuaccguuuuguuc

SEQ ID NO: 4058759 - RNA, 17 nt, Vaccinia virus
cuucuauaaaaauggau

SEQ ID NO: 4058760 - RNA, 13 nt, Vaccinia virus
cuucugauuuuaa

SEQ ID NO: 4058761 - RNA, 18 nt, Vaccinia virus
cuucuguacaaaaucguu

SEQ ID NO: 4058762 - RNA, 18 nt, Vaccinia virus
cuugaaaauuguuuuucu

SEQ ID NO: 4058763 - RNA, 20 nt, Vaccinia virus
cuugacauuuucuucuuucu

SEQ ID NO: 4058764 - RNA, 20 nt, Vaccinia virus
cuugagacuugauagauauu

SEQ ID NO: 4058765 - RNA, 22 nt, Vaccinia virus
cuugaggagaucuaaacaaucu

SEQ ID NO: 4058766 - RNA, 17 nt, Vaccinia virus
cuugauacgcucauuaa

SEQ ID NO: 4058767 - RNA, 17 nt, Vaccinia virus
cuugauacuauccagua

SEQ ID NO: 4058768 - RNA, 21 nt, Vaccinia virus
cuugauucuaguaucuuuugu

SEQ ID NO: 4058769 - RNA, 23 nt, Vaccinia virus
cuugcacuuaaagucuacauugu

SEQ ID NO: 4058770 - RNA, 13 nt, Vaccinia virus
cuuguugacaaaa

SEQ ID NO: 4058771 - RNA, 12 nt, Vaccinia virus
cuuuaacuucug

SEQ ID NO: 4058772 - RNA, 14 nt, Vaccinia virus
cuuuaauagauaua

SEQ ID NO: 4058773 - RNA, 14 nt, Vaccinia virus
cuuuaauguaugaa

SEQ ID NO: 4058774 - RNA, 18 nt, Vaccinia virus
cuuuacaguuucuguaau

SEQ ID NO: 4058775 - RNA, 13 nt, Vaccinia virus
cuuuacuuuucua

SEQ ID NO: 4058776 - RNA, 14 nt, Vaccinia virus
cuuuagaaaaacuu

SEQ ID NO: 4058777 - RNA, 20 nt, Vaccinia virus
cuuuauaagagcuacuaacg

SEQ ID NO: 4058778 - RNA, 13 nt, Vaccinia virus
cuuuaucaagcac

SEQ ID NO: 4058779 - RNA, 20 nt, Vaccinia virus
cuuuauccauaucucuagau

SEQ ID NO: 4058780 - RNA, 13 nt, Vaccinia virus
cuuuauuaucuau

SEQ ID NO: 4058781 - RNA, 21 nt, Vaccinia virus
cuuucaggguaucacaaaaau

SEQ ID NO: 4058782 - RNA, 17 nt, Vaccinia virus
cuuucuagaacauacug

SEQ ID NO: 4058783 - RNA, 23 nt, Vaccinia virus
cuuucugauggucucauaaaaaa

SEQ ID NO: 4058784 - RNA, 17 nt, Vaccinia virus
cuuugcaaauuguauau

SEQ ID NO: 4058785 - RNA, 15 nt, Vaccinia virus
cuuugcaauauugua

SEQ ID NO: 4058786 - RNA, 15 nt, Vaccinia virus
cuuugcauucugaaa

SEQ ID NO: 4058787 - RNA, 19 nt, Vaccinia virus
cuuuggagucucaucuuua

SEQ ID NO: 4058788 - RNA, 23 nt, Vaccinia virus
cuuuggauuuucaccaguaugua

SEQ ID NO: 4058789 - RNA, 15 nt, Vaccinia virus
cuuugucggaagaau

SEQ ID NO: 4058790 - RNA, 18 nt, Vaccinia virus
cuuuuaauucuuaucaau

SEQ ID NO: 4058791 - RNA, 11 nt, Vaccinia virus
cuuuuaauuuu

SEQ ID NO: 4058792 - RNA, 12 nt, Vaccinia virus
cuuuuagaaaag

SEQ ID NO: 4058793 - RNA, 23 nt, Vaccinia virus
cuuuuagagguucccaauuccaa

SEQ ID NO: 4058794 - RNA, 20 nt, Vaccinia virus
cuuuuaguaacguaugugaa

SEQ ID NO: 4058795 - RNA, 17 nt, Vaccinia virus
cuuuugcggacauuuuc

SEQ ID NO: 4058796 - RNA, 15 nt, Vaccinia virus
cuuuugugaaaagau

SEQ ID NO: 4058797 - RNA, 11 nt, Vaccinia virus
cuuuuuaggaa

SEQ ID NO: 4058798 - RNA, 17 nt, Vaccinia virus
cuuuuuauccuuuagau

SEQ ID NO: 4058799 - RNA, 23 nt, Vaccinia virus
cuuuuuuuagagaugaaaaauuu

SEQ ID NO: 4058800 - RNA, 22 nt, Vaccinia virus
gaaaaaaaauugaauugaugau

SEQ ID NO: 4058801 - RNA, 18 nt, Vaccinia virus
gaaaaaguuccauaugau

SEQ ID NO: 4058802 - RNA, 14 nt, Vaccinia virus
gaaaaauauaaugu

SEQ ID NO: 4058803 - RNA, 15 nt, Vaccinia virus
gaaaaauauaaugua

SEQ ID NO: 4058804 - RNA, 13 nt, Vaccinia virus
gaaaaaugaugaa

SEQ ID NO: 4058805 - RNA, 19 nt, Vaccinia virus
gaaaaaugcuagaauuaga

SEQ ID NO: 4058806 - RNA, 19 nt, Vaccinia virus
gaaaaauuauaauguuucc

SEQ ID NO: 4058807 - RNA, 15 nt, Vaccinia virus
gaaaacauuguguuu

SEQ ID NO: 4058808 - RNA, 21 nt, Vaccinia virus
gaaaacauuguguuuaaucuu

SEQ ID NO: 4058809 - RNA, 16 nt, Vaccinia virus
gaaaaccgauaacgau

SEQ ID NO: 4058810 - RNA, 23 nt, Vaccinia virus
gaaaauaaaucacugacgauauu

SEQ ID NO: 4058811 - RNA, 12 nt, Vaccinia virus
gaaaauaaugac

SEQ ID NO: 4058812 - RNA, 22 nt, Vaccinia virus
gaaaauaaugacgcguacgaua

SEQ ID NO: 4058813 - RNA, 15 nt, Vaccinia virus
gaaaauuauaaugaa

SEQ ID NO: 4058814 - RNA, 17 nt, Vaccinia virus
gaaacaguaugauuuua

SEQ ID NO: 4058815 - RNA, 22 nt, Vaccinia virus
gaaacauccaucgauacauaua

SEQ ID NO: 4058816 - RNA, 18 nt, Vaccinia virus
gaaacaucucuucuaguu

SEQ ID NO: 4058817 - RNA, 17 nt, Vaccinia virus
gaaacauggggauugaa

SEQ ID NO: 4058818 - RNA, 20 nt, Vaccinia virus
gaaacccccucauuuuuuaa

SEQ ID NO: 4058819 - RNA, 16 nt, Vaccinia virus
gaaacggugaauacaa

SEQ ID NO: 4058820 - RNA, 23 nt, Vaccinia virus
gaaacguaauauccucaauaacg

SEQ ID NO: 4058821 - RNA, 18 nt, Vaccinia virus
gaaacuaucugauaagau

SEQ ID NO: 4058822 - RNA, 21 nt, Vaccinia virus
gaaacuuaaaauauaaugaua

SEQ ID NO: 4058823 - RNA, 20 nt, Vaccinia virus
gaaagacagccauagccaaa

SEQ ID NO: 4058824 - RNA, 16 nt, Vaccinia virus
gaaagagauaauagaa

SEQ ID NO: 4058825 - RNA, 15 nt, Vaccinia virus
gaaagcgagaaauaa

SEQ ID NO: 4058826 - RNA, 16 nt, Vaccinia virus
gaaaguaaauaauaua

SEQ ID NO: 4058827 - RNA, 14 nt, Vaccinia virus
gaaauaauauuaaa

SEQ ID NO: 4058828 - RNA, 21 nt, Vaccinia virus
gaaauacuaaaaaauguagaa

SEQ ID NO: 4058829 - RNA, 18 nt, Vaccinia virus
gaaauagaggaagacaca

SEQ ID NO: 4058830 - RNA, 15 nt, Vaccinia virus
gaaauagauaaugaa

SEQ ID NO: 4058831 - RNA, 19 nt, Vaccinia virus
gaaauagcucguuucuauu

SEQ ID NO: 4058832 - RNA, 22 nt, Vaccinia virus
gaaauauaaaaccaacuaauau

SEQ ID NO: 4058833 - RNA, 18 nt, Vaccinia virus
gaaauauaguaauaagau

SEQ ID NO: 4058834 - RNA, 14 nt, Vaccinia virus
gaaauauauacaua

SEQ ID NO: 4058835 - RNA, 20 nt, Vaccinia virus
gaaaucauggcgauguuuua

SEQ ID NO: 4058836 - RNA, 14 nt, Vaccinia virus
gaaauccuauuuua

SEQ ID NO: 4058837 - RNA, 22 nt, Vaccinia virus
gaaaucuauaauaucuuugaaa

SEQ ID NO: 4058838 - RNA, 17 nt, Vaccinia virus
gaaaugaugaaggaaag

SEQ ID NO: 4058839 - RNA, 18 nt, Vaccinia virus
gaaaugccugauaaagau

SEQ ID NO: 4058840 - RNA, 22 nt, Vaccinia virus
gaaauguccguuauauaaucua

SEQ ID NO: 4058841 - RNA, 17 nt, Vaccinia virus
gaaauguguaauaauau

SEQ ID NO: 4058842 - RNA, 14 nt, Vaccinia virus
gaaauguuaaaacu

SEQ ID NO: 4058843 - RNA, 16 nt, Vaccinia virus
gaacaauaaacaaaau

SEQ ID NO: 4058844 - RNA, 17 nt, Vaccinia virus
gaacaauuuuaaaucau

SEQ ID NO: 4058845 - RNA, 23 nt, Vaccinia virus
gaacaccacuuacguuaauacua

SEQ ID NO: 4058846 - RNA, 21 nt, Vaccinia virus
gaacacgauuauuauaaaaua

SEQ ID NO: 4058847 - RNA, 16 nt, Vaccinia virus
gaacagauaguuuauu

SEQ ID NO: 4058848 - RNA, 18 nt, Vaccinia virus
gaacagcuaucaaaauau

SEQ ID NO: 4058849 - RNA, 23 nt, Vaccinia virus
gaacagcuaucaaaauauguaga

SEQ ID NO: 4058850 - RNA, 15 nt, Vaccinia virus
gaacauaaacaaauu

SEQ ID NO: 4058851 - RNA, 21 nt, Vaccinia virus
gaacaucuugauuauaauaua

SEQ ID NO: 4058852 - RNA, 18 nt, Vaccinia virus
gaacaugugugaaaauau

SEQ ID NO: 4058853 - RNA, 18 nt, Vaccinia virus
gaacgaagaucuuuucuc

SEQ ID NO: 4058854 - RNA, 18 nt, Vaccinia virus
gaacgagaacgacuaucu

SEQ ID NO: 4058855 - RNA, 17 nt, Vaccinia virus
gaacgaggagacuauau

SEQ ID NO: 4058856 - RNA, 22 nt, Vaccinia virus
gaacgauauuugugaaaaauau

SEQ ID NO: 4058857 - RNA, 12 nt, Vaccinia virus
gaacuaauaaag

SEQ ID NO: 4058858 - RNA, 13 nt, Vaccinia virus
gaacuaccaauau

SEQ ID NO: 4058859 - RNA, 18 nt, Vaccinia virus
gaacuauaaaaacagaua

SEQ ID NO: 4058860 - RNA, 15 nt, Vaccinia virus
gaacuauauaaugaa

SEQ ID NO: 4058861 - RNA, 21 nt, Vaccinia virus
gaacuauuuuuuuauacuucu

SEQ ID NO: 4058862 - RNA, 21 nt, Vaccinia virus
gaacucaagucgaauauaaau

SEQ ID NO: 4058863 - RNA, 18 nt, Vaccinia virus
gaacuucugaucauuaau

SEQ ID NO: 4058864 - RNA, 15 nt, Vaccinia virus
gaagaaaacaaacau

SEQ ID NO: 4058865 - RNA, 14 nt, Vaccinia virus
gaagaaauaaaggc

SEQ ID NO: 4058866 - RNA, 11 nt, Vaccinia virus
gaagaaauuga

SEQ ID NO: 4058867 - RNA, 17 nt, Vaccinia virus
gaagaagaugacaaucu

SEQ ID NO: 4058868 - RNA, 16 nt, Vaccinia virus
gaagagaaaggucaau

SEQ ID NO: 4058869 - RNA, 16 nt, Vaccinia virus
gaagaucauacagaca

SEQ ID NO: 4058870 - RNA, 16 nt, Vaccinia virus
gauuauucuacuauca

SEQ ID NO: 4058871 - RNA, 13 nt, Vaccinia virus
gauuauuuccugc

SEQ ID NO: 4058872 - RNA, 17 nt, Vaccinia virus
gauucaacaaaacucaa

SEQ ID NO: 4058873 - RNA, 20 nt, Vaccinia virus
gauucaacaaaacucaaagc

SEQ ID NO: 4058874 - RNA, 15 nt, Vaccinia virus
gauucaacauuuaua

SEQ ID NO: 4058875 - RNA, 13 nt, Vaccinia virus
gauucacaaauau

SEQ ID NO: 4058876 - RNA, 18 nt, Vaccinia virus
gauucgguuuuauacugu

SEQ ID NO: 4058877 - RNA, 18 nt, Vaccinia virus
gauucuaucuuccuucga

SEQ ID NO: 4058878 - RNA, 23 nt, Vaccinia virus
gauucuauuaagaguaacagcug

SEQ ID NO: 4058879 - RNA, 19 nt, Vaccinia virus
gauucuucacaagugaaau

SEQ ID NO: 4058880 - RNA, 21 nt, Vaccinia virus
gauucuugauagagaugagau

SEQ ID NO: 4058881 - RNA, 20 nt, Vaccinia virus
gauugauccuagaacuagau

SEQ ID NO: 4058882 - RNA, 14 nt, Vaccinia virus
gauugccauaauaa

SEQ ID NO: 4058883 - RNA, 17 nt, Vaccinia virus
gauuuaucuaguuuauc

SEQ ID NO: 4058884 - RNA, 17 nt, Vaccinia virus
gauuugguaguauuuau

SEQ ID NO: 4058885 - RNA, 22 nt, Vaccinia virus
gauuuuauuuaguguagauaug

SEQ ID NO: 4058886 - RNA, 16 nt, Vaccinia virus
gcaaaaauaauaugau

SEQ ID NO: 4058887 - RNA, 18 nt, Vaccinia virus
gcaaaacauuauaauaau

SEQ ID NO: 4058888 - RNA, 14 nt, Vaccinia virus
gcaaacaacaacaa

SEQ ID NO: 4058889 - RNA, 17 nt, Vaccinia virus
gcaaacgcgauaaggau

SEQ ID NO: 4058890 - RNA, 23 nt, Vaccinia virus
gcaaagaacagaauaaacaaaau

SEQ ID NO: 4058891 - RNA, 17 nt, Vaccinia virus
gcaaauacgauagucua

SEQ ID NO: 4058892 - RNA, 18 nt, Vaccinia virus
gcaaauugucuauaucua

SEQ ID NO: 4058893 - RNA, 15 nt, Vaccinia virus
gcaacaaguauacaa

SEQ ID NO: 4058894 - RNA, 21 nt, Vaccinia virus
gcaaccaccgcaugauaauau

SEQ ID NO: 4058895 - RNA, 13 nt, Vaccinia virus
gcaagaaauggau

SEQ ID NO: 4058896 - RNA, 15 nt, Vaccinia virus
gcaauaauggaaucu

SEQ ID NO: 4058897 - RNA, 22 nt, Vaccinia virus
gcaauaauggaaucuagaucua

SEQ ID NO: 4058898 - RNA, 17 nt, Vaccinia virus
gcaauagcugauuauuu

SEQ ID NO: 4058899 - RNA, 13 nt, Vaccinia virus
gcaauaucaucua

SEQ ID NO: 4058900 - RNA, 15 nt, Vaccinia virus
gcaaucaugauuuua

SEQ ID NO: 4058901 - RNA, 22 nt, Vaccinia virus
gcacaacaucuaacuauaugau

SEQ ID NO: 4058902 - RNA, 16 nt, Vaccinia virus
gcacauguauaauaua

SEQ ID NO: 4058903 - RNA, 21 nt, Vaccinia virus
gcacguaucuaaaguauuucu

SEQ ID NO: 4058904 - RNA, 21 nt, Vaccinia virus
gcacuauacauuuugaaacua

SEQ ID NO: 4058905 - RNA, 20 nt, Vaccinia virus
gcagcaucgcgacuauucua

SEQ ID NO: 4058906 - RNA, 23 nt, Vaccinia virus
gcaguacuacuagguagaagaau

SEQ ID NO: 4058907 - RNA, 18 nt, Vaccinia virus
gcaguuacaagauuuuua

SEQ ID NO: 4058908 - RNA, 21 nt, Vaccinia virus
gcaguuuuauuuuaucuuuua

SEQ ID NO: 4058909 - RNA, 15 nt, Vaccinia virus
gcaguuuuguucauu

SEQ ID NO: 4058910 - RNA, 17 nt, Vaccinia virus
gcauaaauuguaaaaaa

SEQ ID NO: 4058911 - RNA, 19 nt, Vaccinia virus
gcauaauccuuguaaugau

SEQ ID NO: 4058912 - RNA, 11 nt, Vaccinia virus
gcauacuaucg

SEQ ID NO: 4058913 - RNA, 11 nt, Vaccinia virus
gcauagauaua

SEQ ID NO: 4058914 - RNA, 21 nt, Vaccinia virus
gcauaguaacucauaauugcu

SEQ ID NO: 4058915 - RNA, 13 nt, Vaccinia virus
gcauaucaugaaa

SEQ ID NO: 4058916 - RNA, 21 nt, Vaccinia virus
gcaucaacaauuacaaaugag

SEQ ID NO: 4058917 - RNA, 18 nt, Vaccinia virus
gcaucaggauauaaagaa

SEQ ID NO: 4058918 - RNA, 17 nt, Vaccinia virus
gcaucaguaucuucaga

SEQ ID NO: 4058919 - RNA, 12 nt, Vaccinia virus
gcaucuauuuua

SEQ ID NO: 4058920 - RNA, 22 nt, Vaccinia virus
gcauguagaagacaauaaagau

SEQ ID NO: 4058921 - RNA, 15 nt, Vaccinia virus
gcauuaaaugaugaa

SEQ ID NO: 4058922 - RNA, 19 nt, Vaccinia virus
gcauuaacuagauuaauuu

SEQ ID NO: 4058923 - RNA, 13 nt, Vaccinia virus
gcauuaauacagu

SEQ ID NO: 4058924 - RNA, 21 nt, Vaccinia virus
gcauuaauacuguuuucuuag

SEQ ID NO: 4058925 - RNA, 18 nt, Vaccinia virus
gcauuacaguucuuuucu

SEQ ID NO: 4058926 - RNA, 14 nt, Vaccinia virus
gcauucaaauggau

SEQ ID NO: 4058927 - RNA, 17 nt, Vaccinia virus
gcauucuucauucuauu

SEQ ID NO: 4058928 - RNA, 16 nt, Vaccinia virus
gcauuucuaauacaug

SEQ ID NO: 4058929 - RNA, 18 nt, Vaccinia virus
gcauuuuuugguuucuuu

SEQ ID NO: 4058930 - RNA, 15 nt, Vaccinia virus
gccaaaaugauagau

SEQ ID NO: 4058931 - RNA, 12 nt, Vaccinia virus
gccaacaaauau

SEQ ID NO: 4058932 - RNA, 21 nt, Vaccinia virus
gccaagauaucuauauaauua

SEQ ID NO: 4058933 - RNA, 23 nt, Vaccinia virus
gccacaaaugaaaaaaauacuua

SEQ ID NO: 4058934 - RNA, 15 nt, Vaccinia virus
gccaccacuucucua

SEQ ID NO: 4058935 - RNA, 20 nt, Vaccinia virus
gccagagauaauuucuguaa

SEQ ID NO: 4058936 - RNA, 21 nt, Vaccinia virus
gccauauuccacagauaauau

SEQ ID NO: 4058937 - RNA, 13 nt, Vaccinia virus
gccauccaaacaa

SEQ ID NO: 4058938 - RNA, 21 nt, Vaccinia virus
gccauugcugccacucauaau

SEQ ID NO: 4058939 - RNA, 22 nt, Vaccinia virus
gccauuuguagucuuucaacau

SEQ ID NO: 4058940 - RNA, 22 nt, Vaccinia virus
gcccaauuuugguguaaaucua

SEQ ID NO: 4058941 - RNA, 17 nt, Vaccinia virus
gcccauagaguauuauu

SEQ ID NO: 4058942 - RNA, 14 nt, Vaccinia virus
gccgaacuaaaaaa

SEQ ID NO: 4058943 - RNA, 18 nt, Vaccinia virus
gccgaugaauggaucacc

SEQ ID NO: 4058944 - RNA, 17 nt, Vaccinia virus
gccgucuuuaucucuua

SEQ ID NO: 4058945 - RNA, 15 nt, Vaccinia virus
gccucaguugucaac

SEQ ID NO: 4058946 - RNA, 19 nt, Vaccinia virus
gccuccacuagaagagaau

SEQ ID NO: 4058947 - RNA, 12 nt, Vaccinia virus
gccugaauaucu

SEQ ID NO: 4058948 - RNA, 13 nt, Vaccinia virus
gcgaaauaaagaa

SEQ ID NO: 4058949 - RNA, 14 nt, Vaccinia virus
gcgaggaaauguau

SEQ ID NO: 4058950 - RNA, 19 nt, Vaccinia virus
gcgauagcugauaauagaa

SEQ ID NO: 4058951 - RNA, 23 nt, Vaccinia virus
gcgauaucuccauuaauaaugau

SEQ ID NO: 4058952 - RNA, 21 nt, Vaccinia virus
gcgccuuauauagcacuuuua

SEQ ID NO: 4058953 - RNA, 22 nt, Vaccinia virus
gcggacauuaaacgauuugaug

SEQ ID NO: 4058954 - RNA, 16 nt, Vaccinia virus
gcggccaucauauuau

SEQ ID NO: 4058955 - RNA, 19 nt, Vaccinia virus
gcgguucaaaauagaaaau

SEQ ID NO: 4058956 - RNA, 18 nt, Vaccinia virus
gcguacacaaucaaucau

SEQ ID NO: 4058957 - RNA, 15 nt, Vaccinia virus
gcguaguauuacuuc

SEQ ID NO: 4058958 - RNA, 15 nt, Vaccinia virus
gcguccgauuccguu

SEQ ID NO: 4058959 - RNA, 17 nt, Vaccinia virus
gcguguuuuauuaauca

SEQ ID NO: 4058960 - RNA, 21 nt, Vaccinia virus
gcguuaacuaucaaacaaacu

SEQ ID NO: 4058961 - RNA, 15 nt, Vaccinia virus
gcguuaauaaaaaca

SEQ ID NO: 4058962 - RNA, 22 nt, Vaccinia virus
gcguucagauugggaucuuuuc

SEQ ID NO: 4058963 - RNA, 15 nt, Vaccinia virus
gcguucauuggaaaa

SEQ ID NO: 4058964 - RNA, 23 nt, Vaccinia virus
gcguuccuugugcuuaauguuuc

SEQ ID NO: 4058965 - RNA, 14 nt, Vaccinia virus
gcuaaaaaauuagu

SEQ ID NO: 4058966 - RNA, 14 nt, Vaccinia virus
gcuaaaauuuucau

SEQ ID NO: 4058967 - RNA, 20 nt, Vaccinia virus
gcuaaguauacgaucuuuua

SEQ ID NO: 4058968 - RNA, 21 nt, Vaccinia virus
gcuaauaaugacuguagauau

SEQ ID NO: 4058969 - RNA, 16 nt, Vaccinia virus
gcuaauauuaguacua

SEQ ID NO: 4058970 - RNA, 22 nt, Vaccinia virus
gcuacacccacuagaaaccacg

SEQ ID NO: 4058971 - RNA, 16 nt, Vaccinia virus
gcuacucguuuggaau

SEQ ID NO: 4058972 - RNA, 15 nt, Vaccinia virus
gcuaguauagaaauu

SEQ ID NO: 4058973 - RNA, 20 nt, Vaccinia virus
gcuaguuaauaguaaaugaa

SEQ ID NO: 4058974 - RNA, 23 nt, Vaccinia virus
gcuauagcauuguuauguauuuc

SEQ ID NO: 4058975 - RNA, 17 nt, Vaccinia virus
gcuaucaaaauauguag

SEQ ID NO: 4058976 - RNA, 20 nt, Vaccinia virus
gcuauccaucagaauguuuc

SEQ ID NO: 4058977 - RNA, 17 nt, Vaccinia virus
gcuaugaaggaaagaca

SEQ ID NO: 4058978 - RNA, 21 nt, Vaccinia virus
gcuauucuggugcuaauuauu

SEQ ID NO: 4058979 - RNA, 15 nt, Vaccinia virus
gcucaguaaauguau

SEQ ID NO: 4058980 - RNA, 12 nt, Vaccinia virus
gcucuacaaaau

SEQ ID NO: 4058981 - RNA, 19 nt, Vaccinia virus
gcucuauauuacaaacuau

SEQ ID NO: 4058982 - RNA, 13 nt, Vaccinia virus
gcucuaucuuuua

SEQ ID NO: 4058983 - RNA, 24 nt, Vaccinia virus
gcucuggcuauucgagaugaacau

SEQ ID NO: 4058984 - RNA, 18 nt, Vaccinia virus
gcucuuuugaugauaaau

SEQ ID NO: 4058985 - RNA, 21 nt, Vaccinia virus
gcugaaguaauuaauuuuucu

SEQ ID NO: 4058986 - RNA, 14 nt, Vaccinia virus
gcugaguauuucau

SEQ ID NO: 4058987 - RNA, 15 nt, Vaccinia virus
gcugccaaaguuauu

SEQ ID NO: 4058988 - RNA, 23 nt, Vaccinia virus
gcugguaauaguuuacagauauu

SEQ ID NO: 4058989 - RNA, 12 nt, Vaccinia virus
gcuguaaaucac

SEQ ID NO: 4058990 - RNA, 13 nt, Vaccinia virus
gcuguuauauauu

SEQ ID NO: 4058991 - RNA, 14 nt, Vaccinia virus
gcuuauauuuucau

SEQ ID NO: 4058992 - RNA, 13 nt, Vaccinia virus
gcuucauccuuua

SEQ ID NO: 4058993 - RNA, 19 nt, Vaccinia virus
gcuugauaagauaaaaucu

SEQ ID NO: 4058994 - RNA, 17 nt, Vaccinia virus
gcuugcauguauuaaag

SEQ ID NO: 4058995 - RNA, 14 nt, Vaccinia virus
gcuuuccuaaagaa

SEQ ID NO: 4058996 - RNA, 17 nt, Vaccinia virus
ggaaaaaauuguugauc

SEQ ID NO: 4058997 - RNA, 21 nt, Vaccinia virus
ggaaaagucaaagucguuuaa

SEQ ID NO: 4058998 - RNA, 14 nt, Vaccinia virus
ggaacaauaaaaga

SEQ ID NO: 4058999 - RNA, 22 nt, Vaccinia virus
ggaacaguucuaccaccaguaa

SEQ ID NO: 4059000 - RNA, 19 nt, Vaccinia virus
ggaacauuaaauguauuuu

SEQ ID NO: 4059001 - RNA, 17 nt, Vaccinia virus
ggaauaugacuauuuuc

SEQ ID NO: 4059002 - RNA, 21 nt, Vaccinia virus
ggaaucaauuacagauuucuc

SEQ ID NO: 4059003 - RNA, 14 nt, Vaccinia virus
ggacaccacuaucu

SEQ ID NO: 4059004 - RNA, 17 nt, Vaccinia virus
ggacacgauauagagag

SEQ ID NO: 4059005 - RNA, 21 nt, Vaccinia virus
ggacagauacuacuauuuguc

SEQ ID NO: 4059006 - RNA, 15 nt, Vaccinia virus
ggacagucuauuuuc

SEQ ID NO: 4059007 - RNA, 14 nt, Vaccinia virus
ggacccauagagaa

SEQ ID NO: 4059008 - RNA, 14 nt, Vaccinia virus
ggagaauguuuccc

SEQ ID NO: 4059009 - RNA, 23 nt, Vaccinia virus
ggaguacccacugaugagauguu

SEQ ID NO: 4059010 - RNA, 14 nt, Vaccinia virus
ggauacucuauuaa

SEQ ID NO: 4059011 - RNA, 14 nt, Vaccinia virus
ggauauguuuuuaa

SEQ ID NO: 4059012 - RNA, 18 nt, Vaccinia virus
ggauauugcaugauagaa

SEQ ID NO: 4059013 - RNA, 20 nt, Vaccinia virus
ggauguuguucgauugauuu

SEQ ID NO: 4059014 - RNA, 20 nt, Vaccinia virus
ggauugguggauauauacgu

SEQ ID NO: 4059015 - RNA, 21 nt, Vaccinia virus
ggauugguuucuaaauucaug

SEQ ID NO: 4059016 - RNA, 11 nt, Vaccinia virus
ggcaucuuuuu

SEQ ID NO: 4059017 - RNA, 14 nt, Vaccinia virus
ggcauguguuuccc

SEQ ID NO: 4059018 - RNA, 15 nt, Vaccinia virus
ggccguuuguuuccu

SEQ ID NO: 4059019 - RNA, 11 nt, Vaccinia virus
gggaaaugaua

SEQ ID NO: 4059020 - RNA, 19 nt, Vaccinia virus
gggacgcguauauguuucu

SEQ ID NO: 4059021 - RNA, 20 nt, Vaccinia virus
gggauuguccggcauaucau

SEQ ID NO: 4059022 - RNA, 12 nt, Vaccinia virus
gguaaauguuuu

SEQ ID NO: 4059023 - RNA, 16 nt, Vaccinia virus
gguaacgcgucuuuaa

SEQ ID NO: 4059024 - RNA, 19 nt, Vaccinia virus
gguaauagauuuuucauau

SEQ ID NO: 4059025 - RNA, 13 nt, Vaccinia virus
gguacuauuucua

SEQ ID NO: 4059026 - RNA, 13 nt, Vaccinia virus
gguauaauaacuu

SEQ ID NO: 4059027 - RNA, 20 nt, Vaccinia virus
gguauaucuggaaagaaauc

SEQ ID NO: 4059028 - RNA, 17 nt, Vaccinia virus
gguaugauuuuugucca

SEQ ID NO: 4059029 - RNA, 21 nt, Vaccinia virus
gguauuuauaaacuuuaucca

SEQ ID NO: 4059030 - RNA, 17 nt, Vaccinia virus
ggucacacguguagaau

SEQ ID NO: 4059031 - RNA, 17 nt, Vaccinia virus
gguggauggagucccag

SEQ ID NO: 4059032 - RNA, 16 nt, Vaccinia virus
gguuaacaucuuauaa

SEQ ID NO: 4059033 - RNA, 19 nt, Vaccinia virus
gguuaacucuuucuuuuga

SEQ ID NO: 4059034 - RNA, 11 nt, Vaccinia virus
gguuagauauu

SEQ ID NO: 4059035 - RNA, 16 nt, Vaccinia virus
gguucgauauaaagga

SEQ ID NO: 4059036 - RNA, 13 nt, Vaccinia virus
gguuguaucucau

SEQ ID NO: 4059037 - RNA, 22 nt, Vaccinia virus
gguuucgaagaucuucuuauuu

SEQ ID NO: 4059038 - RNA, 14 nt, Vaccinia virus
guaaaaauaauuau

SEQ ID NO: 4059039 - RNA, 16 nt, Vaccinia virus
guaaaaaugaaaugau

SEQ ID NO: 4059040 - RNA, 14 nt, Vaccinia virus
guaaaauaaucaua

SEQ ID NO: 4059041 - RNA, 20 nt, Vaccinia virus
guaaaauaaucauacaaucu

SEQ ID NO: 4059042 - RNA, 13 nt, Vaccinia virus
guaaaauaaucuc

SEQ ID NO: 4059043 - RNA, 14 nt, Vaccinia virus
guaaaauauucuuu

SEQ ID NO: 4059044 - RNA, 19 nt, Vaccinia virus
guaaaaugaaauaucuuaa

SEQ ID NO: 4059045 - RNA, 22 nt, Vaccinia virus
guaaaauggccaagaaaauaga

SEQ ID NO: 4059046 - RNA, 15 nt, Vaccinia virus
guaaacacauaucca

SEQ ID NO: 4059047 - RNA, 22 nt, Vaccinia virus
guaaacauuaugccguuaucau

SEQ ID NO: 4059048 - RNA, 23 nt, Vaccinia virus
guaaaccagcggcuacuaaaaga

SEQ ID NO: 4059049 - RNA, 15 nt, Vaccinia virus
guaaaccguuuuuaa

SEQ ID NO: 4059050 - RNA, 17 nt, Vaccinia virus
guaaaggauaugauaug

SEQ ID NO: 4059051 - RNA, 15 nt, Vaccinia virus
guaaauaaauacuuu

SEQ ID NO: 4059052 - RNA, 13 nt, Vaccinia virus
guaaauaguuuua

SEQ ID NO: 4059053 - RNA, 19 nt, Vaccinia virus
guaaauauagaucaaacaa

SEQ ID NO: 4059054 - RNA, 16 nt, Vaccinia virus
guaaaucacauaucua

SEQ ID NO: 4059055 - RNA, 15 nt, Vaccinia virus
guaaaucauuaucua

SEQ ID NO: 4059056 - RNA, 16 nt, Vaccinia virus
guaaauccuaguucug

SEQ ID NO: 4059057 - RNA, 11 nt, Vaccinia virus
guaacaaacug

SEQ ID NO: 4059058 - RNA, 18 nt, Vaccinia virus
guaacagcuuggacaauc

SEQ ID NO: 4059059 - RNA, 17 nt, Vaccinia virus
guaacuauguaaaugau

SEQ ID NO: 4059060 - RNA, 21 nt, Vaccinia virus
guaacucuaguaaaauaauca

SEQ ID NO: 4059061 - RNA, 17 nt, Vaccinia virus
guaagacgauuaaccaa

SEQ ID NO: 4059062 - RNA, 18 nt, Vaccinia virus
guaagacuugacuagauc

SEQ ID NO: 4059063 - RNA, 14 nt, Vaccinia virus
guaagcauuuccuu

SEQ ID NO: 4059064 - RNA, 14 nt, Vaccinia virus
guaauaacauugcu

SEQ ID NO: 4059065 - RNA, 19 nt, Vaccinia virus
guaauaagauuucuauucc

SEQ ID NO: 4059066 - RNA, 13 nt, Vaccinia virus
guaauaaucuguu

SEQ ID NO: 4059067 - RNA, 18 nt, Vaccinia virus
guaauacauauaaauguc

SEQ ID NO: 4059068 - RNA, 14 nt, Vaccinia virus
guaauacaugcaaa

SEQ ID NO: 4059069 - RNA, 23 nt, Vaccinia virus
guaauacuuuucuucauuacuuc

SEQ ID NO: 4059070 - RNA, 22 nt, Vaccinia virus
guaauagaauacgaugauauua

SEQ ID NO: 4059071 - RNA, 14 nt, Vaccinia virus
guaauauauaaacu

SEQ ID NO: 4059072 - RNA, 15 nt, Vaccinia virus
guaauauuuuuaguu

SEQ ID NO: 4059073 - RNA, 13 nt, Vaccinia virus
guaauccauaauc

SEQ ID NO: 4059074 - RNA, 21 nt, Vaccinia virus
guaaucgucguagggagagaa

SEQ ID NO: 4059075 - RNA, 20 nt, Vaccinia virus
guaaugauaaaaucaaucgu

SEQ ID NO: 4059076 - RNA, 15 nt, Vaccinia virus
guaauuaaauguuug

SEQ ID NO: 4059077 - RNA, 22 nt, Vaccinia virus
guacacauauggaauauaucua

SEQ ID NO: 4059078 - RNA, 20 nt, Vaccinia virus
guacauggaugauauagaua

SEQ ID NO: 4059079 - RNA, 18 nt, Vaccinia virus
guacaugggaaaugaaau

SEQ ID NO: 4059080 - RNA, 21 nt, Vaccinia virus
guacauuagccggacaaauau

SEQ ID NO: 4059081 - RNA, 20 nt, Vaccinia virus
guaccagaaggaacauacga

SEQ ID NO: 4059082 - RNA, 16 nt, Vaccinia virus
guaccauuugauuuuc

SEQ ID NO: 4059083 - RNA, 14 nt, Vaccinia virus
guacccaaguuauu

SEQ ID NO: 4059084 - RNA, 20 nt, Vaccinia virus
guaccuggaauguaaagccc

SEQ ID NO: 4059085 - RNA, 15 nt, Vaccinia virus
guaccugguaagaua

SEQ ID NO: 4059086 - RNA, 17 nt, Vaccinia virus
guacuccucccauaaua

SEQ ID NO: 4059087 - RNA, 17 nt, Vaccinia virus
guacuucuguacaaaau

SEQ ID NO: 4059088 - RNA, 16 nt, Vaccinia virus
guacuuguacacauau

SEQ ID NO: 4059089 - RNA, 16 nt, Vaccinia virus
guagaacaauguguga

SEQ ID NO: 4059090 - RNA, 17 nt, Vaccinia virus
guagaauuuuuuaaaaa

SEQ ID NO: 4059091 - RNA, 17 nt, Vaccinia virus
guagauaaucauuuaau

SEQ ID NO: 4059092 - RNA, 22 nt, Vaccinia virus
guagauuuucaauuauguauca

SEQ ID NO: 4059093 - RNA, 20 nt, Vaccinia virus
guagcaaagaaauuaauaga

SEQ ID NO: 4059094 - RNA, 22 nt, Vaccinia virus
guagcaaauaaaaucuauauga

SEQ ID NO: 4059095 - RNA, 19 nt, Vaccinia virus
guagucaguagacaucuga

SEQ ID NO: 4059096 - RNA, 15 nt, Vaccinia virus
guaguuguugguaac

SEQ ID NO: 4059097 - RNA, 23 nt, Vaccinia virus
guauaacaugacauuuauucauc

SEQ ID NO: 4059098 - RNA, 12 nt, Vaccinia virus
guauaacauucu

SEQ ID NO: 4059099 - RNA, 21 nt, Vaccinia virus
guauaauacggacuucauaau

SEQ ID NO: 4059100 - RNA, 18 nt, Vaccinia virus
guauaauauuuaaacaau

SEQ ID NO: 4059101 - RNA, 16 nt, Vaccinia virus
guauaauucuuuauaa

SEQ ID NO: 4059102 - RNA, 20 nt, Vaccinia virus
guauacacaaaaagaaagaa

SEQ ID NO: 4059103 - RNA, 22 nt, Vaccinia virus
guauacagcuggagauuaucau

SEQ ID NO: 4059104 - RNA, 20 nt, Vaccinia virus
guauagauccuccaguaaau

SEQ ID NO: 4059105 - RNA, 14 nt, Vaccinia virus
guauauaacauugu

SEQ ID NO: 4059106 - RNA, 11 nt, Vaccinia virus
guauauacaug

SEQ ID NO: 4059107 - RNA, 23 nt, Vaccinia virus
guaucaauaauagcaacauauga

SEQ ID NO: 4059108 - RNA, 16 nt, Vaccinia virus
guaucaugaacucuaa

SEQ ID NO: 4059109 - RNA, 14 nt, Vaccinia virus
guaucauuaaacau

SEQ ID NO: 4059110 - RNA, 15 nt, Vaccinia virus
guauccauaaacaau

SEQ ID NO: 4059111 - RNA, 22 nt, Vaccinia virus
guauccuauuccacauuuuguu

SEQ ID NO: 4059112 - RNA, 20 nt, Vaccinia virus
guaucgacaucuuuauuauu

SEQ ID NO: 4059113 - RNA, 15 nt, Vaccinia virus
guaucgauaauuauu

SEQ ID NO: 4059114 - RNA, 14 nt, Vaccinia virus
guaucgcacgcucu

SEQ ID NO: 4059115 - RNA, 16 nt, Vaccinia virus
guaucuacgauuuuua

SEQ ID NO: 4059116 - RNA, 17 nt, Vaccinia virus
guaucuagccauaucua

SEQ ID NO: 4059117 - RNA, 15 nt, Vaccinia virus
guaucuauaaucauc

SEQ ID NO: 4059118 - RNA, 16 nt, Vaccinia virus
ucuuccauuuaaauau

SEQ ID NO: 4059119 - RNA, 22 nt, Vaccinia virus
ucuuccguuuauuauuauacau

SEQ ID NO: 4059120 - RNA, 22 nt, Vaccinia virus
ucuuccuuaacuauauauuugu

SEQ ID NO: 4059121 - RNA, 15 nt, Vaccinia virus
ucuuccuucgauaga

SEQ ID NO: 4059122 - RNA, 22 nt, Vaccinia virus
ucuucgcccucaauuucccaaa

SEQ ID NO: 4059123 - RNA, 17 nt, Vaccinia virus
ucuucuauuuuaucauu

SEQ ID NO: 4059124 - RNA, 19 nt, Vaccinia virus
ucuucucuaagagcuacgu

SEQ ID NO: 4059125 - RNA, 18 nt, Vaccinia virus
ucuugauuacaaaaccaa

SEQ ID NO: 4059126 - RNA, 22 nt, Vaccinia virus
ucuugauuaccuuacucaugau

SEQ ID NO: 4059127 - RNA, 15 nt, Vaccinia virus
ucuugguaauacuua

SEQ ID NO: 4059128 - RNA, 14 nt, Vaccinia virus
ucuuuaaugugaaa

SEQ ID NO: 4059129 - RNA, 21 nt, Vaccinia virus
ucuuuaccauaacuguauaaa

SEQ ID NO: 4059130 - RNA, 15 nt, Vaccinia virus
ucuuuacccauccaa

SEQ ID NO: 4059131 - RNA, 17 nt, Vaccinia virus
ucuuuagcuucugaaau

SEQ ID NO: 4059132 - RNA, 14 nt, Vaccinia virus
ucuuucauuucagu

SEQ ID NO: 4059133 - RNA, 17 nt, Vaccinia virus
ucuuucuucuacuauau

SEQ ID NO: 4059134 - RNA, 21 nt, Vaccinia virus
ucuuugaaaaguucuaugaaa

SEQ ID NO: 4059135 - RNA, 22 nt, Vaccinia virus
ucuuugaaacacgauuuaaaau

SEQ ID NO: 4059136 - RNA, 12 nt, Vaccinia virus
ucuuuuaaauau

SEQ ID NO: 4059137 - RNA, 22 nt, Vaccinia virus
ucuuuuuauucucguuaaacag

SEQ ID NO: 4059138 - RNA, 19 nt, Vaccinia virus
ugaaaaaaaacuagucguu

SEQ ID NO: 4059139 - RNA, 14 nt, Vaccinia virus
ugaaaauaaagaua

SEQ ID NO: 4059140 - RNA, 12 nt, Vaccinia virus
ugaaaauacguu

SEQ ID NO: 4059141 - RNA, 15 nt, Vaccinia virus
ugaaaaugaaaauau

SEQ ID NO: 4059142 - RNA, 18 nt, Vaccinia virus
ugaaacaggacauuauca

SEQ ID NO: 4059143 - RNA, 14 nt, Vaccinia virus
ugaaagaacuacau

SEQ ID NO: 4059144 - RNA, 20 nt, Vaccinia virus
ugaaagcgagaaauaaucau

SEQ ID NO: 4059145 - RNA, 13 nt, Vaccinia virus
ugaaauaacucuu

SEQ ID NO: 4059146 - RNA, 20 nt, Vaccinia virus
ugaaauccguagaaacaucu

SEQ ID NO: 4059147 - RNA, 11 nt, Vaccinia virus
ugaaauuauuc

SEQ ID NO: 4059148 - RNA, 17 nt, Vaccinia virus
ugaacauaguaagaaau

SEQ ID NO: 4059149 - RNA, 24 nt, Vaccinia virus
ugaacauauaguucgucauuuaau

SEQ ID NO: 4059150 - RNA, 14 nt, Vaccinia virus
ugaaccaaacauuc

SEQ ID NO: 4059151 - RNA, 21 nt, Vaccinia virus
ugaaccaaacauucuuucaaa

SEQ ID NO: 4059152 - RNA, 23 nt, Vaccinia virus
ugaaccaguuaauguauaucuuu

SEQ ID NO: 4059153 - RNA, 19 nt, Vaccinia virus
ugaaccguaauauaucuag

SEQ ID NO: 4059154 - RNA, 17 nt, Vaccinia virus
ugaacgcuauuaaacau

SEQ ID NO: 4059155 - RNA, 23 nt, Vaccinia virus
ugaagaaccaguaacauaugaua

SEQ ID NO: 4059156 - RNA, 22 nt, Vaccinia virus
ugaagaagugucuauaaaugua

SEQ ID NO: 4059157 - RNA, 12 nt, Vaccinia virus
ugaagaugaugu

SEQ ID NO: 4059158 - RNA, 15 nt, Vaccinia virus
ugaagaugaugugaa

SEQ ID NO: 4059159 - RNA, 16 nt, Vaccinia virus
ugaagcaaaauaugcu

SEQ ID NO: 4059160 - RNA, 16 nt, Vaccinia virus
ugaagccauugaaaac

SEQ ID NO: 4059161 - RNA, 16 nt, Vaccinia virus
ugaauacaauaauuca

SEQ ID NO: 4059162 - RNA, 12 nt, Vaccinia virus
ugaauauacuuu

SEQ ID NO: 4059163 - RNA, 15 nt, Vaccinia virus
ugaauauauaugaca

SEQ ID NO: 4059164 - RNA, 11 nt, Vaccinia virus
ugaaucucugu

SEQ ID NO: 4059165 - RNA, 20 nt, Vaccinia virus
ugaaugcugaugaacagguu

SEQ ID NO: 4059166 - RNA, 16 nt, Vaccinia virus
ugaauggauacuaguu

SEQ ID NO: 4059167 - RNA, 13 nt, Vaccinia virus
ugaauugcauaca

SEQ ID NO: 4059168 - RNA, 18 nt, Vaccinia virus
ugaauugcgauuauaaga

SEQ ID NO: 4059169 - RNA, 14 nt, Vaccinia virus
ugaauuguuucuuu

SEQ ID NO: 4059170 - RNA, 21 nt, Vaccinia virus
ugacaaaaucaacuacauaau

SEQ ID NO: 4059171 - RNA, 13 nt, Vaccinia virus
ugacaaaauuaaa

SEQ ID NO: 4059172 - RNA, 12 nt, Vaccinia virus
ugacaauaauua

SEQ ID NO: 4059173 - RNA, 17 nt, Vaccinia virus
ugacaauaauuauguag

SEQ ID NO: 4059174 - RNA, 16 nt, Vaccinia virus
ugacacuaucuucugu

SEQ ID NO: 4059175 - RNA, 18 nt, Vaccinia virus
ugacaucauacuagauaa

SEQ ID NO: 4059176 - RNA, 19 nt, Vaccinia virus
ugacaucgacgcauuauau

SEQ ID NO: 4059177 - RNA, 12 nt, Vaccinia virus
ugacauggaaau

SEQ ID NO: 4059178 - RNA, 17 nt, Vaccinia virus
ugacauuuauucaucau

SEQ ID NO: 4059179 - RNA, 20 nt, Vaccinia virus
ugacauuuucacaaauacua

SEQ ID NO: 4059180 - RNA, 20 nt, Vaccinia virus
ugacauuuuccuuguaucca

SEQ ID NO: 4059181 - RNA, 18 nt, Vaccinia virus
ugacgaacguauugcuau

SEQ ID NO: 4059182 - RNA, 17 nt, Vaccinia virus
ugacgcaguaacauaua

SEQ ID NO: 4059183 - RNA, 18 nt, Vaccinia virus
ugacgcaguaacauauau

SEQ ID NO: 4059184 - RNA, 19 nt, Vaccinia virus
ugacguacaaaaaaauaaa

SEQ ID NO: 4059185 - RNA, 17 nt, Vaccinia virus
ugacgucagccauagca

SEQ ID NO: 4059186 - RNA, 19 nt, Vaccinia virus
ugacuagacugauuucucu

SEQ ID NO: 4059187 - RNA, 20 nt, Vaccinia virus
ugacuaguuguagaauuuga

SEQ ID NO: 4059188 - RNA, 20 nt, Vaccinia virus
ugacuguagaacucaugaau

SEQ ID NO: 4059189 - RNA, 18 nt, Vaccinia virus
ugacuuaacuuguaauaa

SEQ ID NO: 4059190 - RNA, 23 nt, Vaccinia virus
ugacuuaacuuguaauaauugcu

SEQ ID NO: 4059191 - RNA, 12 nt, Vaccinia virus
ugacuucaucau

SEQ ID NO: 4059192 - RNA, 21 nt, Vaccinia virus
ugacuuuuuuuguaccuuugu

SEQ ID NO: 4059193 - RNA, 19 nt, Vaccinia virus
ugagauaaauaucaucaau

SEQ ID NO: 4059194 - RNA, 21 nt, Vaccinia virus
ugagauacguaguuauguaga

SEQ ID NO: 4059195 - RNA, 22 nt, Vaccinia virus
ugagaucccacaucauuucaac

SEQ ID NO: 4059196 - RNA, 17 nt, Vaccinia virus
ugagauguuuauauguu

SEQ ID NO: 4059197 - RNA, 14 nt, Vaccinia virus
ugaggaaauugaua

SEQ ID NO: 4059198 - RNA, 18 nt, Vaccinia virus
ugaggagaucuaaacaau

SEQ ID NO: 4059199 - RNA, 15 nt, Vaccinia virus
ugaguaaugaaaucc

SEQ ID NO: 4059200 - RNA, 17 nt, Vaccinia virus
ugagucuauaucccauu

SEQ ID NO: 4059201 - RNA, 16 nt, Vaccinia virus
ugauacaccuguaauc

SEQ ID NO: 4059202 - RNA, 16 nt, Vaccinia virus
ugauagagacaaacua

SEQ ID NO: 4059203 - RNA, 11 nt, Vaccinia virus
ugauagauauu

SEQ ID NO: 4059204 - RNA, 16 nt, Vaccinia virus
ugauagauuuucuacu

SEQ ID NO: 4059205 - RNA, 21 nt, Vaccinia virus
ugauagguaucgaugaaggac

SEQ ID NO: 4059206 - RNA, 17 nt, Vaccinia virus
ugauaguaauucucgga

SEQ ID NO: 4059207 - RNA, 22 nt, Vaccinia virus
ugauaguauuccaauaucugag

SEQ ID NO: 4059208 - RNA, 21 nt, Vaccinia virus
ugauauacaaugcucaguaaa

SEQ ID NO: 4059209 - RNA, 19 nt, Vaccinia virus
ugauaucauguuagauaua

SEQ ID NO: 4059210 - RNA, 21 nt, Vaccinia virus
ugauauuagccuuuacagaua

SEQ ID NO: 4059211 - RNA, 17 nt, Vaccinia virus
ugauauuggauauauca

SEQ ID NO: 4059212 - RNA, 23 nt, Vaccinia virus
ugauauugugaaugguaaagaau

SEQ ID NO: 4059213 - RNA, 16 nt, Vaccinia virus
ugaucaaaaagagauu

SEQ ID NO: 4059214 - RNA, 18 nt, Vaccinia virus
ugaucggauaguauucaa

SEQ ID NO: 4059215 - RNA, 13 nt, Vaccinia virus
ugaugaauuaaug

SEQ ID NO: 4059216 - RNA, 14 nt, Vaccinia virus
ugaugaauuuaccu

SEQ ID NO: 4059217 - RNA, 16 nt, Vaccinia virus
ugaugaguuagauauu

SEQ ID NO: 4059218 - RNA, 14 nt, Vaccinia virus
ugaugauagagaua

SEQ ID NO: 4059219 - RNA, 17 nt, Vaccinia virus
ugaugauuauggagaac

SEQ ID NO: 4059220 - RNA, 21 nt, Vaccinia virus
ugaugcguuccauuuguguau

SEQ ID NO: 4059221 - RNA, 22 nt, Vaccinia virus
ugauuaaugauuuagaaaugaa

SEQ ID NO: 4059222 - RNA, 14 nt, Vaccinia virus
ugauuauauagaua

SEQ ID NO: 4059223 - RNA, 14 nt, Vaccinia virus
ugauuauuagauuu

SEQ ID NO: 4059224 - RNA, 21 nt, Vaccinia virus
ugauuauucuauaaguauaga

SEQ ID NO: 4059225 - RNA, 18 nt, Vaccinia virus
ugauucacguuauauaac

SEQ ID NO: 4059226 - RNA, 18 nt, Vaccinia virus
ugauucauucacuaucaa

SEQ ID NO: 4059227 - RNA, 16 nt, Vaccinia virus
ugauuccaaaauugaa

SEQ ID NO: 4059228 - RNA, 11 nt, Vaccinia virus
ugauugaagaa

SEQ ID NO: 4059229 - RNA, 17 nt, Vaccinia virus
ugauugcagauuugcca

SEQ ID NO: 4059230 - RNA, 16 nt, Vaccinia virus
ugauuguacacuucua

SEQ ID NO: 4059231 - RNA, 16 nt, Vaccinia virus
ugauugugucucgaau

SEQ ID NO: 4059232 - RNA, 15 nt, Vaccinia virus
ugauuucaauuuauu

SEQ ID NO: 4059233 - RNA, 23 nt, Vaccinia virus
ugauuucgacggagaugaagaau

SEQ ID NO: 4059234 - RNA, 18 nt, Vaccinia virus
ugauuuucguaacagaua

SEQ ID NO: 4059235 - RNA, 22 nt, Vaccinia virus
ugauuuuguagaugccauauca

SEQ ID NO: 4059236 - RNA, 18 nt, Vaccinia virus
ugcaaagaacagaauaaa

SEQ ID NO: 4059237 - RNA, 14 nt, Vaccinia virus
ugcaaagucuaaau

SEQ ID NO: 4059238 - RNA, 19 nt, Vaccinia virus
ugcaacggcgaaacaaaau

SEQ ID NO: 4059239 - RNA, 12 nt, Vaccinia virus
ugcaaggcauuu

SEQ ID NO: 4059240 - RNA, 13 nt, Vaccinia virus
ugcaauaaaucua

SEQ ID NO: 4059241 - RNA, 18 nt, Vaccinia virus
ugcacaaagaagaauucu

SEQ ID NO: 4059242 - RNA, 18 nt, Vaccinia virus
uuaacgaguuaaaaaaga

SEQ ID NO: 4059243 - RNA, 22 nt, Vaccinia virus
uuaacgauuggaaaucauuaac

SEQ ID NO: 4059244 - RNA, 14 nt, Vaccinia virus
uuaacguauaaaug

SEQ ID NO: 4059245 - RNA, 23 nt, Vaccinia virus
uuaacgucuaccgaaacaucguu

SEQ ID NO: 4059246 - RNA, 16 nt, Vaccinia virus
uuaacuagauuauaca

SEQ ID NO: 4059247 - RNA, 13 nt, Vaccinia virus
uuaacuauuuugu

SEQ ID NO: 4059248 - RNA, 20 nt, Vaccinia virus
uuaacuugacuaaauauuca

SEQ ID NO: 4059249 - RNA, 15 nt, Vaccinia virus
uuaagaaaauuauua

SEQ ID NO: 4059250 - RNA, 17 nt, Vaccinia virus
uuaagagaauaauagau

SEQ ID NO: 4059251 - RNA, 13 nt, Vaccinia virus
uuaagagauaucu

SEQ ID NO: 4059252 - RNA, 22 nt, Vaccinia virus
uuaauaaauccggaacuguaaa

SEQ ID NO: 4059253 - RNA, 20 nt, Vaccinia virus
uuaauaagauuuuuaucauu

SEQ ID NO: 4059254 - RNA, 14 nt, Vaccinia virus
uuaauaauguagua

SEQ ID NO: 4059255 - RNA, 17 nt, Vaccinia virus
uuaauagauauauuaau

SEQ ID NO: 4059256 - RNA, 15 nt, Vaccinia virus
uuaauagauuaacau

SEQ ID NO: 4059257 - RNA, 18 nt, Vaccinia virus
uuaauaggcaucauuuau

SEQ ID NO: 4059258 - RNA, 18 nt, Vaccinia virus
uuaauaguuuacaccuuu

SEQ ID NO: 4059259 - RNA, 20 nt, Vaccinia virus
uuaauauaugcucuagauau

SEQ ID NO: 4059260 - RNA, 18 nt, Vaccinia virus
uuaauauauuuaaacuag

SEQ ID NO: 4059261 - RNA, 15 nt, Vaccinia virus
uuaauauuagaguua

SEQ ID NO: 4059262 - RNA, 16 nt, Vaccinia virus
uuaauccauuauuuca

SEQ ID NO: 4059263 - RNA, 15 nt, Vaccinia virus
uuaauccuagaugau

SEQ ID NO: 4059264 - RNA, 15 nt, Vaccinia virus
uuaaucuauuagaau

SEQ ID NO: 4059265 - RNA, 22 nt, Vaccinia virus
uuaaucuuggcuccauacugua

SEQ ID NO: 4059266 - RNA, 15 nt, Vaccinia virus
uuaaucuuuaaaauu

SEQ ID NO: 4059267 - RNA, 12 nt, Vaccinia virus
uuaaucuuuucu

SEQ ID NO: 4059268 - RNA, 23 nt, Vaccinia virus
uuaaugagcguaaacaauaaucg

SEQ ID NO: 4059269 - RNA, 23 nt, Vaccinia virus
uuaaugcacacaguauuaucuac

SEQ ID NO: 4059270 - RNA, 16 nt, Vaccinia virus
uuaaugcuacagauau

SEQ ID NO: 4059271 - RNA, 13 nt, Vaccinia virus
uuaauguuugcuc

SEQ ID NO: 4059272 - RNA, 14 nt, Vaccinia virus
uuaauuacauccuu

SEQ ID NO: 4059273 - RNA, 12 nt, Vaccinia virus
uuaauuaucuaa

SEQ ID NO: 4059274 - RNA, 12 nt, Vaccinia virus
uuaauucucuau

SEQ ID NO: 4059275 - RNA, 17 nt, Vaccinia virus
uuacaaaauucauuaac

SEQ ID NO: 4059276 - RNA, 12 nt, Vaccinia virus
uuacaauuauug

SEQ ID NO: 4059277 - RNA, 16 nt, Vaccinia virus
uuacauaauauauaca

SEQ ID NO: 4059278 - RNA, 21 nt, Vaccinia virus
uuacauauuucgacaaaaaga

SEQ ID NO: 4059279 - RNA, 13 nt, Vaccinia virus
uuacaucauuaag

SEQ ID NO: 4059280 - RNA, 12 nt, Vaccinia virus
uuacaugugauc

SEQ ID NO: 4059281 - RNA, 21 nt, Vaccinia virus
uuaccaucuucuuugauuaau

SEQ ID NO: 4059282 - RNA, 13 nt, Vaccinia virus
uuaccauguauga

SEQ ID NO: 4059283 - RNA, 20 nt, Vaccinia virus
uuaccccucauaguauuaau

SEQ ID NO: 4059284 - RNA, 13 nt, Vaccinia virus
uuaccgcauuaau

SEQ ID NO: 4059285 - RNA, 17 nt, Vaccinia virus
uuaccggucauauuaau

SEQ ID NO: 4059286 - RNA, 22 nt, Vaccinia virus
uuaccguccuccgccaauauag

SEQ ID NO: 4059287 - RNA, 15 nt, Vaccinia virus
uuacguuaauacuaa

SEQ ID NO: 4059288 - RNA, 16 nt, Vaccinia virus
uuacguuaauacuaag

SEQ ID NO: 4059289 - RNA, 12 nt, Vaccinia virus
uuacuaauagaa

SEQ ID NO: 4059290 - RNA, 14 nt, Vaccinia virus
uuacuacauuauua

SEQ ID NO: 4059291 - RNA, 18 nt, Vaccinia virus
uuacuaccaucauuauua

SEQ ID NO: 4059292 - RNA, 22 nt, Vaccinia virus
uuacuacguucagauuucaauu

SEQ ID NO: 4059293 - RNA, 16 nt, Vaccinia virus
uuacuauagcauuaau

SEQ ID NO: 4059294 - RNA, 19 nt, Vaccinia virus
uuacuaucaauauuauuca

SEQ ID NO: 4059295 - RNA, 13 nt, Vaccinia virus
uuacucaugauua

SEQ ID NO: 4059296 - RNA, 14 nt, Vaccinia virus
uuacuccuuaaaaa

SEQ ID NO: 4059297 - RNA, 14 nt, Vaccinia virus
uuacuucuuccaug

SEQ ID NO: 4059298 - RNA, 20 nt, Vaccinia virus
uuacuugauaggugaaaaga

SEQ ID NO: 4059299 - RNA, 9 nt, Vaccinia virus
uuagaaaaa

SEQ ID NO: 4059300 - RNA, 22 nt, Vaccinia virus
uuagaaagaaacgauuauuucu

SEQ ID NO: 4059301 - RNA, 20 nt, Vaccinia virus
uuagaaggauuggucuuaaa

SEQ ID NO: 4059302 - RNA, 16 nt, Vaccinia virus
uuagaauauauuuucu

SEQ ID NO: 4059303 - RNA, 23 nt, Vaccinia virus
uuagacauaaaaacuaauauuag

SEQ ID NO: 4059304 - RNA, 19 nt, Vaccinia virus
uuagacgacguauuauaca

SEQ ID NO: 4059305 - RNA, 14 nt, Vaccinia virus
uuagagaaaaacaa

SEQ ID NO: 4059306 - RNA, 20 nt, Vaccinia virus
uuagauauauagaauuagua

SEQ ID NO: 4059307 - RNA, 19 nt, Vaccinia virus
uuagauaugugauuuacag

SEQ ID NO: 4059308 - RNA, 13 nt, Vaccinia virus
uuagaucauuaac

SEQ ID NO: 4059309 - RNA, 24 nt, Vaccinia virus
uuagaucugauacaccuguaauca

SEQ ID NO: 4059310 - RNA, 16 nt, Vaccinia virus
uuagccguuguuugag

SEQ ID NO: 4059311 - RNA, 22 nt, Vaccinia virus
uuaguaaaaaauuuauuucuaa

SEQ ID NO: 4059312 - RNA, 20 nt, Vaccinia virus
uuaguacccacgucuuuuca

SEQ ID NO: 4059313 - RNA, 14 nt, Vaccinia virus
uuagucauugcaau

SEQ ID NO: 4059314 - RNA, 15 nt, Vaccinia virus
uuagucuuacacauu

SEQ ID NO: 4059315 - RNA, 14 nt, Vaccinia virus
uuagugaaacauuc

SEQ ID NO: 4059316 - RNA, 16 nt, Vaccinia virus
uuagugaaaucuuuaa

SEQ ID NO: 4059317 - RNA, 16 nt, Vaccinia virus
uuaguucuuuuagaaa

SEQ ID NO: 4059318 - RNA, 15 nt, Vaccinia virus
uuaguugucuaguau

SEQ ID NO: 4059319 - RNA, 23 nt, Vaccinia virus
uuaguuucuauaucuacaucuau

SEQ ID NO: 4059320 - RNA, 16 nt, Vaccinia virus
uuaguuuuuggauaga

SEQ ID NO: 4059321 - RNA, 13 nt, Vaccinia virus
uuauaaaaacuuu

SEQ ID NO: 4059322 - RNA, 12 nt, Vaccinia virus
uuauaacuaaac

SEQ ID NO: 4059323 - RNA, 12 nt, Vaccinia virus
uuauaacuaaca

SEQ ID NO: 4059324 - RNA, 18 nt, Vaccinia virus
uuauacaggucauuacau

SEQ ID NO: 4059325 - RNA, 23 nt, Vaccinia virus
uuauacauguuccagaugucaua

SEQ ID NO: 4059326 - RNA, 18 nt, Vaccinia virus
uuauacgguucugucauu

SEQ ID NO: 4059327 - RNA, 16 nt, Vaccinia virus
uuauacuaauaugaca

SEQ ID NO: 4059328 - RNA, 19 nt, Vaccinia virus
uuauagacaaauuauucau

SEQ ID NO: 4059329 - RNA, 15 nt, Vaccinia virus
uuauagaguguggua

SEQ ID NO: 4059330 - RNA, 23 nt, Vaccinia virus
uuauagcguacaauacauguaca

SEQ ID NO: 4059331 - RNA, 15 nt, Vaccinia virus
uuauauaaauauguu

SEQ ID NO: 4059332 - RNA, 21 nt, Vaccinia virus
uuauauacgaaauauuauaca

SEQ ID NO: 4059333 - RNA, 12 nt, Vaccinia virus
uuauauauguaa

SEQ ID NO: 4059334 - RNA, 12 nt, Vaccinia virus
uuauaucuuuuu

SEQ ID NO: 4059335 - RNA, 21 nt, Vaccinia virus
uuauauggaacacgauuauua

SEQ ID NO: 4059336 - RNA, 19 nt, Vaccinia virus
uuauauugaugaugucgaa

SEQ ID NO: 4059337 - RNA, 16 nt, Vaccinia virus
uuaucaaaucuuuaau

SEQ ID NO: 4059338 - RNA, 19 nt, Vaccinia virus
uuaucaaguguauuaguca

SEQ ID NO: 4059339 - RNA, 14 nt, Vaccinia virus
uuaucacaauauag

SEQ ID NO: 4059340 - RNA, 13 nt, Vaccinia virus
uuaucauacuguc

SEQ ID NO: 4059341 - RNA, 18 nt, Vaccinia virus
uuaucaucauccauuaau

SEQ ID NO: 4059342 - RNA, 13 nt, Vaccinia virus
uuaucaucauuau

SEQ ID NO: 4059343 - RNA, 16 nt, Vaccinia virus
uuaucaucuaaucauc

SEQ ID NO: 4059344 - RNA, 13 nt, Vaccinia virus
uuaucauuuucca

SEQ ID NO: 4059345 - RNA, 16 nt, Vaccinia virus
uuauccacuucacauu

SEQ ID NO: 4059346 - RNA, 17 nt, Vaccinia virus
uuauccauuuauacauu

SEQ ID NO: 4059347 - RNA, 20 nt, Vaccinia virus
uuauccguauuuccauaaua

SEQ ID NO: 4059348 - RNA, 22 nt, Vaccinia virus
uuauccuuuagaugaauuauua

SEQ ID NO: 4059349 - RNA, 22 nt, Vaccinia virus
uuaucgaaugauauauuuuuca

SEQ ID NO: 4059350 - RNA, 17 nt, Vaccinia virus
uuaucguuuucaucuuu

SEQ ID NO: 4059351 - RNA, 14 nt, Vaccinia virus
uuaucuaaugaaug

SEQ ID NO: 4059352 - RNA, 20 nt, Vaccinia virus
uuaucuucauagaauacuaa

SEQ ID NO: 4059353 - RNA, 21 nt, Vaccinia virus
uuaucuuuuuagacacguaua

SEQ ID NO: 4059354 - RNA, 23 nt, Vaccinia virus
uuaugauauaaggaaacagcuuu

SEQ ID NO: 4059355 - RNA, 20 nt, Vaccinia virus
uuauggaucuauucaagaug

SEQ ID NO: 4059356 - RNA, 15 nt, Vaccinia virus
uuauguaaaacauuu

SEQ ID NO: 4059357 - RNA, 19 nt, Vaccinia virus
uuaugucauaaacuguaaa

SEQ ID NO: 4059358 - RNA, 20 nt, Vaccinia virus
uuauuaaauauuuuuggaca

SEQ ID NO: 4059359 - RNA, 11 nt, Vaccinia virus
uuauuaacauc

SEQ ID NO: 4059360 - RNA, 15 nt, Vaccinia virus
uuauuacuuuuggaa

SEQ ID NO: 4059361 - RNA, 16 nt, Vaccinia virus
uuauuagaauaagagu

SEQ ID NO: 4059362 - RNA, 15 nt, Vaccinia virus
uuauuagauuuggua

SEQ ID NO: 4059363 - RNA, 17 nt, Vaccinia virus
uuauucauauucuuaaa

SEQ ID NO: 4059364 - RNA, 23 nt, Vaccinia virus
uuauuccaaucauugauaucuuu

SEQ ID NO: 4059365 - RNA, 14 nt, Vaccinia virus
uuauuccacauaag

SEQ ID NO: 4059366 - RNA, 18 nt, Vaccinia virus
uuauuccaucaugucaac

SEQ ID NO: 4059367 - RNA, 18 nt, Vaccinia virus
uuauucuauuuuacuaaa

SEQ ID NO: 4059368 - RNA, 15 nt, Vaccinia virus
uuauucucuacgagu

SEQ ID NO: 4059369 - RNA, 12 nt, Vaccinia virus
uuauucucuuaa

SEQ ID NO: 4059370 - RNA, 19 nt, Vaccinia virus
uuauucuguucuauucaaa

SEQ ID NO: 4059371 - RNA, 22 nt, Vaccinia virus
uuauugcuagccucaucuucua

SEQ ID NO: 4059372 - RNA, 21 nt, Vaccinia virus
uuauugggccaguauacuguu

SEQ ID NO: 4059373 - RNA, 23 nt, Vaccinia virus
uuauugggugguaaacuagauaa

SEQ ID NO: 4059374 - RNA, 22 nt, Vaccinia virus
uuauuggugcuucguacauaag

SEQ ID NO: 4059375 - RNA, 18 nt, Vaccinia virus
uuauugucgagcauauua

SEQ ID NO: 4059376 - RNA, 12 nt, Vaccinia virus
uuauuucugaau

SEQ ID NO: 4059377 - RNA, 23 nt, Vaccinia virus
uuauuuuaaaccuaaagauguua

SEQ ID NO: 4059378 - RNA, 22 nt, Vaccinia virus
uuauuuuaggaucauauuuaca

SEQ ID NO: 4059379 - RNA, 19 nt, Vaccinia virus
uuauuuucuucuacguaca

SEQ ID NO: 4059380 - RNA, 14 nt, Vaccinia virus
uuauuuuuggaaga

SEQ ID NO: 4059381 - RNA, 15 nt, Vaccinia virus
uucaaaaauuuagaa

SEQ ID NO: 4059382 - RNA, 13 nt, Vaccinia virus
uucaaaauuauuu

SEQ ID NO: 4059383 - RNA, 22 nt, Vaccinia virus
uucaacaaguaggauuuuucca

SEQ ID NO: 4059384 - RNA, 17 nt, Vaccinia virus
uucaacaugauuauucu

SEQ ID NO: 4059385 - RNA, 22 nt, Vaccinia virus
uucaacauuuuauggaaacuau

SEQ ID NO: 4059386 - RNA, 15 nt, Vaccinia virus
uucaauauacuaguu

SEQ ID NO: 4059387 - RNA, 13 nt, Vaccinia virus
uucaauauugaaa

SEQ ID NO: 4059388 - RNA, 20 nt, Vaccinia virus
uucaaugucucuuuuucaga

SEQ ID NO: 4059389 - RNA, 19 nt, Vaccinia virus
uucacaugauguagugaua

SEQ ID NO: 4059390 - RNA, 16 nt, Vaccinia virus
uucacauugaaacuau

SEQ ID NO: 4059391 - RNA, 18 nt, Vaccinia virus
uucacauugaaacuaugu

SEQ ID NO: 4059392 - RNA, 18 nt, Vaccinia virus
uucaccaaacaacuuuua

SEQ ID NO: 4059393 - RNA, 22 nt, Vaccinia virus
uucacgaaaaaugaugaaggca

SEQ ID NO: 4059394 - RNA, 21 nt, Vaccinia virus
uucagaaagacgaauacauau

SEQ ID NO: 4059395 - RNA, 14 nt, Vaccinia virus
uucagaaauuauuc

SEQ ID NO: 4059396 - RNA, 21 nt, Vaccinia virus
uucagaauacaaucuguauuu

SEQ ID NO: 4059397 - RNA, 22 nt, Vaccinia virus
uucagauauaaaaaucuguuuu

SEQ ID NO: 4059398 - RNA, 17 nt, Vaccinia virus
uucaggaacauaaacaa

SEQ ID NO: 4059399 - RNA, 17 nt, Vaccinia virus
uucagucagacaauguc

SEQ ID NO: 4059400 - RNA, 16 nt, Vaccinia virus
uucauaaaguugcugg

SEQ ID NO: 4059401 - RNA, 20 nt, Vaccinia virus
uucauaacgcauaauuauua

SEQ ID NO: 4059402 - RNA, 22 nt, Vaccinia virus
uucauaauuguuagcuguuuuc

SEQ ID NO: 4059403 - RNA, 21 nt, Vaccinia virus
uucauauuuuaccaacucuuu

SEQ ID NO: 4059404 - RNA, 18 nt, Vaccinia virus
uucauauuuuaguuuuua

SEQ ID NO: 4059405 - RNA, 16 nt, Vaccinia virus
uucaucagauuauuua

SEQ ID NO: 4059406 - RNA, 20 nt, Vaccinia virus
uucaucauccaccuguuuua

SEQ ID NO: 4059407 - RNA, 14 nt, Vaccinia virus
uucaucauccauga

SEQ ID NO: 4059408 - RNA, 14 nt, Vaccinia virus
uucaucuuggauga

SEQ ID NO: 4059409 - RNA, 12 nt, Vaccinia virus
uucauuaauuuu

SEQ ID NO: 4059410 - RNA, 15 nt, Vaccinia virus
uucauuacuacugua

SEQ ID NO: 4059411 - RNA, 15 nt, Vaccinia virus
uucauuacuauauau

SEQ ID NO: 4059412 - RNA, 15 nt, Vaccinia virus
uucauuacuaucuuu

SEQ ID NO: 4059413 - RNA, 18 nt, Vaccinia virus
uucauuagauaacagugu

SEQ ID NO: 4059414 - RNA, 15 nt, Vaccinia virus
uuccaacucugucuu

SEQ ID NO: 4059415 - RNA, 14 nt, Vaccinia virus
uuccaagaaacuaa

SEQ ID NO: 4059416 - RNA, 21 nt, Vaccinia virus
uuccaauuccguagguaaacg

SEQ ID NO: 4059417 - RNA, 14 nt, Vaccinia virus
uuccacaauacgag

SEQ ID NO: 4059418 - RNA, 17 nt, Vaccinia virus
uuccaccgacucauuau

SEQ ID NO: 4059419 - RNA, 22 nt, Vaccinia virus
uuccaggaucuagauaauuaau

SEQ ID NO: 4059420 - RNA, 17 nt, Vaccinia virus
uuccaugcuacuaguau

SEQ ID NO: 4059421 - RNA, 13 nt, Vaccinia virus
uuccauuauuaau

SEQ ID NO: 4059422 - RNA, 17 nt, Vaccinia virus
uuccauugauaaagaag

SEQ ID NO: 4059423 - RNA, 19 nt, Vaccinia virus
uuccauuggccucauuaac

SEQ ID NO: 4059424 - RNA, 15 nt, Vaccinia virus
uuccauuuuuaauuu

SEQ ID NO: 4059425 - RNA, 17 nt, Vaccinia virus
uucccaaacauacaucu

SEQ ID NO: 4059426 - RNA, 14 nt, Vaccinia virus
uucccaaauaauca

SEQ ID NO: 4059427 - RNA, 15 nt, Vaccinia virus
uucccaaauaguuuu

SEQ ID NO: 4059428 - RNA, 14 nt, Vaccinia virus
uucccauucuaaug

SEQ ID NO: 4059429 - RNA, 21 nt, Vaccinia virus
uucccugauuaguauuuucua

SEQ ID NO: 4059430 - RNA, 19 nt, Vaccinia virus
uuccgaaguaguagucuuu

SEQ ID NO: 4059431 - RNA, 12 nt, Vaccinia virus
uuccucauuaag

SEQ ID NO: 4059432 - RNA, 13 nt, Vaccinia virus
uuccuccauaauu

SEQ ID NO: 4059433 - RNA, 13 nt, Vaccinia virus
uuccuuccaauga

SEQ ID NO: 4059434 - RNA, 21 nt, Vaccinia virus
uuccuuuacgugauaaaucau

SEQ ID NO: 4059435 - RNA, 13 nt, Vaccinia virus
uucgaagauauca

SEQ ID NO: 4059436 - RNA, 17 nt, Vaccinia virus
uucgaguuuaucaaaac

SEQ ID NO: 4059437 - RNA, 22 nt, Vaccinia virus
uucgaugccggacaauagcaca

SEQ ID NO: 4059438 - RNA, 13 nt, Vaccinia virus
uucgcaucguauu

SEQ ID NO: 4059439 - RNA, 17 nt, Vaccinia virus
uucgcuaaaaaauuagu

SEQ ID NO: 4059440 - RNA, 14 nt, Vaccinia virus
uucguaaaauguag

SEQ ID NO: 4059441 - RNA, 23 nt, Vaccinia virus
uucguaacuggcggauuauucau

SEQ ID NO: 4059442 - RNA, 16 nt, Vaccinia virus
uucgucgaauaaugua

SEQ ID NO: 4059443 - RNA, 12 nt, Vaccinia virus
uucguguuugac

SEQ ID NO: 4059444 - RNA, 20 nt, Vaccinia virus
uucuaaaaaaauauuaacga

SEQ ID NO: 4059445 - RNA, 19 nt, Vaccinia virus
uucuaaaaugguaaacuuu

SEQ ID NO: 4059446 - RNA, 21 nt, Vaccinia virus
uucuaagaaaucuauaauauc

SEQ ID NO: 4059447 - RNA, 15 nt, Vaccinia virus
uucuaaguucuaaug

SEQ ID NO: 4059448 - RNA, 21 nt, Vaccinia virus
uucuacagugauaguuucauu

SEQ ID NO: 4059449 - RNA, 22 nt, Vaccinia virus
uucuacuaugcacauuauucua

SEQ ID NO: 4059450 - RNA, 14 nt, Vaccinia virus
uucuagucuagaaa

SEQ ID NO: 4059451 - RNA, 15 nt, Vaccinia virus
uucuauacauagaug

SEQ ID NO: 4059452 - RNA, 17 nt, Vaccinia virus
uucuauacguuucuauu

SEQ ID NO: 4059453 - RNA, 18 nt, Vaccinia virus
uucuauauagcuauucuu

SEQ ID NO: 4059454 - RNA, 19 nt, Vaccinia virus
uucuaucaucauaaucagu

SEQ ID NO: 4059455 - RNA, 18 nt, Vaccinia virus
uucuaucgauaauugucu

SEQ ID NO: 4059456 - RNA, 19 nt, Vaccinia virus
uucuaugcuauaaaugaau

SEQ ID NO: 4059457 - RNA, 13 nt, Vaccinia virus
uucuauuauuauu

SEQ ID NO: 4059458 - RNA, 20 nt, Vaccinia virus
uucucaaaagaucaaggaaa

SEQ ID NO: 4059459 - RNA, 11 nt, Vaccinia virus
uucucauuaaa

SEQ ID NO: 4059460 - RNA, 19 nt, Vaccinia virus
uucucauugcuuauauuuu

SEQ ID NO: 4059461 - RNA, 16 nt, Vaccinia virus
uucuccaauacuaauu

SEQ ID NO: 4059462 - RNA, 23 nt, Vaccinia virus
uucuccaugaauuaauacauauu

SEQ ID NO: 4059463 - RNA, 22 nt, Vaccinia virus
uucucucauaaauacagagaug

SEQ ID NO: 4059464 - RNA, 20 nt, Vaccinia virus
uucucucaucuaucaaaagu

SEQ ID NO: 4059465 - RNA, 15 nt, Vaccinia virus
uucugauuuuaucuu

SEQ ID NO: 4059466 - RNA, 13 nt, Vaccinia virus
uucugcaauaucu

SEQ ID NO: 4059467 - RNA, 22 nt, Vaccinia virus
uucuggaaguggauauacauag

SEQ ID NO: 4059468 - RNA, 14 nt, Vaccinia virus
uucuggauuauuuu

SEQ ID NO: 4059469 - RNA, 21 nt, Vaccinia virus
uucuuagcgaaugaugcagac

SEQ ID NO: 4059470 - RNA, 20 nt, Vaccinia virus
uucuuauugagagacgucau

SEQ ID NO: 4059471 - RNA, 12 nt, Vaccinia virus
uucuuuauucuc

SEQ ID NO: 4059472 - RNA, 12 nt, Vaccinia virus
uucuuucaaaau

SEQ ID NO: 4059473 - RNA, 14 nt, Vaccinia virus
uugaaaauuauuuu

SEQ ID NO: 4059474 - RNA, 19 nt, Vaccinia virus
uugaaacuaggauacauaa

SEQ ID NO: 4059475 - RNA, 19 nt, Vaccinia virus
uugaauaggaguuugaaua

SEQ ID NO: 4059476 - RNA, 14 nt, Vaccinia virus
uugacaaauuauuc

SEQ ID NO: 4059477 - RNA, 15 nt, Vaccinia virus
uugacaaauuauucu

SEQ ID NO: 4059478 - RNA, 15 nt, Vaccinia virus
uugacaucuauauau

SEQ ID NO: 4059479 - RNA, 21 nt, Vaccinia virus
uugacauuaaucuauuagaau

SEQ ID NO: 4059480 - RNA, 19 nt, Vaccinia virus
uugaccucucagaaucagu

SEQ ID NO: 4059481 - RNA, 14 nt, Vaccinia virus
uugacgacguguac

SEQ ID NO: 4059482 - RNA, 16 nt, Vaccinia virus
uugacuaaaucuuaau

SEQ ID NO: 4059483 - RNA, 20 nt, Vaccinia virus
uugagaugucucauuagaau

SEQ ID NO: 4059484 - RNA, 21 nt, Vaccinia virus
uugagcuaauuuuuguaaaua

SEQ ID NO: 4059485 - RNA, 18 nt, Vaccinia virus
uugagguaaucuucuuug

SEQ ID NO: 4059486 - RNA, 17 nt, Vaccinia virus
uugauaaagauagauga

SEQ ID NO: 4059487 - RNA, 21 nt, Vaccinia virus
uugauaagacacgguagauca

SEQ ID NO: 4059488 - RNA, 15 nt, Vaccinia virus
uugauaauauuauua

SEQ ID NO: 4059489 - RNA, 17 nt, Vaccinia virus
uugauacauacauuaau

SEQ ID NO: 4059490 - RNA, 16 nt, Vaccinia virus
uugauacggcuauucu

SEQ ID NO: 4059491 - RNA, 21 nt, Vaccinia virus
aaaccaacgaggaggaauauc

SEQ ID NO: 4059492 - RNA, 19 nt, Vaccinia virus
aaaccauuuuucagaaagu

SEQ ID NO: 4059493 - RNA, 22 nt, Vaccinia virus
aaaccuuugacuaguuguagaa

SEQ ID NO: 4059494 - RNA, 15 nt, Vaccinia virus
aaacgaaaacuauau

SEQ ID NO: 4059495 - RNA, 15 nt, Vaccinia virus
aaacgaauuacugaa

SEQ ID NO: 4059496 - RNA, 14 nt, Vaccinia virus
aaacgacauacugu

SEQ ID NO: 4059497 - RNA, 18 nt, Vaccinia virus
aaacgauauucuugaaau

SEQ ID NO: 4059498 - RNA, 18 nt, Vaccinia virus
aaacgauguacugaagau

SEQ ID NO: 4059499 - RNA, 15 nt, Vaccinia virus
aaacgcguacauaac

SEQ ID NO: 4059500 - RNA, 21 nt, Vaccinia virus
aaacguauauagaugucaaug

SEQ ID NO: 4059501 - RNA, 19 nt, Vaccinia virus
aaacguggauaaaaugcau

SEQ ID NO: 4059502 - RNA, 16 nt, Vaccinia virus
aaacguuuagagauua

SEQ ID NO: 4059503 - RNA, 13 nt, Vaccinia virus
aaacuaaauaacg

SEQ ID NO: 4059504 - RNA, 13 nt, Vaccinia virus
aaacuagauacaa

SEQ ID NO: 4059505 - RNA, 19 nt, Vaccinia virus
aaacuauaauuuugugaaa

SEQ ID NO: 4059506 - RNA, 12 nt, Vaccinia virus
aaacuaucugau

SEQ ID NO: 4059507 - RNA, 16 nt, Vaccinia virus
aaacuauuuaguuaug

SEQ ID NO: 4059508 - RNA, 21 nt, Vaccinia virus
aaacucguacuaaucucuucu

SEQ ID NO: 4059509 - RNA, 19 nt, Vaccinia virus
aaacucuauuuuaaaauua

SEQ ID NO: 4059510 - RNA, 18 nt, Vaccinia virus
aaacucucuauuucuuaa

SEQ ID NO: 4059511 - RNA, 22 nt, Vaccinia virus
aaacucuuuagcgguauaauua

SEQ ID NO: 4059512 - RNA, 22 nt, Vaccinia virus
aaacugauuuuagcagaauaua

SEQ ID NO: 4059513 - RNA, 17 nt, Vaccinia virus
aaacugcaaauguagua

SEQ ID NO: 4059514 - RNA, 18 nt, Vaccinia virus
aaacuguuuaauauugca

SEQ ID NO: 4059515 - RNA, 18 nt, Vaccinia virus
aaacuuauuuagaauauc

SEQ ID NO: 4059516 - RNA, 17 nt, Vaccinia virus
aaacuuccguuuaaaaa

SEQ ID NO: 4059517 - RNA, 20 nt, Vaccinia virus
aaacuuccucauuaagauug

SEQ ID NO: 4059518 - RNA, 15 nt, Vaccinia virus
aaacuuuauuaucca

SEQ ID NO: 4059519 - RNA, 14 nt, Vaccinia virus
aaacuuuuagaaau

SEQ ID NO: 4059520 - RNA, 14 nt, Vaccinia virus
aaacuuuuuagaaa

SEQ ID NO: 4059521 - RNA, 15 nt, Vaccinia virus
aaacuuuuuagaaau

SEQ ID NO: 4059522 - RNA, 17 nt, Vaccinia virus
aaacuuuuuagaauauc

SEQ ID NO: 4059523 - RNA, 17 nt, Vaccinia virus
aaagaacggagaauugu

SEQ ID NO: 4059524 - RNA, 15 nt, Vaccinia virus
aaagaaguagcuaau

SEQ ID NO: 4059525 - RNA, 15 nt, Vaccinia virus
aaagaaguccauuua

SEQ ID NO: 4059526 - RNA, 15 nt, Vaccinia virus
aaagaaguuauagaa

SEQ ID NO: 4059527 - RNA, 17 nt, Vaccinia virus
aaagaauaauccuauau

SEQ ID NO: 4059528 - RNA, 13 nt, Vaccinia virus
aaagaauuuggaa

SEQ ID NO: 4059529 - RNA, 14 nt, Vaccinia virus
aaagacuucuuucu

SEQ ID NO: 4059530 - RNA, 15 nt, Vaccinia virus
aaagauauuccaaga

SEQ ID NO: 4059531 - RNA, 13 nt, Vaccinia virus
aaagaugauauau

SEQ ID NO: 4059532 - RNA, 12 nt, Vaccinia virus
aaagcauauucc

SEQ ID NO: 4059533 - RNA, 16 nt, Vaccinia virus
aaagcgcuauagagua

SEQ ID NO: 4059534 - RNA, 18 nt, Vaccinia virus
aaaggacaggaauauuua

SEQ ID NO: 4059535 - RNA, 14 nt, Vaccinia virus
aaagguaagaguua

SEQ ID NO: 4059536 - RNA, 13 nt, Vaccinia virus
aaagguucuauca

SEQ ID NO: 4059537 - RNA, 19 nt, Vaccinia virus
aaaguaauauucauaugua

SEQ ID NO: 4059538 - RNA, 22 nt, Vaccinia virus
aaaguagaugguauuucugaaa

SEQ ID NO: 4059539 - RNA, 16 nt, Vaccinia virus
aaaguauacauguuag

SEQ ID NO: 4059540 - RNA, 17 nt, Vaccinia virus
aaaguauucuuauguau

SEQ ID NO: 4059541 - RNA, 17 nt, Vaccinia virus
aaaguauuuuaauacau

SEQ ID NO: 4059542 - RNA, 14 nt, Vaccinia virus
aaagugaaaaucua

SEQ ID NO: 4059543 - RNA, 14 nt, Vaccinia virus
aaaguuaagaauua

SEQ ID NO: 4059544 - RNA, 16 nt, Vaccinia virus
aaaguuaauauuuucu

SEQ ID NO: 4059545 - RNA, 19 nt, Vaccinia virus
aaaguuacaacuggucaua

SEQ ID NO: 4059546 - RNA, 17 nt, Vaccinia virus
aaaguucauaaucucau

SEQ ID NO: 4059547 - RNA, 20 nt, Vaccinia virus
aaauaaaaagguagauguuc

SEQ ID NO: 4059548 - RNA, 15 nt, Vaccinia virus
aaauaaaauaaugau

SEQ ID NO: 4059549 - RNA, 16 nt, Vaccinia virus
aaauaaaauacauuua

SEQ ID NO: 4059550 - RNA, 17 nt, Vaccinia virus
aaauaaacauaacauau

SEQ ID NO: 4059551 - RNA, 12 nt, Vaccinia virus
aaauaaaguuau

SEQ ID NO: 4059552 - RNA, 13 nt, Vaccinia virus
aaauaagagacuu

SEQ ID NO: 4059553 - RNA, 18 nt, Vaccinia virus
aaauaauccugaauauau

SEQ ID NO: 4059554 - RNA, 17 nt, Vaccinia virus
aaauaaucggagaaugu

SEQ ID NO: 4059555 - RNA, 15 nt, Vaccinia virus
aaauaauuagaacua

SEQ ID NO: 4059556 - RNA, 13 nt, Vaccinia virus
aaauacauaaaga

SEQ ID NO: 4059557 - RNA, 21 nt, Vaccinia virus
aaauacauaugacaaacauug

SEQ ID NO: 4059558 - RNA, 15 nt, Vaccinia virus
aaauacgaacuuuau

SEQ ID NO: 4059559 - RNA, 18 nt, Vaccinia virus
aaauacugacacaaacaa

SEQ ID NO: 4059560 - RNA, 13 nt, Vaccinia virus
aaauagauguuag

SEQ ID NO: 4059561 - RNA, 21 nt, Vaccinia virus
aaauagcgauugguguuguaa

SEQ ID NO: 4059562 - RNA, 20 nt, Vaccinia virus
aaauagcguucgucaacaua

SEQ ID NO: 4059563 - RNA, 19 nt, Vaccinia virus
aaauauaaaaccaacuaau

SEQ ID NO: 4059564 - RNA, 18 nt, Vaccinia virus
aaauauaauuuauaauau

SEQ ID NO: 4059565 - RNA, 20 nt, Vaccinia virus
aaauauagguuacuagauua

SEQ ID NO: 4059566 - RNA, 14 nt, Vaccinia virus
aaauauauacuuca

SEQ ID NO: 4059567 - RNA, 17 nt, Vaccinia virus
aaauauauuuucauuua

SEQ ID NO: 4059568 - RNA, 12 nt, Vaccinia virus
aaauaucucauc

SEQ ID NO: 4059569 - RNA, 17 nt, Vaccinia virus
aaauauggaagcgaaug

SEQ ID NO: 4059570 - RNA, 15 nt, Vaccinia virus
aaauauguacauuau

SEQ ID NO: 4059571 - RNA, 19 nt, Vaccinia virus
aaauauuaucgauauugaa

SEQ ID NO: 4059572 - RNA, 17 nt, Vaccinia virus
aaauauucauaacuaau

SEQ ID NO: 4059573 - RNA, 15 nt, Vaccinia virus
aaauauucuacauau

SEQ ID NO: 4059574 - RNA, 16 nt, Vaccinia virus
aaauauuuaacucaug

SEQ ID NO: 4059575 - RNA, 14 nt, Vaccinia virus
aaauauuuacuaau

SEQ ID NO: 4059576 - RNA, 12 nt, Vaccinia virus
aaauauuucauu

SEQ ID NO: 4059577 - RNA, 22 nt, Vaccinia virus
aaauauuucuacuacuucauua

SEQ ID NO: 4059578 - RNA, 13 nt, Vaccinia virus
aaauauuugugua

SEQ ID NO: 4059579 - RNA, 23 nt, Vaccinia virus
aaaucaaacggauugguaacauu

SEQ ID NO: 4059580 - RNA, 17 nt, Vaccinia virus
aaaucaaccaccgauga

SEQ ID NO: 4059581 - RNA, 13 nt, Vaccinia virus
aaaucaacucaua

SEQ ID NO: 4059582 - RNA, 21 nt, Vaccinia virus
aaaucaaucaaggaacuaaau

SEQ ID NO: 4059583 - RNA, 19 nt, Vaccinia virus
aaaucagaauguuacagca

SEQ ID NO: 4059584 - RNA, 17 nt, Vaccinia virus
aaaucaggaaaaaagau

SEQ ID NO: 4059585 - RNA, 16 nt, Vaccinia virus
aaaucaguaacuaugu

SEQ ID NO: 4059586 - RNA, 20 nt, Vaccinia virus
aaaucauuacuaauacucaa

SEQ ID NO: 4059587 - RNA, 17 nt, Vaccinia virus
aaauccaaguuucuauu

SEQ ID NO: 4059588 - RNA, 15 nt, Vaccinia virus
aaauccaauagugaa

SEQ ID NO: 4059589 - RNA, 20 nt, Vaccinia virus
aaauccaugcaaaaaaaugu

SEQ ID NO: 4059590 - RNA, 20 nt, Vaccinia virus
aaaucuaguaucguaucauu

SEQ ID NO: 4059591 - RNA, 19 nt, Vaccinia virus
aaaucuaguucugcauugu

SEQ ID NO: 4059592 - RNA, 16 nt, Vaccinia virus
aaaucuaguuguggaa

SEQ ID NO: 4059593 - RNA, 17 nt, Vaccinia virus
aaaucuauauuguuuaa

SEQ ID NO: 4059594 - RNA, 22 nt, Vaccinia virus
aaaucuaucuuauauacacaua

SEQ ID NO: 4059595 - RNA, 19 nt, Vaccinia virus
aaaugaucggaucuaaaau

SEQ ID NO: 4059596 - RNA, 16 nt, Vaccinia virus
aaaugcgauacagaca

SEQ ID NO: 4059597 - RNA, 17 nt, Vaccinia virus
aaauggauuuauuggau

SEQ ID NO: 4059598 - RNA, 16 nt, Vaccinia virus
aaaugguuagauauua

SEQ ID NO: 4059599 - RNA, 15 nt, Vaccinia virus
aaauguaaauccaau

SEQ ID NO: 4059600 - RNA, 18 nt, Vaccinia virus
aaaugucaugauuaguau

SEQ ID NO: 4059601 - RNA, 22 nt, Vaccinia virus
aaaugucguggacacaacuauu

SEQ ID NO: 4059602 - RNA, 21 nt, Vaccinia virus
aaaugugucguaguuagcaag

SEQ ID NO: 4059603 - RNA, 23 nt, Vaccinia virus
aaauguuaauuuugaaacuaugu

SEQ ID NO: 4059604 - RNA, 21 nt, Vaccinia virus
aaauguuacugaagaauauau

SEQ ID NO: 4059605 - RNA, 18 nt, Vaccinia virus
aaauguucuuaacuacau

SEQ ID NO: 4059606 - RNA, 15 nt, Vaccinia virus
aaauguugucauuau

SEQ ID NO: 4059607 - RNA, 19 nt, Vaccinia virus
aaauuaaaggagcauguau

SEQ ID NO: 4059608 - RNA, 23 nt, Vaccinia virus
aaauuaacagauaaaaagacuuu

SEQ ID NO: 4059609 - RNA, 14 nt, Vaccinia virus
aaauuaauauuucu

SEQ ID NO: 4059610 - RNA, 14 nt, Vaccinia virus
aaauuaauuauugu

SEQ ID NO: 4059611 - RNA, 13 nt, Vaccinia virus
aaauuacuuaaag

SEQ ID NO: 4059612 - RNA, 15 nt, Vaccinia virus
aaauuagaaagauua

SEQ ID NO: 4059613 - RNA, 17 nt, Vaccinia virus
aaauuauaaaauuauau

SEQ ID NO: 4059614 - RNA, 21 nt, Vaccinia virus
aaauuauuuaauuuaauacau

SEQ ID NO: 4059615 - RNA, 18 nt, Vaccinia virus
aaauuauuuuuacuaaua

SEQ ID NO: 4059616 - RNA, 15 nt, Vaccinia virus
aauaagaauaaaaug

SEQ ID NO: 4059617 - RNA, 18 nt, Vaccinia virus
aauaagagacuuaaacaa

SEQ ID NO: 4059618 - RNA, 23 nt, Vaccinia virus
aauaagagcagcacaaacucauu

SEQ ID NO: 4059619 - RNA, 21 nt, Vaccinia virus
aauaauaucccacauuaucau

SEQ ID NO: 4059620 - RNA, 20 nt, Vaccinia virus
aauaaucauaaauuauuuca

SEQ ID NO: 4059621 - RNA, 14 nt, Vaccinia virus
aauaauguuauuau

SEQ ID NO: 4059622 - RNA, 14 nt, Vaccinia virus
aauaauuaaugccc

SEQ ID NO: 4059623 - RNA, 24 nt, Vaccinia virus
aauaauuacuuuacaaacgaugua

SEQ ID NO: 4059624 - RNA, 22 nt, Vaccinia virus
aauaauuauaucacaacaucua

SEQ ID NO: 4059625 - RNA, 15 nt, Vaccinia virus
aauaauuaugaugau

SEQ ID NO: 4059626 - RNA, 15 nt, Vaccinia virus
aauaauuauguagua

SEQ ID NO: 4059627 - RNA, 14 nt, Vaccinia virus
aauaauuauuagaa

SEQ ID NO: 4059628 - RNA, 15 nt, Vaccinia virus
aauaauucagauaau

SEQ ID NO: 4059629 - RNA, 23 nt, Vaccinia virus
aauaauucauggaaauuuaacag

SEQ ID NO: 4059630 - RNA, 23 nt, Vaccinia virus
aauacacuuagguuuuuggaaaa

SEQ ID NO: 4059631 - RNA, 11 nt, Vaccinia virus
aauacagaaug

SEQ ID NO: 4059632 - RNA, 23 nt, Vaccinia virus
aauacauauuauucaaaauauga

SEQ ID NO: 4059633 - RNA, 21 nt, Vaccinia virus
aauacauuucucaaaugaaua

SEQ ID NO: 4059634 - RNA, 21 nt, Vaccinia virus
aauaccauaaauauauuucua

SEQ ID NO: 4059635 - RNA, 16 nt, Vaccinia virus
aauaccucauaaaacg

SEQ ID NO: 4059636 - RNA, 16 nt, Vaccinia virus
aauaccucuacacuau

SEQ ID NO: 4059637 - RNA, 21 nt, Vaccinia virus
aauacgaaaacgauauuauua

SEQ ID NO: 4059638 - RNA, 16 nt, Vaccinia virus
aauacgaauuaugcaa

SEQ ID NO: 4059639 - RNA, 14 nt, Vaccinia virus
aauacguuagagaa

SEQ ID NO: 4059640 - RNA, 20 nt, Vaccinia virus
aauacuaaaaaauguagaaa

SEQ ID NO: 4059641 - RNA, 21 nt, Vaccinia virus
aauacuaaaaaauguagaaau

SEQ ID NO: 4059642 - RNA, 22 nt, Vaccinia virus
aauacuaauaggucuaaaaacc

SEQ ID NO: 4059643 - RNA, 21 nt, Vaccinia virus
aauacuaaugcaucuauuuca

SEQ ID NO: 4059644 - RNA, 19 nt, Vaccinia virus
aauacuauuacagaaguuu

SEQ ID NO: 4059645 - RNA, 18 nt, Vaccinia virus
aauacucaauacuuucca

SEQ ID NO: 4059646 - RNA, 20 nt, Vaccinia virus
aauacucaauccuucagaau

SEQ ID NO: 4059647 - RNA, 23 nt, Vaccinia virus
aauacuccucauuacguuucauu

SEQ ID NO: 4059648 - RNA, 18 nt, Vaccinia virus
aauacucuucaaaguuuc

SEQ ID NO: 4059649 - RNA, 16 nt, Vaccinia virus
aauacugaugcauuuu

SEQ ID NO: 4059650 - RNA, 13 nt, Vaccinia virus
aauacuuaaaaug

SEQ ID NO: 4059651 - RNA, 16 nt, Vaccinia virus
aauacuuaacagagga

SEQ ID NO: 4059652 - RNA, 19 nt, Vaccinia virus
aauacuuauuaauggcucu

SEQ ID NO: 4059653 - RNA, 14 nt, Vaccinia virus
aauacuuuaguaau

SEQ ID NO: 4059654 - RNA, 11 nt, Vaccinia virus
aauagaaucua

SEQ ID NO: 4059655 - RNA, 22 nt, Vaccinia virus
aauagacaaacuguaaguaugu

SEQ ID NO: 4059656 - RNA, 23 nt, Vaccinia virus
aauagacauaagaaauuugccaa

SEQ ID NO: 4059657 - RNA, 21 nt, Vaccinia virus
aauagaggagccauuaaaugu

SEQ ID NO: 4059658 - RNA, 17 nt, Vaccinia virus
aauagauaucaugaaga

SEQ ID NO: 4059659 - RNA, 18 nt, Vaccinia virus
aauagaucaacagaaaua

SEQ ID NO: 4059660 - RNA, 18 nt, Vaccinia virus
aauagaugauagaauauc

SEQ ID NO: 4059661 - RNA, 23 nt, Vaccinia virus
aauagcgcuuaaucucaaaauau

SEQ ID NO: 4059662 - RNA, 13 nt, Vaccinia virus
aauagcucaauau

SEQ ID NO: 4059663 - RNA, 16 nt, Vaccinia virus
aauaggaauggauaau

SEQ ID NO: 4059664 - RNA, 16 nt, Vaccinia virus
aauaggugaugaugca

SEQ ID NO: 4059665 - RNA, 17 nt, Vaccinia virus
aauaggugaugaugcaa

SEQ ID NO: 4059666 - RNA, 14 nt, Vaccinia virus
aauaguaaugauuc

SEQ ID NO: 4059667 - RNA, 22 nt, Vaccinia virus
aauaguauacgcagaaaagaua

SEQ ID NO: 4059668 - RNA, 22 nt, Vaccinia virus
aauaguucaacaucuacuuuug

SEQ ID NO: 4059669 - RNA, 12 nt, Vaccinia virus
aauaguuucaua

SEQ ID NO: 4059670 - RNA, 14 nt, Vaccinia virus
aauaguuucauaau

SEQ ID NO: 4059671 - RNA, 23 nt, Vaccinia virus
aauaguuuguuuuggaaauagau

SEQ ID NO: 4059672 - RNA, 21 nt, Vaccinia virus
aauaguuuugauauuaguaaa

SEQ ID NO: 4059673 - RNA, 20 nt, Vaccinia virus
aauaguuuuuuuguuuccuu

SEQ ID NO: 4059674 - RNA, 14 nt, Vaccinia virus
aauauaaaaauaua

SEQ ID NO: 4059675 - RNA, 18 nt, Vaccinia virus
aauauaaaagaauaugua

SEQ ID NO: 4059676 - RNA, 13 nt, Vaccinia virus
aauauaaauggua

SEQ ID NO: 4059677 - RNA, 15 nt, Vaccinia virus
aauauaauaaauaua

SEQ ID NO: 4059678 - RNA, 17 nt, Vaccinia virus
aauauacaauagaugca

SEQ ID NO: 4059679 - RNA, 17 nt, Vaccinia virus
aauauacgauuaguaau

SEQ ID NO: 4059680 - RNA, 17 nt, Vaccinia virus
aauauacugauuagaaa

SEQ ID NO: 4059681 - RNA, 19 nt, Vaccinia virus
aauauaucuauaauuugau

SEQ ID NO: 4059682 - RNA, 20 nt, Vaccinia virus
aauauaugcaaaauaauauc

SEQ ID NO: 4059683 - RNA, 15 nt, Vaccinia virus
aauauauuaagaaau

SEQ ID NO: 4059684 - RNA, 19 nt, Vaccinia virus
aauauauuauuaguuuaua

SEQ ID NO: 4059685 - RNA, 15 nt, Vaccinia virus
aauaucaacaagucc

SEQ ID NO: 4059686 - RNA, 18 nt, Vaccinia virus
aauaucaucuaaacagua

SEQ ID NO: 4059687 - RNA, 23 nt, Vaccinia virus
aauauccaaguauuuuaauucua

SEQ ID NO: 4059688 - RNA, 18 nt, Vaccinia virus
aauauccacucugucaua

SEQ ID NO: 4059689 - RNA, 17 nt, Vaccinia virus
aauauccucagucaucu

SEQ ID NO: 4059690 - RNA, 22 nt, Vaccinia virus
aauaucuauuaaacgaauaaaa

SEQ ID NO: 4059691 - RNA, 20 nt, Vaccinia virus
aauaucuuuaauacagaugg

SEQ ID NO: 4059692 - RNA, 17 nt, Vaccinia virus
aauaucuuuaauccaau

SEQ ID NO: 4059693 - RNA, 23 nt, Vaccinia virus
aauaugaguuggaguugauucau

SEQ ID NO: 4059694 - RNA, 21 nt, Vaccinia virus
aauaugcggaaccucgagaau

SEQ ID NO: 4059695 - RNA, 21 nt, Vaccinia virus
aauauggacacgcggcuguaa

SEQ ID NO: 4059696 - RNA, 15 nt, Vaccinia virus
aauauggauccucau

SEQ ID NO: 4059697 - RNA, 20 nt, Vaccinia virus
aauaugugcuaaaaucacug

SEQ ID NO: 4059698 - RNA, 15 nt, Vaccinia virus
aauaugugcucugcg

SEQ ID NO: 4059699 - RNA, 19 nt, Vaccinia virus
aauauuaauauuagaguua

SEQ ID NO: 4059700 - RNA, 22 nt, Vaccinia virus
aauauuacuaauugauagaccu

SEQ ID NO: 4059701 - RNA, 17 nt, Vaccinia virus
aauauuagguaaagaua

SEQ ID NO: 4059702 - RNA, 20 nt, Vaccinia virus
aauauucuaugacugaaugu

SEQ ID NO: 4059703 - RNA, 18 nt, Vaccinia virus
aauauugccauaauuuuc

SEQ ID NO: 4059704 - RNA, 15 nt, Vaccinia virus
aauauuguauuguuu

SEQ ID NO: 4059705 - RNA, 17 nt, Vaccinia virus
aauauuguuaucguaau

SEQ ID NO: 4059706 - RNA, 12 nt, Vaccinia virus
aauauuuaacuc

SEQ ID NO: 4059707 - RNA, 14 nt, Vaccinia virus
aauauuuucuauga

SEQ ID NO: 4059708 - RNA, 22 nt, Vaccinia virus
aauauuuuucuauguuaggaau

SEQ ID NO: 4059709 - RNA, 16 nt, Vaccinia virus
aauauuuuuuauaaaa

SEQ ID NO: 4059710 - RNA, 14 nt, Vaccinia virus
aaucaaacaaaaaa

SEQ ID NO: 4059711 - RNA, 14 nt, Vaccinia virus
aaucaaagaauugg

SEQ ID NO: 4059712 - RNA, 18 nt, Vaccinia virus
aaucaacucuaaucacuu

SEQ ID NO: 4059713 - RNA, 22 nt, Vaccinia virus
aaucaagauucauuuuuaaaau

SEQ ID NO: 4059714 - RNA, 12 nt, Vaccinia virus
aaucaauagcuu

SEQ ID NO: 4059715 - RNA, 16 nt, Vaccinia virus
aaucacuauagaaaau

SEQ ID NO: 4059716 - RNA, 17 nt, Vaccinia virus
aaucacuuuaacuuuua

SEQ ID NO: 4059717 - RNA, 13 nt, Vaccinia virus
aaucagaaaacuu

SEQ ID NO: 4059718 - RNA, 13 nt, Vaccinia virus
aaucagaaauugg

SEQ ID NO: 4059719 - RNA, 16 nt, Vaccinia virus
aaucauauuuagaaaa

SEQ ID NO: 4059720 - RNA, 22 nt, Vaccinia virus
aaucauuaaaaaaauuaacuga

SEQ ID NO: 4059721 - RNA, 17 nt, Vaccinia virus
aaucauuccucauaaga

SEQ ID NO: 4059722 - RNA, 13 nt, Vaccinia virus
aaucauugauaca

SEQ ID NO: 4059723 - RNA, 14 nt, Vaccinia virus
aaucauugauacau

SEQ ID NO: 4059724 - RNA, 17 nt, Vaccinia virus
aaucauuuuugcaucau

SEQ ID NO: 4059725 - RNA, 21 nt, Vaccinia virus
aauccaaaguucauucucaga

SEQ ID NO: 4059726 - RNA, 19 nt, Vaccinia virus
aauccaaauaaaauggaua

SEQ ID NO: 4059727 - RNA, 15 nt, Vaccinia virus
aauccaauugauuga

SEQ ID NO: 4059728 - RNA, 20 nt, Vaccinia virus
aauccaauugauugacuauc

SEQ ID NO: 4059729 - RNA, 15 nt, Vaccinia virus
aauccacauaugaua

SEQ ID NO: 4059730 - RNA, 21 nt, Vaccinia virus
aauccauaaauaaaguauaug

SEQ ID NO: 4059731 - RNA, 14 nt, Vaccinia virus
aauccauaccgucc

SEQ ID NO: 4059732 - RNA, 21 nt, Vaccinia virus
aauccaucucuauguuucagu

SEQ ID NO: 4059733 - RNA, 21 nt, Vaccinia virus
aauccauugauaauuucuugu

SEQ ID NO: 4059734 - RNA, 19 nt, Vaccinia virus
aauccuauacucugaaaga

SEQ ID NO: 4059735 - RNA, 13 nt, Vaccinia virus
aauccugaauaua

SEQ ID NO: 4059736 - RNA, 17 nt, Vaccinia virus
aauccuuuuuuauaaaa

SEQ ID NO: 4059737 - RNA, 17 nt, Vaccinia virus
aaucgcgcguuagaaau

SEQ ID NO: 4059738 - RNA, 14 nt, Vaccinia virus
aaucgcuuaauaga

SEQ ID NO: 4059739 - RNA, 19 nt, Vaccinia virus
auguauacauuuuccauuu

SEQ ID NO: 4059740 - RNA, 17 nt, Vaccinia virus
auguauaccauugacuc

SEQ ID NO: 4059741 - RNA, 13 nt, Vaccinia virus
auguauacuguau

SEQ ID NO: 4059742 - RNA, 17 nt, Vaccinia virus
auguauccacaucaaag

SEQ ID NO: 4059743 - RNA, 18 nt, Vaccinia virus
auguaugauucaauguau

SEQ ID NO: 4059744 - RNA, 20 nt, Vaccinia virus
auguaugcaauucacuguau

SEQ ID NO: 4059745 - RNA, 21 nt, Vaccinia virus
auguauuaacuuuguucauuu

SEQ ID NO: 4059746 - RNA, 22 nt, Vaccinia virus
auguauuauuauagauuuucca

SEQ ID NO: 4059747 - RNA, 19 nt, Vaccinia virus
auguauucagucagacaau

SEQ ID NO: 4059748 - RNA, 13 nt, Vaccinia virus
augucacuauuaa

SEQ ID NO: 4059749 - RNA, 11 nt, Vaccinia virus
augucauauag

SEQ ID NO: 4059750 - RNA, 13 nt, Vaccinia virus
augucauuuguau

SEQ ID NO: 4059751 - RNA, 13 nt, Vaccinia virus
auguccgaagaga

SEQ ID NO: 4059752 - RNA, 13 nt, Vaccinia virus
auguccuggugau

SEQ ID NO: 4059753 - RNA, 21 nt, Vaccinia virus
augucgagaaacagaacuauu

SEQ ID NO: 4059754 - RNA, 21 nt, Vaccinia virus
augucggucggcauucuauuu

SEQ ID NO: 4059755 - RNA, 13 nt, Vaccinia virus
augucuacauuau

SEQ ID NO: 4059756 - RNA, 16 nt, Vaccinia virus
augucuguagaaaaaa

SEQ ID NO: 4059757 - RNA, 12 nt, Vaccinia virus
augucuguuuga

SEQ ID NO: 4059758 - RNA, 20 nt, Vaccinia virus
augugaacagauaaaaggua

SEQ ID NO: 4059759 - RNA, 14 nt, Vaccinia virus
augugacuguuuuc

SEQ ID NO: 4059760 - RNA, 15 nt, Vaccinia virus
augugauaauuauuu

SEQ ID NO: 4059761 - RNA, 17 nt, Vaccinia virus
augugauucucugaaaa

SEQ ID NO: 4059762 - RNA, 18 nt, Vaccinia virus
augugcuaaaaaguuuuc

SEQ ID NO: 4059763 - RNA, 13 nt, Vaccinia virus
auguggaauuaug

SEQ ID NO: 4059764 - RNA, 21 nt, Vaccinia virus
auguggucuguuguauaugau

SEQ ID NO: 4059765 - RNA, 21 nt, Vaccinia virus
auguguuucccaaacaaaaug

SEQ ID NO: 4059766 - RNA, 20 nt, Vaccinia virus
auguuaaaacuacaaaaaug

SEQ ID NO: 4059767 - RNA, 22 nt, Vaccinia virus
auguuaaauguagacaaauaua

SEQ ID NO: 4059768 - RNA, 22 nt, Vaccinia virus
auguuaauaacaucagaaaaug

SEQ ID NO: 4059769 - RNA, 14 nt, Vaccinia virus
auguuacaaaugua

SEQ ID NO: 4059770 - RNA, 15 nt, Vaccinia virus
auguuagaacuguag

SEQ ID NO: 4059771 - RNA, 15 nt, Vaccinia virus
auguuauaaaaucua

SEQ ID NO: 4059772 - RNA, 14 nt, Vaccinia virus
auguuaucaaaccu

SEQ ID NO: 4059773 - RNA, 14 nt, Vaccinia virus
auguuauugucaca

SEQ ID NO: 4059774 - RNA, 19 nt, Vaccinia virus
auguuauugucacacuaau

SEQ ID NO: 4059775 - RNA, 16 nt, Vaccinia virus
auguuccaacucuguc

SEQ ID NO: 4059776 - RNA, 19 nt, Vaccinia virus
auguucgguauaaaaauua

SEQ ID NO: 4059777 - RNA, 18 nt, Vaccinia virus
auguugaacauaaaacua

SEQ ID NO: 4059778 - RNA, 16 nt, Vaccinia virus
auguugcaugaaauaa

SEQ ID NO: 4059779 - RNA, 16 nt, Vaccinia virus
auguuguuaaaauaua

SEQ ID NO: 4059780 - RNA, 23 nt, Vaccinia virus
auguuuauuuuuuucauauuaaa

SEQ ID NO: 4059781 - RNA, 17 nt, Vaccinia virus
auguuugggagaauuaa

SEQ ID NO: 4059782 - RNA, 15 nt, Vaccinia virus
auguuuguucagagg

SEQ ID NO: 4059783 - RNA, 14 nt, Vaccinia virus
auguuuuacucugg

SEQ ID NO: 4059784 - RNA, 13 nt, Vaccinia virus
auguuuucacaau

SEQ ID NO: 4059785 - RNA, 19 nt, Vaccinia virus
auuaaaaaacauauauaau

SEQ ID NO: 4059786 - RNA, 17 nt, Vaccinia virus
auuaaaaaauaacuuaa

SEQ ID NO: 4059787 - RNA, 16 nt, Vaccinia virus
auuaaaaauaaaauac

SEQ ID NO: 4059788 - RNA, 15 nt, Vaccinia virus
auuaaaaauaaaguu

SEQ ID NO: 4059789 - RNA, 13 nt, Vaccinia virus
auuaaacauaaau

SEQ ID NO: 4059790 - RNA, 16 nt, Vaccinia virus
auuaaacauuguucau

SEQ ID NO: 4059791 - RNA, 19 nt, Vaccinia virus
auuaaaccauguugugaaa

SEQ ID NO: 4059792 - RNA, 23 nt, Vaccinia virus
auuaaacguaguuaugauaaaug

SEQ ID NO: 4059793 - RNA, 18 nt, Vaccinia virus
auuaaacguauaaaaacg

SEQ ID NO: 4059794 - RNA, 12 nt, Vaccinia virus
auuaaacuaauu

SEQ ID NO: 4059795 - RNA, 20 nt, Vaccinia virus
auuaaacuaauucauuuuca

SEQ ID NO: 4059796 - RNA, 20 nt, Vaccinia virus
auuaaaucauuaaaugauug

SEQ ID NO: 4059797 - RNA, 17 nt, Vaccinia virus
auuaaauguuugaucaa

SEQ ID NO: 4059798 - RNA, 18 nt, Vaccinia virus
auuaacagauaaaaagac

SEQ ID NO: 4059799 - RNA, 22 nt, Vaccinia virus
auuaacuuccacauuaauacag

SEQ ID NO: 4059800 - RNA, 22 nt, Vaccinia virus
auuaagcaacaugucucuaaau

SEQ ID NO: 4059801 - RNA, 17 nt, Vaccinia virus
auuaagcauuuuggaaa

SEQ ID NO: 4059802 - RNA, 21 nt, Vaccinia virus
auuaauaaaaauacaauccuu

SEQ ID NO: 4059803 - RNA, 17 nt, Vaccinia virus
auuaauaauuaauaauu

SEQ ID NO: 4059804 - RNA, 15 nt, Vaccinia virus
auuaauacagacgau

SEQ ID NO: 4059805 - RNA, 19 nt, Vaccinia virus
auuaauaguuuuauuugaa

SEQ ID NO: 4059806 - RNA, 17 nt, Vaccinia virus
auuaauaucuauuaaac

SEQ ID NO: 4059807 - RNA, 23 nt, Vaccinia virus
auuaauauuacuguuaauaacug

SEQ ID NO: 4059808 - RNA, 12 nt, Vaccinia virus
auuaaucaaaug

SEQ ID NO: 4059809 - RNA, 15 nt, Vaccinia virus
auuaaucaagucaau

SEQ ID NO: 4059810 - RNA, 13 nt, Vaccinia virus
auuaaucauauac

SEQ ID NO: 4059811 - RNA, 18 nt, Vaccinia virus
auuaaugggcuuaguaaa

SEQ ID NO: 4059812 - RNA, 17 nt, Vaccinia virus
auuaauguaacuauaga

SEQ ID NO: 4059813 - RNA, 14 nt, Vaccinia virus
auuaauuguaaaug

SEQ ID NO: 4059814 - RNA, 18 nt, Vaccinia virus
auuaauuuccacaucgau

SEQ ID NO: 4059815 - RNA, 14 nt, Vaccinia virus
auuacaaaagaaac

SEQ ID NO: 4059816 - RNA, 12 nt, Vaccinia virus
auuacaaacaug

SEQ ID NO: 4059817 - RNA, 14 nt, Vaccinia virus
auuacaaaccuguc

SEQ ID NO: 4059818 - RNA, 19 nt, Vaccinia virus
auuacaaacuauagaaauu

SEQ ID NO: 4059819 - RNA, 15 nt, Vaccinia virus
auuacaaagaagaac

SEQ ID NO: 4059820 - RNA, 17 nt, Vaccinia virus
auuacaaauaaagcgga

SEQ ID NO: 4059821 - RNA, 23 nt, Vaccinia virus
auuacaaaucuagagguagaacu

SEQ ID NO: 4059822 - RNA, 18 nt, Vaccinia virus
auuacaaguauuauugau

SEQ ID NO: 4059823 - RNA, 22 nt, Vaccinia virus
auuacaaguuaagucacacuaa

SEQ ID NO: 4059824 - RNA, 14 nt, Vaccinia virus
auuacacaaauauu

SEQ ID NO: 4059825 - RNA, 16 nt, Vaccinia virus
auuacacauaaacauc

SEQ ID NO: 4059826 - RNA, 15 nt, Vaccinia virus
auuacacauuuccaa

SEQ ID NO: 4059827 - RNA, 19 nt, Vaccinia virus
auuacacgcuauuaaucau

SEQ ID NO: 4059828 - RNA, 19 nt, Vaccinia virus
auuacauccggcaaaaaua

SEQ ID NO: 4059829 - RNA, 21 nt, Vaccinia virus
auuacauuuuuuauaaauaga

SEQ ID NO: 4059830 - RNA, 20 nt, Vaccinia virus
auuaccagaagguguuguaa

SEQ ID NO: 4059831 - RNA, 22 nt, Vaccinia virus
auuaccaggguucuuguuauau

SEQ ID NO: 4059832 - RNA, 17 nt, Vaccinia virus
auuaccauagaagaugu

SEQ ID NO: 4059833 - RNA, 14 nt, Vaccinia virus
auuacccauggaga

SEQ ID NO: 4059834 - RNA, 23 nt, Vaccinia virus
auuacgaaucauuaaaaaaauua

SEQ ID NO: 4059835 - RNA, 15 nt, Vaccinia virus
auuacgcucuacaaa

SEQ ID NO: 4059836 - RNA, 21 nt, Vaccinia virus
auuacggcgaaauaaagaaaa

SEQ ID NO: 4059837 - RNA, 14 nt, Vaccinia virus
auuacuaaacauuu

SEQ ID NO: 4059838 - RNA, 17 nt, Vaccinia virus
auuacuaggagaauuau

SEQ ID NO: 4059839 - RNA, 13 nt, Vaccinia virus
auuacuauaaaug

SEQ ID NO: 4059840 - RNA, 21 nt, Vaccinia virus
auuacuauaaauggagaaugu

SEQ ID NO: 4059841 - RNA, 13 nt, Vaccinia virus
auuacuaugaauc

SEQ ID NO: 4059842 - RNA, 22 nt, Vaccinia virus
auuacuccagccguagaauauc

SEQ ID NO: 4059843 - RNA, 19 nt, Vaccinia virus
auuacuuuuucaaagaaaa

SEQ ID NO: 4059844 - RNA, 13 nt, Vaccinia virus
auuagaaauggau

SEQ ID NO: 4059845 - RNA, 12 nt, Vaccinia virus
auuagaauguau

SEQ ID NO: 4059846 - RNA, 14 nt, Vaccinia virus
auuagacauaugau

SEQ ID NO: 4059847 - RNA, 19 nt, Vaccinia virus
auuagacguagcuuaucau

SEQ ID NO: 4059848 - RNA, 13 nt, Vaccinia virus
auuagauaaaguu

SEQ ID NO: 4059849 - RNA, 15 nt, Vaccinia virus
auuagcauccuuaua

SEQ ID NO: 4059850 - RNA, 21 nt, Vaccinia virus
auuagcgagguauuuauucau

SEQ ID NO: 4059851 - RNA, 22 nt, Vaccinia virus
auuaggaucuacguucauaugu

SEQ ID NO: 4059852 - RNA, 22 nt, Vaccinia virus
auuaggcacagucaaacauuca

SEQ ID NO: 4059853 - RNA, 15 nt, Vaccinia virus
auuaguaaaaaauuu

SEQ ID NO: 4059854 - RNA, 21 nt, Vaccinia virus
auuaguauucuucuugucauc

SEQ ID NO: 4059855 - RNA, 18 nt, Vaccinia virus
auuagucacgacugaaau

SEQ ID NO: 4059856 - RNA, 15 nt, Vaccinia virus
auuagugacggaaaa

SEQ ID NO: 4059857 - RNA, 17 nt, Vaccinia virus
auuaguggaagaaagau

SEQ ID NO: 4059858 - RNA, 22 nt, Vaccinia virus
auuaguguauacaccaacagua

SEQ ID NO: 4059859 - RNA, 17 nt, Vaccinia virus
auuaguugaugugacug

SEQ ID NO: 4059860 - RNA, 21 nt, Vaccinia virus
auuaguuuccuuuuuauaaaa

SEQ ID NO: 4059861 - RNA, 17 nt, Vaccinia virus
auuauaaauauugaugu

SEQ ID NO: 4059862 - RNA, 14 nt, Vaccinia virus
auuauacaucgagu

SEQ ID NO: 4059863 - RNA, 15 nt, Vaccinia virus
auuguuaaauuauua

SEQ ID NO: 4059864 - RNA, 19 nt, Vaccinia virus
auuguuauugaucaaacau

SEQ ID NO: 4059865 - RNA, 19 nt, Vaccinia virus
auuguugucugaaauacga

SEQ ID NO: 4059866 - RNA, 14 nt, Vaccinia virus
auuguuuagaauac

SEQ ID NO: 4059867 - RNA, 17 nt, Vaccinia virus
auuguuuuuguacauaa

SEQ ID NO: 4059868 - RNA, 16 nt, Vaccinia virus
auuguuuuuuauuuuc

SEQ ID NO: 4059869 - RNA, 19 nt, Vaccinia virus
auuuaacaagagaagagau

SEQ ID NO: 4059870 - RNA, 24 nt, Vaccinia virus
auuuaacgaaucauccauaaauua

SEQ ID NO: 4059871 - RNA, 16 nt, Vaccinia virus
auuuaacguuaaagau

SEQ ID NO: 4059872 - RNA, 18 nt, Vaccinia virus
auuuaagcagagaauguu

SEQ ID NO: 4059873 - RNA, 21 nt, Vaccinia virus
auuuaagugauauaaaacuau

SEQ ID NO: 4059874 - RNA, 16 nt, Vaccinia virus
auuuaauuacauccuu

SEQ ID NO: 4059875 - RNA, 22 nt, Vaccinia virus
auuuaauuuggucauuauuaau

SEQ ID NO: 4059876 - RNA, 16 nt, Vaccinia virus
auuuaauuuuagauaa

SEQ ID NO: 4059877 - RNA, 17 nt, Vaccinia virus
auuuacaccaaaaacuc

SEQ ID NO: 4059878 - RNA, 19 nt, Vaccinia virus
auuuaccguuacuaauaag

SEQ ID NO: 4059879 - RNA, 22 nt, Vaccinia virus
auuuacggaacuucuaaaacug

SEQ ID NO: 4059880 - RNA, 14 nt, Vaccinia virus
auuuagaaaugaag

SEQ ID NO: 4059881 - RNA, 22 nt, Vaccinia virus
auuuagauuaaauccagaaguu

SEQ ID NO: 4059882 - RNA, 17 nt, Vaccinia virus
auuuaggacuuugcaau

SEQ ID NO: 4059883 - RNA, 15 nt, Vaccinia virus
auuuaguauuaaaug

SEQ ID NO: 4059884 - RNA, 17 nt, Vaccinia virus
auuuagucuuacacauu

SEQ ID NO: 4059885 - RNA, 19 nt, Vaccinia virus
auuuauaaccuuuuccuua

SEQ ID NO: 4059886 - RNA, 14 nt, Vaccinia virus
auuuauagaugaag

SEQ ID NO: 4059887 - RNA, 16 nt, Vaccinia virus
auuuauauauuaaaaa

SEQ ID NO: 4059888 - RNA, 13 nt, Vaccinia virus
auuuaucauauau

SEQ ID NO: 4059889 - RNA, 18 nt, Vaccinia virus
auuuauccguaaaaaugu

SEQ ID NO: 4059890 - RNA, 19 nt, Vaccinia virus
auuuaucgcuaacaugcau

SEQ ID NO: 4059891 - RNA, 16 nt, Vaccinia virus
auuuauguuuuaaaua

SEQ ID NO: 4059892 - RNA, 13 nt, Vaccinia virus
auuuauuaaauac

SEQ ID NO: 4059893 - RNA, 14 nt, Vaccinia virus
auuuauuaucuugu

SEQ ID NO: 4059894 - RNA, 19 nt, Vaccinia virus
auuuauucaucaucaaaag

SEQ ID NO: 4059895 - RNA, 22 nt, Vaccinia virus
auuuauuuuuguacauuaauaa

SEQ ID NO: 4059896 - RNA, 15 nt, Vaccinia virus
auuucaaaauuauuu

SEQ ID NO: 4059897 - RNA, 15 nt, Vaccinia virus
auuucacgaaaaaug

SEQ ID NO: 4059898 - RNA, 15 nt, Vaccinia virus
auuucacuacuaucu

SEQ ID NO: 4059899 - RNA, 19 nt, Vaccinia virus
auuucaguuuauguuugua

SEQ ID NO: 4059900 - RNA, 11 nt, Vaccinia virus
auuucauguac

SEQ ID NO: 4059901 - RNA, 15 nt, Vaccinia virus
auuucauuaauuaau

SEQ ID NO: 4059902 - RNA, 22 nt, Vaccinia virus
auuuccacauuagaugguaaau

SEQ ID NO: 4059903 - RNA, 23 nt, Vaccinia virus
auuuccauccgauuguuguguac

SEQ ID NO: 4059904 - RNA, 14 nt, Vaccinia virus
auuuccaugucuac

SEQ ID NO: 4059905 - RNA, 17 nt, Vaccinia virus
auuuccauuuuuaauuu

SEQ ID NO: 4059906 - RNA, 15 nt, Vaccinia virus
auuucgauaaugaac

SEQ ID NO: 4059907 - RNA, 22 nt, Vaccinia virus
auuucggaaucgcaaaccacca

SEQ ID NO: 4059908 - RNA, 17 nt, Vaccinia virus
auuucguuaaaacauuc

SEQ ID NO: 4059909 - RNA, 16 nt, Vaccinia virus
auuucuaagagaauga

SEQ ID NO: 4059910 - RNA, 14 nt, Vaccinia virus
auuucuaauguuuc

SEQ ID NO: 4059911 - RNA, 17 nt, Vaccinia virus
auuucuauuucuguaua

SEQ ID NO: 4059912 - RNA, 23 nt, Vaccinia virus
auuucucuaccacaggagaaugg

SEQ ID NO: 4059913 - RNA, 18 nt, Vaccinia virus
auuucucucauaaauaca

SEQ ID NO: 4059914 - RNA, 23 nt, Vaccinia virus
auuucuggauauguuuuuaauaa

SEQ ID NO: 4059915 - RNA, 13 nt, Vaccinia virus
auuucuguaaauu

SEQ ID NO: 4059916 - RNA, 19 nt, Vaccinia virus
auuucuguauaucuauaau

SEQ ID NO: 4059917 - RNA, 22 nt, Vaccinia virus
auuucuuuuuucuggcauaacu

SEQ ID NO: 4059918 - RNA, 21 nt, Vaccinia virus
auuugaacagagccuguaaca

SEQ ID NO: 4059919 - RNA, 17 nt, Vaccinia virus
auuugacgcuuuucucu

SEQ ID NO: 4059920 - RNA, 21 nt, Vaccinia virus
auuugagagaucauuucuaua

SEQ ID NO: 4059921 - RNA, 16 nt, Vaccinia virus
auuugauauaaugaau

SEQ ID NO: 4059922 - RNA, 14 nt, Vaccinia virus
auuugaucaguuua

SEQ ID NO: 4059923 - RNA, 18 nt, Vaccinia virus
auuugccauauauggaua

SEQ ID NO: 4059924 - RNA, 15 nt, Vaccinia virus
auuuggauuuuguug

SEQ ID NO: 4059925 - RNA, 15 nt, Vaccinia virus
auuugguaaaaugaa

SEQ ID NO: 4059926 - RNA, 19 nt, Vaccinia virus
auuugguauauacauagau

SEQ ID NO: 4059927 - RNA, 17 nt, Vaccinia virus
auuuguaggaaaaagau

SEQ ID NO: 4059928 - RNA, 17 nt, Vaccinia virus
auuuguauccuuaucua

SEQ ID NO: 4059929 - RNA, 22 nt, Vaccinia virus
auuugugccgcauacagaucaa

SEQ ID NO: 4059930 - RNA, 13 nt, Vaccinia virus
auuuguucuugua

SEQ ID NO: 4059931 - RNA, 20 nt, Vaccinia virus
auuuuaaaauuaaaaaggaa

SEQ ID NO: 4059932 - RNA, 20 nt, Vaccinia virus
auuuuacaacuuuuaacaag

SEQ ID NO: 4059933 - RNA, 17 nt, Vaccinia virus
auuuuacccucaaucau

SEQ ID NO: 4059934 - RNA, 22 nt, Vaccinia virus
auuuuacccucaaucauguacu

SEQ ID NO: 4059935 - RNA, 20 nt, Vaccinia virus
auuuuacuaaauaauggcug

SEQ ID NO: 4059936 - RNA, 22 nt, Vaccinia virus
auuuuauaacguuaguuaauaa

SEQ ID NO: 4059937 - RNA, 22 nt, Vaccinia virus
auuuuauauuuuguaauaagaa

SEQ ID NO: 4059938 - RNA, 15 nt, Vaccinia virus
auuuuaucaaacaug

SEQ ID NO: 4059939 - RNA, 18 nt, Vaccinia virus
auuuuaugguauuaauaa

SEQ ID NO: 4059940 - RNA, 23 nt, Vaccinia virus
auuuucagcguggauuucucaua

SEQ ID NO: 4059941 - RNA, 15 nt, Vaccinia virus
auuuucucuugaaaa

SEQ ID NO: 4059942 - RNA, 22 nt, Vaccinia virus
auuuucuugugaccaacucauc

SEQ ID NO: 4059943 - RNA, 12 nt, Vaccinia virus
auuuugaggaaa

SEQ ID NO: 4059944 - RNA, 21 nt, Vaccinia virus
auuuugauauuacuuauaaua

SEQ ID NO: 4059945 - RNA, 21 nt, Vaccinia virus
auuuugcucuauaaacugaau

SEQ ID NO: 4059946 - RNA, 20 nt, Vaccinia virus
auuuuggagagccuuaacga

SEQ ID NO: 4059947 - RNA, 17 nt, Vaccinia virus
auuuuggcguuaucauu

SEQ ID NO: 4059948 - RNA, 18 nt, Vaccinia virus
auuuugguuuacauguaa

SEQ ID NO: 4059949 - RNA, 22 nt, Vaccinia virus
auuuuguagaugccauaucaua

SEQ ID NO: 4059950 - RNA, 21 nt, Vaccinia virus
auuuugucuuuaaguauauac

SEQ ID NO: 4059951 - RNA, 19 nt, Vaccinia virus
auuuugugauauuaauaua

SEQ ID NO: 4059952 - RNA, 17 nt, Vaccinia virus
auuuuuaaacuguuugu

SEQ ID NO: 4059953 - RNA, 20 nt, Vaccinia virus
auuuuuacagcgacacuauu

SEQ ID NO: 4059954 - RNA, 23 nt, Vaccinia virus
auuuuuagacauuagauaugcca

SEQ ID NO: 4059955 - RNA, 20 nt, Vaccinia virus
auuuuuaguuacagaaguga

SEQ ID NO: 4059956 - RNA, 12 nt, Vaccinia virus
auuuuuaucaua

SEQ ID NO: 4059957 - RNA, 19 nt, Vaccinia virus
auuuuucuauguuaggaau

SEQ ID NO: 4059958 - RNA, 12 nt, Vaccinia virus
auuuuuucauuu

SEQ ID NO: 4059959 - RNA, 23 nt, Vaccinia virus
auuuuuuuaaaaaaaaaauacuu

SEQ ID NO: 4059960 - RNA, 14 nt, Vaccinia virus
auuuuuuuauucau

SEQ ID NO: 4059961 - RNA, 18 nt, Vaccinia virus
caaaaagggauauauauu

SEQ ID NO: 4059962 - RNA, 16 nt, Vaccinia virus
caaaaaguaagauauu

SEQ ID NO: 4059963 - RNA, 19 nt, Vaccinia virus
caaaaauauaauagcuaau

SEQ ID NO: 4059964 - RNA, 13 nt, Vaccinia virus
caaaaauauucua

SEQ ID NO: 4059965 - RNA, 16 nt, Vaccinia virus
caaaaauguucuuaau

SEQ ID NO: 4059966 - RNA, 15 nt, Vaccinia virus
caaaacgaguacuuu

SEQ ID NO: 4059967 - RNA, 18 nt, Vaccinia virus
caaaagacaugauaauau

SEQ ID NO: 4059968 - RNA, 18 nt, Vaccinia virus
caaaaggacguagacaau

SEQ ID NO: 4059969 - RNA, 16 nt, Vaccinia virus
caaaaggggugagaau

SEQ ID NO: 4059970 - RNA, 19 nt, Vaccinia virus
caaaaguaagcauuuccuu

SEQ ID NO: 4059971 - RNA, 18 nt, Vaccinia virus
caaaaguucauaaucuca

SEQ ID NO: 4059972 - RNA, 14 nt, Vaccinia virus
caaaaucuuaauau

SEQ ID NO: 4059973 - RNA, 16 nt, Vaccinia virus
caaaaugaaaauacuu

SEQ ID NO: 4059974 - RNA, 15 nt, Vaccinia virus
caaaaugauauacag

SEQ ID NO: 4059975 - RNA, 20 nt, Vaccinia virus
caaaauguuugacauuagua

SEQ ID NO: 4059976 - RNA, 17 nt, Vaccinia virus
caaacaauguauacaaa

SEQ ID NO: 4059977 - RNA, 14 nt, Vaccinia virus
caaacaauguuucu

SEQ ID NO: 4059978 - RNA, 18 nt, Vaccinia virus
caaacaggaaagaaguau

SEQ ID NO: 4059979 - RNA, 16 nt, Vaccinia virus
caaacauuauguagua

SEQ ID NO: 4059980 - RNA, 17 nt, Vaccinia virus
caaacugcauucguguu

SEQ ID NO: 4059981 - RNA, 20 nt, Vaccinia virus
caaacuuaaucuuauuagaa

SEQ ID NO: 4059982 - RNA, 21 nt, Vaccinia virus
caaagaaacaucaaguagaaa

SEQ ID NO: 4059983 - RNA, 12 nt, Vaccinia virus
caaagaaauacg

SEQ ID NO: 4059984 - RNA, 14 nt, Vaccinia virus
caaagaaauuaaua

SEQ ID NO: 4059985 - RNA, 17 nt, Vaccinia virus
caaagaauauaucuaau

SEQ ID NO: 4059986 - RNA, 22 nt, Vaccinia virus
cagacucugauuugaacaaugc

SEQ ID NO: 4059987 - RNA, 12 nt, Vaccinia virus
cagacugaaagu

SEQ ID NO: 4059988 - RNA, 19 nt, Vaccinia virus
cagagaggccaucuggaag

SEQ ID NO: 4059989 - RNA, 23 nt, Vaccinia virus
cagagauccacugucacuggaaa

SEQ ID NO: 4059990 - RNA, 15 nt, Vaccinia virus
cagaguguuucaaag

SEQ ID NO: 4059991 - RNA, 15 nt, Vaccinia virus
cagaguugauuguaa

SEQ ID NO: 4059992 - RNA, 21 nt, Vaccinia virus
cagauaauaaccuccugaaaa

SEQ ID NO: 4059993 - RNA, 21 nt, Vaccinia virus
cagauauuccgacaaaggauu

SEQ ID NO: 4059994 - RNA, 14 nt, Vaccinia virus
cagaucaaaacaaa

SEQ ID NO: 4059995 - RNA, 20 nt, Vaccinia virus
cagauccucccguuaaaacc

SEQ ID NO: 4059996 - RNA, 18 nt, Vaccinia virus
cagaugccagauuacaaa

SEQ ID NO: 4059997 - RNA, 18 nt, Vaccinia virus
cagauguaaauauauuua

SEQ ID NO: 4059998 - RNA, 22 nt, Vaccinia virus
cagaugucauaauauuggauug

SEQ ID NO: 4059999 - RNA, 19 nt, Vaccinia virus
cagauguuggaggaugaag

SEQ ID NO: 4060000 - RNA, 13 nt, Vaccinia virus
cagauguuguaaa

SEQ ID NO: 4060001 - RNA, 13 nt, Vaccinia virus
cagauuuuaauau

SEQ ID NO: 4060002 - RNA, 18 nt, Vaccinia virus
cagauuuugauauucuau

SEQ ID NO: 4060003 - RNA, 22 nt, Vaccinia virus
cagauuuuugaaugaaugaaua

SEQ ID NO: 4060004 - RNA, 21 nt, Vaccinia virus
cagcaauagaucggaugauuu

SEQ ID NO: 4060005 - RNA, 20 nt, Vaccinia virus
cagcacagggagccacagaa

SEQ ID NO: 4060006 - RNA, 12 nt, Vaccinia virus
cagcuguagaac

SEQ ID NO: 4060007 - RNA, 13 nt, Vaccinia virus
caggaacuauuaa

SEQ ID NO: 4060008 - RNA, 15 nt, Vaccinia virus
caggaaggagauauu

SEQ ID NO: 4060009 - RNA, 16 nt, Vaccinia virus
caggagauagauaucc

SEQ ID NO: 4060010 - RNA, 14 nt, Vaccinia virus
caguaacauauauu

SEQ ID NO: 4060011 - RNA, 21 nt, Vaccinia virus
caguaauagcuccauaaacug

SEQ ID NO: 4060012 - RNA, 18 nt, Vaccinia virus
caguaggucuuggugaag

SEQ ID NO: 4060013 - RNA, 17 nt, Vaccinia virus
caguaguaauuaaugaa

SEQ ID NO: 4060014 - RNA, 18 nt, Vaccinia virus
caguauaccucaaaaauu

SEQ ID NO: 4060015 - RNA, 19 nt, Vaccinia virus
cagucaagucaaugauauu

SEQ ID NO: 4060016 - RNA, 15 nt, Vaccinia virus
cagucacagacacug

SEQ ID NO: 4060017 - RNA, 15 nt, Vaccinia virus
caguccacuguauaa

SEQ ID NO: 4060018 - RNA, 17 nt, Vaccinia virus
caguccagaaauauuua

SEQ ID NO: 4060019 - RNA, 16 nt, Vaccinia virus
cagucuaguauccauu

SEQ ID NO: 4060020 - RNA, 17 nt, Vaccinia virus
cagucuaguauccauuu

SEQ ID NO: 4060021 - RNA, 21 nt, Vaccinia virus
cagucuaugauagcaauuacu

SEQ ID NO: 4060022 - RNA, 22 nt, Vaccinia virus
cagucugaacaucaaucuuuuu

SEQ ID NO: 4060023 - RNA, 17 nt, Vaccinia virus
caguguacguauauuua

SEQ ID NO: 4060024 - RNA, 19 nt, Vaccinia virus
caguuaacgaaagcaaaga

SEQ ID NO: 4060025 - RNA, 12 nt, Vaccinia virus
caguuauuggau

SEQ ID NO: 4060026 - RNA, 20 nt, Vaccinia virus
caguuccccuacguaucuau

SEQ ID NO: 4060027 - RNA, 16 nt, Vaccinia virus
caguucguuugaugau

SEQ ID NO: 4060028 - RNA, 11 nt, Vaccinia virus
caguuugagaa

SEQ ID NO: 4060029 - RNA, 20 nt, Vaccinia virus
caguuuuaagaugucauaau

SEQ ID NO: 4060030 - RNA, 23 nt, Vaccinia virus
cauaaaaaaauauauuauuuuua

SEQ ID NO: 4060031 - RNA, 22 nt, Vaccinia virus
cauaaaaacucauuacauaguu

SEQ ID NO: 4060032 - RNA, 13 nt, Vaccinia virus
cauaaaacauaau

SEQ ID NO: 4060033 - RNA, 22 nt, Vaccinia virus
cauaaaauuaucgaggauaucu

SEQ ID NO: 4060034 - RNA, 17 nt, Vaccinia virus
cauaaacauguccaaua

SEQ ID NO: 4060035 - RNA, 18 nt, Vaccinia virus
cauaaacugaucacuaau

SEQ ID NO: 4060036 - RNA, 19 nt, Vaccinia virus
cauaaacugaucacuaauu

SEQ ID NO: 4060037 - RNA, 23 nt, Vaccinia virus
cauaaauaauaaauacaauaauu

SEQ ID NO: 4060038 - RNA, 17 nt, Vaccinia virus
cauaaauauauuucuaa

SEQ ID NO: 4060039 - RNA, 14 nt, Vaccinia virus
cauaacgcauaauu

SEQ ID NO: 4060040 - RNA, 13 nt, Vaccinia virus
cauaacguccaga

SEQ ID NO: 4060041 - RNA, 20 nt, Vaccinia virus
cauaagcuugacuacauuug

SEQ ID NO: 4060042 - RNA, 19 nt, Vaccinia virus
cauaaggaaacuuuuguuu

SEQ ID NO: 4060043 - RNA, 14 nt, Vaccinia virus
cauaaguauguuug

SEQ ID NO: 4060044 - RNA, 17 nt, Vaccinia virus
cauaagucuaauagacu

SEQ ID NO: 4060045 - RNA, 15 nt, Vaccinia virus
cauaauauuaucaaa

SEQ ID NO: 4060046 - RNA, 21 nt, Vaccinia virus
cauaaucaucacugucaucag

SEQ ID NO: 4060047 - RNA, 18 nt, Vaccinia virus
cauaauccuuguaaugau

SEQ ID NO: 4060048 - RNA, 17 nt, Vaccinia virus
cauacauacuaucuuua

SEQ ID NO: 4060049 - RNA, 22 nt, Vaccinia virus
cauacaugaaaugaucucuauu

SEQ ID NO: 4060050 - RNA, 22 nt, Vaccinia virus
cauaccuauaggaauagucucu

SEQ ID NO: 4060051 - RNA, 17 nt, Vaccinia virus
cauacgaugaaaauggu

SEQ ID NO: 4060052 - RNA, 15 nt, Vaccinia virus
cauacuaauagaugu

SEQ ID NO: 4060053 - RNA, 17 nt, Vaccinia virus
cauacuauguuuuguau

SEQ ID NO: 4060054 - RNA, 20 nt, Vaccinia virus
cauacuuagaauuuuaggac

SEQ ID NO: 4060055 - RNA, 13 nt, Vaccinia virus
cauagaaaaugau

SEQ ID NO: 4060056 - RNA, 20 nt, Vaccinia virus
cauagaacugccauauguug

SEQ ID NO: 4060057 - RNA, 17 nt, Vaccinia virus
cauagauguauauauca

SEQ ID NO: 4060058 - RNA, 13 nt, Vaccinia virus
cauagcaauacuu

SEQ ID NO: 4060059 - RNA, 22 nt, Vaccinia virus
cauagguggagucuuuaucaau

SEQ ID NO: 4060060 - RNA, 17 nt, Vaccinia virus
cauaguaacucauaauu

SEQ ID NO: 4060061 - RNA, 16 nt, Vaccinia virus
cauaguaauacauauu

SEQ ID NO: 4060062 - RNA, 13 nt, Vaccinia virus
cauagucuucaau

SEQ ID NO: 4060063 - RNA, 18 nt, Vaccinia virus
cauauagaugcagaagua

SEQ ID NO: 4060064 - RNA, 14 nt, Vaccinia virus
cauauagauuacaa

SEQ ID NO: 4060065 - RNA, 19 nt, Vaccinia virus
cauauaggaaacuauaaag

SEQ ID NO: 4060066 - RNA, 17 nt, Vaccinia virus
cauauauggauaaugcu

SEQ ID NO: 4060067 - RNA, 13 nt, Vaccinia virus
cauauauuucauu

SEQ ID NO: 4060068 - RNA, 20 nt, Vaccinia virus
cauaucaucauuguguaaac

SEQ ID NO: 4060069 - RNA, 14 nt, Vaccinia virus
cauaucuauccaua

SEQ ID NO: 4060070 - RNA, 22 nt, Vaccinia virus
cauaucuauccauaugcaucuu

SEQ ID NO: 4060071 - RNA, 14 nt, Vaccinia virus
cauaugauguuugu

SEQ ID NO: 4060072 - RNA, 12 nt, Vaccinia virus
cauauguuuauu

SEQ ID NO: 4060073 - RNA, 12 nt, Vaccinia virus
cauauuaaacau

SEQ ID NO: 4060074 - RNA, 20 nt, Vaccinia virus
cauauuaucaccuauugcca

SEQ ID NO: 4060075 - RNA, 22 nt, Vaccinia virus
cauauucauuaggauuaucaaa

SEQ ID NO: 4060076 - RNA, 20 nt, Vaccinia virus
cauauucuaccuuuuuauuu

SEQ ID NO: 4060077 - RNA, 22 nt, Vaccinia virus
cauauugaugugucuguuuaua

SEQ ID NO: 4060078 - RNA, 19 nt, Vaccinia virus
cauauuuauucuauggaug

SEQ ID NO: 4060079 - RNA, 14 nt, Vaccinia virus
caucaaaaaacaac

SEQ ID NO: 4060080 - RNA, 22 nt, Vaccinia virus
caucaaaaauaaguaaaaagug

SEQ ID NO: 4060081 - RNA, 20 nt, Vaccinia virus
caucaaaauaggagauaucu

SEQ ID NO: 4060082 - RNA, 14 nt, Vaccinia virus
caucaaaauauguu

SEQ ID NO: 4060083 - RNA, 17 nt, Vaccinia virus
caucacuauauguucca

SEQ ID NO: 4060084 - RNA, 21 nt, Vaccinia virus
caucagaauaaaucaauaucu

SEQ ID NO: 4060085 - RNA, 16 nt, Vaccinia virus
caucagacgcaauaac

SEQ ID NO: 4060086 - RNA, 22 nt, Vaccinia virus
caucaucgaagagcauuuuguu

SEQ ID NO: 4060087 - RNA, 18 nt, Vaccinia virus
caucaucgugacauaagu

SEQ ID NO: 4060088 - RNA, 13 nt, Vaccinia virus
caucaucuggaau

SEQ ID NO: 4060089 - RNA, 18 nt, Vaccinia virus
cauccguuguuauauacc

SEQ ID NO: 4060090 - RNA, 22 nt, Vaccinia virus
cauccuucucuucccucuucua

SEQ ID NO: 4060091 - RNA, 22 nt, Vaccinia virus
cauccuuggauagagauugaga

SEQ ID NO: 4060092 - RNA, 21 nt, Vaccinia virus
caucgauucccauaugauguu

SEQ ID NO: 4060093 - RNA, 18 nt, Vaccinia virus
caucgcauuguacgaugu

SEQ ID NO: 4060094 - RNA, 16 nt, Vaccinia virus
caucggaucuguaaaa

SEQ ID NO: 4060095 - RNA, 16 nt, Vaccinia virus
caucgucucaucuguu

SEQ ID NO: 4060096 - RNA, 16 nt, Vaccinia virus
caucuacuuuaucuau

SEQ ID NO: 4060097 - RNA, 21 nt, Vaccinia virus
caucuagccucgguaaucugu

SEQ ID NO: 4060098 - RNA, 20 nt, Vaccinia virus
caucuauauugcuacauaau

SEQ ID NO: 4060099 - RNA, 21 nt, Vaccinia virus
caucuauguagaauccaucag

SEQ ID NO: 4060100 - RNA, 14 nt, Vaccinia virus
caucugcucaacaa

SEQ ID NO: 4060101 - RNA, 23 nt, Vaccinia virus
caucugguacaauaaauagcuuu

SEQ ID NO: 4060102 - RNA, 16 nt, Vaccinia virus
caucuuaguauaacac

SEQ ID NO: 4060103 - RNA, 14 nt, Vaccinia virus
caucuugacauuuu

SEQ ID NO: 4060104 - RNA, 23 nt, Vaccinia virus
caugaacaaucacaagaacagag

SEQ ID NO: 4060105 - RNA, 22 nt, Vaccinia virus
caugaaggagauuuaguauuua

SEQ ID NO: 4060106 - RNA, 20 nt, Vaccinia virus
caugaauccauucuaaugau

SEQ ID NO: 4060107 - RNA, 18 nt, Vaccinia virus
caugacaaaauuaaaaaa

SEQ ID NO: 4060108 - RNA, 16 nt, Vaccinia virus
caugacguaaauguaa

SEQ ID NO: 4060109 - RNA, 21 nt, Vaccinia virus
guucaacuggagauuauagca

SEQ ID NO: 4060110 - RNA, 21 nt, Vaccinia virus
guucagauugggaucuuuuca

SEQ ID NO: 4060111 - RNA, 20 nt, Vaccinia virus
guucauacaugaaaugaucu

SEQ ID NO: 4060112 - RNA, 20 nt, Vaccinia virus
guuccaauauguaucaaaga

SEQ ID NO: 4060113 - RNA, 18 nt, Vaccinia virus
guuccguaucuguauuua

SEQ ID NO: 4060114 - RNA, 23 nt, Vaccinia virus
guucgugccaauugaguaacauu

SEQ ID NO: 4060115 - RNA, 13 nt, Vaccinia virus
guucguucuggga

SEQ ID NO: 4060116 - RNA, 21 nt, Vaccinia virus
guucuaacgccgaucucugaa

SEQ ID NO: 4060117 - RNA, 14 nt, Vaccinia virus
guucuuaauagucu

SEQ ID NO: 4060118 - RNA, 16 nt, Vaccinia virus
guugacauguauauau

SEQ ID NO: 4060119 - RNA, 19 nt, Vaccinia virus
guugacauguauauaucca

SEQ ID NO: 4060120 - RNA, 18 nt, Vaccinia virus
guugauaaaauguugaua

SEQ ID NO: 4060121 - RNA, 21 nt, Vaccinia virus
guugaucagaaugaauguuua

SEQ ID NO: 4060122 - RNA, 17 nt, Vaccinia virus
guugcaauaauaaaagu

SEQ ID NO: 4060123 - RNA, 21 nt, Vaccinia virus
guugcaauaauaaaaguuauc

SEQ ID NO: 4060124 - RNA, 20 nt, Vaccinia virus
guugcgcagagugaauaauu

SEQ ID NO: 4060125 - RNA, 19 nt, Vaccinia virus
guugcugcucguauaaucu

SEQ ID NO: 4060126 - RNA, 13 nt, Vaccinia virus
guugguagauauu

SEQ ID NO: 4060127 - RNA, 14 nt, Vaccinia virus
guuguauagaaauu

SEQ ID NO: 4060128 - RNA, 18 nt, Vaccinia virus
guugucuaguauuuaaca

SEQ ID NO: 4060129 - RNA, 18 nt, Vaccinia virus
guuguuaaaguuaauauu

SEQ ID NO: 4060130 - RNA, 13 nt, Vaccinia virus
guuuaaaauuagc

SEQ ID NO: 4060131 - RNA, 21 nt, Vaccinia virus
guuuaaaguaaacuucguaaa

SEQ ID NO: 4060132 - RNA, 19 nt, Vaccinia virus
guuuaacaaaguuauucau

SEQ ID NO: 4060133 - RNA, 16 nt, Vaccinia virus
guuuaauuuucacaag

SEQ ID NO: 4060134 - RNA, 17 nt, Vaccinia virus
guuuacaguaguaauga

SEQ ID NO: 4060135 - RNA, 13 nt, Vaccinia virus
guuuagagaaugc

SEQ ID NO: 4060136 - RNA, 14 nt, Vaccinia virus
guuuagaugucgaa

SEQ ID NO: 4060137 - RNA, 22 nt, Vaccinia virus
guuuauaauuacaacauaauag

SEQ ID NO: 4060138 - RNA, 19 nt, Vaccinia virus
guuuaucgccuacaucauc

SEQ ID NO: 4060139 - RNA, 17 nt, Vaccinia virus
guuucaucaauagaaga

SEQ ID NO: 4060140 - RNA, 18 nt, Vaccinia virus
guuucauguuuauaaaaa

SEQ ID NO: 4060141 - RNA, 19 nt, Vaccinia virus
guuuccuggauaaaccaca

SEQ ID NO: 4060142 - RNA, 16 nt, Vaccinia virus
guuucucauguggauc

SEQ ID NO: 4060143 - RNA, 20 nt, Vaccinia virus
guuucugucaacaauguuug

SEQ ID NO: 4060144 - RNA, 13 nt, Vaccinia virus
guuuggaauaacu

SEQ ID NO: 4060145 - RNA, 16 nt, Vaccinia virus
guuuggauuaauaauu

SEQ ID NO: 4060146 - RNA, 15 nt, Vaccinia virus
guuuguuuuggaaau

SEQ ID NO: 4060147 - RNA, 22 nt, Vaccinia virus
guuuuaacgaauuauauagucu

SEQ ID NO: 4060148 - RNA, 19 nt, Vaccinia virus
guuuuacguuauuaaucau

SEQ ID NO: 4060149 - RNA, 20 nt, Vaccinia virus
guuuucagaagauaauuauc

SEQ ID NO: 4060150 - RNA, 11 nt, Vaccinia virus
guuuucaucag

SEQ ID NO: 4060151 - RNA, 20 nt, Vaccinia virus
guuuuccaaccggacucauu

SEQ ID NO: 4060152 - RNA, 17 nt, Vaccinia virus
guuuucccauacuaauu

SEQ ID NO: 4060153 - RNA, 15 nt, Vaccinia virus
guuuucgauacuuuu

SEQ ID NO: 4060154 - RNA, 16 nt, Vaccinia virus
guuuucuacaauaacu

SEQ ID NO: 4060155 - RNA, 17 nt, Vaccinia virus
guuuucuagauggaaau

SEQ ID NO: 4060156 - RNA, 15 nt, Vaccinia virus
uaaaaaaaaugacuu

SEQ ID NO: 4060157 - RNA, 13 nt, Vaccinia virus
uaaaaaaacauua

SEQ ID NO: 4060158 - RNA, 23 nt, Vaccinia virus
uaaaaaaaugauugaagaaggag

SEQ ID NO: 4060159 - RNA, 14 nt, Vaccinia virus
uaaaaaagauaaag

SEQ ID NO: 4060160 - RNA, 16 nt, Vaccinia virus
uaaaaaauauucuuca

SEQ ID NO: 4060161 - RNA, 18 nt, Vaccinia virus
uaaaaacauuuuauuucu

SEQ ID NO: 4060162 - RNA, 20 nt, Vaccinia virus
uaaaaaguucgaguuucuca

SEQ ID NO: 4060163 - RNA, 21 nt, Vaccinia virus
uaaaaaguuuuccaucuaugu

SEQ ID NO: 4060164 - RNA, 16 nt, Vaccinia virus
uaaaaauaaacaacau

SEQ ID NO: 4060165 - RNA, 12 nt, Vaccinia virus
uaaaaauuauug

SEQ ID NO: 4060166 - RNA, 16 nt, Vaccinia virus
uaaaacgauuaaacaa

SEQ ID NO: 4060167 - RNA, 19 nt, Vaccinia virus
uaaaacuuguaagaaguaa

SEQ ID NO: 4060168 - RNA, 13 nt, Vaccinia virus
uaaaagucaacau

SEQ ID NO: 4060169 - RNA, 13 nt, Vaccinia virus
uaaaauaauacau

SEQ ID NO: 4060170 - RNA, 18 nt, Vaccinia virus
uaaaauaguucuguaaua

SEQ ID NO: 4060171 - RNA, 19 nt, Vaccinia virus
uaaaauaguuuauaacauu

SEQ ID NO: 4060172 - RNA, 18 nt, Vaccinia virus
uaaaauauaaugauauac

SEQ ID NO: 4060173 - RNA, 22 nt, Vaccinia virus
uaaaauauacucgacaacuuua

SEQ ID NO: 4060174 - RNA, 17 nt, Vaccinia virus
uaaaaucacugaacauu

SEQ ID NO: 4060175 - RNA, 20 nt, Vaccinia virus
uaaaaucucagauugugcau

SEQ ID NO: 4060176 - RNA, 16 nt, Vaccinia virus
uaaaaucugaucuugu

SEQ ID NO: 4060177 - RNA, 12 nt, Vaccinia virus
uaaaauggauua

SEQ ID NO: 4060178 - RNA, 19 nt, Vaccinia virus
uaaaaugguaaacuuuugc

SEQ ID NO: 4060179 - RNA, 16 nt, Vaccinia virus
uaaaauuccuacucau

SEQ ID NO: 4060180 - RNA, 14 nt, Vaccinia virus
uaaacaaaauacuc

SEQ ID NO: 4060181 - RNA, 16 nt, Vaccinia virus
uaaacaaucuaguuuu

SEQ ID NO: 4060182 - RNA, 22 nt, Vaccinia virus
uaaacaaucuaguuuugagaac

SEQ ID NO: 4060183 - RNA, 20 nt, Vaccinia virus
uaaacaaucugucgaaaaag

SEQ ID NO: 4060184 - RNA, 21 nt, Vaccinia virus
uaaacaauugggguuuccagg

SEQ ID NO: 4060185 - RNA, 16 nt, Vaccinia virus
uaaacacauuauuaau

SEQ ID NO: 4060186 - RNA, 23 nt, Vaccinia virus
uaaacauauagggaaucauauau

SEQ ID NO: 4060187 - RNA, 21 nt, Vaccinia virus
uaaacaucuuugcaucauacu

SEQ ID NO: 4060188 - RNA, 17 nt, Vaccinia virus
uaaacauuguucaugau

SEQ ID NO: 4060189 - RNA, 14 nt, Vaccinia virus
uaaacgaacuauau

SEQ ID NO: 4060190 - RNA, 22 nt, Vaccinia virus
uaaacgacuauaaaauuauuga

SEQ ID NO: 4060191 - RNA, 14 nt, Vaccinia virus
uaaacguacauuuu

SEQ ID NO: 4060192 - RNA, 18 nt, Vaccinia virus
uaaacucagauaauagca

SEQ ID NO: 4060193 - RNA, 19 nt, Vaccinia virus
uaaacucagauaauagcaa

SEQ ID NO: 4060194 - RNA, 23 nt, Vaccinia virus
uaaacuccacccauuacauauau

SEQ ID NO: 4060195 - RNA, 20 nt, Vaccinia virus
uaaacucgcuuaauaucuuc

SEQ ID NO: 4060196 - RNA, 18 nt, Vaccinia virus
uaaacugcgccaaauugu

SEQ ID NO: 4060197 - RNA, 16 nt, Vaccinia virus
uaaagaaaagauaucc

SEQ ID NO: 4060198 - RNA, 20 nt, Vaccinia virus
uaaagaagaagaucauacag

SEQ ID NO: 4060199 - RNA, 15 nt, Vaccinia virus
uaaagaccgaauaca

SEQ ID NO: 4060200 - RNA, 16 nt, Vaccinia virus
uaaagacuuaagacuu

SEQ ID NO: 4060201 - RNA, 13 nt, Vaccinia virus
uaaagauaaacau

SEQ ID NO: 4060202 - RNA, 16 nt, Vaccinia virus
uaaagauauuguuaca

SEQ ID NO: 4060203 - RNA, 17 nt, Vaccinia virus
uaaagccgguguaacau

SEQ ID NO: 4060204 - RNA, 15 nt, Vaccinia virus
uaaaggauguggaca

SEQ ID NO: 4060205 - RNA, 14 nt, Vaccinia virus
uaaagguaaaugua

SEQ ID NO: 4060206 - RNA, 15 nt, Vaccinia virus
uaaaguaauaaucuu

SEQ ID NO: 4060207 - RNA, 21 nt, Vaccinia virus
uaaaguaugaacaaagaaaug

SEQ ID NO: 4060208 - RNA, 22 nt, Vaccinia virus
uaaaguauuugauaaaucucuu

SEQ ID NO: 4060209 - RNA, 13 nt, Vaccinia virus
uaaaguuaucaug

SEQ ID NO: 4060210 - RNA, 15 nt, Vaccinia virus
uaaauaaauaugugu

SEQ ID NO: 4060211 - RNA, 12 nt, Vaccinia virus
uaaauaaauguc

SEQ ID NO: 4060212 - RNA, 14 nt, Vaccinia virus
uaaauacauuauca

SEQ ID NO: 4060213 - RNA, 16 nt, Vaccinia virus
uaaauacauuaucaug

SEQ ID NO: 4060214 - RNA, 20 nt, Vaccinia virus
uaaauaccauacaauuuaug

SEQ ID NO: 4060215 - RNA, 12 nt, Vaccinia virus
uaaauagaauau

SEQ ID NO: 4060216 - RNA, 24 nt, Vaccinia virus
uaaauagaauucucuucauaucau

SEQ ID NO: 4060217 - RNA, 17 nt, Vaccinia virus
uaaauagagagauauca

SEQ ID NO: 4060218 - RNA, 19 nt, Vaccinia virus
uaaauauagguuacuagau

SEQ ID NO: 4060219 - RNA, 16 nt, Vaccinia virus
uaaauauccacucugu

SEQ ID NO: 4060220 - RNA, 18 nt, Vaccinia virus
uaaauauguguauuauca

SEQ ID NO: 4060221 - RNA, 18 nt, Vaccinia virus
uaaauauugauguuaaua

SEQ ID NO: 4060222 - RNA, 16 nt, Vaccinia virus
uaaauauuuuaaaauu

SEQ ID NO: 4060223 - RNA, 17 nt, Vaccinia virus
uaaaucagaauguuaca

SEQ ID NO: 4060224 - RNA, 21 nt, Vaccinia virus
uaaaucauuccaucgauacau

SEQ ID NO: 4060225 - RNA, 14 nt, Vaccinia virus
uaaauccagaaguu

SEQ ID NO: 4060226 - RNA, 15 nt, Vaccinia virus
uaaaucguauauguu

SEQ ID NO: 4060227 - RNA, 21 nt, Vaccinia virus
uaaaucuacucagauuauucu

SEQ ID NO: 4060228 - RNA, 18 nt, Vaccinia virus
uaaaucuauuauauuuua

SEQ ID NO: 4060229 - RNA, 13 nt, Vaccinia virus
uaaaugaaaagau

SEQ ID NO: 4060230 - RNA, 22 nt, Vaccinia virus
uaaaugaucggaucuaaaaucc

SEQ ID NO: 4060231 - RNA, 23 nt, Vaccinia virus
uaaaugauucuaacgacaucucu

SEQ ID NO: 4060232 - RNA, 17 nt, Vaccinia virus
uaaauguagacaaauau

SEQ ID NO: 4060233 - RNA, 21 nt, Vaccinia virus
uaguucuucaguaguaauaac

SEQ ID NO: 4060234 - RNA, 19 nt, Vaccinia virus
uaguucuuugaacaucuug

SEQ ID NO: 4060235 - RNA, 21 nt, Vaccinia virus
uaguucuuuuagaaaauucua

SEQ ID NO: 4060236 - RNA, 21 nt, Vaccinia virus
uaguugauagaacaaaauaca

SEQ ID NO: 4060237 - RNA, 18 nt, Vaccinia virus
uaguuguggaaauacuuc

SEQ ID NO: 4060238 - RNA, 15 nt, Vaccinia virus
uaguuuacuuuucua

SEQ ID NO: 4060239 - RNA, 20 nt, Vaccinia virus
uaguuuccuuaacaaaucua

SEQ ID NO: 4060240 - RNA, 17 nt, Vaccinia virus
uaguuugauugucucau

SEQ ID NO: 4060241 - RNA, 19 nt, Vaccinia virus
uaguuuuaacauuauuaua

SEQ ID NO: 4060242 - RNA, 14 nt, Vaccinia virus
uaguuuuuacacau

SEQ ID NO: 4060243 - RNA, 17 nt, Vaccinia virus
uaguuuuucuuuacaca

SEQ ID NO: 4060244 - RNA, 13 nt, Vaccinia virus
uaguuuuuuucau

SEQ ID NO: 4060245 - RNA, 17 nt, Vaccinia virus
uaguuuuuuuguuuccu

SEQ ID NO: 4060246 - RNA, 19 nt, Vaccinia virus
uauaaaaaaacauuauucu

SEQ ID NO: 4060247 - RNA, 16 nt, Vaccinia virus
uauaaaaauuaauauu

SEQ ID NO: 4060248 - RNA, 18 nt, Vaccinia virus
uauaaaacuacuacaaug

SEQ ID NO: 4060249 - RNA, 13 nt, Vaccinia virus
uauaaaaucacuu

SEQ ID NO: 4060250 - RNA, 17 nt, Vaccinia virus
uauaaaaucuguaucga

SEQ ID NO: 4060251 - RNA, 13 nt, Vaccinia virus
uauaaaaugacau

SEQ ID NO: 4060252 - RNA, 14 nt, Vaccinia virus
uauaaacaaaaaua

SEQ ID NO: 4060253 - RNA, 20 nt, Vaccinia virus
uauaaacauuuguguuugua

SEQ ID NO: 4060254 - RNA, 15 nt, Vaccinia virus
uauaaagacaaacaa

SEQ ID NO: 4060255 - RNA, 15 nt, Vaccinia virus
uauaaauaacauuua

SEQ ID NO: 4060256 - RNA, 18 nt, Vaccinia virus
uauaaauagauguuagua

SEQ ID NO: 4060257 - RNA, 15 nt, Vaccinia virus
uauaaauauccuuaa

SEQ ID NO: 4060258 - RNA, 22 nt, Vaccinia virus
uauaaauaugagcauuaguauu

SEQ ID NO: 4060259 - RNA, 14 nt, Vaccinia virus
uauaaauauguucc

SEQ ID NO: 4060260 - RNA, 18 nt, Vaccinia virus
uauaaaugaaguacuguu

SEQ ID NO: 4060261 - RNA, 12 nt, Vaccinia virus
uauaaauuaaag

SEQ ID NO: 4060262 - RNA, 15 nt, Vaccinia virus
uauaacaaauacaga

SEQ ID NO: 4060263 - RNA, 22 nt, Vaccinia virus
uauaaccuaaaacccauguaua

SEQ ID NO: 4060264 - RNA, 21 nt, Vaccinia virus
uauaaguuguuaaaaaaagga

SEQ ID NO: 4060265 - RNA, 20 nt, Vaccinia virus
uauaauaacgauuuguuuaa

SEQ ID NO: 4060266 - RNA, 16 nt, Vaccinia virus
uauaauaaucaauaau

SEQ ID NO: 4060267 - RNA, 14 nt, Vaccinia virus
uauaauauacucuu

SEQ ID NO: 4060268 - RNA, 17 nt, Vaccinia virus
uauaauauauuagauau

SEQ ID NO: 4060269 - RNA, 12 nt, Vaccinia virus
uauaauaucuua

SEQ ID NO: 4060270 - RNA, 14 nt, Vaccinia virus
uauaaucaaagauu

SEQ ID NO: 4060271 - RNA, 22 nt, Vaccinia virus
uauaaucaguagcguguuuuaa

SEQ ID NO: 4060272 - RNA, 18 nt, Vaccinia virus
uauaaucaucguaacugc

SEQ ID NO: 4060273 - RNA, 16 nt, Vaccinia virus
uauaauucuccugaaa

SEQ ID NO: 4060274 - RNA, 23 nt, Vaccinia virus
uauaauuuuauugagauuucuga

SEQ ID NO: 4060275 - RNA, 21 nt, Vaccinia virus
uauacaagaguggaaacucac

SEQ ID NO: 4060276 - RNA, 22 nt, Vaccinia virus
uauacaaggcggauguugugaa

SEQ ID NO: 4060277 - RNA, 15 nt, Vaccinia virus
uauacaaguguagau

SEQ ID NO: 4060278 - RNA, 13 nt, Vaccinia virus
uauacaauuauca

SEQ ID NO: 4060279 - RNA, 14 nt, Vaccinia virus
uauacacauuuuca

SEQ ID NO: 4060280 - RNA, 16 nt, Vaccinia virus
uauacacgcuaaaaua

SEQ ID NO: 4060281 - RNA, 20 nt, Vaccinia virus
uauacagcuggagauuauca

SEQ ID NO: 4060282 - RNA, 22 nt, Vaccinia virus
uauacagcuggagauuaucauc

SEQ ID NO: 4060283 - RNA, 20 nt, Vaccinia virus
uauacagugaacacacaaua

SEQ ID NO: 4060284 - RNA, 15 nt, Vaccinia virus
uauacauaaacugau

SEQ ID NO: 4060285 - RNA, 22 nt, Vaccinia virus
uauacaugauaccguuuagcau

SEQ ID NO: 4060286 - RNA, 17 nt, Vaccinia virus
uauacaugauauuauca

SEQ ID NO: 4060287 - RNA, 14 nt, Vaccinia virus
uauacauuacugaa

SEQ ID NO: 4060288 - RNA, 23 nt, Vaccinia virus
uauacccauacugaauggaugaa

SEQ ID NO: 4060289 - RNA, 21 nt, Vaccinia virus
uauacgaaauaaaauagacaa

SEQ ID NO: 4060290 - RNA, 19 nt, Vaccinia virus
uauacgaaauauuauacau

SEQ ID NO: 4060291 - RNA, 17 nt, Vaccinia virus
uauacgaauguaucaaa

SEQ ID NO: 4060292 - RNA, 17 nt, Vaccinia virus
uauacggcagcagcuuc

SEQ ID NO: 4060293 - RNA, 20 nt, Vaccinia virus
uauacggcuacaauuucaua

SEQ ID NO: 4060294 - RNA, 23 nt, Vaccinia virus
uauacgguaucgcgauuagugua

SEQ ID NO: 4060295 - RNA, 16 nt, Vaccinia virus
uauacucuauucuuca

SEQ ID NO: 4060296 - RNA, 18 nt, Vaccinia virus
uauacucuuauuaucaaa

SEQ ID NO: 4060297 - RNA, 21 nt, Vaccinia virus
uauacuugucaucauuucuaa

SEQ ID NO: 4060298 - RNA, 13 nt, Vaccinia virus
uauagaauugucu

SEQ ID NO: 4060299 - RNA, 20 nt, Vaccinia virus
uauagaggaauaucaucaaa

SEQ ID NO: 4060300 - RNA, 22 nt, Vaccinia virus
uauagauagcuuuagcuaauau

SEQ ID NO: 4060301 - RNA, 19 nt, Vaccinia virus
uauagcuauucuucuuuaa

SEQ ID NO: 4060302 - RNA, 14 nt, Vaccinia virus
uauaggaauagucu

SEQ ID NO: 4060303 - RNA, 16 nt, Vaccinia virus
uauaggagaaaaacaa

SEQ ID NO: 4060304 - RNA, 16 nt, Vaccinia virus
uauaggcgguguauuu

SEQ ID NO: 4060305 - RNA, 22 nt, Vaccinia virus
uauaguuaauaguguacuacaa

SEQ ID NO: 4060306 - RNA, 16 nt, Vaccinia virus
uauaguuuuaaacuga

SEQ ID NO: 4060307 - RNA, 13 nt, Vaccinia virus
uauauaacguuau

SEQ ID NO: 4060308 - RNA, 17 nt, Vaccinia virus
uauauaauaaauacuuu

SEQ ID NO: 4060309 - RNA, 19 nt, Vaccinia virus
uauauaauccaucaacaau

SEQ ID NO: 4060310 - RNA, 24 nt, Vaccinia virus
uauauaccacuuaaugacaaaauc

SEQ ID NO: 4060311 - RNA, 12 nt, Vaccinia virus
uauauagauguc

SEQ ID NO: 4060312 - RNA, 13 nt, Vaccinia virus
uauauaucaugau

SEQ ID NO: 4060313 - RNA, 17 nt, Vaccinia virus
uauauaucauuuguaca

SEQ ID NO: 4060314 - RNA, 12 nt, Vaccinia virus
uauauauucucu

SEQ ID NO: 4060315 - RNA, 15 nt, Vaccinia virus
uauauauuugaaaau

SEQ ID NO: 4060316 - RNA, 17 nt, Vaccinia virus
uauaucaauaagaaagu

SEQ ID NO: 4060317 - RNA, 17 nt, Vaccinia virus
uauaucaucauuuugau

SEQ ID NO: 4060318 - RNA, 15 nt, Vaccinia virus
uauauccuuuuguau

SEQ ID NO: 4060319 - RNA, 22 nt, Vaccinia virus
uauaugcaguuuuaagauguca

SEQ ID NO: 4060320 - RNA, 19 nt, Vaccinia virus
uauaugcccuauuaucaua

SEQ ID NO: 4060321 - RNA, 22 nt, Vaccinia virus
uauauggaacacgauuauuaua

SEQ ID NO: 4060322 - RNA, 13 nt, Vaccinia virus
uauauguaacauu

SEQ ID NO: 4060323 - RNA, 12 nt, Vaccinia virus
uauauguagcaa

SEQ ID NO: 4060324 - RNA, 11 nt, Vaccinia virus
uauauguuucu

SEQ ID NO: 4060325 - RNA, 13 nt, Vaccinia virus
uauauguuuucau

SEQ ID NO: 4060326 - RNA, 15 nt, Vaccinia virus
uauauuagagaagau

SEQ ID NO: 4060327 - RNA, 17 nt, Vaccinia virus
uauauuaucauagaccu

SEQ ID NO: 4060328 - RNA, 16 nt, Vaccinia virus
uauauucgaauucaaa

SEQ ID NO: 4060329 - RNA, 13 nt, Vaccinia virus
uauauucuaugau

SEQ ID NO: 4060330 - RNA, 14 nt, Vaccinia virus
uauauuucuaugau

SEQ ID NO: 4060331 - RNA, 16 nt, Vaccinia virus
uauauuugcaacaauu

SEQ ID NO: 4060332 - RNA, 22 nt, Vaccinia virus
uauauuuucacuuuaucucauu

SEQ ID NO: 4060333 - RNA, 20 nt, Vaccinia virus
uauauuuuccaugaaaucaa

SEQ ID NO: 4060334 - RNA, 14 nt, Vaccinia virus
uaucaaaacauaua

SEQ ID NO: 4060335 - RNA, 13 nt, Vaccinia virus
uaucaaaagacuu

SEQ ID NO: 4060336 - RNA, 14 nt, Vaccinia virus
uaucaaauacugua

SEQ ID NO: 4060337 - RNA, 18 nt, Vaccinia virus
uaucaaggaacaaauauu

SEQ ID NO: 4060338 - RNA, 23 nt, Vaccinia virus
uaucaauaacgcaaucaugauuu

SEQ ID NO: 4060339 - RNA, 14 nt, Vaccinia virus
uaucaauaacuaca

SEQ ID NO: 4060340 - RNA, 19 nt, Vaccinia virus
uaucaauagcaguuuauua

SEQ ID NO: 4060341 - RNA, 18 nt, Vaccinia virus
uaucaccguuaaugaggu

SEQ ID NO: 4060342 - RNA, 19 nt, Vaccinia virus
uaucacgugcaaggcauuu

SEQ ID NO: 4060343 - RNA, 20 nt, Vaccinia virus
uaucagaagugugaauauga

SEQ ID NO: 4060344 - RNA, 16 nt, Vaccinia virus
uaucagacuacuuauu

SEQ ID NO: 4060345 - RNA, 18 nt, Vaccinia virus
uaucagacuacuuauucu

SEQ ID NO: 4060346 - RNA, 14 nt, Vaccinia virus
uaucaguagaugca

SEQ ID NO: 4060347 - RNA, 16 nt, Vaccinia virus
uaucauaaaugaaaua

SEQ ID NO: 4060348 - RNA, 17 nt, Vaccinia virus
uaucauagaguaucuua

SEQ ID NO: 4060349 - RNA, 16 nt, Vaccinia virus
uaucaucauuaucauu

SEQ ID NO: 4060350 - RNA, 18 nt, Vaccinia virus
uaucaucgacacaaauga

SEQ ID NO: 4060351 - RNA, 20 nt, Vaccinia virus
uaucauugauugagaagaag

SEQ ID NO: 4060352 - RNA, 14 nt, Vaccinia virus
uaucauuuacuaga

SEQ ID NO: 4060353 - RNA, 20 nt, Vaccinia virus
uauccaacuugacaaaucuu

SEQ ID NO: 4060354 - RNA, 16 nt, Vaccinia virus
uauccaauacagaaug

SEQ ID NO: 4060355 - RNA, 19 nt, Vaccinia virus
uauccauaucucuagauac

SEQ ID NO: 4060356 - RNA, 13 nt, Vaccinia virus
uauccauuauucu

SEQ ID NO: 4060357 - RNA, 18 nt, Vaccinia virus
uuugguaauggcaaugua

SEQ ID NO: 4060358 - RNA, 16 nt, Vaccinia virus
uuugguauauacauag

SEQ ID NO: 4060359 - RNA, 14 nt, Vaccinia virus
uuugguucuucucu

SEQ ID NO: 4060360 - RNA, 14 nt, Vaccinia virus
uuuguaauugacau

SEQ ID NO: 4060361 - RNA, 18 nt, Vaccinia virus
uuuguacgucacaucuuc

SEQ ID NO: 4060362 - RNA, 16 nt, Vaccinia virus
uuuguauaacgucuuu

SEQ ID NO: 4060363 - RNA, 18 nt, Vaccinia virus
uuuguccuuaagacuaua

SEQ ID NO: 4060364 - RNA, 15 nt, Vaccinia virus
uuuguugagaugcug

SEQ ID NO: 4060365 - RNA, 15 nt, Vaccinia virus
uuuuaaagguaucua

SEQ ID NO: 4060366 - RNA, 17 nt, Vaccinia virus
uuuuaaauauuguauua

SEQ ID NO: 4060367 - RNA, 20 nt, Vaccinia virus
uuuuacagaucuaguauaau

SEQ ID NO: 4060368 - RNA, 15 nt, Vaccinia virus
uuuuacgaauaaacg

SEQ ID NO: 4060369 - RNA, 23 nt, Vaccinia virus
uuuuacgccucuccuuccguaaa

SEQ ID NO: 4060370 - RNA, 21 nt, Vaccinia virus
uuuuagauaaaaaauuauaua

SEQ ID NO: 4060371 - RNA, 20 nt, Vaccinia virus
uuuuaggauaugcuuucaua

SEQ ID NO: 4060372 - RNA, 14 nt, Vaccinia virus
uuuuaguuuaucaa

SEQ ID NO: 4060373 - RNA, 12 nt, Vaccinia virus
uuuuauaaacau

SEQ ID NO: 4060374 - RNA, 23 nt, Vaccinia virus
uuuuauaugucucgcauaaacau

SEQ ID NO: 4060375 - RNA, 17 nt, Vaccinia virus
uuuuaucgauucuaaug

SEQ ID NO: 4060376 - RNA, 21 nt, Vaccinia virus
uuuuaucuauauuguauucua

SEQ ID NO: 4060377 - RNA, 15 nt, Vaccinia virus
uuuuauuacauguuu

SEQ ID NO: 4060378 - RNA, 19 nt, Vaccinia virus
uuuuccaucuauguagaau

SEQ ID NO: 4060379 - RNA, 14 nt, Vaccinia virus
uuuucgaaauggua

SEQ ID NO: 4060380 - RNA, 23 nt, Vaccinia virus
uuuucuguacucagauucaguuu

SEQ ID NO: 4060381 - RNA, 19 nt, Vaccinia virus
uuuucuuucuaauacuaua

SEQ ID NO: 4060382 - RNA, 14 nt, Vaccinia virus
uuuugguucuucuc

SEQ ID NO: 4060383 - RNA, 12 nt, Vaccinia virus
uuuuguaauaag

SEQ ID NO: 4060384 - RNA, 22 nt, Vaccinia virus
uuuuguaauaagaauaaaaugc

SEQ ID NO: 4060385 - RNA, 13 nt, Vaccinia virus
uuuuguacauaau

SEQ ID NO: 4060386 - RNA, 17 nt, Vaccinia virus
uuuuguuugggaaacac

SEQ ID NO: 4060387 - RNA, 14 nt, Vaccinia virus
uuuuuaaaaucauu

SEQ ID NO: 4060388 - RNA, 11 nt, Vaccinia virus
uuuuuaacaug

SEQ ID NO: 4060389 - RNA, 23 nt, Vaccinia virus
uuuuuagccggaauaacaucauc

SEQ ID NO: 4060390 - RNA, 12 nt, Vaccinia virus
uuuuucaugauu

SEQ ID NO: 4060391 - RNA, 14 nt, Vaccinia virus
uuuuucgacauauu

SEQ ID NO: 4060392 - RNA, 23 nt, Vaccinia virus
uuuuucguuuacaaaaucaaaua

SEQ ID NO: 4060393 - RNA, 15 nt, Vaccinia virus
uuuuuuacguaguaa

SEQ ID NO: 4060394 - RNA, 11 nt, Vaccinia virus
uuuuuuggaau

SEQ ID NO: 4060395 - RNA, 24 nt, Vaccinia virus
aguuguuguccguuaucuaacaug

SEQ ID NO: 4060396 - RNA, 12 nt, Vaccinia virus
aguuuaacuagu

SEQ ID NO: 4060397 - RNA, 22 nt, Vaccinia virus
aguuuaagaaucucaugucaaa

SEQ ID NO: 4060398 - RNA, 19 nt, Vaccinia virus
aguuuaucaauaacuacau

SEQ ID NO: 4060399 - RNA, 16 nt, Vaccinia virus
aguuuaucauacuuag

SEQ ID NO: 4060400 - RNA, 12 nt, Vaccinia virus
aguuucagaauu

SEQ ID NO: 4060401 - RNA, 21 nt, Vaccinia virus
aguuucucaugucucuauaua

SEQ ID NO: 4060402 - RNA, 20 nt, Vaccinia virus
aguuucuugagugcgaaugu

SEQ ID NO: 4060403 - RNA, 15 nt, Vaccinia virus
aguuuggauuaauaa

SEQ ID NO: 4060404 - RNA, 16 nt, Vaccinia virus
aguuuuaaaaauacuu

SEQ ID NO: 4060405 - RNA, 17 nt, Vaccinia virus
aguuuuaaaaauacuua

SEQ ID NO: 4060406 - RNA, 15 nt, Vaccinia virus
aguuuuauaaacucg

SEQ ID NO: 4060407 - RNA, 14 nt, Vaccinia virus
aguuuucuaaagau

SEQ ID NO: 4060408 - RNA, 19 nt, Vaccinia virus
aguuuucucuauucugaaa

SEQ ID NO: 4060409 - RNA, 12 nt, Vaccinia virus
auaaaaaaauua

SEQ ID NO: 4060410 - RNA, 11 nt, Vaccinia virus
auaaaaacaag

SEQ ID NO: 4060411 - RNA, 16 nt, Vaccinia virus
auaaaaacuuauacau

SEQ ID NO: 4060412 - RNA, 23 nt, Vaccinia virus
auaaaaagacuuuuauaauucau

SEQ ID NO: 4060413 - RNA, 19 nt, Vaccinia virus
auaaaaaguauagguguau

SEQ ID NO: 4060414 - RNA, 13 nt, Vaccinia virus
auaaaaauauauu

SEQ ID NO: 4060415 - RNA, 20 nt, Vaccinia virus
auaaaaguuccagaaaaugu

SEQ ID NO: 4060416 - RNA, 14 nt, Vaccinia virus
auaaaauaacaaua

SEQ ID NO: 4060417 - RNA, 12 nt, Vaccinia virus
auaaaauagaca

SEQ ID NO: 4060418 - RNA, 14 nt, Vaccinia virus
auaaaauaucuuaa

SEQ ID NO: 4060419 - RNA, 12 nt, Vaccinia virus
auaaaaucucca

SEQ ID NO: 4060420 - RNA, 17 nt, Vaccinia virus
auaaaauguuaauacau

SEQ ID NO: 4060421 - RNA, 14 nt, Vaccinia virus
auaaaauuacuuaa

SEQ ID NO: 4060422 - RNA, 17 nt, Vaccinia virus
auaaaauugaaguaaua

SEQ ID NO: 4060423 - RNA, 19 nt, Vaccinia virus
auaaaauuuuaauuaaugu

SEQ ID NO: 4060424 - RNA, 14 nt, Vaccinia virus
auaaacaauauuaa

SEQ ID NO: 4060425 - RNA, 22 nt, Vaccinia virus
auaaacauaauaaacaaaauua

SEQ ID NO: 4060426 - RNA, 15 nt, Vaccinia virus
auaaacaugucuauu

SEQ ID NO: 4060427 - RNA, 17 nt, Vaccinia virus
auaaacaugucuauugu

SEQ ID NO: 4060428 - RNA, 20 nt, Vaccinia virus
auaaaccauuagauaaaguu

SEQ ID NO: 4060429 - RNA, 16 nt, Vaccinia virus
auaaaccauuguauaa

SEQ ID NO: 4060430 - RNA, 24 nt, Vaccinia virus
auaaaccucuggcacuuauuucau

SEQ ID NO: 4060431 - RNA, 18 nt, Vaccinia virus
auaaacggguguaaacaa

SEQ ID NO: 4060432 - RNA, 22 nt, Vaccinia virus
auaaacguucacguaaauacaa

SEQ ID NO: 4060433 - RNA, 18 nt, Vaccinia virus
auaaacuaacauuguuaa

SEQ ID NO: 4060434 - RNA, 15 nt, Vaccinia virus
auaaacuauuuuacc

SEQ ID NO: 4060435 - RNA, 16 nt, Vaccinia virus
auaaacugaucacuaa

SEQ ID NO: 4060436 - RNA, 16 nt, Vaccinia virus
auaaacuuaacccauu

SEQ ID NO: 4060437 - RNA, 14 nt, Vaccinia virus
auaaagaugauaua

SEQ ID NO: 4060438 - RNA, 23 nt, Vaccinia virus
auaaaguccgacuauuguucuau

SEQ ID NO: 4060439 - RNA, 19 nt, Vaccinia virus
auaaagucugucaaaucau

SEQ ID NO: 4060440 - RNA, 14 nt, Vaccinia virus
auaaaguguucauc

SEQ ID NO: 4060441 - RNA, 14 nt, Vaccinia virus
auaaauaacaaugg

SEQ ID NO: 4060442 - RNA, 17 nt, Vaccinia virus
auaaauaauaaauacaa

SEQ ID NO: 4060443 - RNA, 17 nt, Vaccinia virus
auaaauacaccaaauau

SEQ ID NO: 4060444 - RNA, 16 nt, Vaccinia virus
auaaauauaauaacaa

SEQ ID NO: 4060445 - RNA, 19 nt, Vaccinia virus
auaaauaucauuaauauau

SEQ ID NO: 4060446 - RNA, 21 nt, Vaccinia virus
auaaauaugcaaagucuaaau

SEQ ID NO: 4060447 - RNA, 20 nt, Vaccinia virus
auaaaucaagaucauaauua

SEQ ID NO: 4060448 - RNA, 21 nt, Vaccinia virus
auaaaucacuuuuuauacuaa

SEQ ID NO: 4060449 - RNA, 13 nt, Vaccinia virus
auaaaucauauaa

SEQ ID NO: 4060450 - RNA, 12 nt, Vaccinia virus
auaaaucauauu

SEQ ID NO: 4060451 - RNA, 20 nt, Vaccinia virus
auaaauuaggagauaaucua

SEQ ID NO: 4060452 - RNA, 14 nt, Vaccinia virus
auaaauuauaucua

SEQ ID NO: 4060453 - RNA, 18 nt, Vaccinia virus
auaaauuaucaaauacuu

SEQ ID NO: 4060454 - RNA, 14 nt, Vaccinia virus
auaaauuauuucau

SEQ ID NO: 4060455 - RNA, 14 nt, Vaccinia virus
auaaauucuagcau

SEQ ID NO: 4060456 - RNA, 17 nt, Vaccinia virus
auaaauuugucauuuau

SEQ ID NO: 4060457 - RNA, 15 nt, Vaccinia virus
auaacaaguaugaca

SEQ ID NO: 4060458 - RNA, 15 nt, Vaccinia virus
auaacaaucguauau

SEQ ID NO: 4060459 - RNA, 15 nt, Vaccinia virus
auaacaauuaacaau

SEQ ID NO: 4060460 - RNA, 17 nt, Vaccinia virus
auaacacaaaaugugaa

SEQ ID NO: 4060461 - RNA, 19 nt, Vaccinia virus
auaacagagccaucuguaa

SEQ ID NO: 4060462 - RNA, 21 nt, Vaccinia virus
auaacagagccaucuguaaaa

SEQ ID NO: 4060463 - RNA, 18 nt, Vaccinia virus
auaacaggggaaugaaca

SEQ ID NO: 4060464 - RNA, 18 nt, Vaccinia virus
auaacauucuaggaaugu

SEQ ID NO: 4060465 - RNA, 15 nt, Vaccinia virus
auaacauugauguau

SEQ ID NO: 4060466 - RNA, 22 nt, Vaccinia virus
auaaccacaucuggaaggcuua

SEQ ID NO: 4060467 - RNA, 19 nt, Vaccinia virus
auaaccucuccuauaugaa

SEQ ID NO: 4060468 - RNA, 13 nt, Vaccinia virus
auaaccuuuuccu

SEQ ID NO: 4060469 - RNA, 22 nt, Vaccinia virus
auaacgaguacauucugcaaua

SEQ ID NO: 4060470 - RNA, 16 nt, Vaccinia virus
auaacgauaacgauau

SEQ ID NO: 4060471 - RNA, 21 nt, Vaccinia virus
auaacuagcuuaaacagauga

SEQ ID NO: 4060472 - RNA, 15 nt, Vaccinia virus
auaacuauguuuuaa

SEQ ID NO: 4060473 - RNA, 16 nt, Vaccinia virus
auaacucuucgucaaa

SEQ ID NO: 4060474 - RNA, 19 nt, Vaccinia virus
auaacuucuagauguagaa

SEQ ID NO: 4060475 - RNA, 16 nt, Vaccinia virus
auaagaaauauauacu

SEQ ID NO: 4060476 - RNA, 14 nt, Vaccinia virus
auaagaauaaagua

SEQ ID NO: 4060477 - RNA, 14 nt, Vaccinia virus
auaagacuuuacuu

SEQ ID NO: 4060478 - RNA, 22 nt, Vaccinia virus
auaagaguguaguaucauagau

SEQ ID NO: 4060479 - RNA, 13 nt, Vaccinia virus
auaagauaucuuc

SEQ ID NO: 4060480 - RNA, 23 nt, Vaccinia virus
auaagaugacuguagaacucaug

SEQ ID NO: 4060481 - RNA, 15 nt, Vaccinia virus
auaagauuaguaaca

SEQ ID NO: 4060482 - RNA, 23 nt, Vaccinia virus
auaagcuauaauaauaaauguau

SEQ ID NO: 4060483 - RNA, 13 nt, Vaccinia virus
auaaguaguaaua

SEQ ID NO: 4060484 - RNA, 15 nt, Vaccinia virus
auaaguuucauagau

SEQ ID NO: 4060485 - RNA, 15 nt, Vaccinia virus
auaauaaaucaaaau

SEQ ID NO: 4060486 - RNA, 16 nt, Vaccinia virus
auaauaaccagaaagu

SEQ ID NO: 4060487 - RNA, 14 nt, Vaccinia virus
auaauaauaaaugu

SEQ ID NO: 4060488 - RNA, 17 nt, Vaccinia virus
auaauaauccagaaugu

SEQ ID NO: 4060489 - RNA, 19 nt, Vaccinia virus
auaauaaucucgucgaugu

SEQ ID NO: 4060490 - RNA, 16 nt, Vaccinia virus
auaauacaaaugacua

SEQ ID NO: 4060491 - RNA, 19 nt, Vaccinia virus
auaauacggacuucauaau

SEQ ID NO: 4060492 - RNA, 18 nt, Vaccinia virus
auaauagauuuaucuagu

SEQ ID NO: 4060493 - RNA, 17 nt, Vaccinia virus
auaauagccaaucgauu

SEQ ID NO: 4060494 - RNA, 21 nt, Vaccinia virus
auaauaggagguaaugauaug

SEQ ID NO: 4060495 - RNA, 16 nt, Vaccinia virus
auaauaggauaagacu

SEQ ID NO: 4060496 - RNA, 16 nt, Vaccinia virus
auaauaggguaucuaa

SEQ ID NO: 4060497 - RNA, 20 nt, Vaccinia virus
auaauaguacgacuuuaaau

SEQ ID NO: 4060498 - RNA, 16 nt, Vaccinia virus
auaauauaucaaacau

SEQ ID NO: 4060499 - RNA, 22 nt, Vaccinia virus
auaauaucggucuuauucuuaa

SEQ ID NO: 4060500 - RNA, 13 nt, Vaccinia virus
auaauaucuauau

SEQ ID NO: 4060501 - RNA, 14 nt, Vaccinia virus
auaauauuaaauau

SEQ ID NO: 4060502 - RNA, 19 nt, Vaccinia virus
auaauauuuuaauagauua

SEQ ID NO: 4060503 - RNA, 19 nt, Vaccinia virus
auaaucaaaauugucuaug

SEQ ID NO: 4060504 - RNA, 22 nt, Vaccinia virus
auaaucaaaauugucuaugaug

SEQ ID NO: 4060505 - RNA, 16 nt, Vaccinia virus
auaaucaauguuguaa

SEQ ID NO: 4060506 - RNA, 14 nt, Vaccinia virus
auaaucauucuuaa

SEQ ID NO: 4060507 - RNA, 18 nt, Vaccinia virus
auaaucuaaaauaguucu

SEQ ID NO: 4060508 - RNA, 14 nt, Vaccinia virus
auaaugaucauaua

SEQ ID NO: 4060509 - RNA, 15 nt, Vaccinia virus
auaaugaucauauag

SEQ ID NO: 4060510 - RNA, 17 nt, Vaccinia virus
auaauguagaagaucau

SEQ ID NO: 4060511 - RNA, 16 nt, Vaccinia virus
auaaugucaugucuag

SEQ ID NO: 4060512 - RNA, 13 nt, Vaccinia virus
auaauuaauacaa

SEQ ID NO: 4060513 - RNA, 14 nt, Vaccinia virus
auaauuauaagacu

SEQ ID NO: 4060514 - RNA, 15 nt, Vaccinia virus
auaauuauuagaaua

SEQ ID NO: 4060515 - RNA, 18 nt, Vaccinia virus
aggguaucuaauuuccug

SEQ ID NO: 4060516 - RNA, 22 nt, Vaccinia virus
agguacauggucuagauguaaa

SEQ ID NO: 4060517 - RNA, 19 nt, Vaccinia virus
agguacuauaauauuaaaa

SEQ ID NO: 4060518 - RNA, 16 nt, Vaccinia virus
aggucagaaaaaauuu

SEQ ID NO: 4060519 - RNA, 20 nt, Vaccinia virus
aggucuaccgcauacgaaau

SEQ ID NO: 4060520 - RNA, 21 nt, Vaccinia virus
aggucuauuaggccucagaau

SEQ ID NO: 4060521 - RNA, 19 nt, Vaccinia virus
agguguguuuuuuaccauu

SEQ ID NO: 4060522 - RNA, 23 nt, Vaccinia virus
agguguuccggagaaucaguaaa

SEQ ID NO: 4060523 - RNA, 16 nt, Vaccinia virus
agguuaaauagaaugc

SEQ ID NO: 4060524 - RNA, 15 nt, Vaccinia virus
agguuuaguaucuca

SEQ ID NO: 4060525 - RNA, 19 nt, Vaccinia virus
agguuuauauauucaauau

SEQ ID NO: 4060526 - RNA, 22 nt, Vaccinia virus
agguuuugcaacauguuaaaau

SEQ ID NO: 4060527 - RNA, 20 nt, Vaccinia virus
aguaaacauaucauaauauu

SEQ ID NO: 4060528 - RNA, 22 nt, Vaccinia virus
aguaaacuugacuaaaucuuaa

SEQ ID NO: 4060529 - RNA, 19 nt, Vaccinia virus
aguaaagauuucaaagaug

SEQ ID NO: 4060530 - RNA, 16 nt, Vaccinia virus
aguaaagucaggacug

SEQ ID NO: 4060531 - RNA, 16 nt, Vaccinia virus
aguaaauaauaaaaca

SEQ ID NO: 4060532 - RNA, 20 nt, Vaccinia virus
aguaacagucugaacgcauu

SEQ ID NO: 4060533 - RNA, 15 nt, Vaccinia virus
aguaaguaugauauc

SEQ ID NO: 4060534 - RNA, 17 nt, Vaccinia virus
aguaaguuuaugauggu

SEQ ID NO: 4060535 - RNA, 17 nt, Vaccinia virus
aguaauaucaugucuaa

SEQ ID NO: 4060536 - RNA, 20 nt, Vaccinia virus
aguaaucauauaaauguuua

SEQ ID NO: 4060537 - RNA, 22 nt, Vaccinia virus
aguacccacugaugagauguua

SEQ ID NO: 4060538 - RNA, 23 nt, Vaccinia virus
aguacgaugcaaugaguaagaca

SEQ ID NO: 4060539 - RNA, 22 nt, Vaccinia virus
aguacucucucauaaaguggau

SEQ ID NO: 4060540 - RNA, 13 nt, Vaccinia virus
aguacuuaaugaa

SEQ ID NO: 4060541 - RNA, 15 nt, Vaccinia virus
aguacuuguacacau

SEQ ID NO: 4060542 - RNA, 21 nt, Vaccinia virus
aguacuuugaugauuuuucca

SEQ ID NO: 4060543 - RNA, 14 nt, Vaccinia virus
aguagaaaauaaua

SEQ ID NO: 4060544 - RNA, 22 nt, Vaccinia virus
aguagaaaauacaacggauauc

SEQ ID NO: 4060545 - RNA, 22 nt, Vaccinia virus
aguagagauucggguacuguau

SEQ ID NO: 4060546 - RNA, 17 nt, Vaccinia virus
aguagauacauaucaau

SEQ ID NO: 4060547 - RNA, 22 nt, Vaccinia virus
aguagauacauaucaauaucau

SEQ ID NO: 4060548 - RNA, 15 nt, Vaccinia virus
aguagauuuaauagu

SEQ ID NO: 4060549 - RNA, 15 nt, Vaccinia virus
aguaguucaacauaa

SEQ ID NO: 4060550 - RNA, 17 nt, Vaccinia virus
aguaguuuaugauaaag

SEQ ID NO: 4060551 - RNA, 13 nt, Vaccinia virus
aguauaauguaaa

SEQ ID NO: 4060552 - RNA, 22 nt, Vaccinia virus
aguauaccaugaccuucuucau

SEQ ID NO: 4060553 - RNA, 18 nt, Vaccinia virus
aguauacuaucgucauuu

SEQ ID NO: 4060554 - RNA, 21 nt, Vaccinia virus
aguauauauaaguuauugcau

SEQ ID NO: 4060555 - RNA, 19 nt, Vaccinia virus
aguauaugggcgauauucu

SEQ ID NO: 4060556 - RNA, 23 nt, Vaccinia virus
aguaucaagauguaaaauacuua

SEQ ID NO: 4060557 - RNA, 21 nt, Vaccinia virus
aguaugaagaccuauuaauaa

SEQ ID NO: 4060558 - RNA, 19 nt, Vaccinia virus
aguaugaaguugaacuaau

SEQ ID NO: 4060559 - RNA, 21 nt, Vaccinia virus
aguaugacauuguaaaagaca

SEQ ID NO: 4060560 - RNA, 14 nt, Vaccinia virus
aguaugcaauauau

SEQ ID NO: 4060561 - RNA, 15 nt, Vaccinia virus
aguauguaaaaaugu

SEQ ID NO: 4060562 - RNA, 13 nt, Vaccinia virus
aguauguaacaga

SEQ ID NO: 4060563 - RNA, 16 nt, Vaccinia virus
aguauguuuaauauga

SEQ ID NO: 4060564 - RNA, 14 nt, Vaccinia virus
aguauuaaauauua

SEQ ID NO: 4060565 - RNA, 21 nt, Vaccinia virus
aguauuaaauauuaauaagaa

SEQ ID NO: 4060566 - RNA, 22 nt, Vaccinia virus
aguauuaaccaugaaagaaaga

SEQ ID NO: 4060567 - RNA, 18 nt, Vaccinia virus
aguauuagucauaaacuu

SEQ ID NO: 4060568 - RNA, 13 nt, Vaccinia virus
aguauuaucaaag

SEQ ID NO: 4060569 - RNA, 19 nt, Vaccinia virus
aguauucgccccaaaggau

SEQ ID NO: 4060570 - RNA, 16 nt, Vaccinia virus
aguauugaaacuauau

SEQ ID NO: 4060571 - RNA, 16 nt, Vaccinia virus
aguauuucuuacucaa

SEQ ID NO: 4060572 - RNA, 12 nt, Vaccinia virus
aguauuuucuau

SEQ ID NO: 4060573 - RNA, 19 nt, Vaccinia virus
aguauuuuuacaaaaaugu

SEQ ID NO: 4060574 - RNA, 19 nt, Vaccinia virus
agucacugccguucuaaug

SEQ ID NO: 4060575 - RNA, 19 nt, Vaccinia virus
agucagaggaacauuaaac

SEQ ID NO: 4060576 - RNA, 23 nt, Vaccinia virus
agucagcuggucuaaaauuucca

SEQ ID NO: 4060577 - RNA, 17 nt, Vaccinia virus
agucauagaaaaauaua

SEQ ID NO: 4060578 - RNA, 17 nt, Vaccinia virus
agucauguuaaaaauga

SEQ ID NO: 4060579 - RNA, 13 nt, Vaccinia virus
agucauuguuuua

SEQ ID NO: 4060580 - RNA, 15 nt, Vaccinia virus
agucgguauuucauc

SEQ ID NO: 4060581 - RNA, 18 nt, Vaccinia virus
agucguuuauuaucuugu

SEQ ID NO: 4060582 - RNA, 17 nt, Vaccinia virus
agucuacugcuagaaaa

SEQ ID NO: 4060583 - RNA, 19 nt, Vaccinia virus
agucuagguucacaaugaa

SEQ ID NO: 4060584 - RNA, 22 nt, Vaccinia virus
agucuaucgccuuagauacuuu

SEQ ID NO: 4060585 - RNA, 17 nt, Vaccinia virus
agucuccagaaaucugu

SEQ ID NO: 4060586 - RNA, 15 nt, Vaccinia virus
agucucuugguuuua

SEQ ID NO: 4060587 - RNA, 16 nt, Vaccinia virus
agugaaaaguucacau

SEQ ID NO: 4060588 - RNA, 19 nt, Vaccinia virus
agugaaauguugucauuau

SEQ ID NO: 4060589 - RNA, 23 nt, Vaccinia virus
agugaauauaucauuaggauuua

SEQ ID NO: 4060590 - RNA, 15 nt, Vaccinia virus
agugacaaaaugcua

SEQ ID NO: 4060591 - RNA, 19 nt, Vaccinia virus
agugacaacaaaaaaugaa

SEQ ID NO: 4060592 - RNA, 21 nt, Vaccinia virus
agugauaaguaauaacuaugu

SEQ ID NO: 4060593 - RNA, 16 nt, Vaccinia virus
agugauaugaacauau

SEQ ID NO: 4060594 - RNA, 22 nt, Vaccinia virus
agugaugauaacacauauucau

SEQ ID NO: 4060595 - RNA, 15 nt, Vaccinia virus
agugcaaugaauauc

SEQ ID NO: 4060596 - RNA, 15 nt, Vaccinia virus
agugcacguuuacau

SEQ ID NO: 4060597 - RNA, 20 nt, Vaccinia virus
agugcacucucuaccacaau

SEQ ID NO: 4060598 - RNA, 21 nt, Vaccinia virus
agugcuauggaacaaaacaau

SEQ ID NO: 4060599 - RNA, 13 nt, Vaccinia virus
agugcuucuucuu

SEQ ID NO: 4060600 - RNA, 14 nt, Vaccinia virus
aguggaguaauuua

SEQ ID NO: 4060601 - RNA, 14 nt, Vaccinia virus
aguggauucuucua

SEQ ID NO: 4060602 - RNA, 23 nt, Vaccinia virus
agugguaggucauacuccaucaa

SEQ ID NO: 4060603 - RNA, 20 nt, Vaccinia virus
agugguauauaauccaucaa

SEQ ID NO: 4060604 - RNA, 15 nt, Vaccinia virus
agugguauaucuugu

SEQ ID NO: 4060605 - RNA, 15 nt, Vaccinia virus
aguguagauaugaua

SEQ ID NO: 4060606 - RNA, 16 nt, Vaccinia virus
agugucuauaaaugua

SEQ ID NO: 4060607 - RNA, 23 nt, Vaccinia virus
agugugaauaugaucuucaucua

SEQ ID NO: 4060608 - RNA, 16 nt, Vaccinia virus
aguguuauaaauggau

SEQ ID NO: 4060609 - RNA, 24 nt, Vaccinia virus
aguguuuagcguggcuagaauagu

SEQ ID NO: 4060610 - RNA, 16 nt, Vaccinia virus
aguuaaggauaauaag

SEQ ID NO: 4060611 - RNA, 14 nt, Vaccinia virus
aguuaauaaaaucu

SEQ ID NO: 4060612 - RNA, 17 nt, Vaccinia virus
aguuaauauuauugggu

SEQ ID NO: 4060613 - RNA, 17 nt, Vaccinia virus
aguuaauggagaaauac

SEQ ID NO: 4060614 - RNA, 22 nt, Vaccinia virus
aguuacucuuggucuaauacug

SEQ ID NO: 4060615 - RNA, 15 nt, Vaccinia virus
aguuauaaguuugaa

SEQ ID NO: 4060616 - RNA, 13 nt, Vaccinia virus
aguuauauauacu

SEQ ID NO: 4060617 - RNA, 13 nt, Vaccinia virus
aguuauaugaaua

SEQ ID NO: 4060618 - RNA, 15 nt, Vaccinia virus
aguuaucaaguuugu

SEQ ID NO: 4060619 - RNA, 17 nt, Vaccinia virus
aguuaucccacuagaga

SEQ ID NO: 4060620 - RNA, 18 nt, Vaccinia virus
aguuaucuaucuuaaaaa

SEQ ID NO: 4060621 - RNA, 22 nt, Vaccinia virus
aguuaucugguaaguucauuau

SEQ ID NO: 4060622 - RNA, 20 nt, Vaccinia virus
aguucaccaaacaacuuuua

SEQ ID NO: 4060623 - RNA, 11 nt, Vaccinia virus
aguucaguuuu

SEQ ID NO: 4060624 - RNA, 17 nt, Vaccinia virus
aguucauaaaaauaaua

SEQ ID NO: 4060625 - RNA, 13 nt, Vaccinia virus
agauauacgcuau

SEQ ID NO: 4060626 - RNA, 15 nt, Vaccinia virus
agauauacuacuucu

SEQ ID NO: 4060627 - RNA, 18 nt, Vaccinia virus
agauauagaagauaaaca

SEQ ID NO: 4060628 - RNA, 14 nt, Vaccinia virus
agauauagauguua

SEQ ID NO: 4060629 - RNA, 15 nt, Vaccinia virus
agauauauuauaauu

SEQ ID NO: 4060630 - RNA, 13 nt, Vaccinia virus
agauauauuggag

SEQ ID NO: 4060631 - RNA, 15 nt, Vaccinia virus
agauauccagaguuu

SEQ ID NO: 4060632 - RNA, 19 nt, Vaccinia virus
agauaucgacgguauguau

SEQ ID NO: 4060633 - RNA, 20 nt, Vaccinia virus
agauaucgccuuuauuucca

SEQ ID NO: 4060634 - RNA, 15 nt, Vaccinia virus
agauaucuauacuua

SEQ ID NO: 4060635 - RNA, 14 nt, Vaccinia virus
agauaucuucucaa

SEQ ID NO: 4060636 - RNA, 21 nt, Vaccinia virus
agauaugaauuugauaagacu

SEQ ID NO: 4060637 - RNA, 18 nt, Vaccinia virus
agauaugccagaacuauu

SEQ ID NO: 4060638 - RNA, 20 nt, Vaccinia virus
agauaugugauaaaaaucgu

SEQ ID NO: 4060639 - RNA, 19 nt, Vaccinia virus
agauauguuuagagaaugc

SEQ ID NO: 4060640 - RNA, 23 nt, Vaccinia virus
agauauuagucaaggaugugauu

SEQ ID NO: 4060641 - RNA, 23 nt, Vaccinia virus
agauauuauacaaaauacuauau

SEQ ID NO: 4060642 - RNA, 19 nt, Vaccinia virus
agauauuccgacaaaggau

SEQ ID NO: 4060643 - RNA, 19 nt, Vaccinia virus
agauauuuggcuaaacuau

SEQ ID NO: 4060644 - RNA, 16 nt, Vaccinia virus
agaucaaaacaaaauu

SEQ ID NO: 4060645 - RNA, 17 nt, Vaccinia virus
agaucaucaaaauaugu

SEQ ID NO: 4060646 - RNA, 13 nt, Vaccinia virus
agaucauuaaaug

SEQ ID NO: 4060647 - RNA, 17 nt, Vaccinia virus
agaucauuugaaauuau

SEQ ID NO: 4060648 - RNA, 19 nt, Vaccinia virus
agauccaaagaagauguuc

SEQ ID NO: 4060649 - RNA, 13 nt, Vaccinia virus
agaucccacauca

SEQ ID NO: 4060650 - RNA, 15 nt, Vaccinia virus
agaucgauagacacu

SEQ ID NO: 4060651 - RNA, 22 nt, Vaccinia virus
agaucugauaauauuaaaaagu

SEQ ID NO: 4060652 - RNA, 16 nt, Vaccinia virus
agaucuuaagaaaauu

SEQ ID NO: 4060653 - RNA, 18 nt, Vaccinia virus
agaucuucguuaaaaagu

SEQ ID NO: 4060654 - RNA, 13 nt, Vaccinia virus
agaugaaaaaugg

SEQ ID NO: 4060655 - RNA, 15 nt, Vaccinia virus
agaugaaauagcguu

SEQ ID NO: 4060656 - RNA, 19 nt, Vaccinia virus
agaugaggauagcaaaaua

SEQ ID NO: 4060657 - RNA, 18 nt, Vaccinia virus
agaugauguuaacuaugu

SEQ ID NO: 4060658 - RNA, 19 nt, Vaccinia virus
agaugauucgauaaauaga

SEQ ID NO: 4060659 - RNA, 18 nt, Vaccinia virus
agaugccaagauaucuau

SEQ ID NO: 4060660 - RNA, 21 nt, Vaccinia virus
agaugccaagauaucuauaua

SEQ ID NO: 4060661 - RNA, 13 nt, Vaccinia virus
agaugccauauca

SEQ ID NO: 4060662 - RNA, 19 nt, Vaccinia virus
agaugcuauaucaaaauau

SEQ ID NO: 4060663 - RNA, 17 nt, Vaccinia virus
agaugcugcuccuggau

SEQ ID NO: 4060664 - RNA, 14 nt, Vaccinia virus
agauguaaauauau

SEQ ID NO: 4060665 - RNA, 14 nt, Vaccinia virus
agauguauacuccu

SEQ ID NO: 4060666 - RNA, 12 nt, Vaccinia virus
agaugucauuau

SEQ ID NO: 4060667 - RNA, 22 nt, Vaccinia virus
agaugucguuagaaucauuuau

SEQ ID NO: 4060668 - RNA, 16 nt, Vaccinia virus
agauguguauguuugu

SEQ ID NO: 4060669 - RNA, 21 nt, Vaccinia virus
agauuaaaauuaacaaaauua

SEQ ID NO: 4060670 - RNA, 24 nt, Vaccinia virus
agauuaucuaguuagaacuaucau

SEQ ID NO: 4060671 - RNA, 17 nt, Vaccinia virus
agauuauggagcaaaca

SEQ ID NO: 4060672 - RNA, 20 nt, Vaccinia virus
agauucagaauuucuacaua

SEQ ID NO: 4060673 - RNA, 14 nt, Vaccinia virus
agauucccaaauaa

SEQ ID NO: 4060674 - RNA, 21 nt, Vaccinia virus
agauuccuucuacugcagcaa

SEQ ID NO: 4060675 - RNA, 20 nt, Vaccinia virus
agauucuggaggagauggau

SEQ ID NO: 4060676 - RNA, 15 nt, Vaccinia virus
agauugaaauuauau

SEQ ID NO: 4060677 - RNA, 19 nt, Vaccinia virus
agauugaaugccauuuacg

SEQ ID NO: 4060678 - RNA, 13 nt, Vaccinia virus
agauuguacuucu

SEQ ID NO: 4060679 - RNA, 22 nt, Vaccinia virus
agauuguuuaagaagagaauua

SEQ ID NO: 4060680 - RNA, 20 nt, Vaccinia virus
agauuuauugaaaaugugua

SEQ ID NO: 4060681 - RNA, 22 nt, Vaccinia virus
agauuugcauuucuauacuugu

SEQ ID NO: 4060682 - RNA, 19 nt, Vaccinia virus
agauuugccauauauggau

SEQ ID NO: 4060683 - RNA, 23 nt, Vaccinia virus
agauuuuccauccacaauuauug

SEQ ID NO: 4060684 - RNA, 18 nt, Vaccinia virus
agauuuuggugaaauuau

SEQ ID NO: 4060685 - RNA, 15 nt, Vaccinia virus
agcaaaacaaaauua

SEQ ID NO: 4060686 - RNA, 16 nt, Vaccinia virus
agcaagagaaucauca

SEQ ID NO: 4060687 - RNA, 15 nt, Vaccinia virus
agcaauaguauaauu

SEQ ID NO: 4060688 - RNA, 16 nt, Vaccinia virus
agcacaagauuuccaa

SEQ ID NO: 4060689 - RNA, 15 nt, Vaccinia virus
agcacaucaaaugau

SEQ ID NO: 4060690 - RNA, 22 nt, Vaccinia virus
agcacgaucgugguuaacaaua

SEQ ID NO: 4060691 - RNA, 17 nt, Vaccinia virus
agcacuguggaugugac

SEQ ID NO: 4060692 - RNA, 13 nt, Vaccinia virus
agcagcgauuuug

SEQ ID NO: 4060693 - RNA, 13 nt, Vaccinia virus
agcaguuuauuau

SEQ ID NO: 4060694 - RNA, 16 nt, Vaccinia virus
agcaguuuauuaucca

SEQ ID NO: 4060695 - RNA, 19 nt, Vaccinia virus
agcauaaacauaauaaaca

SEQ ID NO: 4060696 - RNA, 19 nt, Vaccinia virus
agcauacgaauuacaauaa

SEQ ID NO: 4060697 - RNA, 12 nt, Vaccinia virus
agcauacucuau

SEQ ID NO: 4060698 - RNA, 13 nt, Vaccinia virus
agcauauaacuaa

SEQ ID NO: 4060699 - RNA, 12 nt, Vaccinia virus
agcauauguuua

SEQ ID NO: 4060700 - RNA, 11 nt, Vaccinia virus
agcauauuaaa

SEQ ID NO: 4060701 - RNA, 19 nt, Vaccinia virus
agcaucagcaaaacaguua

SEQ ID NO: 4060702 - RNA, 16 nt, Vaccinia virus
agcauccaguaugaau

SEQ ID NO: 4060703 - RNA, 23 nt, Vaccinia virus
agcauccuauucgaauaaugagu

SEQ ID NO: 4060704 - RNA, 11 nt, Vaccinia virus
agcauguagac

SEQ ID NO: 4060705 - RNA, 15 nt, Vaccinia virus
agcauuuuuauaauu

SEQ ID NO: 4060706 - RNA, 15 nt, Vaccinia virus
agccaauacuuuaac

SEQ ID NO: 4060707 - RNA, 22 nt, Vaccinia virus
agccaaucaaaaagauuagaca

SEQ ID NO: 4060708 - RNA, 22 nt, Vaccinia virus
agccauguugauaaacuacuua

SEQ ID NO: 4060709 - RNA, 14 nt, Vaccinia virus
agccuagaaaucaa

SEQ ID NO: 4060710 - RNA, 20 nt, Vaccinia virus
agccugaagcucaucuuguu

SEQ ID NO: 4060711 - RNA, 21 nt, Vaccinia virus
agccugaguaguuggaagaau

SEQ ID NO: 4060712 - RNA, 21 nt, Vaccinia virus
agcgaugauauguuaaauaua

SEQ ID NO: 4060713 - RNA, 16 nt, Vaccinia virus
agcgcuuccuaaauaa

SEQ ID NO: 4060714 - RNA, 15 nt, Vaccinia virus
agcguaucuauaauu

SEQ ID NO: 4060715 - RNA, 19 nt, Vaccinia virus
agcguuaacuaucaaacaa

SEQ ID NO: 4060716 - RNA, 18 nt, Vaccinia virus
agcuaaagacucuaaaug

SEQ ID NO: 4060717 - RNA, 21 nt, Vaccinia virus
agcuagagugauaauuucguu

SEQ ID NO: 4060718 - RNA, 15 nt, Vaccinia virus
agcuauauagaugac

SEQ ID NO: 4060719 - RNA, 17 nt, Vaccinia virus
agcuaucaagucuuuau

SEQ ID NO: 4060720 - RNA, 14 nt, Vaccinia virus
agcuaugaacuugu

SEQ ID NO: 4060721 - RNA, 17 nt, Vaccinia virus
agcuauguuuacugcug

SEQ ID NO: 4060722 - RNA, 15 nt, Vaccinia virus
agcucaauauaaaug

SEQ ID NO: 4060723 - RNA, 21 nt, Vaccinia virus
agcuccuacaggaauaucuuu

SEQ ID NO: 4060724 - RNA, 13 nt, Vaccinia virus
agcugaaaugaga

SEQ ID NO: 4060725 - RNA, 15 nt, Vaccinia virus
agcuguucaaaauau

SEQ ID NO: 4060726 - RNA, 21 nt, Vaccinia virus
agcuguuccaauaaauuauuu

SEQ ID NO: 4060727 - RNA, 18 nt, Vaccinia virus
agcuuaaacagaugagac

SEQ ID NO: 4060728 - RNA, 21 nt, Vaccinia virus
agcuucaucuauaucuagauu

SEQ ID NO: 4060729 - RNA, 14 nt, Vaccinia virus
agcuuccagauaca

SEQ ID NO: 4060730 - RNA, 16 nt, Vaccinia virus
agcuuccagauuuaaa

SEQ ID NO: 4060731 - RNA, 21 nt, Vaccinia virus
agcuuccagauuuaaaaaggu

SEQ ID NO: 4060732 - RNA, 19 nt, Vaccinia virus
agcuucuccuccuauuugu

SEQ ID NO: 4060733 - RNA, 14 nt, Vaccinia virus
agcuucugaaauaa

SEQ ID NO: 4060734 - RNA, 16 nt, Vaccinia virus
agcuuuacucugaaaa

SEQ ID NO: 4060735 - RNA, 22 nt, Vaccinia virus
agcuuuuguucacaaaaauaca

SEQ ID NO: 4060736 - RNA, 12 nt, Vaccinia virus
aggaaacuauaa

SEQ ID NO: 4060737 - RNA, 12 nt, Vaccinia virus
aggaaauacuug

SEQ ID NO: 4060738 - RNA, 22 nt, Vaccinia virus
aggaaaucccaccgccuuucug

SEQ ID NO: 4060739 - RNA, 12 nt, Vaccinia virus
aggaaugagagu

SEQ ID NO: 4060740 - RNA, 18 nt, Vaccinia virus
aggaaugccacaaaugaa

SEQ ID NO: 4060741 - RNA, 17 nt, Vaccinia virus
aggacagaaaaaugcua

SEQ ID NO: 4060742 - RNA, 22 nt, Vaccinia virus
aggaccacuagcaaaagauaaa

SEQ ID NO: 4060743 - RNA, 13 nt, Vaccinia virus
aggagaaguaaua

SEQ ID NO: 4060744 - RNA, 17 nt, Vaccinia virus
aggagcaccagaaguau

SEQ ID NO: 4060745 - RNA, 19 nt, Vaccinia virus
aggagguauauaucaugau

SEQ ID NO: 4060746 - RNA, 20 nt, Vaccinia virus
aggauaaaaucguuuauccu

SEQ ID NO: 4060747 - RNA, 20 nt, Vaccinia virus
aggauacauaaaauuuaaga

SEQ ID NO: 4060748 - RNA, 21 nt, Vaccinia virus
aggauaccguuaaauauaacu

SEQ ID NO: 4060749 - RNA, 16 nt, Vaccinia virus
aggauacucuaugaau

SEQ ID NO: 4060750 - RNA, 21 nt, Vaccinia virus
aggauaucucaaaaaauaaua

SEQ ID NO: 4060751 - RNA, 23 nt, Vaccinia virus
aggauauuagcgaauauaucaaa

SEQ ID NO: 4060752 - RNA, 14 nt, Vaccinia virus
aaguaccuggaaug

SEQ ID NO: 4060753 - RNA, 22 nt, Vaccinia virus
aaguacuguucaaacaugauga

SEQ ID NO: 4060754 - RNA, 18 nt, Vaccinia virus
aaguaguaauaaugauuc

SEQ ID NO: 4060755 - RNA, 16 nt, Vaccinia virus
aaguaguauaaaagua

SEQ ID NO: 4060756 - RNA, 11 nt, Vaccinia virus
aaguauaacga

SEQ ID NO: 4060757 - RNA, 13 nt, Vaccinia virus
aaguauaauucuu

SEQ ID NO: 4060758 - RNA, 20 nt, Vaccinia virus
aaguauaucgacauacuacu

SEQ ID NO: 4060759 - RNA, 13 nt, Vaccinia virus
aaguaucaaaucu

SEQ ID NO: 4060760 - RNA, 15 nt, Vaccinia virus
aaguauuuauacaaa

SEQ ID NO: 4060761 - RNA, 14 nt, Vaccinia virus
aagucaucaaucau

SEQ ID NO: 4060762 - RNA, 16 nt, Vaccinia virus
aagucaucgucuacaa

SEQ ID NO: 4060763 - RNA, 21 nt, Vaccinia virus
aagucucgcauguucagcaau

SEQ ID NO: 4060764 - RNA, 18 nt, Vaccinia virus
aagugacaacaaaaaaug

SEQ ID NO: 4060765 - RNA, 21 nt, Vaccinia virus
aagugaucucgagaaauaaua

SEQ ID NO: 4060766 - RNA, 17 nt, Vaccinia virus
aagugucgauuguaaua

SEQ ID NO: 4060767 - RNA, 20 nt, Vaccinia virus
aagugugaugauuguacacu

SEQ ID NO: 4060768 - RNA, 22 nt, Vaccinia virus
aaguguguaaccgcguuaaugu

SEQ ID NO: 4060769 - RNA, 11 nt, Vaccinia virus
aaguuaauagc

SEQ ID NO: 4060770 - RNA, 18 nt, Vaccinia virus
aaguuacuuaaaaugguu

SEQ ID NO: 4060771 - RNA, 23 nt, Vaccinia virus
aaguuagaagagucauuaaaaua

SEQ ID NO: 4060772 - RNA, 17 nt, Vaccinia virus
aaguuauagacaaauua

SEQ ID NO: 4060773 - RNA, 22 nt, Vaccinia virus
aaguuauccaaguuaaaggaua

SEQ ID NO: 4060774 - RNA, 21 nt, Vaccinia virus
aaguuaucucuaacaaaacua

SEQ ID NO: 4060775 - RNA, 18 nt, Vaccinia virus
aaguucauaaaaauaaua

SEQ ID NO: 4060776 - RNA, 19 nt, Vaccinia virus
aaguucauuaucugaaaua

SEQ ID NO: 4060777 - RNA, 18 nt, Vaccinia virus
aaguucuggcaauguuuc

SEQ ID NO: 4060778 - RNA, 15 nt, Vaccinia virus
aaguuuaaaaaagac

SEQ ID NO: 4060779 - RNA, 14 nt, Vaccinia virus
aaguuucaaacugu

SEQ ID NO: 4060780 - RNA, 20 nt, Vaccinia virus
aaguuucaaacuguugacuu

SEQ ID NO: 4060781 - RNA, 20 nt, Vaccinia virus
aaguuucauagauagauaau

SEQ ID NO: 4060782 - RNA, 15 nt, Vaccinia virus
aaguuucguacaaau

SEQ ID NO: 4060783 - RNA, 15 nt, Vaccinia virus
aaguuuguaggaaag

SEQ ID NO: 4060784 - RNA, 20 nt, Vaccinia virus
aaguuuuaucuuucucucuu

SEQ ID NO: 4060785 - RNA, 23 nt, Vaccinia virus
aaguuuuucacccauaaauaaua

SEQ ID NO: 4060786 - RNA, 12 nt, Vaccinia virus
aauaaaaacaag

SEQ ID NO: 4060787 - RNA, 14 nt, Vaccinia virus
aauaaaaauguuuu

SEQ ID NO: 4060788 - RNA, 11 nt, Vaccinia virus
aauaaaacaau

SEQ ID NO: 4060789 - RNA, 17 nt, Vaccinia virus
aauaaaagacaaaucuu

SEQ ID NO: 4060790 - RNA, 20 nt, Vaccinia virus
aauaaaauguuaauacauca

SEQ ID NO: 4060791 - RNA, 14 nt, Vaccinia virus
aauaaaauuaucau

SEQ ID NO: 4060792 - RNA, 17 nt, Vaccinia virus
aauaaacaauuucacaa

SEQ ID NO: 4060793 - RNA, 22 nt, Vaccinia virus
aauaaacuccguagagaaauau

SEQ ID NO: 4060794 - RNA, 12 nt, Vaccinia virus
aauaaauacuuu

SEQ ID NO: 4060795 - RNA, 12 nt, Vaccinia virus
aauaaauaugug

SEQ ID NO: 4060796 - RNA, 24 nt, Vaccinia virus
aauaaauguuuugauuucaauuua

SEQ ID NO: 4060797 - RNA, 21 nt, Vaccinia virus
aauaaauuauuuguugugacu

SEQ ID NO: 4060798 - RNA, 15 nt, Vaccinia virus
aauaaauuuuuccaa

SEQ ID NO: 4060799 - RNA, 13 nt, Vaccinia virus
aauaacaggcuaa

SEQ ID NO: 4060800 - RNA, 20 nt, Vaccinia virus
aauaacuauguuuuaaaaau

SEQ ID NO: 4060801 - RNA, 23 nt, Vaccinia virus
aauaacuucgugaauaauguuuc

SEQ ID NO: 4060802 - RNA, 16 nt, Vaccinia virus
aauaaguguagcaaau

SEQ ID NO: 4060803 - RNA, 13 nt, Vaccinia virus
aauaauaaaugua

SEQ ID NO: 4060804 - RNA, 19 nt, Vaccinia virus
aauaauaauuuaacaaucu

SEQ ID NO: 4060805 - RNA, 23 nt, Vaccinia virus
aauaauacaauauuuuucguuua

SEQ ID NO: 4060806 - RNA, 19 nt, Vaccinia virus
aauaauaucuauauuucca

SEQ ID NO: 4060807 - RNA, 23 nt, Vaccinia virus
aauaauauuugagaguauuggua

SEQ ID NO: 4060808 - RNA, 14 nt, Vaccinia virus
aauaaucauacaau

SEQ ID NO: 4060809 - RNA, 15 nt, Vaccinia virus
aauaaucguuauuau

SEQ ID NO: 4060810 - RNA, 15 nt, Vaccinia virus
agacaacgaauacaa

SEQ ID NO: 4060811 - RNA, 21 nt, Vaccinia virus
agacaaguauccguuugauau

SEQ ID NO: 4060812 - RNA, 22 nt, Vaccinia virus
agacaaguauccguuugauauu

SEQ ID NO: 4060813 - RNA, 19 nt, Vaccinia virus
agacaauaacuaacaauua

SEQ ID NO: 4060814 - RNA, 21 nt, Vaccinia virus
agacaaucaucuuggagcaac

SEQ ID NO: 4060815 - RNA, 21 nt, Vaccinia virus
agacacauaugcgaucagaua

SEQ ID NO: 4060816 - RNA, 16 nt, Vaccinia virus
agacacuaacucuguu

SEQ ID NO: 4060817 - RNA, 18 nt, Vaccinia virus
agacagcgugaauaaugu

SEQ ID NO: 4060818 - RNA, 18 nt, Vaccinia virus
agacagugguuucauguu

SEQ ID NO: 4060819 - RNA, 16 nt, Vaccinia virus
agacauaaaaacuaau

SEQ ID NO: 4060820 - RNA, 15 nt, Vaccinia virus
agacauaagaaauuu

SEQ ID NO: 4060821 - RNA, 21 nt, Vaccinia virus
agacauaucgguaaaaugcau

SEQ ID NO: 4060822 - RNA, 17 nt, Vaccinia virus
agacauaugauaaaacg

SEQ ID NO: 4060823 - RNA, 22 nt, Vaccinia virus
agacauuagaccguuuaauaga

SEQ ID NO: 4060824 - RNA, 12 nt, Vaccinia virus
agaccaaaaauu

SEQ ID NO: 4060825 - RNA, 13 nt, Vaccinia virus
agaccaaacaaua

SEQ ID NO: 4060826 - RNA, 21 nt, Vaccinia virus
agaccaagcuucguuguagaa

SEQ ID NO: 4060827 - RNA, 22 nt, Vaccinia virus
agaccaagcuucguuguagaaa

SEQ ID NO: 4060828 - RNA, 14 nt, Vaccinia virus
agaccaauaauaaa

SEQ ID NO: 4060829 - RNA, 16 nt, Vaccinia virus
agaccauuuaauacga

SEQ ID NO: 4060830 - RNA, 15 nt, Vaccinia virus
agacgaauacauaua

SEQ ID NO: 4060831 - RNA, 22 nt, Vaccinia virus
agacgaggagauuuagaaaugu

SEQ ID NO: 4060832 - RNA, 18 nt, Vaccinia virus
agacgauuaguaauauau

SEQ ID NO: 4060833 - RNA, 16 nt, Vaccinia virus
agacguacuccagaua

SEQ ID NO: 4060834 - RNA, 18 nt, Vaccinia virus
agacguggagaucuagaa

SEQ ID NO: 4060835 - RNA, 22 nt, Vaccinia virus
agacguucacgacacuggaaaa

SEQ ID NO: 4060836 - RNA, 13 nt, Vaccinia virus
agacuaacacaca

SEQ ID NO: 4060837 - RNA, 21 nt, Vaccinia virus
agacuaggugcuauggauggg

SEQ ID NO: 4060838 - RNA, 21 nt, Vaccinia virus
agacuauaccuagagcuauuu

SEQ ID NO: 4060839 - RNA, 22 nt, Vaccinia virus
agacugagauacgcaaagaauc

SEQ ID NO: 4060840 - RNA, 17 nt, Vaccinia virus
agacugguagagaauga

SEQ ID NO: 4060841 - RNA, 17 nt, Vaccinia virus
agacuguuuauacaaga

SEQ ID NO: 4060842 - RNA, 15 nt, Vaccinia virus
agacuguuuguagaa

SEQ ID NO: 4060843 - RNA, 14 nt, Vaccinia virus
agacuugugggaaa

SEQ ID NO: 4060844 - RNA, 17 nt, Vaccinia virus
agacuuucgucaauuug

SEQ ID NO: 4060845 - RNA, 15 nt, Vaccinia virus
agagaacaaauaaua

SEQ ID NO: 4060846 - RNA, 20 nt, Vaccinia virus
agagaagcacucguuauuaa

SEQ ID NO: 4060847 - RNA, 21 nt, Vaccinia virus
agagaagucgucaagcauauu

SEQ ID NO: 4060848 - RNA, 13 nt, Vaccinia virus
agagaauacgcau

SEQ ID NO: 4060849 - RNA, 12 nt, Vaccinia virus
agagaauauacu

SEQ ID NO: 4060850 - RNA, 13 nt, Vaccinia virus
agagaaugauaua

SEQ ID NO: 4060851 - RNA, 21 nt, Vaccinia virus
agagaauugcugcaauauauu

SEQ ID NO: 4060852 - RNA, 14 nt, Vaccinia virus
agagacaaugaaaa

SEQ ID NO: 4060853 - RNA, 15 nt, Vaccinia virus
agagacggaaauagu

SEQ ID NO: 4060854 - RNA, 17 nt, Vaccinia virus
agagacgucauacucuu

SEQ ID NO: 4060855 - RNA, 21 nt, Vaccinia virus
agagauaauauagagguguuu

SEQ ID NO: 4060856 - RNA, 19 nt, Vaccinia virus
agagaucaacgaaaaggaa

SEQ ID NO: 4060857 - RNA, 23 nt, Vaccinia virus
agagauccacugucacuggaaag

SEQ ID NO: 4060858 - RNA, 23 nt, Vaccinia virus
agagaucuacuggcgaaauggua

SEQ ID NO: 4060859 - RNA, 14 nt, Vaccinia virus
agagaugaaaaauu

SEQ ID NO: 4060860 - RNA, 16 nt, Vaccinia virus
agagauuguuaaauua

SEQ ID NO: 4060861 - RNA, 19 nt, Vaccinia virus
agagauuuaacuguucauc

SEQ ID NO: 4060862 - RNA, 15 nt, Vaccinia virus
agagcagcacaaacu

SEQ ID NO: 4060863 - RNA, 18 nt, Vaccinia virus
agagcuuuauuaacuucu

SEQ ID NO: 4060864 - RNA, 22 nt, Vaccinia virus
agaggaaacauggggauugaaa

SEQ ID NO: 4060865 - RNA, 21 nt, Vaccinia virus
agaggaugaaauagauagaau

SEQ ID NO: 4060866 - RNA, 13 nt, Vaccinia virus
agaggauugaugg

SEQ ID NO: 4060867 - RNA, 14 nt, Vaccinia virus
agaggauuuucuag

SEQ ID NO: 4060868 - RNA, 14 nt, Vaccinia virus
agagguaaugaugu

SEQ ID NO: 4060869 - RNA, 21 nt, Vaccinia virus
agaguaaacggcugaacuugu

SEQ ID NO: 4060870 - RNA, 17 nt, Vaccinia virus
agaguagauauuaaugu

SEQ ID NO: 4060871 - RNA, 16 nt, Vaccinia virus
agaguaguauauuguc

SEQ ID NO: 4060872 - RNA, 21 nt, Vaccinia virus
agaguauaaaacauuaaaugu

SEQ ID NO: 4060873 - RNA, 19 nt, Vaccinia virus
agaguaugacgucucucaa

SEQ ID NO: 4060874 - RNA, 18 nt, Vaccinia virus
agagugagucuagaauuc

SEQ ID NO: 4060875 - RNA, 18 nt, Vaccinia virus
agaguguucgaaugccaa

SEQ ID NO: 4060876 - RNA, 13 nt, Vaccinia virus
agaguucauuuau

SEQ ID NO: 4060877 - RNA, 23 nt, Vaccinia virus
agaguucuuacacauaucacugu

SEQ ID NO: 4060878 - RNA, 19 nt, Vaccinia virus
agaguugauuguaaauaca

SEQ ID NO: 4060879 - RNA, 15 nt, Vaccinia virus
agaguuuuauaacga

SEQ ID NO: 4060880 - RNA, 20 nt, Vaccinia virus
agauaaaccguuuauguauu

SEQ ID NO: 4060881 - RNA, 13 nt, Vaccinia virus
agauaaacuuuau

SEQ ID NO: 4060882 - RNA, 18 nt, Vaccinia virus
agauaaacuuuauguauu

SEQ ID NO: 4060883 - RNA, 16 nt, Vaccinia virus
agauaaaguuuauaca

SEQ ID NO: 4060884 - RNA, 12 nt, Vaccinia virus
agauaaauaugg

SEQ ID NO: 4060885 - RNA, 12 nt, Vaccinia virus
agauaaaugguc

SEQ ID NO: 4060886 - RNA, 21 nt, Vaccinia virus
agauaaugauauauuaaacaa

SEQ ID NO: 4060887 - RNA, 14 nt, Vaccinia virus
agauacaaauaugu

SEQ ID NO: 4060888 - RNA, 17 nt, Vaccinia virus
agauacaaauuuuaaga

SEQ ID NO: 4060889 - RNA, 15 nt, Vaccinia virus
agauacagauguaaa

SEQ ID NO: 4060890 - RNA, 14 nt, Vaccinia virus
agauacagauguua

SEQ ID NO: 4060891 - RNA, 17 nt, Vaccinia virus
agauaccaacauuaaaa

SEQ ID NO: 4060892 - RNA, 21 nt, Vaccinia virus
agauaccucaccgaguuaaaa

SEQ ID NO: 4060893 - RNA, 16 nt, Vaccinia virus
agauacguauuagaua

SEQ ID NO: 4060894 - RNA, 19 nt, Vaccinia virus
agauacgugauuaauacau

SEQ ID NO: 4060895 - RNA, 19 nt, Vaccinia virus
agauacuacagaaacuaau

SEQ ID NO: 4060896 - RNA, 16 nt, Vaccinia virus
agauacuauauuuguu

SEQ ID NO: 4060897 - RNA, 15 nt, Vaccinia virus
agauacuuuaauaca

SEQ ID NO: 4060898 - RNA, 19 nt, Vaccinia virus
agauacuuuauuacuccau

SEQ ID NO: 4060899 - RNA, 20 nt, Vaccinia virus
agauacuuuauuacuccauu

SEQ ID NO: 4060900 - RNA, 15 nt, Vaccinia virus
agauagaaacuauag

SEQ ID NO: 4060901 - RNA, 15 nt, Vaccinia virus
agauagaaaugaauu

SEQ ID NO: 4060902 - RNA, 18 nt, Vaccinia virus
agauagcuucaucuauau

SEQ ID NO: 4060903 - RNA, 17 nt, Vaccinia virus
agauaggacgguauaug

SEQ ID NO: 4060904 - RNA, 16 nt, Vaccinia virus
agauaguaaauagaua

SEQ ID NO: 4060905 - RNA, 13 nt, Vaccinia virus
aaaagaauugcuu

SEQ ID NO: 4060906 - RNA, 15 nt, Vaccinia virus
aaaagaccaauaaua

SEQ ID NO: 4060907 - RNA, 21 nt, Vaccinia virus
aaaagacgucacuauuaccaa

SEQ ID NO: 4060908 - RNA, 13 nt, Vaccinia virus
aaaagauaauaca

SEQ ID NO: 4060909 - RNA, 13 nt, Vaccinia virus
aaaagauacguac

SEQ ID NO: 4060910 - RNA, 22 nt, Vaccinia virus
aaaagauggaggauaugguggu

SEQ ID NO: 4060911 - RNA, 14 nt, Vaccinia virus
aaaagauuauacaa

SEQ ID NO: 4060912 - RNA, 12 nt, Vaccinia virus
aaaaggaaaaua

SEQ ID NO: 4060913 - RNA, 21 nt, Vaccinia virus
aaaagguauuacaagaauaua

SEQ ID NO: 4060914 - RNA, 14 nt, Vaccinia virus
aaaaguaaauacug

SEQ ID NO: 4060915 - RNA, 18 nt, Vaccinia virus
aaaaguuccagaaaaugu

SEQ ID NO: 4060916 - RNA, 21 nt, Vaccinia virus
aaaaguuccagaaaauguaga

SEQ ID NO: 4060917 - RNA, 23 nt, Vaccinia virus
aaaaguuuuccaucuauguagaa

SEQ ID NO: 4060918 - RNA, 18 nt, Vaccinia virus
aaaauaaagauaaaaacg

SEQ ID NO: 4060919 - RNA, 23 nt, Vaccinia virus
aaaauacauaugacaaacauugu

SEQ ID NO: 4060920 - RNA, 21 nt, Vaccinia virus
aaaauaccaucaucauagcau

SEQ ID NO: 4060921 - RNA, 13 nt, Vaccinia virus
aaaauacuacugu

SEQ ID NO: 4060922 - RNA, 12 nt, Vaccinia virus
aaaauagcaaag

SEQ ID NO: 4060923 - RNA, 14 nt, Vaccinia virus
aaaauaguucugua

SEQ ID NO: 4060924 - RNA, 16 nt, Vaccinia virus
aaaauauauaguauua

SEQ ID NO: 4060925 - RNA, 13 nt, Vaccinia virus
aaaauauauucua

SEQ ID NO: 4060926 - RNA, 17 nt, Vaccinia virus
aaaauauguaauaauca

SEQ ID NO: 4060927 - RNA, 20 nt, Vaccinia virus
aaaauauuaaaccucuuucu

SEQ ID NO: 4060928 - RNA, 23 nt, Vaccinia virus
aaaaucaggguuaucaaaguguu

SEQ ID NO: 4060929 - RNA, 15 nt, Vaccinia virus
aaaauccuccuauca

SEQ ID NO: 4060930 - RNA, 24 nt, Vaccinia virus
aaaaugaaaauacuuuaguaauua

SEQ ID NO: 4060931 - RNA, 22 nt, Vaccinia virus
aaaaugacaucguugcccggau

SEQ ID NO: 4060932 - RNA, 17 nt, Vaccinia virus
aaaaugcugaagcaaua

SEQ ID NO: 4060933 - RNA, 15 nt, Vaccinia virus
aaaauggauuacuua

SEQ ID NO: 4060934 - RNA, 12 nt, Vaccinia virus
aaaauuagaaag

SEQ ID NO: 4060935 - RNA, 13 nt, Vaccinia virus
aaaauuauaacua

SEQ ID NO: 4060936 - RNA, 21 nt, Vaccinia virus
aaaauuauguuuuuauaucua

SEQ ID NO: 4060937 - RNA, 17 nt, Vaccinia virus
aaaauucuaagguagaa

SEQ ID NO: 4060938 - RNA, 20 nt, Vaccinia virus
aaaauuuaaagaauguauaa

SEQ ID NO: 4060939 - RNA, 14 nt, Vaccinia virus
aaaauuuugaucau

SEQ ID NO: 4060940 - RNA, 13 nt, Vaccinia virus
aaacaaaaaaaag

SEQ ID NO: 4060941 - RNA, 21 nt, Vaccinia virus
aaacaacaaugccauuuuaca

SEQ ID NO: 4060942 - RNA, 16 nt, Vaccinia virus
aaacaacuaaacagua

SEQ ID NO: 4060943 - RNA, 21 nt, Vaccinia virus
aaacaauggucgauuauagaa

SEQ ID NO: 4060944 - RNA, 18 nt, Vaccinia virus
aaacaauguauacaaaug

SEQ ID NO: 4060945 - RNA, 19 nt, Vaccinia virus
aaacaauguauacaaaugu

SEQ ID NO: 4060946 - RNA, 22 nt, Vaccinia virus
aaacaauuucacaaauggaugu

SEQ ID NO: 4060947 - RNA, 13 nt, Vaccinia virus
aaacacauaucca

SEQ ID NO: 4060948 - RNA, 16 nt, Vaccinia virus
aaacacgcuacacaac

SEQ ID NO: 4060949 - RNA, 16 nt, Vaccinia virus
aaacacguuagaguuu

SEQ ID NO: 4060950 - RNA, 18 nt, Vaccinia virus
aaacacugauucagaaau

SEQ ID NO: 4060951 - RNA, 16 nt, Vaccinia virus
aaacauacaucuguuu

SEQ ID NO: 4060952 - RNA, 14 nt, Vaccinia virus
aaacaucauauaca

SEQ ID NO: 4060953 - RNA, 16 nt, Vaccinia virus
aaacaucauugcucca

SEQ ID NO: 4060954 - RNA, 14 nt, Vaccinia virus
aaacauucauguac

SEQ ID NO: 4060955 - RNA, 20 nt, Vaccinia virus
aaaccaacguaggucuaaau

SEQ ID NO: 4060956 - RNA, 20 nt, Vaccinia virus
aaaccaaggacuuuguagaa

SEQ ID NO: 4060957 - RNA, 20 nt, Vaccinia virus
aaaccaggugaguguagaaa

SEQ ID NO: 4060958 - RNA, 16 nt, Vaccinia virus
aaaccaucgucugaau

SEQ ID NO: 4060959 - RNA, 16 nt, Vaccinia virus
aaaccuaaagauguua

SEQ ID NO: 4060960 - RNA, 12 nt, Vaccinia virus
aaacgauuaaac

SEQ ID NO: 4060961 - RNA, 17 nt, Vaccinia virus
aaacuacugauguuauc

SEQ ID NO: 4060962 - RNA, 21 nt, Vaccinia virus
aaacuaggaaucgguaacagu

SEQ ID NO: 4060963 - RNA, 17 nt, Vaccinia virus
aaacuaguucugagaaa

SEQ ID NO: 4060964 - RNA, 12 nt, Vaccinia virus
aaacuauacgaa

SEQ ID NO: 4060965 - RNA, 21 nt, Vaccinia virus
aaacuauuacuaggagaauua

SEQ ID NO: 4060966 - RNA, 18 nt, Vaccinia virus
aaacugaaaauauauuga

SEQ ID NO: 4060967 - RNA, 12 nt, Vaccinia virus
aaacuuacagaa

SEQ ID NO: 4060968 - RNA, 22 nt, Vaccinia virus
aaacuucaaucuguuaagauua

SEQ ID NO: 4060969 - RNA, 17 nt, Vaccinia virus
aaacuucucuaaaugag

SEQ ID NO: 4060970 - RNA, 19 nt, Vaccinia virus
aaacuugauaauuaauaau

SEQ ID NO: 4060971 - RNA, 21 nt, Vaccinia virus
aaacuuuaauaacaaagaaag

SEQ ID NO: 4060972 - RNA, 19 nt, Vaccinia virus
aaacuuuacgauagacuuu

SEQ ID NO: 4060973 - RNA, 13 nt, Vaccinia virus
aaagaauaauccu

SEQ ID NO: 4060974 - RNA, 22 nt, Vaccinia virus
aaagaauuuuuucguguuccaa

SEQ ID NO: 4060975 - RNA, 15 nt, Vaccinia virus
aaagacaaacaaugg

SEQ ID NO: 4060976 - RNA, 14 nt, Vaccinia virus
aaagacaaauauau

SEQ ID NO: 4060977 - RNA, 19 nt, Vaccinia virus
aaagacagcgacaucaaga

SEQ ID NO: 4060978 - RNA, 15 nt, Vaccinia virus
aaagacaucauauau

SEQ ID NO: 4060979 - RNA, 18 nt, Vaccinia virus
aaagaccgaauacauaac

SEQ ID NO: 4060980 - RNA, 15 nt, Vaccinia virus
aaagacgaauacaua

SEQ ID NO: 4060981 - RNA, 24 nt, Vaccinia virus
aaagagaacguauuuauuguuacu

SEQ ID NO: 4060982 - RNA, 14 nt, Vaccinia virus
aaagagaauuauau

SEQ ID NO: 4060983 - RNA, 13 nt, Vaccinia virus
aaagagacuacaa

SEQ ID NO: 4060984 - RNA, 18 nt, Vaccinia virus
aaagaggcugguaacaac

SEQ ID NO: 4060985 - RNA, 22 nt, Vaccinia virus
aaagaguugguaaaauaugaaa

SEQ ID NO: 4060986 - RNA, 13 nt, Vaccinia virus
aaagauaacuauu

SEQ ID NO: 4060987 - RNA, 12 nt, Vaccinia virus
aaagauauuguu

SEQ ID NO: 4060988 - RNA, 15 nt, Vaccinia virus
aaagaugauauaucu

SEQ ID NO: 4060989 - RNA, 24 nt, Vaccinia virus
aaagauuaaaucauuaaaugauug

SEQ ID NO: 4060990 - RNA, 12 nt, Vaccinia virus
aaagauuguaca

SEQ ID NO: 4060991 - RNA, 19 nt, Vaccinia virus
aaagcaauugacuaauaaa

SEQ ID NO: 4060992 - RNA, 15 nt, Vaccinia virus
aaagcauuaauacag

SEQ ID NO: 4060993 - RNA, 23 nt, Vaccinia virus
aaagcuauuaucaaauacuguac

SEQ ID NO: 4060994 - RNA, 17 nt, Vaccinia virus
aaaguauauauaaguua

SEQ ID NO: 4060995 - RNA, 20 nt, Vaccinia virus
aaaguauuuuaauacaugua

SEQ ID NO: 4060996 - RNA, 17 nt, Vaccinia virus
aaagucaucucuuguau

SEQ ID NO: 4060997 - RNA, 18 nt, Vaccinia virus
aaaguuagaugugucaua

SEQ ID NO: 4060998 - RNA, 15 nt, Vaccinia virus
aaaguuaguacagaa

SEQ ID NO: 4060999 - RNA, 21 nt, Vaccinia virus
aaaguuucugaaauaagauua

SEQ ID NO: 4061000 - RNA, 12 nt, Vaccinia virus
aaaguuugagau

SEQ ID NO: 4061001 - RNA, 20 nt, Vaccinia virus
aaaguuuucuuucaaaauag

SEQ ID NO: 4061002 - RNA, 14 nt, Vaccinia virus
aaauaaaacuauag

SEQ ID NO: 4061003 - RNA, 15 nt, Vaccinia virus
aaauaaaaucuauau

SEQ ID NO: 4061004 - RNA, 22 nt, Vaccinia virus
aaauaaaccguuuaauauugau

SEQ ID NO: 4061005 - RNA, 13 nt, Vaccinia virus
aaauaaaguauau

SEQ ID NO: 4061006 - RNA, 11 nt, Vaccinia virus
aaauaaauguc

SEQ ID NO: 4061007 - RNA, 20 nt, Vaccinia virus
aaauaacaccguuacacgaa

SEQ ID NO: 4061008 - RNA, 18 nt, Vaccinia virus
aaauaacauuuauuauca

SEQ ID NO: 4061009 - RNA, 17 nt, Vaccinia virus
aaauaaguaguaauaau

SEQ ID NO: 4061010 - RNA, 14 nt, Vaccinia virus
aaauaauaauggaa

SEQ ID NO: 4061011 - RNA, 13 nt, Vaccinia virus
aaauaauauauca

SEQ ID NO: 4061012 - RNA, 19 nt, Vaccinia virus
aaauaauauaucaaacaug

SEQ ID NO: 4061013 - RNA, 12 nt, Vaccinia virus
aaauaauccaac

SEQ ID NO: 4061014 - RNA, 22 nt, Vaccinia virus
aaauaaucccgcaauucauuuu

SEQ ID NO: 4061015 - RNA, 13 nt, Vaccinia virus
aaauaauccugaa

SEQ ID NO: 4061016 - RNA, 22 nt, Vaccinia virus
aaauaaucucuuaguguuggaa

SEQ ID NO: 4061017 - RNA, 14 nt, Vaccinia virus
aaauaauucauuuu

SEQ ID NO: 4061018 - RNA, 16 nt, Vaccinia virus
aaauacaaaacagaga

SEQ ID NO: 4061019 - RNA, 18 nt, Vaccinia virus
aaauacaaaauaauagau

SEQ ID NO: 4061020 - RNA, 14 nt, Vaccinia virus
aaauacaaauauau

SEQ ID NO: 4061021 - RNA, 11 nt, Vaccinia virus
aaauacagaua

SEQ ID NO: 4061022 - RNA, 18 nt, Vaccinia virus
aaauacauaauuuuguaa

SEQ ID NO: 4061023 - RNA, 18 nt, Vaccinia virus
aaauacaugggaaaugau

SEQ ID NO: 4061024 - RNA, 17 nt, Vaccinia virus
aaauacuuaacagagga

SEQ ID NO: 4061025 - RNA, 16 nt, Vaccinia virus
aaauacuuuauauucu

SEQ ID NO: 4061026 - RNA, 13 nt, Vaccinia virus
aaauagagcaauu

SEQ ID NO: 4061027 - RNA, 15 nt, Vaccinia virus
aaauagauagaacua

SEQ ID NO: 4061028 - RNA, 16 nt, Vaccinia virus
aaauagauagaacuac

SEQ ID NO: 4061029 - RNA, 22 nt, Vaccinia virus
aaauagcgcugaaaauaaagau

SEQ ID NO: 4061030 - RNA, 20 nt, Vaccinia virus
aaauaggguuguguauaauu

SEQ ID NO: 4061031 - RNA, 16 nt, Vaccinia virus
aaauagguacucuguu

SEQ ID NO: 4061032 - RNA, 23 nt, Vaccinia virus
aaauaggucuucgucuacaguag

SEQ ID NO: 4061033 - RNA, 16 nt, Vaccinia virus
aaauagguuuuguucu

SEQ ID NO: 4061034 - RNA, 13 nt, Vaccinia virus
aaauauaacuauu

SEQ ID NO: 4061035 - RNA, 12 nt, Vaccinia virus
aaauauaaugau

SEQ ID NO: 4061036 - RNA, 20 nt, Vaccinia virus
aaauauaguagaauuucauu

SEQ ID NO: 4061037 - RNA, 14 nt, Vaccinia virus
aaauauauaaugaa

SEQ ID NO: 4061038 - RNA, 14 nt, Vaccinia virus
aaauauauacauau

SEQ ID NO: 4061039 - RNA, 12 nt, Vaccinia virus
aaauauauuguu

SEQ ID NO: 4061040 - RNA, 22 nt, Vaccinia virus
aaauauauuuacaauuauugga

SEQ ID NO: 4061041 - RNA, 23 nt, Vaccinia virus
aaauauauuuacaauuauuggaa

SEQ ID NO: 4061042 - RNA, 17 nt, Vaccinia virus
aaauaucauuaauauau

SEQ ID NO: 4061043 - RNA, 16 nt, Vaccinia virus
aaauaugauuuuguaa

SEQ ID NO: 4061044 - RNA, 12 nt, Vaccinia virus
aaauauguguau

SEQ ID NO: 4061045 - RNA, 17 nt, Vaccinia virus
aaauauguuauguuuau

SEQ ID NO: 4061046 - RNA, 17 nt, Vaccinia virus
aaaucaaaacauuuuca

SEQ ID NO: 4061047 - RNA, 18 nt, Vaccinia virus
aaaucaaaauccauauca

SEQ ID NO: 4061048 - RNA, 21 nt, Vaccinia virus
aaaucaaacacaagaucuucu

SEQ ID NO: 4061049 - RNA, 20 nt, Vaccinia virus
aaaucaagucuagaauauau

SEQ ID NO: 4061050 - RNA, 23 nt, Vaccinia virus
aaaucaguaacuauguucauuuu

SEQ ID NO: 4061051 - RNA, 20 nt, Vaccinia virus
aaaucauuaaaugauuguau

SEQ ID NO: 4061052 - RNA, 21 nt, Vaccinia virus
aaauccuguaauauuuuuagu

SEQ ID NO: 4061053 - RNA, 15 nt, Vaccinia virus
aaaucuugauuacaa

SEQ ID NO: 4061054 - RNA, 22 nt, Vaccinia virus
aaaucuugucugcuuaauacac

SEQ ID NO: 4061055 - RNA, 18 nt, Vaccinia virus
aaaucuuuaauugucuug

SEQ ID NO: 4061056 - RNA, 23 nt, Vaccinia virus
aaaucuuucauuucuuccuggua

SEQ ID NO: 4061057 - RNA, 23 nt, Vaccinia virus
aaaucuuuguucuaaaaacugua

SEQ ID NO: 4061058 - RNA, 17 nt, Vaccinia virus
aaaugacuaauuuugua

SEQ ID NO: 4061059 - RNA, 21 nt, Vaccinia virus
aaaugaggucgcaaaaaaacu

SEQ ID NO: 4061060 - RNA, 15 nt, Vaccinia virus
aaaugauaacuagau

SEQ ID NO: 4061061 - RNA, 21 nt, Vaccinia virus
aaaugaugacuugauagaaua

SEQ ID NO: 4061062 - RNA, 18 nt, Vaccinia virus
aaaugauguuaccacuuu

SEQ ID NO: 4061063 - RNA, 22 nt, Vaccinia virus
aaaugcgauacagacauuaaga

SEQ ID NO: 4061064 - RNA, 22 nt, Vaccinia virus
aaauggaggaggagacaaugac

SEQ ID NO: 4061065 - RNA, 17 nt, Vaccinia virus
aaaugguaaauacugua

SEQ ID NO: 4061066 - RNA, 23 nt, Vaccinia virus
aaaugguugaauccagcauguau

SEQ ID NO: 4061067 - RNA, 19 nt, Vaccinia virus
aaauguauaaaaaacuaau

SEQ ID NO: 4061068 - RNA, 12 nt, Vaccinia virus
aaaugucaugau

SEQ ID NO: 4061069 - RNA, 17 nt, Vaccinia virus
aaauguugauagcugaa

SEQ ID NO: 4061070 - RNA, 22 nt, Vaccinia virus
aaauguuugaucaauaacaaug

SEQ ID NO: 4061071 - RNA, 23 nt, Vaccinia virus
aaauuaaaaaauaacuuaauuua

SEQ ID NO: 4061072 - RNA, 22 nt, Vaccinia virus
aaauuacuccagccguagaaua

SEQ ID NO: 4061073 - RNA, 15 nt, Vaccinia virus
aaauuagaucaaaga

SEQ ID NO: 4061074 - RNA, 18 nt, Vaccinia virus
aaauuagucauacguaau

SEQ ID NO: 4061075 - RNA, 15 nt, Vaccinia virus
aaauuauauacugaa

SEQ ID NO: 4061076 - RNA, 19 nt, Vaccinia virus
aaauuauccuaucauguau

SEQ ID NO: 4061077 - RNA, 20 nt, Vaccinia virus
aaauuauuaaacaauacucu

SEQ ID NO: 4061078 - RNA, 21 nt, Vaccinia virus
aaauuauuuaauaaaguauau

SEQ ID NO: 4061079 - RNA, 21 nt, Vaccinia virus
aaauucccaaguagauauccu

SEQ ID NO: 4061080 - RNA, 17 nt, Vaccinia virus
aaauuguaacaacaaug

SEQ ID NO: 4061081 - RNA, 17 nt, Vaccinia virus
aaauuguccuauauaau

SEQ ID NO: 4061082 - RNA, 15 nt, Vaccinia virus
aaauuuaaaaugaua

SEQ ID NO: 4061083 - RNA, 16 nt, Vaccinia virus
aaauuuagauacaucu

SEQ ID NO: 4061084 - RNA, 20 nt, Vaccinia virus
aaauuuccauuuuuaauuua

SEQ ID NO: 4061085 - RNA, 17 nt, Vaccinia virus
aaauuugaaagaacuac

SEQ ID NO: 4061086 - RNA, 21 nt, Vaccinia virus
aaauuuuacaaaucuauaaca

SEQ ID NO: 4061087 - RNA, 13 nt, Vaccinia virus
aaauuuucaauua

SEQ ID NO: 4061088 - RNA, 21 nt, Vaccinia virus
aaauuuuugguucuucucuaa

SEQ ID NO: 4061089 - RNA, 14 nt, Vaccinia virus
aacaaaaaaguuau

SEQ ID NO: 4061090 - RNA, 20 nt, Vaccinia virus
aacaaaaugugauauagaaa

SEQ ID NO: 4061091 - RNA, 13 nt, Vaccinia virus
aacaaauacagaa

SEQ ID NO: 4061092 - RNA, 17 nt, Vaccinia virus
aacaaccaaaaaaauau

SEQ ID NO: 4061093 - RNA, 17 nt, Vaccinia virus
aacaacugaaaaaaauu

SEQ ID NO: 4061094 - RNA, 17 nt, Vaccinia virus
aacaagaucuuugauau

SEQ ID NO: 4061095 - RNA, 12 nt, Vaccinia virus
aacaagcaauug

SEQ ID NO: 4061096 - RNA, 18 nt, Vaccinia virus
aacaagguaucgaaucua

SEQ ID NO: 4061097 - RNA, 21 nt, Vaccinia virus
aacaaguaugacauuguaaaa

SEQ ID NO: 4061098 - RNA, 18 nt, Vaccinia virus
aacaauagucuuguaaag

SEQ ID NO: 4061099 - RNA, 18 nt, Vaccinia virus
aacaauauaaauccagua

SEQ ID NO: 4061100 - RNA, 20 nt, Vaccinia virus
aacaaucaucgcauauagua

SEQ ID NO: 4061101 - RNA, 15 nt, Vaccinia virus
aacaauguuugucau

SEQ ID NO: 4061102 - RNA, 12 nt, Vaccinia virus
aacaauuacaaa

SEQ ID NO: 4061103 - RNA, 16 nt, Vaccinia virus
aacaauuuugucagua

SEQ ID NO: 4061104 - RNA, 11 nt, Vaccinia virus
aacacaaauau

SEQ ID NO: 4061105 - RNA, 22 nt, Vaccinia virus
aacaccguuacacgaagagaua

SEQ ID NO: 4061106 - RNA, 16 nt, Vaccinia virus
aacaccuauaagauua

SEQ ID NO: 4061107 - RNA, 18 nt, Vaccinia virus
aacacguuagaguuuaua

SEQ ID NO: 4061108 - RNA, 16 nt, Vaccinia virus
aacacuauuaaaauau

SEQ ID NO: 4061109 - RNA, 22 nt, Vaccinia virus
aacacuauuccaucuguggaaa

SEQ ID NO: 4061110 - RNA, 17 nt, Vaccinia virus
aacacugauucagaaau

SEQ ID NO: 4061111 - RNA, 16 nt, Vaccinia virus
aacacuggcuagaaaa

SEQ ID NO: 4061112 - RNA, 16 nt, Vaccinia virus
aacacuuuccugauuu

SEQ ID NO: 4061113 - RNA, 13 nt, Vaccinia virus
aacacuuuucuau

SEQ ID NO: 4061114 - RNA, 18 nt, Vaccinia virus
aacagaaacguuuagaga

SEQ ID NO: 4061115 - RNA, 18 nt, Vaccinia virus
aacagacgacaacaugua

SEQ ID NO: 4061116 - RNA, 12 nt, Vaccinia virus
aacagauacaua

SEQ ID NO: 4061117 - RNA, 21 nt, Vaccinia virus
aacagauauuacaaccaaugu

SEQ ID NO: 4061118 - RNA, 19 nt, Vaccinia virus
aacagcuaucaaaauaugu

SEQ ID NO: 4061119 - RNA, 21 nt, Vaccinia virus
aacaggucgcuauauccacca

SEQ ID NO: 4061120 - RNA, 19 nt, Vaccinia virus
aacaggugguauauuauau

SEQ ID NO: 4061121 - RNA, 16 nt, Vaccinia virus
aacagucgaacaaucu

SEQ ID NO: 4061122 - RNA, 16 nt, Vaccinia virus
aacagucuaaacaaua

SEQ ID NO: 4061123 - RNA, 18 nt, Vaccinia virus
aacaguuacuguuaguau

SEQ ID NO: 4061124 - RNA, 21 nt, Vaccinia virus
aacaguuugguauuagaauca

SEQ ID NO: 4061125 - RNA, 16 nt, Vaccinia virus
aacauaaauaauucua

SEQ ID NO: 4061126 - RNA, 12 nt, Vaccinia virus
aacauaaugccg

SEQ ID NO: 4061127 - RNA, 18 nt, Vaccinia virus
aacaucaacugaaaaagu

SEQ ID NO: 4061128 - RNA, 12 nt, Vaccinia virus
aacaucaagaau

SEQ ID NO: 4061129 - RNA, 22 nt, Vaccinia virus
aacaucguaucuucaaaaaggu

SEQ ID NO: 4061130 - RNA, 20 nt, Vaccinia virus
aacaucuuggggaaauaugg

SEQ ID NO: 4061131 - RNA, 20 nt, Vaccinia virus
aacaucuuuguaaacagaua

SEQ ID NO: 4061132 - RNA, 16 nt, Vaccinia virus
aacauggauacagaua

SEQ ID NO: 4061133 - RNA, 11 nt, Vaccinia virus
aacauguacau

SEQ ID NO: 4061134 - RNA, 13 nt, Vaccinia virus
aacauguuccauu

SEQ ID NO: 4061135 - RNA, 15 nt, Vaccinia virus
aacauguuuagaaag

SEQ ID NO: 4061136 - RNA, 13 nt, Vaccinia virus
aacauuaaaaugu

SEQ ID NO: 4061137 - RNA, 22 nt, Vaccinia virus
aacauuaaaauguccacagaua

SEQ ID NO: 4061138 - RNA, 16 nt, Vaccinia virus
aacauuaaauguauuu

SEQ ID NO: 4061139 - RNA, 14 nt, Vaccinia virus
aacauuaauacaga

SEQ ID NO: 4061140 - RNA, 13 nt, Vaccinia virus
aacauuaauugau

SEQ ID NO: 4061141 - RNA, 15 nt, Vaccinia virus
aacauuauguaguaa

SEQ ID NO: 4061142 - RNA, 18 nt, Vaccinia virus
aacauuccacauucagau

SEQ ID NO: 4061143 - RNA, 19 nt, Vaccinia virus
aacauuguuuguauucucc

SEQ ID NO: 4061144 - RNA, 17 nt, Vaccinia virus
aacauuuauuaucauga

SEQ ID NO: 4061145 - RNA, 21 nt, Vaccinia virus
aacauuuauuaucaugaugac

SEQ ID NO: 4061146 - RNA, 16 nt, Vaccinia virus
aaccagaauuguaaaa

SEQ ID NO: 4061147 - RNA, 16 nt, Vaccinia virus
aaccagaucaaaacaa

SEQ ID NO: 4061148 - RNA, 20 nt, Vaccinia virus
aaccauauaaaaacaauagu

SEQ ID NO: 4061149 - RNA, 16 nt, Vaccinia virus
aaccaugagugugaaa

SEQ ID NO: 4061150 - RNA, 15 nt, Vaccinia virus
aacccagauaauaac

SEQ ID NO: 4061151 - RNA, 19 nt, Vaccinia virus
aacccuuacaacuacagua

SEQ ID NO: 4061152 - RNA, 17 nt, Vaccinia virus
aaccgcguuaauguuug

SEQ ID NO: 4061153 - RNA, 22 nt, Vaccinia virus
aaccucacuguuaaaaauaugu

SEQ ID NO: 4061154 - RNA, 12 nt, Vaccinia virus
aacgaacuagag

SEQ ID NO: 4061155 - RNA, 15 nt, Vaccinia virus
aacgaaguaaaaagu

SEQ ID NO: 4061156 - RNA, 17 nt, Vaccinia virus
aacgaaguauuuauacu

SEQ ID NO: 4061157 - RNA, 20 nt, Vaccinia virus
aacgaccaucuuugaaaauu

SEQ ID NO: 4061158 - RNA, 21 nt, Vaccinia virus
aacgaguacaaguagaacuua

SEQ ID NO: 4061159 - RNA, 16 nt, Vaccinia virus
aacgauuaaacaauau

SEQ ID NO: 4061160 - RNA, 14 nt, Vaccinia virus
aacgccuuuagaaa

SEQ ID NO: 4061161 - RNA, 16 nt, Vaccinia virus
aacggaacauauuuau

SEQ ID NO: 4061162 - RNA, 21 nt, Vaccinia virus
aacggagaauaucuauacaua

SEQ ID NO: 4061163 - RNA, 14 nt, Vaccinia virus
aacggaugaaaaua

SEQ ID NO: 4061164 - RNA, 13 nt, Vaccinia virus
aacggcuaucacu

SEQ ID NO: 4061165 - RNA, 14 nt, Vaccinia virus
aacgguauaugaau

SEQ ID NO: 4061166 - RNA, 16 nt, Vaccinia virus
aacguacaaauggaua

SEQ ID NO: 4061167 - RNA, 21 nt, Vaccinia virus
aacgugaaugaucuauuaucu

SEQ ID NO: 4061168 - RNA, 14 nt, Vaccinia virus
aacgugaauguaug

SEQ ID NO: 4061169 - RNA, 17 nt, Vaccinia virus
aacgugaguauuuuacu

SEQ ID NO: 4061170 - RNA, 18 nt, Vaccinia virus
aacguuuuaaaaaaagau

SEQ ID NO: 4061171 - RNA, 15 nt, Vaccinia virus
aacuaaaaaaaauga

SEQ ID NO: 4061172 - RNA, 19 nt, Vaccinia virus
aacuaaaugguauacacau

SEQ ID NO: 4061173 - RNA, 19 nt, Vaccinia virus
aacuaacaaacuauacaag

SEQ ID NO: 4061174 - RNA, 15 nt, Vaccinia virus
aacuaagucuagaau

SEQ ID NO: 4061175 - RNA, 21 nt, Vaccinia virus
aacuacaucgguaucuagauc

SEQ ID NO: 4061176 - RNA, 23 nt, Vaccinia virus
aacuaccaauaugucuguacaaa

SEQ ID NO: 4061177 - RNA, 23 nt, Vaccinia virus
aacuacuccauuuuauuguggaa

SEQ ID NO: 4061178 - RNA, 17 nt, Vaccinia virus
aacuacucgaacagaua

SEQ ID NO: 4061179 - RNA, 20 nt, Vaccinia virus
aacuaguagaagguacgacu

SEQ ID NO: 4061180 - RNA, 15 nt, Vaccinia virus
aacuaguauaaaauc

SEQ ID NO: 4061181 - RNA, 15 nt, Vaccinia virus
aacuaguguagaaaa

SEQ ID NO: 4061182 - RNA, 19 nt, Vaccinia virus
aacuauagagaacaaauaa

SEQ ID NO: 4061183 - RNA, 14 nt, Vaccinia virus
aacuauauaaugaa

SEQ ID NO: 4061184 - RNA, 16 nt, Vaccinia virus
aacuaucaauauuaac

SEQ ID NO: 4061185 - RNA, 21 nt, Vaccinia virus
aacuaucguuggaaaauggug

SEQ ID NO: 4061186 - RNA, 18 nt, Vaccinia virus
aacuauguucauuuuuuu

SEQ ID NO: 4061187 - RNA, 17 nt, Vaccinia virus
aacuauuccaauguuua

SEQ ID NO: 4061188 - RNA, 22 nt, Vaccinia virus
aacuauuuccggcuguuguaua

SEQ ID NO: 4061189 - RNA, 12 nt, Vaccinia virus
aacuauuuuuuu

SEQ ID NO: 4061190 - RNA, 13 nt, Vaccinia virus
aacucaaucccaa

SEQ ID NO: 4061191 - RNA, 21 nt, Vaccinia virus
aacucauauaacuucuagaug

SEQ ID NO: 4061192 - RNA, 21 nt, Vaccinia virus
aacucauuuaaauaucauaau

SEQ ID NO: 4061193 - RNA, 22 nt, Vaccinia virus
aacuccuccuaggauauuugua

SEQ ID NO: 4061194 - RNA, 14 nt, Vaccinia virus
aacuccuggauaac

SEQ ID NO: 4061195 - RNA, 19 nt, Vaccinia virus
aacucgcuuaauaucuucu

SEQ ID NO: 4061196 - RNA, 15 nt, Vaccinia virus
aacucguaaaaagau

SEQ ID NO: 4061197 - RNA, 20 nt, Vaccinia virus
aacucgucuccccaaacauu

SEQ ID NO: 4061198 - RNA, 15 nt, Vaccinia virus
aacucuaaucaaaau

SEQ ID NO: 4061199 - RNA, 13 nt, Vaccinia virus
aacucuaucaugg

SEQ ID NO: 4061200 - RNA, 20 nt, Vaccinia virus
aacucucguauagucauaga

SEQ ID NO: 4061201 - RNA, 21 nt, Vaccinia virus
aacucugauuauugucuaaua

SEQ ID NO: 4061202 - RNA, 17 nt, Vaccinia virus
aacuguaauuugauucu

SEQ ID NO: 4061203 - RNA, 12 nt, Vaccinia virus
aacuuaaaauau

SEQ ID NO: 4061204 - RNA, 14 nt, Vaccinia virus
aacuuaaacaaaau

SEQ ID NO: 4061205 - RNA, 13 nt, Vaccinia virus
aacuuaacagcuc

SEQ ID NO: 4061206 - RNA, 21 nt, Vaccinia virus
aacuuauaauccuuuuuauuu

SEQ ID NO: 4061207 - RNA, 22 nt, Vaccinia virus
aacuuauaauccuuuuuauuua

SEQ ID NO: 4061208 - RNA, 15 nt, Vaccinia virus
aacuuauccauuuau

SEQ ID NO: 4061209 - RNA, 19 nt, Vaccinia virus
aacuuccguuuaaaaaugg

SEQ ID NO: 4061210 - RNA, 20 nt, Vaccinia virus
aacuucuggaaguuccaaac

SEQ ID NO: 4061211 - RNA, 21 nt, Vaccinia virus
aacuuggaaacaucucuucua

SEQ ID NO: 4061212 - RNA, 19 nt, Vaccinia virus
aacuugguauuuuuugguu

SEQ ID NO: 4061213 - RNA, 15 nt, Vaccinia virus
aacuuucaucuaaua

SEQ ID NO: 4061214 - RNA, 15 nt, Vaccinia virus
aacuuugauuauccu

SEQ ID NO: 4061215 - RNA, 12 nt, Vaccinia virus
aacuuuugcaua

SEQ ID NO: 4061216 - RNA, 13 nt, Vaccinia virus
aagaaaacaaaca

SEQ ID NO: 4061217 - RNA, 23 nt, Vaccinia virus
aagaaacugacuugauaaaaaug

SEQ ID NO: 4061218 - RNA, 14 nt, Vaccinia virus
aagaaauauuucca

SEQ ID NO: 4061219 - RNA, 14 nt, Vaccinia virus
aagaaauuaauaga

SEQ ID NO: 4061220 - RNA, 20 nt, Vaccinia virus
aagaacacacgaacaucuuu

SEQ ID NO: 4061221 - RNA, 23 nt, Vaccinia virus
aagaagaaauacuaaaaaaugua

SEQ ID NO: 4061222 - RNA, 13 nt, Vaccinia virus
aagaagagaauua

SEQ ID NO: 4061223 - RNA, 21 nt, Vaccinia virus
aagaaguauacuaucgucauu

SEQ ID NO: 4061224 - RNA, 15 nt, Vaccinia virus
aagaaguuauagaca

SEQ ID NO: 4061225 - RNA, 20 nt, Vaccinia virus
aagaaucaaaagaaugauuc

SEQ ID NO: 4061226 - RNA, 21 nt, Vaccinia virus
aagaaugcuucagaauuagaa

SEQ ID NO: 4061227 - RNA, 12 nt, Vaccinia virus
aagaauggauga

SEQ ID NO: 4061228 - RNA, 23 nt, Vaccinia virus
aagacaacgaauacaaacgccau

SEQ ID NO: 4061229 - RNA, 18 nt, Vaccinia virus
aagacaucauauauagaa

SEQ ID NO: 4061230 - RNA, 18 nt, Vaccinia virus
aagaccugacuagcaaau

SEQ ID NO: 4061231 - RNA, 20 nt, Vaccinia virus
aagacgaggagauuuagaaa

SEQ ID NO: 4061232 - RNA, 14 nt, Vaccinia virus
aagacggggauuuc

SEQ ID NO: 4061233 - RNA, 21 nt, Vaccinia virus
aagacguuguacaauaugaac

SEQ ID NO: 4061234 - RNA, 20 nt, Vaccinia virus
aagacuuagugacggacuua

SEQ ID NO: 4061235 - RNA, 22 nt, Vaccinia virus
aagagauaaaagcauuuuaacu

SEQ ID NO: 4061236 - RNA, 18 nt, Vaccinia virus
aagagcgacguacaacug

SEQ ID NO: 4061237 - RNA, 14 nt, Vaccinia virus
aagaguuaaugaau

SEQ ID NO: 4061238 - RNA, 14 nt, Vaccinia virus
aagauaaucuucuc

SEQ ID NO: 4061239 - RNA, 16 nt, Vaccinia virus
aagauacaacaaauua

SEQ ID NO: 4061240 - RNA, 22 nt, Vaccinia virus
aagauaccaaacagaauccuaa

SEQ ID NO: 4061241 - RNA, 20 nt, Vaccinia virus
aagauaccaguauaccucaa

SEQ ID NO: 4061242 - RNA, 17 nt, Vaccinia virus
aagauacuguuuagaga

SEQ ID NO: 4061243 - RNA, 20 nt, Vaccinia virus
aagauacuugaagacauucc

SEQ ID NO: 4061244 - RNA, 21 nt, Vaccinia virus
aagauagcggaagauacgacu

SEQ ID NO: 4061245 - RNA, 14 nt, Vaccinia virus
aagauauaaaugac

SEQ ID NO: 4061246 - RNA, 14 nt, Vaccinia virus
aagauauauacacu

SEQ ID NO: 4061247 - RNA, 14 nt, Vaccinia virus
aagauauuccaaga

SEQ ID NO: 4061248 - RNA, 17 nt, Vaccinia virus
aagauauuguuaaauaa

SEQ ID NO: 4061249 - RNA, 21 nt, Vaccinia virus
aagaucauacagucacagaca

SEQ ID NO: 4061250 - RNA, 18 nt, Vaccinia virus
aagaugauaaaaacauuu

SEQ ID NO: 4061251 - RNA, 16 nt, Vaccinia virus
aagaugauauaaguua

SEQ ID NO: 4061252 - RNA, 13 nt, Vaccinia virus
aagaugaugugaa

SEQ ID NO: 4061253 - RNA, 17 nt, Vaccinia virus
aagaugcaaacauuaug

SEQ ID NO: 4061254 - RNA, 15 nt, Vaccinia virus
aagauguuuagaaaa

SEQ ID NO: 4061255 - RNA, 21 nt, Vaccinia virus
aagauuaaaucauuaaaugau

SEQ ID NO: 4061256 - RNA, 17 nt, Vaccinia virus
aagauuccauuaucuaa

SEQ ID NO: 4061257 - RNA, 13 nt, Vaccinia virus
aagauuguacacu

SEQ ID NO: 4061258 - RNA, 13 nt, Vaccinia virus
aagauuguagaau

SEQ ID NO: 4061259 - RNA, 19 nt, Vaccinia virus
aagauugucauguggauua

SEQ ID NO: 4061260 - RNA, 21 nt, Vaccinia virus
aagauuguuuaagaagagaau

SEQ ID NO: 4061261 - RNA, 18 nt, Vaccinia virus
aagcagacuagaaauaac

SEQ ID NO: 4061262 - RNA, 20 nt, Vaccinia virus
aagcauuuuggaaacauaaa

SEQ ID NO: 4061263 - RNA, 19 nt, Vaccinia virus
aagccaauuccaauuguug

SEQ ID NO: 4061264 - RNA, 22 nt, Vaccinia virus
aagcggaacaauaaacaaaaua

SEQ ID NO: 4061265 - RNA, 20 nt, Vaccinia virus
aagcguguaaacgaaaacua

SEQ ID NO: 4061266 - RNA, 22 nt, Vaccinia virus
aagcguuggcaccggaauacua

SEQ ID NO: 4061267 - RNA, 16 nt, Vaccinia virus
aagcucuaaauccaaa

SEQ ID NO: 4061268 - RNA, 15 nt, Vaccinia virus
aaggaagaaggacaa

SEQ ID NO: 4061269 - RNA, 19 nt, Vaccinia virus
aaggaauaaaauaugaaau

SEQ ID NO: 4061270 - RNA, 17 nt, Vaccinia virus
aaggacaguuaaaacua

SEQ ID NO: 4061271 - RNA, 17 nt, Vaccinia virus
aaggacuuuguagaaau

SEQ ID NO: 4061272 - RNA, 19 nt, Vaccinia virus
aaggaguagcagauuuccu

SEQ ID NO: 4061273 - RNA, 19 nt, Vaccinia virus
aaggauaaaauauuaucca

SEQ ID NO: 4061274 - RNA, 11 nt, Vaccinia virus
aaggauaaaga

SEQ ID NO: 4061275 - RNA, 15 nt, Vaccinia virus
aaggcacuaugucca

SEQ ID NO: 4061276 - RNA, 12 nt, Vaccinia virus
aaggcagaaaug

SEQ ID NO: 4061277 - RNA, 21 nt, Vaccinia virus
aaggucaauuacggcgaaaua

SEQ ID NO: 4061278 - RNA, 15 nt, Vaccinia virus
aagguuaacaucuua

SEQ ID NO: 4061279 - RNA, 12 nt, Vaccinia virus
aagguuguaaau

SEQ ID NO: 4061280 - RNA, 20 nt, Vaccinia virus
aaguaaaagaucuauaaugu

SEQ ID NO: 4061281 - RNA, 12 nt, Vaccinia virus
aaguaaacuucg

SEQ ID NO: 4061282 - RNA, 23 nt, Vaccinia virus
aaguaaauaauaaaacaauaaau

SEQ ID NO: 4061283 - RNA, 16 nt, Vaccinia virus
aaguaauuaauuuuuc

SEQ ID NO: 4061284 - RNA, 12 nt, Vaccinia virus
aaguaauucaga

SEQ ID NO: 4061285 - RNA, 18 nt, Vaccinia virus
aaguacauggaugauaua

SEQ ID NO: 4061286 - RNA, 21 nt, Vaccinia virus
auuaaacauuguucaugauau

SEQ ID NO: 4061287 - RNA, 20 nt, Vaccinia virus
auuaaagacuuaagacuuaa

SEQ ID NO: 4061288 - RNA, 17 nt, Vaccinia virus
auuaaauauagguauau

SEQ ID NO: 4061289 - RNA, 16 nt, Vaccinia virus
auuaaaucauugacug

SEQ ID NO: 4061290 - RNA, 17 nt, Vaccinia virus
auuaaaucuuucauuuc

SEQ ID NO: 4061291 - RNA, 21 nt, Vaccinia virus
auuaaaugcaauaacaaagau

SEQ ID NO: 4061292 - RNA, 19 nt, Vaccinia virus
auuaaauuuuuuuauuaau

SEQ ID NO: 4061293 - RNA, 22 nt, Vaccinia virus
auuaacaacgaccgauaauaaa

SEQ ID NO: 4061294 - RNA, 17 nt, Vaccinia virus
auuaacagguucucaau

SEQ ID NO: 4061295 - RNA, 21 nt, Vaccinia virus
auuaacagguucucaauauua

SEQ ID NO: 4061296 - RNA, 18 nt, Vaccinia virus
auuaacauaguugaauaa

SEQ ID NO: 4061297 - RNA, 24 nt, Vaccinia virus
auuaacgaguuccauuuauaucau

SEQ ID NO: 4061298 - RNA, 17 nt, Vaccinia virus
auuaacgguuauaaaau

SEQ ID NO: 4061299 - RNA, 14 nt, Vaccinia virus
auuaacuaucugua

SEQ ID NO: 4061300 - RNA, 13 nt, Vaccinia virus
auuaacuauuuug

SEQ ID NO: 4061301 - RNA, 21 nt, Vaccinia virus
auuaacucagaagauuauuau

SEQ ID NO: 4061302 - RNA, 14 nt, Vaccinia virus
auuaaguguggugu

SEQ ID NO: 4061303 - RNA, 17 nt, Vaccinia virus
auuaaguguuauaagau

SEQ ID NO: 4061304 - RNA, 14 nt, Vaccinia virus
auuaauaaauccgu

SEQ ID NO: 4061305 - RNA, 15 nt, Vaccinia virus
auuaauacacauaau

SEQ ID NO: 4061306 - RNA, 12 nt, Vaccinia virus
auuaauacuuuu

SEQ ID NO: 4061307 - RNA, 15 nt, Vaccinia virus
auuaauagaaugaag

SEQ ID NO: 4061308 - RNA, 22 nt, Vaccinia virus
auuaaucaaaugguaaauacug

SEQ ID NO: 4061309 - RNA, 14 nt, Vaccinia virus
auuaaucuuuacca

SEQ ID NO: 4061310 - RNA, 16 nt, Vaccinia virus
auuaaucuuuucugua

SEQ ID NO: 4061311 - RNA, 17 nt, Vaccinia virus
auuaaucuuuucuguac

SEQ ID NO: 4061312 - RNA, 15 nt, Vaccinia virus
auuaaugagaucuuc

SEQ ID NO: 4061313 - RNA, 17 nt, Vaccinia virus
auuaaugcuacagauau

SEQ ID NO: 4061314 - RNA, 19 nt, Vaccinia virus
auuaauguccaagucuuga

SEQ ID NO: 4061315 - RNA, 13 nt, Vaccinia virus
auuaauuauucau

SEQ ID NO: 4061316 - RNA, 23 nt, Vaccinia virus
auuaauuucuaaaggagcaaaug

SEQ ID NO: 4061317 - RNA, 14 nt, Vaccinia virus
auuaauuuuagaaa

SEQ ID NO: 4061318 - RNA, 19 nt, Vaccinia virus
auuaauuuuugugggaagc

SEQ ID NO: 4061319 - RNA, 13 nt, Vaccinia virus
auuacaaaaacua

SEQ ID NO: 4061320 - RNA, 14 nt, Vaccinia virus
auuacaacauaaua

SEQ ID NO: 4061321 - RNA, 21 nt, Vaccinia virus
auuacaauuugcauguugcau

SEQ ID NO: 4061322 - RNA, 14 nt, Vaccinia virus
auuaccauggauga

SEQ ID NO: 4061323 - RNA, 18 nt, Vaccinia virus
auuacguggagaaaucau

SEQ ID NO: 4061324 - RNA, 19 nt, Vaccinia virus
auuacuaccuucagaaauu

SEQ ID NO: 4061325 - RNA, 13 nt, Vaccinia virus
auuacuacguaaa

SEQ ID NO: 4061326 - RNA, 14 nt, Vaccinia virus
auuacuacugaaga

SEQ ID NO: 4061327 - RNA, 16 nt, Vaccinia virus
auuacuccauuaaaua

SEQ ID NO: 4061328 - RNA, 18 nt, Vaccinia virus
auuacucuccuagguuuc

SEQ ID NO: 4061329 - RNA, 15 nt, Vaccinia virus
auuacuuaucauuua

SEQ ID NO: 4061330 - RNA, 14 nt, Vaccinia virus
auuacuuuaauagu

SEQ ID NO: 4061331 - RNA, 20 nt, Vaccinia virus
auuagaaaaaguguauucau

SEQ ID NO: 4061332 - RNA, 16 nt, Vaccinia virus
auuagcgaacauauau

SEQ ID NO: 4061333 - RNA, 18 nt, Vaccinia virus
auuaggaaaaguauucug

SEQ ID NO: 4061334 - RNA, 20 nt, Vaccinia virus
auuaguaggaaauuucuuga

SEQ ID NO: 4061335 - RNA, 17 nt, Vaccinia virus
auuagucauguuaaaaa

SEQ ID NO: 4061336 - RNA, 18 nt, Vaccinia virus
auuagugacggaaaaucg

SEQ ID NO: 4061337 - RNA, 17 nt, Vaccinia virus
auuagugauagaacguu

SEQ ID NO: 4061338 - RNA, 21 nt, Vaccinia virus
auuagugaugaauugaaaauu

SEQ ID NO: 4061339 - RNA, 21 nt, Vaccinia virus
auuaguuagauauauagaauu

SEQ ID NO: 4061340 - RNA, 16 nt, Vaccinia virus
auuauaagauuaaaug

SEQ ID NO: 4061341 - RNA, 18 nt, Vaccinia virus
auuauaauaguuuaucau

SEQ ID NO: 4061342 - RNA, 12 nt, Vaccinia virus
auuauaauguau

SEQ ID NO: 4061343 - RNA, 15 nt, Vaccinia virus
auuauacaaaaauuu

SEQ ID NO: 4061344 - RNA, 22 nt, Vaccinia virus
auuauacaccuuauaauaggug

SEQ ID NO: 4061345 - RNA, 12 nt, Vaccinia virus
auuauaccaaaa

SEQ ID NO: 4061346 - RNA, 21 nt, Vaccinia virus
auuauaguucuuaacaucuau

SEQ ID NO: 4061347 - RNA, 14 nt, Vaccinia virus
auuauauaauguau

SEQ ID NO: 4061348 - RNA, 23 nt, Vaccinia virus
auuauauagauacagaacaucaa

SEQ ID NO: 4061349 - RNA, 14 nt, Vaccinia virus
auuauauauggauu

SEQ ID NO: 4061350 - RNA, 15 nt, Vaccinia virus
auuauauauggauuu

SEQ ID NO: 4061351 - RNA, 23 nt, Vaccinia virus
auuauaugggguuacucuaaauc

SEQ ID NO: 4061352 - RNA, 20 nt, Vaccinia virus
auuauaugguagauuguuaa

SEQ ID NO: 4061353 - RNA, 18 nt, Vaccinia virus
auuaucaaaagacaugau

SEQ ID NO: 4061354 - RNA, 18 nt, Vaccinia virus
auuaucaaaauuaacaga

SEQ ID NO: 4061355 - RNA, 18 nt, Vaccinia virus
auuaucaaaauuuggaaa

SEQ ID NO: 4061356 - RNA, 14 nt, Vaccinia virus
auuaucaaauggau

SEQ ID NO: 4061357 - RNA, 14 nt, Vaccinia virus
auuaucaaauguug

SEQ ID NO: 4061358 - RNA, 24 nt, Vaccinia virus
auuaucaacguaacuauauuccaa

SEQ ID NO: 4061359 - RNA, 21 nt, Vaccinia virus
auuaucaagauguguauguuu

SEQ ID NO: 4061360 - RNA, 22 nt, Vaccinia virus
auuaucaugacaaaauuaaaaa

SEQ ID NO: 4061361 - RNA, 19 nt, Vaccinia virus
auuaucaugagauguguau

SEQ ID NO: 4061362 - RNA, 16 nt, Vaccinia virus
auuauccguauuucca

SEQ ID NO: 4061363 - RNA, 15 nt, Vaccinia virus
auuaucgacauaggu

SEQ ID NO: 4061364 - RNA, 17 nt, Vaccinia virus
auuaucgacuaugaauc

SEQ ID NO: 4061365 - RNA, 20 nt, Vaccinia virus
auuaucgaggauaucucaaa

SEQ ID NO: 4061366 - RNA, 20 nt, Vaccinia virus
auuaucgaguuuaaaucauu

SEQ ID NO: 4061367 - RNA, 19 nt, Vaccinia virus
auuaucgcuaauugacaca

SEQ ID NO: 4061368 - RNA, 16 nt, Vaccinia virus
auuaucuacaguguau

SEQ ID NO: 4061369 - RNA, 20 nt, Vaccinia virus
auuaucuuuguuuugauauc

SEQ ID NO: 4061370 - RNA, 21 nt, Vaccinia virus
auuaugaaaaaguaaaugaug

SEQ ID NO: 4061371 - RNA, 15 nt, Vaccinia virus
auuaugaaacaauau

SEQ ID NO: 4061372 - RNA, 15 nt, Vaccinia virus
auuaugaaacuauau

SEQ ID NO: 4061373 - RNA, 13 nt, Vaccinia virus
auuaugagaauga

SEQ ID NO: 4061374 - RNA, 15 nt, Vaccinia virus
auuaugauagaaauu

SEQ ID NO: 4061375 - RNA, 20 nt, Vaccinia virus
auuaugcauucguuuaaaga

SEQ ID NO: 4061376 - RNA, 17 nt, Vaccinia virus
auuaugcgauagcaaga

SEQ ID NO: 4061377 - RNA, 17 nt, Vaccinia virus
auuauguuuuaugaaua

SEQ ID NO: 4061378 - RNA, 13 nt, Vaccinia virus
auuauuaauaaag

SEQ ID NO: 4061379 - RNA, 12 nt, Vaccinia virus
auuauuaauaag

SEQ ID NO: 4061380 - RNA, 18 nt, Vaccinia virus
auuauuaucuuuagaaau

SEQ ID NO: 4061381 - RNA, 14 nt, Vaccinia virus
auuauuaugaugau

SEQ ID NO: 4061382 - RNA, 18 nt, Vaccinia virus
auuauucuacuaucaaag

SEQ ID NO: 4061383 - RNA, 16 nt, Vaccinia virus
auuauucuaucaauuu

SEQ ID NO: 4061384 - RNA, 19 nt, Vaccinia virus
auuauucuauuucgaauuu

SEQ ID NO: 4061385 - RNA, 17 nt, Vaccinia virus
auuauucuuaaaugccu

SEQ ID NO: 4061386 - RNA, 21 nt, Vaccinia virus
auuauuggguaaguuuaaaaa

SEQ ID NO: 4061387 - RNA, 19 nt, Vaccinia virus
auuauugguucauuggaau

SEQ ID NO: 4061388 - RNA, 21 nt, Vaccinia virus
auuauuuuucaccauauagau

SEQ ID NO: 4061389 - RNA, 13 nt, Vaccinia virus
auucaaaaaagaa

SEQ ID NO: 4061390 - RNA, 14 nt, Vaccinia virus
auucaaauguuguu

SEQ ID NO: 4061391 - RNA, 21 nt, Vaccinia virus
auucaaauguuguuaaaugau

SEQ ID NO: 4061392 - RNA, 23 nt, Vaccinia virus
auucaaccacucucgauacauua

SEQ ID NO: 4061393 - RNA, 20 nt, Vaccinia virus
auucaagcgaauuacucugu

SEQ ID NO: 4061394 - RNA, 20 nt, Vaccinia virus
auucagacacuucuuaacga

SEQ ID NO: 4061395 - RNA, 19 nt, Vaccinia virus
auucauacuuaacaaauug

SEQ ID NO: 4061396 - RNA, 16 nt, Vaccinia virus
auucauagcuguauuu

SEQ ID NO: 4061397 - RNA, 18 nt, Vaccinia virus
auucauauuaauacuuug

SEQ ID NO: 4061398 - RNA, 12 nt, Vaccinia virus
auucaucaauau

SEQ ID NO: 4061399 - RNA, 15 nt, Vaccinia virus
auucauccuuaaaug

SEQ ID NO: 4061400 - RNA, 21 nt, Vaccinia virus
auucauuaggauuaucaaauc

SEQ ID NO: 4061401 - RNA, 17 nt, Vaccinia virus
auucauucaaugucucu

SEQ ID NO: 4061402 - RNA, 18 nt, Vaccinia virus
auuccaauguuuaacaag

SEQ ID NO: 4061403 - RNA, 23 nt, Vaccinia virus
auuccaggaucuagauaauuaau

SEQ ID NO: 4061404 - RNA, 22 nt, Vaccinia virus
auuccauauagauauaauuuua

SEQ ID NO: 4061405 - RNA, 12 nt, Vaccinia virus
auuccauggaag

SEQ ID NO: 4061406 - RNA, 22 nt, Vaccinia virus
auucccccugccauuuuagaga

SEQ ID NO: 4061407 - RNA, 21 nt, Vaccinia virus
auuccuuauucacacaaaaag

SEQ ID NO: 4061408 - RNA, 14 nt, Vaccinia virus
auucguagaaagua

SEQ ID NO: 4061409 - RNA, 18 nt, Vaccinia virus
auucguauaaauauccuu

SEQ ID NO: 4061410 - RNA, 15 nt, Vaccinia virus
ugaguguagaugcug

SEQ ID NO: 4061411 - RNA, 18 nt, Vaccinia virus
ugaguuacgaagauauca

SEQ ID NO: 4061412 - RNA, 23 nt, Vaccinia virus
ugauaaagauaaaagaauucaga

SEQ ID NO: 4061413 - RNA, 13 nt, Vaccinia virus
ugauaaauuauuu

SEQ ID NO: 4061414 - RNA, 16 nt, Vaccinia virus
ugauaacuucaggaaa

SEQ ID NO: 4061415 - RNA, 13 nt, Vaccinia virus
ugauaauaugaaa

SEQ ID NO: 4061416 - RNA, 22 nt, Vaccinia virus
ugauaauauuaaaagauggaua

SEQ ID NO: 4061417 - RNA, 18 nt, Vaccinia virus
ugauaauuauaccaagga

SEQ ID NO: 4061418 - RNA, 18 nt, Vaccinia virus
ugauacaaaaacgaaaua

SEQ ID NO: 4061419 - RNA, 21 nt, Vaccinia virus
ugauacaacaauauaugugca

SEQ ID NO: 4061420 - RNA, 18 nt, Vaccinia virus
ugauacccgcaauuauua

SEQ ID NO: 4061421 - RNA, 21 nt, Vaccinia virus
ugauacguacaaugauaauga

SEQ ID NO: 4061422 - RNA, 21 nt, Vaccinia virus
ugauacucucaaccauuauua

SEQ ID NO: 4061423 - RNA, 21 nt, Vaccinia virus
ugauagacaagauauauacac

SEQ ID NO: 4061424 - RNA, 16 nt, Vaccinia virus
ugauagagguaaacuu

SEQ ID NO: 4061425 - RNA, 23 nt, Vaccinia virus
ugauagauacgcauuuucuggag

SEQ ID NO: 4061426 - RNA, 17 nt, Vaccinia virus
ugauagccguagaucuu

SEQ ID NO: 4061427 - RNA, 17 nt, Vaccinia virus
ugauaguauuauucauu

SEQ ID NO: 4061428 - RNA, 15 nt, Vaccinia virus
ugauaguuucucauu

SEQ ID NO: 4061429 - RNA, 15 nt, Vaccinia virus
ugauauaaaacuauc

SEQ ID NO: 4061430 - RNA, 20 nt, Vaccinia virus
ugauauagaaaagcauauca

SEQ ID NO: 4061431 - RNA, 21 nt, Vaccinia virus
ugauauaggggucuucauaac

SEQ ID NO: 4061432 - RNA, 16 nt, Vaccinia virus
ugauauaguaauauua

SEQ ID NO: 4061433 - RNA, 16 nt, Vaccinia virus
ugauauauaauuuaca

SEQ ID NO: 4061434 - RNA, 20 nt, Vaccinia virus
ugauauauaauuuacagcua

SEQ ID NO: 4061435 - RNA, 20 nt, Vaccinia virus
ugauaucgcauagaaauaca

SEQ ID NO: 4061436 - RNA, 22 nt, Vaccinia virus
ugauaugauuuuuaaucaagau

SEQ ID NO: 4061437 - RNA, 21 nt, Vaccinia virus
ugauauuggagcaaaauccua

SEQ ID NO: 4061438 - RNA, 13 nt, Vaccinia virus
ugauauuuggauc

SEQ ID NO: 4061439 - RNA, 22 nt, Vaccinia virus
ugaucauuuugauauugugaau

SEQ ID NO: 4061440 - RNA, 13 nt, Vaccinia virus
ugaucggaucuaa

SEQ ID NO: 4061441 - RNA, 13 nt, Vaccinia virus
ugaucuagucuuu

SEQ ID NO: 4061442 - RNA, 21 nt, Vaccinia virus
ugaucucaauggaaugcaaaa

SEQ ID NO: 4061443 - RNA, 20 nt, Vaccinia virus
ugaugaaagauaaacuaaau

SEQ ID NO: 4061444 - RNA, 20 nt, Vaccinia virus
ugaugaaguucgaugauguc

SEQ ID NO: 4061445 - RNA, 22 nt, Vaccinia virus
ugaugaaguugagaaugauaug

SEQ ID NO: 4061446 - RNA, 23 nt, Vaccinia virus
ugaugaaucuucauuaucugaua

SEQ ID NO: 4061447 - RNA, 18 nt, Vaccinia virus
ugaugaguuguacaucuu

SEQ ID NO: 4061448 - RNA, 22 nt, Vaccinia virus
ugaugaugcagaauuuuggaua

SEQ ID NO: 4061449 - RNA, 15 nt, Vaccinia virus
ugaugcaaagauguu

SEQ ID NO: 4061450 - RNA, 22 nt, Vaccinia virus
ugauggaugagauauacagcua

SEQ ID NO: 4061451 - RNA, 17 nt, Vaccinia virus
ugauguaagucuuacaa

SEQ ID NO: 4061452 - RNA, 19 nt, Vaccinia virus
ugaugucaaagauuguaca

SEQ ID NO: 4061453 - RNA, 22 nt, Vaccinia virus
ugaugugagagagaaauacuuc

SEQ ID NO: 4061454 - RNA, 16 nt, Vaccinia virus
ugauuaauaugugaca

SEQ ID NO: 4061455 - RNA, 20 nt, Vaccinia virus
ugauuaguauaacuagauuu

SEQ ID NO: 4061456 - RNA, 17 nt, Vaccinia virus
ugauuaguauuuucuau

SEQ ID NO: 4061457 - RNA, 23 nt, Vaccinia virus
ugauuaucuucuugagacauaac

SEQ ID NO: 4061458 - RNA, 21 nt, Vaccinia virus
ugauucaucaacauuugcugu

SEQ ID NO: 4061459 - RNA, 16 nt, Vaccinia virus
ugauucgauaaauaga

SEQ ID NO: 4061460 - RNA, 19 nt, Vaccinia virus
ugauugauuauuucaaaga

SEQ ID NO: 4061461 - RNA, 17 nt, Vaccinia virus
ugauuggguagaaguag

SEQ ID NO: 4061462 - RNA, 18 nt, Vaccinia virus
ugauuguaaauacagaua

SEQ ID NO: 4061463 - RNA, 22 nt, Vaccinia virus
ugauuuuaacgacgacauauua

SEQ ID NO: 4061464 - RNA, 18 nt, Vaccinia virus
ugauuuuuccuaaaucua

SEQ ID NO: 4061465 - RNA, 20 nt, Vaccinia virus
ugauuuuucuucauuuauca

SEQ ID NO: 4061466 - RNA, 23 nt, Vaccinia virus
ugcaaaaaacgccaauacauguu

SEQ ID NO: 4061467 - RNA, 17 nt, Vaccinia virus
ugcaaacuuaacagcuc

SEQ ID NO: 4061468 - RNA, 16 nt, Vaccinia virus
ugcaaauguaguauuu

SEQ ID NO: 4061469 - RNA, 17 nt, Vaccinia virus
ugcaacaucuggagaau

SEQ ID NO: 4061470 - RNA, 21 nt, Vaccinia virus
ugcaacgaauuauuagucugu

SEQ ID NO: 4061471 - RNA, 15 nt, Vaccinia virus
ugcaaguuauucucg

SEQ ID NO: 4061472 - RNA, 16 nt, Vaccinia virus
ugcaauaacaaagauu

SEQ ID NO: 4061473 - RNA, 17 nt, Vaccinia virus
ugcaaugaauaucuaca

SEQ ID NO: 4061474 - RNA, 23 nt, Vaccinia virus
ugcacguaaccauucuaaacaau

SEQ ID NO: 4061475 - RNA, 16 nt, Vaccinia virus
ugcagaagcaauaaau

SEQ ID NO: 4061476 - RNA, 15 nt, Vaccinia virus
ugcagaaguaaugaa

SEQ ID NO: 4061477 - RNA, 20 nt, Vaccinia virus
ugcaugauguacagauuucg

SEQ ID NO: 4061478 - RNA, 13 nt, Vaccinia virus
ugccaaaaugaua

SEQ ID NO: 4061479 - RNA, 21 nt, Vaccinia virus
ugccaauaugucaucuaugga

SEQ ID NO: 4061480 - RNA, 23 nt, Vaccinia virus
ugccacaaaugaaaaaaauacuu

SEQ ID NO: 4061481 - RNA, 15 nt, Vaccinia virus
ugccacgguuccaag

SEQ ID NO: 4061482 - RNA, 18 nt, Vaccinia virus
ugccuuuuuauacauguu

SEQ ID NO: 4061483 - RNA, 17 nt, Vaccinia virus
ugcggguaucacuguua

SEQ ID NO: 4061484 - RNA, 14 nt, Vaccinia virus
ugcuaaaauaccua

SEQ ID NO: 4061485 - RNA, 12 nt, Vaccinia virus
ugcuaaauacua

SEQ ID NO: 4061486 - RNA, 13 nt, Vaccinia virus
ugcuaauauacaa

SEQ ID NO: 4061487 - RNA, 17 nt, Vaccinia virus
ugcuauaccuaauacua

SEQ ID NO: 4061488 - RNA, 20 nt, Vaccinia virus
ugcuaucaucacucuaaaau

SEQ ID NO: 4061489 - RNA, 16 nt, Vaccinia virus
ugcucggcaauaacua

SEQ ID NO: 4061490 - RNA, 14 nt, Vaccinia virus
ugcucuuucggugg

SEQ ID NO: 4061491 - RNA, 14 nt, Vaccinia virus
ugcugaagcaauaa

SEQ ID NO: 4061492 - RNA, 15 nt, Vaccinia virus
ugcuguuguacauac

SEQ ID NO: 4061493 - RNA, 15 nt, Vaccinia virus
ugcuuauauuuucau

SEQ ID NO: 4061494 - RNA, 19 nt, Vaccinia virus
ugcuugcuagacaccuuuu

SEQ ID NO: 4061495 - RNA, 15 nt, Vaccinia virus
uggaaagaaaucuac

SEQ ID NO: 4061496 - RNA, 13 nt, Vaccinia virus
uggaaagauauca

SEQ ID NO: 4061497 - RNA, 20 nt, Vaccinia virus
uggaaagauaucagauaagu

SEQ ID NO: 4061498 - RNA, 12 nt, Vaccinia virus
uggaaauacuuc

SEQ ID NO: 4061499 - RNA, 18 nt, Vaccinia virus
uggaaauaucugugaaua

SEQ ID NO: 4061500 - RNA, 13 nt, Vaccinia virus
uggaacaauaaaa

SEQ ID NO: 4061501 - RNA, 20 nt, Vaccinia virus
uggaagagucuucaacgaua

SEQ ID NO: 4061502 - RNA, 15 nt, Vaccinia virus
uggaagauauuucca

SEQ ID NO: 4061503 - RNA, 21 nt, Vaccinia virus
uggaagaugcuauaucaaaau

SEQ ID NO: 4061504 - RNA, 22 nt, Vaccinia virus
uggaagaugcuauaucaaaaua

SEQ ID NO: 4061505 - RNA, 16 nt, Vaccinia virus
uggaagcguauguucc

SEQ ID NO: 4061506 - RNA, 16 nt, Vaccinia virus
uggaaucaucuucuga

SEQ ID NO: 4061507 - RNA, 19 nt, Vaccinia virus
uggaaugacgaauccuguu

SEQ ID NO: 4061508 - RNA, 23 nt, Vaccinia virus
uggaaugacgaauccuguuucua

SEQ ID NO: 4061509 - RNA, 23 nt, Vaccinia virus
uggaaugcaaaaccccauaguga

SEQ ID NO: 4061510 - RNA, 15 nt, Vaccinia virus
uggacaaaucuggaa

SEQ ID NO: 4061511 - RNA, 15 nt, Vaccinia virus
uggacauacuaauau

SEQ ID NO: 4061512 - RNA, 14 nt, Vaccinia virus
uggaccaauuuauu

SEQ ID NO: 4061513 - RNA, 23 nt, Vaccinia virus
uggagacgccugauauguaggca

SEQ ID NO: 4061514 - RNA, 14 nt, Vaccinia virus
uggagaucuagaaa

SEQ ID NO: 4061515 - RNA, 16 nt, Vaccinia virus
uggagcaaacauuaac

SEQ ID NO: 4061516 - RNA, 15 nt, Vaccinia virus
uggaguaguacaaga

SEQ ID NO: 4061517 - RNA, 21 nt, Vaccinia virus
uggaguguauauuuaucucuu

SEQ ID NO: 4061518 - RNA, 13 nt, Vaccinia virus
uggaguugaagau

SEQ ID NO: 4061519 - RNA, 17 nt, Vaccinia virus
uggauaauauauacguu

SEQ ID NO: 4061520 - RNA, 20 nt, Vaccinia virus
uggauaccgcacuagguaca

SEQ ID NO: 4061521 - RNA, 16 nt, Vaccinia virus
uggauauguguuuaca

SEQ ID NO: 4061522 - RNA, 19 nt, Vaccinia virus
uggauauuacaaauacuuu

SEQ ID NO: 4061523 - RNA, 17 nt, Vaccinia virus
uggaucaucgugugaua

SEQ ID NO: 4061524 - RNA, 21 nt, Vaccinia virus
uguuuaaugaauuacuaaaau

SEQ ID NO: 4061525 - RNA, 19 nt, Vaccinia virus
uguuuacaguaguaaugaa

SEQ ID NO: 4061526 - RNA, 17 nt, Vaccinia virus
uguuuaccagcuccaug

SEQ ID NO: 4061527 - RNA, 21 nt, Vaccinia virus
uguuuaccagcuccaugacuu

SEQ ID NO: 4061528 - RNA, 17 nt, Vaccinia virus
uguuuagaaaaaugcua

SEQ ID NO: 4061529 - RNA, 13 nt, Vaccinia virus
uguuuauuuucaa

SEQ ID NO: 4061530 - RNA, 19 nt, Vaccinia virus
uguuucacauuuacauauu

SEQ ID NO: 4061531 - RNA, 12 nt, Vaccinia virus
uguuucauauuu

SEQ ID NO: 4061532 - RNA, 18 nt, Vaccinia virus
uguuuccaugacauauua

SEQ ID NO: 4061533 - RNA, 15 nt, Vaccinia virus
uguuugaaaacagaa

SEQ ID NO: 4061534 - RNA, 22 nt, Vaccinia virus
uguuugaaaacagaaacaucau

SEQ ID NO: 4061535 - RNA, 23 nt, Vaccinia virus
uguuuuaaauaucaaccgcaaau

SEQ ID NO: 4061536 - RNA, 16 nt, Vaccinia virus
uguuuuauguuuauua

SEQ ID NO: 4061537 - RNA, 13 nt, Vaccinia virus
uguuuucauacau

SEQ ID NO: 4061538 - RNA, 13 nt, Vaccinia virus
uguuuuuaucauc

SEQ ID NO: 4061539 - RNA, 22 nt, Vaccinia virus
uuaaaaaaaaaauacuuauucu

SEQ ID NO: 4061540 - RNA, 23 nt, Vaccinia virus
uuaaaaacaaacuuuuuauccuu

SEQ ID NO: 4061541 - RNA, 18 nt, Vaccinia virus
uuaaaaaggaaaauacua

SEQ ID NO: 4061542 - RNA, 18 nt, Vaccinia virus
uuaaaaauaguauuauca

SEQ ID NO: 4061543 - RNA, 15 nt, Vaccinia virus
uuaaaaauaugugcu

SEQ ID NO: 4061544 - RNA, 17 nt, Vaccinia virus
uuaaaacuguuuaagaa

SEQ ID NO: 4061545 - RNA, 22 nt, Vaccinia virus
uuaaaagaauuacuuagucugu

SEQ ID NO: 4061546 - RNA, 12 nt, Vaccinia virus
uuaaaauacuaa

SEQ ID NO: 4061547 - RNA, 19 nt, Vaccinia virus
uuaaaauauauucuaauau

SEQ ID NO: 4061548 - RNA, 15 nt, Vaccinia virus
uuaaaauauuauuua

SEQ ID NO: 4061549 - RNA, 13 nt, Vaccinia virus
uuaaaaucauuau

SEQ ID NO: 4061550 - RNA, 12 nt, Vaccinia virus
uuaaaaugugua

SEQ ID NO: 4061551 - RNA, 15 nt, Vaccinia virus
uuaaaauuauuaaac

SEQ ID NO: 4061552 - RNA, 12 nt, Vaccinia virus
uuaaaauuauuu

SEQ ID NO: 4061553 - RNA, 17 nt, Vaccinia virus
uuaaacauacaucuguu

SEQ ID NO: 4061554 - RNA, 12 nt, Vaccinia virus
uuaaacaucuuu

SEQ ID NO: 4061555 - RNA, 20 nt, Vaccinia virus
uuaaacgauuugaugaguua

SEQ ID NO: 4061556 - RNA, 22 nt, Vaccinia virus
uuaaagauggaguauaaucuuu

SEQ ID NO: 4061557 - RNA, 21 nt, Vaccinia virus
uuaaaggaguaugucaugaau

SEQ ID NO: 4061558 - RNA, 24 nt, Vaccinia virus
uuaaaggauggugaaauuauugca

SEQ ID NO: 4061559 - RNA, 17 nt, Vaccinia virus
uuaaaguacguaaaucu

SEQ ID NO: 4061560 - RNA, 17 nt, Vaccinia virus
uuaaauauuguauuaau

SEQ ID NO: 4061561 - RNA, 23 nt, Vaccinia virus
uuaaaucccaauucagaaaucaa

SEQ ID NO: 4061562 - RNA, 13 nt, Vaccinia virus
uuaaauccuuaau

SEQ ID NO: 4061563 - RNA, 11 nt, Vaccinia virus
uuaaauuauua

SEQ ID NO: 4061564 - RNA, 14 nt, Vaccinia virus
uuaaauuauuauua

SEQ ID NO: 4061565 - RNA, 13 nt, Vaccinia virus
uuaaauuauuuag

SEQ ID NO: 4061566 - RNA, 13 nt, Vaccinia virus
uuaaauucaucau

SEQ ID NO: 4061567 - RNA, 13 nt, Vaccinia virus
uuaaauucuuuaa

SEQ ID NO: 4061568 - RNA, 18 nt, Vaccinia virus
uuaaauuuuuuuauuaau

SEQ ID NO: 4061569 - RNA, 23 nt, Vaccinia virus
uuaacaaaugguucaaagacuag

SEQ ID NO: 4061570 - RNA, 20 nt, Vaccinia virus
uuaacagaguagauauuaau

SEQ ID NO: 4061571 - RNA, 23 nt, Vaccinia virus
uuaacaucuaaaaaauccuuaau

SEQ ID NO: 4061572 - RNA, 15 nt, Vaccinia virus
uuaacaucuauuaau

SEQ ID NO: 4061573 - RNA, 18 nt, Vaccinia virus
uuaacgcaccuauaaaga

SEQ ID NO: 4061574 - RNA, 15 nt, Vaccinia virus
uuaacguauaaauga

SEQ ID NO: 4061575 - RNA, 16 nt, Vaccinia virus
uuaacuuuucauuaau

SEQ ID NO: 4061576 - RNA, 19 nt, Vaccinia virus
uuaagaggacuauuagaag

SEQ ID NO: 4061577 - RNA, 17 nt, Vaccinia virus
uuaagauuguacacuuu

SEQ ID NO: 4061578 - RNA, 19 nt, Vaccinia virus
uuaagauuuuaaauguaua

SEQ ID NO: 4061579 - RNA, 20 nt, Vaccinia virus
uuaagcaacaugucucuaaa

SEQ ID NO: 4061580 - RNA, 20 nt, Vaccinia virus
uuaaggaauacaauacauac

SEQ ID NO: 4061581 - RNA, 15 nt, Vaccinia virus
uuaaggggaaaaagc

SEQ ID NO: 4061582 - RNA, 22 nt, Vaccinia virus
uuaaguauuguuuuuucauuau

SEQ ID NO: 4061583 - RNA, 18 nt, Vaccinia virus
uuaauaaaaauacaaucc

SEQ ID NO: 4061584 - RNA, 15 nt, Vaccinia virus
uuaauaauuguauug

SEQ ID NO: 4061585 - RNA, 21 nt, Vaccinia virus
uuaauaauuguuauuauuuca

SEQ ID NO: 4061586 - RNA, 14 nt, Vaccinia virus
uuaauacauuauua

SEQ ID NO: 4061587 - RNA, 16 nt, Vaccinia virus
uuaauacuacauauuu

SEQ ID NO: 4061588 - RNA, 21 nt, Vaccinia virus
uuaauagauauaucucuuaau

SEQ ID NO: 4061589 - RNA, 17 nt, Vaccinia virus
uuaauauaguuauuaau

SEQ ID NO: 4061590 - RNA, 13 nt, Vaccinia virus
uuaauauguauga

SEQ ID NO: 4061591 - RNA, 13 nt, Vaccinia virus
uuaauauuucuau

SEQ ID NO: 4061592 - RNA, 23 nt, Vaccinia virus
uuaaucauauacaacucuuuaau

SEQ ID NO: 4061593 - RNA, 15 nt, Vaccinia virus
uuaaucauguacaug

SEQ ID NO: 4061594 - RNA, 14 nt, Vaccinia virus
uuaaucauuaacuu

SEQ ID NO: 4061595 - RNA, 17 nt, Vaccinia virus
uuaaucguacucauuau

SEQ ID NO: 4061596 - RNA, 15 nt, Vaccinia virus
uuaaucguauguaua

SEQ ID NO: 4061597 - RNA, 14 nt, Vaccinia virus
uuaaugaaacauuu

SEQ ID NO: 4061598 - RNA, 17 nt, Vaccinia virus
uuaaugaacaaauccuu

SEQ ID NO: 4061599 - RNA, 15 nt, Vaccinia virus
uuaaugcaccgaaca

SEQ ID NO: 4061600 - RNA, 16 nt, Vaccinia virus
uuaaugcaucauuaau

SEQ ID NO: 4061601 - RNA, 21 nt, Vaccinia virus
uuaaugccgauuuaauacguu

SEQ ID NO: 4061602 - RNA, 20 nt, Vaccinia virus
uuaaugucaggaaauguaua

SEQ ID NO: 4061603 - RNA, 23 nt, Vaccinia virus
uuaaugucugcgccauuaucuau

SEQ ID NO: 4061604 - RNA, 22 nt, Vaccinia virus
uuaauucuagacuauuuggaca

SEQ ID NO: 4061605 - RNA, 15 nt, Vaccinia virus
uuaauucucucaggu

SEQ ID NO: 4061606 - RNA, 23 nt, Vaccinia virus
uuaauuguuaaacauacaucugu

SEQ ID NO: 4061607 - RNA, 18 nt, Vaccinia virus
uuaauuuggucauuauua

SEQ ID NO: 4061608 - RNA, 11 nt, Vaccinia virus
uuacaaacauc

SEQ ID NO: 4061609 - RNA, 21 nt, Vaccinia virus
uuacaaacgacauacuguaug

SEQ ID NO: 4061610 - RNA, 22 nt, Vaccinia virus
uuacaaacugaauaauaucaga

SEQ ID NO: 4061611 - RNA, 12 nt, Vaccinia virus
uuacaaaucuag

SEQ ID NO: 4061612 - RNA, 16 nt, Vaccinia virus
uuacaacaacauauga

SEQ ID NO: 4061613 - RNA, 17 nt, Vaccinia virus
uuacaagaauauaaaaa

SEQ ID NO: 4061614 - RNA, 15 nt, Vaccinia virus
uuacaagcuguuuau

SEQ ID NO: 4061615 - RNA, 19 nt, Vaccinia virus
uuacacuauuugucuuaau

SEQ ID NO: 4061616 - RNA, 18 nt, Vaccinia virus
uuacagaucuaguauaau

SEQ ID NO: 4061617 - RNA, 17 nt, Vaccinia virus
uuacauauuuacuggua

SEQ ID NO: 4061618 - RNA, 22 nt, Vaccinia virus
uuacaucaccucuaacaucauc

SEQ ID NO: 4061619 - RNA, 16 nt, Vaccinia virus
uuacaucuaguucuuu

SEQ ID NO: 4061620 - RNA, 17 nt, Vaccinia virus
uuacauuaguaaucuuu

SEQ ID NO: 4061621 - RNA, 16 nt, Vaccinia virus
uuacauuauaagaaau

SEQ ID NO: 4061622 - RNA, 16 nt, Vaccinia virus
uuaccaacucuuuaau

SEQ ID NO: 4061623 - RNA, 20 nt, Vaccinia virus
uuaccagcauuaguaacagc

SEQ ID NO: 4061624 - RNA, 12 nt, Vaccinia virus
uuaccuauucac

SEQ ID NO: 4061625 - RNA, 15 nt, Vaccinia virus
uuacgaaucauuaaa

SEQ ID NO: 4061626 - RNA, 20 nt, Vaccinia virus
uuacguggagaaaucauguu

SEQ ID NO: 4061627 - RNA, 20 nt, Vaccinia virus
uuacuaguuuuccaguguuc

SEQ ID NO: 4061628 - RNA, 22 nt, Vaccinia virus
uuacuauguuguuuaugucuuu

SEQ ID NO: 4061629 - RNA, 15 nt, Vaccinia virus
uuacucuaaaucgcu

SEQ ID NO: 4061630 - RNA, 21 nt, Vaccinia virus
uuacugcugcguuaaacauuc

SEQ ID NO: 4061631 - RNA, 21 nt, Vaccinia virus
uuacuggugcuccuguagcau

SEQ ID NO: 4061632 - RNA, 22 nt, Vaccinia virus
uuagaaaaaaugaugcugguua

SEQ ID NO: 4061633 - RNA, 20 nt, Vaccinia virus
uuagaaaacucucuauuucu

SEQ ID NO: 4061634 - RNA, 23 nt, Vaccinia virus
uuagaaaacucucuauuucuuaa

SEQ ID NO: 4061635 - RNA, 17 nt, Vaccinia virus
uuagaaaauucucuuac

SEQ ID NO: 4061636 - RNA, 16 nt, Vaccinia virus
uuagaaggaguguuuu

SEQ ID NO: 4061637 - RNA, 17 nt, Vaccinia virus
uuagaauagucucuuua

SEQ ID NO: 4061638 - RNA, 19 nt, Vaccinia virus
uuagaaucauugcuguaaa

SEQ ID NO: 4061639 - RNA, 19 nt, Vaccinia virus
uuagacagugguuucaugu

SEQ ID NO: 4061640 - RNA, 17 nt, Vaccinia virus
uuagacgcuuauuauua

SEQ ID NO: 4061641 - RNA, 22 nt, Vaccinia virus
uuagacuguuuguagaaugcug

SEQ ID NO: 4061642 - RNA, 14 nt, Vaccinia virus
uuagacuuguauuc

SEQ ID NO: 4061643 - RNA, 21 nt, Vaccinia virus
uuagagauaauauccugaaca

SEQ ID NO: 4061644 - RNA, 19 nt, Vaccinia virus
uuagaguaguaucauuaaa

SEQ ID NO: 4061645 - RNA, 20 nt, Vaccinia virus
uuagauaaauggaauacuaa

SEQ ID NO: 4061646 - RNA, 17 nt, Vaccinia virus
uuagauaauugugguaa

SEQ ID NO: 4061647 - RNA, 18 nt, Vaccinia virus
uuuaaacacucuuucuga

SEQ ID NO: 4061648 - RNA, 20 nt, Vaccinia virus
uuuaaauauuauauaaacau

SEQ ID NO: 4061649 - RNA, 18 nt, Vaccinia virus
uuuaacaaaguuauucau

SEQ ID NO: 4061650 - RNA, 15 nt, Vaccinia virus
uuuaacaauuucuau

SEQ ID NO: 4061651 - RNA, 12 nt, Vaccinia virus
uuuaacacuaua

SEQ ID NO: 4061652 - RNA, 16 nt, Vaccinia virus
uuuaagaaauggugua

SEQ ID NO: 4061653 - RNA, 23 nt, Vaccinia virus
uuuaagacugcugaauguaucuu

SEQ ID NO: 4061654 - RNA, 14 nt, Vaccinia virus
uuuaauacagaugg

SEQ ID NO: 4061655 - RNA, 16 nt, Vaccinia virus
uuuaauagauauacac

SEQ ID NO: 4061656 - RNA, 18 nt, Vaccinia virus
uuuaaugacgaauucaua

SEQ ID NO: 4061657 - RNA, 21 nt, Vaccinia virus
uuuaccgacacccguuucaug

SEQ ID NO: 4061658 - RNA, 17 nt, Vaccinia virus
uuuaccucuucugauau

SEQ ID NO: 4061659 - RNA, 22 nt, Vaccinia virus
uuuacgagcuauuaaacuguuu

SEQ ID NO: 4061660 - RNA, 21 nt, Vaccinia virus
uuuacuuuucuaaauucauaa

SEQ ID NO: 4061661 - RNA, 20 nt, Vaccinia virus
uuuagaaauguuauauauaa

SEQ ID NO: 4061662 - RNA, 16 nt, Vaccinia virus
uuuagaagugauucuu

SEQ ID NO: 4061663 - RNA, 19 nt, Vaccinia virus
uuuagaauauauguaugua

SEQ ID NO: 4061664 - RNA, 18 nt, Vaccinia virus
uuuagaugaauuauuauu

SEQ ID NO: 4061665 - RNA, 14 nt, Vaccinia virus
uuuagucgagauau

SEQ ID NO: 4061666 - RNA, 14 nt, Vaccinia virus
uuuaguguagauau

SEQ ID NO: 4061667 - RNA, 15 nt, Vaccinia virus
uuuauaaacaaaaau

SEQ ID NO: 4061668 - RNA, 14 nt, Vaccinia virus
uuuauacuucuaau

SEQ ID NO: 4061669 - RNA, 14 nt, Vaccinia virus
uuuauagaauuuag

SEQ ID NO: 4061670 - RNA, 20 nt, Vaccinia virus
uuuaucucgaggauacguaa

SEQ ID NO: 4061671 - RNA, 22 nt, Vaccinia virus
uuuaugaaugaugauauauaac

SEQ ID NO: 4061672 - RNA, 15 nt, Vaccinia virus
uuuaugauacguaca

SEQ ID NO: 4061673 - RNA, 17 nt, Vaccinia virus
uuuauguuaaaucaauu

SEQ ID NO: 4061674 - RNA, 14 nt, Vaccinia virus
uuuauuaaauacuc

SEQ ID NO: 4061675 - RNA, 19 nt, Vaccinia virus
uuuauuaagaaaauucaga

SEQ ID NO: 4061676 - RNA, 22 nt, Vaccinia virus
uuuauuuaaggacuuaacaauu

SEQ ID NO: 4061677 - RNA, 13 nt, Vaccinia virus
uuuauuuauucuc

SEQ ID NO: 4061678 - RNA, 14 nt, Vaccinia virus
uuuauuuuauucua

SEQ ID NO: 4061679 - RNA, 19 nt, Vaccinia virus
uuucaaagcaauuguauua

SEQ ID NO: 4061680 - RNA, 14 nt, Vaccinia virus
uuucaccaauaaga

SEQ ID NO: 4061681 - RNA, 16 nt, Vaccinia virus
uuucagaaucuagauu

SEQ ID NO: 4061682 - RNA, 16 nt, Vaccinia virus
uuucagaggaauacag

SEQ ID NO: 4061683 - RNA, 13 nt, Vaccinia virus
uuucaucgaugau

SEQ ID NO: 4061684 - RNA, 14 nt, Vaccinia virus
uuucaucuagauac

SEQ ID NO: 4061685 - RNA, 14 nt, Vaccinia virus
uuucauguucgaaa

SEQ ID NO: 4061686 - RNA, 12 nt, Vaccinia virus
uuuccaaagaua

SEQ ID NO: 4061687 - RNA, 21 nt, Vaccinia virus
uuuccaaaucaguaacuaugu

SEQ ID NO: 4061688 - RNA, 20 nt, Vaccinia virus
uuuccauggcccauucuauu

SEQ ID NO: 4061689 - RNA, 16 nt, Vaccinia virus
uuucccagcauuaacu

SEQ ID NO: 4061690 - RNA, 19 nt, Vaccinia virus
uuuccuaguauucgucaaa

SEQ ID NO: 4061691 - RNA, 21 nt, Vaccinia virus
uuucgauucuggcuauuucaa

SEQ ID NO: 4061692 - RNA, 21 nt, Vaccinia virus
uuucuaccaaccaagaauaac

SEQ ID NO: 4061693 - RNA, 16 nt, Vaccinia virus
uuucuacuacuucauu

SEQ ID NO: 4061694 - RNA, 16 nt, Vaccinia virus
uuucucaaagauguua

SEQ ID NO: 4061695 - RNA, 16 nt, Vaccinia virus
uuucuccacuacauau

SEQ ID NO: 4061696 - RNA, 22 nt, Vaccinia virus
uuucugguguaauauucuaguu

SEQ ID NO: 4061697 - RNA, 16 nt, Vaccinia virus
uuucugguuagauaac

SEQ ID NO: 4061698 - RNA, 18 nt, Vaccinia virus
uuucuguaaauucaugau

SEQ ID NO: 4061699 - RNA, 22 nt, Vaccinia virus
uuugaaaauguuacugaagaau

SEQ ID NO: 4061700 - RNA, 12 nt, Vaccinia virus
uuugaaacugaa

SEQ ID NO: 4061701 - RNA, 19 nt, Vaccinia virus
uuugaauauacuuuuaauu

SEQ ID NO: 4061702 - RNA, 19 nt, Vaccinia virus
uuugaauuaguuuauaauu

SEQ ID NO: 4061703 - RNA, 14 nt, Vaccinia virus
uuugacgacaacca

SEQ ID NO: 4061704 - RNA, 15 nt, Vaccinia virus
uuugagauuucauaa

SEQ ID NO: 4061705 - RNA, 17 nt, Vaccinia virus
uuugagguaaucuucuu

SEQ ID NO: 4061706 - RNA, 18 nt, Vaccinia virus
uuugauaaauuucuucuu

SEQ ID NO: 4061707 - RNA, 16 nt, Vaccinia virus
uuugauacccugauau

SEQ ID NO: 4061708 - RNA, 17 nt, Vaccinia virus
uuugauauuacuaaaca

SEQ ID NO: 4061709 - RNA, 21 nt, Vaccinia virus
uuugauauuacuaaacacaca

SEQ ID NO: 4061710 - RNA, 19 nt, Vaccinia virus
uuugccaagguuagaugua

SEQ ID NO: 4061711 - RNA, 21 nt, Vaccinia virus
uuuggaaacauaaaauaacuc

SEQ ID NO: 4061712 - RNA, 22 nt, Vaccinia virus
uuuggcuaaacuauauaauucu

SEQ ID NO: 4061713 - RNA, 14 nt, Vaccinia virus
uuuggcucuucuau

SEQ ID NO: 4061714 - RNA, 23 nt, Vaccinia virus
uuuggucccgauaccauuaaaga

SEQ ID NO: 4061715 - RNA, 18 nt, Vaccinia virus
uuuguaaagcuauguaaa

SEQ ID NO: 4061716 - RNA, 22 nt, Vaccinia virus
uuuguaaauaacuaucuauaaa

SEQ ID NO: 4061717 - RNA, 23 nt, Vaccinia virus
uuuguacagaacguaguaguuua

SEQ ID NO: 4061718 - RNA, 17 nt, Vaccinia virus
uuuguaccuuuguacau

SEQ ID NO: 4061719 - RNA, 13 nt, Vaccinia virus
uuuguauguacca

SEQ ID NO: 4061720 - RNA, 14 nt, Vaccinia virus
uuuguauucauaga

SEQ ID NO: 4061721 - RNA, 16 nt, Vaccinia virus
uuugucauuaacuuua

SEQ ID NO: 4061722 - RNA, 14 nt, Vaccinia virus
uuuguguugugcau

SEQ ID NO: 4061723 - RNA, 14 nt, Vaccinia virus
uuuuaaacacucuu

SEQ ID NO: 4061724 - RNA, 14 nt, Vaccinia virus
uuuuaaggggaaaa

SEQ ID NO: 4061725 - RNA, 14 nt, Vaccinia virus
uuuuaauauaaacg

SEQ ID NO: 4061726 - RNA, 16 nt, Vaccinia virus
uuuuaauguauaacag

SEQ ID NO: 4061727 - RNA, 23 nt, Vaccinia virus
uuuuacauggauuuaucauauca

SEQ ID NO: 4061728 - RNA, 18 nt, Vaccinia virus
uuuuacguaguaaucguc

SEQ ID NO: 4061729 - RNA, 18 nt, Vaccinia virus
uuuuagaaauguuauaua

SEQ ID NO: 4061730 - RNA, 15 nt, Vaccinia virus
uuuuagcagucuaac

SEQ ID NO: 4061731 - RNA, 20 nt, Vaccinia virus
uuuuagccagagauaucaua

SEQ ID NO: 4061732 - RNA, 13 nt, Vaccinia virus
uuuuauacuucua

SEQ ID NO: 4061733 - RNA, 19 nt, Vaccinia virus
uuuuauggcaaacuuuacu

SEQ ID NO: 4061734 - RNA, 12 nt, Vaccinia virus
uuuuauuuaauu

SEQ ID NO: 4061735 - RNA, 15 nt, Vaccinia virus
uuuucacuaaauaag

SEQ ID NO: 4061736 - RNA, 18 nt, Vaccinia virus
uuuucauuagcaugaauc

SEQ ID NO: 4061737 - RNA, 15 nt, Vaccinia virus
uuuucguguuccaaa

SEQ ID NO: 4061738 - RNA, 21 nt, Vaccinia virus
uuuugaaggauuggacaaauc

SEQ ID NO: 4061739 - RNA, 23 nt, Vaccinia virus
uuuugacaaagauggucuaaaau

SEQ ID NO: 4061740 - RNA, 15 nt, Vaccinia virus
uuuugcgcuauuaaa

SEQ ID NO: 4061741 - RNA, 22 nt, Vaccinia virus
uuuugguuucuuucauuucagu

SEQ ID NO: 4061742 - RNA, 20 nt, Vaccinia virus
uuuuguuggagaacuugaua

SEQ ID NO: 4061743 - RNA, 19 nt, Vaccinia virus
uuuuuaaagguaucuaaug

SEQ ID NO: 4061744 - RNA, 15 nt, Vaccinia virus
uuuuuacuaaucaua

SEQ ID NO: 4061745 - RNA, 21 nt, Vaccinia virus
uuuuuauaaaaacuuuuagaa

SEQ ID NO: 4061746 - RNA, 21 nt, Vaccinia virus
uuuuuauaaaaugacaucguu

SEQ ID NO: 4061747 - RNA, 21 nt, Vaccinia virus
uuuuuauuacauguuuucaua

SEQ ID NO: 4061748 - RNA, 17 nt, Vaccinia virus
uuuuucaucuuuacaua

SEQ ID NO: 4061749 - RNA, 13 nt, Vaccinia virus
uuuuucaugauug

SEQ ID NO: 4061750 - RNA, 19 nt, Vaccinia virus
uuuuucuucauuuaucaua

SEQ ID NO: 4061751 - RNA, 15 nt, Vaccinia virus
uuuuugacuuacaua

SEQ ID NO: 4061752 - RNA, 19 nt, Vaccinia virus
uuuuugcaggaaguauauc

SEQ ID NO: 4061753 - RNA, 18 nt, Vaccinia virus
uuuuuuagauguaguauc

SEQ ID NO: 4061754 - RNA, 21 nt, Vaccinia virus
ggaauuaaucuaguagaaaag

SEQ ID NO: 4061755 - RNA, 16 nt, Vaccinia virus
ggacaaauucuuuuga

SEQ ID NO: 4061756 - RNA, 19 nt, Vaccinia virus
ggacauacguauauuucua

SEQ ID NO: 4061757 - RNA, 21 nt, Vaccinia virus
ggacaucgacgccuuagaaau

SEQ ID NO: 4061758 - RNA, 22 nt, Vaccinia virus
ggaccacauccuucuucaucaa

SEQ ID NO: 4061759 - RNA, 22 nt, Vaccinia virus
ggacgacauauuaaucuuuuua

SEQ ID NO: 4061760 - RNA, 18 nt, Vaccinia virus
ggacgauauauuguuuca

SEQ ID NO: 4061761 - RNA, 17 nt, Vaccinia virus
ggagacauccauugaua

SEQ ID NO: 4061762 - RNA, 17 nt, Vaccinia virus
ggagguggauauuucug

SEQ ID NO: 4061763 - RNA, 13 nt, Vaccinia virus
ggaguuagaaaac

SEQ ID NO: 4061764 - RNA, 18 nt, Vaccinia virus
ggauaaaacaaaaaugcu

SEQ ID NO: 4061765 - RNA, 22 nt, Vaccinia virus
ggauacguccguccaagaauac

SEQ ID NO: 4061766 - RNA, 21 nt, Vaccinia virus
ggaucuaaaauccauauuuuc

SEQ ID NO: 4061767 - RNA, 20 nt, Vaccinia virus
ggaucuccaucauccacaug

SEQ ID NO: 4061768 - RNA, 23 nt, Vaccinia virus
ggaugguccaaacugccacugau

SEQ ID NO: 4061769 - RNA, 13 nt, Vaccinia virus
ggcaaaagaauac

SEQ ID NO: 4061770 - RNA, 17 nt, Vaccinia virus
ggcaugcaugugccugc

SEQ ID NO: 4061771 - RNA, 14 nt, Vaccinia virus
ggcauuuguauuuu

SEQ ID NO: 4061772 - RNA, 22 nt, Vaccinia virus
ggcggauguugugaaugacauc

SEQ ID NO: 4061773 - RNA, 13 nt, Vaccinia virus
ggcucauugauua

SEQ ID NO: 4061774 - RNA, 17 nt, Vaccinia virus
gggaaauauggaagaaa

SEQ ID NO: 4061775 - RNA, 23 nt, Vaccinia virus
gguagauguuuggagaaaugaga

SEQ ID NO: 4061776 - RNA, 19 nt, Vaccinia virus
gguagcuuccagauuuaaa

SEQ ID NO: 4061777 - RNA, 15 nt, Vaccinia virus
gguauauguuuacca

SEQ ID NO: 4061778 - RNA, 22 nt, Vaccinia virus
ggucaaccccuaagucuuuuua

SEQ ID NO: 4061779 - RNA, 12 nt, Vaccinia virus
ggucagaaauau

SEQ ID NO: 4061780 - RNA, 15 nt, Vaccinia virus
ggucuaucaauaacu

SEQ ID NO: 4061781 - RNA, 13 nt, Vaccinia virus
ggucuaucuauua

SEQ ID NO: 4061782 - RNA, 19 nt, Vaccinia virus
ggugucuccauguacauac

SEQ ID NO: 4061783 - RNA, 17 nt, Vaccinia virus
guaaaaaguuuauuaau

SEQ ID NO: 4061784 - RNA, 13 nt, Vaccinia virus
guaaaacaaacuu

SEQ ID NO: 4061785 - RNA, 19 nt, Vaccinia virus
guaaaagaucuauaauguc

SEQ ID NO: 4061786 - RNA, 17 nt, Vaccinia virus
guaaaaucaaacacaag

SEQ ID NO: 4061787 - RNA, 18 nt, Vaccinia virus
guaaaaugaaauaucuua

SEQ ID NO: 4061788 - RNA, 14 nt, Vaccinia virus
guaaacauaucaua

SEQ ID NO: 4061789 - RNA, 13 nt, Vaccinia virus
guaaagauaucua

SEQ ID NO: 4061790 - RNA, 14 nt, Vaccinia virus
guaaauaauaauau

SEQ ID NO: 4061791 - RNA, 13 nt, Vaccinia virus
guaaaucuuuuca

SEQ ID NO: 4061792 - RNA, 17 nt, Vaccinia virus
guaaauguuuuuaucau

SEQ ID NO: 4061793 - RNA, 19 nt, Vaccinia virus
guaaauuuuaucaugugua

SEQ ID NO: 4061794 - RNA, 18 nt, Vaccinia virus
gugcauacgcauucaucu

SEQ ID NO: 4061795 - RNA, 19 nt, Vaccinia virus
gugccaaaaugauauacag

SEQ ID NO: 4061796 - RNA, 18 nt, Vaccinia virus
gugcucaagcuaaacaag

SEQ ID NO: 4061797 - RNA, 15 nt, Vaccinia virus
gugcuuaauguuucc

SEQ ID NO: 4061798 - RNA, 19 nt, Vaccinia virus
guggaagcugaacacauua

SEQ ID NO: 4061799 - RNA, 19 nt, Vaccinia virus
guggucaauuacaaauaaa

SEQ ID NO: 4061800 - RNA, 21 nt, Vaccinia virus
guguacguauauuuagauguu

SEQ ID NO: 4061801 - RNA, 22 nt, Vaccinia virus
guguauuaccccucauaguauu

SEQ ID NO: 4061802 - RNA, 12 nt, Vaccinia virus
guguauuuccau

SEQ ID NO: 4061803 - RNA, 15 nt, Vaccinia virus
guguauuuccaucau

SEQ ID NO: 4061804 - RNA, 15 nt, Vaccinia virus
guguccauaauccuc

SEQ ID NO: 4061805 - RNA, 15 nt, Vaccinia virus
gugucgauucaucaa

SEQ ID NO: 4061806 - RNA, 15 nt, Vaccinia virus
gugucugaaucgaua

SEQ ID NO: 4061807 - RNA, 13 nt, Vaccinia virus
guguuaaaacaau

SEQ ID NO: 4061808 - RNA, 10 nt, Vaccinia virus
guguuagcca

SEQ ID NO: 4061809 - RNA, 13 nt, Vaccinia virus
guguuauaauauu

SEQ ID NO: 4061810 - RNA, 22 nt, Vaccinia virus
guguuccggagaaucaguaaag

SEQ ID NO: 4061811 - RNA, 15 nt, Vaccinia virus
guguuuuaguuuauc

SEQ ID NO: 4061812 - RNA, 13 nt, Vaccinia virus
guuaaaaaaaaga

SEQ ID NO: 4061813 - RNA, 14 nt, Vaccinia virus
guuaaaaauuuaga

SEQ ID NO: 4061814 - RNA, 19 nt, Vaccinia virus
guuaaaggauauuaugcau

SEQ ID NO: 4061815 - RNA, 17 nt, Vaccinia virus
guuaagagaauaauaga

SEQ ID NO: 4061816 - RNA, 17 nt, Vaccinia virus
guuaauaaguaaaugaa

SEQ ID NO: 4061817 - RNA, 23 nt, Vaccinia virus
guuaauauagacaauucuuuugu

SEQ ID NO: 4061818 - RNA, 17 nt, Vaccinia virus
guuaaucccaacaauga

SEQ ID NO: 4061819 - RNA, 19 nt, Vaccinia virus
guuaauuaugcaaauuuga

SEQ ID NO: 4061820 - RNA, 13 nt, Vaccinia virus
guuacaaauguag

SEQ ID NO: 4061821 - RNA, 18 nt, Vaccinia virus
guuacaauuuguuaaaaa

SEQ ID NO: 4061822 - RNA, 16 nt, Vaccinia virus
guuacaccaaaaaaga

SEQ ID NO: 4061823 - RNA, 22 nt, Vaccinia virus
guuacacgcauccuuauaaaga

SEQ ID NO: 4061824 - RNA, 16 nt, Vaccinia virus
guuacgauuuuaucau

SEQ ID NO: 4061825 - RNA, 21 nt, Vaccinia virus
guuacucaguugaacagauga

SEQ ID NO: 4061826 - RNA, 18 nt, Vaccinia virus
guuagaaucauuuaucau

SEQ ID NO: 4061827 - RNA, 14 nt, Vaccinia virus
guuagacauaaaaa

SEQ ID NO: 4061828 - RNA, 19 nt, Vaccinia virus
guuagaugauuauaaagga

SEQ ID NO: 4061829 - RNA, 22 nt, Vaccinia virus
guuagaugguaaaauacaaaau

SEQ ID NO: 4061830 - RNA, 15 nt, Vaccinia virus
guuagauguuaaaaa

SEQ ID NO: 4061831 - RNA, 16 nt, Vaccinia virus
guuaguucucuuuuca

SEQ ID NO: 4061832 - RNA, 19 nt, Vaccinia virus
guuauacgucauuucaucu

SEQ ID NO: 4061833 - RNA, 15 nt, Vaccinia virus
guuauauauaaaaga

SEQ ID NO: 4061834 - RNA, 23 nt, Vaccinia virus
guuauauguaacauugaguaaau

SEQ ID NO: 4061835 - RNA, 21 nt, Vaccinia virus
guuaucaucguauaaauuaaa

SEQ ID NO: 4061836 - RNA, 18 nt, Vaccinia virus
guuaucaugaaauguuug

SEQ ID NO: 4061837 - RNA, 11 nt, Vaccinia virus
guuaucuuuug

SEQ ID NO: 4061838 - RNA, 23 nt, Vaccinia virus
guuaugaaucuggauugccuaaa

SEQ ID NO: 4061839 - RNA, 22 nt, Vaccinia virus
guuauuacuacugaagaacuac

SEQ ID NO: 4061840 - RNA, 15 nt, Vaccinia virus
guuauuauaaacucu

SEQ ID NO: 4061841 - RNA, 13 nt, Vaccinia virus
guuauuauacaug

SEQ ID NO: 4061842 - RNA, 19 nt, Vaccinia virus
guuauucucggaugcuaaa

SEQ ID NO: 4061843 - RNA, 15 nt, Vaccinia virus
guucaaaaccuuuga

SEQ ID NO: 4061844 - RNA, 14 nt, Vaccinia virus
guucaaauauauga

SEQ ID NO: 4061845 - RNA, 12 nt, Vaccinia virus
guucaaauuaag

SEQ ID NO: 4061846 - RNA, 16 nt, Vaccinia virus
guucaccuucuauaga

SEQ ID NO: 4061847 - RNA, 18 nt, Vaccinia virus
guucauaagucuaauaga

SEQ ID NO: 4061848 - RNA, 18 nt, Vaccinia virus
guucauaaucucaucauc

SEQ ID NO: 4061849 - RNA, 15 nt, Vaccinia virus
guucaucacauaugc

SEQ ID NO: 4061850 - RNA, 21 nt, Vaccinia virus
guucauuaaaaacaaacuuuu

SEQ ID NO: 4061851 - RNA, 12 nt, Vaccinia virus
guuccauggcag

SEQ ID NO: 4061852 - RNA, 15 nt, Vaccinia virus
guuccauuacaaaua

SEQ ID NO: 4061853 - RNA, 22 nt, Vaccinia virus
guuccugguauauagauaaaga

SEQ ID NO: 4061854 - RNA, 19 nt, Vaccinia virus
guuccuguagauaauaacu

SEQ ID NO: 4061855 - RNA, 23 nt, Vaccinia virus
guucguaaacgaacuauaucauc

SEQ ID NO: 4061856 - RNA, 21 nt, Vaccinia virus
guucgugccaauugaguaaca

SEQ ID NO: 4061857 - RNA, 18 nt, Vaccinia virus
guucuaaauuuagauagu

SEQ ID NO: 4061858 - RNA, 13 nt, Vaccinia virus
guucuaacaucau

SEQ ID NO: 4061859 - RNA, 21 nt, Vaccinia virus
guucuaaugugauucucugaa

SEQ ID NO: 4061860 - RNA, 21 nt, Vaccinia virus
guucuagcccucuucaagaac

SEQ ID NO: 4061861 - RNA, 23 nt, Vaccinia virus
guucuagucgguauuucaucauu

SEQ ID NO: 4061862 - RNA, 21 nt, Vaccinia virus
guucuaguuccgcauuaaaug

SEQ ID NO: 4061863 - RNA, 12 nt, Vaccinia virus
guucucuaaaug

SEQ ID NO: 4061864 - RNA, 17 nt, Vaccinia virus
guucugggaauagaaac

SEQ ID NO: 4061865 - RNA, 19 nt, Vaccinia virus
guucuucgcagaugaugau

SEQ ID NO: 4061866 - RNA, 16 nt, Vaccinia virus
guucuuugaacaucuu

SEQ ID NO: 4061867 - RNA, 15 nt, Vaccinia virus
guucuuuuagaaaau

SEQ ID NO: 4061868 - RNA, 17 nt, Vaccinia virus
guugacgcuguaaaaga

SEQ ID NO: 4061869 - RNA, 20 nt, Vaccinia virus
guugagcuaauuuuuguaaa

SEQ ID NO: 4061870 - RNA, 12 nt, Vaccinia virus
guugauauuaac

SEQ ID NO: 4061871 - RNA, 23 nt, Vaccinia virus
guugaucucaagccgucuuuucu

SEQ ID NO: 4061872 - RNA, 19 nt, Vaccinia virus
guugaugugacuguuuucu

SEQ ID NO: 4061873 - RNA, 16 nt, Vaccinia virus
guugauuacucuuuuu

SEQ ID NO: 4061874 - RNA, 17 nt, Vaccinia virus
guuggaaaaaugaugaa

SEQ ID NO: 4061875 - RNA, 20 nt, Vaccinia virus
guuguacaaauggagauauu

SEQ ID NO: 4061876 - RNA, 10 nt, Vaccinia virus
guuguauuua

SEQ ID NO: 4061877 - RNA, 17 nt, Vaccinia virus
guuguuaaaaaauuaag

SEQ ID NO: 4061878 - RNA, 23 nt, Vaccinia virus
guuguuacauuaguaaucuuuuu

SEQ ID NO: 4061879 - RNA, 16 nt, Vaccinia virus
guuguuccuagauaug

SEQ ID NO: 4061880 - RNA, 14 nt, Vaccinia virus
guuuaaaacuucua

SEQ ID NO: 4061881 - RNA, 21 nt, Vaccinia virus
guuuaacgaggacuuauucag

SEQ ID NO: 4061882 - RNA, 13 nt, Vaccinia virus
guuuaauacuuau

SEQ ID NO: 4061883 - RNA, 13 nt, Vaccinia virus
guuuaauauccuc

SEQ ID NO: 4061884 - RNA, 21 nt, Vaccinia virus
guuuacaaacugaauaauauc

SEQ ID NO: 4061885 - RNA, 19 nt, Vaccinia virus
guuuagacggcaacauaga

SEQ ID NO: 4061886 - RNA, 17 nt, Vaccinia virus
guuuagcuauucguaac

SEQ ID NO: 4061887 - RNA, 14 nt, Vaccinia virus
guuuauagauguuc

SEQ ID NO: 4061888 - RNA, 19 nt, Vaccinia virus
uaaaaacaaauuuguacau

SEQ ID NO: 4061889 - RNA, 21 nt, Vaccinia virus
uaaaaaccaucgucugaaucc

SEQ ID NO: 4061890 - RNA, 16 nt, Vaccinia virus
uaaaaacucauuacau

SEQ ID NO: 4061891 - RNA, 21 nt, Vaccinia virus
uaaaaacucuaacauguguuu

SEQ ID NO: 4061892 - RNA, 15 nt, Vaccinia virus
uaaaaagauaaacuu

SEQ ID NO: 4061893 - RNA, 19 nt, Vaccinia virus
uaaaaagaugauauaucua

SEQ ID NO: 4061894 - RNA, 16 nt, Vaccinia virus
uaaaaaggaaauacuu

SEQ ID NO: 4061895 - RNA, 16 nt, Vaccinia virus
uaaaaauaauauuguu

SEQ ID NO: 4061896 - RNA, 15 nt, Vaccinia virus
uaaaaauaauuauua

SEQ ID NO: 4061897 - RNA, 14 nt, Vaccinia virus
uaaaaauaugugcu

SEQ ID NO: 4061898 - RNA, 14 nt, Vaccinia virus
uaaaaauuauguuu

SEQ ID NO: 4061899 - RNA, 12 nt, Vaccinia virus
uaaaacauaaag

SEQ ID NO: 4061900 - RNA, 14 nt, Vaccinia virus
uaaaacauuugcau

SEQ ID NO: 4061901 - RNA, 20 nt, Vaccinia virus
uaaaacuaucucgacuuauu

SEQ ID NO: 4061902 - RNA, 22 nt, Vaccinia virus
uaaaacuggagagacugauuac

SEQ ID NO: 4061903 - RNA, 17 nt, Vaccinia virus
uaaaagacaaaucuugu

SEQ ID NO: 4061904 - RNA, 13 nt, Vaccinia virus
uaaaagacuuauu

SEQ ID NO: 4061905 - RNA, 18 nt, Vaccinia virus
uaaaaguuaaugagagca

SEQ ID NO: 4061906 - RNA, 15 nt, Vaccinia virus
uaaaauacuacuguu

SEQ ID NO: 4061907 - RNA, 12 nt, Vaccinia virus
uaaaauaucuua

SEQ ID NO: 4061908 - RNA, 14 nt, Vaccinia virus
uaaaauauguaguc

SEQ ID NO: 4061909 - RNA, 12 nt, Vaccinia virus
uaaaaugagcau

SEQ ID NO: 4061910 - RNA, 17 nt, Vaccinia virus
uaaaaugauauuucauu

SEQ ID NO: 4061911 - RNA, 15 nt, Vaccinia virus
uaaaaugguaaacuu

SEQ ID NO: 4061912 - RNA, 17 nt, Vaccinia virus
uaaaauguccacagaua

SEQ ID NO: 4061913 - RNA, 15 nt, Vaccinia virus
uaaaauuacuuaaag

SEQ ID NO: 4061914 - RNA, 22 nt, Vaccinia virus
uaaaauuaucuacacaaauaga

SEQ ID NO: 4061915 - RNA, 20 nt, Vaccinia virus
uaaaauuauugauauguaua

SEQ ID NO: 4061916 - RNA, 22 nt, Vaccinia virus
uaaaauuccuaacgaugauaug

SEQ ID NO: 4061917 - RNA, 15 nt, Vaccinia virus
uaaaauuuaaaauga

SEQ ID NO: 4061918 - RNA, 21 nt, Vaccinia virus
uaaacaaacuaauaaacauuc

SEQ ID NO: 4061919 - RNA, 18 nt, Vaccinia virus
uaaacaagcuaucucuug

SEQ ID NO: 4061920 - RNA, 15 nt, Vaccinia virus
uaaacaauuucacaa

SEQ ID NO: 4061921 - RNA, 17 nt, Vaccinia virus
uaaacacacauuauuca

SEQ ID NO: 4061922 - RNA, 16 nt, Vaccinia virus
uaaacacgaauacuau

SEQ ID NO: 4061923 - RNA, 20 nt, Vaccinia virus
uaaacagcauuucugucaac

SEQ ID NO: 4061924 - RNA, 22 nt, Vaccinia virus
uaaacauaaauauccauuggaa

SEQ ID NO: 4061925 - RNA, 17 nt, Vaccinia virus
uaaacaucuugauacuu

SEQ ID NO: 4061926 - RNA, 13 nt, Vaccinia virus
uaaacauggauuu

SEQ ID NO: 4061927 - RNA, 23 nt, Vaccinia virus
uaaacauuaucgagcaagcauug

SEQ ID NO: 4061928 - RNA, 23 nt, Vaccinia virus
uaaacauuguuuguauucuccag

SEQ ID NO: 4061929 - RNA, 21 nt, Vaccinia virus
uaaacccucgaucaugaaugg

SEQ ID NO: 4061930 - RNA, 18 nt, Vaccinia virus
uaaaccgauaguguauaa

SEQ ID NO: 4061931 - RNA, 15 nt, Vaccinia virus
uaaacgauauucuug

SEQ ID NO: 4061932 - RNA, 20 nt, Vaccinia virus
uaaacgauuuuccaaaucag

SEQ ID NO: 4061933 - RNA, 20 nt, Vaccinia virus
uaaacgcgucaaauuuuuca

SEQ ID NO: 4061934 - RNA, 23 nt, Vaccinia virus
uaaacggcaaaccaaaaacauuu

SEQ ID NO: 4061935 - RNA, 18 nt, Vaccinia virus
uaaacggcuuuuaaacag

SEQ ID NO: 4061936 - RNA, 18 nt, Vaccinia virus
uaaacguauucaugacau

SEQ ID NO: 4061937 - RNA, 18 nt, Vaccinia virus
uaaacuacucgaacagau

SEQ ID NO: 4061938 - RNA, 15 nt, Vaccinia virus
uaaacuacuggaaua

SEQ ID NO: 4061939 - RNA, 20 nt, Vaccinia virus
uaaacuauacuaugaugucu

SEQ ID NO: 4061940 - RNA, 20 nt, Vaccinia virus
uaaacuauuuuaccagcauu

SEQ ID NO: 4061941 - RNA, 17 nt, Vaccinia virus
uaaacucacauuucaaa

SEQ ID NO: 4061942 - RNA, 17 nt, Vaccinia virus
uaaacucuuuaguuucc

SEQ ID NO: 4061943 - RNA, 23 nt, Vaccinia virus
uaaacugcgccaaauuguggcau

SEQ ID NO: 4061944 - RNA, 12 nt, Vaccinia virus
uaaagaaaauau

SEQ ID NO: 4061945 - RNA, 17 nt, Vaccinia virus
uaaagaaaugucuacau

SEQ ID NO: 4061946 - RNA, 15 nt, Vaccinia virus
uaaagacaaacaaug

SEQ ID NO: 4061947 - RNA, 17 nt, Vaccinia virus
uaaagacaacgaauaca

SEQ ID NO: 4061948 - RNA, 21 nt, Vaccinia virus
uaaagauauucuaaaauggua

SEQ ID NO: 4061949 - RNA, 19 nt, Vaccinia virus
uaaagcauauuccauuaau

SEQ ID NO: 4061950 - RNA, 15 nt, Vaccinia virus
uaaaggaugauacau

SEQ ID NO: 4061951 - RNA, 14 nt, Vaccinia virus
uaaagucugucaaa

SEQ ID NO: 4061952 - RNA, 21 nt, Vaccinia virus
uaaaguuagaugugucauacu

SEQ ID NO: 4061953 - RNA, 15 nt, Vaccinia virus
uaaauaaauaauguu

SEQ ID NO: 4061954 - RNA, 13 nt, Vaccinia virus
uaaauauaaacac

SEQ ID NO: 4061955 - RNA, 13 nt, Vaccinia virus
uaaauauauuuac

SEQ ID NO: 4061956 - RNA, 14 nt, Vaccinia virus
uaaauaucauuaau

SEQ ID NO: 4061957 - RNA, 13 nt, Vaccinia virus
uaaauauuucauu

SEQ ID NO: 4061958 - RNA, 16 nt, Vaccinia virus
uaaaucaacagaaguu

SEQ ID NO: 4061959 - RNA, 15 nt, Vaccinia virus
uaaaucaauaucucu

SEQ ID NO: 4061960 - RNA, 23 nt, Vaccinia virus
uaaauccaaauucggaucuaauu

SEQ ID NO: 4061961 - RNA, 14 nt, Vaccinia virus
uaaaucuauuauau

SEQ ID NO: 4061962 - RNA, 19 nt, Vaccinia virus
uaaaucuguauaucuuucc

SEQ ID NO: 4061963 - RNA, 18 nt, Vaccinia virus
uaaaucuguuucuaaaga

SEQ ID NO: 4061964 - RNA, 23 nt, Vaccinia virus
uaaaugaaguacuguucaaacau

SEQ ID NO: 4061965 - RNA, 14 nt, Vaccinia virus
uaaaugacaaguau

SEQ ID NO: 4061966 - RNA, 14 nt, Vaccinia virus
uaaaugauaucuua

SEQ ID NO: 4061967 - RNA, 22 nt, Vaccinia virus
uaaaugggugccgcagcaagca

SEQ ID NO: 4061968 - RNA, 14 nt, Vaccinia virus
uaaauguauccauu

SEQ ID NO: 4061969 - RNA, 22 nt, Vaccinia virus
uaaauguuuaaacaucaaacau

SEQ ID NO: 4061970 - RNA, 22 nt, Vaccinia virus
uaaauguuuuacaacuaucaua

SEQ ID NO: 4061971 - RNA, 18 nt, Vaccinia virus
uaaauguuuucucuguaa

SEQ ID NO: 4061972 - RNA, 15 nt, Vaccinia virus
uaaauuaauuuacca

SEQ ID NO: 4061973 - RNA, 17 nt, Vaccinia virus
uaaauuaguucauacac

SEQ ID NO: 4061974 - RNA, 21 nt, Vaccinia virus
uaaauuauaaaaaaagcaaug

SEQ ID NO: 4061975 - RNA, 19 nt, Vaccinia virus
uaaauuauuuaauggagua

SEQ ID NO: 4061976 - RNA, 16 nt, Vaccinia virus
uaaauuuucuauacau

SEQ ID NO: 4061977 - RNA, 16 nt, Vaccinia virus
uaaauuuuuaacgauu

SEQ ID NO: 4061978 - RNA, 23 nt, Vaccinia virus
uaaauuuuuuuucaguuaucuau

SEQ ID NO: 4061979 - RNA, 21 nt, Vaccinia virus
uaacaaaaauuaugaaauaac

SEQ ID NO: 4061980 - RNA, 16 nt, Vaccinia virus
uaacaaaacuauuuca

SEQ ID NO: 4061981 - RNA, 14 nt, Vaccinia virus
uaacaaaauuaaag

SEQ ID NO: 4061982 - RNA, 12 nt, Vaccinia virus
uaacaaacaucu

SEQ ID NO: 4061983 - RNA, 16 nt, Vaccinia virus
uaacaaccucuuuaau

SEQ ID NO: 4061984 - RNA, 17 nt, Vaccinia virus
uaacaaccucuuuaaua

SEQ ID NO: 4061985 - RNA, 21 nt, Vaccinia virus
uaacaaguugaccaauucauu

SEQ ID NO: 4061986 - RNA, 13 nt, Vaccinia virus
uaacaauauggaa

SEQ ID NO: 4061987 - RNA, 14 nt, Vaccinia virus
uaacaauguuucca

SEQ ID NO: 4061988 - RNA, 14 nt, Vaccinia virus
uaacaauuaaugau

SEQ ID NO: 4061989 - RNA, 19 nt, Vaccinia virus
uaacacaaccaaauacuug

SEQ ID NO: 4061990 - RNA, 13 nt, Vaccinia virus
uaacacauauuca

SEQ ID NO: 4061991 - RNA, 17 nt, Vaccinia virus
uaacacauuucaacaau

SEQ ID NO: 4061992 - RNA, 17 nt, Vaccinia virus
uaacacauuuucaucua

SEQ ID NO: 4061993 - RNA, 17 nt, Vaccinia virus
uaacagaaaaaacaaug

SEQ ID NO: 4061994 - RNA, 21 nt, Vaccinia virus
uaacagagaggccaucuggaa

SEQ ID NO: 4061995 - RNA, 15 nt, Vaccinia virus
uaacagauacauaaa

SEQ ID NO: 4061996 - RNA, 17 nt, Vaccinia virus
uaacagcucuauuauau

SEQ ID NO: 4061997 - RNA, 22 nt, Vaccinia virus
uaacaguaucauuuaaacauuu

SEQ ID NO: 4061998 - RNA, 22 nt, Vaccinia virus
uaacauaaaaacuuauacaucc

SEQ ID NO: 4061999 - RNA, 15 nt, Vaccinia virus
uaacaucacuaauau

SEQ ID NO: 4062000 - RNA, 20 nt, Vaccinia virus
uaacaucaucaaaagacuua

SEQ ID NO: 4062001 - RNA, 24 nt, Vaccinia virus
uaacaucaucaaaagacuuaugau

SEQ ID NO: 4062002 - RNA, 16 nt, Vaccinia virus
uaacaucuuucaucau

SEQ ID NO: 4062003 - RNA, 13 nt, Vaccinia virus
uaacaugaacgau

SEQ ID NO: 4062004 - RNA, 17 nt, Vaccinia virus
uaacaugagacauaaau

SEQ ID NO: 4062005 - RNA, 20 nt, Vaccinia virus
uaacaugcauuugaaaagau

SEQ ID NO: 4062006 - RNA, 18 nt, Vaccinia virus
uaacaugcgguucaaaau

SEQ ID NO: 4062007 - RNA, 16 nt, Vaccinia virus
uaacauucugauuuaa

SEQ ID NO: 4062008 - RNA, 20 nt, Vaccinia virus
uaacauuuuuuguaaaugua

SEQ ID NO: 4062009 - RNA, 23 nt, Vaccinia virus
uaacgagugaucaaaucauugau

SEQ ID NO: 4062010 - RNA, 20 nt, Vaccinia virus
uaacgauaacacaaaaugug

SEQ ID NO: 4062011 - RNA, 21 nt, Vaccinia virus
uaacgauaucuugcaaaauag

SEQ ID NO: 4062012 - RNA, 19 nt, Vaccinia virus
auuacggaauuauuggcuu

SEQ ID NO: 4062013 - RNA, 13 nt, Vaccinia virus
auuacuacugaag

SEQ ID NO: 4062014 - RNA, 19 nt, Vaccinia virus
auuacuaucuuuaacauaa

SEQ ID NO: 4062015 - RNA, 22 nt, Vaccinia virus
auuacucauguaaccuacuaga

SEQ ID NO: 4062016 - RNA, 21 nt, Vaccinia virus
auuacucuccuagguuucucu

SEQ ID NO: 4062017 - RNA, 16 nt, Vaccinia virus
auuacuuuaauaguug

SEQ ID NO: 4062018 - RNA, 12 nt, Vaccinia virus
auuacuuuacaa

SEQ ID NO: 4062019 - RNA, 20 nt, Vaccinia virus
auuacuuuacauauaauauc

SEQ ID NO: 4062020 - RNA, 16 nt, Vaccinia virus
auuagacgaugugaga

SEQ ID NO: 4062021 - RNA, 14 nt, Vaccinia virus
auuagagaagcacu

SEQ ID NO: 4062022 - RNA, 16 nt, Vaccinia virus
auuagauauuaaugag

SEQ ID NO: 4062023 - RNA, 17 nt, Vaccinia virus
auuagauuuaauagcau

SEQ ID NO: 4062024 - RNA, 17 nt, Vaccinia virus
auuagcguauugagaag

SEQ ID NO: 4062025 - RNA, 15 nt, Vaccinia virus
auuaggaaauguuuc

SEQ ID NO: 4062026 - RNA, 15 nt, Vaccinia virus
auuaggauuaucaaa

SEQ ID NO: 4062027 - RNA, 16 nt, Vaccinia virus
auuaguaacagucuua

SEQ ID NO: 4062028 - RNA, 20 nt, Vaccinia virus
auuaguaaggcuuuagaaac

SEQ ID NO: 4062029 - RNA, 22 nt, Vaccinia virus
auuaguaaggcuuuagaaacuu

SEQ ID NO: 4062030 - RNA, 22 nt, Vaccinia virus
auuaguacaccgcuauguuuaa

SEQ ID NO: 4062031 - RNA, 13 nt, Vaccinia virus
auuaguuaaauau

SEQ ID NO: 4062032 - RNA, 22 nt, Vaccinia virus
auuaguucccaauggaucaaug

SEQ ID NO: 4062033 - RNA, 22 nt, Vaccinia virus
auuauaacaucguaucuucaaa

SEQ ID NO: 4062034 - RNA, 20 nt, Vaccinia virus
auuauaaugaauauuauuau

SEQ ID NO: 4062035 - RNA, 13 nt, Vaccinia virus
auuauacaugugu

SEQ ID NO: 4062036 - RNA, 14 nt, Vaccinia virus
auuauacuagaguu

SEQ ID NO: 4062037 - RNA, 14 nt, Vaccinia virus
auuauagacacuau

SEQ ID NO: 4062038 - RNA, 23 nt, Vaccinia virus
auuauagacuugauccauuuccu

SEQ ID NO: 4062039 - RNA, 22 nt, Vaccinia virus
auuauauagauaauucuaauug

SEQ ID NO: 4062040 - RNA, 14 nt, Vaccinia virus
auuauauuuauuau

SEQ ID NO: 4062041 - RNA, 14 nt, Vaccinia virus
auuaucaaaaagaa

SEQ ID NO: 4062042 - RNA, 20 nt, Vaccinia virus
auuaucaaaauuuggaaacu

SEQ ID NO: 4062043 - RNA, 16 nt, Vaccinia virus
auuaucaaagucacaa

SEQ ID NO: 4062044 - RNA, 16 nt, Vaccinia virus
auuaucaaauggaugc

SEQ ID NO: 4062045 - RNA, 15 nt, Vaccinia virus
auuaucaagaugugu

SEQ ID NO: 4062046 - RNA, 18 nt, Vaccinia virus
auuaucaucaaaaaacaa

SEQ ID NO: 4062047 - RNA, 14 nt, Vaccinia virus
auuauccaauagau

SEQ ID NO: 4062048 - RNA, 19 nt, Vaccinia virus
auuauccaugauagaaaga

SEQ ID NO: 4062049 - RNA, 17 nt, Vaccinia virus
auuauccggauucauuu

SEQ ID NO: 4062050 - RNA, 17 nt, Vaccinia virus
auuauccuaucauguau

SEQ ID NO: 4062051 - RNA, 20 nt, Vaccinia virus
auuaucuaaguccuguugau

SEQ ID NO: 4062052 - RNA, 12 nt, Vaccinia virus
auuaucuuuacc

SEQ ID NO: 4062053 - RNA, 21 nt, Vaccinia virus
auuaucuuuuuagacacguau

SEQ ID NO: 4062054 - RNA, 16 nt, Vaccinia virus
auuaugaaaaaguaaa

SEQ ID NO: 4062055 - RNA, 20 nt, Vaccinia virus
auuaugaaaaaguaaaugau

SEQ ID NO: 4062056 - RNA, 24 nt, Vaccinia virus
auuaugacgucagccauagcauca

SEQ ID NO: 4062057 - RNA, 11 nt, Vaccinia virus
auuaugauacu

SEQ ID NO: 4062058 - RNA, 17 nt, Vaccinia virus
auuaugccguuaucauu

SEQ ID NO: 4062059 - RNA, 20 nt, Vaccinia virus
auuauggaaaucaacauaau

SEQ ID NO: 4062060 - RNA, 17 nt, Vaccinia virus
auuauuaaacaauacuc

SEQ ID NO: 4062061 - RNA, 12 nt, Vaccinia virus
auuauuaaauau

SEQ ID NO: 4062062 - RNA, 16 nt, Vaccinia virus
auuauuaauaagaaug

SEQ ID NO: 4062063 - RNA, 18 nt, Vaccinia virus
auuauuaaucauuaacuu

SEQ ID NO: 4062064 - RNA, 14 nt, Vaccinia virus
auuauuacauagau

SEQ ID NO: 4062065 - RNA, 18 nt, Vaccinia virus
auuauuacauagauguau

SEQ ID NO: 4062066 - RNA, 19 nt, Vaccinia virus
auuauucagauacgucuau

SEQ ID NO: 4062067 - RNA, 12 nt, Vaccinia virus
auuauucauuuu

SEQ ID NO: 4062068 - RNA, 18 nt, Vaccinia virus
auuauucauuuucuauuu

SEQ ID NO: 4062069 - RNA, 16 nt, Vaccinia virus
auuauuccuaauuaag

SEQ ID NO: 4062070 - RNA, 21 nt, Vaccinia virus
auuauucuuugauucgaauuu

SEQ ID NO: 4062071 - RNA, 20 nt, Vaccinia virus
auuauugucauaaacauuau

SEQ ID NO: 4062072 - RNA, 13 nt, Vaccinia virus
auuauuuaaugag

SEQ ID NO: 4062073 - RNA, 14 nt, Vaccinia virus
auuauuuuuggaag

SEQ ID NO: 4062074 - RNA, 12 nt, Vaccinia virus
auucaaauccuu

SEQ ID NO: 4062075 - RNA, 17 nt, Vaccinia virus
auucaagauuuuauuau

SEQ ID NO: 4062076 - RNA, 20 nt, Vaccinia virus
auucaagcaaaaacaaaaaa

SEQ ID NO: 4062077 - RNA, 20 nt, Vaccinia virus
auucaauuacuacaaaaauu

SEQ ID NO: 4062078 - RNA, 21 nt, Vaccinia virus
auucaauuacuacaaaaauua

SEQ ID NO: 4062079 - RNA, 14 nt, Vaccinia virus
auucacaaauauga

SEQ ID NO: 4062080 - RNA, 22 nt, Vaccinia virus
auucagaauuucuacauaauua

SEQ ID NO: 4062081 - RNA, 19 nt, Vaccinia virus
auucagaguccucuaauug

SEQ ID NO: 4062082 - RNA, 16 nt, Vaccinia virus
auucagaguuguuguu

SEQ ID NO: 4062083 - RNA, 17 nt, Vaccinia virus
auucagcugaaaugaga

SEQ ID NO: 4062084 - RNA, 16 nt, Vaccinia virus
auucauaaaacauaau

SEQ ID NO: 4062085 - RNA, 23 nt, Vaccinia virus
auucauaaaacauaaucaaggau

SEQ ID NO: 4062086 - RNA, 18 nt, Vaccinia virus
auucauaacgucauugau

SEQ ID NO: 4062087 - RNA, 12 nt, Vaccinia virus
auucauaacuaa

SEQ ID NO: 4062088 - RNA, 18 nt, Vaccinia virus
auucauauucuuaaaagg

SEQ ID NO: 4062089 - RNA, 16 nt, Vaccinia virus
auucauccuguugucu

SEQ ID NO: 4062090 - RNA, 21 nt, Vaccinia virus
auucaucuacgcgauaauaga

SEQ ID NO: 4062091 - RNA, 21 nt, Vaccinia virus
auucauucacuaucaaucgau

SEQ ID NO: 4062092 - RNA, 22 nt, Vaccinia virus
auuccaguaucugaaguacuau

SEQ ID NO: 4062093 - RNA, 18 nt, Vaccinia virus
auuccauuaucugaaaug

SEQ ID NO: 4062094 - RNA, 15 nt, Vaccinia virus
auuccuauucauuuu

SEQ ID NO: 4062095 - RNA, 21 nt, Vaccinia virus
auuccuuuucguaggcacaca

SEQ ID NO: 4062096 - RNA, 13 nt, Vaccinia virus
auucgacacuauu

SEQ ID NO: 4062097 - RNA, 14 nt, Vaccinia virus
auucgauauuacga

SEQ ID NO: 4062098 - RNA, 16 nt, Vaccinia virus
auucgcuaaaaaauua

SEQ ID NO: 4062099 - RNA, 13 nt, Vaccinia virus
auucguaguuuuu

SEQ ID NO: 4062100 - RNA, 23 nt, Vaccinia virus
auucgugacagauccaugucuga

SEQ ID NO: 4062101 - RNA, 15 nt, Vaccinia virus
auucuaauacauaau

SEQ ID NO: 4062102 - RNA, 21 nt, Vaccinia virus
auucuaccuuuuuauuuucua

SEQ ID NO: 4062103 - RNA, 22 nt, Vaccinia virus
auucuacuaggcugacacuaug

SEQ ID NO: 4062104 - RNA, 15 nt, Vaccinia virus
auucuagaccaaaaa

SEQ ID NO: 4062105 - RNA, 20 nt, Vaccinia virus
auucuagucuuaaccaaaaa

SEQ ID NO: 4062106 - RNA, 19 nt, Vaccinia virus
auucuaugaauuuauaaaa

SEQ ID NO: 4062107 - RNA, 13 nt, Vaccinia virus
auucuaugaugaa

SEQ ID NO: 4062108 - RNA, 17 nt, Vaccinia virus
auucuauggaugaugcu

SEQ ID NO: 4062109 - RNA, 22 nt, Vaccinia virus
auucuaugucgucuacuggaug

SEQ ID NO: 4062110 - RNA, 16 nt, Vaccinia virus
auucuauuaaugucua

SEQ ID NO: 4062111 - RNA, 16 nt, Vaccinia virus
auucuauuauauuaac

SEQ ID NO: 4062112 - RNA, 14 nt, Vaccinia virus
auucucauuaaaug

SEQ ID NO: 4062113 - RNA, 16 nt, Vaccinia virus
auucucgaaucuaaag

SEQ ID NO: 4062114 - RNA, 13 nt, Vaccinia virus
auucucuauuuug

SEQ ID NO: 4062115 - RNA, 19 nt, Vaccinia virus
auucucuuaauuauaacga

SEQ ID NO: 4062116 - RNA, 23 nt, Vaccinia virus
auucucuuacaaauauucacaag

SEQ ID NO: 4062117 - RNA, 15 nt, Vaccinia virus
auucugaaacaguau

SEQ ID NO: 4062118 - RNA, 19 nt, Vaccinia virus
auucuggugcuaauuauuc

SEQ ID NO: 4062119 - RNA, 17 nt, Vaccinia virus
auucuguaaaaaaauua

SEQ ID NO: 4062120 - RNA, 19 nt, Vaccinia virus
auucuuaagacacauuucu

SEQ ID NO: 4062121 - RNA, 22 nt, Vaccinia virus
auucuuagaaauauaaaacuug

SEQ ID NO: 4062122 - RNA, 18 nt, Vaccinia virus
auucuucacagacugaag

SEQ ID NO: 4062123 - RNA, 23 nt, Vaccinia virus
auucuucuuuaaacgauuuucca

SEQ ID NO: 4062124 - RNA, 21 nt, Vaccinia virus
auucuugaaacuuuuuagaau

SEQ ID NO: 4062125 - RNA, 12 nt, Vaccinia virus
auucuuucaaag

SEQ ID NO: 4062126 - RNA, 16 nt, Vaccinia virus
auugaacgguaucuuc

SEQ ID NO: 4062127 - RNA, 12 nt, Vaccinia virus
auugacaaaauu

SEQ ID NO: 4062128 - RNA, 19 nt, Vaccinia virus
auugacuaucuuuugaaaa

SEQ ID NO: 4062129 - RNA, 17 nt, Vaccinia virus
auugagcggaccaucug

SEQ ID NO: 4062130 - RNA, 13 nt, Vaccinia virus
auugauagauuac

SEQ ID NO: 4062131 - RNA, 15 nt, Vaccinia virus
auugaucaaacauuu

SEQ ID NO: 4062132 - RNA, 16 nt, Vaccinia virus
auugaugacacuagau

SEQ ID NO: 4062133 - RNA, 23 nt, Vaccinia virus
auugaugcaaauagcagauagau

SEQ ID NO: 4062134 - RNA, 17 nt, Vaccinia virus
auugauuagaaaauaua

SEQ ID NO: 4062135 - RNA, 20 nt, Vaccinia virus
auugauuauuucaaagacua

SEQ ID NO: 4062136 - RNA, 16 nt, Vaccinia virus
auugcaacguauauag

SEQ ID NO: 4062137 - RNA, 16 nt, Vaccinia virus
auugcauuuuguuaua

SEQ ID NO: 4062138 - RNA, 14 nt, Vaccinia virus
auugcgacacuauu

SEQ ID NO: 4062139 - RNA, 18 nt, Vaccinia virus
auugcuaccguaaauaua

SEQ ID NO: 4062140 - RNA, 18 nt, Vaccinia virus
auuggaaaucauuaacgg

SEQ ID NO: 4062141 - RNA, 17 nt, Vaccinia virus
auuggaacuaguauuua

SEQ ID NO: 4062142 - RNA, 18 nt, Vaccinia virus
auuggaauaccaaauauu

SEQ ID NO: 4062143 - RNA, 13 nt, Vaccinia virus
auuggaauuauuu

SEQ ID NO: 4062144 - RNA, 19 nt, Vaccinia virus
auuggauaguuuuuuugaa

SEQ ID NO: 4062145 - RNA, 17 nt, Vaccinia virus
auuggauuggauacacu

SEQ ID NO: 4062146 - RNA, 23 nt, Vaccinia virus
auuggcaaaaacggauauggaug

SEQ ID NO: 4062147 - RNA, 15 nt, Vaccinia virus
auuggcuuuucuuua

SEQ ID NO: 4062148 - RNA, 17 nt, Vaccinia virus
auuggguccuauugcuu

SEQ ID NO: 4062149 - RNA, 14 nt, Vaccinia virus
auugguaaauccua

SEQ ID NO: 4062150 - RNA, 21 nt, Vaccinia virus
auugguagaguuuuauaacga

SEQ ID NO: 4062151 - RNA, 16 nt, Vaccinia virus
auugguauaaauguug

SEQ ID NO: 4062152 - RNA, 19 nt, Vaccinia virus
auugguuacccuugucauu

SEQ ID NO: 4062153 - RNA, 19 nt, Vaccinia virus
auugguuuaugauguauaa

SEQ ID NO: 4062154 - RNA, 12 nt, Vaccinia virus
auuguaaaugau

SEQ ID NO: 4062155 - RNA, 15 nt, Vaccinia virus
auuguacgaacgaag

SEQ ID NO: 4062156 - RNA, 20 nt, Vaccinia virus
auuguacgucucaauagcug

SEQ ID NO: 4062157 - RNA, 22 nt, Vaccinia virus
auuguccauaggauacuuugua

SEQ ID NO: 4062158 - RNA, 21 nt, Vaccinia virus
auugucucgucaaugucuaua

SEQ ID NO: 4062159 - RNA, 17 nt, Vaccinia virus
auugucugaugaagaau

SEQ ID NO: 4062160 - RNA, 17 nt, Vaccinia virus
auugugcuuaauuauuu

SEQ ID NO: 4062161 - RNA, 16 nt, Vaccinia virus
auuguuaauugaaaag

SEQ ID NO: 4062162 - RNA, 13 nt, Vaccinia virus
auuguuacaaaag

SEQ ID NO: 4062163 - RNA, 16 nt, Vaccinia virus
auuguuagcuguuuuc

SEQ ID NO: 4062164 - RNA, 19 nt, Vaccinia virus
auuguugccguaaauccug

SEQ ID NO: 4062165 - RNA, 20 nt, Vaccinia virus
auuguuuugaagaaaugaua

SEQ ID NO: 4062166 - RNA, 13 nt, Vaccinia virus
auuuaaacaaaaa

SEQ ID NO: 4062167 - RNA, 21 nt, Vaccinia virus
auuuaaaugaaucccaaacau

SEQ ID NO: 4062168 - RNA, 13 nt, Vaccinia virus
auuuaacacuaua

SEQ ID NO: 4062169 - RNA, 20 nt, Vaccinia virus
auuuaacuagauuauacaau

SEQ ID NO: 4062170 - RNA, 18 nt, Vaccinia virus
auuuaacucaugaugaag

SEQ ID NO: 4062171 - RNA, 20 nt, Vaccinia virus
auuuaaggcuuuaaaauuga

SEQ ID NO: 4062172 - RNA, 17 nt, Vaccinia virus
auuuaauacguucauua

SEQ ID NO: 4062173 - RNA, 13 nt, Vaccinia virus
auuuaauagagau

SEQ ID NO: 4062174 - RNA, 13 nt, Vaccinia virus
auuuaauauagau

SEQ ID NO: 4062175 - RNA, 14 nt, Vaccinia virus
auuuacaaaaauuu

SEQ ID NO: 4062176 - RNA, 16 nt, Vaccinia virus
auuuacaccaauagug

SEQ ID NO: 4062177 - RNA, 19 nt, Vaccinia virus
auuuaccgaacaggcauuu

SEQ ID NO: 4062178 - RNA, 17 nt, Vaccinia virus
auuuacuaucuguaaug

SEQ ID NO: 4062179 - RNA, 14 nt, Vaccinia virus
auuuagcaaaauua

SEQ ID NO: 4062180 - RNA, 16 nt, Vaccinia virus
auuuaguauuaaauga

SEQ ID NO: 4062181 - RNA, 12 nt, Vaccinia virus
auuuauaaacau

SEQ ID NO: 4062182 - RNA, 12 nt, Vaccinia virus
auuuauaaugag

SEQ ID NO: 4062183 - RNA, 19 nt, Vaccinia virus
auuuauacccgcuaugaag

SEQ ID NO: 4062184 - RNA, 16 nt, Vaccinia virus
auuuauacuucuucua

SEQ ID NO: 4062185 - RNA, 14 nt, Vaccinia virus
auuuauauaugcau

SEQ ID NO: 4062186 - RNA, 14 nt, Vaccinia virus
auuuaucauggagu

SEQ ID NO: 4062187 - RNA, 20 nt, Vaccinia virus
auuuauccagucugagaaaa

SEQ ID NO: 4062188 - RNA, 14 nt, Vaccinia virus
auuuaucuauuuua

SEQ ID NO: 4062189 - RNA, 17 nt, Vaccinia virus
auuuauuucuauaccuu

SEQ ID NO: 4062190 - RNA, 22 nt, Vaccinia virus
auuucaacaauaaugagaaugu

SEQ ID NO: 4062191 - RNA, 16 nt, Vaccinia virus
auuucaacgucuaaug

SEQ ID NO: 4062192 - RNA, 22 nt, Vaccinia virus
auuucacagaaacacuagcauu

SEQ ID NO: 4062193 - RNA, 17 nt, Vaccinia virus
auuucacgaaaaaugau

SEQ ID NO: 4062194 - RNA, 18 nt, Vaccinia virus
auuucacgaaaaaugaug

SEQ ID NO: 4062195 - RNA, 14 nt, Vaccinia virus
auuucacguucagc

SEQ ID NO: 4062196 - RNA, 16 nt, Vaccinia virus
auuucagaacauagaa

SEQ ID NO: 4062197 - RNA, 15 nt, Vaccinia virus
auuucauauaauaga

SEQ ID NO: 4062198 - RNA, 14 nt, Vaccinia virus
auuucauccaauuu

SEQ ID NO: 4062199 - RNA, 20 nt, Vaccinia virus
auuucaucuccguaaauaua

SEQ ID NO: 4062200 - RNA, 20 nt, Vaccinia virus
auuucauuacccaaguuuga

SEQ ID NO: 4062201 - RNA, 14 nt, Vaccinia virus
auuucauuguaaau

SEQ ID NO: 4062202 - RNA, 14 nt, Vaccinia virus
auuuccaucaaaug

SEQ ID NO: 4062203 - RNA, 18 nt, Vaccinia virus
auuuccugauuuaaauag

SEQ ID NO: 4062204 - RNA, 15 nt, Vaccinia virus
auuucgaaaauacua

SEQ ID NO: 4062205 - RNA, 14 nt, Vaccinia virus
auuucgacaaaaag

SEQ ID NO: 4062206 - RNA, 15 nt, Vaccinia virus
auuucuauucaugaa

SEQ ID NO: 4062207 - RNA, 12 nt, Vaccinia virus
auuucuauuuuu

SEQ ID NO: 4062208 - RNA, 23 nt, Vaccinia virus
auuucuccaaagaauauaucuaa

SEQ ID NO: 4062209 - RNA, 19 nt, Vaccinia virus
auuucucguaaaaguagaa

SEQ ID NO: 4062210 - RNA, 15 nt, Vaccinia virus
auuucucuaucgaug

SEQ ID NO: 4062211 - RNA, 16 nt, Vaccinia virus
auuucugguuagauaa

SEQ ID NO: 4062212 - RNA, 23 nt, Vaccinia virus
auuucuuuucccucguucaucua

SEQ ID NO: 4062213 - RNA, 16 nt, Vaccinia virus
auuugagaguuuuaua

SEQ ID NO: 4062214 - RNA, 22 nt, Vaccinia virus
auuugauacgauauuuguugga

SEQ ID NO: 4062215 - RNA, 20 nt, Vaccinia virus
auuugaucgauuacauuuau

SEQ ID NO: 4062216 - RNA, 14 nt, Vaccinia virus
auuugauguuguag

SEQ ID NO: 4062217 - RNA, 22 nt, Vaccinia virus
auuugcgugguuguuuaucaca

SEQ ID NO: 4062218 - RNA, 23 nt, Vaccinia virus
auuuggaaaacgucaacguguau

SEQ ID NO: 4062219 - RNA, 13 nt, Vaccinia virus
auuuggaaaagaa

SEQ ID NO: 4062220 - RNA, 18 nt, Vaccinia virus
auuuggagcuuuaauagu

SEQ ID NO: 4062221 - RNA, 20 nt, Vaccinia virus
auuuguaucuccuuucucuu

SEQ ID NO: 4062222 - RNA, 22 nt, Vaccinia virus
auuuguauuauccaauacagaa

SEQ ID NO: 4062223 - RNA, 21 nt, Vaccinia virus
auuugucuuccuuaacuauau

SEQ ID NO: 4062224 - RNA, 19 nt, Vaccinia virus
auuugucuucuuucuuuua

SEQ ID NO: 4062225 - RNA, 16 nt, Vaccinia virus
auuuguuguucauaag

SEQ ID NO: 4062226 - RNA, 20 nt, Vaccinia virus
auuuuaaaauuauuaaacaa

SEQ ID NO: 4062227 - RNA, 15 nt, Vaccinia virus
auuuuaagaaauggu

SEQ ID NO: 4062228 - RNA, 21 nt, Vaccinia virus
auuuuaagaaaugguguaacu

SEQ ID NO: 4062229 - RNA, 17 nt, Vaccinia virus
auuuuaaguuuauugac

SEQ ID NO: 4062230 - RNA, 15 nt, Vaccinia virus
auuuuaauauagcug

SEQ ID NO: 4062231 - RNA, 21 nt, Vaccinia virus
auuuuaccaacucuuuaauaa

SEQ ID NO: 4062232 - RNA, 18 nt, Vaccinia virus
auuuuacgaauaaacgaa

SEQ ID NO: 4062233 - RNA, 19 nt, Vaccinia virus
auuuuacucauuuuuuaua

SEQ ID NO: 4062234 - RNA, 15 nt, Vaccinia virus
auuuuacuuuaauaa

SEQ ID NO: 4062235 - RNA, 13 nt, Vaccinia virus
auuuuagacacua

SEQ ID NO: 4062236 - RNA, 18 nt, Vaccinia virus
auuuuagcagugaaauaa

SEQ ID NO: 4062237 - RNA, 16 nt, Vaccinia virus
auuuuagucauugcaa

SEQ ID NO: 4062238 - RNA, 20 nt, Vaccinia virus
auuuuauaccgaauaagaga

SEQ ID NO: 4062239 - RNA, 14 nt, Vaccinia virus
auuuuaucaaacau

SEQ ID NO: 4062240 - RNA, 20 nt, Vaccinia virus
auuuuauccaaaaagaauga

SEQ ID NO: 4062241 - RNA, 18 nt, Vaccinia virus
auuuuaucgauucuaaug

SEQ ID NO: 4062242 - RNA, 15 nt, Vaccinia virus
auuuuaucuuuuacu

SEQ ID NO: 4062243 - RNA, 16 nt, Vaccinia virus
auuuucaauuauaaua

SEQ ID NO: 4062244 - RNA, 16 nt, Vaccinia virus
auuuucacaaauacua

SEQ ID NO: 4062245 - RNA, 16 nt, Vaccinia virus
auuuucauuuaaauga

SEQ ID NO: 4062246 - RNA, 13 nt, Vaccinia virus
auuuuccauuuau

SEQ ID NO: 4062247 - RNA, 23 nt, Vaccinia virus
auuuugaugauaauguuaccaua

SEQ ID NO: 4062248 - RNA, 19 nt, Vaccinia virus
auuuugauuccaaaauuga

SEQ ID NO: 4062249 - RNA, 19 nt, Vaccinia virus
auuuugcaauuucuucaua

SEQ ID NO: 4062250 - RNA, 12 nt, Vaccinia virus
auuuuguaacug

SEQ ID NO: 4062251 - RNA, 14 nt, Vaccinia virus
auuuuuaaaaauuu

SEQ ID NO: 4062252 - RNA, 16 nt, Vaccinia virus
auuuuuagugaaacau

SEQ ID NO: 4062253 - RNA, 19 nt, Vaccinia virus
auuuuuaguuuauacuauu

SEQ ID NO: 4062254 - RNA, 23 nt, Vaccinia virus
auuuuuauauuauuuacacaauu

SEQ ID NO: 4062255 - RNA, 12 nt, Vaccinia virus
auuuuuaucaug

SEQ ID NO: 4062256 - RNA, 12 nt, Vaccinia virus
auuuuuaucauu

SEQ ID NO: 4062257 - RNA, 23 nt, Vaccinia virus
auuuuuauuaaugauacaaaaac

SEQ ID NO: 4062258 - RNA, 19 nt, Vaccinia virus
auuuuuggauuacaagaaa

SEQ ID NO: 4062259 - RNA, 12 nt, Vaccinia virus
auuuuuuaucua

SEQ ID NO: 4062260 - RNA, 11 nt, Vaccinia virus
caaaaaaccau

SEQ ID NO: 4062261 - RNA, 13 nt, Vaccinia virus
caaaaaauauauu

SEQ ID NO: 4062262 - RNA, 13 nt, Vaccinia virus
caaaaacgauauu

SEQ ID NO: 4062263 - RNA, 12 nt, Vaccinia virus
caaaaagagagu

SEQ ID NO: 4062264 - RNA, 16 nt, Vaccinia virus
caaaaagauauaaaau

SEQ ID NO: 4062265 - RNA, 11 nt, Vaccinia virus
caaaaagcaua

SEQ ID NO: 4062266 - RNA, 20 nt, Vaccinia virus
caaaaauauuuuuauucucu

SEQ ID NO: 4062267 - RNA, 21 nt, Vaccinia virus
aucauauuccggcguaugaau

SEQ ID NO: 4062268 - RNA, 22 nt, Vaccinia virus
aucauauuccggcguaugaauu

SEQ ID NO: 4062269 - RNA, 16 nt, Vaccinia virus
aucaucaacaauccaa

SEQ ID NO: 4062270 - RNA, 15 nt, Vaccinia virus
aucauccaaguggau

SEQ ID NO: 4062271 - RNA, 21 nt, Vaccinia virus
aucaucguuaggauuugguaa

SEQ ID NO: 4062272 - RNA, 12 nt, Vaccinia virus
aucaucugaaaa

SEQ ID NO: 4062273 - RNA, 13 nt, Vaccinia virus
aucaugaaauaua

SEQ ID NO: 4062274 - RNA, 14 nt, Vaccinia virus
aucaugaaaugaug

SEQ ID NO: 4062275 - RNA, 23 nt, Vaccinia virus
aucaugauuggguagcaaauauu

SEQ ID NO: 4062276 - RNA, 15 nt, Vaccinia virus
aucaugguaugcaug

SEQ ID NO: 4062277 - RNA, 12 nt, Vaccinia virus
aucauguagaaa

SEQ ID NO: 4062278 - RNA, 17 nt, Vaccinia virus
aucauguagaagaauuc

SEQ ID NO: 4062279 - RNA, 13 nt, Vaccinia virus
aucauuaaaggau

SEQ ID NO: 4062280 - RNA, 16 nt, Vaccinia virus
aucauugcuguaaaca

SEQ ID NO: 4062281 - RNA, 23 nt, Vaccinia virus
aucauuucuauaauuuaggaaug

SEQ ID NO: 4062282 - RNA, 14 nt, Vaccinia virus
auccaaaaaaugaa

SEQ ID NO: 4062283 - RNA, 17 nt, Vaccinia virus
auccaaacccuugaucu

SEQ ID NO: 4062284 - RNA, 14 nt, Vaccinia virus
auccaagauacuua

SEQ ID NO: 4062285 - RNA, 21 nt, Vaccinia virus
auccaaguuaaaggauauuau

SEQ ID NO: 4062286 - RNA, 16 nt, Vaccinia virus
auccaauacagaaugu

SEQ ID NO: 4062287 - RNA, 14 nt, Vaccinia virus
auccaaucauauau

SEQ ID NO: 4062288 - RNA, 19 nt, Vaccinia virus
auccaauuguuugauauau

SEQ ID NO: 4062289 - RNA, 14 nt, Vaccinia virus
auccacaauuauug

SEQ ID NO: 4062290 - RNA, 19 nt, Vaccinia virus
auccacugcugaacagcua

SEQ ID NO: 4062291 - RNA, 19 nt, Vaccinia virus
auccagaauguacacuauu

SEQ ID NO: 4062292 - RNA, 15 nt, Vaccinia virus
auccauaucguauau

SEQ ID NO: 4062293 - RNA, 16 nt, Vaccinia virus
aucccuacauauuuua

SEQ ID NO: 4062294 - RNA, 17 nt, Vaccinia virus
aucccuauauucaacau

SEQ ID NO: 4062295 - RNA, 18 nt, Vaccinia virus
aucccuaucuauaauauc

SEQ ID NO: 4062296 - RNA, 16 nt, Vaccinia virus
auccgacuagaauuag

SEQ ID NO: 4062297 - RNA, 15 nt, Vaccinia virus
auccgauaaacauug

SEQ ID NO: 4062298 - RNA, 18 nt, Vaccinia virus
auccgggugaaauuauuc

SEQ ID NO: 4062299 - RNA, 15 nt, Vaccinia virus
auccguagaaauaug

SEQ ID NO: 4062300 - RNA, 14 nt, Vaccinia virus
auccguauccauga

SEQ ID NO: 4062301 - RNA, 19 nt, Vaccinia virus
auccguuaaaauaauuaau

SEQ ID NO: 4062302 - RNA, 22 nt, Vaccinia virus
auccguuacaauuuguuaaaaa

SEQ ID NO: 4062303 - RNA, 15 nt, Vaccinia virus
auccguucuuaacuu

SEQ ID NO: 4062304 - RNA, 22 nt, Vaccinia virus
auccucuauccgacuagaauua

SEQ ID NO: 4062305 - RNA, 14 nt, Vaccinia virus
auccugauauuaau

SEQ ID NO: 4062306 - RNA, 23 nt, Vaccinia virus
auccuguaauauuuuuaguuuuu

SEQ ID NO: 4062307 - RNA, 16 nt, Vaccinia virus
auccuguucuaucaac

SEQ ID NO: 4062308 - RNA, 21 nt, Vaccinia virus
auccuguugucuaaaucucuu

SEQ ID NO: 4062309 - RNA, 18 nt, Vaccinia virus
auccuuguucagauacua

SEQ ID NO: 4062310 - RNA, 20 nt, Vaccinia virus
auccuuuaccaccaaauaaa

SEQ ID NO: 4062311 - RNA, 22 nt, Vaccinia virus
auccuuucguaaauuauaauaa

SEQ ID NO: 4062312 - RNA, 17 nt, Vaccinia virus
aucgaaaucuuaaauac

SEQ ID NO: 4062313 - RNA, 19 nt, Vaccinia virus
aucgacauggcuucuucca

SEQ ID NO: 4062314 - RNA, 17 nt, Vaccinia virus
aucgacgccuuagaaau

SEQ ID NO: 4062315 - RNA, 14 nt, Vaccinia virus
aucgacgucaaaga

SEQ ID NO: 4062316 - RNA, 19 nt, Vaccinia virus
aucgaguugauaucuaucg

SEQ ID NO: 4062317 - RNA, 14 nt, Vaccinia virus
aucgauacgcauuu

SEQ ID NO: 4062318 - RNA, 18 nt, Vaccinia virus
aucgauucccauaugaug

SEQ ID NO: 4062319 - RNA, 22 nt, Vaccinia virus
aucgcaucaaauaaaauuauug

SEQ ID NO: 4062320 - RNA, 16 nt, Vaccinia virus
aucggacgcagaaauu

SEQ ID NO: 4062321 - RNA, 21 nt, Vaccinia virus
aucggacucuucuaucauuau

SEQ ID NO: 4062322 - RNA, 19 nt, Vaccinia virus
aucggacuuugugcauaug

SEQ ID NO: 4062323 - RNA, 14 nt, Vaccinia virus
aucguaaaucuguu

SEQ ID NO: 4062324 - RNA, 13 nt, Vaccinia virus
aucguaaugaaca

SEQ ID NO: 4062325 - RNA, 15 nt, Vaccinia virus
aucgucacaaugaua

SEQ ID NO: 4062326 - RNA, 14 nt, Vaccinia virus
aucguccauagcaa

SEQ ID NO: 4062327 - RNA, 15 nt, Vaccinia virus
aucgucucuaucuuu

SEQ ID NO: 4062328 - RNA, 12 nt, Vaccinia virus
aucuaaaaaacu

SEQ ID NO: 4062329 - RNA, 13 nt, Vaccinia virus
aucuaaaaaacua

SEQ ID NO: 4062330 - RNA, 13 nt, Vaccinia virus
aucuaaaauccau

SEQ ID NO: 4062331 - RNA, 19 nt, Vaccinia virus
aucuaaacgcguuagauaa

SEQ ID NO: 4062332 - RNA, 16 nt, Vaccinia virus
aucuaacagaaacguu

SEQ ID NO: 4062333 - RNA, 22 nt, Vaccinia virus
aucuaacagaaacguuuagaga

SEQ ID NO: 4062334 - RNA, 22 nt, Vaccinia virus
aucuaaccaagacggauaagaa

SEQ ID NO: 4062335 - RNA, 15 nt, Vaccinia virus
aucuaacguauucua

SEQ ID NO: 4062336 - RNA, 13 nt, Vaccinia virus
aucuaauauaauu

SEQ ID NO: 4062337 - RNA, 11 nt, Vaccinia virus
aucuaauuaau

SEQ ID NO: 4062338 - RNA, 22 nt, Vaccinia virus
aucuaauuaguuuuucuuuaca

SEQ ID NO: 4062339 - RNA, 18 nt, Vaccinia virus
aucuacaaauuggagauc

SEQ ID NO: 4062340 - RNA, 16 nt, Vaccinia virus
aucuacacauguauuu

SEQ ID NO: 4062341 - RNA, 20 nt, Vaccinia virus
aucuaccucuccaaaaagaa

SEQ ID NO: 4062342 - RNA, 21 nt, Vaccinia virus
aucuacgauccaucaaaaaac

SEQ ID NO: 4062343 - RNA, 19 nt, Vaccinia virus
cgguuugcaaaacaaaaau

SEQ ID NO: 4062344 - RNA, 14 nt, Vaccinia virus
cgguuuuaacuuua

SEQ ID NO: 4062345 - RNA, 14 nt, Vaccinia virus
cgguuuuccaucau

SEQ ID NO: 4062346 - RNA, 21 nt, Vaccinia virus
cguaaaccguuuaauaauauu

SEQ ID NO: 4062347 - RNA, 16 nt, Vaccinia virus
cguaaacgcagauauu

SEQ ID NO: 4062348 - RNA, 14 nt, Vaccinia virus
cguacauugugugu

SEQ ID NO: 4062349 - RNA, 22 nt, Vaccinia virus
cguaccaacucauuuaaauauc

SEQ ID NO: 4062350 - RNA, 13 nt, Vaccinia virus
cguaccagcauuu

SEQ ID NO: 4062351 - RNA, 24 nt, Vaccinia virus
cguacucccaauauguguacgaac

SEQ ID NO: 4062352 - RNA, 19 nt, Vaccinia virus
cguagaaguuguaaaugac

SEQ ID NO: 4062353 - RNA, 21 nt, Vaccinia virus
cguagcaaaaguaagcauuuc

SEQ ID NO: 4062354 - RNA, 23 nt, Vaccinia virus
cguauaaaaaucgauaaacugcg

SEQ ID NO: 4062355 - RNA, 20 nt, Vaccinia virus
cguauagcaauguaauggag

SEQ ID NO: 4062356 - RNA, 19 nt, Vaccinia virus
cauauuuagaaaaaagauu

SEQ ID NO: 4062357 - RNA, 20 nt, Vaccinia virus
cauauuuaucaauucuucua

SEQ ID NO: 4062358 - RNA, 15 nt, Vaccinia virus
cauauuucauuucca

SEQ ID NO: 4062359 - RNA, 16 nt, Vaccinia virus
caucaaaaaacaacug

SEQ ID NO: 4062360 - RNA, 13 nt, Vaccinia virus
caucaauauaaau

SEQ ID NO: 4062361 - RNA, 16 nt, Vaccinia virus
caucagacaaugcuuu

SEQ ID NO: 4062362 - RNA, 21 nt, Vaccinia virus
caucauacuagauaaaucguu

SEQ ID NO: 4062363 - RNA, 14 nt, Vaccinia virus
caucauuaucauuu

SEQ ID NO: 4062364 - RNA, 15 nt, Vaccinia virus
caucauuccauaauu

SEQ ID NO: 4062365 - RNA, 15 nt, Vaccinia virus
cauccaagucaauau

SEQ ID NO: 4062366 - RNA, 22 nt, Vaccinia virus
cauccgauaacauguuaauuuc

SEQ ID NO: 4062367 - RNA, 17 nt, Vaccinia virus
cauccuuuauuaaauca

SEQ ID NO: 4062368 - RNA, 22 nt, Vaccinia virus
caucgagguaaccaccucucug

SEQ ID NO: 4062369 - RNA, 20 nt, Vaccinia virus
caucgaugauacauuucauc

SEQ ID NO: 4062370 - RNA, 17 nt, Vaccinia virus
caucgcaguauauauca

SEQ ID NO: 4062371 - RNA, 17 nt, Vaccinia virus
caucggguguauucuca

SEQ ID NO: 4062372 - RNA, 15 nt, Vaccinia virus
caucguauacuaaca

SEQ ID NO: 4062373 - RNA, 18 nt, Vaccinia virus
caucuacuuuugucauau

SEQ ID NO: 4062374 - RNA, 20 nt, Vaccinia virus
caucuaguccuuuaauucca

SEQ ID NO: 4062375 - RNA, 12 nt, Vaccinia virus
caucuaugauuu

SEQ ID NO: 4062376 - RNA, 22 nt, Vaccinia virus
caucuauuccaaauaaucagaa

SEQ ID NO: 4062377 - RNA, 22 nt, Vaccinia virus
caucuauuucaucguuuuguau

SEQ ID NO: 4062378 - RNA, 20 nt, Vaccinia virus
caucucguuuagauuuucca

SEQ ID NO: 4062379 - RNA, 15 nt, Vaccinia virus
caucucuauguuuca

SEQ ID NO: 4062380 - RNA, 21 nt, Vaccinia virus
caucugacaaacgaugccuuu

SEQ ID NO: 4062381 - RNA, 19 nt, Vaccinia virus
caucuggcuauuauguuua

SEQ ID NO: 4062382 - RNA, 22 nt, Vaccinia virus
caucuguaggauaucuauuuuu

SEQ ID NO: 4062383 - RNA, 18 nt, Vaccinia virus
caucugucauauuuagau

SEQ ID NO: 4062384 - RNA, 22 nt, Vaccinia virus
caucuucuuugauuaaugauuu

SEQ ID NO: 4062385 - RNA, 21 nt, Vaccinia virus
caucuuggggaaauauggaag

SEQ ID NO: 4062386 - RNA, 17 nt, Vaccinia virus
caugaaacguuuggaaa

SEQ ID NO: 4062387 - RNA, 13 nt, Vaccinia virus
caugaaagaaaga

SEQ ID NO: 4062388 - RNA, 16 nt, Vaccinia virus
caugaaaugaugauau

SEQ ID NO: 4062389 - RNA, 22 nt, Vaccinia virus
caugaacacgaugauauagaau

SEQ ID NO: 4062390 - RNA, 13 nt, Vaccinia virus
caugaacauaauc

SEQ ID NO: 4062391 - RNA, 14 nt, Vaccinia virus
caugaauuuuuugc

SEQ ID NO: 4062392 - RNA, 14 nt, Vaccinia virus
caugaccuucuuca

SEQ ID NO: 4062393 - RNA, 17 nt, Vaccinia virus
caugaguacuuguacac

SEQ ID NO: 4062394 - RNA, 19 nt, Vaccinia virus
caugaguacuuguacacau

SEQ ID NO: 4062395 - RNA, 13 nt, Vaccinia virus
caugauaucaugu

SEQ ID NO: 4062396 - RNA, 18 nt, Vaccinia virus
caugaugagauguuuaua

SEQ ID NO: 4062397 - RNA, 22 nt, Vaccinia virus
caugauguacagauuucggaau

SEQ ID NO: 4062398 - RNA, 19 nt, Vaccinia virus
caugccgugguguaacaau

SEQ ID NO: 4062399 - RNA, 18 nt, Vaccinia virus
cauggaacaauaaaagag

SEQ ID NO: 4062400 - RNA, 18 nt, Vaccinia virus
cauggacauaguaauaca

SEQ ID NO: 4062401 - RNA, 18 nt, Vaccinia virus
cauggccgaugaauggau

SEQ ID NO: 4062402 - RNA, 15 nt, Vaccinia virus
caugguggcauuuug

SEQ ID NO: 4062403 - RNA, 18 nt, Vaccinia virus
cauguaauacauuuugaa

SEQ ID NO: 4062404 - RNA, 14 nt, Vaccinia virus
cauguauauaucca

SEQ ID NO: 4062405 - RNA, 20 nt, Vaccinia virus
caugucccuauuauaaucau

SEQ ID NO: 4062406 - RNA, 22 nt, Vaccinia virus
caugucuaauggcgaacauguu

SEQ ID NO: 4062407 - RNA, 22 nt, Vaccinia virus
caugucuaauguguuaaaaaaa

SEQ ID NO: 4062408 - RNA, 15 nt, Vaccinia virus
caugucuacauuaua

SEQ ID NO: 4062409 - RNA, 22 nt, Vaccinia virus
cauguguuuuagaauauauaua

SEQ ID NO: 4062410 - RNA, 21 nt, Vaccinia virus
cauguugauaaacuacuuaca

SEQ ID NO: 4062411 - RNA, 17 nt, Vaccinia virus
cauguuuauaaaaaugu

SEQ ID NO: 4062412 - RNA, 13 nt, Vaccinia virus
cauuaacuuuaau

SEQ ID NO: 4062413 - RNA, 20 nt, Vaccinia virus
cauuaaguaaaguaaacaau

SEQ ID NO: 4062414 - RNA, 14 nt, Vaccinia virus
cauuaaucacugau

SEQ ID NO: 4062415 - RNA, 14 nt, Vaccinia virus
cauuaauuauaacg

SEQ ID NO: 4062416 - RNA, 15 nt, Vaccinia virus
cauuaauuauaacgg

SEQ ID NO: 4062417 - RNA, 21 nt, Vaccinia virus
cauuaauuucugauauggaau

SEQ ID NO: 4062418 - RNA, 21 nt, Vaccinia virus
cauuaccuccacgauacauuu

SEQ ID NO: 4062419 - RNA, 14 nt, Vaccinia virus
cauuacuaaaaaaa

SEQ ID NO: 4062420 - RNA, 15 nt, Vaccinia virus
cauuacuacuguaaa

SEQ ID NO: 4062421 - RNA, 17 nt, Vaccinia virus
cauuagauaacagugua

SEQ ID NO: 4062422 - RNA, 13 nt, Vaccinia virus
cauuagauacaau

SEQ ID NO: 4062423 - RNA, 15 nt, Vaccinia virus
cauuaggaaauguuu

SEQ ID NO: 4062424 - RNA, 15 nt, Vaccinia virus
cauuauacuuuuuuu

SEQ ID NO: 4062425 - RNA, 20 nt, Vaccinia virus
cauuauagauguguauacau

SEQ ID NO: 4062426 - RNA, 14 nt, Vaccinia virus
cauucauaaaaacc

SEQ ID NO: 4062427 - RNA, 11 nt, Vaccinia virus
cauucaugaaa

SEQ ID NO: 4062428 - RNA, 15 nt, Vaccinia virus
cauuccaguauucuc

SEQ ID NO: 4062429 - RNA, 17 nt, Vaccinia virus
cauucuaauguucauaa

SEQ ID NO: 4062430 - RNA, 17 nt, Vaccinia virus
cauugaucuauuauuua

SEQ ID NO: 4062431 - RNA, 16 nt, Vaccinia virus
cauugauugcauaauu

SEQ ID NO: 4062432 - RNA, 22 nt, Vaccinia virus
cauuggaguugauaauaauaca

SEQ ID NO: 4062433 - RNA, 20 nt, Vaccinia virus
cauuguaugguuuuaaauau

SEQ ID NO: 4062434 - RNA, 15 nt, Vaccinia virus
cauuguauuaugaug

SEQ ID NO: 4062435 - RNA, 23 nt, Vaccinia virus
cauuguguguuagucuugcuauc

SEQ ID NO: 4062436 - RNA, 23 nt, Vaccinia virus
cauuguuauugaucaaacauuua

SEQ ID NO: 4062437 - RNA, 21 nt, Vaccinia virus
cauuuaaaguacagauuuuag

SEQ ID NO: 4062438 - RNA, 19 nt, Vaccinia virus
cauuuaaaguuacaaacaa

SEQ ID NO: 4062439 - RNA, 17 nt, Vaccinia virus
cauuuaaauaucauaau

SEQ ID NO: 4062440 - RNA, 12 nt, Vaccinia virus
cauuuaauuaca

SEQ ID NO: 4062441 - RNA, 19 nt, Vaccinia virus
cauuuauaacggucaauau

SEQ ID NO: 4062442 - RNA, 18 nt, Vaccinia virus
cauuuauaacguacaaau

SEQ ID NO: 4062443 - RNA, 14 nt, Vaccinia virus
cauuuauagcauuu

SEQ ID NO: 4062444 - RNA, 20 nt, Vaccinia virus
cauuuaugagugauaaguaa

SEQ ID NO: 4062445 - RNA, 17 nt, Vaccinia virus
cauuuauuggagacgua

SEQ ID NO: 4062446 - RNA, 9 nt, Vaccinia virus
cauuucagu

SEQ ID NO: 4062447 - RNA, 14 nt, Vaccinia virus
cauuucuacaaaaa

SEQ ID NO: 4062448 - RNA, 18 nt, Vaccinia virus
cauuuuaggauaugcuuu

SEQ ID NO: 4062449 - RNA, 19 nt, Vaccinia virus
cauuuuaggauaugcuuuc

SEQ ID NO: 4062450 - RNA, 15 nt, Vaccinia virus
cauuuucuaucuuua

SEQ ID NO: 4062451 - RNA, 15 nt, Vaccinia virus
cauuuugauauugug

SEQ ID NO: 4062452 - RNA, 18 nt, Vaccinia virus
cauuuuuuauaaaaacuu

SEQ ID NO: 4062453 - RNA, 22 nt, Vaccinia virus
ccaaaaaguguuuggcaauaaa

SEQ ID NO: 4062454 - RNA, 16 nt, Vaccinia virus
ccaaacaauguuucua

SEQ ID NO: 4062455 - RNA, 17 nt, Vaccinia virus
ccaaacugcaaauguag

SEQ ID NO: 4062456 - RNA, 13 nt, Vaccinia virus
ccaaacuuuuuca

SEQ ID NO: 4062457 - RNA, 20 nt, Vaccinia virus
ccaaagucaucaaucaucau

SEQ ID NO: 4062458 - RNA, 14 nt, Vaccinia virus
ccaaauguuggaaa

SEQ ID NO: 4062459 - RNA, 14 nt, Vaccinia virus
ccaaauuaaugaau

SEQ ID NO: 4062460 - RNA, 21 nt, Vaccinia virus
ccaacauggugaauucuugca

SEQ ID NO: 4062461 - RNA, 13 nt, Vaccinia virus
ccaagacacauau

SEQ ID NO: 4062462 - RNA, 14 nt, Vaccinia virus
ccaaguuauugcuu

SEQ ID NO: 4062463 - RNA, 17 nt, Vaccinia virus
ccaauaaacuauuucua

SEQ ID NO: 4062464 - RNA, 21 nt, Vaccinia virus
ccaauauaguaguuaaauuau

SEQ ID NO: 4062465 - RNA, 23 nt, Vaccinia virus
ccaauaugucuguacaaauguua

SEQ ID NO: 4062466 - RNA, 17 nt, Vaccinia virus
ccaaugaugucaggaaa

SEQ ID NO: 4062467 - RNA, 17 nt, Vaccinia virus
ccaauuaccaacuagaa

SEQ ID NO: 4062468 - RNA, 22 nt, Vaccinia virus
ccaauuguuuuuguacauaaua

SEQ ID NO: 4062469 - RNA, 21 nt, Vaccinia virus
ccacaccgccucuagauaucg

SEQ ID NO: 4062470 - RNA, 16 nt, Vaccinia virus
ccaccaucuccuccaa

SEQ ID NO: 4062471 - RNA, 21 nt, Vaccinia virus
ccacguaaaacuuaaaauuua

SEQ ID NO: 4062472 - RNA, 23 nt, Vaccinia virus
ccacuacaucaauuuuacaaaag

SEQ ID NO: 4062473 - RNA, 19 nt, Vaccinia virus
ccacuaccggucucaguga

SEQ ID NO: 4062474 - RNA, 15 nt, Vaccinia virus
ccacuaucugauuca

SEQ ID NO: 4062475 - RNA, 15 nt, Vaccinia virus
gauaaguaauaacua

SEQ ID NO: 4062476 - RNA, 13 nt, Vaccinia virus
gauaauaauacac

SEQ ID NO: 4062477 - RNA, 18 nt, Vaccinia virus
gauaauaauuaauaucua

SEQ ID NO: 4062478 - RNA, 22 nt, Vaccinia virus
gauaauaucuauauaugaucua

SEQ ID NO: 4062479 - RNA, 18 nt, Vaccinia virus
gauaaucugaaaaugaaa

SEQ ID NO: 4062480 - RNA, 21 nt, Vaccinia virus
gauaaugauacaguaccauca

SEQ ID NO: 4062481 - RNA, 20 nt, Vaccinia virus
gauaaugauauauuaaacaa

SEQ ID NO: 4062482 - RNA, 16 nt, Vaccinia virus
gauaauuaauaauaua

SEQ ID NO: 4062483 - RNA, 15 nt, Vaccinia virus
gauaauuauuuccag

SEQ ID NO: 4062484 - RNA, 15 nt, Vaccinia virus
gauaauuauuucuac

SEQ ID NO: 4062485 - RNA, 19 nt, Vaccinia virus
gauacaacgguuacuauca

SEQ ID NO: 4062486 - RNA, 17 nt, Vaccinia virus
gauacaauggaugauau

SEQ ID NO: 4062487 - RNA, 14 nt, Vaccinia virus
gauacauaaacgaa

SEQ ID NO: 4062488 - RNA, 17 nt, Vaccinia virus
gauacaucuauauugcu

SEQ ID NO: 4062489 - RNA, 14 nt, Vaccinia virus
gauacauuuugcau

SEQ ID NO: 4062490 - RNA, 17 nt, Vaccinia virus
gauacccugauauuaau

SEQ ID NO: 4062491 - RNA, 21 nt, Vaccinia virus
gauaccgaucacguucuaguu

SEQ ID NO: 4062492 - RNA, 14 nt, Vaccinia virus
gauacgaugaugau

SEQ ID NO: 4062493 - RNA, 18 nt, Vaccinia virus
gauacgcuauuaaaauau

SEQ ID NO: 4062494 - RNA, 16 nt, Vaccinia virus
gauacguaauaaucuu

SEQ ID NO: 4062495 - RNA, 17 nt, Vaccinia virus
gauacuaguaugauggu

SEQ ID NO: 4062496 - RNA, 16 nt, Vaccinia virus
gauacuaucaaaauau

SEQ ID NO: 4062497 - RNA, 17 nt, Vaccinia virus
gauacuauuuauuucua

SEQ ID NO: 4062498 - RNA, 17 nt, Vaccinia virus
gauacugguuugauaaa

SEQ ID NO: 4062499 - RNA, 13 nt, Vaccinia virus
gauagacuuucuc

SEQ ID NO: 4062500 - RNA, 15 nt, Vaccinia virus
gauagagaacauaua

SEQ ID NO: 4062501 - RNA, 15 nt, Vaccinia virus
gauagcaaaauaaag

SEQ ID NO: 4062502 - RNA, 18 nt, Vaccinia virus
gauagcauuaauacagua

SEQ ID NO: 4062503 - RNA, 15 nt, Vaccinia virus
gauagccaacuauac

SEQ ID NO: 4062504 - RNA, 19 nt, Vaccinia virus
gauaguacagcguaguaca

SEQ ID NO: 4062505 - RNA, 23 nt, Vaccinia virus
gauaguuuuuuucauuacuaucu

SEQ ID NO: 4062506 - RNA, 18 nt, Vaccinia virus
gauauaaaaaucuguuuu

SEQ ID NO: 4062507 - RNA, 20 nt, Vaccinia virus
gauauagaaaucggaaauuu

SEQ ID NO: 4062508 - RNA, 14 nt, Vaccinia virus
gauauagauaugau

SEQ ID NO: 4062509 - RNA, 16 nt, Vaccinia virus
gauauauaucuuuuca

SEQ ID NO: 4062510 - RNA, 17 nt, Vaccinia virus
gauauaucaaaauuaga

SEQ ID NO: 4062511 - RNA, 20 nt, Vaccinia virus
gauauauggacgauaauaau

SEQ ID NO: 4062512 - RNA, 17 nt, Vaccinia virus
gauauauugauaauaau

SEQ ID NO: 4062513 - RNA, 18 nt, Vaccinia virus
gauauauuguuucauaau

SEQ ID NO: 4062514 - RNA, 23 nt, Vaccinia virus
gauauauuugcacacauaaucca

SEQ ID NO: 4062515 - RNA, 19 nt, Vaccinia virus
gauauauuuuugauaauau

SEQ ID NO: 4062516 - RNA, 17 nt, Vaccinia virus
gauauccauagauggag

SEQ ID NO: 4062517 - RNA, 20 nt, Vaccinia virus
gauaucgagaucuuuuguau

SEQ ID NO: 4062518 - RNA, 15 nt, Vaccinia virus
gauaucuaaauaugc

SEQ ID NO: 4062519 - RNA, 15 nt, Vaccinia virus
gauauuagaacugcu

SEQ ID NO: 4062520 - RNA, 12 nt, Vaccinia virus
gauauuauuaca

SEQ ID NO: 4062521 - RNA, 17 nt, Vaccinia virus
gauauucguugaugaau

SEQ ID NO: 4062522 - RNA, 13 nt, Vaccinia virus
gauauucuucaga

SEQ ID NO: 4062523 - RNA, 15 nt, Vaccinia virus
gauauuucuggaaug

SEQ ID NO: 4062524 - RNA, 21 nt, Vaccinia virus
gauauuuuaguuuuggcagau

SEQ ID NO: 4062525 - RNA, 14 nt, Vaccinia virus
gaucaacaaaagaa

SEQ ID NO: 4062526 - RNA, 15 nt, Vaccinia virus
gaucaacagaaauau

SEQ ID NO: 4062527 - RNA, 17 nt, Vaccinia virus
gaucacuguagugcuau

SEQ ID NO: 4062528 - RNA, 16 nt, Vaccinia virus
gaucauaucuacuaau

SEQ ID NO: 4062529 - RNA, 18 nt, Vaccinia virus
gaucaugcuguaaucaua

SEQ ID NO: 4062530 - RNA, 15 nt, Vaccinia virus
gaucauguagaaaac

SEQ ID NO: 4062531 - RNA, 22 nt, Vaccinia virus
gaucauuaauaugcucaugaac

SEQ ID NO: 4062532 - RNA, 14 nt, Vaccinia virus
gaucauuaaucauc

SEQ ID NO: 4062533 - RNA, 19 nt, Vaccinia virus
gauccuagaacuagauaua

SEQ ID NO: 4062534 - RNA, 20 nt, Vaccinia virus
gauccugcauagaaauaucu

SEQ ID NO: 4062535 - RNA, 17 nt, Vaccinia virus
gaucgauaaugagaaua

SEQ ID NO: 4062536 - RNA, 17 nt, Vaccinia virus
gaucguaaaucuguuuc

SEQ ID NO: 4062537 - RNA, 15 nt, Vaccinia virus
gaucgucacaaugau

SEQ ID NO: 4062538 - RNA, 18 nt, Vaccinia virus
gaucuccaucgaugauac

SEQ ID NO: 4062539 - RNA, 13 nt, Vaccinia virus
gaucuguauuaua

SEQ ID NO: 4062540 - RNA, 23 nt, Vaccinia virus
gaucuuuauuuuucguguauuuu

SEQ ID NO: 4062541 - RNA, 19 nt, Vaccinia virus
gaugaaggugggacuauau

SEQ ID NO: 4062542 - RNA, 13 nt, Vaccinia virus
gaugaauuauuau

SEQ ID NO: 4062543 - RNA, 15 nt, Vaccinia virus
gaugauauagaucuu

SEQ ID NO: 4062544 - RNA, 15 nt, Vaccinia virus
gaugauauauauauu

SEQ ID NO: 4062545 - RNA, 12 nt, Vaccinia virus
gaugauauuaac

SEQ ID NO: 4062546 - RNA, 14 nt, Vaccinia virus
gaugcauaaguaca

SEQ ID NO: 4062547 - RNA, 17 nt, Vaccinia virus
gaugcauauauuucauu

SEQ ID NO: 4062548 - RNA, 16 nt, Vaccinia virus
gaugccgguacuuaug

SEQ ID NO: 4062549 - RNA, 14 nt, Vaccinia virus
gaugccucuuuuag

SEQ ID NO: 4062550 - RNA, 19 nt, Vaccinia virus
gaugcuauguauauauauu

SEQ ID NO: 4062551 - RNA, 12 nt, Vaccinia virus
gaugguauuauc

SEQ ID NO: 4062552 - RNA, 15 nt, Vaccinia virus
gauguaguaguauau

SEQ ID NO: 4062553 - RNA, 18 nt, Vaccinia virus
gauguagugauagauaug

SEQ ID NO: 4062554 - RNA, 12 nt, Vaccinia virus
gauguauccaca

SEQ ID NO: 4062555 - RNA, 20 nt, Vaccinia virus
gauguauuagcaucuuauua

SEQ ID NO: 4062556 - RNA, 18 nt, Vaccinia virus
gaugucaaaggaugaaag

SEQ ID NO: 4062557 - RNA, 17 nt, Vaccinia virus
gaugucaaugaagagua

SEQ ID NO: 4062558 - RNA, 22 nt, Vaccinia virus
uucuagaauuagaauuacaaaa

SEQ ID NO: 4062559 - RNA, 13 nt, Vaccinia virus
uucuagaccaaaa

SEQ ID NO: 4062560 - RNA, 15 nt, Vaccinia virus
uucuagcgcugauuu

SEQ ID NO: 4062561 - RNA, 21 nt, Vaccinia virus
uucuaucaacgauucuagaau

SEQ ID NO: 4062562 - RNA, 17 nt, Vaccinia virus
uucuauuuuuaauauag

SEQ ID NO: 4062563 - RNA, 19 nt, Vaccinia virus
uucucaaaagaucaaggaa

SEQ ID NO: 4062564 - RNA, 20 nt, Vaccinia virus
uucucaaauccauagucuuc

SEQ ID NO: 4062565 - RNA, 18 nt, Vaccinia virus
uucucaugagaauggaaa

SEQ ID NO: 4062566 - RNA, 23 nt, Vaccinia virus
uucuccuggagggauaguauaau

SEQ ID NO: 4062567 - RNA, 15 nt, Vaccinia virus
uucucguuuccaaaa

SEQ ID NO: 4062568 - RNA, 19 nt, Vaccinia virus
uucucuuugguaacugcuu

SEQ ID NO: 4062569 - RNA, 15 nt, Vaccinia virus
uucugauuuuaacga

SEQ ID NO: 4062570 - RNA, 14 nt, Vaccinia virus
uucuggaucucacc

SEQ ID NO: 4062571 - RNA, 17 nt, Vaccinia virus
uucugguguaauauucu

SEQ ID NO: 4062572 - RNA, 15 nt, Vaccinia virus
uucugguuuaaaaac

SEQ ID NO: 4062573 - RNA, 12 nt, Vaccinia virus
uucuguacaaag

SEQ ID NO: 4062574 - RNA, 18 nt, Vaccinia virus
uucugucgauauagcuuu

SEQ ID NO: 4062575 - RNA, 20 nt, Vaccinia virus
uucuuaacuacguuaucauc

SEQ ID NO: 4062576 - RNA, 15 nt, Vaccinia virus
uucuuaagacacauu

SEQ ID NO: 4062577 - RNA, 20 nt, Vaccinia virus
uucuuacauaaaugaaaaga

SEQ ID NO: 4062578 - RNA, 16 nt, Vaccinia virus
uucuuauucuuauucu

SEQ ID NO: 4062579 - RNA, 17 nt, Vaccinia virus
uucuuauucuuauucuu

SEQ ID NO: 4062580 - RNA, 17 nt, Vaccinia virus
uucuucaauaaaaugag

SEQ ID NO: 4062581 - RNA, 23 nt, Vaccinia virus
uucuucaguaguaauaacagugc

SEQ ID NO: 4062582 - RNA, 17 nt, Vaccinia virus
gacuuuauaauuucauc

SEQ ID NO: 4062583 - RNA, 16 nt, Vaccinia virus
gagaaaaacaacgaga

SEQ ID NO: 4062584 - RNA, 16 nt, Vaccinia virus
gagaaagaagaaauac

SEQ ID NO: 4062585 - RNA, 14 nt, Vaccinia virus
gagaaauuauuccu

SEQ ID NO: 4062586 - RNA, 14 nt, Vaccinia virus
gagagauagaagaa

SEQ ID NO: 4062587 - RNA, 20 nt, Vaccinia virus
gagagcaugaaggagauuua

SEQ ID NO: 4062588 - RNA, 14 nt, Vaccinia virus
gagagcauucacag

SEQ ID NO: 4062589 - RNA, 19 nt, Vaccinia virus
gagaguagauaucauuaau

SEQ ID NO: 4062590 - RNA, 15 nt, Vaccinia virus
gagauaauagaaaau

SEQ ID NO: 4062591 - RNA, 20 nt, Vaccinia virus
gagauccugcauagaaauau

SEQ ID NO: 4062592 - RNA, 14 nt, Vaccinia virus
gagaugucugaaac

SEQ ID NO: 4062593 - RNA, 14 nt, Vaccinia virus
gagauuaaaugcaa

SEQ ID NO: 4062594 - RNA, 13 nt, Vaccinia virus
gagauuuucuauu

SEQ ID NO: 4062595 - RNA, 20 nt, Vaccinia virus
gagcuaaacacauuagauau

SEQ ID NO: 4062596 - RNA, 21 nt, Vaccinia virus
gagcuaaacacauuagauauu

SEQ ID NO: 4062597 - RNA, 20 nt, Vaccinia virus
gagcuaucuagacuacgaua

SEQ ID NO: 4062598 - RNA, 18 nt, Vaccinia virus
gaggacuuggauguuugu

SEQ ID NO: 4062599 - RNA, 13 nt, Vaccinia virus
gaggagaaguaau

SEQ ID NO: 4062600 - RNA, 22 nt, Vaccinia virus
gaggaggaauaucugaugaugu

SEQ ID NO: 4062601 - RNA, 14 nt, Vaccinia virus
gaggagguauauau

SEQ ID NO: 4062602 - RNA, 23 nt, Vaccinia virus
gaggauaguugauuuauuacuua

SEQ ID NO: 4062603 - RNA, 16 nt, Vaccinia virus
gaggaugaugaagaag

SEQ ID NO: 4062604 - RNA, 12 nt, Vaccinia virus
gaguaguuuaug

SEQ ID NO: 4062605 - RNA, 19 nt, Vaccinia virus
gaguauucgccccaaagga

SEQ ID NO: 4062606 - RNA, 11 nt, Vaccinia virus
gaguauuucuc

SEQ ID NO: 4062607 - RNA, 15 nt, Vaccinia virus
gaguuacuuaaaugc

SEQ ID NO: 4062608 - RNA, 15 nt, Vaccinia virus
gaguuagauauuaau

SEQ ID NO: 4062609 - RNA, 14 nt, Vaccinia virus
gaguuaucaagaga

SEQ ID NO: 4062610 - RNA, 20 nt, Vaccinia virus
gauaaaaaggaaucuauuaa

SEQ ID NO: 4062611 - RNA, 18 nt, Vaccinia virus
gauaaaacaaguuuucau

SEQ ID NO: 4062612 - RNA, 18 nt, Vaccinia virus
gauaaaacgauaaaagau

SEQ ID NO: 4062613 - RNA, 18 nt, Vaccinia virus
gauaaaauccuccuauca

SEQ ID NO: 4062614 - RNA, 18 nt, Vaccinia virus
gauaaacgugauaaaagu

SEQ ID NO: 4062615 - RNA, 14 nt, Vaccinia virus
gauaaaguuaucau

SEQ ID NO: 4062616 - RNA, 20 nt, Vaccinia virus
gauaaauucguaauaaucug

SEQ ID NO: 4062617 - RNA, 19 nt, Vaccinia virus
gauaacaauagucuuguaa

SEQ ID NO: 4062618 - RNA, 21 nt, Vaccinia virus
gauaacauguuaauuuccgac

SEQ ID NO: 4062619 - RNA, 21 nt, Vaccinia virus
gauaacuuuuucaauaucgua

SEQ ID NO: 4062620 - RNA, 22 nt, Vaccinia virus
gauaagagacguguuauuacau

SEQ ID NO: 4062621 - RNA, 20 nt, Vaccinia virus
agaauuuucauggauguaga

SEQ ID NO: 4062622 - RNA, 17 nt, Vaccinia virus
agaauuuuuuaaaaagu

SEQ ID NO: 4062623 - RNA, 21 nt, Vaccinia virus
agacaauugacaaaauucaca

SEQ ID NO: 4062624 - RNA, 20 nt, Vaccinia virus
agacaccuuuucaauguuua

SEQ ID NO: 4062625 - RNA, 19 nt, Vaccinia virus
agacacgaauaugacuaga

SEQ ID NO: 4062626 - RNA, 22 nt, Vaccinia virus
agacagccaaucaaaaagauua

SEQ ID NO: 4062627 - RNA, 16 nt, Vaccinia virus
agacagugguuucaug

SEQ ID NO: 4062628 - RNA, 13 nt, Vaccinia virus
agacauaauacua

SEQ ID NO: 4062629 - RNA, 20 nt, Vaccinia virus
agacaugguaucaacagaua

SEQ ID NO: 4062630 - RNA, 13 nt, Vaccinia virus
agacauuaauaga

SEQ ID NO: 4062631 - RNA, 16 nt, Vaccinia virus
agaccacacggagaac

SEQ ID NO: 4062632 - RNA, 14 nt, Vaccinia virus
agaccauauacuga

SEQ ID NO: 4062633 - RNA, 18 nt, Vaccinia virus
agacgaauacauauaccg

SEQ ID NO: 4062634 - RNA, 16 nt, Vaccinia virus
agacgacaacauguaa

SEQ ID NO: 4062635 - RNA, 18 nt, Vaccinia virus
agacgauuccaacaaacg

SEQ ID NO: 4062636 - RNA, 22 nt, Vaccinia virus
agacggcaauggauggauuaua

SEQ ID NO: 4062637 - RNA, 15 nt, Vaccinia virus
agacguauaagucua

SEQ ID NO: 4062638 - RNA, 16 nt, Vaccinia virus
agacgucaucuguucu

SEQ ID NO: 4062639 - RNA, 18 nt, Vaccinia virus
agacguggcaaacaaugu

SEQ ID NO: 4062640 - RNA, 14 nt, Vaccinia virus
agacguguuauuac

SEQ ID NO: 4062641 - RNA, 22 nt, Vaccinia virus
agacuacuuauucuauuuuacu

SEQ ID NO: 4062642 - RNA, 14 nt, Vaccinia virus
agacuaugauugac

SEQ ID NO: 4062643 - RNA, 17 nt, Vaccinia virus
agacuaugggaauauau

SEQ ID NO: 4062644 - RNA, 17 nt, Vaccinia virus
agacucaucaacgauga

SEQ ID NO: 4062645 - RNA, 16 nt, Vaccinia virus
agacuguuuguagaau

SEQ ID NO: 4062646 - RNA, 14 nt, Vaccinia virus
agacuuguauucaa

SEQ ID NO: 4062647 - RNA, 17 nt, Vaccinia virus
agacuuuacuuuucuaa

SEQ ID NO: 4062648 - RNA, 15 nt, Vaccinia virus
agacuuugaaauaua

SEQ ID NO: 4062649 - RNA, 14 nt, Vaccinia virus
agacuuuguagaaa

SEQ ID NO: 4062650 - RNA, 20 nt, Vaccinia virus
acaacgaauacaaacgccau

SEQ ID NO: 4062651 - RNA, 15 nt, Vaccinia virus
acaacgaauguguac

SEQ ID NO: 4062652 - RNA, 16 nt, Vaccinia virus
acaacgagauaucuug

SEQ ID NO: 4062653 - RNA, 19 nt, Vaccinia virus
acaacuuaaugaagaucua

SEQ ID NO: 4062654 - RNA, 19 nt, Vaccinia virus
acaacuuuuaaauacaaau

SEQ ID NO: 4062655 - RNA, 16 nt, Vaccinia virus
acaagaucaaaguaca

SEQ ID NO: 4062656 - RNA, 18 nt, Vaccinia virus
acaaguaggauuuuucca

SEQ ID NO: 4062657 - RNA, 12 nt, Vaccinia virus
acaaguuuucau

SEQ ID NO: 4062658 - RNA, 18 nt, Vaccinia virus
acaauaaauagcuuuacu

SEQ ID NO: 4062659 - RNA, 15 nt, Vaccinia virus
acaauaacuacauau

SEQ ID NO: 4062660 - RNA, 17 nt, Vaccinia virus
acaauacauguacaaau

SEQ ID NO: 4062661 - RNA, 17 nt, Vaccinia virus
acaauacggaauaucua

SEQ ID NO: 4062662 - RNA, 21 nt, Vaccinia virus
acaauagauggauaauggaag

SEQ ID NO: 4062663 - RNA, 16 nt, Vaccinia virus
acaauaguuagauaca

SEQ ID NO: 4062664 - RNA, 20 nt, Vaccinia virus
acaauauauucucauaguau

SEQ ID NO: 4062665 - RNA, 15 nt, Vaccinia virus
acaauaucauaaaca

SEQ ID NO: 4062666 - RNA, 15 nt, Vaccinia virus
acaauauuacaaaau

SEQ ID NO: 4062667 - RNA, 23 nt, Vaccinia virus
acaauauuuuucguuuacaaaau

SEQ ID NO: 4062668 - RNA, 14 nt, Vaccinia virus
acaauccaauaaua

SEQ ID NO: 4062669 - RNA, 18 nt, Vaccinia virus
acaauccuagaacgaaua

SEQ ID NO: 4062670 - RNA, 14 nt, Vaccinia virus
acaaucguuaauaa

SEQ ID NO: 4062671 - RNA, 15 nt, Vaccinia virus
acaaucucuauaucu

SEQ ID NO: 4062672 - RNA, 13 nt, Vaccinia virus
acaaugaacuaau

SEQ ID NO: 4062673 - RNA, 16 nt, Vaccinia virus
acaaugacugauauau

SEQ ID NO: 4062674 - RNA, 20 nt, Vaccinia virus
acaaugaugccaucauagau

SEQ ID NO: 4062675 - RNA, 22 nt, Vaccinia virus
acaaugaugcggaagaacaauu

SEQ ID NO: 4062676 - RNA, 15 nt, Vaccinia virus
acaaugcuaauauau

SEQ ID NO: 4062677 - RNA, 15 nt, Vaccinia virus
acaauguagaaauua

SEQ ID NO: 4062678 - RNA, 19 nt, Vaccinia virus
acaauguccaaaucuauau

SEQ ID NO: 4062679 - RNA, 21 nt, Vaccinia virus
acaauguuugacugaauauau

SEQ ID NO: 4062680 - RNA, 21 nt, Vaccinia virus
acaauguuugucauauguauu

SEQ ID NO: 4062681 - RNA, 16 nt, Vaccinia virus
acaauuacaaaugagu

SEQ ID NO: 4062682 - RNA, 19 nt, Vaccinia virus
acaauuauuauauaauucu

SEQ ID NO: 4062683 - RNA, 14 nt, Vaccinia virus
acaauuuacauguu

SEQ ID NO: 4062684 - RNA, 17 nt, Vaccinia virus
acaauuuauucagagag

SEQ ID NO: 4062685 - RNA, 22 nt, Vaccinia virus
acaauuuuuuuauaauaauucu

SEQ ID NO: 4062686 - RNA, 14 nt, Vaccinia virus
acacaaaaagaaag

SEQ ID NO: 4062687 - RNA, 20 nt, Vaccinia virus
acacaacgcgucuagacuuc

SEQ ID NO: 4062688 - RNA, 20 nt, Vaccinia virus
acacacugagaaacagcaua

SEQ ID NO: 4062689 - RNA, 18 nt, Vaccinia virus
acacaguagaaaauaaua

SEQ ID NO: 4062690 - RNA, 13 nt, Vaccinia virus
acacaucaaaaua

SEQ ID NO: 4062691 - RNA, 19 nt, Vaccinia virus
acacauucuuuagaacuuc

SEQ ID NO: 4062692 - RNA, 18 nt, Vaccinia virus
acacauuuucaaauaaua

SEQ ID NO: 4062693 - RNA, 15 nt, Vaccinia virus
acacgauauucaugg

SEQ ID NO: 4062694 - RNA, 13 nt, Vaccinia virus
acacgaugaugau

SEQ ID NO: 4062695 - RNA, 19 nt, Vaccinia virus
acacgauuuaauccaucug

SEQ ID NO: 4062696 - RNA, 16 nt, Vaccinia virus
acacuacccaauaaau

SEQ ID NO: 4062697 - RNA, 17 nt, Vaccinia virus
acacucuauaucuagaa

SEQ ID NO: 4062698 - RNA, 13 nt, Vaccinia virus
acacucuauuuca

SEQ ID NO: 4062699 - RNA, 19 nt, Vaccinia virus
acacuuuuguaaaauauua

SEQ ID NO: 4062700 - RNA, 19 nt, Vaccinia virus
acagaaaagauauuuguua

SEQ ID NO: 4062701 - RNA, 16 nt, Vaccinia virus
acagaacaguaaaugu

SEQ ID NO: 4062702 - RNA, 22 nt, Vaccinia virus
acagaagauagcaaagagauga

SEQ ID NO: 4062703 - RNA, 17 nt, Vaccinia virus
acagaauaugagaauga

SEQ ID NO: 4062704 - RNA, 22 nt, Vaccinia virus
acagaauguagauaaucauuua

SEQ ID NO: 4062705 - RNA, 18 nt, Vaccinia virus
acagacacgaauaugacu

SEQ ID NO: 4062706 - RNA, 14 nt, Vaccinia virus
acagaccaaauaua

SEQ ID NO: 4062707 - RNA, 22 nt, Vaccinia virus
acagacuguuauaaucaaagau

SEQ ID NO: 4062708 - RNA, 12 nt, Vaccinia virus
acagacuuuaac

SEQ ID NO: 4062709 - RNA, 23 nt, Vaccinia virus
acagagccaucuguaaaaagaua

SEQ ID NO: 4062710 - RNA, 21 nt, Vaccinia virus
acagaguauguaaaaauguua

SEQ ID NO: 4062711 - RNA, 21 nt, Vaccinia virus
acagaguuagaaauagauaau

SEQ ID NO: 4062712 - RNA, 18 nt, Vaccinia virus
acagaguuuucagaagau

SEQ ID NO: 4062713 - RNA, 23 nt, Vaccinia virus
aucaaugauagacuagaagaaag

SEQ ID NO: 4062714 - RNA, 21 nt, Vaccinia virus
aucaauguccugcuauacuuc

SEQ ID NO: 4062715 - RNA, 19 nt, Vaccinia virus
aucaauguguguaacucca

SEQ ID NO: 4062716 - RNA, 17 nt, Vaccinia virus
aucaauuaaauaauuaa

SEQ ID NO: 4062717 - RNA, 17 nt, Vaccinia virus
aucaauuucaaaaagag

SEQ ID NO: 4062718 - RNA, 13 nt, Vaccinia virus
aucacaaacauua

SEQ ID NO: 4062719 - RNA, 13 nt, Vaccinia virus
aucacaagaaguu

SEQ ID NO: 4062720 - RNA, 18 nt, Vaccinia virus
aucacaauauauguugau

SEQ ID NO: 4062721 - RNA, 13 nt, Vaccinia virus
aucacaaugacuu

SEQ ID NO: 4062722 - RNA, 22 nt, Vaccinia virus
aucacacaagccauuguugucu

SEQ ID NO: 4062723 - RNA, 16 nt, Vaccinia virus
aucacacuuaaaauaa

SEQ ID NO: 4062724 - RNA, 17 nt, Vaccinia virus
aucacacuuaaaauaaa

SEQ ID NO: 4062725 - RNA, 20 nt, Vaccinia virus
aucacauuguauauaguuua

SEQ ID NO: 4062726 - RNA, 21 nt, Vaccinia virus
aucacccgcgugugagagaag

SEQ ID NO: 4062727 - RNA, 22 nt, Vaccinia virus
aucacgucagcggcaucuaaau

SEQ ID NO: 4062728 - RNA, 19 nt, Vaccinia virus
aucacguguuaaacaaugg

SEQ ID NO: 4062729 - RNA, 17 nt, Vaccinia virus
aucacuaucuuugaaaa

SEQ ID NO: 4062730 - RNA, 19 nt, Vaccinia virus
aucacucucauaauguaaa

SEQ ID NO: 4062731 - RNA, 15 nt, Vaccinia virus
aucacucuucgaaaa

SEQ ID NO: 4062732 - RNA, 18 nt, Vaccinia virus
aucagaaaggauagagca

SEQ ID NO: 4062733 - RNA, 23 nt, Vaccinia virus
aucagacucugguauuuauauau

SEQ ID NO: 4062734 - RNA, 13 nt, Vaccinia virus
aucagagaacuuc

SEQ ID NO: 4062735 - RNA, 14 nt, Vaccinia virus
aucagauauuugcg

SEQ ID NO: 4062736 - RNA, 13 nt, Vaccinia virus
aucagaucauauu

SEQ ID NO: 4062737 - RNA, 15 nt, Vaccinia virus
aucagauuauuuaac

SEQ ID NO: 4062738 - RNA, 21 nt, Vaccinia virus
aucaguacguucuucauuuau

SEQ ID NO: 4062739 - RNA, 21 nt, Vaccinia virus
aucagucuccaguuaauauau

SEQ ID NO: 4062740 - RNA, 16 nt, Vaccinia virus
aucauaagcaucaugu

SEQ ID NO: 4062741 - RNA, 14 nt, Vaccinia virus
aucauaaguuuaua

SEQ ID NO: 4062742 - RNA, 15 nt, Vaccinia virus
aucauacaaugaauu

SEQ ID NO: 4062743 - RNA, 16 nt, Vaccinia virus
aucauacauuuaauaa

SEQ ID NO: 4062744 - RNA, 17 nt, Vaccinia virus
aucauagauucauauag

SEQ ID NO: 4062745 - RNA, 15 nt, Vaccinia virus
aucauagucgaacau

SEQ ID NO: 4062746 - RNA, 13 nt, Vaccinia virus
aucauauauaaug

SEQ ID NO: 4062747 - RNA, 15 nt, Vaccinia virus
aucauauauagaaug

SEQ ID NO: 4062748 - RNA, 22 nt, Vaccinia virus
aucauaucuauaucauccaugu

SEQ ID NO: 4062749 - RNA, 17 nt, Vaccinia virus
aucaucaccuaucuugu

SEQ ID NO: 4062750 - RNA, 18 nt, Vaccinia virus
aucaucgaucuaauagau

SEQ ID NO: 4062751 - RNA, 14 nt, Vaccinia virus
aucaucgauuuuca

SEQ ID NO: 4062752 - RNA, 22 nt, Vaccinia virus
aucaucugcacuaauuaacagu

SEQ ID NO: 4062753 - RNA, 22 nt, Vaccinia virus
aucaucuuaugaggaaugauug

SEQ ID NO: 4062754 - RNA, 20 nt, Vaccinia virus
aucaugauuggguagcaaau

SEQ ID NO: 4062755 - RNA, 17 nt, Vaccinia virus
aucauguccauuuaacu

SEQ ID NO: 4062756 - RNA, 11 nt, Vaccinia virus
aucauuaacga

SEQ ID NO: 4062757 - RNA, 19 nt, Vaccinia virus
aucauuacuaacuuuauca

SEQ ID NO: 4062758 - RNA, 19 nt, Vaccinia virus
aucauugauugagaagaag

SEQ ID NO: 4062759 - RNA, 19 nt, Vaccinia virus
aucauuuaaacauuuaacu

SEQ ID NO: 4062760 - RNA, 23 nt, Vaccinia virus
aucauuugacgauauuucuggaa

SEQ ID NO: 4062761 - RNA, 15 nt, Vaccinia virus
auccaaaauuuugua

SEQ ID NO: 4062762 - RNA, 12 nt, Vaccinia virus
auccaaacauua

SEQ ID NO: 4062763 - RNA, 19 nt, Vaccinia virus
auccaaacccuugaucucc

SEQ ID NO: 4062764 - RNA, 14 nt, Vaccinia virus
auccaaaguauuuu

SEQ ID NO: 4062765 - RNA, 24 nt, Vaccinia virus
auccaaauuuuuuuuacaaacauc

SEQ ID NO: 4062766 - RNA, 23 nt, Vaccinia virus
auccaaggauguaauuaaauguu

SEQ ID NO: 4062767 - RNA, 17 nt, Vaccinia virus
auccaauauuauugaaa

SEQ ID NO: 4062768 - RNA, 17 nt, Vaccinia virus
auccagucuuuaaugaa

SEQ ID NO: 4062769 - RNA, 22 nt, Vaccinia virus
auccauaguuuguaucaauaau

SEQ ID NO: 4062770 - RNA, 15 nt, Vaccinia virus
auccauauuucuuaa

SEQ ID NO: 4062771 - RNA, 15 nt, Vaccinia virus
auccaugauagaaag

SEQ ID NO: 4062772 - RNA, 17 nt, Vaccinia virus
auccauggcagagacga

SEQ ID NO: 4062773 - RNA, 16 nt, Vaccinia virus
aucccauauaauacag

SEQ ID NO: 4062774 - RNA, 14 nt, Vaccinia virus
aucccauuguaaag

SEQ ID NO: 4062775 - RNA, 15 nt, Vaccinia virus
aucccuuaaaaauua

SEQ ID NO: 4062776 - RNA, 21 nt, Vaccinia virus
auccgaaacaaucucagauau

SEQ ID NO: 4062777 - RNA, 17 nt, Vaccinia virus
auccgauacuuguaaga

SEQ ID NO: 4062778 - RNA, 17 nt, Vaccinia virus
auccggauauaauauau

SEQ ID NO: 4062779 - RNA, 15 nt, Vaccinia virus
auccguuaaguuugu

SEQ ID NO: 4062780 - RNA, 22 nt, Vaccinia virus
auccuaaagguaaauguaaauu

SEQ ID NO: 4062781 - RNA, 17 nt, Vaccinia virus
auccuaacuuuaaacaa

SEQ ID NO: 4062782 - RNA, 16 nt, Vaccinia virus
auccuacuguauacuu

SEQ ID NO: 4062783 - RNA, 17 nt, Vaccinia virus
auccuauacucugaaag

SEQ ID NO: 4062784 - RNA, 17 nt, Vaccinia virus
auccucagucaucuugu

SEQ ID NO: 4062785 - RNA, 18 nt, Vaccinia virus
auccucagucaucuuguc

SEQ ID NO: 4062786 - RNA, 19 nt, Vaccinia virus
auccuccggaguauuaaug

SEQ ID NO: 4062787 - RNA, 17 nt, Vaccinia virus
auccucgcuuuguguau

SEQ ID NO: 4062788 - RNA, 13 nt, Vaccinia virus
auccucuaugaag

SEQ ID NO: 4062789 - RNA, 15 nt, Vaccinia virus
auccuuaaauguuuu

SEQ ID NO: 4062790 - RNA, 17 nt, Vaccinia virus
auccuucagaauacaau

SEQ ID NO: 4062791 - RNA, 19 nt, Vaccinia virus
auccuucuauguugacaug

SEQ ID NO: 4062792 - RNA, 16 nt, Vaccinia virus
auccuuuguaaagaaa

SEQ ID NO: 4062793 - RNA, 18 nt, Vaccinia virus
auccuuuucuucagaaua

SEQ ID NO: 4062794 - RNA, 22 nt, Vaccinia virus
auccuuuuguuggaaaaaugau

SEQ ID NO: 4062795 - RNA, 23 nt, Vaccinia virus
aucgaauaacgaacauaacuuua

SEQ ID NO: 4062796 - RNA, 17 nt, Vaccinia virus
aucgauacauauaugca

SEQ ID NO: 4062797 - RNA, 14 nt, Vaccinia virus
aucgauagacacug

SEQ ID NO: 4062798 - RNA, 16 nt, Vaccinia virus
aucgauagacuuucuc

SEQ ID NO: 4062799 - RNA, 23 nt, Vaccinia virus
aucgaucaaaagacuauacauuu

SEQ ID NO: 4062800 - RNA, 19 nt, Vaccinia virus
aucgauccaugagaaauac

SEQ ID NO: 4062801 - RNA, 20 nt, Vaccinia virus
aucgauuuuuagauuucauu

SEQ ID NO: 4062802 - RNA, 17 nt, Vaccinia virus
aucgcuaaucaaaacua

SEQ ID NO: 4062803 - RNA, 22 nt, Vaccinia virus
aucggaacacuugguaguugaa

SEQ ID NO: 4062804 - RNA, 18 nt, Vaccinia virus
aucggaugauauuaaugu

SEQ ID NO: 4062805 - RNA, 13 nt, Vaccinia virus
aucggcucaaaga

SEQ ID NO: 4062806 - RNA, 15 nt, Vaccinia virus
aucguacuauauaca

SEQ ID NO: 4062807 - RNA, 24 nt, Vaccinia virus
aucguauaucuucuucugugauag

SEQ ID NO: 4062808 - RNA, 14 nt, Vaccinia virus
aucgucguacaugg

SEQ ID NO: 4062809 - RNA, 18 nt, Vaccinia virus
aucgucuaaaagaauugc

SEQ ID NO: 4062810 - RNA, 14 nt, Vaccinia virus
aucgucuucacaaa

SEQ ID NO: 4062811 - RNA, 19 nt, Vaccinia virus
aucgucuucacaaagaaug

SEQ ID NO: 4062812 - RNA, 23 nt, Vaccinia virus
aucguguuguguuggugaauauu

SEQ ID NO: 4062813 - RNA, 15 nt, Vaccinia virus
aucguuaagaauugu

SEQ ID NO: 4062814 - RNA, 23 nt, Vaccinia virus
aucguucucuaaaugucacaauc

SEQ ID NO: 4062815 - RNA, 16 nt, Vaccinia virus
aucguuuaaaauacua

SEQ ID NO: 4062816 - RNA, 15 nt, Vaccinia virus
aucguuuaaaguaaa

SEQ ID NO: 4062817 - RNA, 17 nt, Vaccinia virus
aucguuucuacaaaauc

SEQ ID NO: 4062818 - RNA, 14 nt, Vaccinia virus
aucguuuucaucuu

SEQ ID NO: 4062819 - RNA, 14 nt, Vaccinia virus
aucuaaaaacaaua

SEQ ID NO: 4062820 - RNA, 15 nt, Vaccinia virus
aucuaaaaucauaau

SEQ ID NO: 4062821 - RNA, 22 nt, Vaccinia virus
aucuaaacagacgacaacaugu

SEQ ID NO: 4062822 - RNA, 20 nt, Vaccinia virus
aucuaaagaugaugcuauuu

SEQ ID NO: 4062823 - RNA, 15 nt, Vaccinia virus
aucuaaauuaaauau

SEQ ID NO: 4062824 - RNA, 13 nt, Vaccinia virus
aucuaaugaauga

SEQ ID NO: 4062825 - RNA, 17 nt, Vaccinia virus
aucuaauggauaaacug

SEQ ID NO: 4062826 - RNA, 14 nt, Vaccinia virus
aucuaauuucugaa

SEQ ID NO: 4062827 - RNA, 14 nt, Vaccinia virus
aucuacaucuaugu

SEQ ID NO: 4062828 - RNA, 13 nt, Vaccinia virus
aucuaccuuauuu

SEQ ID NO: 4062829 - RNA, 17 nt, Vaccinia virus
aucuacuacauuagaca

SEQ ID NO: 4062830 - RNA, 15 nt, Vaccinia virus
aucuacuauacuuua

SEQ ID NO: 4062831 - RNA, 14 nt, Vaccinia virus
aucuagacauagau

SEQ ID NO: 4062832 - RNA, 19 nt, Vaccinia virus
aucuagaugcggugaucag

SEQ ID NO: 4062833 - RNA, 22 nt, Vaccinia virus
aucuagccauaucuaaagcuau

SEQ ID NO: 4062834 - RNA, 22 nt, Vaccinia virus
aucuagcugucuguaucauauu

SEQ ID NO: 4062835 - RNA, 20 nt, Vaccinia virus
aucuaguuguggaaauacuu

SEQ ID NO: 4062836 - RNA, 12 nt, Vaccinia virus
aucuauaaaagu

SEQ ID NO: 4062837 - RNA, 21 nt, Vaccinia virus
aucuauaacaugcuaaaccuu

SEQ ID NO: 4062838 - RNA, 19 nt, Vaccinia virus
aucuauaauuugauccaug

SEQ ID NO: 4062839 - RNA, 18 nt, Vaccinia virus
aucuauauacgauccacg

SEQ ID NO: 4062840 - RNA, 13 nt, Vaccinia virus
auauauagaauua

SEQ ID NO: 4062841 - RNA, 15 nt, Vaccinia virus
auauauauacaguga

SEQ ID NO: 4062842 - RNA, 14 nt, Vaccinia virus
auauaucaaacaug

SEQ ID NO: 4062843 - RNA, 20 nt, Vaccinia virus
auauaucaucgacaaagaca

SEQ ID NO: 4062844 - RNA, 18 nt, Vaccinia virus
auauaucccuuaaaaauu

SEQ ID NO: 4062845 - RNA, 15 nt, Vaccinia virus
auauaugauauacca

SEQ ID NO: 4062846 - RNA, 16 nt, Vaccinia virus
auauaugguuguugau

SEQ ID NO: 4062847 - RNA, 13 nt, Vaccinia virus
auauauugucuaa

SEQ ID NO: 4062848 - RNA, 18 nt, Vaccinia virus
auauauuugaaaaucguu

SEQ ID NO: 4062849 - RNA, 12 nt, Vaccinia virus
auauauuuguau

SEQ ID NO: 4062850 - RNA, 23 nt, Vaccinia virus
auauauuuucacuuuaucucauu

SEQ ID NO: 4062851 - RNA, 20 nt, Vaccinia virus
auaucaaacaauccaaaaaa

SEQ ID NO: 4062852 - RNA, 19 nt, Vaccinia virus
auaucacaaccuuuguuaa

SEQ ID NO: 4062853 - RNA, 20 nt, Vaccinia virus
auaucacaggagcaauguuu

SEQ ID NO: 4062854 - RNA, 15 nt, Vaccinia virus
auaucagacagcaug

SEQ ID NO: 4062855 - RNA, 17 nt, Vaccinia virus
auaucagacgauccaca

SEQ ID NO: 4062856 - RNA, 17 nt, Vaccinia virus
auaucauaaucuaaaau

SEQ ID NO: 4062857 - RNA, 11 nt, Vaccinia virus
auaucauauau

SEQ ID NO: 4062858 - RNA, 17 nt, Vaccinia virus
auaucaucauuguguaa

SEQ ID NO: 4062859 - RNA, 16 nt, Vaccinia virus
auaucaucgacaaaga

SEQ ID NO: 4062860 - RNA, 23 nt, Vaccinia virus
auaucaugaugauuugguuguau

SEQ ID NO: 4062861 - RNA, 17 nt, Vaccinia virus
auauccagugcauuucu

SEQ ID NO: 4062862 - RNA, 22 nt, Vaccinia virus
auauccguguuaaaaaaaauua

SEQ ID NO: 4062863 - RNA, 15 nt, Vaccinia virus
auauccguuaauagg

SEQ ID NO: 4062864 - RNA, 19 nt, Vaccinia virus
auauccuccuuuaaaauua

SEQ ID NO: 4062865 - RNA, 14 nt, Vaccinia virus
auauccuuuuguau

SEQ ID NO: 4062866 - RNA, 16 nt, Vaccinia virus
auauccuuuuguauaa

SEQ ID NO: 4062867 - RNA, 14 nt, Vaccinia virus
auaucgauaauaga

SEQ ID NO: 4062868 - RNA, 13 nt, Vaccinia virus
auaucgaugugga

SEQ ID NO: 4062869 - RNA, 19 nt, Vaccinia virus
auaucggauuauuaacaua

SEQ ID NO: 4062870 - RNA, 19 nt, Vaccinia virus
auaucgguaccguuaaaga

SEQ ID NO: 4062871 - RNA, 13 nt, Vaccinia virus
auaucguuaaaga

SEQ ID NO: 4062872 - RNA, 23 nt, Vaccinia virus
auaucuaggagguggauauuucu

SEQ ID NO: 4062873 - RNA, 15 nt, Vaccinia virus
auaucuauauuucca

SEQ ID NO: 4062874 - RNA, 19 nt, Vaccinia virus
auaucuauuuuuuugucau

SEQ ID NO: 4062875 - RNA, 14 nt, Vaccinia virus
auaucucaacgaug

SEQ ID NO: 4062876 - RNA, 23 nt, Vaccinia virus
auaucuucuaugaaaggagagaa

SEQ ID NO: 4062877 - RNA, 14 nt, Vaccinia virus
auaucuucucaaaa

SEQ ID NO: 4062878 - RNA, 17 nt, Vaccinia virus
auaucuucuuuuuucca

SEQ ID NO: 4062879 - RNA, 14 nt, Vaccinia virus
auaucuuguucuau

SEQ ID NO: 4062880 - RNA, 21 nt, Vaccinia virus
auaucuuguuuagaaaaaugc

SEQ ID NO: 4062881 - RNA, 20 nt, Vaccinia virus
auaucuuuacuaagaaaguu

SEQ ID NO: 4062882 - RNA, 13 nt, Vaccinia virus
auaugacaaacau

SEQ ID NO: 4062883 - RNA, 19 nt, Vaccinia virus
auaugauaauauuaaaaga

SEQ ID NO: 4062884 - RNA, 16 nt, Vaccinia virus
auaugaucaaaaagag

SEQ ID NO: 4062885 - RNA, 20 nt, Vaccinia virus
auaugcaccuagagaauugc

SEQ ID NO: 4062886 - RNA, 18 nt, Vaccinia virus
auaugccuccagaaguug

SEQ ID NO: 4062887 - RNA, 15 nt, Vaccinia virus
auaugcuacauguaa

SEQ ID NO: 4062888 - RNA, 14 nt, Vaccinia virus
auaugcucauauau

SEQ ID NO: 4062889 - RNA, 14 nt, Vaccinia virus
auaugcucuagaua

SEQ ID NO: 4062890 - RNA, 22 nt, Vaccinia virus
auauggaaaaguucaacaugau

SEQ ID NO: 4062891 - RNA, 13 nt, Vaccinia virus
auauguagcaaac

SEQ ID NO: 4062892 - RNA, 15 nt, Vaccinia virus
auauguagcaaacau

SEQ ID NO: 4062893 - RNA, 14 nt, Vaccinia virus
auauguaucauaau

SEQ ID NO: 4062894 - RNA, 16 nt, Vaccinia virus
auauguauuuuaauaa

SEQ ID NO: 4062895 - RNA, 20 nt, Vaccinia virus
auaugucucgcauaaacauu

SEQ ID NO: 4062896 - RNA, 21 nt, Vaccinia virus
auauguuaaauauaaaaaaug

SEQ ID NO: 4062897 - RNA, 15 nt, Vaccinia virus
auauguuauaauaga

SEQ ID NO: 4062898 - RNA, 14 nt, Vaccinia virus
auauguuguuguaa

SEQ ID NO: 4062899 - RNA, 13 nt, Vaccinia virus
auauguuuguaaa

SEQ ID NO: 4062900 - RNA, 15 nt, Vaccinia virus
auauuaaaauagcua

SEQ ID NO: 4062901 - RNA, 16 nt, Vaccinia virus
auauuaaagucuuuac

SEQ ID NO: 4062902 - RNA, 21 nt, Vaccinia virus
auauuaacgaguuccauuuau

SEQ ID NO: 4062903 - RNA, 18 nt, Vaccinia virus
auauuaauacacauaaug

SEQ ID NO: 4062904 - RNA, 23 nt, Vaccinia virus
auauuaaucauccacguuuugau

SEQ ID NO: 4062905 - RNA, 15 nt, Vaccinia virus
auauuaauucuguaa

SEQ ID NO: 4062906 - RNA, 13 nt, Vaccinia virus
auauuacaaaauc

SEQ ID NO: 4062907 - RNA, 20 nt, Vaccinia virus
auauuacaaccaauguuaug

SEQ ID NO: 4062908 - RNA, 20 nt, Vaccinia virus
auauuacauaccauuaauaa

SEQ ID NO: 4062909 - RNA, 16 nt, Vaccinia virus
auauuacuuauaauaa

SEQ ID NO: 4062910 - RNA, 16 nt, Vaccinia virus
auauuagacaauacua

SEQ ID NO: 4062911 - RNA, 17 nt, Vaccinia virus
auauuagauauuuuaug

SEQ ID NO: 4062912 - RNA, 14 nt, Vaccinia virus
auauuagauuuacu

SEQ ID NO: 4062913 - RNA, 16 nt, Vaccinia virus
auauuagauuuuguau

SEQ ID NO: 4062914 - RNA, 20 nt, Vaccinia virus
auauuaucgagauuuaauaa

SEQ ID NO: 4062915 - RNA, 13 nt, Vaccinia virus
auauuauuaaaga

SEQ ID NO: 4062916 - RNA, 21 nt, Vaccinia virus
auauuccgacaugcaaaaaug

SEQ ID NO: 4062917 - RNA, 21 nt, Vaccinia virus
auauuccggcguaugaauuga

SEQ ID NO: 4062918 - RNA, 23 nt, Vaccinia virus
auauucuauaacuugagacuuga

SEQ ID NO: 4062919 - RNA, 18 nt, Vaccinia virus
auauucucuauuuuggug

SEQ ID NO: 4062920 - RNA, 23 nt, Vaccinia virus
auauucuuguuauguuaauacau

SEQ ID NO: 4062921 - RNA, 18 nt, Vaccinia virus
auauucuuuuuuuauaga

SEQ ID NO: 4062922 - RNA, 16 nt, Vaccinia virus
auauugauguuaauaa

SEQ ID NO: 4062923 - RNA, 21 nt, Vaccinia virus
auauugcaccagaauuaauaa

SEQ ID NO: 4062924 - RNA, 19 nt, Vaccinia virus
auauuggagcaaaauccua

SEQ ID NO: 4062925 - RNA, 20 nt, Vaccinia virus
auauuguaccagauuaauga

SEQ ID NO: 4062926 - RNA, 15 nt, Vaccinia virus
auauuguuuaauaua

SEQ ID NO: 4062927 - RNA, 12 nt, Vaccinia virus
auauuuaaacaa

SEQ ID NO: 4062928 - RNA, 19 nt, Vaccinia virus
auauuuacauauuuacugg

SEQ ID NO: 4062929 - RNA, 15 nt, Vaccinia virus
auauuuaguauuauu

SEQ ID NO: 4062930 - RNA, 17 nt, Vaccinia virus
auauuuguauagauaau

SEQ ID NO: 4062931 - RNA, 21 nt, Vaccinia virus
auauuuguuccuguagauaau

SEQ ID NO: 4062932 - RNA, 22 nt, Vaccinia virus
auauuuuucuauguuaggaaua

SEQ ID NO: 4062933 - RNA, 21 nt, Vaccinia virus
auauuuuugauggguaagcca

SEQ ID NO: 4062934 - RNA, 15 nt, Vaccinia virus
auauuuuuuaauagu

SEQ ID NO: 4062935 - RNA, 14 nt, Vaccinia virus
auauuuuuuucuau

SEQ ID NO: 4062936 - RNA, 17 nt, Vaccinia virus
auauuuuuuuuuaaaga

SEQ ID NO: 4062937 - RNA, 22 nt, Vaccinia virus
aucaaaaccauuucuaagagaa

SEQ ID NO: 4062938 - RNA, 15 nt, Vaccinia virus
aucaaaagaaugauu

SEQ ID NO: 4062939 - RNA, 17 nt, Vaccinia virus
aucaaaauagcaaagua

SEQ ID NO: 4062940 - RNA, 22 nt, Vaccinia virus
aucaaagaucuuguuaucgauu

SEQ ID NO: 4062941 - RNA, 19 nt, Vaccinia virus
aucaaagucacaaagcaag

SEQ ID NO: 4062942 - RNA, 19 nt, Vaccinia virus
aucaaauggaugcuaauug

SEQ ID NO: 4062943 - RNA, 19 nt, Vaccinia virus
aucaaaugguacaaaaaag

SEQ ID NO: 4062944 - RNA, 17 nt, Vaccinia virus
aucaaaugguugauaau

SEQ ID NO: 4062945 - RNA, 13 nt, Vaccinia virus
aucaacaauuuug

SEQ ID NO: 4062946 - RNA, 20 nt, Vaccinia virus
aucaacagauagcuugaaug

SEQ ID NO: 4062947 - RNA, 17 nt, Vaccinia virus
aucaacauuguuucaaa

SEQ ID NO: 4062948 - RNA, 18 nt, Vaccinia virus
aucaaccgcauaauacaa

SEQ ID NO: 4062949 - RNA, 18 nt, Vaccinia virus
aucaacgaguucaaauau

SEQ ID NO: 4062950 - RNA, 21 nt, Vaccinia virus
aucaacgaguucaaauaugaa

SEQ ID NO: 4062951 - RNA, 23 nt, Vaccinia virus
aucaacgaguucaaauaugaaau

SEQ ID NO: 4062952 - RNA, 23 nt, Vaccinia virus
aucaacggaacauauuuauauaa

SEQ ID NO: 4062953 - RNA, 14 nt, Vaccinia virus
aucaacuacauaau

SEQ ID NO: 4062954 - RNA, 18 nt, Vaccinia virus
aucaagaauauccagauu

SEQ ID NO: 4062955 - RNA, 22 nt, Vaccinia virus
aucaagacguggcaaacaaugu

SEQ ID NO: 4062956 - RNA, 14 nt, Vaccinia virus
aucaagaguaacua

SEQ ID NO: 4062957 - RNA, 21 nt, Vaccinia virus
aucaagaguaacuauugacuu

SEQ ID NO: 4062958 - RNA, 23 nt, Vaccinia virus
aucaagauguguauguuugugaa

SEQ ID NO: 4062959 - RNA, 23 nt, Vaccinia virus
aucaaggacuuuuauaucccaca

SEQ ID NO: 4062960 - RNA, 22 nt, Vaccinia virus
aucaaggauacacucucaauau

SEQ ID NO: 4062961 - RNA, 23 nt, Vaccinia virus
aucaagucuuuauacaaugacau

SEQ ID NO: 4062962 - RNA, 23 nt, Vaccinia virus
aucaaguuuguaggaaaggacaa

SEQ ID NO: 4062963 - RNA, 14 nt, Vaccinia virus
aucaauaaauggau

SEQ ID NO: 4062964 - RNA, 20 nt, Vaccinia virus
aucaauaauuguuuugaauu

SEQ ID NO: 4062965 - RNA, 16 nt, Vaccinia virus
aucaaucgauaacaag

SEQ ID NO: 4062966 - RNA, 12 nt, Vaccinia virus
aguauacauguu

SEQ ID NO: 4062967 - RNA, 23 nt, Vaccinia virus
aguauacgaguaaauaacuauag

SEQ ID NO: 4062968 - RNA, 23 nt, Vaccinia virus
aguauacuaccuguuauauuucu

SEQ ID NO: 4062969 - RNA, 14 nt, Vaccinia virus
aguauagaaauugu

SEQ ID NO: 4062970 - RNA, 12 nt, Vaccinia virus
aguauaguuuua

SEQ ID NO: 4062971 - RNA, 13 nt, Vaccinia virus
aguauaucaaaua

SEQ ID NO: 4062972 - RNA, 20 nt, Vaccinia virus
aguauaucaaauacaucuau

SEQ ID NO: 4062973 - RNA, 21 nt, Vaccinia virus
aguaucaugaacucuaaucaa

SEQ ID NO: 4062974 - RNA, 15 nt, Vaccinia virus
aguaucauuaaaucu

SEQ ID NO: 4062975 - RNA, 17 nt, Vaccinia virus
aguaucgaaaaaugcug

SEQ ID NO: 4062976 - RNA, 20 nt, Vaccinia virus
aguaucuuauguauauguuu

SEQ ID NO: 4062977 - RNA, 18 nt, Vaccinia virus
aguaugacuuacuuguau

SEQ ID NO: 4062978 - RNA, 15 nt, Vaccinia virus
aguauggaauacaua

SEQ ID NO: 4062979 - RNA, 16 nt, Vaccinia virus
aguauguuugacuuua

SEQ ID NO: 4062980 - RNA, 18 nt, Vaccinia virus
aguauucucggauacucu

SEQ ID NO: 4062981 - RNA, 19 nt, Vaccinia virus
aguauugacaauacuguau

SEQ ID NO: 4062982 - RNA, 14 nt, Vaccinia virus
aguauuuaacaaga

SEQ ID NO: 4062983 - RNA, 22 nt, Vaccinia virus
aguauuuauacuuuuaggaaau

SEQ ID NO: 4062984 - RNA, 14 nt, Vaccinia virus
aguauuuuaauaca

SEQ ID NO: 4062985 - RNA, 13 nt, Vaccinia virus
aguauuuuuauca

SEQ ID NO: 4062986 - RNA, 15 nt, Vaccinia virus
agucaagaugaugaa

SEQ ID NO: 4062987 - RNA, 16 nt, Vaccinia virus
agucaagucaaugaua

SEQ ID NO: 4062988 - RNA, 17 nt, Vaccinia virus
agucaauguuuuugaaa

SEQ ID NO: 4062989 - RNA, 21 nt, Vaccinia virus
agucacuauuuuuauaacuaa

SEQ ID NO: 4062990 - RNA, 18 nt, Vaccinia virus
agucagacuguaguucua

SEQ ID NO: 4062991 - RNA, 14 nt, Vaccinia virus
agucauaaaaggau

SEQ ID NO: 4062992 - RNA, 12 nt, Vaccinia virus
agucauacuaga

SEQ ID NO: 4062993 - RNA, 19 nt, Vaccinia virus
agucaucuugucuagaaug

SEQ ID NO: 4062994 - RNA, 19 nt, Vaccinia virus
agucauggcgacuaaauua

SEQ ID NO: 4062995 - RNA, 13 nt, Vaccinia virus
agucauuaacaaa

SEQ ID NO: 4062996 - RNA, 21 nt, Vaccinia virus
aguccauccgauuaugagaca

SEQ ID NO: 4062997 - RNA, 20 nt, Vaccinia virus
agucccauuggauaguuuuu

SEQ ID NO: 4062998 - RNA, 15 nt, Vaccinia virus
agucgacagaagaau

SEQ ID NO: 4062999 - RNA, 22 nt, Vaccinia virus
agucucaaucuuauuuaacuaa

SEQ ID NO: 4063000 - RNA, 15 nt, Vaccinia virus
agucuccacacuauu

SEQ ID NO: 4063001 - RNA, 16 nt, Vaccinia virus
agucugucuguagaua

SEQ ID NO: 4063002 - RNA, 17 nt, Vaccinia virus
agugaaacaaucaagaa

SEQ ID NO: 4063003 - RNA, 13 nt, Vaccinia virus
agugaaacuaucu

SEQ ID NO: 4063004 - RNA, 23 nt, Vaccinia virus
agugaauugauugcuguuauuaa

SEQ ID NO: 4063005 - RNA, 19 nt, Vaccinia virus
agugacacucuauaucuag

SEQ ID NO: 4063006 - RNA, 18 nt, Vaccinia virus
agugauauaaaacuaucu

SEQ ID NO: 4063007 - RNA, 14 nt, Vaccinia virus
agugcaaugaauau

SEQ ID NO: 4063008 - RNA, 16 nt, Vaccinia virus
agugcuacuuuaagau

SEQ ID NO: 4063009 - RNA, 16 nt, Vaccinia virus
agugguauaucuuguu

SEQ ID NO: 4063010 - RNA, 17 nt, Vaccinia virus
aguggugugaauacaac

SEQ ID NO: 4063011 - RNA, 14 nt, Vaccinia virus
agugguuaaucuua

SEQ ID NO: 4063012 - RNA, 13 nt, Vaccinia virus
aguguaaagacaa

SEQ ID NO: 4063013 - RNA, 22 nt, Vaccinia virus
aguguacgaagcgguuuuacga

SEQ ID NO: 4063014 - RNA, 20 nt, Vaccinia virus
agugucaauuuuaaaugaug

SEQ ID NO: 4063015 - RNA, 18 nt, Vaccinia virus
agugugaauaugaucuuc

SEQ ID NO: 4063016 - RNA, 19 nt, Vaccinia virus
aguuaaaacuuguaagaag

SEQ ID NO: 4063017 - RNA, 23 nt, Vaccinia virus
aguuaaaauaucaugguuaucca

SEQ ID NO: 4063018 - RNA, 17 nt, Vaccinia virus
aguuaaaauuuuaagau

SEQ ID NO: 4063019 - RNA, 23 nt, Vaccinia virus
aguuaaaauuuuaagauuuuaaa

SEQ ID NO: 4063020 - RNA, 18 nt, Vaccinia virus
aguuaaagaaaaauacuc

SEQ ID NO: 4063021 - RNA, 13 nt, Vaccinia virus
aguuaaauauuaa

SEQ ID NO: 4063022 - RNA, 19 nt, Vaccinia virus
aguuaagagauuuagaaaa

SEQ ID NO: 4063023 - RNA, 13 nt, Vaccinia virus
aguuaauuuauca

SEQ ID NO: 4063024 - RNA, 19 nt, Vaccinia virus
aguuacauacaaacugaaa

SEQ ID NO: 4063025 - RNA, 18 nt, Vaccinia virus
aguuacauguuuaaauaa

SEQ ID NO: 4063026 - RNA, 22 nt, Vaccinia virus
aguuagaugugucauacuuguu

SEQ ID NO: 4063027 - RNA, 20 nt, Vaccinia virus
aguuagcaauuucaaaauag

SEQ ID NO: 4063028 - RNA, 21 nt, Vaccinia virus
aguuauauuuucgucuaucca

SEQ ID NO: 4063029 - RNA, 22 nt, Vaccinia virus
aguucacaacucgccucuaaug

SEQ ID NO: 4063030 - RNA, 20 nt, Vaccinia virus
aguucauaacagauacauaa

SEQ ID NO: 4063031 - RNA, 15 nt, Vaccinia virus
aguucauuaucugaa

SEQ ID NO: 4063032 - RNA, 23 nt, Vaccinia virus
aguucuugcuccuccuugauucu

SEQ ID NO: 4063033 - RNA, 15 nt, Vaccinia virus
aguucuuuuagaaaa

SEQ ID NO: 4063034 - RNA, 15 nt, Vaccinia virus
aguuggaaguuuaau

SEQ ID NO: 4063035 - RNA, 20 nt, Vaccinia virus
aguuguaaaguuaaaauugu

SEQ ID NO: 4063036 - RNA, 16 nt, Vaccinia virus
aguugucuaguauuua

SEQ ID NO: 4063037 - RNA, 20 nt, Vaccinia virus
aguuuaagauuguacacuuu

SEQ ID NO: 4063038 - RNA, 22 nt, Vaccinia virus
aguuuacuuucaugauuucauu

SEQ ID NO: 4063039 - RNA, 12 nt, Vaccinia virus
aguuuauaagaa

SEQ ID NO: 4063040 - RNA, 13 nt, Vaccinia virus
aguuuauuagaca

SEQ ID NO: 4063041 - RNA, 22 nt, Vaccinia virus
aguuuccuguaaauuuucuaua

SEQ ID NO: 4063042 - RNA, 17 nt, Vaccinia virus
aguuucuagauacuaga

SEQ ID NO: 4063043 - RNA, 16 nt, Vaccinia virus
aguuugaauaguuugu

SEQ ID NO: 4063044 - RNA, 22 nt, Vaccinia virus
aguuugcggauaaugauagaca

SEQ ID NO: 4063045 - RNA, 13 nt, Vaccinia virus
aguuuuauuggga

SEQ ID NO: 4063046 - RNA, 22 nt, Vaccinia virus
aguuuucuuucaaaauagcuau

SEQ ID NO: 4063047 - RNA, 12 nt, Vaccinia virus
aguuuuuaagag

SEQ ID NO: 4063048 - RNA, 17 nt, Vaccinia virus
aguuuuuaggaaauauu

SEQ ID NO: 4063049 - RNA, 13 nt, Vaccinia virus
aguuuuucuggaa

SEQ ID NO: 4063050 - RNA, 18 nt, Vaccinia virus
auaaaaaaacauuauucu

SEQ ID NO: 4063051 - RNA, 21 nt, Vaccinia virus
auaaaaacgagaaugacauaa

SEQ ID NO: 4063052 - RNA, 13 nt, Vaccinia virus
auaaaaagaaugu

SEQ ID NO: 4063053 - RNA, 22 nt, Vaccinia virus
auaaaaaguaauauucauaugu

SEQ ID NO: 4063054 - RNA, 13 nt, Vaccinia virus
auaaaaauacuua

SEQ ID NO: 4063055 - RNA, 23 nt, Vaccinia virus
auaaaaauguucuuuuuguguga

SEQ ID NO: 4063056 - RNA, 11 nt, Vaccinia virus
auaaaacauua

SEQ ID NO: 4063057 - RNA, 16 nt, Vaccinia virus
auaaaaccaguauuug

SEQ ID NO: 4063058 - RNA, 20 nt, Vaccinia virus
auaaaaccaugaaauauauu

SEQ ID NO: 4063059 - RNA, 19 nt, Vaccinia virus
auaaaacgaauuauagaca

SEQ ID NO: 4063060 - RNA, 12 nt, Vaccinia virus
auaaaacuauau

SEQ ID NO: 4063061 - RNA, 15 nt, Vaccinia virus
auaaaacucauauag

SEQ ID NO: 4063062 - RNA, 14 nt, Vaccinia virus
auaaaaguaauaaa

SEQ ID NO: 4063063 - RNA, 13 nt, Vaccinia virus
auaaaauaauaca

SEQ ID NO: 4063064 - RNA, 18 nt, Vaccinia virus
auaaaaugacaaauacuc

SEQ ID NO: 4063065 - RNA, 16 nt, Vaccinia virus
auaaaauguuaauaca

SEQ ID NO: 4063066 - RNA, 17 nt, Vaccinia virus
auaaaauuaucaugaca

SEQ ID NO: 4063067 - RNA, 21 nt, Vaccinia virus
auaaaauucuuaguuauauau

SEQ ID NO: 4063068 - RNA, 14 nt, Vaccinia virus
auaaaauuuaagag

SEQ ID NO: 4063069 - RNA, 17 nt, Vaccinia virus
auaaacaaacuaauaaa

SEQ ID NO: 4063070 - RNA, 16 nt, Vaccinia virus
auaaacauaaguauau

SEQ ID NO: 4063071 - RNA, 12 nt, Vaccinia virus
auaaacauagaa

SEQ ID NO: 4063072 - RNA, 15 nt, Vaccinia virus
auaaacaucaacauu

SEQ ID NO: 4063073 - RNA, 14 nt, Vaccinia virus
auaaacaugucuau

SEQ ID NO: 4063074 - RNA, 20 nt, Vaccinia virus
auaaacaugucuauuguuaa

SEQ ID NO: 4063075 - RNA, 17 nt, Vaccinia virus
auaaacucacauuucaa

SEQ ID NO: 4063076 - RNA, 14 nt, Vaccinia virus
auaaacucagauaa

SEQ ID NO: 4063077 - RNA, 20 nt, Vaccinia virus
auaaacucagauaauagcaa

SEQ ID NO: 4063078 - RNA, 13 nt, Vaccinia virus
auaaacuguuuau

SEQ ID NO: 4063079 - RNA, 15 nt, Vaccinia virus
auaaagaaaaaucua

SEQ ID NO: 4063080 - RNA, 22 nt, Vaccinia virus
auaaagaaaugucuacauaaau

SEQ ID NO: 4063081 - RNA, 16 nt, Vaccinia virus
auaaagaguccuauau

SEQ ID NO: 4063082 - RNA, 17 nt, Vaccinia virus
auaaaggagaaggaaaa

SEQ ID NO: 4063083 - RNA, 18 nt, Vaccinia virus
auaaaguaugaacaaaga

SEQ ID NO: 4063084 - RNA, 15 nt, Vaccinia virus
auaaauacauuuaca

SEQ ID NO: 4063085 - RNA, 12 nt, Vaccinia virus
auaaauagagaa

SEQ ID NO: 4063086 - RNA, 22 nt, Vaccinia virus
auaaauagcuuuacuucuauau

SEQ ID NO: 4063087 - RNA, 22 nt, Vaccinia virus
auaaauaggaguuagaauaaua

SEQ ID NO: 4063088 - RNA, 13 nt, Vaccinia virus
auaaauaguuuuu

SEQ ID NO: 4063089 - RNA, 15 nt, Vaccinia virus
auaaauaucauauau

SEQ ID NO: 4063090 - RNA, 20 nt, Vaccinia virus
auaaauauccuuggaauuga

SEQ ID NO: 4063091 - RNA, 23 nt, Vaccinia virus
auaaaucacuaaauaauauccca

SEQ ID NO: 4063092 - RNA, 22 nt, Vaccinia virus
auaaaucuacucagauuauucu

SEQ ID NO: 4063093 - RNA, 13 nt, Vaccinia virus
agcacagaacaca

SEQ ID NO: 4063094 - RNA, 18 nt, Vaccinia virus
agcacauguauaauauaa

SEQ ID NO: 4063095 - RNA, 16 nt, Vaccinia virus
agcagcguauucauug

SEQ ID NO: 4063096 - RNA, 18 nt, Vaccinia virus
agcaguagcgagaaagca

SEQ ID NO: 4063097 - RNA, 17 nt, Vaccinia virus
agcaguuaccaaagaga

SEQ ID NO: 4063098 - RNA, 14 nt, Vaccinia virus
agcauaaacuauac

SEQ ID NO: 4063099 - RNA, 20 nt, Vaccinia virus
agcauagcgauagaucuuaa

SEQ ID NO: 4063100 - RNA, 22 nt, Vaccinia virus
agcaucauguccauuuaacuaa

SEQ ID NO: 4063101 - RNA, 17 nt, Vaccinia virus
agcauccaguaugaaua

SEQ ID NO: 4063102 - RNA, 20 nt, Vaccinia virus
agcauccguaugcuacuaga

SEQ ID NO: 4063103 - RNA, 18 nt, Vaccinia virus
agcauucgcuaaaaaauu

SEQ ID NO: 4063104 - RNA, 22 nt, Vaccinia virus
agcauucuuuccagaacuauau

SEQ ID NO: 4063105 - RNA, 21 nt, Vaccinia virus
agcauugcguguuuuagugau

SEQ ID NO: 4063106 - RNA, 14 nt, Vaccinia virus
agcauuguuauuag

SEQ ID NO: 4063107 - RNA, 12 nt, Vaccinia virus
agccaauacuuu

SEQ ID NO: 4063108 - RNA, 13 nt, Vaccinia virus
agccaauacuuua

SEQ ID NO: 4063109 - RNA, 17 nt, Vaccinia virus
agccauagcaauacuuc

SEQ ID NO: 4063110 - RNA, 14 nt, Vaccinia virus
agccgaaaacauug

SEQ ID NO: 4063111 - RNA, 15 nt, Vaccinia virus
agccggacaaauaua

SEQ ID NO: 4063112 - RNA, 15 nt, Vaccinia virus
agcgaaggagaccac

SEQ ID NO: 4063113 - RNA, 12 nt, Vaccinia virus
agcgaauuauuu

SEQ ID NO: 4063114 - RNA, 19 nt, Vaccinia virus
agcgcugaaaauaaagaua

SEQ ID NO: 4063115 - RNA, 14 nt, Vaccinia virus
agcggcuacuaaaa

SEQ ID NO: 4063116 - RNA, 18 nt, Vaccinia virus
agcggggucgaucuugug

SEQ ID NO: 4063117 - RNA, 14 nt, Vaccinia virus
agcguaaaaguaaa

SEQ ID NO: 4063118 - RNA, 12 nt, Vaccinia virus
agcuaaaaaugc

SEQ ID NO: 4063119 - RNA, 16 nt, Vaccinia virus
agcuaagcaacuaaga

SEQ ID NO: 4063120 - RNA, 18 nt, Vaccinia virus
agcuaauccugauauuaa

SEQ ID NO: 4063121 - RNA, 19 nt, Vaccinia virus
agcuagaggaaaugaaaga

SEQ ID NO: 4063122 - RNA, 19 nt, Vaccinia virus
agcuauugcauaauacaag

SEQ ID NO: 4063123 - RNA, 14 nt, Vaccinia virus
agcuauuuaaaugg

SEQ ID NO: 4063124 - RNA, 20 nt, Vaccinia virus
agcuccaugacuuaugaaua

SEQ ID NO: 4063125 - RNA, 16 nt, Vaccinia virus
agcucgugguauuaua

SEQ ID NO: 4063126 - RNA, 19 nt, Vaccinia virus
agcucucccagauuucuuu

SEQ ID NO: 4063127 - RNA, 16 nt, Vaccinia virus
agcugaaaaacuaugu

SEQ ID NO: 4063128 - RNA, 12 nt, Vaccinia virus
agcugaaaugag

SEQ ID NO: 4063129 - RNA, 20 nt, Vaccinia virus
agcugaaucugauaaauaua

SEQ ID NO: 4063130 - RNA, 17 nt, Vaccinia virus
agcuugauaauuagaua

SEQ ID NO: 4063131 - RNA, 15 nt, Vaccinia virus
aggaaacuaauauug

SEQ ID NO: 4063132 - RNA, 17 nt, Vaccinia virus
aggaaacuuaaaauaua

SEQ ID NO: 4063133 - RNA, 21 nt, Vaccinia virus
aggaaauaccauaaauauauu

SEQ ID NO: 4063134 - RNA, 17 nt, Vaccinia virus
aggaaauggaagauauu

SEQ ID NO: 4063135 - RNA, 18 nt, Vaccinia virus
aggaaauugauaaugagu

SEQ ID NO: 4063136 - RNA, 22 nt, Vaccinia virus
aggaauaaaauaugaaauaagu

SEQ ID NO: 4063137 - RNA, 19 nt, Vaccinia virus
aggaauacaauacauaccu

SEQ ID NO: 4063138 - RNA, 18 nt, Vaccinia virus
aggaauaucugaugaugu

SEQ ID NO: 4063139 - RNA, 14 nt, Vaccinia virus
aggaaucaaugaua

SEQ ID NO: 4063140 - RNA, 20 nt, Vaccinia virus
aggaauuaaucuaguagaaa

SEQ ID NO: 4063141 - RNA, 15 nt, Vaccinia virus
aggaauuaauuauuc

SEQ ID NO: 4063142 - RNA, 22 nt, Vaccinia virus
aggaauuggaauccaauuguuu

SEQ ID NO: 4063143 - RNA, 18 nt, Vaccinia virus
aggaccguauuagaaugu

SEQ ID NO: 4063144 - RNA, 21 nt, Vaccinia virus
aggaccuuccaacuguggaua

SEQ ID NO: 4063145 - RNA, 15 nt, Vaccinia virus
aggacgguauaugua

SEQ ID NO: 4063146 - RNA, 17 nt, Vaccinia virus
aggacguaauacaugca

SEQ ID NO: 4063147 - RNA, 22 nt, Vaccinia virus
aggacuaucuccgaauuuguuu

SEQ ID NO: 4063148 - RNA, 18 nt, Vaccinia virus
aggagaauccgaaauauu

SEQ ID NO: 4063149 - RNA, 19 nt, Vaccinia virus
aggagauacuaucaaaaua

SEQ ID NO: 4063150 - RNA, 17 nt, Vaccinia virus
aggaguaggaaugccac

SEQ ID NO: 4063151 - RNA, 18 nt, Vaccinia virus
aggagucuuauagaugua

SEQ ID NO: 4063152 - RNA, 15 nt, Vaccinia virus
aggauaaagaugucu

SEQ ID NO: 4063153 - RNA, 17 nt, Vaccinia virus
aggauacucuaugaaug

SEQ ID NO: 4063154 - RNA, 15 nt, Vaccinia virus
aggaucgacuccaua

SEQ ID NO: 4063155 - RNA, 15 nt, Vaccinia virus
aggaugaaaaaggac

SEQ ID NO: 4063156 - RNA, 11 nt, Vaccinia virus
aggauggugaa

SEQ ID NO: 4063157 - RNA, 19 nt, Vaccinia virus
aggauuaacagguucucaa

SEQ ID NO: 4063158 - RNA, 20 nt, Vaccinia virus
aggauuaucaaaucuuuaau

SEQ ID NO: 4063159 - RNA, 17 nt, Vaccinia virus
aggcaaaagaugucaag

SEQ ID NO: 4063160 - RNA, 20 nt, Vaccinia virus
aggcacagucaaacauucaa

SEQ ID NO: 4063161 - RNA, 16 nt, Vaccinia virus
aggcaguuaaggauaa

SEQ ID NO: 4063162 - RNA, 15 nt, Vaccinia virus
aggcauuaacuagau

SEQ ID NO: 4063163 - RNA, 18 nt, Vaccinia virus
aggccaagcgaauuauuu

SEQ ID NO: 4063164 - RNA, 18 nt, Vaccinia virus
aggcggauguugugaaug

SEQ ID NO: 4063165 - RNA, 13 nt, Vaccinia virus
aggcuaucaaaug

SEQ ID NO: 4063166 - RNA, 21 nt, Vaccinia virus
aggcuucucaucucuuucaga

SEQ ID NO: 4063167 - RNA, 19 nt, Vaccinia virus
agggaaauuaaagaagaag

SEQ ID NO: 4063168 - RNA, 16 nt, Vaccinia virus
aggggagguaaauaua

SEQ ID NO: 4063169 - RNA, 14 nt, Vaccinia virus
agggguauacuucu

SEQ ID NO: 4063170 - RNA, 20 nt, Vaccinia virus
agguaagauaucuacuagaa

SEQ ID NO: 4063171 - RNA, 15 nt, Vaccinia virus
agguagcaaaaagau

SEQ ID NO: 4063172 - RNA, 17 nt, Vaccinia virus
agguaucuugccaugga

SEQ ID NO: 4063173 - RNA, 15 nt, Vaccinia virus
agguauuaaguuugg

SEQ ID NO: 4063174 - RNA, 17 nt, Vaccinia virus
agguauuccuuuaucca

SEQ ID NO: 4063175 - RNA, 14 nt, Vaccinia virus
aggucuaugucucu

SEQ ID NO: 4063176 - RNA, 14 nt, Vaccinia virus
aggugaacaagaga

SEQ ID NO: 4063177 - RNA, 14 nt, Vaccinia virus
agguguuguaacuu

SEQ ID NO: 4063178 - RNA, 18 nt, Vaccinia virus
agguugauguagaagaag

SEQ ID NO: 4063179 - RNA, 19 nt, Vaccinia virus
agguuuuuuaaaacagaug

SEQ ID NO: 4063180 - RNA, 18 nt, Vaccinia virus
aguaaaaucuaucauauu

SEQ ID NO: 4063181 - RNA, 13 nt, Vaccinia virus
aguaaauaauaaa

SEQ ID NO: 4063182 - RNA, 21 nt, Vaccinia virus
aguaaauagauaguuuuucca

SEQ ID NO: 4063183 - RNA, 13 nt, Vaccinia virus
aguaaaugaaugc

SEQ ID NO: 4063184 - RNA, 13 nt, Vaccinia virus
aguaaaugaugaa

SEQ ID NO: 4063185 - RNA, 19 nt, Vaccinia virus
aguaacacguuuuuuagau

SEQ ID NO: 4063186 - RNA, 17 nt, Vaccinia virus
aguaacgagucucaguu

SEQ ID NO: 4063187 - RNA, 16 nt, Vaccinia virus
aguaacuauguaaaug

SEQ ID NO: 4063188 - RNA, 21 nt, Vaccinia virus
aguaagacaauaggaaaucua

SEQ ID NO: 4063189 - RNA, 18 nt, Vaccinia virus
aguaagacuugacuagau

SEQ ID NO: 4063190 - RNA, 20 nt, Vaccinia virus
aguaaguauuuauaaaacuc

SEQ ID NO: 4063191 - RNA, 16 nt, Vaccinia virus
aguaaguauuuauaca

SEQ ID NO: 4063192 - RNA, 14 nt, Vaccinia virus
aguaaguuuaugau

SEQ ID NO: 4063193 - RNA, 17 nt, Vaccinia virus
aguaauaaaacaaaaaa

SEQ ID NO: 4063194 - RNA, 13 nt, Vaccinia virus
aguaaucaacaau

SEQ ID NO: 4063195 - RNA, 19 nt, Vaccinia virus
aguaaucauauaaauguuu

SEQ ID NO: 4063196 - RNA, 14 nt, Vaccinia virus
aguaauuauaagaa

SEQ ID NO: 4063197 - RNA, 17 nt, Vaccinia virus
aguacaagaaauauuuc

SEQ ID NO: 4063198 - RNA, 22 nt, Vaccinia virus
aguacacuuaguccaggaccua

SEQ ID NO: 4063199 - RNA, 24 nt, Vaccinia virus
aguacauagcaucuucacaaauua

SEQ ID NO: 4063200 - RNA, 13 nt, Vaccinia virus
aguacauuucaca

SEQ ID NO: 4063201 - RNA, 19 nt, Vaccinia virus
aguacccucaauuaguuua

SEQ ID NO: 4063202 - RNA, 15 nt, Vaccinia virus
aguaccuacacuauu

SEQ ID NO: 4063203 - RNA, 13 nt, Vaccinia virus
aguaccuggaaug

SEQ ID NO: 4063204 - RNA, 20 nt, Vaccinia virus
aguacuaauaaggaacuaga

SEQ ID NO: 4063205 - RNA, 14 nt, Vaccinia virus
aguacuaucauaau

SEQ ID NO: 4063206 - RNA, 22 nt, Vaccinia virus
aguacuccucccauaauacuuu

SEQ ID NO: 4063207 - RNA, 19 nt, Vaccinia virus
aguacuguucaaacaugau

SEQ ID NO: 4063208 - RNA, 14 nt, Vaccinia virus
aguacuuguaugug

SEQ ID NO: 4063209 - RNA, 14 nt, Vaccinia virus
aguacuuucgcaag

SEQ ID NO: 4063210 - RNA, 19 nt, Vaccinia virus
aguagaaaauaauauagau

SEQ ID NO: 4063211 - RNA, 23 nt, Vaccinia virus
aguagacauuaauagaaugaaga

SEQ ID NO: 4063212 - RNA, 18 nt, Vaccinia virus
aguagaccguuaaugaaa

SEQ ID NO: 4063213 - RNA, 21 nt, Vaccinia virus
aguagauacgcaaacuuagau

SEQ ID NO: 4063214 - RNA, 19 nt, Vaccinia virus
aguagauuguuggcuacau

SEQ ID NO: 4063215 - RNA, 22 nt, Vaccinia virus
aguaggguuauuaacacuaaaa

SEQ ID NO: 4063216 - RNA, 13 nt, Vaccinia virus
aguaguucauuau

SEQ ID NO: 4063217 - RNA, 19 nt, Vaccinia virus
aguaguuuaacuagucuuc

SEQ ID NO: 4063218 - RNA, 18 nt, Vaccinia virus
aguauaacgugaauguau

SEQ ID NO: 4063219 - RNA, 14 nt, Vaccinia virus
aguauaauauuuaa

SEQ ID NO: 4063220 - RNA, 22 nt, Vaccinia virus
cugaaaauuggaguuagguauu

SEQ ID NO: 4063221 - RNA, 23 nt, Vaccinia virus
cugaaacaaagaauugugcauua

SEQ ID NO: 4063222 - RNA, 16 nt, Vaccinia virus
cugaaacaucacuaau

SEQ ID NO: 4063223 - RNA, 15 nt, Vaccinia virus
cugaaccuacuuuau

SEQ ID NO: 4063224 - RNA, 22 nt, Vaccinia virus
cugaagaagagguaagauaucu

SEQ ID NO: 4063225 - RNA, 23 nt, Vaccinia virus
cugaagcguguuauauauacaag

SEQ ID NO: 4063226 - RNA, 17 nt, Vaccinia virus
cugaauauagaacauca

SEQ ID NO: 4063227 - RNA, 23 nt, Vaccinia virus
cugagauuuguuuuguuaaacaa

SEQ ID NO: 4063228 - RNA, 20 nt, Vaccinia virus
cugaguaccuacacuauuau

SEQ ID NO: 4063229 - RNA, 16 nt, Vaccinia virus
cugaguauuuggauuu

SEQ ID NO: 4063230 - RNA, 20 nt, Vaccinia virus
cugauaaguucuuuauacag

SEQ ID NO: 4063231 - RNA, 17 nt, Vaccinia virus
cugauaauuuagauaau

SEQ ID NO: 4063232 - RNA, 16 nt, Vaccinia virus
cugauagaaagaauaa

SEQ ID NO: 4063233 - RNA, 19 nt, Vaccinia virus
cugauagcaauucauguac

SEQ ID NO: 4063234 - RNA, 23 nt, Vaccinia virus
cugauauggaaucuguauucucg

SEQ ID NO: 4063235 - RNA, 14 nt, Vaccinia virus
cugaucauuaauau

SEQ ID NO: 4063236 - RNA, 16 nt, Vaccinia virus
cugaugauauuagaac

SEQ ID NO: 4063237 - RNA, 19 nt, Vaccinia virus
cugauuaacuuccacauua

SEQ ID NO: 4063238 - RNA, 14 nt, Vaccinia virus
cugauuaucuugag

SEQ ID NO: 4063239 - RNA, 16 nt, Vaccinia virus
cugcauagaaauaucu

SEQ ID NO: 4063240 - RNA, 15 nt, Vaccinia virus
cugccgaauuuagag

SEQ ID NO: 4063241 - RNA, 21 nt, Vaccinia virus
cugccguauauaggagaaaaa

SEQ ID NO: 4063242 - RNA, 13 nt, Vaccinia virus
cugcuauauuguu

SEQ ID NO: 4063243 - RNA, 16 nt, Vaccinia virus
cugcugcguuaaacau

SEQ ID NO: 4063244 - RNA, 16 nt, Vaccinia virus
cuggaaaaauacuuuu

SEQ ID NO: 4063245 - RNA, 13 nt, Vaccinia virus
cuggaaaaguugu

SEQ ID NO: 4063246 - RNA, 15 nt, Vaccinia virus
cuggauauauuuugc

SEQ ID NO: 4063247 - RNA, 14 nt, Vaccinia virus
cuggauauuacaaa

SEQ ID NO: 4063248 - RNA, 16 nt, Vaccinia virus
cugguaacaugauauc

SEQ ID NO: 4063249 - RNA, 12 nt, Vaccinia virus
cugguaauuuaa

SEQ ID NO: 4063250 - RNA, 16 nt, Vaccinia virus
cugguucaaaauuaau

SEQ ID NO: 4063251 - RNA, 23 nt, Vaccinia virus
cugguuuucuauaaauaaaagac

SEQ ID NO: 4063252 - RNA, 15 nt, Vaccinia virus
cuguaaacaaguuug

SEQ ID NO: 4063253 - RNA, 16 nt, Vaccinia virus
cuguaaguauguuuaa

SEQ ID NO: 4063254 - RNA, 14 nt, Vaccinia virus
cuguaaucuauagg

SEQ ID NO: 4063255 - RNA, 21 nt, Vaccinia virus
cuguacaaauguuaaacauua

SEQ ID NO: 4063256 - RNA, 21 nt, Vaccinia virus
cuguacacauaguguuacaaa

SEQ ID NO: 4063257 - RNA, 21 nt, Vaccinia virus
cuguagugucaguacuauuag

SEQ ID NO: 4063258 - RNA, 20 nt, Vaccinia virus
cuguaucaaccggauuuaaa

SEQ ID NO: 4063259 - RNA, 22 nt, Vaccinia virus
cuguauccgucaaucuaauauu

SEQ ID NO: 4063260 - RNA, 16 nt, Vaccinia virus
cuguauuccaauuagu

SEQ ID NO: 4063261 - RNA, 20 nt, Vaccinia virus
cuguauuguuaauagauaua

SEQ ID NO: 4063262 - RNA, 17 nt, Vaccinia virus
cugucaauagacaucca

SEQ ID NO: 4063263 - RNA, 19 nt, Vaccinia virus
cugucaauugauucuuauu

SEQ ID NO: 4063264 - RNA, 19 nt, Vaccinia virus
cugucugcagccauuuuua

SEQ ID NO: 4063265 - RNA, 16 nt, Vaccinia virus
cugucuggcaauaaau

SEQ ID NO: 4063266 - RNA, 22 nt, Vaccinia virus
cugucuugaguuccauuacaaa

SEQ ID NO: 4063267 - RNA, 16 nt, Vaccinia virus
cugugaugccaauaag

SEQ ID NO: 4063268 - RNA, 22 nt, Vaccinia virus
cuguuaccauaauuccuuugau

SEQ ID NO: 4063269 - RNA, 21 nt, Vaccinia virus
cuguuuaaacgaggacuauaa

SEQ ID NO: 4063270 - RNA, 13 nt, Vaccinia virus
cuguuuauacaag

SEQ ID NO: 4063271 - RNA, 16 nt, Vaccinia virus
cuguuucgaaacuuua

SEQ ID NO: 4063272 - RNA, 19 nt, Vaccinia virus
cuuaaaauauaaugauaua

SEQ ID NO: 4063273 - RNA, 19 nt, Vaccinia virus
cuuaaaugccuuauucucu

SEQ ID NO: 4063274 - RNA, 21 nt, Vaccinia virus
cuuaauauuguauuguuuaua

SEQ ID NO: 4063275 - RNA, 16 nt, Vaccinia virus
cuuaauucaucuucua

SEQ ID NO: 4063276 - RNA, 13 nt, Vaccinia virus
cuuaauuuugugc

SEQ ID NO: 4063277 - RNA, 21 nt, Vaccinia virus
cuuagacaagcggguaaauga

SEQ ID NO: 4063278 - RNA, 21 nt, Vaccinia virus
cuuaggcggauucaguacaau

SEQ ID NO: 4063279 - RNA, 17 nt, Vaccinia virus
cuuauacaggucauuac

SEQ ID NO: 4063280 - RNA, 21 nt, Vaccinia virus
cuuaucacgugcaaggcauuu

SEQ ID NO: 4063281 - RNA, 20 nt, Vaccinia virus
cuuaugauauucauucuuua

SEQ ID NO: 4063282 - RNA, 17 nt, Vaccinia virus
cuuauucggaaaguauu

SEQ ID NO: 4063283 - RNA, 15 nt, Vaccinia virus
cuucaauaacuuaua

SEQ ID NO: 4063284 - RNA, 19 nt, Vaccinia virus
cuucacauucggagauucu

SEQ ID NO: 4063285 - RNA, 18 nt, Vaccinia virus
cuucagaauacaaucugu

SEQ ID NO: 4063286 - RNA, 21 nt, Vaccinia virus
cuucagaauacaaucuguauu

SEQ ID NO: 4063287 - RNA, 23 nt, Vaccinia virus
cuucagauaaucugaaaaugaaa

SEQ ID NO: 4063288 - RNA, 18 nt, Vaccinia virus
cuucaucuaccaaagaaa

SEQ ID NO: 4063289 - RNA, 16 nt, Vaccinia virus
cuucauuaaucuuuuc

SEQ ID NO: 4063290 - RNA, 20 nt, Vaccinia virus
cuucauucguaaaucuuuuc

SEQ ID NO: 4063291 - RNA, 17 nt, Vaccinia virus
cuucccucuaucauguu

SEQ ID NO: 4063292 - RNA, 21 nt, Vaccinia virus
cuucgauagauauucuucaga

SEQ ID NO: 4063293 - RNA, 12 nt, Vaccinia virus
cuucgcaauaau

SEQ ID NO: 4063294 - RNA, 16 nt, Vaccinia virus
cuucgcuuuauauacc

SEQ ID NO: 4063295 - RNA, 19 nt, Vaccinia virus
cuucuaaucuuguaauauu

SEQ ID NO: 4063296 - RNA, 14 nt, Vaccinia virus
cuucuacauuuuca

SEQ ID NO: 4063297 - RNA, 13 nt, Vaccinia virus
cuucuagauaucc

SEQ ID NO: 4063298 - RNA, 20 nt, Vaccinia virus
cuucuauuuuaucauuuucc

SEQ ID NO: 4063299 - RNA, 23 nt, Vaccinia virus
cuucuggaagguuuguauucuga

SEQ ID NO: 4063300 - RNA, 15 nt, Vaccinia virus
cuucuuguauuuccu

SEQ ID NO: 4063301 - RNA, 21 nt, Vaccinia virus
cuucuuuaaacgauuuuccaa

SEQ ID NO: 4063302 - RNA, 17 nt, Vaccinia virus
cuucuuuuuauauccaa

SEQ ID NO: 4063303 - RNA, 21 nt, Vaccinia virus
cuucuuuuucugucucaauag

SEQ ID NO: 4063304 - RNA, 14 nt, Vaccinia virus
cuugaagaugauuu

SEQ ID NO: 4063305 - RNA, 15 nt, Vaccinia virus
cuugaauucuuuuau

SEQ ID NO: 4063306 - RNA, 22 nt, Vaccinia virus
cuugauaaccuuggcugucuca

SEQ ID NO: 4063307 - RNA, 17 nt, Vaccinia virus
cuugauacuuuuucuag

SEQ ID NO: 4063308 - RNA, 16 nt, Vaccinia virus
cuuggaaaagauaacu

SEQ ID NO: 4063309 - RNA, 13 nt, Vaccinia virus
cuuggaaguuuua

SEQ ID NO: 4063310 - RNA, 18 nt, Vaccinia virus
cuugguuuuaaucuauug

SEQ ID NO: 4063311 - RNA, 14 nt, Vaccinia virus
cuuguguuuggaag

SEQ ID NO: 4063312 - RNA, 16 nt, Vaccinia virus
cuuguuguuuauuuuc

SEQ ID NO: 4063313 - RNA, 20 nt, Vaccinia virus
cuuguuuuugcuaauuauuu

SEQ ID NO: 4063314 - RNA, 17 nt, Vaccinia virus
cuuuaaaagaaacugac

SEQ ID NO: 4063315 - RNA, 12 nt, Vaccinia virus
cuuuaaauacuu

SEQ ID NO: 4063316 - RNA, 15 nt, Vaccinia virus
cuuuaaccuauacau

SEQ ID NO: 4063317 - RNA, 15 nt, Vaccinia virus
cuuuaacguauaaau

SEQ ID NO: 4063318 - RNA, 18 nt, Vaccinia virus
cuuuaacuuuauacuuuu

SEQ ID NO: 4063319 - RNA, 17 nt, Vaccinia virus
cuuuaagagagguauaa

SEQ ID NO: 4063320 - RNA, 21 nt, Vaccinia virus
cuuuacaucaucgaacuucug

SEQ ID NO: 4063321 - RNA, 19 nt, Vaccinia virus
cuuuaguuuauacuauuac

SEQ ID NO: 4063322 - RNA, 20 nt, Vaccinia virus
cuuuauacuauaauaguacu

SEQ ID NO: 4063323 - RNA, 11 nt, Vaccinia virus
cuuuauccaua

SEQ ID NO: 4063324 - RNA, 19 nt, Vaccinia virus
cuuuaucucauuugagaau

SEQ ID NO: 4063325 - RNA, 16 nt, Vaccinia virus
cuuucaugauuucauu

SEQ ID NO: 4063326 - RNA, 15 nt, Vaccinia virus
cuuugaagagauauu

SEQ ID NO: 4063327 - RNA, 18 nt, Vaccinia virus
cuuugaaguuuuuaagag

SEQ ID NO: 4063328 - RNA, 19 nt, Vaccinia virus
cuuugauggcugauagugu

SEQ ID NO: 4063329 - RNA, 20 nt, Vaccinia virus
cuuugcguaucucagucugu

SEQ ID NO: 4063330 - RNA, 11 nt, Vaccinia virus
cuuugcuuucg

SEQ ID NO: 4063331 - RNA, 21 nt, Vaccinia virus
cuuuguaaagaaauuauuuuc

SEQ ID NO: 4063332 - RNA, 11 nt, Vaccinia virus
cuuuguagaaa

SEQ ID NO: 4063333 - RNA, 20 nt, Vaccinia virus
cuuuguggaugaugauaaaa

SEQ ID NO: 4063334 - RNA, 23 nt, Vaccinia virus
cuuuuaaauacaaauauaucaau

SEQ ID NO: 4063335 - RNA, 20 nt, Vaccinia virus
cuuuuagaagugauucuuug

SEQ ID NO: 4063336 - RNA, 21 nt, Vaccinia virus
cuuuuagaagugauucuuuga

SEQ ID NO: 4063337 - RNA, 15 nt, Vaccinia virus
cuuuuauaauucaua

SEQ ID NO: 4063338 - RNA, 18 nt, Vaccinia virus
cuuuugcggacauuuucu

SEQ ID NO: 4063339 - RNA, 16 nt, Vaccinia virus
cuuuugcuauuaccaa

SEQ ID NO: 4063340 - RNA, 16 nt, Vaccinia virus
cuuuuuaggaauguau

SEQ ID NO: 4063341 - RNA, 13 nt, Vaccinia virus
cuuuuuauucucg

SEQ ID NO: 4063342 - RNA, 16 nt, Vaccinia virus
cuuuuuuccaaacugc

SEQ ID NO: 4063343 - RNA, 16 nt, Vaccinia virus
gaaaaaaaauuaucua

SEQ ID NO: 4063344 - RNA, 14 nt, Vaccinia virus
gaaaaaaguuuauu

SEQ ID NO: 4063345 - RNA, 12 nt, Vaccinia virus
gaaaaaauagcu

SEQ ID NO: 4063346 - RNA, 18 nt, Vaccinia virus
gauacauuguaugaugau

SEQ ID NO: 4063347 - RNA, 15 nt, Vaccinia virus
gauacccuacucgau

SEQ ID NO: 4063348 - RNA, 15 nt, Vaccinia virus
gauaccuagaagauc

SEQ ID NO: 4063349 - RNA, 22 nt, Vaccinia virus
gauacguacugucuauaaugac

SEQ ID NO: 4063350 - RNA, 19 nt, Vaccinia virus
gauacuaucggcucaaaga

SEQ ID NO: 4063351 - RNA, 23 nt, Vaccinia virus
gauacuccguauccuauuccaca

SEQ ID NO: 4063352 - RNA, 20 nt, Vaccinia virus
gauacuccuuuguauguacc

SEQ ID NO: 4063353 - RNA, 18 nt, Vaccinia virus
gauagauuuaucuuuccu

SEQ ID NO: 4063354 - RNA, 16 nt, Vaccinia virus
gauagcaaagagauga

SEQ ID NO: 4063355 - RNA, 15 nt, Vaccinia virus
gauaguauuauucau

SEQ ID NO: 4063356 - RNA, 17 nt, Vaccinia virus
gauauaaaauagaaaau

SEQ ID NO: 4063357 - RNA, 19 nt, Vaccinia virus
gauauacauuguauaaaaa

SEQ ID NO: 4063358 - RNA, 18 nt, Vaccinia virus
gauauagaguauaaugau

SEQ ID NO: 4063359 - RNA, 16 nt, Vaccinia virus
gauauauaucauaaau

SEQ ID NO: 4063360 - RNA, 15 nt, Vaccinia virus
gauauauaucuuuuc

SEQ ID NO: 4063361 - RNA, 23 nt, Vaccinia virus
gauauaucaaaauuagacuggag

SEQ ID NO: 4063362 - RNA, 14 nt, Vaccinia virus
gauauauuuuucau

SEQ ID NO: 4063363 - RNA, 19 nt, Vaccinia virus
gauaucuuuacuaagaaag

SEQ ID NO: 4063364 - RNA, 13 nt, Vaccinia virus
gauauuaaacaag

SEQ ID NO: 4063365 - RNA, 13 nt, Vaccinia virus
gauauuacuuaua

SEQ ID NO: 4063366 - RNA, 12 nt, Vaccinia virus
gauauuaguaca

SEQ ID NO: 4063367 - RNA, 23 nt, Vaccinia virus
gauauuaucaugaauuagauaua

SEQ ID NO: 4063368 - RNA, 19 nt, Vaccinia virus
gauauuaucgacuaugaau

SEQ ID NO: 4063369 - RNA, 21 nt, Vaccinia virus
gauauucgaucccgauauccu

SEQ ID NO: 4063370 - RNA, 22 nt, Vaccinia virus
gauauugucccacggaagugaa

SEQ ID NO: 4063371 - RNA, 19 nt, Vaccinia virus
gauauuguugauaauacaa

SEQ ID NO: 4063372 - RNA, 17 nt, Vaccinia virus
gaucaacaaaagaauac

SEQ ID NO: 4063373 - RNA, 13 nt, Vaccinia virus
gaucaucugaaaa

SEQ ID NO: 4063374 - RNA, 22 nt, Vaccinia virus
gaucauuuugauauugugaaug

SEQ ID NO: 4063375 - RNA, 17 nt, Vaccinia virus
gauccaaacaauguuuc

SEQ ID NO: 4063376 - RNA, 16 nt, Vaccinia virus
gauccuuuucuucaga

SEQ ID NO: 4063377 - RNA, 15 nt, Vaccinia virus
gaucuaaaaaaaacu

SEQ ID NO: 4063378 - RNA, 14 nt, Vaccinia virus
gaucucauauuaaa

SEQ ID NO: 4063379 - RNA, 17 nt, Vaccinia virus
gaucuggaaaauaaucu

SEQ ID NO: 4063380 - RNA, 21 nt, Vaccinia virus
gaucuuaacuccucuauuaau

SEQ ID NO: 4063381 - RNA, 16 nt, Vaccinia virus
gaucuuaccaucuucu

SEQ ID NO: 4063382 - RNA, 15 nt, Vaccinia virus
gaucuucuacaauau

SEQ ID NO: 4063383 - RNA, 22 nt, Vaccinia virus
gaugaaggugggacuauaucua

SEQ ID NO: 4063384 - RNA, 18 nt, Vaccinia virus
gaugaauuaauuaauguu

SEQ ID NO: 4063385 - RNA, 14 nt, Vaccinia virus
gaugagacauaucc

SEQ ID NO: 4063386 - RNA, 17 nt, Vaccinia virus
gaugagguaaaaaauaa

SEQ ID NO: 4063387 - RNA, 22 nt, Vaccinia virus
gaugauacauguauuaaaauac

SEQ ID NO: 4063388 - RNA, 15 nt, Vaccinia virus
gaugauacuucacuc

SEQ ID NO: 4063389 - RNA, 15 nt, Vaccinia virus
gaugauagagauauu

SEQ ID NO: 4063390 - RNA, 17 nt, Vaccinia virus
gaugauuagauggagag

SEQ ID NO: 4063391 - RNA, 22 nt, Vaccinia virus
gaugccaauaagcuuuagauau

SEQ ID NO: 4063392 - RNA, 17 nt, Vaccinia virus
gaugccaucauagauau

SEQ ID NO: 4063393 - RNA, 21 nt, Vaccinia virus
gaugcuauguuuauagauguu

SEQ ID NO: 4063394 - RNA, 21 nt, Vaccinia virus
gauggaaacauuguuauugau

SEQ ID NO: 4063395 - RNA, 16 nt, Vaccinia virus
gauggacccauagaga

SEQ ID NO: 4063396 - RNA, 13 nt, Vaccinia virus
gaugguacuuaug

SEQ ID NO: 4063397 - RNA, 15 nt, Vaccinia virus
gaugguauuucugaa

SEQ ID NO: 4063398 - RNA, 14 nt, Vaccinia virus
gauguacgaaagaa

SEQ ID NO: 4063399 - RNA, 19 nt, Vaccinia virus
gaugucaaaggaugaaaga

SEQ ID NO: 4063400 - RNA, 23 nt, Vaccinia virus
gaugucaucuucgucuauuucua

SEQ ID NO: 4063401 - RNA, 18 nt, Vaccinia virus
gaugucgaugguauguau

SEQ ID NO: 4063402 - RNA, 22 nt, Vaccinia virus
gaugucugaaacguauucucuu

SEQ ID NO: 4063403 - RNA, 13 nt, Vaccinia virus
gaugugguaauau

SEQ ID NO: 4063404 - RNA, 19 nt, Vaccinia virus
gauuaaaucguguauucau

SEQ ID NO: 4063405 - RNA, 21 nt, Vaccinia virus
gauuaaguauuguuuuuucau

SEQ ID NO: 4063406 - RNA, 22 nt, Vaccinia virus
gauuaauaauucauggaaauuu

SEQ ID NO: 4063407 - RNA, 22 nt, Vaccinia virus
gauuacagucuuuaugauucau

SEQ ID NO: 4063408 - RNA, 14 nt, Vaccinia virus
gauuaguaaauuca

SEQ ID NO: 4063409 - RNA, 22 nt, Vaccinia virus
gauuaguaugaagauaaacacu

SEQ ID NO: 4063410 - RNA, 11 nt, Vaccinia virus
gauuaguucuu

SEQ ID NO: 4063411 - RNA, 23 nt, Vaccinia virus
gauuauaagauuaaauggcagac

SEQ ID NO: 4063412 - RNA, 12 nt, Vaccinia virus
gauuauuuucau

SEQ ID NO: 4063413 - RNA, 22 nt, Vaccinia virus
gauucacguuauauaacuauca

SEQ ID NO: 4063414 - RNA, 23 nt, Vaccinia virus
gauucauucacuaucaaucgaua

SEQ ID NO: 4063415 - RNA, 23 nt, Vaccinia virus
gauuccauggaagcucuagagua

SEQ ID NO: 4063416 - RNA, 21 nt, Vaccinia virus
gauucuaacgacaucucucgc

SEQ ID NO: 4063417 - RNA, 22 nt, Vaccinia virus
gauugacgcauuuaauagagau

SEQ ID NO: 4063418 - RNA, 13 nt, Vaccinia virus
gauugauuagaaa

SEQ ID NO: 4063419 - RNA, 21 nt, Vaccinia virus
gauugauuuggaauucuuuuu

SEQ ID NO: 4063420 - RNA, 22 nt, Vaccinia virus
gauuggauaagaaaacauaucu

SEQ ID NO: 4063421 - RNA, 22 nt, Vaccinia virus
gauuggauacacuaaaauuaaa

SEQ ID NO: 4063422 - RNA, 15 nt, Vaccinia virus
gauugggugaggaaa

SEQ ID NO: 4063423 - RNA, 23 nt, Vaccinia virus
gauuggucuuaaaagauauuaau

SEQ ID NO: 4063424 - RNA, 22 nt, Vaccinia virus
gauuguccggcauaucauguag

SEQ ID NO: 4063425 - RNA, 15 nt, Vaccinia virus
gauuguuaacuauag

SEQ ID NO: 4063426 - RNA, 16 nt, Vaccinia virus
gauuuaauaguuacca

SEQ ID NO: 4063427 - RNA, 17 nt, Vaccinia virus
gauuuaucauauuucuc

SEQ ID NO: 4063428 - RNA, 19 nt, Vaccinia virus
gauuucuaucccgaaagaa

SEQ ID NO: 4063429 - RNA, 20 nt, Vaccinia virus
gauuuuccaaaucaguaacu

SEQ ID NO: 4063430 - RNA, 13 nt, Vaccinia virus
gauuuucuagauc

SEQ ID NO: 4063431 - RNA, 14 nt, Vaccinia virus
gauuuuuccaaagu

SEQ ID NO: 4063432 - RNA, 22 nt, Vaccinia virus
gcaaaaaaucugauagaaagaa

SEQ ID NO: 4063433 - RNA, 13 nt, Vaccinia virus
gcaaaaauaauau

SEQ ID NO: 4063434 - RNA, 22 nt, Vaccinia virus
gcaaacuuacagaaacaaugau

SEQ ID NO: 4063435 - RNA, 15 nt, Vaccinia virus
gcaaagaaugaugac

SEQ ID NO: 4063436 - RNA, 13 nt, Vaccinia virus
gcaaagagaugau

SEQ ID NO: 4063437 - RNA, 18 nt, Vaccinia virus
gcaaaguaacgauaauca

SEQ ID NO: 4063438 - RNA, 14 nt, Vaccinia virus
gcaaauaaaaucua

SEQ ID NO: 4063439 - RNA, 16 nt, Vaccinia virus
gcaacugguaauuaaa

SEQ ID NO: 4063440 - RNA, 22 nt, Vaccinia virus
gcaagaacacacgaacaucuuu

SEQ ID NO: 4063441 - RNA, 17 nt, Vaccinia virus
gcaagaauuuauuucua

SEQ ID NO: 4063442 - RNA, 16 nt, Vaccinia virus
gcaagacuaacacaca

SEQ ID NO: 4063443 - RNA, 20 nt, Vaccinia virus
gcaagauuuuuaaacaacaa

SEQ ID NO: 4063444 - RNA, 20 nt, Vaccinia virus
gcaauacauuuuucuauguu

SEQ ID NO: 4063445 - RNA, 15 nt, Vaccinia virus
gcaauaguauaauua

SEQ ID NO: 4063446 - RNA, 19 nt, Vaccinia virus
gcaauauaucaucuuuuca

SEQ ID NO: 4063447 - RNA, 19 nt, Vaccinia virus
gcaaucacuacaauaauua

SEQ ID NO: 4063448 - RNA, 19 nt, Vaccinia virus
gcaaucauuccucauaaga

SEQ ID NO: 4063449 - RNA, 19 nt, Vaccinia virus
gcaaugagucgucaauccu

SEQ ID NO: 4063450 - RNA, 15 nt, Vaccinia virus
gcaauuauauaaugu

SEQ ID NO: 4063451 - RNA, 17 nt, Vaccinia virus
gcaauugcauucccauc

SEQ ID NO: 4063452 - RNA, 18 nt, Vaccinia virus
gcaauuuguuaauaagau

SEQ ID NO: 4063453 - RNA, 17 nt, Vaccinia virus
gcacuacgcaauaugau

SEQ ID NO: 4063454 - RNA, 20 nt, Vaccinia virus
gcacuacuguuaagaaugau

SEQ ID NO: 4063455 - RNA, 23 nt, Vaccinia virus
gcacuacuguuaagaaugauuac

SEQ ID NO: 4063456 - RNA, 12 nt, Vaccinia virus
gcagcauuuccu

SEQ ID NO: 4063457 - RNA, 21 nt, Vaccinia virus
gcaguacuacuagguagaaga

SEQ ID NO: 4063458 - RNA, 17 nt, Vaccinia virus
gcagucggauuggaaca

SEQ ID NO: 4063459 - RNA, 18 nt, Vaccinia virus
gcauaaacuauacuauga

SEQ ID NO: 4063460 - RNA, 13 nt, Vaccinia virus
gcauaagaaaaac

SEQ ID NO: 4063461 - RNA, 11 nt, Vaccinia virus
gcauaauacaa

SEQ ID NO: 4063462 - RNA, 12 nt, Vaccinia virus
gcauaauacaau

SEQ ID NO: 4063463 - RNA, 23 nt, Vaccinia virus
gcauagaguuugcggauaaugau

SEQ ID NO: 4063464 - RNA, 17 nt, Vaccinia virus
gcauaguuuuucauaau

SEQ ID NO: 4063465 - RNA, 18 nt, Vaccinia virus
gcauauaacaacaaauaa

SEQ ID NO: 4063466 - RNA, 17 nt, Vaccinia virus
gcauauauuagaaauac

SEQ ID NO: 4063467 - RNA, 17 nt, Vaccinia virus
gcauauucgaaauuaga

SEQ ID NO: 4063468 - RNA, 22 nt, Vaccinia virus
gcauccaaugaguaaaaucaaa

SEQ ID NO: 4063469 - RNA, 23 nt, Vaccinia virus
gcauccacucauauagaagaugc

SEQ ID NO: 4063470 - RNA, 15 nt, Vaccinia virus
gcaucgauuugcuaa

SEQ ID NO: 4063471 - RNA, 18 nt, Vaccinia virus
gcaucgcuucguuuacau

SEQ ID NO: 4063472 - RNA, 20 nt, Vaccinia virus
cuacgaaaacgaaaucugua

SEQ ID NO: 4063473 - RNA, 21 nt, Vaccinia virus
cuacuaaaagaucaaccaaaa

SEQ ID NO: 4063474 - RNA, 15 nt, Vaccinia virus
cuacucguuuggaau

SEQ ID NO: 4063475 - RNA, 18 nt, Vaccinia virus
cuacugacgauaguaucu

SEQ ID NO: 4063476 - RNA, 17 nt, Vaccinia virus
cuagaagauauagcacc

SEQ ID NO: 4063477 - RNA, 18 nt, Vaccinia virus
cuagacgauauagugaaa

SEQ ID NO: 4063478 - RNA, 20 nt, Vaccinia virus
cuagacuaacuaucucuuuc

SEQ ID NO: 4063479 - RNA, 16 nt, Vaccinia virus
cuagacuauauuauca

SEQ ID NO: 4063480 - RNA, 15 nt, Vaccinia virus
cuagagauaaaaucu

SEQ ID NO: 4063481 - RNA, 15 nt, Vaccinia virus
cuagaggagaaguaa

SEQ ID NO: 4063482 - RNA, 11 nt, Vaccinia virus
cuagauacauu

SEQ ID NO: 4063483 - RNA, 18 nt, Vaccinia virus
cuagaucuauagaaucaa

SEQ ID NO: 4063484 - RNA, 23 nt, Vaccinia virus
cuagauuaauuuuugugggaagc

SEQ ID NO: 4063485 - RNA, 16 nt, Vaccinia virus
cuaggauccuuuagaa

SEQ ID NO: 4063486 - RNA, 15 nt, Vaccinia virus
cuaggauuuaaacaa

SEQ ID NO: 4063487 - RNA, 16 nt, Vaccinia virus
cuagguuucucuauaa

SEQ ID NO: 4063488 - RNA, 21 nt, Vaccinia virus
cuaguacuuguauguguuaua

SEQ ID NO: 4063489 - RNA, 15 nt, Vaccinia virus
cuagucauauguuua

SEQ ID NO: 4063490 - RNA, 22 nt, Vaccinia virus
cuagugaguacggauuaaacau

SEQ ID NO: 4063491 - RNA, 18 nt, Vaccinia virus
cuaguggauguacaugua

SEQ ID NO: 4063492 - RNA, 19 nt, Vaccinia virus
cuauaaaaagaguuucaaa

SEQ ID NO: 4063493 - RNA, 15 nt, Vaccinia virus
cuauaaaaauggauu

SEQ ID NO: 4063494 - RNA, 16 nt, Vaccinia virus
cuauaaaaauggauuu

SEQ ID NO: 4063495 - RNA, 19 nt, Vaccinia virus
cuauaaaacgauuaaacaa

SEQ ID NO: 4063496 - RNA, 18 nt, Vaccinia virus
cuauaaaacuacuacaau

SEQ ID NO: 4063497 - RNA, 15 nt, Vaccinia virus
cuauaaacaugaauu

SEQ ID NO: 4063498 - RNA, 23 nt, Vaccinia virus
cuauaaagucugucaaaucaucu

SEQ ID NO: 4063499 - RNA, 16 nt, Vaccinia virus
cuauaaauagaucucu

SEQ ID NO: 4063500 - RNA, 11 nt, Vaccinia virus
cuauaaauguc

SEQ ID NO: 4063501 - RNA, 17 nt, Vaccinia virus
cuauaagccuuuguuua

SEQ ID NO: 4063502 - RNA, 14 nt, Vaccinia virus
cuauaauaaugaau

SEQ ID NO: 4063503 - RNA, 18 nt, Vaccinia virus
cuauaauauccauuuugu

SEQ ID NO: 4063504 - RNA, 20 nt, Vaccinia virus
cuauaaugaugauacucuca

SEQ ID NO: 4063505 - RNA, 23 nt, Vaccinia virus
cuauagaagagcgacagacaucu

SEQ ID NO: 4063506 - RNA, 14 nt, Vaccinia virus
cuauagauuuugaa

SEQ ID NO: 4063507 - RNA, 16 nt, Vaccinia virus
cuauaguuuguuuuca

SEQ ID NO: 4063508 - RNA, 12 nt, Vaccinia virus
cuauaucgaugu

SEQ ID NO: 4063509 - RNA, 15 nt, Vaccinia virus
cuauauuaacaucua

SEQ ID NO: 4063510 - RNA, 13 nt, Vaccinia virus
cuauauuguauuc

SEQ ID NO: 4063511 - RNA, 17 nt, Vaccinia virus
cuaucagaguccaugua

SEQ ID NO: 4063512 - RNA, 17 nt, Vaccinia virus
cuaucguaucugucaau

SEQ ID NO: 4063513 - RNA, 20 nt, Vaccinia virus
cuaucguuacuaguaaaaug

SEQ ID NO: 4063514 - RNA, 15 nt, Vaccinia virus
cuaucuaaauguaau

SEQ ID NO: 4063515 - RNA, 17 nt, Vaccinia virus
cuaucuccgaauuuguu

SEQ ID NO: 4063516 - RNA, 23 nt, Vaccinia virus
cuaucucuuucucuuucucucuu

SEQ ID NO: 4063517 - RNA, 20 nt, Vaccinia virus
cuaucuuuagcuucugaaau

SEQ ID NO: 4063518 - RNA, 18 nt, Vaccinia virus
cuaugaaaggagagaaug

SEQ ID NO: 4063519 - RNA, 21 nt, Vaccinia virus
cuaugaauaccauuaaacaau

SEQ ID NO: 4063520 - RNA, 16 nt, Vaccinia virus
cuaugauuaaaucguu

SEQ ID NO: 4063521 - RNA, 14 nt, Vaccinia virus
cuauguaaaugaua

SEQ ID NO: 4063522 - RNA, 18 nt, Vaccinia virus
cuaugucaaaaauuguag

SEQ ID NO: 4063523 - RNA, 15 nt, Vaccinia virus
cuauguugacaugua

SEQ ID NO: 4063524 - RNA, 19 nt, Vaccinia virus
cuauguugacauguauaua

SEQ ID NO: 4063525 - RNA, 11 nt, Vaccinia virus
cuauguuuaua

SEQ ID NO: 4063526 - RNA, 13 nt, Vaccinia virus
cuauguuuauaga

SEQ ID NO: 4063527 - RNA, 13 nt, Vaccinia virus
cuauuaaacuguu

SEQ ID NO: 4063528 - RNA, 20 nt, Vaccinia virus
cuauugaucaaguaugcaau

SEQ ID NO: 4063529 - RNA, 22 nt, Vaccinia virus
cuauuguuacaaaaguuaauaa

SEQ ID NO: 4063530 - RNA, 12 nt, Vaccinia virus
cuauuguuuauu

SEQ ID NO: 4063531 - RNA, 21 nt, Vaccinia virus
cuauuuagaucauuaacucua

SEQ ID NO: 4063532 - RNA, 21 nt, Vaccinia virus
cuauuucaacgucuaauguau

SEQ ID NO: 4063533 - RNA, 12 nt, Vaccinia virus
cuauuuggauuu

SEQ ID NO: 4063534 - RNA, 20 nt, Vaccinia virus
cucaaaguagauaaacccuc

SEQ ID NO: 4063535 - RNA, 18 nt, Vaccinia virus
cucaaaugaauaaguuua

SEQ ID NO: 4063536 - RNA, 16 nt, Vaccinia virus
cucaaccauagauaua

SEQ ID NO: 4063537 - RNA, 14 nt, Vaccinia virus
cucaauaguuucau

SEQ ID NO: 4063538 - RNA, 13 nt, Vaccinia virus
cucagaaacagaa

SEQ ID NO: 4063539 - RNA, 17 nt, Vaccinia virus
cucagugaauccaucuc

SEQ ID NO: 4063540 - RNA, 17 nt, Vaccinia virus
cucauaaaauaguucuc

SEQ ID NO: 4063541 - RNA, 18 nt, Vaccinia virus
cucauauuaucaggaaca

SEQ ID NO: 4063542 - RNA, 16 nt, Vaccinia virus
cucaucggaucuguaa

SEQ ID NO: 4063543 - RNA, 22 nt, Vaccinia virus
cucaugagaauggaaaggaaac

SEQ ID NO: 4063544 - RNA, 15 nt, Vaccinia virus
cucaugucaaauugu

SEQ ID NO: 4063545 - RNA, 13 nt, Vaccinia virus
cucauuaacaucu

SEQ ID NO: 4063546 - RNA, 19 nt, Vaccinia virus
cuccaaacgaguuaaguuu

SEQ ID NO: 4063547 - RNA, 14 nt, Vaccinia virus
cuccaauacuaauu

SEQ ID NO: 4063548 - RNA, 22 nt, Vaccinia virus
cuccagacuuuauaauuucauc

SEQ ID NO: 4063549 - RNA, 16 nt, Vaccinia virus
cuccguuacacuguua

SEQ ID NO: 4063550 - RNA, 12 nt, Vaccinia virus
cuccuguuugau

SEQ ID NO: 4063551 - RNA, 16 nt, Vaccinia virus
cuccuuuaaaauuaau

SEQ ID NO: 4063552 - RNA, 23 nt, Vaccinia virus
cucguaaauugggauaaaaauua

SEQ ID NO: 4063553 - RNA, 16 nt, Vaccinia virus
cucguauacucugccc

SEQ ID NO: 4063554 - RNA, 16 nt, Vaccinia virus
cucuaaacaaggaaac

SEQ ID NO: 4063555 - RNA, 18 nt, Vaccinia virus
cucuacucauuucauuau

SEQ ID NO: 4063556 - RNA, 13 nt, Vaccinia virus
cucuaguuucaga

SEQ ID NO: 4063557 - RNA, 18 nt, Vaccinia virus
cucuaucauggcaauaac

SEQ ID NO: 4063558 - RNA, 18 nt, Vaccinia virus
cucuauccgacuagaauu

SEQ ID NO: 4063559 - RNA, 13 nt, Vaccinia virus
cucuauuaaauac

SEQ ID NO: 4063560 - RNA, 14 nt, Vaccinia virus
cucuauucaucuga

SEQ ID NO: 4063561 - RNA, 18 nt, Vaccinia virus
cucuauucgaaaacucua

SEQ ID NO: 4063562 - RNA, 11 nt, Vaccinia virus
cucuauuuugg

SEQ ID NO: 4063563 - RNA, 22 nt, Vaccinia virus
cucuauuuugucauuaacuuua

SEQ ID NO: 4063564 - RNA, 19 nt, Vaccinia virus
cucucaacauuggaauaau

SEQ ID NO: 4063565 - RNA, 17 nt, Vaccinia virus
cucucauaauaaauuuu

SEQ ID NO: 4063566 - RNA, 12 nt, Vaccinia virus
cucucauuuucu

SEQ ID NO: 4063567 - RNA, 22 nt, Vaccinia virus
cucucauuuucuuuaacaaauu

SEQ ID NO: 4063568 - RNA, 16 nt, Vaccinia virus
cucucuauuucuuaau

SEQ ID NO: 4063569 - RNA, 19 nt, Vaccinia virus
cucugacauucagaaagag

SEQ ID NO: 4063570 - RNA, 18 nt, Vaccinia virus
cucugccaagauagcuuc

SEQ ID NO: 4063571 - RNA, 18 nt, Vaccinia virus
cucuucaacaucuuugau

SEQ ID NO: 4063572 - RNA, 12 nt, Vaccinia virus
cucuuuaauagc

SEQ ID NO: 4063573 - RNA, 16 nt, Vaccinia virus
cucuuucuccuuucuc

SEQ ID NO: 4063574 - RNA, 17 nt, Vaccinia virus
cugaaaauaaagauaaa

SEQ ID NO: 4063575 - RNA, 16 nt, Vaccinia virus
cugaaaaugaaauugu

SEQ ID NO: 4063576 - RNA, 19 nt, Vaccinia virus
uuacaauguagaaauuaga

SEQ ID NO: 4063577 - RNA, 16 nt, Vaccinia virus
uuacacauaaacaucg

SEQ ID NO: 4063578 - RNA, 19 nt, Vaccinia virus
uuacagaauuuguauccuu

SEQ ID NO: 4063579 - RNA, 16 nt, Vaccinia virus
uuacagauauuuucca

SEQ ID NO: 4063580 - RNA, 18 nt, Vaccinia virus
uuacauaguugauaaaaa

SEQ ID NO: 4063581 - RNA, 17 nt, Vaccinia virus
uuacauaucuacguucu

SEQ ID NO: 4063582 - RNA, 20 nt, Vaccinia virus
uuacaucgacgagauuauua

SEQ ID NO: 4063583 - RNA, 18 nt, Vaccinia virus
uuacauguaauacauuuu

SEQ ID NO: 4063584 - RNA, 20 nt, Vaccinia virus
uuacauuuuuuauaaauaga

SEQ ID NO: 4063585 - RNA, 23 nt, Vaccinia virus
uuaccacaauguauaauauaaga

SEQ ID NO: 4063586 - RNA, 13 nt, Vaccinia virus
uuaccagauaucu

SEQ ID NO: 4063587 - RNA, 15 nt, Vaccinia virus
uuaccagauaucuuc

SEQ ID NO: 4063588 - RNA, 15 nt, Vaccinia virus
uuaccucuacaaaua

SEQ ID NO: 4063589 - RNA, 21 nt, Vaccinia virus
uuacuaaaauaucgauguuua

SEQ ID NO: 4063590 - RNA, 17 nt, Vaccinia virus
uuacuaauaucauuagu

SEQ ID NO: 4063591 - RNA, 13 nt, Vaccinia virus
uuacuauguaguu

SEQ ID NO: 4063592 - RNA, 20 nt, Vaccinia virus
uuacugaggggaaaaucaau

SEQ ID NO: 4063593 - RNA, 17 nt, Vaccinia virus
uuacuggaauuagacaa

SEQ ID NO: 4063594 - RNA, 16 nt, Vaccinia virus
uuacuuagucuguaca

SEQ ID NO: 4063595 - RNA, 16 nt, Vaccinia virus
uuacuuguauaauaag

SEQ ID NO: 4063596 - RNA, 21 nt, Vaccinia virus
uuacuuuagaaggaaaaucau

SEQ ID NO: 4063597 - RNA, 16 nt, Vaccinia virus
uuacuuuguggaugau

SEQ ID NO: 4063598 - RNA, 15 nt, Vaccinia virus
uuacuuuuucaaaga

SEQ ID NO: 4063599 - RNA, 18 nt, Vaccinia virus
uuagaaacuucaaagauu

SEQ ID NO: 4063600 - RNA, 14 nt, Vaccinia virus
uuagaaaguauuuu

SEQ ID NO: 4063601 - RNA, 20 nt, Vaccinia virus
uuagaaaugaguucauuaaa

SEQ ID NO: 4063602 - RNA, 20 nt, Vaccinia virus
uuagaauauccagugcauuu

SEQ ID NO: 4063603 - RNA, 20 nt, Vaccinia virus
uuagacaagcggguaaauga

SEQ ID NO: 4063604 - RNA, 18 nt, Vaccinia virus
uuagacggcaacauagaa

SEQ ID NO: 4063605 - RNA, 22 nt, Vaccinia virus
uuagagaacauacauuuguaaa

SEQ ID NO: 4063606 - RNA, 17 nt, Vaccinia virus
uuagauaaaugcgguaa

SEQ ID NO: 4063607 - RNA, 18 nt, Vaccinia virus
uuagauaacggacaacaa

SEQ ID NO: 4063608 - RNA, 16 nt, Vaccinia virus
uuagauaauuguggua

SEQ ID NO: 4063609 - RNA, 19 nt, Vaccinia virus
uuagaugagaaauuauucc

SEQ ID NO: 4063610 - RNA, 17 nt, Vaccinia virus
uuagaugguuucuuuuu

SEQ ID NO: 4063611 - RNA, 21 nt, Vaccinia virus
uuagauuaugaggaugcuguu

SEQ ID NO: 4063612 - RNA, 16 nt, Vaccinia virus
uuagauuuccuagauu

SEQ ID NO: 4063613 - RNA, 17 nt, Vaccinia virus
uuagcagaauauauaag

SEQ ID NO: 4063614 - RNA, 16 nt, Vaccinia virus
uuaggauuaacauagu

SEQ ID NO: 4063615 - RNA, 11 nt, Vaccinia virus
uuaguauacac

SEQ ID NO: 4063616 - RNA, 18 nt, Vaccinia virus
uuagucauugcaauauag

SEQ ID NO: 4063617 - RNA, 23 nt, Vaccinia virus
uuagugaaacauuccacaucguu

SEQ ID NO: 4063618 - RNA, 22 nt, Vaccinia virus
uuaguucaucgcuuucuagaau

SEQ ID NO: 4063619 - RNA, 15 nt, Vaccinia virus
uuaguuccaacaauu

SEQ ID NO: 4063620 - RNA, 22 nt, Vaccinia virus
uuaguuucugguuuucuauaaa

SEQ ID NO: 4063621 - RNA, 15 nt, Vaccinia virus
uuauaaaacauagau

SEQ ID NO: 4063622 - RNA, 17 nt, Vaccinia virus
uuauaaaggagacuugu

SEQ ID NO: 4063623 - RNA, 13 nt, Vaccinia virus
uuauaaauagaug

SEQ ID NO: 4063624 - RNA, 19 nt, Vaccinia virus
uuauaacacuuauguauua

SEQ ID NO: 4063625 - RNA, 21 nt, Vaccinia virus
uuauaaccuuuuccuuaucuu

SEQ ID NO: 4063626 - RNA, 16 nt, Vaccinia virus
uuauaacuuauugucu

SEQ ID NO: 4063627 - RNA, 22 nt, Vaccinia virus
uuauaauauaaaaauacuuaug

SEQ ID NO: 4063628 - RNA, 15 nt, Vaccinia virus
uuauaaucaaagauu

SEQ ID NO: 4063629 - RNA, 19 nt, Vaccinia virus
uuauaaugaggauaauaag

SEQ ID NO: 4063630 - RNA, 14 nt, Vaccinia virus
uuauacaaaguuuu

SEQ ID NO: 4063631 - RNA, 14 nt, Vaccinia virus
uuauacaaugaacu

SEQ ID NO: 4063632 - RNA, 17 nt, Vaccinia virus
uuauacagaguauguaa

SEQ ID NO: 4063633 - RNA, 14 nt, Vaccinia virus
uuauacauuaucuu

SEQ ID NO: 4063634 - RNA, 21 nt, Vaccinia virus
uuauacauugaauauaaaaua

SEQ ID NO: 4063635 - RNA, 13 nt, Vaccinia virus
uuauagaauguau

SEQ ID NO: 4063636 - RNA, 18 nt, Vaccinia virus
uuauagacaaauuauuca

SEQ ID NO: 4063637 - RNA, 13 nt, Vaccinia virus
uuauagauguaca

SEQ ID NO: 4063638 - RNA, 17 nt, Vaccinia virus
uuauagauuuguaucuc

SEQ ID NO: 4063639 - RNA, 12 nt, Vaccinia virus
uuauaguuuuua

SEQ ID NO: 4063640 - RNA, 18 nt, Vaccinia virus
uuauauacucuaaucuuu

SEQ ID NO: 4063641 - RNA, 20 nt, Vaccinia virus
uuauaucaauaccaaagaag

SEQ ID NO: 4063642 - RNA, 22 nt, Vaccinia virus
uuauaucauccaauauuauuga

SEQ ID NO: 4063643 - RNA, 14 nt, Vaccinia virus
uuauauuauuuaca

SEQ ID NO: 4063644 - RNA, 16 nt, Vaccinia virus
uuauauucucuggaau

SEQ ID NO: 4063645 - RNA, 14 nt, Vaccinia virus
uuaucaaaaauaag

SEQ ID NO: 4063646 - RNA, 22 nt, Vaccinia virus
uuaucacaaugaaauauuuugg

SEQ ID NO: 4063647 - RNA, 20 nt, Vaccinia virus
uuaucacauaucacauuaau

SEQ ID NO: 4063648 - RNA, 23 nt, Vaccinia virus
uuaucagaagauggauggaugaa

SEQ ID NO: 4063649 - RNA, 19 nt, Vaccinia virus
uuaucagugucguaaauua

SEQ ID NO: 4063650 - RNA, 13 nt, Vaccinia virus
uuaucauaaaagu

SEQ ID NO: 4063651 - RNA, 14 nt, Vaccinia virus
uuaucaucauuaaa

SEQ ID NO: 4063652 - RNA, 22 nt, Vaccinia virus
uuaucgguaacaucuuuguaaa

SEQ ID NO: 4063653 - RNA, 22 nt, Vaccinia virus
uuaucguuuaagaauaauacag

SEQ ID NO: 4063654 - RNA, 14 nt, Vaccinia virus
uuaucuaucuuaaa

SEQ ID NO: 4063655 - RNA, 20 nt, Vaccinia virus
uuaucucaacaaaauucaga

SEQ ID NO: 4063656 - RNA, 15 nt, Vaccinia virus
uuaucucccauaauc

SEQ ID NO: 4063657 - RNA, 13 nt, Vaccinia virus
uuaucuguagacg

SEQ ID NO: 4063658 - RNA, 21 nt, Vaccinia virus
uuaugacaaaguuuacauucu

SEQ ID NO: 4063659 - RNA, 21 nt, Vaccinia virus
uuaugacgcaguaacauauau

SEQ ID NO: 4063660 - RNA, 17 nt, Vaccinia virus
uuaugauagaaauuagc

SEQ ID NO: 4063661 - RNA, 22 nt, Vaccinia virus
uuauggaguuagcaauuucaaa

SEQ ID NO: 4063662 - RNA, 21 nt, Vaccinia virus
uuaugggcauuuguauuuuga

SEQ ID NO: 4063663 - RNA, 15 nt, Vaccinia virus
uuauguaacuguaaa

SEQ ID NO: 4063664 - RNA, 12 nt, Vaccinia virus
uuauguacuaag

SEQ ID NO: 4063665 - RNA, 12 nt, Vaccinia virus
uuauguuucuuu

SEQ ID NO: 4063666 - RNA, 22 nt, Vaccinia virus
uuauuaaaguuuacaguuugaa

SEQ ID NO: 4063667 - RNA, 14 nt, Vaccinia virus
uuauuaaguauaau

SEQ ID NO: 4063668 - RNA, 20 nt, Vaccinia virus
uuauuacacgcuauuaauca

SEQ ID NO: 4063669 - RNA, 17 nt, Vaccinia virus
uuauuacugaauuauua

SEQ ID NO: 4063670 - RNA, 19 nt, Vaccinia virus
uuauuacuuaaguuguaaa

SEQ ID NO: 4063671 - RNA, 13 nt, Vaccinia virus
uuauuagaucuuu

SEQ ID NO: 4063672 - RNA, 20 nt, Vaccinia virus
uuauuagcccaaucuguaaa

SEQ ID NO: 4063673 - RNA, 17 nt, Vaccinia virus
uuauuagcgcaaucagu

SEQ ID NO: 4063674 - RNA, 13 nt, Vaccinia virus
uuauuauuucagg

SEQ ID NO: 4063675 - RNA, 16 nt, Vaccinia virus
uuauuauuucauuaau

SEQ ID NO: 4063676 - RNA, 23 nt, Vaccinia virus
uuauuccgguacugguuuagaua

SEQ ID NO: 4063677 - RNA, 17 nt, Vaccinia virus
uuauugauaauuguaaa

SEQ ID NO: 4063678 - RNA, 15 nt, Vaccinia virus
uuauugauauguaua

SEQ ID NO: 4063679 - RNA, 21 nt, Vaccinia virus
uuauuggcguuggaaaaauua

SEQ ID NO: 4063680 - RNA, 12 nt, Vaccinia virus
uuauuguaacag

SEQ ID NO: 4063681 - RNA, 13 nt, Vaccinia virus
uuauuuaacaauu

SEQ ID NO: 4063682 - RNA, 19 nt, Vaccinia virus
uuauuuagauacagaugua

SEQ ID NO: 4063683 - RNA, 16 nt, Vaccinia virus
uuauuuauauuuggua

SEQ ID NO: 4063684 - RNA, 12 nt, Vaccinia virus
uuauuuauguca

SEQ ID NO: 4063685 - RNA, 23 nt, Vaccinia virus
uuauuucagucgcugauuaauca

SEQ ID NO: 4063686 - RNA, 15 nt, Vaccinia virus
uuauuucauccaauu

SEQ ID NO: 4063687 - RNA, 13 nt, Vaccinia virus
uuauuuuuggaau

SEQ ID NO: 4063688 - RNA, 16 nt, Vaccinia virus
uucaaaauagcuaucu

SEQ ID NO: 4063689 - RNA, 14 nt, Vaccinia virus
uucaaaguuucuga

SEQ ID NO: 4063690 - RNA, 18 nt, Vaccinia virus
uucaaaguuucugaaaua

SEQ ID NO: 4063691 - RNA, 21 nt, Vaccinia virus
uucaaaguuucugaaauaaga

SEQ ID NO: 4063692 - RNA, 12 nt, Vaccinia virus
uucaacaucuuu

SEQ ID NO: 4063693 - RNA, 14 nt, Vaccinia virus
uucaacauguuuaa

SEQ ID NO: 4063694 - RNA, 16 nt, Vaccinia virus
uucaacgcuuggcuga

SEQ ID NO: 4063695 - RNA, 15 nt, Vaccinia virus
uucaagauuaucuuu

SEQ ID NO: 4063696 - RNA, 16 nt, Vaccinia virus
uucaagcgaauuacuc

SEQ ID NO: 4063697 - RNA, 21 nt, Vaccinia virus
uucaaggaugccauagauucu

SEQ ID NO: 4063698 - RNA, 17 nt, Vaccinia virus
uucaauugauaagacac

SEQ ID NO: 4063699 - RNA, 13 nt, Vaccinia virus
uucacaaauacua

SEQ ID NO: 4063700 - RNA, 20 nt, Vaccinia virus
uucacaacuuuacuguuuuu

SEQ ID NO: 4063701 - RNA, 19 nt, Vaccinia virus
uucacaagaugaauucagu

SEQ ID NO: 4063702 - RNA, 22 nt, Vaccinia virus
uucacaagaugaauucaguaau

SEQ ID NO: 4063703 - RNA, 14 nt, Vaccinia virus
ugucucuguuuuua

SEQ ID NO: 4063704 - RNA, 19 nt, Vaccinia virus
ugucuguaucauauucaac

SEQ ID NO: 4063705 - RNA, 17 nt, Vaccinia virus
ugucuuagaacaacauu

SEQ ID NO: 4063706 - RNA, 18 nt, Vaccinia virus
ugugauagucgauacguu

SEQ ID NO: 4063707 - RNA, 18 nt, Vaccinia virus
ugugauauugauaucuuu

SEQ ID NO: 4063708 - RNA, 13 nt, Vaccinia virus
ugugaucuucucg

SEQ ID NO: 4063709 - RNA, 15 nt, Vaccinia virus
ugugaugauuguaca

SEQ ID NO: 4063710 - RNA, 16 nt, Vaccinia virus
ugugaugccaauaagc

SEQ ID NO: 4063711 - RNA, 16 nt, Vaccinia virus
ugugcaucuacugaua

SEQ ID NO: 4063712 - RNA, 17 nt, Vaccinia virus
ugugcaucuacugauau

SEQ ID NO: 4063713 - RNA, 23 nt, Vaccinia virus
ugugggaagcgauucaaaaggac

SEQ ID NO: 4063714 - RNA, 18 nt, Vaccinia virus
uguguaacacuuuggaua

SEQ ID NO: 4063715 - RNA, 20 nt, Vaccinia virus
uguguauacgcuaacgguau

SEQ ID NO: 4063716 - RNA, 21 nt, Vaccinia virus
ugugucuacauaaauaugcaa

SEQ ID NO: 4063717 - RNA, 14 nt, Vaccinia virus
uguguuacauaucu

SEQ ID NO: 4063718 - RNA, 22 nt, Vaccinia virus
uguguuaucagccgcuacagaa

SEQ ID NO: 4063719 - RNA, 17 nt, Vaccinia virus
uguuaaaauauaaacag

SEQ ID NO: 4063720 - RNA, 14 nt, Vaccinia virus
uguuaaacaaauaa

SEQ ID NO: 4063721 - RNA, 14 nt, Vaccinia virus
uguuaaauuucagu

SEQ ID NO: 4063722 - RNA, 17 nt, Vaccinia virus
uguuaaauuuucuaaug

SEQ ID NO: 4063723 - RNA, 19 nt, Vaccinia virus
uguuaagaaugauuacuaa

SEQ ID NO: 4063724 - RNA, 21 nt, Vaccinia virus
uguuaauacaucaauggaaga

SEQ ID NO: 4063725 - RNA, 17 nt, Vaccinia virus
uguuacaaauguagaag

SEQ ID NO: 4063726 - RNA, 15 nt, Vaccinia virus
uguuacaacaucacg

SEQ ID NO: 4063727 - RNA, 22 nt, Vaccinia virus
uguuaccauaucguauaacuug

SEQ ID NO: 4063728 - RNA, 20 nt, Vaccinia virus
uguuauacagauguauuaca

SEQ ID NO: 4063729 - RNA, 12 nt, Vaccinia virus
uguuauauguaa

SEQ ID NO: 4063730 - RNA, 22 nt, Vaccinia virus
uguuaucaugaaauguuugaua

SEQ ID NO: 4063731 - RNA, 22 nt, Vaccinia virus
uguuauguauuucauuguucau

SEQ ID NO: 4063732 - RNA, 15 nt, Vaccinia virus
uguucaacaaacuaa

SEQ ID NO: 4063733 - RNA, 18 nt, Vaccinia virus
uguucaaggcaacagaug

SEQ ID NO: 4063734 - RNA, 21 nt, Vaccinia virus
uguucauuaacgauaucuugc

SEQ ID NO: 4063735 - RNA, 17 nt, Vaccinia virus
uguucguccgucaugau

SEQ ID NO: 4063736 - RNA, 19 nt, Vaccinia virus
uguugugaaugacaucauc

SEQ ID NO: 4063737 - RNA, 20 nt, Vaccinia virus
uguugugucaguuuauaaua

SEQ ID NO: 4063738 - RNA, 23 nt, Vaccinia virus
uguuuaacauucuuuuuuggaga

SEQ ID NO: 4063739 - RNA, 22 nt, Vaccinia virus
uguuuaauacuuauucauauuu

SEQ ID NO: 4063740 - RNA, 16 nt, Vaccinia virus
uguuuaauuuuuucua

SEQ ID NO: 4063741 - RNA, 21 nt, Vaccinia virus
uguuuaucuauacuauuaaaa

SEQ ID NO: 4063742 - RNA, 13 nt, Vaccinia virus
uguuucaaagcaa

SEQ ID NO: 4063743 - RNA, 20 nt, Vaccinia virus
uguuuccaugacauauuaca

SEQ ID NO: 4063744 - RNA, 16 nt, Vaccinia virus
uguuucuuacauauuu

SEQ ID NO: 4063745 - RNA, 15 nt, Vaccinia virus
uguuuguucauugga

SEQ ID NO: 4063746 - RNA, 12 nt, Vaccinia virus
uguuuuaacauc

SEQ ID NO: 4063747 - RNA, 13 nt, Vaccinia virus
uguuuuauaaaau

SEQ ID NO: 4063748 - RNA, 13 nt, Vaccinia virus
uguuuucaucauu

SEQ ID NO: 4063749 - RNA, 17 nt, Vaccinia virus
uuaaaaaaugaaaauaa

SEQ ID NO: 4063750 - RNA, 15 nt, Vaccinia virus
uuaaaaacaaacuuu

SEQ ID NO: 4063751 - RNA, 13 nt, Vaccinia virus
uuaaaaauuauua

SEQ ID NO: 4063752 - RNA, 17 nt, Vaccinia virus
uuaaaacagaugauuca

SEQ ID NO: 4063753 - RNA, 19 nt, Vaccinia virus
uuaaaacuugauaauuaau

SEQ ID NO: 4063754 - RNA, 22 nt, Vaccinia virus
uuaaaauaaaaaguaauauuca

SEQ ID NO: 4063755 - RNA, 17 nt, Vaccinia virus
uuaaaauacuaaauuga

SEQ ID NO: 4063756 - RNA, 23 nt, Vaccinia virus
uuaaaauaguuuauaacauuaau

SEQ ID NO: 4063757 - RNA, 12 nt, Vaccinia virus
uuaaaauuauua

SEQ ID NO: 4063758 - RNA, 21 nt, Vaccinia virus
uuaaacaaauaaguauuauca

SEQ ID NO: 4063759 - RNA, 23 nt, Vaccinia virus
uuaaacaauacucuauuauuaau

SEQ ID NO: 4063760 - RNA, 23 nt, Vaccinia virus
uuaaacaauaucacgaaaguaga

SEQ ID NO: 4063761 - RNA, 17 nt, Vaccinia virus
uuaaacauggcauuaau

SEQ ID NO: 4063762 - RNA, 19 nt, Vaccinia virus
uuaaacuaauucauuuuca

SEQ ID NO: 4063763 - RNA, 14 nt, Vaccinia virus
uuaaacuguaucga

SEQ ID NO: 4063764 - RNA, 16 nt, Vaccinia virus
uuaaagaaaaauacuc

SEQ ID NO: 4063765 - RNA, 12 nt, Vaccinia virus
uuaaagauauca

SEQ ID NO: 4063766 - RNA, 21 nt, Vaccinia virus
uuaaagauauuguuacaccac

SEQ ID NO: 4063767 - RNA, 17 nt, Vaccinia virus
uuaaaggauauuaugca

SEQ ID NO: 4063768 - RNA, 22 nt, Vaccinia virus
uuaaaggauggugaaauuauug

SEQ ID NO: 4063769 - RNA, 14 nt, Vaccinia virus
uuaaagguauuucu

SEQ ID NO: 4063770 - RNA, 14 nt, Vaccinia virus
uuaaaguguaaaua

SEQ ID NO: 4063771 - RNA, 22 nt, Vaccinia virus
uuaaauaacccgaguauugaaa

SEQ ID NO: 4063772 - RNA, 17 nt, Vaccinia virus
uuaaauaacucauuuau

SEQ ID NO: 4063773 - RNA, 13 nt, Vaccinia virus
uuaaauaauuaau

SEQ ID NO: 4063774 - RNA, 14 nt, Vaccinia virus
uuaaauaucauaau

SEQ ID NO: 4063775 - RNA, 12 nt, Vaccinia virus
uuaaauauuucu

SEQ ID NO: 4063776 - RNA, 21 nt, Vaccinia virus
uuaaauccucuauuuauugac

SEQ ID NO: 4063777 - RNA, 19 nt, Vaccinia virus
uuaaaucgccgaaugaaca

SEQ ID NO: 4063778 - RNA, 23 nt, Vaccinia virus
uuaaaugaauccaucuuauccuu

SEQ ID NO: 4063779 - RNA, 23 nt, Vaccinia virus
uuaaaugaguguccauauuuugc

SEQ ID NO: 4063780 - RNA, 14 nt, Vaccinia virus
uuaaauucuuuaau

SEQ ID NO: 4063781 - RNA, 18 nt, Vaccinia virus
uuaacaauugucuguaaa

SEQ ID NO: 4063782 - RNA, 22 nt, Vaccinia virus
uuaacacuauacucauauuaau

SEQ ID NO: 4063783 - RNA, 15 nt, Vaccinia virus
uuaacagauguagua

SEQ ID NO: 4063784 - RNA, 16 nt, Vaccinia virus
uuaacaucacuaauau

SEQ ID NO: 4063785 - RNA, 21 nt, Vaccinia virus
uuaaccaauacuauucauaau

SEQ ID NO: 4063786 - RNA, 21 nt, Vaccinia virus
uuaaccuuauuuuuauguucg

SEQ ID NO: 4063787 - RNA, 18 nt, Vaccinia virus
uuaacgaggacuuauuca

SEQ ID NO: 4063788 - RNA, 14 nt, Vaccinia virus
uuaacgauaucuug

SEQ ID NO: 4063789 - RNA, 18 nt, Vaccinia virus
uuaacguaucgcauuaau

SEQ ID NO: 4063790 - RNA, 21 nt, Vaccinia virus
uuaacgucuaccgaaacaucg

SEQ ID NO: 4063791 - RNA, 15 nt, Vaccinia virus
uuaacuaucuguaaa

SEQ ID NO: 4063792 - RNA, 23 nt, Vaccinia virus
uuaacuauuuugucucuguuuuu

SEQ ID NO: 4063793 - RNA, 19 nt, Vaccinia virus
uuaacucagaagauuauua

SEQ ID NO: 4063794 - RNA, 17 nt, Vaccinia virus
uuaacuccucuauuaau

SEQ ID NO: 4063795 - RNA, 22 nt, Vaccinia virus
uuaacucggucgguuuaucuac

SEQ ID NO: 4063796 - RNA, 15 nt, Vaccinia virus
uuaacuguucaucgu

SEQ ID NO: 4063797 - RNA, 14 nt, Vaccinia virus
uuaacuuacuuauu

SEQ ID NO: 4063798 - RNA, 17 nt, Vaccinia virus
uuaacuuccacauuaau

SEQ ID NO: 4063799 - RNA, 16 nt, Vaccinia virus
uuaacuuucaucuaau

SEQ ID NO: 4063800 - RNA, 22 nt, Vaccinia virus
uuaagagauuuagaaaacauua

SEQ ID NO: 4063801 - RNA, 21 nt, Vaccinia virus
uuaagccauaacauaauuuuc

SEQ ID NO: 4063802 - RNA, 21 nt, Vaccinia virus
uuaaguucaccaaacaacuuu

SEQ ID NO: 4063803 - RNA, 17 nt, Vaccinia virus
uuaauaaaguaugaaca

SEQ ID NO: 4063804 - RNA, 17 nt, Vaccinia virus
uuaauaaauguuuugau

SEQ ID NO: 4063805 - RNA, 22 nt, Vaccinia virus
uuaauaagaaugacuccuaugu

SEQ ID NO: 4063806 - RNA, 14 nt, Vaccinia virus
uuaauaauaauuca

SEQ ID NO: 4063807 - RNA, 14 nt, Vaccinia virus
uuaauaauacuauu

SEQ ID NO: 4063808 - RNA, 17 nt, Vaccinia virus
uuaauacguucauuaaa

SEQ ID NO: 4063809 - RNA, 20 nt, Vaccinia virus
uuaauacuacauauuuuuca

SEQ ID NO: 4063810 - RNA, 21 nt, Vaccinia virus
uuaauaguagucaguagacau

SEQ ID NO: 4063811 - RNA, 13 nt, Vaccinia virus
uuaaucauguaca

SEQ ID NO: 4063812 - RNA, 22 nt, Vaccinia virus
uuaauccaucguacaugguugg

SEQ ID NO: 4063813 - RNA, 18 nt, Vaccinia virus
uuaaucucaaaauauguu

SEQ ID NO: 4063814 - RNA, 17 nt, Vaccinia virus
uuaaucuuagaaaucaa

SEQ ID NO: 4063815 - RNA, 19 nt, Vaccinia virus
uuaaucuuggaaauuauuu

SEQ ID NO: 4063816 - RNA, 18 nt, Vaccinia virus
uuaaucuuuuuauuagua

SEQ ID NO: 4063817 - RNA, 16 nt, Vaccinia virus
uuaaugacaaacauuu

SEQ ID NO: 4063818 - RNA, 17 nt, Vaccinia virus
uuaaugacaaacauuuu

SEQ ID NO: 4063819 - RNA, 15 nt, Vaccinia virus
uuaaugauacaaaaa

SEQ ID NO: 4063820 - RNA, 21 nt, Vaccinia virus
uuaaugcuacagauauuauca

SEQ ID NO: 4063821 - RNA, 14 nt, Vaccinia virus
uuaauguauuauua

SEQ ID NO: 4063822 - RNA, 17 nt, Vaccinia virus
uuaauuaagauauuguu

SEQ ID NO: 4063823 - RNA, 16 nt, Vaccinia virus
uuaauuaguaacuguu

SEQ ID NO: 4063824 - RNA, 23 nt, Vaccinia virus
uuaauuauuguauuuauuauuua

SEQ ID NO: 4063825 - RNA, 22 nt, Vaccinia virus
uuaauuuccggaucuacauuuu

SEQ ID NO: 4063826 - RNA, 19 nt, Vaccinia virus
uuaauuuguacauucuuaa

SEQ ID NO: 4063827 - RNA, 22 nt, Vaccinia virus
uuaauuuuuaguuuauacuauu

SEQ ID NO: 4063828 - RNA, 20 nt, Vaccinia virus
uuacaaaugaguucugugua

SEQ ID NO: 4063829 - RNA, 15 nt, Vaccinia virus
uggcaauguuucaua

SEQ ID NO: 4063830 - RNA, 15 nt, Vaccinia virus
uggccaagaaaauag

SEQ ID NO: 4063831 - RNA, 15 nt, Vaccinia virus
uggccaauugucuuu

SEQ ID NO: 4063832 - RNA, 23 nt, Vaccinia virus
uggcugaaaucagagcucaucua

SEQ ID NO: 4063833 - RNA, 20 nt, Vaccinia virus
ugggaaaaacgaaauuaucg

SEQ ID NO: 4063834 - RNA, 16 nt, Vaccinia virus
ugggauaaaaauuaug

SEQ ID NO: 4063835 - RNA, 22 nt, Vaccinia virus
uggggaaauauggaagaaaguu

SEQ ID NO: 4063836 - RNA, 13 nt, Vaccinia virus
uggguuccauaac

SEQ ID NO: 4063837 - RNA, 17 nt, Vaccinia virus
ugguaaugaaauuauuc

SEQ ID NO: 4063838 - RNA, 20 nt, Vaccinia virus
ugguaauuaaauauaucaug

SEQ ID NO: 4063839 - RNA, 23 nt, Vaccinia virus
ugguacguaaccgaaucuuccca

SEQ ID NO: 4063840 - RNA, 19 nt, Vaccinia virus
ugguagauuuucaauuaug

SEQ ID NO: 4063841 - RNA, 22 nt, Vaccinia virus
ugguaguucuuccguggaauca

SEQ ID NO: 4063842 - RNA, 14 nt, Vaccinia virus
ugguauaucaacau

SEQ ID NO: 4063843 - RNA, 22 nt, Vaccinia virus
ugguauaucuggaaagaaaucu

SEQ ID NO: 4063844 - RNA, 14 nt, Vaccinia virus
ugguaucaacagau

SEQ ID NO: 4063845 - RNA, 15 nt, Vaccinia virus
ugguaucaacagaua

SEQ ID NO: 4063846 - RNA, 20 nt, Vaccinia virus
uggucaaccccuaagucuuu

SEQ ID NO: 4063847 - RNA, 17 nt, Vaccinia virus
uggucgauuauagaaau

SEQ ID NO: 4063848 - RNA, 14 nt, Vaccinia virus
ugguggaugauguc

SEQ ID NO: 4063849 - RNA, 13 nt, Vaccinia virus
ugguguaaaucua

SEQ ID NO: 4063850 - RNA, 17 nt, Vaccinia virus
ugguuguggaucuucua

SEQ ID NO: 4063851 - RNA, 19 nt, Vaccinia virus
ugguuguugauggaucugu

SEQ ID NO: 4063852 - RNA, 22 nt, Vaccinia virus
ugguuucgacucauuauaaugu

SEQ ID NO: 4063853 - RNA, 19 nt, Vaccinia virus
ugguuucuuucauuucagu

SEQ ID NO: 4063854 - RNA, 13 nt, Vaccinia virus
ugguuuucuaaau

SEQ ID NO: 4063855 - RNA, 15 nt, Vaccinia virus
uguaaaaaauauguu

SEQ ID NO: 4063856 - RNA, 20 nt, Vaccinia virus
uguaaaaacaaauuuguaca

SEQ ID NO: 4063857 - RNA, 16 nt, Vaccinia virus
uguaaaagcauauguu

SEQ ID NO: 4063858 - RNA, 23 nt, Vaccinia virus
uguaaacagauaugguguagcau

SEQ ID NO: 4063859 - RNA, 14 nt, Vaccinia virus
uguaacaaaguuuc

SEQ ID NO: 4063860 - RNA, 19 nt, Vaccinia virus
uguaaccgauaauaauguu

SEQ ID NO: 4063861 - RNA, 21 nt, Vaccinia virus
uguaaccgcguuaauguuugc

SEQ ID NO: 4063862 - RNA, 18 nt, Vaccinia virus
uguaacgaugaaaaccag

SEQ ID NO: 4063863 - RNA, 20 nt, Vaccinia virus
uguaauagugaaauuacauu

SEQ ID NO: 4063864 - RNA, 12 nt, Vaccinia virus
uguaauaucuua

SEQ ID NO: 4063865 - RNA, 15 nt, Vaccinia virus
uguaauauucaucau

SEQ ID NO: 4063866 - RNA, 19 nt, Vaccinia virus
uguaauuggaguaacuguu

SEQ ID NO: 4063867 - RNA, 14 nt, Vaccinia virus
uguacaccauagca

SEQ ID NO: 4063868 - RNA, 13 nt, Vaccinia virus
uguacauguaguu

SEQ ID NO: 4063869 - RNA, 16 nt, Vaccinia virus
uguacauuguuucaua

SEQ ID NO: 4063870 - RNA, 18 nt, Vaccinia virus
uguacccuguuuaacaug

SEQ ID NO: 4063871 - RNA, 16 nt, Vaccinia virus
uguaccggacacuaua

SEQ ID NO: 4063872 - RNA, 22 nt, Vaccinia virus
uguacucaugaaacguuuggaa

SEQ ID NO: 4063873 - RNA, 14 nt, Vaccinia virus
uguacuucuguaca

SEQ ID NO: 4063874 - RNA, 15 nt, Vaccinia virus
uguagaaaacaacaa

SEQ ID NO: 4063875 - RNA, 16 nt, Vaccinia virus
uguagaacguaaauua

SEQ ID NO: 4063876 - RNA, 13 nt, Vaccinia virus
uguagaacucaug

SEQ ID NO: 4063877 - RNA, 22 nt, Vaccinia virus
uguagaacucaugaaucuaaaa

SEQ ID NO: 4063878 - RNA, 17 nt, Vaccinia virus
uguagaaucagcaucca

SEQ ID NO: 4063879 - RNA, 18 nt, Vaccinia virus
uguagcucucccagauuu

SEQ ID NO: 4063880 - RNA, 13 nt, Vaccinia virus
uguaguuuucaca

SEQ ID NO: 4063881 - RNA, 13 nt, Vaccinia virus
uguauacuguaug

SEQ ID NO: 4063882 - RNA, 18 nt, Vaccinia virus
uguauauuuaucucuuca

SEQ ID NO: 4063883 - RNA, 22 nt, Vaccinia virus
uguauccgucaaucuaauauua

SEQ ID NO: 4063884 - RNA, 17 nt, Vaccinia virus
uguaucgaaaaacuuua

SEQ ID NO: 4063885 - RNA, 17 nt, Vaccinia virus
uguauggcguuuacuau

SEQ ID NO: 4063886 - RNA, 19 nt, Vaccinia virus
uguaugugugauauugaua

SEQ ID NO: 4063887 - RNA, 22 nt, Vaccinia virus
uguauuaaagauauuguuacac

SEQ ID NO: 4063888 - RNA, 22 nt, Vaccinia virus
uguauucaacaugcuuuucuau

SEQ ID NO: 4063889 - RNA, 19 nt, Vaccinia virus
uguauucgucuuucugaau

SEQ ID NO: 4063890 - RNA, 14 nt, Vaccinia virus
ugucaaaaauugua

SEQ ID NO: 4063891 - RNA, 18 nt, Vaccinia virus
ugucaaagguauaugaua

SEQ ID NO: 4063892 - RNA, 19 nt, Vaccinia virus
ugucaacaaaaaugugaua

SEQ ID NO: 4063893 - RNA, 16 nt, Vaccinia virus
ugucaauugauucuua

SEQ ID NO: 4063894 - RNA, 18 nt, Vaccinia virus
ugucaucaguuauguacg

SEQ ID NO: 4063895 - RNA, 15 nt, Vaccinia virus
ugucaugaauacguu

SEQ ID NO: 4063896 - RNA, 18 nt, Vaccinia virus
uguccaugcggauacuuu

SEQ ID NO: 4063897 - RNA, 21 nt, Vaccinia virus
ugucuaauaauagcguuuucu

SEQ ID NO: 4063898 - RNA, 18 nt, Vaccinia virus
ugucuacuccaaugacug

SEQ ID NO: 4063899 - RNA, 20 nt, Vaccinia virus
ugucucgcauaaacauuacu

SEQ ID NO: 4063900 - RNA, 20 nt, Vaccinia virus
uauagcauuguuauguauuu

SEQ ID NO: 4063901 - RNA, 18 nt, Vaccinia virus
uauaggaaacuauaaagu

SEQ ID NO: 4063902 - RNA, 18 nt, Vaccinia virus
uauaggaccacuagcaaa

SEQ ID NO: 4063903 - RNA, 14 nt, Vaccinia virus
uauaguauuaacuu

SEQ ID NO: 4063904 - RNA, 14 nt, Vaccinia virus
uauaguuaacauuu

SEQ ID NO: 4063905 - RNA, 20 nt, Vaccinia virus
uauaguucaaauuaagcauu

SEQ ID NO: 4063906 - RNA, 23 nt, Vaccinia virus
uauauaaaaucucguuacauguu

SEQ ID NO: 4063907 - RNA, 24 nt, Vaccinia virus
uauauaaaguuggaauuugacuau

SEQ ID NO: 4063908 - RNA, 19 nt, Vaccinia virus
uauauaaucagaguuuuua

SEQ ID NO: 4063909 - RNA, 17 nt, Vaccinia virus
uauauaccgauuucaca

SEQ ID NO: 4063910 - RNA, 18 nt, Vaccinia virus
uauauaccgauuucacaa

SEQ ID NO: 4063911 - RNA, 21 nt, Vaccinia virus
uauauagagccaagacgaaca

SEQ ID NO: 4063912 - RNA, 22 nt, Vaccinia virus
uauauagauaauucuaauugcu

SEQ ID NO: 4063913 - RNA, 23 nt, Vaccinia virus
uauauagccgucgccaauugugu

SEQ ID NO: 4063914 - RNA, 21 nt, Vaccinia virus
uauauaggccgaaucuaugau

SEQ ID NO: 4063915 - RNA, 19 nt, Vaccinia virus
uauauagguaauacauaua

SEQ ID NO: 4063916 - RNA, 15 nt, Vaccinia virus
uauauaguuuggauu

SEQ ID NO: 4063917 - RNA, 16 nt, Vaccinia virus
uauauauccuuuugua

SEQ ID NO: 4063918 - RNA, 19 nt, Vaccinia virus
uauauaucuaucuauuaca

SEQ ID NO: 4063919 - RNA, 11 nt, Vaccinia virus
uauauaucuuu

SEQ ID NO: 4063920 - RNA, 21 nt, Vaccinia virus
uauaucauccauguacuugcu

SEQ ID NO: 4063921 - RNA, 14 nt, Vaccinia virus
uauauccaauguau

SEQ ID NO: 4063922 - RNA, 18 nt, Vaccinia virus
uauauccguucuuaacuu

SEQ ID NO: 4063923 - RNA, 16 nt, Vaccinia virus
uauauccucggaugau

SEQ ID NO: 4063924 - RNA, 19 nt, Vaccinia virus
uauaucugaguaugaugau

SEQ ID NO: 4063925 - RNA, 20 nt, Vaccinia virus
uauaugaauaugauuucaga

SEQ ID NO: 4063926 - RNA, 15 nt, Vaccinia virus
uauaugccuguacuu

SEQ ID NO: 4063927 - RNA, 20 nt, Vaccinia virus
uauauuaucaaaauuuggaa

SEQ ID NO: 4063928 - RNA, 12 nt, Vaccinia virus
uauauuauuaca

SEQ ID NO: 4063929 - RNA, 10 nt, Vaccinia virus
uauauucucu

SEQ ID NO: 4063930 - RNA, 23 nt, Vaccinia virus
uauauugcauggaaucauagaug

SEQ ID NO: 4063931 - RNA, 14 nt, Vaccinia virus
uauauuguuucaua

SEQ ID NO: 4063932 - RNA, 17 nt, Vaccinia virus
uauauuuucucaacaag

SEQ ID NO: 4063933 - RNA, 17 nt, Vaccinia virus
uaucaacagauagcuug

SEQ ID NO: 4063934 - RNA, 20 nt, Vaccinia virus
uaucaagauguaaaauacuu

SEQ ID NO: 4063935 - RNA, 21 nt, Vaccinia virus
uaucacaacaucuauaaaagu

SEQ ID NO: 4063936 - RNA, 16 nt, Vaccinia virus
uaucacagucuguuuu

SEQ ID NO: 4063937 - RNA, 12 nt, Vaccinia virus
uaucacauauca

SEQ ID NO: 4063938 - RNA, 14 nt, Vaccinia virus
uaucauaaaugaaa

SEQ ID NO: 4063939 - RNA, 23 nt, Vaccinia virus
uaucaucgauaguauaauuauau

SEQ ID NO: 4063940 - RNA, 18 nt, Vaccinia virus
uaucaucgguucaacgau

SEQ ID NO: 4063941 - RNA, 20 nt, Vaccinia virus
uaucauuauaacucuagaau

SEQ ID NO: 4063942 - RNA, 22 nt, Vaccinia virus
uauccaaggacaaggaugaaaa

SEQ ID NO: 4063943 - RNA, 14 nt, Vaccinia virus
uauccaaucuuauu

SEQ ID NO: 4063944 - RNA, 14 nt, Vaccinia virus
uauccaauguauuu

SEQ ID NO: 4063945 - RNA, 18 nt, Vaccinia virus
uauccagauggaguggaa

SEQ ID NO: 4063946 - RNA, 15 nt, Vaccinia virus
uauccaugaugguca

SEQ ID NO: 4063947 - RNA, 16 nt, Vaccinia virus
uauccauuuagcaaaa

SEQ ID NO: 4063948 - RNA, 15 nt, Vaccinia virus
uauccgcgacaaauu

SEQ ID NO: 4063949 - RNA, 14 nt, Vaccinia virus
uauccucaaacauc

SEQ ID NO: 4063950 - RNA, 15 nt, Vaccinia virus
uauccucaaacaucc

SEQ ID NO: 4063951 - RNA, 21 nt, Vaccinia virus
uaucgacaauugcguggagau

SEQ ID NO: 4063952 - RNA, 19 nt, Vaccinia virus
uaucgauaauuauuucuac

SEQ ID NO: 4063953 - RNA, 16 nt, Vaccinia virus
uaucgcauauuuauau

SEQ ID NO: 4063954 - RNA, 22 nt, Vaccinia virus
uaucggacacaagaucuguaaa

SEQ ID NO: 4063955 - RNA, 16 nt, Vaccinia virus
uaucggaggaauuaag

SEQ ID NO: 4063956 - RNA, 22 nt, Vaccinia virus
uaucguauauuaaguugggaga

SEQ ID NO: 4063957 - RNA, 20 nt, Vaccinia virus
uaucguauuggauucugaaa

SEQ ID NO: 4063958 - RNA, 23 nt, Vaccinia virus
uaucuaaauuucuaguacuugua

SEQ ID NO: 4063959 - RNA, 17 nt, Vaccinia virus
uaucuacacaaauagaa

SEQ ID NO: 4063960 - RNA, 14 nt, Vaccinia virus
uaucuacacaugua

SEQ ID NO: 4063961 - RNA, 16 nt, Vaccinia virus
uaucuauaauaucuua

SEQ ID NO: 4063962 - RNA, 18 nt, Vaccinia virus
uaucuaugcuuacuguau

SEQ ID NO: 4063963 - RNA, 14 nt, Vaccinia virus
uaucuauguuuuua

SEQ ID NO: 4063964 - RNA, 19 nt, Vaccinia virus
uaucucaaaaaauaauaag

SEQ ID NO: 4063965 - RNA, 12 nt, Vaccinia virus
uaucucaaugag

SEQ ID NO: 4063966 - RNA, 21 nt, Vaccinia virus
uaucucacccucuuggaucau

SEQ ID NO: 4063967 - RNA, 23 nt, Vaccinia virus
uaucuccacucucgauaaaucua

SEQ ID NO: 4063968 - RNA, 14 nt, Vaccinia virus
uaucuccaguauuu

SEQ ID NO: 4063969 - RNA, 14 nt, Vaccinia virus
uaucucuugucuga

SEQ ID NO: 4063970 - RNA, 14 nt, Vaccinia virus
uaucugacauaaac

SEQ ID NO: 4063971 - RNA, 16 nt, Vaccinia virus
uaucugguucuaaaag

SEQ ID NO: 4063972 - RNA, 21 nt, Vaccinia virus
uaucuuauguauauguuugua

SEQ ID NO: 4063973 - RNA, 13 nt, Vaccinia virus
uaucuucuaaaaa

SEQ ID NO: 4063974 - RNA, 20 nt, Vaccinia virus
uaucuugaguacgaugacuu

SEQ ID NO: 4063975 - RNA, 13 nt, Vaccinia virus
uaucuuguuacaa

SEQ ID NO: 4063976 - RNA, 21 nt, Vaccinia virus
uaucuuguuuagaaaaaugcu

SEQ ID NO: 4063977 - RNA, 15 nt, Vaccinia virus
uaucuuuaacauaag

SEQ ID NO: 4063978 - RNA, 22 nt, Vaccinia virus
uaucuuuaacuaagucaaugau

SEQ ID NO: 4063979 - RNA, 21 nt, Vaccinia virus
uaucuuuuagagguucccaau

SEQ ID NO: 4063980 - RNA, 13 nt, Vaccinia virus
uaugaaaauagca

SEQ ID NO: 4063981 - RNA, 17 nt, Vaccinia virus
uaugaacgaaauagcua

SEQ ID NO: 4063982 - RNA, 13 nt, Vaccinia virus
uaugaaucuggau

SEQ ID NO: 4063983 - RNA, 12 nt, Vaccinia virus
uaugaaugacuc

SEQ ID NO: 4063984 - RNA, 14 nt, Vaccinia virus
uaugaaugaugaua

SEQ ID NO: 4063985 - RNA, 19 nt, Vaccinia virus
uaugacgacuucaaucaaa

SEQ ID NO: 4063986 - RNA, 18 nt, Vaccinia virus
uaugacucugauuucuug

SEQ ID NO: 4063987 - RNA, 22 nt, Vaccinia virus
uaugagggaaaagauucucauu

SEQ ID NO: 4063988 - RNA, 20 nt, Vaccinia virus
uaugaucaauucuggauuau

SEQ ID NO: 4063989 - RNA, 20 nt, Vaccinia virus
uaugauccucucucauugau

SEQ ID NO: 4063990 - RNA, 22 nt, Vaccinia virus
uaugaugaccggcgauaucaua

SEQ ID NO: 4063991 - RNA, 20 nt, Vaccinia virus
uaugaugcaaagauguuuaa

SEQ ID NO: 4063992 - RNA, 15 nt, Vaccinia virus
uaugauuuugaugau

SEQ ID NO: 4063993 - RNA, 15 nt, Vaccinia virus
uaugcaaucaauggu

SEQ ID NO: 4063994 - RNA, 23 nt, Vaccinia virus
uaugcuauaaaugaauucucauu

SEQ ID NO: 4063995 - RNA, 14 nt, Vaccinia virus
uaugcucuagauac

SEQ ID NO: 4063996 - RNA, 23 nt, Vaccinia virus
uaugcuuuuauuuuuggaaugau

SEQ ID NO: 4063997 - RNA, 13 nt, Vaccinia virus
uauggaagaaagu

SEQ ID NO: 4063998 - RNA, 19 nt, Vaccinia virus
uauggaagaagaaauaaag

SEQ ID NO: 4063999 - RNA, 18 nt, Vaccinia virus
uauggagaaccaaucauu

SEQ ID NO: 4064000 - RNA, 15 nt, Vaccinia virus
uauggagcaaacauu

SEQ ID NO: 4064001 - RNA, 18 nt, Vaccinia virus
uauggagcgaguguuaca

SEQ ID NO: 4064002 - RNA, 20 nt, Vaccinia virus
uauggaucuccaucgaugau

SEQ ID NO: 4064003 - RNA, 18 nt, Vaccinia virus
uauggccauagaggaugu

SEQ ID NO: 4064004 - RNA, 21 nt, Vaccinia virus
uauggguccaucuaugagaaa

SEQ ID NO: 4064005 - RNA, 18 nt, Vaccinia virus
uaugguucgcucaaaaau

SEQ ID NO: 4064006 - RNA, 19 nt, Vaccinia virus
uauguaaaacauuugcauu

SEQ ID NO: 4064007 - RNA, 19 nt, Vaccinia virus
uauguaaucauuguccaga

SEQ ID NO: 4064008 - RNA, 21 nt, Vaccinia virus
uauguacaacagugauaugug

SEQ ID NO: 4064009 - RNA, 20 nt, Vaccinia virus
uauguauuccuuuacgugau

SEQ ID NO: 4064010 - RNA, 15 nt, Vaccinia virus
uaugucguuaucauc

SEQ ID NO: 4064011 - RNA, 17 nt, Vaccinia virus
uauguugaaucuaaacu

SEQ ID NO: 4064012 - RNA, 19 nt, Vaccinia virus
uauguugugauucuagaau

SEQ ID NO: 4064013 - RNA, 14 nt, Vaccinia virus
uauguuuguaaaau

SEQ ID NO: 4064014 - RNA, 16 nt, Vaccinia virus
uauuaaaacuaucaau

SEQ ID NO: 4064015 - RNA, 14 nt, Vaccinia virus
uauuaaaauuauuu

SEQ ID NO: 4064016 - RNA, 22 nt, Vaccinia virus
uauuaaacaaggacauuguaaa

SEQ ID NO: 4064017 - RNA, 21 nt, Vaccinia virus
uauuaaagauuguuuaagaag

SEQ ID NO: 4064018 - RNA, 23 nt, Vaccinia virus
uauuaaaggaguaugucaugaau

SEQ ID NO: 4064019 - RNA, 19 nt, Vaccinia virus
uauuaaaugcgucaaucau

SEQ ID NO: 4064020 - RNA, 14 nt, Vaccinia virus
uauuaaccaugaaa

SEQ ID NO: 4064021 - RNA, 21 nt, Vaccinia virus
uauuaacgugaaacguaguau

SEQ ID NO: 4064022 - RNA, 17 nt, Vaccinia virus
uauuaacuaucuguaaa

SEQ ID NO: 4064023 - RNA, 22 nt, Vaccinia virus
uauuaauacaggaucuagcaaa

SEQ ID NO: 4064024 - RNA, 22 nt, Vaccinia virus
uauuaauccacuauauauucua

SEQ ID NO: 4064025 - RNA, 21 nt, Vaccinia virus
uauuaaugauacaaaaacgaa

SEQ ID NO: 4064026 - RNA, 14 nt, Vaccinia virus
uacgacuguuacgu

SEQ ID NO: 4064027 - RNA, 16 nt, Vaccinia virus
uacgaggauucaaaaa

SEQ ID NO: 4064028 - RNA, 22 nt, Vaccinia virus
uacgauauuauuacacauaaac

SEQ ID NO: 4064029 - RNA, 16 nt, Vaccinia virus
uacgauguuguaaagu

SEQ ID NO: 4064030 - RNA, 23 nt, Vaccinia virus
uacgcauuuuagcagucuaacau

SEQ ID NO: 4064031 - RNA, 16 nt, Vaccinia virus
uacgcauuuucaaaau

SEQ ID NO: 4064032 - RNA, 19 nt, Vaccinia virus
uacgccuuuaaauccucua

SEQ ID NO: 4064033 - RNA, 13 nt, Vaccinia virus
uacgcugauaaau

SEQ ID NO: 4064034 - RNA, 13 nt, Vaccinia virus
uacggaauuauug

SEQ ID NO: 4064035 - RNA, 13 nt, Vaccinia virus
uacggccauccag

SEQ ID NO: 4064036 - RNA, 15 nt, Vaccinia virus
uacguaaaaaagaua

SEQ ID NO: 4064037 - RNA, 17 nt, Vaccinia virus
uacguauuauauaugua

SEQ ID NO: 4064038 - RNA, 18 nt, Vaccinia virus
uacguguaaucagucucu

SEQ ID NO: 4064039 - RNA, 15 nt, Vaccinia virus
uacguucagauuuca

SEQ ID NO: 4064040 - RNA, 14 nt, Vaccinia virus
uacguuuacaugug

SEQ ID NO: 4064041 - RNA, 20 nt, Vaccinia virus
uacuaaaagaucaaccaaaa

SEQ ID NO: 4064042 - RNA, 14 nt, Vaccinia virus
uacuaaaauuccua

SEQ ID NO: 4064043 - RNA, 14 nt, Vaccinia virus
uacuaaaggaugag

SEQ ID NO: 4064044 - RNA, 19 nt, Vaccinia virus
uacuaagcaaguacaugga

SEQ ID NO: 4064045 - RNA, 20 nt, Vaccinia virus
uacuaaggccacuacucaaa

SEQ ID NO: 4064046 - RNA, 19 nt, Vaccinia virus
uacuaauuacuaaaucugu

SEQ ID NO: 4064047 - RNA, 23 nt, Vaccinia virus
uacuacaauacgguuuaccgaaa

SEQ ID NO: 4064048 - RNA, 13 nt, Vaccinia virus
uacuacaauuugu

SEQ ID NO: 4064049 - RNA, 14 nt, Vaccinia virus
uacuacguacugua

SEQ ID NO: 4064050 - RNA, 15 nt, Vaccinia virus
uacuacuucauuaau

SEQ ID NO: 4064051 - RNA, 14 nt, Vaccinia virus
uacuagaguacuua

SEQ ID NO: 4064052 - RNA, 20 nt, Vaccinia virus
uacuaguggauguacaugua

SEQ ID NO: 4064053 - RNA, 15 nt, Vaccinia virus
uacuaguuccaacau

SEQ ID NO: 4064054 - RNA, 19 nt, Vaccinia virus
uacuaguuuuacuaucaua

SEQ ID NO: 4064055 - RNA, 17 nt, Vaccinia virus
uacuauaauaguacuag

SEQ ID NO: 4064056 - RNA, 13 nt, Vaccinia virus
uacuauaauauua

SEQ ID NO: 4064057 - RNA, 15 nt, Vaccinia virus
uacuauauauaaaau

SEQ ID NO: 4064058 - RNA, 21 nt, Vaccinia virus
uacuauauccggcaauauuua

SEQ ID NO: 4064059 - RNA, 20 nt, Vaccinia virus
uacuaucuggaucuacacau

SEQ ID NO: 4064060 - RNA, 15 nt, Vaccinia virus
uacuaucuuuaacau

SEQ ID NO: 4064061 - RNA, 16 nt, Vaccinia virus
uacuaucuuuaacaua

SEQ ID NO: 4064062 - RNA, 23 nt, Vaccinia virus
uacuaugaauaucuucuaugaaa

SEQ ID NO: 4064063 - RNA, 17 nt, Vaccinia virus
uacuauuuuuuacauua

SEQ ID NO: 4064064 - RNA, 20 nt, Vaccinia virus
uacucaguugaacagaugau

SEQ ID NO: 4064065 - RNA, 22 nt, Vaccinia virus
uacuccauuauauauuccuuga

SEQ ID NO: 4064066 - RNA, 13 nt, Vaccinia virus
uacuccguuuuau

SEQ ID NO: 4064067 - RNA, 15 nt, Vaccinia virus
uacucuaaaucgcuu

SEQ ID NO: 4064068 - RNA, 20 nt, Vaccinia virus
uacucuaaucuuuaauagau

SEQ ID NO: 4064069 - RNA, 23 nt, Vaccinia virus
uacucuagguaacaaacaaacuc

SEQ ID NO: 4064070 - RNA, 16 nt, Vaccinia virus
uacucuaguaaaguca

SEQ ID NO: 4064071 - RNA, 22 nt, Vaccinia virus
uacucuccgaguguaaauauua

SEQ ID NO: 4064072 - RNA, 13 nt, Vaccinia virus
uacugaauuauua

SEQ ID NO: 4064073 - RNA, 20 nt, Vaccinia virus
uacugauaacaaaauauuag

SEQ ID NO: 4064074 - RNA, 13 nt, Vaccinia virus
uacugcaaaacuc

SEQ ID NO: 4064075 - RNA, 16 nt, Vaccinia virus
uacugcugauaaugau

SEQ ID NO: 4064076 - RNA, 18 nt, Vaccinia virus
uacuguaaacacauaucc

SEQ ID NO: 4064077 - RNA, 14 nt, Vaccinia virus
uacugucuuuugug

SEQ ID NO: 4064078 - RNA, 14 nt, Vaccinia virus
uacuguucaaacau

SEQ ID NO: 4064079 - RNA, 19 nt, Vaccinia virus
uacuguugaguaaaucagu

SEQ ID NO: 4064080 - RNA, 17 nt, Vaccinia virus
uacuguuuagaugauau

SEQ ID NO: 4064081 - RNA, 21 nt, Vaccinia virus
uacuuaaagauagaaaugaau

SEQ ID NO: 4064082 - RNA, 17 nt, Vaccinia virus
uacuuaacaucuaaaaa

SEQ ID NO: 4064083 - RNA, 11 nt, Vaccinia virus
uacuuaaugaa

SEQ ID NO: 4064084 - RNA, 23 nt, Vaccinia virus
uacuuacggcuacggcauuagau

SEQ ID NO: 4064085 - RNA, 20 nt, Vaccinia virus
uacuuagucuguacaaaagu

SEQ ID NO: 4064086 - RNA, 23 nt, Vaccinia virus
uacuuccaucaacauuguuucaa

SEQ ID NO: 4064087 - RNA, 20 nt, Vaccinia virus
uacuuguuaguaguuagaua

SEQ ID NO: 4064088 - RNA, 19 nt, Vaccinia virus
uacuuucaaugagauaaau

SEQ ID NO: 4064089 - RNA, 15 nt, Vaccinia virus
uacuuucgguuucau

SEQ ID NO: 4064090 - RNA, 16 nt, Vaccinia virus
uacuuucgguuucaua

SEQ ID NO: 4064091 - RNA, 15 nt, Vaccinia virus
uacuuugacaaaugu

SEQ ID NO: 4064092 - RNA, 16 nt, Vaccinia virus
uacuuuuacgagaaau

SEQ ID NO: 4064093 - RNA, 18 nt, Vaccinia virus
uagaaaaaacauguggua

SEQ ID NO: 4064094 - RNA, 20 nt, Vaccinia virus
uagaaaaaauagaacuuauc

SEQ ID NO: 4064095 - RNA, 22 nt, Vaccinia virus
uagaaaacagagauaguaaaua

SEQ ID NO: 4064096 - RNA, 18 nt, Vaccinia virus
uagaaaaugauucacaau

SEQ ID NO: 4064097 - RNA, 15 nt, Vaccinia virus
uagaaacauauucua

SEQ ID NO: 4064098 - RNA, 16 nt, Vaccinia virus
uagaaacaugaaacca

SEQ ID NO: 4064099 - RNA, 17 nt, Vaccinia virus
uagaaacuucaaagauu

SEQ ID NO: 4064100 - RNA, 18 nt, Vaccinia virus
uagaaauaaaaauuauua

SEQ ID NO: 4064101 - RNA, 14 nt, Vaccinia virus
uagaaaucaacgau

SEQ ID NO: 4064102 - RNA, 20 nt, Vaccinia virus
uagaaaucaacuuauucuug

SEQ ID NO: 4064103 - RNA, 20 nt, Vaccinia virus
uagaaauucaucaauaucca

SEQ ID NO: 4064104 - RNA, 17 nt, Vaccinia virus
uagaacaaaauacauaa

SEQ ID NO: 4064105 - RNA, 15 nt, Vaccinia virus
uagaacaauguguga

SEQ ID NO: 4064106 - RNA, 18 nt, Vaccinia virus
uagaacugccauauguug

SEQ ID NO: 4064107 - RNA, 22 nt, Vaccinia virus
uagaacugccauauguuggaga

SEQ ID NO: 4064108 - RNA, 19 nt, Vaccinia virus
uagaacugcuaauggaugu

SEQ ID NO: 4064109 - RNA, 17 nt, Vaccinia virus
uagaacuuuuaauuuug

SEQ ID NO: 4064110 - RNA, 17 nt, Vaccinia virus
uagaagauaucauaaau

SEQ ID NO: 4064111 - RNA, 20 nt, Vaccinia virus
uagaagaucgucgucaaagu

SEQ ID NO: 4064112 - RNA, 18 nt, Vaccinia virus
uagaauaagaacuauaaa

SEQ ID NO: 4064113 - RNA, 13 nt, Vaccinia virus
uagaauacuaaag

SEQ ID NO: 4064114 - RNA, 16 nt, Vaccinia virus
uagaauauauguaugu

SEQ ID NO: 4064115 - RNA, 18 nt, Vaccinia virus
uagaaugaagauaucauu

SEQ ID NO: 4064116 - RNA, 18 nt, Vaccinia virus
uagaaugcucuuaaauaa

SEQ ID NO: 4064117 - RNA, 19 nt, Vaccinia virus
uagaaugugauaauuauuu

SEQ ID NO: 4064118 - RNA, 22 nt, Vaccinia virus
uagaauuuauagacgacucauu

SEQ ID NO: 4064119 - RNA, 22 nt, Vaccinia virus
uagacaauacuuuuacggaaaa

SEQ ID NO: 4064120 - RNA, 16 nt, Vaccinia virus
uagacauagauauucu

SEQ ID NO: 4064121 - RNA, 13 nt, Vaccinia virus
uagacguauaagu

SEQ ID NO: 4064122 - RNA, 19 nt, Vaccinia virus
uagacuuaucgacaucuug

SEQ ID NO: 4064123 - RNA, 19 nt, Vaccinia virus
uagagaauuaauaucuauu

SEQ ID NO: 4064124 - RNA, 14 nt, Vaccinia virus
uagagagauucauu

SEQ ID NO: 4064125 - RNA, 21 nt, Vaccinia virus
uagagaggcugcugaaaauaa

SEQ ID NO: 4064126 - RNA, 22 nt, Vaccinia virus
uagagauaaaacaaguuuucau

SEQ ID NO: 4064127 - RNA, 19 nt, Vaccinia virus
uagagauacuuucagucug

SEQ ID NO: 4064128 - RNA, 14 nt, Vaccinia virus
uagagaucuaaagc

SEQ ID NO: 4064129 - RNA, 22 nt, Vaccinia virus
uagagccugugaaugcaaucaa

SEQ ID NO: 4064130 - RNA, 23 nt, Vaccinia virus
uagaggagacauuagaaucauug

SEQ ID NO: 4064131 - RNA, 13 nt, Vaccinia virus
uagaggucuaagu

SEQ ID NO: 4064132 - RNA, 16 nt, Vaccinia virus
uagaguaucguugaga

SEQ ID NO: 4064133 - RNA, 19 nt, Vaccinia virus
uagagugagucuagaauuc

SEQ ID NO: 4064134 - RNA, 22 nt, Vaccinia virus
uagauaacggacaacaacuauc

SEQ ID NO: 4064135 - RNA, 13 nt, Vaccinia virus
uagauaauucuaa

SEQ ID NO: 4064136 - RNA, 20 nt, Vaccinia virus
uagauacauuggccguaaua

SEQ ID NO: 4064137 - RNA, 23 nt, Vaccinia virus
uagauaguuuuuuugagccauau

SEQ ID NO: 4064138 - RNA, 16 nt, Vaccinia virus
uagauauaacuucugg

SEQ ID NO: 4064139 - RNA, 13 nt, Vaccinia virus
uagauauagauuu

SEQ ID NO: 4064140 - RNA, 20 nt, Vaccinia virus
uagauaucaaauccaaugga

SEQ ID NO: 4064141 - RNA, 17 nt, Vaccinia virus
uagauauccuuuuucau

SEQ ID NO: 4064142 - RNA, 14 nt, Vaccinia virus
uagauauuaaacaa

SEQ ID NO: 4064143 - RNA, 19 nt, Vaccinia virus
uagauccucauaaguguau

SEQ ID NO: 4064144 - RNA, 23 nt, Vaccinia virus
uagaucuuuacacaaauaauuac

SEQ ID NO: 4064145 - RNA, 14 nt, Vaccinia virus
uagaugaauuauua

SEQ ID NO: 4064146 - RNA, 16 nt, Vaccinia virus
uagaugaggauagcaa

SEQ ID NO: 4064147 - RNA, 16 nt, Vaccinia virus
uagaugcgucuagaag

SEQ ID NO: 4064148 - RNA, 15 nt, Vaccinia virus
uagauguaaugguaa

SEQ ID NO: 4064149 - RNA, 15 nt, Vaccinia virus
uagauguguauacau

SEQ ID NO: 4064150 - RNA, 14 nt, Vaccinia virus
uagauuguuuucag

SEQ ID NO: 4064151 - RNA, 17 nt, Vaccinia virus
uagauuuauaauacuuu

SEQ ID NO: 4064152 - RNA, 21 nt, Vaccinia virus
uagauuucauucagaggaugu

SEQ ID NO: 4064153 - RNA, 17 nt, Vaccinia virus
ggaugaguuaauguaua

SEQ ID NO: 4064154 - RNA, 14 nt, Vaccinia virus
ggauggacacauuc

SEQ ID NO: 4064155 - RNA, 18 nt, Vaccinia virus
ggauuaauauauguuaua

SEQ ID NO: 4064156 - RNA, 17 nt, Vaccinia virus
ggauuacaagaaauaug

SEQ ID NO: 4064157 - RNA, 18 nt, Vaccinia virus
ggauuaucaaaucuuuaa

SEQ ID NO: 4064158 - RNA, 21 nt, Vaccinia virus
ggauucauccuuaaauguuuu

SEQ ID NO: 4064159 - RNA, 22 nt, Vaccinia virus
ggauucauuaauaucuuuauaa

SEQ ID NO: 4064160 - RNA, 19 nt, Vaccinia virus
ggauucuuugcguaucuca

SEQ ID NO: 4064161 - RNA, 18 nt, Vaccinia virus
ggauuuggucauaauaga

SEQ ID NO: 4064162 - RNA, 13 nt, Vaccinia virus
ggauuuucuagau

SEQ ID NO: 4064163 - RNA, 19 nt, Vaccinia virus
ggcaauaacuaaaaaugua

SEQ ID NO: 4064164 - RNA, 21 nt, Vaccinia virus
ggcaauaauugcgaauguuuu

SEQ ID NO: 4064165 - RNA, 16 nt, Vaccinia virus
ggcaauuguagauaua

SEQ ID NO: 4064166 - RNA, 13 nt, Vaccinia virus
ggccaaaaugaua

SEQ ID NO: 4064167 - RNA, 17 nt, Vaccinia virus
ggccuaaagaauaucuu

SEQ ID NO: 4064168 - RNA, 19 nt, Vaccinia virus
ggcuacggcagauauaccu

SEQ ID NO: 4064169 - RNA, 18 nt, Vaccinia virus
ggcuagucaagaugauga

SEQ ID NO: 4064170 - RNA, 19 nt, Vaccinia virus
ggcuugcauguauuaaaga

SEQ ID NO: 4064171 - RNA, 21 nt, Vaccinia virus
ggggaaaaauuauaauguuuc

SEQ ID NO: 4064172 - RNA, 17 nt, Vaccinia virus
ggguuaaauuugaacaa

SEQ ID NO: 4064173 - RNA, 18 nt, Vaccinia virus
gguaaauguuuuuaucau

SEQ ID NO: 4064174 - RNA, 14 nt, Vaccinia virus
gguaaguucauuau

SEQ ID NO: 4064175 - RNA, 15 nt, Vaccinia virus
gguacaacauuccaa

SEQ ID NO: 4064176 - RNA, 17 nt, Vaccinia virus
gguacauagauuaucca

SEQ ID NO: 4064177 - RNA, 14 nt, Vaccinia virus
gguagagaaugaua

SEQ ID NO: 4064178 - RNA, 17 nt, Vaccinia virus
ggucccuauuguuacag

SEQ ID NO: 4064179 - RNA, 15 nt, Vaccinia virus
gguccuauugcuucc

SEQ ID NO: 4064180 - RNA, 14 nt, Vaccinia virus
ggucgaugucaaua

SEQ ID NO: 4064181 - RNA, 18 nt, Vaccinia virus
ggucuguguuacauaucu

SEQ ID NO: 4064182 - RNA, 16 nt, Vaccinia virus
ggugacaugugugaua

SEQ ID NO: 4064183 - RNA, 16 nt, Vaccinia virus
ggugagaacaugagac

SEQ ID NO: 4064184 - RNA, 16 nt, Vaccinia virus
uucacagaaacacuag

SEQ ID NO: 4064185 - RNA, 23 nt, Vaccinia virus
uucacagauagaucauuuugaac

SEQ ID NO: 4064186 - RNA, 13 nt, Vaccinia virus
uucacucauauga

SEQ ID NO: 4064187 - RNA, 15 nt, Vaccinia virus
uucagaaaauaaucc

SEQ ID NO: 4064188 - RNA, 21 nt, Vaccinia virus
uucagaaaguaauucauuaau

SEQ ID NO: 4064189 - RNA, 20 nt, Vaccinia virus
uucagaauuaauagauauau

SEQ ID NO: 4064190 - RNA, 20 nt, Vaccinia virus
uucagauauaaaaaucuguu

SEQ ID NO: 4064191 - RNA, 18 nt, Vaccinia virus
uucagcggauccuguauu

SEQ ID NO: 4064192 - RNA, 13 nt, Vaccinia virus
uucaggaacauaa

SEQ ID NO: 4064193 - RNA, 17 nt, Vaccinia virus
uucaguuucucaucuuu

SEQ ID NO: 4064194 - RNA, 16 nt, Vaccinia virus
uucauaaaaaccaucg

SEQ ID NO: 4064195 - RNA, 21 nt, Vaccinia virus
uucauaauuguuagcuguuuu

SEQ ID NO: 4064196 - RNA, 16 nt, Vaccinia virus
uucauauccuacugua

SEQ ID NO: 4064197 - RNA, 18 nt, Vaccinia virus
uucauauuaaacauacug

SEQ ID NO: 4064198 - RNA, 21 nt, Vaccinia virus
uucaucagauuauuuaacaau

SEQ ID NO: 4064199 - RNA, 13 nt, Vaccinia virus
uucaucauauuca

SEQ ID NO: 4064200 - RNA, 21 nt, Vaccinia virus
uucaucauauucaucaucaau

SEQ ID NO: 4064201 - RNA, 18 nt, Vaccinia virus
uucaucgcuuucuagaau

SEQ ID NO: 4064202 - RNA, 18 nt, Vaccinia virus
uucaucggcuuuaacaau

SEQ ID NO: 4064203 - RNA, 13 nt, Vaccinia virus
uucauuaaucuuu

SEQ ID NO: 4064204 - RNA, 13 nt, Vaccinia virus
uucauucguaaau

SEQ ID NO: 4064205 - RNA, 17 nt, Vaccinia virus
uucauucguaaaucuuu

SEQ ID NO: 4064206 - RNA, 11 nt, Vaccinia virus
uuccaaacauu

SEQ ID NO: 4064207 - RNA, 15 nt, Vaccinia virus
uuccaaauuauucuu

SEQ ID NO: 4064208 - RNA, 21 nt, Vaccinia virus
uuccaaauuuuuuucauugau

SEQ ID NO: 4064209 - RNA, 20 nt, Vaccinia virus
uuccaauaucugagcuaucu

SEQ ID NO: 4064210 - RNA, 18 nt, Vaccinia virus
uuccacgaacuucuaauu

SEQ ID NO: 4064211 - RNA, 16 nt, Vaccinia virus
uuccagaugucauaau

SEQ ID NO: 4064212 - RNA, 15 nt, Vaccinia virus
uuccaguauuuucca

SEQ ID NO: 4064213 - RNA, 13 nt, Vaccinia virus
uuccauaaacagu

SEQ ID NO: 4064214 - RNA, 20 nt, Vaccinia virus
uuccauauagauauaauuuu

SEQ ID NO: 4064215 - RNA, 14 nt, Vaccinia virus
uuccauccuuugua

SEQ ID NO: 4064216 - RNA, 18 nt, Vaccinia virus
uuccauucggauucacaa

SEQ ID NO: 4064217 - RNA, 19 nt, Vaccinia virus
uucccaaauaaucauucau

SEQ ID NO: 4064218 - RNA, 14 nt, Vaccinia virus
uucccauaaguuug

SEQ ID NO: 4064219 - RNA, 15 nt, Vaccinia virus
uuccgccaaauuuuc

SEQ ID NO: 4064220 - RNA, 15 nt, Vaccinia virus
uuccguaucuguauu

SEQ ID NO: 4064221 - RNA, 20 nt, Vaccinia virus
uuccguuaauaauacuauuu

SEQ ID NO: 4064222 - RNA, 18 nt, Vaccinia virus
uuccugaaggaaaugaac

SEQ ID NO: 4064223 - RNA, 19 nt, Vaccinia virus
uuccugacgucuagaguuu

SEQ ID NO: 4064224 - RNA, 21 nt, Vaccinia virus
gaaaaaauauuuuauuaguuu

SEQ ID NO: 4064225 - RNA, 22 nt, Vaccinia virus
gaaaaagaauuuuuauaaauuu

SEQ ID NO: 4064226 - RNA, 13 nt, Vaccinia virus
gaaaaauauauca

SEQ ID NO: 4064227 - RNA, 16 nt, Vaccinia virus
gaaaaauuuguagauu

SEQ ID NO: 4064228 - RNA, 20 nt, Vaccinia virus
gaaaacauuuuuaucauguu

SEQ ID NO: 4064229 - RNA, 21 nt, Vaccinia virus
uagauuuccucguccuaugga

SEQ ID NO: 4064230 - RNA, 15 nt, Vaccinia virus
uagcaauauguguaa

SEQ ID NO: 4064231 - RNA, 21 nt, Vaccinia virus
uagcacuacgcaauaugauca

SEQ ID NO: 4064232 - RNA, 16 nt, Vaccinia virus
uagcagauagauaaag

SEQ ID NO: 4064233 - RNA, 16 nt, Vaccinia virus
uagcauuaauacagua

SEQ ID NO: 4064234 - RNA, 20 nt, Vaccinia virus
uagccaaaagacuaugggaa

SEQ ID NO: 4064235 - RNA, 15 nt, Vaccinia virus
uagccacaauuauug

SEQ ID NO: 4064236 - RNA, 17 nt, Vaccinia virus
uagcccucuucaagaac

SEQ ID NO: 4064237 - RNA, 19 nt, Vaccinia virus
uagccgauaaacaaaucau

SEQ ID NO: 4064238 - RNA, 18 nt, Vaccinia virus
uagccuguuuuaacaucu

SEQ ID NO: 4064239 - RNA, 16 nt, Vaccinia virus
uagcgguaaguauaaa

SEQ ID NO: 4064240 - RNA, 21 nt, Vaccinia virus
uagcuaaagauuugucacaau

SEQ ID NO: 4064241 - RNA, 19 nt, Vaccinia virus
uagcuaauauaaaaauaua

SEQ ID NO: 4064242 - RNA, 17 nt, Vaccinia virus
uagcugagaauaucuuu

SEQ ID NO: 4064243 - RNA, 13 nt, Vaccinia virus
uaggauuaacaua

SEQ ID NO: 4064244 - RNA, 13 nt, Vaccinia virus
uaggcacacaauc

SEQ ID NO: 4064245 - RNA, 17 nt, Vaccinia virus
uaggcacagucaaacau

SEQ ID NO: 4064246 - RNA, 21 nt, Vaccinia virus
uaggcauaccauuagauaauc

SEQ ID NO: 4064247 - RNA, 21 nt, Vaccinia virus
uagggagaguauaaaacauua

SEQ ID NO: 4064248 - RNA, 15 nt, Vaccinia virus
uaggguuguguauaa

SEQ ID NO: 4064249 - RNA, 19 nt, Vaccinia virus
uagguauuuuaucucuauu

SEQ ID NO: 4064250 - RNA, 13 nt, Vaccinia virus
uaggugaugaugc

SEQ ID NO: 4064251 - RNA, 18 nt, Vaccinia virus
uagguuuaguaucucaau

SEQ ID NO: 4064252 - RNA, 15 nt, Vaccinia virus
uaguaaaaauaauua

SEQ ID NO: 4064253 - RNA, 18 nt, Vaccinia virus
uaguaaaaauaauuauua

SEQ ID NO: 4064254 - RNA, 21 nt, Vaccinia virus
uaguaaacuugacuaaaucuu

SEQ ID NO: 4064255 - RNA, 21 nt, Vaccinia virus
uaguaaguagaaauuaucaaa

SEQ ID NO: 4064256 - RNA, 14 nt, Vaccinia virus
uaguaauguuuaug

SEQ ID NO: 4064257 - RNA, 15 nt, Vaccinia virus
uaguaauuugugcau

SEQ ID NO: 4064258 - RNA, 20 nt, Vaccinia virus
uaguaauuuuuuaucauaaa

SEQ ID NO: 4064259 - RNA, 18 nt, Vaccinia virus
uaguagaguuuuauucuc

SEQ ID NO: 4064260 - RNA, 12 nt, Vaccinia virus
uaguagaugcua

SEQ ID NO: 4064261 - RNA, 19 nt, Vaccinia virus
uaguagauuuuuaagcugu

SEQ ID NO: 4064262 - RNA, 14 nt, Vaccinia virus
uaguaguguuuccc

SEQ ID NO: 4064263 - RNA, 17 nt, Vaccinia virus
uaguauaauuauaugua

SEQ ID NO: 4064264 - RNA, 14 nt, Vaccinia virus
uaguauaauuauug

SEQ ID NO: 4064265 - RNA, 16 nt, Vaccinia virus
uaguauaccaugaccu

SEQ ID NO: 4064266 - RNA, 20 nt, Vaccinia virus
uaguauagaucaaauacuug

SEQ ID NO: 4064267 - RNA, 20 nt, Vaccinia virus
uaguauaucuacacauguau

SEQ ID NO: 4064268 - RNA, 13 nt, Vaccinia virus
uaguaucuaaaac

SEQ ID NO: 4064269 - RNA, 15 nt, Vaccinia virus
uaguaucuaaacauu

SEQ ID NO: 4064270 - RNA, 18 nt, Vaccinia virus
uaguaucuuuuuuacgua

SEQ ID NO: 4064271 - RNA, 14 nt, Vaccinia virus
uaguaugguuucau

SEQ ID NO: 4064272 - RNA, 15 nt, Vaccinia virus
uaguaugguuucaua

SEQ ID NO: 4064273 - RNA, 15 nt, Vaccinia virus
uaguauucguuuucu

SEQ ID NO: 4064274 - RNA, 18 nt, Vaccinia virus
uaguauuuauacuacuaa

SEQ ID NO: 4064275 - RNA, 18 nt, Vaccinia virus
uagucaaucuuauucaag

SEQ ID NO: 4064276 - RNA, 17 nt, Vaccinia virus
uagucagaccauucuug

SEQ ID NO: 4064277 - RNA, 16 nt, Vaccinia virus
uagucauaauaucuuu

SEQ ID NO: 4064278 - RNA, 17 nt, Vaccinia virus
uagucauagacaaugcu

SEQ ID NO: 4064279 - RNA, 17 nt, Vaccinia virus
uagucauagaugaaaua

SEQ ID NO: 4064280 - RNA, 15 nt, Vaccinia virus
uagucgguauuucau

SEQ ID NO: 4064281 - RNA, 21 nt, Vaccinia virus
uagucuuagcugaccugaguu

SEQ ID NO: 4064282 - RNA, 23 nt, Vaccinia virus
uagugaugaauugaaaauuauuu

SEQ ID NO: 4064283 - RNA, 16 nt, Vaccinia virus
uagugaugguuuucua

SEQ ID NO: 4064284 - RNA, 23 nt, Vaccinia virus
uagugccaucagaauaggaugaa

SEQ ID NO: 4064285 - RNA, 18 nt, Vaccinia virus
uagugcucaaacaaaaug

SEQ ID NO: 4064286 - RNA, 14 nt, Vaccinia virus
uaguguuacaaaac

SEQ ID NO: 4064287 - RNA, 16 nt, Vaccinia virus
uaguuaccgcaaagaa

SEQ ID NO: 4064288 - RNA, 19 nt, Vaccinia virus
uaguuacgauuuuaucauc

SEQ ID NO: 4064289 - RNA, 19 nt, Vaccinia virus
uaguuacuacgaucucauc

SEQ ID NO: 4064290 - RNA, 17 nt, Vaccinia virus
uaguuacuuuaauaacc

SEQ ID NO: 4064291 - RNA, 17 nt, Vaccinia virus
uaguuaucuaucuuaaa

SEQ ID NO: 4064292 - RNA, 14 nt, Vaccinia virus
uaguuauuaaugau

SEQ ID NO: 4064293 - RNA, 17 nt, Vaccinia virus
uaguuauuacuuuucuc

SEQ ID NO: 4064294 - RNA, 23 nt, Vaccinia virus
uaguuccucaggauucuaaugau

SEQ ID NO: 4064295 - RNA, 14 nt, Vaccinia virus
uaguucgucauaac

SEQ ID NO: 4064296 - RNA, 22 nt, Vaccinia virus
uaguugacacguuuauuucaua

SEQ ID NO: 4064297 - RNA, 18 nt, Vaccinia virus
uaguugauuuauuacuua

SEQ ID NO: 4064298 - RNA, 22 nt, Vaccinia virus
uaguuguauacugagaauugac

SEQ ID NO: 4064299 - RNA, 17 nt, Vaccinia virus
uaguuguggaaauacuu

SEQ ID NO: 4064300 - RNA, 17 nt, Vaccinia virus
uauaaaaccaaggacuu

SEQ ID NO: 4064301 - RNA, 17 nt, Vaccinia virus
uauaaaauagaaaauaa

SEQ ID NO: 4064302 - RNA, 20 nt, Vaccinia virus
uauaaacaucuugauacuuu

SEQ ID NO: 4064303 - RNA, 17 nt, Vaccinia virus
uauaaacucucaacauu

SEQ ID NO: 4064304 - RNA, 20 nt, Vaccinia virus
uauaaagaugguaaacucuu

SEQ ID NO: 4064305 - RNA, 16 nt, Vaccinia virus
uauaaaguguaugucu

SEQ ID NO: 4064306 - RNA, 14 nt, Vaccinia virus
uauaaauagauguu

SEQ ID NO: 4064307 - RNA, 14 nt, Vaccinia virus
uauaaauggaugaa

SEQ ID NO: 4064308 - RNA, 17 nt, Vaccinia virus
uauaaauggaugaagca

SEQ ID NO: 4064309 - RNA, 13 nt, Vaccinia virus
uauaaauuuuaga

SEQ ID NO: 4064310 - RNA, 22 nt, Vaccinia virus
uauaacacuuauguauuaacuu

SEQ ID NO: 4064311 - RNA, 18 nt, Vaccinia virus
uauaacaugcuaaaccuu

SEQ ID NO: 4064312 - RNA, 17 nt, Vaccinia virus
uauaacauuaauaucaa

SEQ ID NO: 4064313 - RNA, 15 nt, Vaccinia virus
uauaaccuuaucauu

SEQ ID NO: 4064314 - RNA, 22 nt, Vaccinia virus
uauaacuaaacacguuaguguu

SEQ ID NO: 4064315 - RNA, 22 nt, Vaccinia virus
uauaacuaucaauauuaacagu

SEQ ID NO: 4064316 - RNA, 17 nt, Vaccinia virus
uauaacuucuaaucuug

SEQ ID NO: 4064317 - RNA, 17 nt, Vaccinia virus
uauaagacgauacuguu

SEQ ID NO: 4064318 - RNA, 22 nt, Vaccinia virus
uauaagauauccauaucaucau

SEQ ID NO: 4064319 - RNA, 15 nt, Vaccinia virus
uauaagauuaucaaa

SEQ ID NO: 4064320 - RNA, 20 nt, Vaccinia virus
uauaagauuaucaaaaucuu

SEQ ID NO: 4064321 - RNA, 19 nt, Vaccinia virus
uauaagcucuauuguuuga

SEQ ID NO: 4064322 - RNA, 14 nt, Vaccinia virus
uauaaggucagaaa

SEQ ID NO: 4064323 - RNA, 19 nt, Vaccinia virus
uauaauaacaaguaugaca

SEQ ID NO: 4064324 - RNA, 17 nt, Vaccinia virus
uauaauagucaauagau

SEQ ID NO: 4064325 - RNA, 14 nt, Vaccinia virus
uauaauauauucua

SEQ ID NO: 4064326 - RNA, 12 nt, Vaccinia virus
uauaauaucuuu

SEQ ID NO: 4064327 - RNA, 15 nt, Vaccinia virus
uauaaucguuaaauu

SEQ ID NO: 4064328 - RNA, 16 nt, Vaccinia virus
uauaaucguuaaauuu

SEQ ID NO: 4064329 - RNA, 23 nt, Vaccinia virus
uauaaucucauucgaacauacga

SEQ ID NO: 4064330 - RNA, 23 nt, Vaccinia virus
uauaaugacaucuaugauuuuac

SEQ ID NO: 4064331 - RNA, 14 nt, Vaccinia virus
uauaauguagacau

SEQ ID NO: 4064332 - RNA, 22 nt, Vaccinia virus
uauaauguucgccauuuauaua

SEQ ID NO: 4064333 - RNA, 21 nt, Vaccinia virus
uauaauguuuccucuuucaua

SEQ ID NO: 4064334 - RNA, 15 nt, Vaccinia virus
uauaauuauacuauu

SEQ ID NO: 4064335 - RNA, 16 nt, Vaccinia virus
uauaauuuuuaacagu

SEQ ID NO: 4064336 - RNA, 15 nt, Vaccinia virus
uauacaagauugaaa

SEQ ID NO: 4064337 - RNA, 15 nt, Vaccinia virus
uauacaauuaucauu

SEQ ID NO: 4064338 - RNA, 24 nt, Vaccinia virus
uauacaauuguuuguauucauuca

SEQ ID NO: 4064339 - RNA, 16 nt, Vaccinia virus
uauacagcguuacauu

SEQ ID NO: 4064340 - RNA, 21 nt, Vaccinia virus
uauacauccguagaaauauga

SEQ ID NO: 4064341 - RNA, 20 nt, Vaccinia virus
uauacauuacugaauuauua

SEQ ID NO: 4064342 - RNA, 13 nt, Vaccinia virus
uauacccaaagag

SEQ ID NO: 4064343 - RNA, 18 nt, Vaccinia virus
uauaccuuguaauuaaau

SEQ ID NO: 4064344 - RNA, 19 nt, Vaccinia virus
uauaccuuguaauuaaauu

SEQ ID NO: 4064345 - RNA, 13 nt, Vaccinia virus
uauacgacuauga

SEQ ID NO: 4064346 - RNA, 16 nt, Vaccinia virus
uauacuaaucaauaau

SEQ ID NO: 4064347 - RNA, 13 nt, Vaccinia virus
uauacuacaauug

SEQ ID NO: 4064348 - RNA, 18 nt, Vaccinia virus
uauacuccgguugaugau

SEQ ID NO: 4064349 - RNA, 16 nt, Vaccinia virus
uauagaaacauauucu

SEQ ID NO: 4064350 - RNA, 19 nt, Vaccinia virus
uauagagcacuauuucuaa

SEQ ID NO: 4064351 - RNA, 21 nt, Vaccinia virus
uauagagcacuauuucuaaau

SEQ ID NO: 4064352 - RNA, 23 nt, Vaccinia virus
uauagaggaauaucaucaaacaa

SEQ ID NO: 4064353 - RNA, 21 nt, Vaccinia virus
uauagaucagucaacggaaaa

SEQ ID NO: 4064354 - RNA, 20 nt, Vaccinia virus
uauagauggcuuguauguca

SEQ ID NO: 4064355 - RNA, 22 nt, Vaccinia virus
ucucacugaauacgaggaugau

SEQ ID NO: 4064356 - RNA, 14 nt, Vaccinia virus
ucucagaauucuaa

SEQ ID NO: 4064357 - RNA, 14 nt, Vaccinia virus
uagauaaacgugau

SEQ ID NO: 4064358 - RNA, 13 nt, Vaccinia virus
uagauaaacuauc

SEQ ID NO: 4064359 - RNA, 15 nt, Vaccinia virus
uagauaauucuaauu

SEQ ID NO: 4064360 - RNA, 16 nt, Vaccinia virus
uagauacaacgucauc

SEQ ID NO: 4064361 - RNA, 16 nt, Vaccinia virus
uagauaccauuaauca

SEQ ID NO: 4064362 - RNA, 16 nt, Vaccinia virus
uagauaccguaguaua

SEQ ID NO: 4064363 - RNA, 21 nt, Vaccinia virus
uagauacucuaccauuucugc

SEQ ID NO: 4064364 - RNA, 17 nt, Vaccinia virus
uagauagaaacuuauac

SEQ ID NO: 4064365 - RNA, 15 nt, Vaccinia virus
uagauauaaauucaa

SEQ ID NO: 4064366 - RNA, 18 nt, Vaccinia virus
uagaucacccuaaucuua

SEQ ID NO: 4064367 - RNA, 15 nt, Vaccinia virus
uagaucaucugaaaa

SEQ ID NO: 4064368 - RNA, 17 nt, Vaccinia virus
uagaucauuugaaauua

SEQ ID NO: 4064369 - RNA, 16 nt, Vaccinia virus
uagauccaacauuaau

SEQ ID NO: 4064370 - RNA, 17 nt, Vaccinia virus
uagaucggaugauuuac

SEQ ID NO: 4064371 - RNA, 16 nt, Vaccinia virus
uagaucugaauuaaau

SEQ ID NO: 4064372 - RNA, 22 nt, Vaccinia virus
uagaucuuccaaucuaucuauu

SEQ ID NO: 4064373 - RNA, 22 nt, Vaccinia virus
uagaugauagagguaauacuuu

SEQ ID NO: 4064374 - RNA, 15 nt, Vaccinia virus
uagaugauauuguaa

SEQ ID NO: 4064375 - RNA, 19 nt, Vaccinia virus
uagauguaaguaugauguc

SEQ ID NO: 4064376 - RNA, 20 nt, Vaccinia virus
uagauguuaaaaaaacaucg

SEQ ID NO: 4064377 - RNA, 14 nt, Vaccinia virus
uagauuaaugcuua

SEQ ID NO: 4064378 - RNA, 16 nt, Vaccinia virus
uagauuauaauccuua

SEQ ID NO: 4064379 - RNA, 13 nt, Vaccinia virus
uagauuaucuauu

SEQ ID NO: 4064380 - RNA, 19 nt, Vaccinia virus
uagauucauucguuauaga

SEQ ID NO: 4064381 - RNA, 13 nt, Vaccinia virus
uagauuuaucuag

SEQ ID NO: 4064382 - RNA, 16 nt, Vaccinia virus
uagauuuccaaagaua

SEQ ID NO: 4064383 - RNA, 16 nt, Vaccinia virus
uagauuuuccauccac

SEQ ID NO: 4064384 - RNA, 20 nt, Vaccinia virus
uagauuuuuuaaaggaugau

SEQ ID NO: 4064385 - RNA, 13 nt, Vaccinia virus
uagcaaaauuaac

SEQ ID NO: 4064386 - RNA, 18 nt, Vaccinia virus
uagcaaaggaaauugugc

SEQ ID NO: 4064387 - RNA, 23 nt, Vaccinia virus
uagcaagauuuuuaaacaacaau

SEQ ID NO: 4064388 - RNA, 19 nt, Vaccinia virus
uagcacauccaucaaagaa

SEQ ID NO: 4064389 - RNA, 15 nt, Vaccinia virus
uagcagucuaacauu

SEQ ID NO: 4064390 - RNA, 21 nt, Vaccinia virus
uagcaucuuauuagaauauua

SEQ ID NO: 4064391 - RNA, 21 nt, Vaccinia virus
uagcauuguuauguauuucau

SEQ ID NO: 4064392 - RNA, 14 nt, Vaccinia virus
uagccaucguuaau

SEQ ID NO: 4064393 - RNA, 19 nt, Vaccinia virus
aacuauuuugucucuguuu

SEQ ID NO: 4064394 - RNA, 20 nt, Vaccinia virus
aacucagucaauauauuaag

SEQ ID NO: 4064395 - RNA, 15 nt, Vaccinia virus
aacucauuauagaua

SEQ ID NO: 4064396 - RNA, 19 nt, Vaccinia virus
aacucauuuauauauuaaa

SEQ ID NO: 4064397 - RNA, 23 nt, Vaccinia virus
aacuccaauaaaaagaugauaua

SEQ ID NO: 4064398 - RNA, 20 nt, Vaccinia virus
aacuccggauagagaaauau

SEQ ID NO: 4064399 - RNA, 17 nt, Vaccinia virus
aacuccggccauuugua

SEQ ID NO: 4064400 - RNA, 18 nt, Vaccinia virus
aacuccguagagaaauau

SEQ ID NO: 4064401 - RNA, 14 nt, Vaccinia virus
aacuccucuagaug

SEQ ID NO: 4064402 - RNA, 15 nt, Vaccinia virus
aacucgguuaacaug

SEQ ID NO: 4064403 - RNA, 13 nt, Vaccinia virus
aacucuaaucaaa

SEQ ID NO: 4064404 - RNA, 18 nt, Vaccinia virus
aacucuuucgaauacuua

SEQ ID NO: 4064405 - RNA, 19 nt, Vaccinia virus
aacucuuucgaauacuuau

SEQ ID NO: 4064406 - RNA, 15 nt, Vaccinia virus
aacucuuugacauau

SEQ ID NO: 4064407 - RNA, 18 nt, Vaccinia virus
aacucuuugauuuuguau

SEQ ID NO: 4064408 - RNA, 22 nt, Vaccinia virus
aacugacguauuggaugaugca

SEQ ID NO: 4064409 - RNA, 20 nt, Vaccinia virus
aacuguagagggucaacaau

SEQ ID NO: 4064410 - RNA, 14 nt, Vaccinia virus
aacuguuaaauguu

SEQ ID NO: 4064411 - RNA, 15 nt, Vaccinia virus
aacuuaaaagaauua

SEQ ID NO: 4064412 - RNA, 21 nt, Vaccinia virus
aacuuaccacguaaaacuuaa

SEQ ID NO: 4064413 - RNA, 20 nt, Vaccinia virus
aacuuacgauacaucuguuu

SEQ ID NO: 4064414 - RNA, 15 nt, Vaccinia virus
aacuucguaaaauau

SEQ ID NO: 4064415 - RNA, 16 nt, Vaccinia virus
aacuucuaaucuugua

SEQ ID NO: 4064416 - RNA, 20 nt, Vaccinia virus
aacuucugccugaaauccaa

SEQ ID NO: 4064417 - RNA, 16 nt, Vaccinia virus
aacuugcaaaaaagac

SEQ ID NO: 4064418 - RNA, 23 nt, Vaccinia virus
aacuuuaaauaauuuacaaaaau

SEQ ID NO: 4064419 - RNA, 16 nt, Vaccinia virus
aacuuuccucagagau

SEQ ID NO: 4064420 - RNA, 14 nt, Vaccinia virus
aacuuugaaauugu

SEQ ID NO: 4064421 - RNA, 12 nt, Vaccinia virus
aacuuuuuggua

SEQ ID NO: 4064422 - RNA, 17 nt, Vaccinia virus
aagaaaaaugauuaucu

SEQ ID NO: 4064423 - RNA, 15 nt, Vaccinia virus
aagaaaacaaacauc

SEQ ID NO: 4064424 - RNA, 13 nt, Vaccinia virus
aagaaaacucguc

SEQ ID NO: 4064425 - RNA, 14 nt, Vaccinia virus
aagaaaaugcagaa

SEQ ID NO: 4064426 - RNA, 11 nt, Vaccinia virus
aagaaaugaua

SEQ ID NO: 4064427 - RNA, 23 nt, Vaccinia virus
aagaacguaaaauacauaugaca

SEQ ID NO: 4064428 - RNA, 12 nt, Vaccinia virus
aagaagaaguag

SEQ ID NO: 4064429 - RNA, 18 nt, Vaccinia virus
aagaagagaauuaaaaga

SEQ ID NO: 4064430 - RNA, 24 nt, Vaccinia virus
aagaagauuaucaagauguguaug

SEQ ID NO: 4064431 - RNA, 20 nt, Vaccinia virus
aagaagugucuauaaaugua

SEQ ID NO: 4064432 - RNA, 22 nt, Vaccinia virus
aagaagugucuauaaauguaga

SEQ ID NO: 4064433 - RNA, 18 nt, Vaccinia virus
aagaaguuauagaaugua

SEQ ID NO: 4064434 - RNA, 12 nt, Vaccinia virus
aagaauaaagua

SEQ ID NO: 4064435 - RNA, 13 nt, Vaccinia virus
aagaauauaacgu

SEQ ID NO: 4064436 - RNA, 13 nt, Vaccinia virus
aagaauucuuaug

SEQ ID NO: 4064437 - RNA, 15 nt, Vaccinia virus
aagacaauaaagaua

SEQ ID NO: 4064438 - RNA, 16 nt, Vaccinia virus
aagacaauauuaucau

SEQ ID NO: 4064439 - RNA, 16 nt, Vaccinia virus
aagacaaucauuuacu

SEQ ID NO: 4064440 - RNA, 18 nt, Vaccinia virus
aagaccaauuaacgauga

SEQ ID NO: 4064441 - RNA, 19 nt, Vaccinia virus
aagaccgaauacauaacag

SEQ ID NO: 4064442 - RNA, 21 nt, Vaccinia virus
aagacgaggagauuuagaaau

SEQ ID NO: 4064443 - RNA, 14 nt, Vaccinia virus
aagacuuaaaacuu

SEQ ID NO: 4064444 - RNA, 23 nt, Vaccinia virus
aagagauuccugacuuugcauuc

SEQ ID NO: 4064445 - RNA, 13 nt, Vaccinia virus
aagaggauuuucu

SEQ ID NO: 4064446 - RNA, 22 nt, Vaccinia virus
aagauauccagaguuuagauua

SEQ ID NO: 4064447 - RNA, 15 nt, Vaccinia virus
aagauaucugguucu

SEQ ID NO: 4064448 - RNA, 13 nt, Vaccinia virus
aagaucaaccaaa

SEQ ID NO: 4064449 - RNA, 14 nt, Vaccinia virus
aagaucaaggaaau

SEQ ID NO: 4064450 - RNA, 22 nt, Vaccinia virus
aagaugcaaacauuauguagua

SEQ ID NO: 4064451 - RNA, 18 nt, Vaccinia virus
aagauggaguauaaucuu

SEQ ID NO: 4064452 - RNA, 21 nt, Vaccinia virus
aagauguuuucugucagaaaa

SEQ ID NO: 4064453 - RNA, 21 nt, Vaccinia virus
aagauuaacuccauaaugucu

SEQ ID NO: 4064454 - RNA, 13 nt, Vaccinia virus
aagauuaguaaau

SEQ ID NO: 4064455 - RNA, 15 nt, Vaccinia virus
aagauuccuaaauua

SEQ ID NO: 4064456 - RNA, 14 nt, Vaccinia virus
aagauuguuuaaga

SEQ ID NO: 4064457 - RNA, 15 nt, Vaccinia virus
aagauuuauauaucu

SEQ ID NO: 4064458 - RNA, 20 nt, Vaccinia virus
aagauuucaucuauaucauu

SEQ ID NO: 4064459 - RNA, 23 nt, Vaccinia virus
aagcacucguuauuaauacaagu

SEQ ID NO: 4064460 - RNA, 17 nt, Vaccinia virus
aagcauaauacucuguu

SEQ ID NO: 4064461 - RNA, 18 nt, Vaccinia virus
aagccuuaugcauccaaa

SEQ ID NO: 4064462 - RNA, 14 nt, Vaccinia virus
aagcgguuaaauca

SEQ ID NO: 4064463 - RNA, 12 nt, Vaccinia virus
aagcuauguaaa

SEQ ID NO: 4064464 - RNA, 16 nt, Vaccinia virus
aagcuucguuguagaa

SEQ ID NO: 4064465 - RNA, 14 nt, Vaccinia virus
aaggaaaaugaaca

SEQ ID NO: 4064466 - RNA, 17 nt, Vaccinia virus
aaggaauauacaaaguu

SEQ ID NO: 4064467 - RNA, 12 nt, Vaccinia virus
aaggacaaaaug

SEQ ID NO: 4064468 - RNA, 15 nt, Vaccinia virus
aaggacauuguaaau

SEQ ID NO: 4064469 - RNA, 16 nt, Vaccinia virus
aaggcauuuggucuau

SEQ ID NO: 4064470 - RNA, 16 nt, Vaccinia virus
aaggcgguauauguau

SEQ ID NO: 4064471 - RNA, 15 nt, Vaccinia virus
aaggggugagaaugu

SEQ ID NO: 4064472 - RNA, 15 nt, Vaccinia virus
aagguauacgaaugu

SEQ ID NO: 4064473 - RNA, 15 nt, Vaccinia virus
aagguguuaaaauua

SEQ ID NO: 4064474 - RNA, 19 nt, Vaccinia virus
aagguuagcgcucagaaua

SEQ ID NO: 4064475 - RNA, 15 nt, Vaccinia virus
aaguaaacaauuuua

SEQ ID NO: 4064476 - RNA, 12 nt, Vaccinia virus
aaguaaauacug

SEQ ID NO: 4064477 - RNA, 11 nt, Vaccinia virus
aaguaaaugaa

SEQ ID NO: 4064478 - RNA, 20 nt, Vaccinia virus
aaguaauuauaguauaaugu

SEQ ID NO: 4064479 - RNA, 14 nt, Vaccinia virus
aaguacagaauuaa

SEQ ID NO: 4064480 - RNA, 18 nt, Vaccinia virus
aaguacagauuuuagaaa

SEQ ID NO: 4064481 - RNA, 19 nt, Vaccinia virus
aaguauagcuaaugaugcg

SEQ ID NO: 4064482 - RNA, 22 nt, Vaccinia virus
aaguaugaagaaaaauguugug

SEQ ID NO: 4064483 - RNA, 12 nt, Vaccinia virus
aaguaugauaca

SEQ ID NO: 4064484 - RNA, 15 nt, Vaccinia virus
ugaggaaugagagug

SEQ ID NO: 4064485 - RNA, 16 nt, Vaccinia virus
ugaggauuuaaaacuc

SEQ ID NO: 4064486 - RNA, 20 nt, Vaccinia virus
ugaguauugguauuacuaua

SEQ ID NO: 4064487 - RNA, 14 nt, Vaccinia virus
ugaguguagaugcu

SEQ ID NO: 4064488 - RNA, 21 nt, Vaccinia virus
ugaguuccuuguuuuugcuaa

SEQ ID NO: 4064489 - RNA, 18 nt, Vaccinia virus
ugauaaacacguuagagu

SEQ ID NO: 4064490 - RNA, 12 nt, Vaccinia virus
ugauaaaccauc

SEQ ID NO: 4064491 - RNA, 22 nt, Vaccinia virus
ugauaaauauacaauagaugca

SEQ ID NO: 4064492 - RNA, 16 nt, Vaccinia virus
ugauaacacauauuca

SEQ ID NO: 4064493 - RNA, 17 nt, Vaccinia virus
ugauaacuucaggaaau

SEQ ID NO: 4064494 - RNA, 15 nt, Vaccinia virus
ugauaccaugaaauu

SEQ ID NO: 4064495 - RNA, 15 nt, Vaccinia virus
ugauacguauauaca

SEQ ID NO: 4064496 - RNA, 16 nt, Vaccinia virus
ugauacguauauacac

SEQ ID NO: 4064497 - RNA, 19 nt, Vaccinia virus
ugauacucuuauagaugua

SEQ ID NO: 4064498 - RNA, 19 nt, Vaccinia virus
ugauagagguaaacuucua

SEQ ID NO: 4064499 - RNA, 12 nt, Vaccinia virus
ugauagcaagga

SEQ ID NO: 4064500 - RNA, 20 nt, Vaccinia virus
ugauagcaauucauguacca

SEQ ID NO: 4064501 - RNA, 22 nt, Vaccinia virus
ugauagugaaugaaucagauag

SEQ ID NO: 4064502 - RNA, 16 nt, Vaccinia virus
ugauauacuaagcaag

SEQ ID NO: 4064503 - RNA, 18 nt, Vaccinia virus
ugauauagcauugcgcau

SEQ ID NO: 4064504 - RNA, 16 nt, Vaccinia virus
ugauauaucuaguguu

SEQ ID NO: 4064505 - RNA, 14 nt, Vaccinia virus
ugauauauuuucca

SEQ ID NO: 4064506 - RNA, 17 nt, Vaccinia virus
ugauauccgcgaacgau

SEQ ID NO: 4064507 - RNA, 17 nt, Vaccinia virus
ugauaucgagaacagau

SEQ ID NO: 4064508 - RNA, 22 nt, Vaccinia virus
ugauaucuacaucguuuggauu

SEQ ID NO: 4064509 - RNA, 23 nt, Vaccinia virus
ugauaucuauaauaggguaucua

SEQ ID NO: 4064510 - RNA, 21 nt, Vaccinia virus
ugauaugauuaucguuuucau

SEQ ID NO: 4064511 - RNA, 16 nt, Vaccinia virus
ugauauguguaagaac

SEQ ID NO: 4064512 - RNA, 20 nt, Vaccinia virus
ugauauguguaagaacucuc

SEQ ID NO: 4064513 - RNA, 15 nt, Vaccinia virus
ugauauuacuuauaa

SEQ ID NO: 4064514 - RNA, 19 nt, Vaccinia virus
ugauauuacuuauaauaac

SEQ ID NO: 4064515 - RNA, 14 nt, Vaccinia virus
ugauauuucauaua

SEQ ID NO: 4064516 - RNA, 20 nt, Vaccinia virus
ugauauuucauugacagaua

SEQ ID NO: 4064517 - RNA, 18 nt, Vaccinia virus
ugaucacauuuagauaaa

SEQ ID NO: 4064518 - RNA, 16 nt, Vaccinia virus
ugaucaggaaaguuua

SEQ ID NO: 4064519 - RNA, 20 nt, Vaccinia virus
ugaucaugugagaauacuaa

SEQ ID NO: 4064520 - RNA, 20 nt, Vaccinia virus
ugaucauuggcaaaauccua

SEQ ID NO: 4064521 - RNA, 12 nt, Vaccinia virus
ugauccacaaaa

SEQ ID NO: 4064522 - RNA, 15 nt, Vaccinia virus
ugauccuuuuccaga

SEQ ID NO: 4064523 - RNA, 16 nt, Vaccinia virus
ugaucuaacuaagaua

SEQ ID NO: 4064524 - RNA, 16 nt, Vaccinia virus
ugaucucguguguaca

SEQ ID NO: 4064525 - RNA, 17 nt, Vaccinia virus
ugaugacacuagaugau

SEQ ID NO: 4064526 - RNA, 13 nt, Vaccinia virus
ugaugauaauguu

SEQ ID NO: 4064527 - RNA, 23 nt, Vaccinia virus
ugaugauuagauggagaguauau

SEQ ID NO: 4064528 - RNA, 14 nt, Vaccinia virus
ugaugcaugcgaua

SEQ ID NO: 4064529 - RNA, 19 nt, Vaccinia virus
ugaugcauucgacucaaca

SEQ ID NO: 4064530 - RNA, 17 nt, Vaccinia virus
ugaugccgguaaauguu

SEQ ID NO: 4064531 - RNA, 16 nt, Vaccinia virus
ugaugcugguucugga

SEQ ID NO: 4064532 - RNA, 17 nt, Vaccinia virus
ugauggguguacaauca

SEQ ID NO: 4064533 - RNA, 19 nt, Vaccinia virus
ugaugguuuucuaaauaga

SEQ ID NO: 4064534 - RNA, 22 nt, Vaccinia virus
ugauguaagauccaaacgagga

SEQ ID NO: 4064535 - RNA, 16 nt, Vaccinia virus
ugaugucaucuuccag

SEQ ID NO: 4064536 - RNA, 19 nt, Vaccinia virus
ugaugucguuauucugaaa

SEQ ID NO: 4064537 - RNA, 22 nt, Vaccinia virus
ugauuaaguauuguuuuuucau

SEQ ID NO: 4064538 - RNA, 17 nt, Vaccinia virus
ugauuacauuuuugaua

SEQ ID NO: 4064539 - RNA, 14 nt, Vaccinia virus
ugauuagaaaauau

SEQ ID NO: 4064540 - RNA, 15 nt, Vaccinia virus
ugauuagaauucauc

SEQ ID NO: 4064541 - RNA, 16 nt, Vaccinia virus
ugauuauaguuucuau

SEQ ID NO: 4064542 - RNA, 23 nt, Vaccinia virus
ugauuauucuauaaguauagaua

SEQ ID NO: 4064543 - RNA, 14 nt, Vaccinia virus
ugauuauuuacuau

SEQ ID NO: 4064544 - RNA, 17 nt, Vaccinia virus
ugauucauucacuauca

SEQ ID NO: 4064545 - RNA, 23 nt, Vaccinia virus
ugauucuccagccgaaacauauu

SEQ ID NO: 4064546 - RNA, 13 nt, Vaccinia virus
ugauugaacgauu

SEQ ID NO: 4064547 - RNA, 13 nt, Vaccinia virus
ugauuuacucauu

SEQ ID NO: 4064548 - RNA, 20 nt, Vaccinia virus
ugauuucguuagucauauua

SEQ ID NO: 4064549 - RNA, 23 nt, Vaccinia virus
ugauuuugaugauaauguuacca

SEQ ID NO: 4064550 - RNA, 22 nt, Vaccinia virus
ugcaaaauaugcucuagauacu

SEQ ID NO: 4064551 - RNA, 17 nt, Vaccinia virus
ugcaaggaaucaucuga

SEQ ID NO: 4064552 - RNA, 20 nt, Vaccinia virus
ugcacgacuacuuuguuaau

SEQ ID NO: 4064553 - RNA, 14 nt, Vaccinia virus
ugcacucaugauuc

SEQ ID NO: 4064554 - RNA, 20 nt, Vaccinia virus
ugcauccaugcagcauuucc

SEQ ID NO: 4064555 - RNA, 15 nt, Vaccinia virus
ugcaucuacaucauc

SEQ ID NO: 4064556 - RNA, 23 nt, Vaccinia virus
ugcaucuauauaaucuuuuucau

SEQ ID NO: 4064557 - RNA, 15 nt, Vaccinia virus
ugcaucuauaugucc

SEQ ID NO: 4064558 - RNA, 22 nt, Vaccinia virus
ugcauuaguaagugccacaaaa

SEQ ID NO: 4064559 - RNA, 11 nt, Vaccinia virus
ugcauucaaau

SEQ ID NO: 4064560 - RNA, 17 nt, Vaccinia virus
ugcauucguuuaaagau

SEQ ID NO: 4064561 - RNA, 16 nt, Vaccinia virus
ugccaaguacauaaau

SEQ ID NO: 4064562 - RNA, 18 nt, Vaccinia virus
ugccauaaauaaaugcuu

SEQ ID NO: 4064563 - RNA, 14 nt, Vaccinia virus
ugccauaauaauua

SEQ ID NO: 4064564 - RNA, 13 nt, Vaccinia virus
ugccauagauucu

SEQ ID NO: 4064565 - RNA, 17 nt, Vaccinia virus
ugccauaucauacauga

SEQ ID NO: 4064566 - RNA, 22 nt, Vaccinia virus
ugccguuuauaggucuagccac

SEQ ID NO: 4064567 - RNA, 15 nt, Vaccinia virus
ugcgacacuauucau

SEQ ID NO: 4064568 - RNA, 11 nt, Vaccinia virus
ugcgauacauu

SEQ ID NO: 4064569 - RNA, 14 nt, Vaccinia virus
ugcgaucugaauaa

SEQ ID NO: 4064570 - RNA, 15 nt, Vaccinia virus
ugcgugacagcacag

SEQ ID NO: 4064571 - RNA, 18 nt, Vaccinia virus
ugcuaaacuuuauguacu

SEQ ID NO: 4064572 - RNA, 14 nt, Vaccinia virus
ugcuaauuauuccu

SEQ ID NO: 4064573 - RNA, 12 nt, Vaccinia virus
ugcuaauuauuu

SEQ ID NO: 4064574 - RNA, 13 nt, Vaccinia virus
ugcuacgcaaaua

SEQ ID NO: 4064575 - RNA, 19 nt, Vaccinia virus
ugcuagacaccuuuucaau

SEQ ID NO: 4064576 - RNA, 23 nt, Vaccinia virus
ugcuauaucucuuccguuuauua

SEQ ID NO: 4064577 - RNA, 16 nt, Vaccinia virus
ugcuauccaucagaau

SEQ ID NO: 4064578 - RNA, 20 nt, Vaccinia virus
ugcucaaacaaaaugugaua

SEQ ID NO: 4064579 - RNA, 13 nt, Vaccinia virus
ugcuccaugauuu

SEQ ID NO: 4064580 - RNA, 22 nt, Vaccinia virus
ugcucgacaguguauacuauuu

SEQ ID NO: 4064581 - RNA, 22 nt, Vaccinia virus
ugcucggcaguaaucaacaaua

SEQ ID NO: 4064582 - RNA, 21 nt, Vaccinia virus
ugcugcaacaauucagacucc

SEQ ID NO: 4064583 - RNA, 21 nt, Vaccinia virus
ugcuguguguaugaaaugcuu

SEQ ID NO: 4064584 - RNA, 22 nt, Vaccinia virus
ugcuuaauacaccguuaacaau

SEQ ID NO: 4064585 - RNA, 18 nt, Vaccinia virus
ugcuucaacgaggaagau

SEQ ID NO: 4064586 - RNA, 23 nt, Vaccinia virus
ugcuucguuuaaauaauauauca

SEQ ID NO: 4064587 - RNA, 21 nt, Vaccinia virus
uggaaaaaggauggaaagaua

SEQ ID NO: 4064588 - RNA, 13 nt, Vaccinia virus
uggaaaaaugaug

SEQ ID NO: 4064589 - RNA, 21 nt, Vaccinia virus
uggaaaaaugaugaauuaaug

SEQ ID NO: 4064590 - RNA, 22 nt, Vaccinia virus
uggaaaagaauuuaccagauau

SEQ ID NO: 4064591 - RNA, 17 nt, Vaccinia virus
uggaaacuauaauuuug

SEQ ID NO: 4064592 - RNA, 22 nt, Vaccinia virus
uggaaacuauguuuuuuauuag

SEQ ID NO: 4064593 - RNA, 15 nt, Vaccinia virus
uggaaagaugcuguu

SEQ ID NO: 4064594 - RNA, 22 nt, Vaccinia virus
uggaaauaucugugaauacuuu

SEQ ID NO: 4064595 - RNA, 18 nt, Vaccinia virus
uggaacaaaacaaugacg

SEQ ID NO: 4064596 - RNA, 14 nt, Vaccinia virus
uggaacauaagaua

SEQ ID NO: 4064597 - RNA, 22 nt, Vaccinia virus
uggaagacagcgugaauaaugu

SEQ ID NO: 4064598 - RNA, 17 nt, Vaccinia virus
uggaagguuuguauucu

SEQ ID NO: 4064599 - RNA, 17 nt, Vaccinia virus
uggaauauaucuauaau

SEQ ID NO: 4064600 - RNA, 13 nt, Vaccinia virus
uggaaucaauaau

SEQ ID NO: 4064601 - RNA, 12 nt, Vaccinia virus
uggaaucacaaa

SEQ ID NO: 4064602 - RNA, 21 nt, Vaccinia virus
uggaaucagaagaugauucca

SEQ ID NO: 4064603 - RNA, 21 nt, Vaccinia virus
uggaaucaucuucugauucca

SEQ ID NO: 4064604 - RNA, 23 nt, Vaccinia virus
uuuauauauugcuuacuagaugu

SEQ ID NO: 4064605 - RNA, 21 nt, Vaccinia virus
uuuauaucauuuguuuuaauu

SEQ ID NO: 4064606 - RNA, 22 nt, Vaccinia virus
uuuaucuuuaacgauaccuaua

SEQ ID NO: 4064607 - RNA, 15 nt, Vaccinia virus
uuuaugcuucguaaa

SEQ ID NO: 4064608 - RNA, 12 nt, Vaccinia virus
uuuauuauucuu

SEQ ID NO: 4064609 - RNA, 23 nt, Vaccinia virus
uuuauuggagacguaacaaugua

SEQ ID NO: 4064610 - RNA, 11 nt, Vaccinia virus
uuuauuucuag

SEQ ID NO: 4064611 - RNA, 11 nt, Vaccinia virus
uuucaaagaug

SEQ ID NO: 4064612 - RNA, 16 nt, Vaccinia virus
uuucacccauaaauaa

SEQ ID NO: 4064613 - RNA, 17 nt, Vaccinia virus
uuucacuuuaucucauu

SEQ ID NO: 4064614 - RNA, 19 nt, Vaccinia virus
uuucagcguggauuucuca

SEQ ID NO: 4064615 - RNA, 14 nt, Vaccinia virus
uuucagucauugau

SEQ ID NO: 4064616 - RNA, 21 nt, Vaccinia virus
uuucauaauauuaucaaaaga

SEQ ID NO: 4064617 - RNA, 12 nt, Vaccinia virus
uuucauacauau

SEQ ID NO: 4064618 - RNA, 22 nt, Vaccinia virus
uuucaucuuucuccaauacuaa

SEQ ID NO: 4064619 - RNA, 22 nt, Vaccinia virus
uuucauuccaggaucuagauaa

SEQ ID NO: 4064620 - RNA, 13 nt, Vaccinia virus
uuucccauacuaa

SEQ ID NO: 4064621 - RNA, 15 nt, Vaccinia virus
uuucgaauacuuauu

SEQ ID NO: 4064622 - RNA, 19 nt, Vaccinia virus
uuucuacccauaaguuauc

SEQ ID NO: 4064623 - RNA, 15 nt, Vaccinia virus
uuucuacuagacuau

SEQ ID NO: 4064624 - RNA, 11 nt, Vaccinia virus
uuucuagauac

SEQ ID NO: 4064625 - RNA, 17 nt, Vaccinia virus
uuucuauuucuuucaug

SEQ ID NO: 4064626 - RNA, 15 nt, Vaccinia virus
uuucuggcuaagaag

SEQ ID NO: 4064627 - RNA, 15 nt, Vaccinia virus
uuucuuuaacaaauu

SEQ ID NO: 4064628 - RNA, 15 nt, Vaccinia virus
uuucuuuuuaaugau

SEQ ID NO: 4064629 - RNA, 13 nt, Vaccinia virus
uuugaacaucuug

SEQ ID NO: 4064630 - RNA, 18 nt, Vaccinia virus
uuugagagaucauuucua

SEQ ID NO: 4064631 - RNA, 19 nt, Vaccinia virus
uuugagagaucauuucuau

SEQ ID NO: 4064632 - RNA, 21 nt, Vaccinia virus
uuugauaggaucuauaaugua

SEQ ID NO: 4064633 - RNA, 22 nt, Vaccinia virus
uuugauauacuaagcaaguaca

SEQ ID NO: 4064634 - RNA, 13 nt, Vaccinia virus
uuugauucgaauu

SEQ ID NO: 4064635 - RNA, 20 nt, Vaccinia virus
uuugauuugcuuugaaugau

SEQ ID NO: 4064636 - RNA, 23 nt, Vaccinia virus
uacgucucagaauucuaaaugau

SEQ ID NO: 4064637 - RNA, 21 nt, Vaccinia virus
uacguuagguauguaccacau

SEQ ID NO: 4064638 - RNA, 17 nt, Vaccinia virus
uacguuucuauuuucua

SEQ ID NO: 4064639 - RNA, 16 nt, Vaccinia virus
uacuaaagcaaaggua

SEQ ID NO: 4064640 - RNA, 20 nt, Vaccinia virus
uacuacagaaacuaauauag

SEQ ID NO: 4064641 - RNA, 16 nt, Vaccinia virus
uacuagaauaaagcag

SEQ ID NO: 4064642 - RNA, 22 nt, Vaccinia virus
uacuagacugacuucuaacaaa

SEQ ID NO: 4064643 - RNA, 15 nt, Vaccinia virus
uacuagauguuguaa

SEQ ID NO: 4064644 - RNA, 21 nt, Vaccinia virus
uacuagccuacugccuauuaa

SEQ ID NO: 4064645 - RNA, 17 nt, Vaccinia virus
uacuaggagaauuauuu

SEQ ID NO: 4064646 - RNA, 12 nt, Vaccinia virus
uacuaucagaaa

SEQ ID NO: 4064647 - RNA, 16 nt, Vaccinia virus
uacuaucguaaugggg

SEQ ID NO: 4064648 - RNA, 18 nt, Vaccinia virus
uacuauuuguaauauuua

SEQ ID NO: 4064649 - RNA, 21 nt, Vaccinia virus
uacucagauucaguuucucau

SEQ ID NO: 4064650 - RNA, 14 nt, Vaccinia virus
uacucauuaucauu

SEQ ID NO: 4064651 - RNA, 18 nt, Vaccinia virus
uacucauuuaacagaugu

SEQ ID NO: 4064652 - RNA, 24 nt, Vaccinia virus
uacuccaaaaaacaaaauaacuag

SEQ ID NO: 4064653 - RNA, 20 nt, Vaccinia virus
uacuccucauuacguuucau

SEQ ID NO: 4064654 - RNA, 18 nt, Vaccinia virus
uacucuauucgaaaacuc

SEQ ID NO: 4064655 - RNA, 19 nt, Vaccinia virus
uacucucuauaacaaauau

SEQ ID NO: 4064656 - RNA, 15 nt, Vaccinia virus
uacucuuaagagagc

SEQ ID NO: 4064657 - RNA, 12 nt, Vaccinia virus
uacugcaauaau

SEQ ID NO: 4064658 - RNA, 22 nt, Vaccinia virus
uacuguuuacggagacaaaauu

SEQ ID NO: 4064659 - RNA, 15 nt, Vaccinia virus
uacuuaaaaaaugaa

SEQ ID NO: 4064660 - RNA, 14 nt, Vaccinia virus
uacuuacuuuagaa

SEQ ID NO: 4064661 - RNA, 15 nt, Vaccinia virus
uacuuaucauuuacu

SEQ ID NO: 4064662 - RNA, 17 nt, Vaccinia virus
uacuuauguaugugcau

SEQ ID NO: 4064663 - RNA, 17 nt, Vaccinia virus
uacuucagguuucuuag

SEQ ID NO: 4064664 - RNA, 14 nt, Vaccinia virus
uacuucauaaaaga

SEQ ID NO: 4064665 - RNA, 22 nt, Vaccinia virus
uacuucuccaaucauauagaua

SEQ ID NO: 4064666 - RNA, 14 nt, Vaccinia virus
uacuuguacacaua

SEQ ID NO: 4064667 - RNA, 16 nt, Vaccinia virus
uacuuucaugauuuca

SEQ ID NO: 4064668 - RNA, 13 nt, Vaccinia virus
uacuuuucuaaau

SEQ ID NO: 4064669 - RNA, 19 nt, Vaccinia virus
uacuuuuucaucuuuacau

SEQ ID NO: 4064670 - RNA, 14 nt, Vaccinia virus
uacuuuuucucaua

SEQ ID NO: 4064671 - RNA, 19 nt, Vaccinia virus
uagaaaaacuauaucuaug

SEQ ID NO: 4064672 - RNA, 13 nt, Vaccinia virus
uagaaaaacuuua

SEQ ID NO: 4064673 - RNA, 15 nt, Vaccinia virus
uagaaaacagagaua

SEQ ID NO: 4064674 - RNA, 23 nt, Vaccinia virus
uagaaaauaucacgcuuuccauu

SEQ ID NO: 4064675 - RNA, 14 nt, Vaccinia virus
uagaaaauggauuu

SEQ ID NO: 4064676 - RNA, 16 nt, Vaccinia virus
uagaaaauucuaaggu

SEQ ID NO: 4064677 - RNA, 21 nt, Vaccinia virus
uagaaaccacggaucguaaua

SEQ ID NO: 4064678 - RNA, 21 nt, Vaccinia virus
uagaaacgauaccaucuucug

SEQ ID NO: 4064679 - RNA, 17 nt, Vaccinia virus
uagaaacuauacgaaau

SEQ ID NO: 4064680 - RNA, 22 nt, Vaccinia virus
uagaaauaagagacuuaaacaa

SEQ ID NO: 4064681 - RNA, 14 nt, Vaccinia virus
uagaaauacaaaag

SEQ ID NO: 4064682 - RNA, 12 nt, Vaccinia virus
uagaaauacuua

SEQ ID NO: 4064683 - RNA, 18 nt, Vaccinia virus
uagaacagauuuaacaau

SEQ ID NO: 4064684 - RNA, 18 nt, Vaccinia virus
uagaacgaugucaaaaua

SEQ ID NO: 4064685 - RNA, 14 nt, Vaccinia virus
uagaacucuuuuca

SEQ ID NO: 4064686 - RNA, 17 nt, Vaccinia virus
uagaacuuaucaaagaa

SEQ ID NO: 4064687 - RNA, 15 nt, Vaccinia virus
uagaagaucauacag

SEQ ID NO: 4064688 - RNA, 18 nt, Vaccinia virus
uagaaggaaaaucaucau

SEQ ID NO: 4064689 - RNA, 15 nt, Vaccinia virus
uagaagucaaggaua

SEQ ID NO: 4064690 - RNA, 23 nt, Vaccinia virus
uagaagucugaucuuaacuccuc

SEQ ID NO: 4064691 - RNA, 18 nt, Vaccinia virus
uagaaguuguaaaugaca

SEQ ID NO: 4064692 - RNA, 17 nt, Vaccinia virus
uagaauaaauauccuug

SEQ ID NO: 4064693 - RNA, 19 nt, Vaccinia virus
uagaauaucuccucaagga

SEQ ID NO: 4064694 - RNA, 13 nt, Vaccinia virus
uagaaucaaagga

SEQ ID NO: 4064695 - RNA, 17 nt, Vaccinia virus
uagaaucguccauagca

SEQ ID NO: 4064696 - RNA, 22 nt, Vaccinia virus
uagaaucucuauuugccaauau

SEQ ID NO: 4064697 - RNA, 15 nt, Vaccinia virus
uagaaugaagaaugc

SEQ ID NO: 4064698 - RNA, 21 nt, Vaccinia virus
uagaauguuaucgaugaugua

SEQ ID NO: 4064699 - RNA, 11 nt, Vaccinia virus
uagaauuuaua

SEQ ID NO: 4064700 - RNA, 13 nt, Vaccinia virus
uagacaaaacuau

SEQ ID NO: 4064701 - RNA, 16 nt, Vaccinia virus
uagacaacaggaugaa

SEQ ID NO: 4064702 - RNA, 21 nt, Vaccinia virus
uagacaaugcuaauauauucu

SEQ ID NO: 4064703 - RNA, 21 nt, Vaccinia virus
uagacauaaaaacuaauauua

SEQ ID NO: 4064704 - RNA, 14 nt, Vaccinia virus
uagacauaauacua

SEQ ID NO: 4064705 - RNA, 15 nt, Vaccinia virus
uagacauuaauagaa

SEQ ID NO: 4064706 - RNA, 13 nt, Vaccinia virus
uagacauuuacca

SEQ ID NO: 4064707 - RNA, 14 nt, Vaccinia virus
uagaccuguagccg

SEQ ID NO: 4064708 - RNA, 18 nt, Vaccinia virus
uagacgaggaaacaaugc

SEQ ID NO: 4064709 - RNA, 20 nt, Vaccinia virus
uagacgagggguuagauggu

SEQ ID NO: 4064710 - RNA, 14 nt, Vaccinia virus
uagacgauaugaca

SEQ ID NO: 4064711 - RNA, 17 nt, Vaccinia virus
uagagagguacguguaa

SEQ ID NO: 4064712 - RNA, 13 nt, Vaccinia virus
uagagaucuaauu

SEQ ID NO: 4064713 - RNA, 12 nt, Vaccinia virus
uagagaugaugc

SEQ ID NO: 4064714 - RNA, 20 nt, Vaccinia virus
uagagauuguuaaauuauua

SEQ ID NO: 4064715 - RNA, 21 nt, Vaccinia virus
uagagcccacguuuaaacauu

SEQ ID NO: 4064716 - RNA, 22 nt, Vaccinia virus
uagagcccacguuuaaacauuc

SEQ ID NO: 4064717 - RNA, 14 nt, Vaccinia virus
uagagcucgaugau

SEQ ID NO: 4064718 - RNA, 14 nt, Vaccinia virus
uagagguagcaaaa

SEQ ID NO: 4064719 - RNA, 16 nt, Vaccinia virus
uagaguagacauuaau

SEQ ID NO: 4064720 - RNA, 15 nt, Vaccinia virus
uagauaaaauacuga

SEQ ID NO: 4064721 - RNA, 20 nt, Vaccinia virus
gucaaucuuauucaagcaaa

SEQ ID NO: 4064722 - RNA, 13 nt, Vaccinia virus
gucaauugauucu

SEQ ID NO: 4064723 - RNA, 12 nt, Vaccinia virus
gucacacgcucc

SEQ ID NO: 4064724 - RNA, 14 nt, Vaccinia virus
gucacgaugaugga

SEQ ID NO: 4064725 - RNA, 14 nt, Vaccinia virus
gucaggaaauguau

SEQ ID NO: 4064726 - RNA, 18 nt, Vaccinia virus
gucaugauuaguauuuua

SEQ ID NO: 4064727 - RNA, 14 nt, Vaccinia virus
gucauguuggaaca

SEQ ID NO: 4064728 - RNA, 20 nt, Vaccinia virus
gucauugaaggauaaacucg

SEQ ID NO: 4064729 - RNA, 13 nt, Vaccinia virus
guccaaugauugc

SEQ ID NO: 4064730 - RNA, 16 nt, Vaccinia virus
guccaucauuacagaa

SEQ ID NO: 4064731 - RNA, 16 nt, Vaccinia virus
guccauuaucaguaau

SEQ ID NO: 4064732 - RNA, 13 nt, Vaccinia virus
guccguacuuauu

SEQ ID NO: 4064733 - RNA, 15 nt, Vaccinia virus
guccguuauauaauc

SEQ ID NO: 4064734 - RNA, 18 nt, Vaccinia virus
guccuaaucucuuaacaa

SEQ ID NO: 4064735 - RNA, 23 nt, Vaccinia virus
guccuaaugccuaugauguguuu

SEQ ID NO: 4064736 - RNA, 15 nt, Vaccinia virus
gucgagguuuaaaaa

SEQ ID NO: 4064737 - RNA, 18 nt, Vaccinia virus
gucgauaaaaauuaaaaa

SEQ ID NO: 4064738 - RNA, 14 nt, Vaccinia virus
gucgauaacaaauu

SEQ ID NO: 4064739 - RNA, 14 nt, Vaccinia virus
gucgauauacuuau

SEQ ID NO: 4064740 - RNA, 16 nt, Vaccinia virus
gucggaggauguguua

SEQ ID NO: 4064741 - RNA, 19 nt, Vaccinia virus
gucuaaaccuucuuauucu

SEQ ID NO: 4064742 - RNA, 21 nt, Vaccinia virus
gucuagaauaucacauacuga

SEQ ID NO: 4064743 - RNA, 20 nt, Vaccinia virus
gucuaguaaguagaaauuau

SEQ ID NO: 4064744 - RNA, 13 nt, Vaccinia virus
gucuauaguucuc

SEQ ID NO: 4064745 - RNA, 20 nt, Vaccinia virus
gucuauccauuguuucacau

SEQ ID NO: 4064746 - RNA, 18 nt, Vaccinia virus
gucucagaauucuaaaug

SEQ ID NO: 4064747 - RNA, 13 nt, Vaccinia virus
gucucauagagaa

SEQ ID NO: 4064748 - RNA, 22 nt, Vaccinia virus
gucucauggccguguaugaaau

SEQ ID NO: 4064749 - RNA, 16 nt, Vaccinia virus
gucucuauaaaaauga

SEQ ID NO: 4064750 - RNA, 14 nt, Vaccinia virus
gucuggauuaaucu

SEQ ID NO: 4064751 - RNA, 15 nt, Vaccinia virus
gucuggauuaaucug

SEQ ID NO: 4064752 - RNA, 16 nt, Vaccinia virus
gucuuacacauucgcu

SEQ ID NO: 4064753 - RNA, 11 nt, Vaccinia virus
gucuuuucuaa

SEQ ID NO: 4064754 - RNA, 19 nt, Vaccinia virus
gugaaaauuacauacuuaa

SEQ ID NO: 4064755 - RNA, 14 nt, Vaccinia virus
gugacguacaaaaa

SEQ ID NO: 4064756 - RNA, 14 nt, Vaccinia virus
gugaucaucuucau

SEQ ID NO: 4064757 - RNA, 23 nt, Vaccinia virus
gugauccuauaaacaugaauuua

SEQ ID NO: 4064758 - RNA, 17 nt, Vaccinia virus
gugauggauuuaaacau

SEQ ID NO: 4064759 - RNA, 16 nt, Vaccinia virus
gugauguuguaacacu

SEQ ID NO: 4064760 - RNA, 13 nt, Vaccinia virus
gugauuuuccaac

SEQ ID NO: 4064761 - RNA, 13 nt, Vaccinia virus
gugcaaaugaggu

SEQ ID NO: 4064762 - RNA, 18 nt, Vaccinia virus
gugcaaggaaucaucuga

SEQ ID NO: 4064763 - RNA, 20 nt, Vaccinia virus
gugcaauuagauccaaagaa

SEQ ID NO: 4064764 - RNA, 23 nt, Vaccinia virus
gugcauaaauuaagauacaacaa

SEQ ID NO: 4064765 - RNA, 14 nt, Vaccinia virus
gugcauaucuuuuu

SEQ ID NO: 4064766 - RNA, 15 nt, Vaccinia virus
gugcgcugaggucgg

SEQ ID NO: 4064767 - RNA, 22 nt, Vaccinia virus
gugcuauuagaauuuacaaaac

SEQ ID NO: 4064768 - RNA, 13 nt, Vaccinia virus
gugcuguaacauu

SEQ ID NO: 4064769 - RNA, 14 nt, Vaccinia virus
gugcuuaauguuuc

SEQ ID NO: 4064770 - RNA, 13 nt, Vaccinia virus
guggacauuuaac

SEQ ID NO: 4064771 - RNA, 20 nt, Vaccinia virus
guggauacaaugaguauuua

SEQ ID NO: 4064772 - RNA, 12 nt, Vaccinia virus
gugggaugaugu

SEQ ID NO: 4064773 - RNA, 15 nt, Vaccinia virus
gugguagauauauag

SEQ ID NO: 4064774 - RNA, 18 nt, Vaccinia virus
gugguauuggauagaauu

SEQ ID NO: 4064775 - RNA, 18 nt, Vaccinia virus
gugguguaacaauaucuu

SEQ ID NO: 4064776 - RNA, 17 nt, Vaccinia virus
guguauaaaauauacug

SEQ ID NO: 4064777 - RNA, 15 nt, Vaccinia virus
guguauaacaucuuu

SEQ ID NO: 4064778 - RNA, 22 nt, Vaccinia virus
guguauauuuuuucauuuuuua

SEQ ID NO: 4064779 - RNA, 17 nt, Vaccinia virus
guguaucgacaucuuua

SEQ ID NO: 4064780 - RNA, 19 nt, Vaccinia virus
guguauuaaauagaauauu

SEQ ID NO: 4064781 - RNA, 21 nt, Vaccinia virus
guguauuguuuaguucauccu

SEQ ID NO: 4064782 - RNA, 22 nt, Vaccinia virus
guguauuuaaguugguagauuu

SEQ ID NO: 4064783 - RNA, 14 nt, Vaccinia virus
guguccauuuuuua

SEQ ID NO: 4064784 - RNA, 19 nt, Vaccinia virus
guguccguauaccaacaug

SEQ ID NO: 4064785 - RNA, 17 nt, Vaccinia virus
guguccuuuuucauccu

SEQ ID NO: 4064786 - RNA, 18 nt, Vaccinia virus
gugucuuuaaucauguac

SEQ ID NO: 4064787 - RNA, 13 nt, Vaccinia virus
guguguagauauc

SEQ ID NO: 4064788 - RNA, 18 nt, Vaccinia virus
gcaaaucuaguaaaucaa

SEQ ID NO: 4064789 - RNA, 14 nt, Vaccinia virus
gcaaauuauuucuu

SEQ ID NO: 4064790 - RNA, 18 nt, Vaccinia virus
gcaacggauuuaauuuua

SEQ ID NO: 4064791 - RNA, 22 nt, Vaccinia virus
gcaauaacaaagauucuuccuc

SEQ ID NO: 4064792 - RNA, 22 nt, Vaccinia virus
gcaauauaaaugguauauuuua

SEQ ID NO: 4064793 - RNA, 21 nt, Vaccinia virus
gcaauauaucaucuuuucacu

SEQ ID NO: 4064794 - RNA, 19 nt, Vaccinia virus
gcaauggcucuaacaacaa

SEQ ID NO: 4064795 - RNA, 16 nt, Vaccinia virus
gcaauuauauaaugua

SEQ ID NO: 4064796 - RNA, 14 nt, Vaccinia virus
gcaauucauuuucg

SEQ ID NO: 4064797 - RNA, 21 nt, Vaccinia virus
gcacaaucguuccaugauggg

SEQ ID NO: 4064798 - RNA, 16 nt, Vaccinia virus
gcacaaugaaugauau

SEQ ID NO: 4064799 - RNA, 17 nt, Vaccinia virus
gcacauccaucaaagaa

SEQ ID NO: 4064800 - RNA, 19 nt, Vaccinia virus
gcacuaaugcaaauuacuu

SEQ ID NO: 4064801 - RNA, 12 nt, Vaccinia virus
gcacuauuucua

SEQ ID NO: 4064802 - RNA, 16 nt, Vaccinia virus
gcacugguuuaguuca

SEQ ID NO: 4064803 - RNA, 19 nt, Vaccinia virus
gcagacuagaaauaacagg

SEQ ID NO: 4064804 - RNA, 12 nt, Vaccinia virus
gcagaugaugau

SEQ ID NO: 4064805 - RNA, 23 nt, Vaccinia virus
gcagauuguugccguaaauccug

SEQ ID NO: 4064806 - RNA, 16 nt, Vaccinia virus
gcagguacuauaauau

SEQ ID NO: 4064807 - RNA, 19 nt, Vaccinia virus
gcagucauuccaucauuua

SEQ ID NO: 4064808 - RNA, 13 nt, Vaccinia virus
gcauacauagaag

SEQ ID NO: 4064809 - RNA, 20 nt, Vaccinia virus
gcauauuaaaguaaaaucua

SEQ ID NO: 4064810 - RNA, 15 nt, Vaccinia virus
gcauauuagaaucua

SEQ ID NO: 4064811 - RNA, 21 nt, Vaccinia virus
gcauauuccuaaauacaucua

SEQ ID NO: 4064812 - RNA, 18 nt, Vaccinia virus
gcaucagacgcaauaaca

SEQ ID NO: 4064813 - RNA, 17 nt, Vaccinia virus
gcaucauaaaaaugagu

SEQ ID NO: 4064814 - RNA, 23 nt, Vaccinia virus
gcaucauacgaaaauagauucua

SEQ ID NO: 4064815 - RNA, 12 nt, Vaccinia virus
gcauccauccaa

SEQ ID NO: 4064816 - RNA, 21 nt, Vaccinia virus
gcauccuauucgaauaaugag

SEQ ID NO: 4064817 - RNA, 17 nt, Vaccinia virus
gcaucugguacaauaaa

SEQ ID NO: 4064818 - RNA, 20 nt, Vaccinia virus
gcaugguaguucguagauuu

SEQ ID NO: 4064819 - RNA, 22 nt, Vaccinia virus
gcauguagaaugugauaauuau

SEQ ID NO: 4064820 - RNA, 20 nt, Vaccinia virus
gcauguauuuuuuucugaau

SEQ ID NO: 4064821 - RNA, 18 nt, Vaccinia virus
gcauuaauacuguuuucu

SEQ ID NO: 4064822 - RNA, 20 nt, Vaccinia virus
gcauuagaugaaaaauggaa

SEQ ID NO: 4064823 - RNA, 16 nt, Vaccinia virus
gcauuaguaacagcuu

SEQ ID NO: 4064824 - RNA, 16 nt, Vaccinia virus
gcauucuuggaugaau

SEQ ID NO: 4064825 - RNA, 14 nt, Vaccinia virus
gcauuguuaagaca

SEQ ID NO: 4064826 - RNA, 14 nt, Vaccinia virus
gcauuuccaaagaa

SEQ ID NO: 4064827 - RNA, 15 nt, Vaccinia virus
gcauuucuaauacau

SEQ ID NO: 4064828 - RNA, 22 nt, Vaccinia virus
gcauuugugccgcauacagauc

SEQ ID NO: 4064829 - RNA, 16 nt, Vaccinia virus
gccaauugucuuucuc

SEQ ID NO: 4064830 - RNA, 13 nt, Vaccinia virus
gccacaaaugaaa

SEQ ID NO: 4064831 - RNA, 14 nt, Vaccinia virus
gccauuauuagaaa

SEQ ID NO: 4064832 - RNA, 23 nt, Vaccinia virus
gccauuuaguuauugaaauuaau

SEQ ID NO: 4064833 - RNA, 20 nt, Vaccinia virus
gccgauagucucauagucua

SEQ ID NO: 4064834 - RNA, 16 nt, Vaccinia virus
gccuauccaauaaucc

SEQ ID NO: 4064835 - RNA, 22 nt, Vaccinia virus
gccugaguaguuggaagaaucu

SEQ ID NO: 4064836 - RNA, 21 nt, Vaccinia virus
gccuuaauccuagaugaugau

SEQ ID NO: 4064837 - RNA, 16 nt, Vaccinia virus
gccuucgaauaaauaa

SEQ ID NO: 4064838 - RNA, 12 nt, Vaccinia virus
gcgaauauuaaa

SEQ ID NO: 4064839 - RNA, 14 nt, Vaccinia virus
gcgaauuacucugu

SEQ ID NO: 4064840 - RNA, 13 nt, Vaccinia virus
gcgaguguuacaa

SEQ ID NO: 4064841 - RNA, 13 nt, Vaccinia virus
gcggauacaaaac

SEQ ID NO: 4064842 - RNA, 17 nt, Vaccinia virus
gcgguaaacauucaugu

SEQ ID NO: 4064843 - RNA, 19 nt, Vaccinia virus
gcgguuuaauaaauguuuu

SEQ ID NO: 4064844 - RNA, 18 nt, Vaccinia virus
gcguaaaagucaaauuag

SEQ ID NO: 4064845 - RNA, 15 nt, Vaccinia virus
gcguaauguuagccc

SEQ ID NO: 4064846 - RNA, 21 nt, Vaccinia virus
gcguauaaugaaucuaaacuu

SEQ ID NO: 4064847 - RNA, 13 nt, Vaccinia virus
gcguauuuaagag

SEQ ID NO: 4064848 - RNA, 23 nt, Vaccinia virus
gcgucuguuuuauacauuuuuua

SEQ ID NO: 4064849 - RNA, 15 nt, Vaccinia virus
gcguggauuguuaac

SEQ ID NO: 4064850 - RNA, 11 nt, Vaccinia virus
gcguuaaacau

SEQ ID NO: 4064851 - RNA, 19 nt, Vaccinia virus
gcguucaagauuaucuuua

SEQ ID NO: 4064852 - RNA, 17 nt, Vaccinia virus
gcuaaaauuuucaucaa

SEQ ID NO: 4064853 - RNA, 16 nt, Vaccinia virus
gcuaauaaauaaugau

SEQ ID NO: 4064854 - RNA, 17 nt, Vaccinia virus
gcuaauuugauaaagau

SEQ ID NO: 4064855 - RNA, 21 nt, Vaccinia virus
gcuacaggucuaccuuuacaa

SEQ ID NO: 4064856 - RNA, 12 nt, Vaccinia virus
gcuacaguaaaa

SEQ ID NO: 4064857 - RNA, 21 nt, Vaccinia virus
gcuaccaucccacucuagaga

SEQ ID NO: 4064858 - RNA, 17 nt, Vaccinia virus
gcuauaacuugcuucaa

SEQ ID NO: 4064859 - RNA, 17 nt, Vaccinia virus
gcuauauggauauucau

SEQ ID NO: 4064860 - RNA, 22 nt, Vaccinia virus
gcuauauuccuguuaucaucau

SEQ ID NO: 4064861 - RNA, 16 nt, Vaccinia virus
gcuaucgcauaaucug

SEQ ID NO: 4064862 - RNA, 19 nt, Vaccinia virus
gcuauggcuucuuaaauca

SEQ ID NO: 4064863 - RNA, 17 nt, Vaccinia virus
gcuauguuaucaugaaa

SEQ ID NO: 4064864 - RNA, 14 nt, Vaccinia virus
gcuauuaaucuuua

SEQ ID NO: 4064865 - RNA, 10 nt, Vaccinia virus
ggauuacuua

SEQ ID NO: 4064866 - RNA, 13 nt, Vaccinia virus
ggauucaaaaaga

SEQ ID NO: 4064867 - RNA, 22 nt, Vaccinia virus
ggauucauccuguugucuaaau

SEQ ID NO: 4064868 - RNA, 17 nt, Vaccinia virus
ggauuucucauagaccu

SEQ ID NO: 4064869 - RNA, 20 nt, Vaccinia virus
ggauuugguaagacuauuac

SEQ ID NO: 4064870 - RNA, 15 nt, Vaccinia virus
ggcacuuauuucaug

SEQ ID NO: 4064871 - RNA, 13 nt, Vaccinia virus
ggcauuguuucua

SEQ ID NO: 4064872 - RNA, 20 nt, Vaccinia virus
ggccuguucauaaauaaaaa

SEQ ID NO: 4064873 - RNA, 20 nt, Vaccinia virus
ggcggaguaaguguugagcu

SEQ ID NO: 4064874 - RNA, 19 nt, Vaccinia virus
ggcguguuauacggagaag

SEQ ID NO: 4064875 - RNA, 20 nt, Vaccinia virus
ggcuacacacgguagaaaaa

SEQ ID NO: 4064876 - RNA, 16 nt, Vaccinia virus
ggcuccucucucaggc

SEQ ID NO: 4064877 - RNA, 19 nt, Vaccinia virus
ggcuccucucucaggcucu

SEQ ID NO: 4064878 - RNA, 13 nt, Vaccinia virus
gggaaaagucaaa

SEQ ID NO: 4064879 - RNA, 11 nt, Vaccinia virus
gggaaucgaug

SEQ ID NO: 4064880 - RNA, 21 nt, Vaccinia virus
gguagauuuguucuauagagc

SEQ ID NO: 4064881 - RNA, 17 nt, Vaccinia virus
gguauacuaguagguaa

SEQ ID NO: 4064882 - RNA, 20 nt, Vaccinia virus
ggucauauuauagauuuaau

SEQ ID NO: 4064883 - RNA, 23 nt, Vaccinia virus
ggucgucgauaacaaauuaaaga

SEQ ID NO: 4064884 - RNA, 15 nt, Vaccinia virus
ggugaauccaucucu

SEQ ID NO: 4064885 - RNA, 16 nt, Vaccinia virus
gguuaugauuuauaca

SEQ ID NO: 4064886 - RNA, 18 nt, Vaccinia virus
gguucccaauuccaaaga

SEQ ID NO: 4064887 - RNA, 16 nt, Vaccinia virus
gguugccaaauuuauu

SEQ ID NO: 4064888 - RNA, 20 nt, Vaccinia virus
guaaaaaaauuauacuguaa

SEQ ID NO: 4064889 - RNA, 14 nt, Vaccinia virus
guaaaaaauaauau

SEQ ID NO: 4064890 - RNA, 18 nt, Vaccinia virus
guaaaagaucuauaaugu

SEQ ID NO: 4064891 - RNA, 23 nt, Vaccinia virus
guaaaaguacagaauuaauuaga

SEQ ID NO: 4064892 - RNA, 12 nt, Vaccinia virus
guaaaauaucua

SEQ ID NO: 4064893 - RNA, 13 nt, Vaccinia virus
guaaaaucuauca

SEQ ID NO: 4064894 - RNA, 14 nt, Vaccinia virus
guaaacacauaucc

SEQ ID NO: 4064895 - RNA, 22 nt, Vaccinia virus
guaaacauugacggauaaaaca

SEQ ID NO: 4064896 - RNA, 23 nt, Vaccinia virus
guaaacauugacggauaaaacaa

SEQ ID NO: 4064897 - RNA, 13 nt, Vaccinia virus
guaaagacaauga

SEQ ID NO: 4064898 - RNA, 22 nt, Vaccinia virus
guaaauagaaucguauaauguc

SEQ ID NO: 4064899 - RNA, 23 nt, Vaccinia virus
guaaauaguuuuacguuauuaau

SEQ ID NO: 4064900 - RNA, 18 nt, Vaccinia virus
guaaauauucuaaauuaa

SEQ ID NO: 4064901 - RNA, 17 nt, Vaccinia virus
guaaaucauuaucuaca

SEQ ID NO: 4064902 - RNA, 14 nt, Vaccinia virus
guaaaugaugaaau

SEQ ID NO: 4064903 - RNA, 10 nt, Vaccinia virus
guaaauuaac

SEQ ID NO: 4064904 - RNA, 17 nt, Vaccinia virus
guaaccaaauacauauu

SEQ ID NO: 4064905 - RNA, 17 nt, Vaccinia virus
guaacuacguucaucau

SEQ ID NO: 4064906 - RNA, 22 nt, Vaccinia virus
guaacuaguuuuauacacaucu

SEQ ID NO: 4064907 - RNA, 20 nt, Vaccinia virus
guaacuccagaacaucuucc

SEQ ID NO: 4064908 - RNA, 19 nt, Vaccinia virus
guaagaagauuauauucua

SEQ ID NO: 4064909 - RNA, 19 nt, Vaccinia virus
guaagauuccuaaauuagu

SEQ ID NO: 4064910 - RNA, 13 nt, Vaccinia virus
guaauaaacuguu

SEQ ID NO: 4064911 - RNA, 12 nt, Vaccinia virus
guaauaauugcu

SEQ ID NO: 4064912 - RNA, 15 nt, Vaccinia virus
guaauaccauguuua

SEQ ID NO: 4064913 - RNA, 19 nt, Vaccinia virus
guaauaccauguuuaagau

SEQ ID NO: 4064914 - RNA, 13 nt, Vaccinia virus
guaauauucuagu

SEQ ID NO: 4064915 - RNA, 14 nt, Vaccinia virus
guaauauucuaguu

SEQ ID NO: 4064916 - RNA, 13 nt, Vaccinia virus
guaaugaagagaa

SEQ ID NO: 4064917 - RNA, 15 nt, Vaccinia virus
guaauggauaaugac

SEQ ID NO: 4064918 - RNA, 19 nt, Vaccinia virus
guaauguccaaaucuaguu

SEQ ID NO: 4064919 - RNA, 17 nt, Vaccinia virus
guaauuaguuucugguu

SEQ ID NO: 4064920 - RNA, 17 nt, Vaccinia virus
guacaaaaaagaacuaa

SEQ ID NO: 4064921 - RNA, 15 nt, Vaccinia virus
guacaaauauguaca

SEQ ID NO: 4064922 - RNA, 20 nt, Vaccinia virus
guacacuuuuuaauucucua

SEQ ID NO: 4064923 - RNA, 19 nt, Vaccinia virus
guacagaauuaauuagacg

SEQ ID NO: 4064924 - RNA, 12 nt, Vaccinia virus
guacauacuaga

SEQ ID NO: 4064925 - RNA, 15 nt, Vaccinia virus
guacauggaugauau

SEQ ID NO: 4064926 - RNA, 23 nt, Vaccinia virus
guacauggaugauauagauauga

SEQ ID NO: 4064927 - RNA, 16 nt, Vaccinia virus
guacauuaauaaauga

SEQ ID NO: 4064928 - RNA, 18 nt, Vaccinia virus
guaccaucgugauucuua

SEQ ID NO: 4064929 - RNA, 14 nt, Vaccinia virus
guaccauuuuuaac

SEQ ID NO: 4064930 - RNA, 17 nt, Vaccinia virus
guacccacugaugagau

SEQ ID NO: 4064931 - RNA, 17 nt, Vaccinia virus
guacggucugauauuau

SEQ ID NO: 4064932 - RNA, 20 nt, Vaccinia virus
guacuauuuuuuacauuacu

SEQ ID NO: 4064933 - RNA, 18 nt, Vaccinia virus
guacucguguccauaauc

SEQ ID NO: 4064934 - RNA, 23 nt, Vaccinia virus
guacuguucaaacaugaugagau

SEQ ID NO: 4064935 - RNA, 14 nt, Vaccinia virus
guagaaauuuuucu

SEQ ID NO: 4064936 - RNA, 21 nt, Vaccinia virus
guagaacaacgauuuaaucau

SEQ ID NO: 4064937 - RNA, 17 nt, Vaccinia virus
guagaacguaaauuagu

SEQ ID NO: 4064938 - RNA, 21 nt, Vaccinia virus
guagacgagccuagaaaucaa

SEQ ID NO: 4064939 - RNA, 15 nt, Vaccinia virus
guagauaucuuuacu

SEQ ID NO: 4064940 - RNA, 18 nt, Vaccinia virus
guagaucgucuaaaagaa

SEQ ID NO: 4064941 - RNA, 17 nt, Vaccinia virus
guagcaaagaaauuaau

SEQ ID NO: 4064942 - RNA, 18 nt, Vaccinia virus
guagcauuuucuuaacaa

SEQ ID NO: 4064943 - RNA, 16 nt, Vaccinia virus
guaggguuaaucgaac

SEQ ID NO: 4064944 - RNA, 18 nt, Vaccinia virus
guaguauaugaacaaacg

SEQ ID NO: 4064945 - RNA, 23 nt, Vaccinia virus
guaguuuaucgguuuuaaaucaa

SEQ ID NO: 4064946 - RNA, 11 nt, Vaccinia virus
guauaaacucc

SEQ ID NO: 4064947 - RNA, 14 nt, Vaccinia virus
guauaaagauguua

SEQ ID NO: 4064948 - RNA, 22 nt, Vaccinia virus
guauaauagaccacgauaauau

SEQ ID NO: 4064949 - RNA, 16 nt, Vaccinia virus
guauaauauuuaaaca

SEQ ID NO: 4064950 - RNA, 15 nt, Vaccinia virus
guauaaucuggugga

SEQ ID NO: 4064951 - RNA, 19 nt, Vaccinia virus
guauacucccuugcaucau

SEQ ID NO: 4064952 - RNA, 22 nt, Vaccinia virus
guauacucugcccuuuauuaca

SEQ ID NO: 4064953 - RNA, 16 nt, Vaccinia virus
guauacuugucaucau

SEQ ID NO: 4064954 - RNA, 13 nt, Vaccinia virus
guauauacauaga

SEQ ID NO: 4064955 - RNA, 22 nt, Vaccinia virus
guauauaucauuuguacauugu

SEQ ID NO: 4064956 - RNA, 16 nt, Vaccinia virus
guauaucuauauuaac

SEQ ID NO: 4064957 - RNA, 13 nt, Vaccinia virus
guauauguuucua

SEQ ID NO: 4064958 - RNA, 15 nt, Vaccinia virus
guauauucucuaguu

SEQ ID NO: 4064959 - RNA, 15 nt, Vaccinia virus
guaucauauauuaaa

SEQ ID NO: 4064960 - RNA, 23 nt, Vaccinia virus
guauccacaaauaguaaaugaga

SEQ ID NO: 4064961 - RNA, 20 nt, Vaccinia virus
guauccauuuuauaucacua

SEQ ID NO: 4064962 - RNA, 17 nt, Vaccinia virus
guaucgaaaaacuuuaa

SEQ ID NO: 4064963 - RNA, 19 nt, Vaccinia virus
guaucgauaauuauuucua

SEQ ID NO: 4064964 - RNA, 20 nt, Vaccinia virus
guaucgauaguguaguuauu

SEQ ID NO: 4064965 - RNA, 12 nt, Vaccinia virus
guaucuacuaga

SEQ ID NO: 4064966 - RNA, 14 nt, Vaccinia virus
guaucuuuacuaga

SEQ ID NO: 4064967 - RNA, 19 nt, Vaccinia virus
guauggaauauaauaaucu

SEQ ID NO: 4064968 - RNA, 21 nt, Vaccinia virus
guaugucccaauauuaaugca

SEQ ID NO: 4064969 - RNA, 15 nt, Vaccinia virus
guaugucuuauguau

SEQ ID NO: 4064970 - RNA, 15 nt, Vaccinia virus
guauguuuaaacacu

SEQ ID NO: 4064971 - RNA, 16 nt, Vaccinia virus
guauuaaguuuggaga

SEQ ID NO: 4064972 - RNA, 21 nt, Vaccinia virus
guauuaauacaugucuuagau

SEQ ID NO: 4064973 - RNA, 13 nt, Vaccinia virus
guauuagauaaau

SEQ ID NO: 4064974 - RNA, 17 nt, Vaccinia virus
guauuaucagauaucca

SEQ ID NO: 4064975 - RNA, 19 nt, Vaccinia virus
guauuauucauuuucuauu

SEQ ID NO: 4064976 - RNA, 23 nt, Vaccinia virus
guauucauuguuuagaauacaag

SEQ ID NO: 4064977 - RNA, 19 nt, Vaccinia virus
guauucauuuaucacaaaa

SEQ ID NO: 4064978 - RNA, 18 nt, Vaccinia virus
guauucggcauuucuaaa

SEQ ID NO: 4064979 - RNA, 22 nt, Vaccinia virus
guauucuauacccaucauguaa

SEQ ID NO: 4064980 - RNA, 16 nt, Vaccinia virus
guauucuauuuuggaa

SEQ ID NO: 4064981 - RNA, 17 nt, Vaccinia virus
guauucugaugauauua

SEQ ID NO: 4064982 - RNA, 14 nt, Vaccinia virus
guauugacaaauau

SEQ ID NO: 4064983 - RNA, 17 nt, Vaccinia virus
guauugcgcuacugauu

SEQ ID NO: 4064984 - RNA, 21 nt, Vaccinia virus
guauuuccauaauaagguuua

SEQ ID NO: 4064985 - RNA, 22 nt, Vaccinia virus
guauuucguaccuguauguaca

SEQ ID NO: 4064986 - RNA, 18 nt, Vaccinia virus
guauuucuggugauaaau

SEQ ID NO: 4064987 - RNA, 11 nt, Vaccinia virus
guauuuggauu

SEQ ID NO: 4064988 - RNA, 13 nt, Vaccinia virus
gucaaagaaauac

SEQ ID NO: 4064989 - RNA, 14 nt, Vaccinia virus
gucaagaugaugaa

SEQ ID NO: 4064990 - RNA, 20 nt, Vaccinia virus
gucaauaaggcguuuaaaaa

SEQ ID NO: 4064991 - RNA, 12 nt, Vaccinia virus
gucaauacugua

SEQ ID NO: 4064992 - RNA, 18 nt, Vaccinia virus
auuaauaaaggaugugga

SEQ ID NO: 4064993 - RNA, 14 nt, Vaccinia virus
auuaauacauuauu

SEQ ID NO: 4064994 - RNA, 17 nt, Vaccinia virus
auuaauagauauaucuc

SEQ ID NO: 4064995 - RNA, 13 nt, Vaccinia virus
auuaauaguuuug

SEQ ID NO: 4064996 - RNA, 17 nt, Vaccinia virus
auuaauaugcucaugaa

SEQ ID NO: 4064997 - RNA, 19 nt, Vaccinia virus
auuaaucuaguagaaaaga

SEQ ID NO: 4064998 - RNA, 16 nt, Vaccinia virus
auuaauguauuauuau

SEQ ID NO: 4064999 - RNA, 17 nt, Vaccinia virus
auuaauuaucacauauu

SEQ ID NO: 4065000 - RNA, 11 nt, Vaccinia virus
auuaauuauug

SEQ ID NO: 4065001 - RNA, 15 nt, Vaccinia virus
auuaauucuguaaau

SEQ ID NO: 4065002 - RNA, 13 nt, Vaccinia virus
auuaauuguuaaa

SEQ ID NO: 4065003 - RNA, 20 nt, Vaccinia virus
auuaauuguuauuuuauuca

SEQ ID NO: 4065004 - RNA, 17 nt, Vaccinia virus
auuacaacaacauauga

SEQ ID NO: 4065005 - RNA, 14 nt, Vaccinia virus
auuacacauuucca

SEQ ID NO: 4065006 - RNA, 20 nt, Vaccinia virus
auuacgaauauauaaaagac

SEQ ID NO: 4065007 - RNA, 16 nt, Vaccinia virus
auuacggagugugaaa

SEQ ID NO: 4065008 - RNA, 15 nt, Vaccinia virus
auuacguuucauuuu

SEQ ID NO: 4065009 - RNA, 19 nt, Vaccinia virus
auuacuaaaucuguauauc

SEQ ID NO: 4065010 - RNA, 22 nt, Vaccinia virus
auuacuaugaauaucuucuaug

SEQ ID NO: 4065011 - RNA, 20 nt, Vaccinia virus
auuacuaugaaucauaaaga

SEQ ID NO: 4065012 - RNA, 14 nt, Vaccinia virus
auuacuauuuguaa

SEQ ID NO: 4065013 - RNA, 15 nt, Vaccinia virus
auuacucaugcauuu

SEQ ID NO: 4065014 - RNA, 12 nt, Vaccinia virus
auuacuuaaaaa

SEQ ID NO: 4065015 - RNA, 17 nt, Vaccinia virus
auuagaauagucucuuu

SEQ ID NO: 4065016 - RNA, 17 nt, Vaccinia virus
auuagacgauaugacau

SEQ ID NO: 4065017 - RNA, 23 nt, Vaccinia virus
auuagacuuuucguauguaaugu

SEQ ID NO: 4065018 - RNA, 16 nt, Vaccinia virus
auuagagguaaugaug

SEQ ID NO: 4065019 - RNA, 20 nt, Vaccinia virus
auuagaguuaggcaauguau

SEQ ID NO: 4065020 - RNA, 15 nt, Vaccinia virus
auuagauacauagau

SEQ ID NO: 4065021 - RNA, 15 nt, Vaccinia virus
auuagaugagaaauu

SEQ ID NO: 4065022 - RNA, 20 nt, Vaccinia virus
auuagauggagaguauauuu

SEQ ID NO: 4065023 - RNA, 22 nt, Vaccinia virus
auuagguaaaguaggacauaau

SEQ ID NO: 4065024 - RNA, 18 nt, Vaccinia virus
auuaguaaaacuagcauu

SEQ ID NO: 4065025 - RNA, 14 nt, Vaccinia virus
auuaguaacagcuu

SEQ ID NO: 4065026 - RNA, 15 nt, Vaccinia virus
auuaguaugguuuca

SEQ ID NO: 4065027 - RNA, 19 nt, Vaccinia virus
auuagugaugaauugaaaa

SEQ ID NO: 4065028 - RNA, 20 nt, Vaccinia virus
auuaguuaguguaauguuaa

SEQ ID NO: 4065029 - RNA, 13 nt, Vaccinia virus
auuaguuucuuga

SEQ ID NO: 4065030 - RNA, 15 nt, Vaccinia virus
auuauaaagauaugu

SEQ ID NO: 4065031 - RNA, 14 nt, Vaccinia virus
auuauaagaaauau

SEQ ID NO: 4065032 - RNA, 15 nt, Vaccinia virus
auuauaaugaauauu

SEQ ID NO: 4065033 - RNA, 21 nt, Vaccinia virus
auuauacgcauaaauuguaaa

SEQ ID NO: 4065034 - RNA, 15 nt, Vaccinia virus
auuauagauguguau

SEQ ID NO: 4065035 - RNA, 22 nt, Vaccinia virus
auuauagguaacauaaaaacug

SEQ ID NO: 4065036 - RNA, 19 nt, Vaccinia virus
auaaaucuuuaucaagcac

SEQ ID NO: 4065037 - RNA, 15 nt, Vaccinia virus
auaaaugacaaguau

SEQ ID NO: 4065038 - RNA, 13 nt, Vaccinia virus
auaaauggagaau

SEQ ID NO: 4065039 - RNA, 19 nt, Vaccinia virus
auaaauucaaccaugaauu

SEQ ID NO: 4065040 - RNA, 14 nt, Vaccinia virus
auauaguuaauagu

SEQ ID NO: 4065041 - RNA, 21 nt, Vaccinia virus
auauaguuauuaaugaugaaa

SEQ ID NO: 4065042 - RNA, 16 nt, Vaccinia virus
auauaguucaaauuaa

SEQ ID NO: 4065043 - RNA, 22 nt, Vaccinia virus
auauauacucugagauaaaaca

SEQ ID NO: 4065044 - RNA, 13 nt, Vaccinia virus
auauauagaaugg

SEQ ID NO: 4065045 - RNA, 22 nt, Vaccinia virus
acuuuaauccuguguuuauaga

SEQ ID NO: 4065046 - RNA, 23 nt, Vaccinia virus
acuuuacaaacgauguacugaag

SEQ ID NO: 4065047 - RNA, 16 nt, Vaccinia virus
acuuuaucagauuaaa

SEQ ID NO: 4065048 - RNA, 23 nt, Vaccinia virus
acuuuauuacuccauuaaauaau

SEQ ID NO: 4065049 - RNA, 21 nt, Vaccinia virus
acuuucgaauaaguuugcaga

SEQ ID NO: 4065050 - RNA, 15 nt, Vaccinia virus
acuuucgguucuuua

SEQ ID NO: 4065051 - RNA, 13 nt, Vaccinia virus
acuuucucuaaau

SEQ ID NO: 4065052 - RNA, 13 nt, Vaccinia virus
acuuuguuaauaa

SEQ ID NO: 4065053 - RNA, 16 nt, Vaccinia virus
acuuuuaauuaacaaa

SEQ ID NO: 4065054 - RNA, 16 nt, Vaccinia virus
acuuuucauuaauagg

SEQ ID NO: 4065055 - RNA, 22 nt, Vaccinia virus
acuuuuggaaucguucaaaacc

SEQ ID NO: 4065056 - RNA, 13 nt, Vaccinia virus
acuuuuuacuaau

SEQ ID NO: 4065057 - RNA, 22 nt, Vaccinia virus
acuuuuucuagaaaaaaaauug

SEQ ID NO: 4065058 - RNA, 15 nt, Vaccinia virus
acuuuuucucauaau

SEQ ID NO: 4065059 - RNA, 22 nt, Vaccinia virus
acuuuuuguuuauauuaaauau

SEQ ID NO: 4065060 - RNA, 13 nt, Vaccinia virus
agaaaaaaauauu

SEQ ID NO: 4065061 - RNA, 14 nt, Vaccinia virus
agaaaaaacaaugu

SEQ ID NO: 4065062 - RNA, 12 nt, Vaccinia virus
agaaaaaaugau

SEQ ID NO: 4065063 - RNA, 16 nt, Vaccinia virus
agaaaaauauaaugua

SEQ ID NO: 4065064 - RNA, 20 nt, Vaccinia virus
agaaaaaucauuaaaaagau

SEQ ID NO: 4065065 - RNA, 12 nt, Vaccinia virus
agaaaaaugauu

SEQ ID NO: 4065066 - RNA, 11 nt, Vaccinia virus
agaaaacauuu

SEQ ID NO: 4065067 - RNA, 23 nt, Vaccinia virus
agaaaacucguuauuaacuaugu

SEQ ID NO: 4065068 - RNA, 22 nt, Vaccinia virus
agaaaagcaguuaccaaagaga

SEQ ID NO: 4065069 - RNA, 17 nt, Vaccinia virus
agaaaauacaacggaua

SEQ ID NO: 4065070 - RNA, 20 nt, Vaccinia virus
agaaaaugcagaaaugauuu

SEQ ID NO: 4065071 - RNA, 13 nt, Vaccinia virus
agaaacaaaaagu

SEQ ID NO: 4065072 - RNA, 19 nt, Vaccinia virus
agaaacgauaccaucuucu

SEQ ID NO: 4065073 - RNA, 18 nt, Vaccinia virus
agaaacgcaacaaaugau

SEQ ID NO: 4065074 - RNA, 16 nt, Vaccinia virus
agaaacggaggagaac

SEQ ID NO: 4065075 - RNA, 19 nt, Vaccinia virus
agaaacuugcaaaaaagac

SEQ ID NO: 4065076 - RNA, 22 nt, Vaccinia virus
agaaaggugugcacucugaauu

SEQ ID NO: 4065077 - RNA, 16 nt, Vaccinia virus
agaaagugcaaaugag

SEQ ID NO: 4065078 - RNA, 17 nt, Vaccinia virus
agaaagugcaaaugagg

SEQ ID NO: 4065079 - RNA, 18 nt, Vaccinia virus
agaaaguggauaaaacaa

SEQ ID NO: 4065080 - RNA, 18 nt, Vaccinia virus
agaaauaaaaauuauuau

SEQ ID NO: 4065081 - RNA, 18 nt, Vaccinia virus
agaaauaaacgaguaugu

SEQ ID NO: 4065082 - RNA, 17 nt, Vaccinia virus
agaaauacuaaaaaaug

SEQ ID NO: 4065083 - RNA, 12 nt, Vaccinia virus
agaaauacuucu

SEQ ID NO: 4065084 - RNA, 13 nt, Vaccinia virus
agaaauauauauu

SEQ ID NO: 4065085 - RNA, 12 nt, Vaccinia virus
agaaauaugauu

SEQ ID NO: 4065086 - RNA, 22 nt, Vaccinia virus
agaaauauguauacaugauauu

SEQ ID NO: 4065087 - RNA, 22 nt, Vaccinia virus
agaaaucaacgaucuaauacaa

SEQ ID NO: 4065088 - RNA, 13 nt, Vaccinia virus
agaaaucauauau

SEQ ID NO: 4065089 - RNA, 19 nt, Vaccinia virus
agaaaucauauaugauauu

SEQ ID NO: 4065090 - RNA, 15 nt, Vaccinia virus
agaaaugacuccaug

SEQ ID NO: 4065091 - RNA, 17 nt, Vaccinia virus
agaaaugagaaacuguu

SEQ ID NO: 4065092 - RNA, 22 nt, Vaccinia virus
agaaauggaaaucguaauacca

SEQ ID NO: 4065093 - RNA, 22 nt, Vaccinia virus
agaaaugguaaauaaauacuuu

SEQ ID NO: 4065094 - RNA, 13 nt, Vaccinia virus
agaaauuaauaaa

SEQ ID NO: 4065095 - RNA, 15 nt, Vaccinia virus
agaaauucauauccu

SEQ ID NO: 4065096 - RNA, 20 nt, Vaccinia virus
agaacaaaaucuaacagaua

SEQ ID NO: 4065097 - RNA, 16 nt, Vaccinia virus
agaacaacgaaauuau

SEQ ID NO: 4065098 - RNA, 14 nt, Vaccinia virus
agaacaauaucucg

SEQ ID NO: 4065099 - RNA, 16 nt, Vaccinia virus
agaacagaauaaacaa

SEQ ID NO: 4065100 - RNA, 18 nt, Vaccinia virus
agaacauauaaauguaga

SEQ ID NO: 4065101 - RNA, 21 nt, Vaccinia virus
agaacauuuuuauaaacauga

SEQ ID NO: 4065102 - RNA, 20 nt, Vaccinia virus
agaacccauuagguuaaaug

SEQ ID NO: 4065103 - RNA, 18 nt, Vaccinia virus
agaacuaacaaacuauac

SEQ ID NO: 4065104 - RNA, 14 nt, Vaccinia virus
agaacuaacacaac

SEQ ID NO: 4065105 - RNA, 16 nt, Vaccinia virus
agaacuaccaauaugu

SEQ ID NO: 4065106 - RNA, 22 nt, Vaccinia virus
agaacucucuucauuacuauau

SEQ ID NO: 4065107 - RNA, 19 nt, Vaccinia virus
agaacucuugaagaugauu

SEQ ID NO: 4065108 - RNA, 22 nt, Vaccinia virus
agaagaaauacuaaaaaaugua

SEQ ID NO: 4065109 - RNA, 16 nt, Vaccinia virus
agaagcguguuauugu

SEQ ID NO: 4065110 - RNA, 20 nt, Vaccinia virus
agaauaaaacucuacuauau

SEQ ID NO: 4065111 - RNA, 14 nt, Vaccinia virus
agaauaaaaugauu

SEQ ID NO: 4065112 - RNA, 13 nt, Vaccinia virus
agaauaaaguaau

SEQ ID NO: 4065113 - RNA, 16 nt, Vaccinia virus
agaauacgcauguuuu

SEQ ID NO: 4065114 - RNA, 21 nt, Vaccinia virus
agaauagaugcuauuuauccg

SEQ ID NO: 4065115 - RNA, 16 nt, Vaccinia virus
agaauauaaauuauau

SEQ ID NO: 4065116 - RNA, 21 nt, Vaccinia virus
agaauauaaccacuacaucau

SEQ ID NO: 4065117 - RNA, 20 nt, Vaccinia virus
agaauauauagguaauacau

SEQ ID NO: 4065118 - RNA, 22 nt, Vaccinia virus
agaauauauagguaauacauau

SEQ ID NO: 4065119 - RNA, 16 nt, Vaccinia virus
agaauaucuaauggau

SEQ ID NO: 4065120 - RNA, 19 nt, Vaccinia virus
agaauaucuauacauaccu

SEQ ID NO: 4065121 - RNA, 14 nt, Vaccinia virus
agaauaucucuaac

SEQ ID NO: 4065122 - RNA, 12 nt, Vaccinia virus
agaauaugagaa

SEQ ID NO: 4065123 - RNA, 16 nt, Vaccinia virus
agaaucauaaagaaca

SEQ ID NO: 4065124 - RNA, 14 nt, Vaccinia virus
agaaucuguuauau

SEQ ID NO: 4065125 - RNA, 16 nt, Vaccinia virus
agaauggaaaggaaac

SEQ ID NO: 4065126 - RNA, 14 nt, Vaccinia virus
agaauggaaauaua

SEQ ID NO: 4065127 - RNA, 19 nt, Vaccinia virus
agaauguuccagaguguuu

SEQ ID NO: 4065128 - RNA, 13 nt, Vaccinia virus
agaauuaagauua

SEQ ID NO: 4065129 - RNA, 20 nt, Vaccinia virus
agaauucacaccuagagaca

SEQ ID NO: 4065130 - RNA, 13 nt, Vaccinia virus
agaauucuagauc

SEQ ID NO: 4065131 - RNA, 19 nt, Vaccinia virus
agaauugacgaaacaaugu

SEQ ID NO: 4065132 - RNA, 20 nt, Vaccinia virus
agaauuggaauaccaaauau

SEQ ID NO: 4065133 - RNA, 17 nt, Vaccinia virus
agaauuuagaaauauau

SEQ ID NO: 4065134 - RNA, 16 nt, Vaccinia virus
agaauuucuacauaau

SEQ ID NO: 4065135 - RNA, 22 nt, Vaccinia virus
guucuuuccguacaacauacug

SEQ ID NO: 4065136 - RNA, 18 nt, Vaccinia virus
guucuuucgauuuggaaa

SEQ ID NO: 4065137 - RNA, 15 nt, Vaccinia virus
guugacuauaacaga

SEQ ID NO: 4065138 - RNA, 22 nt, Vaccinia virus
guugagugaaagguggaagauc

SEQ ID NO: 4065139 - RNA, 22 nt, Vaccinia virus
guugaugaggcacauaauaucu

SEQ ID NO: 4065140 - RNA, 22 nt, Vaccinia virus
guugauggaaaaauucuuuucg

SEQ ID NO: 4065141 - RNA, 19 nt, Vaccinia virus
guuuaaauucuuuaauauc

SEQ ID NO: 4065142 - RNA, 18 nt, Vaccinia virus
guuuaacuagucuucucu

SEQ ID NO: 4065143 - RNA, 14 nt, Vaccinia virus
guuuaauaaauguu

SEQ ID NO: 4065144 - RNA, 14 nt, Vaccinia virus
guuuaauacauuga

SEQ ID NO: 4065145 - RNA, 14 nt, Vaccinia virus
guuuaauacuuauu

SEQ ID NO: 4065146 - RNA, 19 nt, Vaccinia virus
guuuaauacuuauucauau

SEQ ID NO: 4065147 - RNA, 15 nt, Vaccinia virus
guuuagauucuuuuu

SEQ ID NO: 4065148 - RNA, 21 nt, Vaccinia virus
guuuauaaaaauguucuuuuu

SEQ ID NO: 4065149 - RNA, 16 nt, Vaccinia virus
guuuaucaacauggcu

SEQ ID NO: 4065150 - RNA, 22 nt, Vaccinia virus
guuucaaagcaauuguauuauu

SEQ ID NO: 4065151 - RNA, 12 nt, Vaccinia virus
guuuccauccau

SEQ ID NO: 4065152 - RNA, 23 nt, Vaccinia virus
guuucccuauuaaaauucuuaaa

SEQ ID NO: 4065153 - RNA, 13 nt, Vaccinia virus
guuuccuguaaau

SEQ ID NO: 4065154 - RNA, 22 nt, Vaccinia virus
guuucucaucuuuuacuugauu

SEQ ID NO: 4065155 - RNA, 14 nt, Vaccinia virus
guuucuuacauauu

SEQ ID NO: 4065156 - RNA, 14 nt, Vaccinia virus
guuugguaaucauu

SEQ ID NO: 4065157 - RNA, 15 nt, Vaccinia virus
guuuguauaauaucu

SEQ ID NO: 4065158 - RNA, 17 nt, Vaccinia virus
guuuguuccugugacaa

SEQ ID NO: 4065159 - RNA, 20 nt, Vaccinia virus
guuuuagagacuuugaagcu

SEQ ID NO: 4065160 - RNA, 16 nt, Vaccinia virus
guuuucauacauaugg

SEQ ID NO: 4065161 - RNA, 15 nt, Vaccinia virus
guuuucauuauuauu

SEQ ID NO: 4065162 - RNA, 15 nt, Vaccinia virus
guuuuguuggagaac

SEQ ID NO: 4065163 - RNA, 11 nt, Vaccinia virus
guuuuuacaga

SEQ ID NO: 4065164 - RNA, 17 nt, Vaccinia virus
uaaaaaaaaaauacuua

SEQ ID NO: 4065165 - RNA, 17 nt, Vaccinia virus
uaaaaaaaauagaaaaa

SEQ ID NO: 4065166 - RNA, 17 nt, Vaccinia virus
uaaaaaaguuaaaacuu

SEQ ID NO: 4065167 - RNA, 17 nt, Vaccinia virus
uaaaaagauaaacuuua

SEQ ID NO: 4065168 - RNA, 16 nt, Vaccinia virus
uaaaaagguagauguu

SEQ ID NO: 4065169 - RNA, 13 nt, Vaccinia virus
uaaaaauaaaagu

SEQ ID NO: 4065170 - RNA, 14 nt, Vaccinia virus
uaaaaauauguaua

SEQ ID NO: 4065171 - RNA, 16 nt, Vaccinia virus
uaaaaauguuaauuua

SEQ ID NO: 4065172 - RNA, 12 nt, Vaccinia virus
uaaaaauuauua

SEQ ID NO: 4065173 - RNA, 22 nt, Vaccinia virus
uaaaaauuuuuuagauguagua

SEQ ID NO: 4065174 - RNA, 13 nt, Vaccinia virus
uaaaacaauaaau

SEQ ID NO: 4065175 - RNA, 19 nt, Vaccinia virus
uaaaacauaaucaaggaua

SEQ ID NO: 4065176 - RNA, 14 nt, Vaccinia virus
uaaaacauuuccua

SEQ ID NO: 4065177 - RNA, 19 nt, Vaccinia virus
uaaaacuuaugauuaguca

SEQ ID NO: 4065178 - RNA, 17 nt, Vaccinia virus
uaaaauaaaaauccauu

SEQ ID NO: 4065179 - RNA, 16 nt, Vaccinia virus
uaaaauaaaaugagua

SEQ ID NO: 4065180 - RNA, 16 nt, Vaccinia virus
uaaaauaaauaucauu

SEQ ID NO: 4065181 - RNA, 23 nt, Vaccinia virus
uaaaauaacucuguagacgauac

SEQ ID NO: 4065182 - RNA, 15 nt, Vaccinia virus
ugcaaauguaguauu

SEQ ID NO: 4065183 - RNA, 14 nt, Vaccinia virus
ugcaacaucuggag

SEQ ID NO: 4065184 - RNA, 19 nt, Vaccinia virus
ugcaauggauaauuuccau

SEQ ID NO: 4065185 - RNA, 18 nt, Vaccinia virus
ugcacaaucugagauuuu

SEQ ID NO: 4065186 - RNA, 19 nt, Vaccinia virus
ugcaucgugcuuuaacauc

SEQ ID NO: 4065187 - RNA, 16 nt, Vaccinia virus
ugcaucuauaugucca

SEQ ID NO: 4065188 - RNA, 15 nt, Vaccinia virus
ugcauuuuguuauau

SEQ ID NO: 4065189 - RNA, 16 nt, Vaccinia virus
ugcauuuuuauauaca

SEQ ID NO: 4065190 - RNA, 14 nt, Vaccinia virus
ugccaaagauuucu

SEQ ID NO: 4065191 - RNA, 18 nt, Vaccinia virus
ugccacugaucaugauug

SEQ ID NO: 4065192 - RNA, 19 nt, Vaccinia virus
ugcccccauucuuaauaau

SEQ ID NO: 4065193 - RNA, 20 nt, Vaccinia virus
ugccguguuuaaagauuucu

SEQ ID NO: 4065194 - RNA, 18 nt, Vaccinia virus
ugcgccgacgaggaugaa

SEQ ID NO: 4065195 - RNA, 21 nt, Vaccinia virus
ugcgcgaaccaaaaugugaua

SEQ ID NO: 4065196 - RNA, 18 nt, Vaccinia virus
ugcgcuacauuguuacgu

SEQ ID NO: 4065197 - RNA, 16 nt, Vaccinia virus
ugcuaauauucccaaa

SEQ ID NO: 4065198 - RNA, 24 nt, Vaccinia virus
ugcuauguuuauagauguucacau

SEQ ID NO: 4065199 - RNA, 19 nt, Vaccinia virus
ugcuauuaagguuaaggau

SEQ ID NO: 4065200 - RNA, 15 nt, Vaccinia virus
ugcucaaacaaaaug

SEQ ID NO: 4065201 - RNA, 21 nt, Vaccinia virus
ugcugaccuggaaaaauacuu

SEQ ID NO: 4065202 - RNA, 17 nt, Vaccinia virus
ugcuguuccucuguaaa

SEQ ID NO: 4065203 - RNA, 14 nt, Vaccinia virus
ugcuguuuuuuacu

SEQ ID NO: 4065204 - RNA, 19 nt, Vaccinia virus
ugcuuacaugcauacuuga

SEQ ID NO: 4065205 - RNA, 16 nt, Vaccinia virus
ugcuuuagugaaauuu

SEQ ID NO: 4065206 - RNA, 21 nt, Vaccinia virus
ugcuuucugauaguauagaua

SEQ ID NO: 4065207 - RNA, 15 nt, Vaccinia virus
uggaaaaauaguguu

SEQ ID NO: 4065208 - RNA, 23 nt, Vaccinia virus
uggaaaacuuuaauaacaaagaa

SEQ ID NO: 4065209 - RNA, 19 nt, Vaccinia virus
uggaaacaauucauaauua

SEQ ID NO: 4065210 - RNA, 14 nt, Vaccinia virus
uggaaaucguaaua

SEQ ID NO: 4065211 - RNA, 20 nt, Vaccinia virus
uggaagaaauugaacuccuc

SEQ ID NO: 4065212 - RNA, 15 nt, Vaccinia virus
uggaauaaauuauua

SEQ ID NO: 4065213 - RNA, 14 nt, Vaccinia virus
uggaaugauacugu

SEQ ID NO: 4065214 - RNA, 17 nt, Vaccinia virus
uggaaugcguuccuugu

SEQ ID NO: 4065215 - RNA, 17 nt, Vaccinia virus
uggaauggaaugcuguu

SEQ ID NO: 4065216 - RNA, 16 nt, Vaccinia virus
uggaauuaguuagaua

SEQ ID NO: 4065217 - RNA, 19 nt, Vaccinia virus
uggacauaaagauagauau

SEQ ID NO: 4065218 - RNA, 20 nt, Vaccinia virus
uggaccaccgacuguaacau

SEQ ID NO: 4065219 - RNA, 17 nt, Vaccinia virus
uggacgauuuugugaua

SEQ ID NO: 4065220 - RNA, 12 nt, Vaccinia virus
uggagaaauacu

SEQ ID NO: 4065221 - RNA, 22 nt, Vaccinia virus
uggagaauguuccuaauguaua

SEQ ID NO: 4065222 - RNA, 14 nt, Vaccinia virus
uggagaucauuaaa

SEQ ID NO: 4065223 - RNA, 18 nt, Vaccinia virus
uggagaucauuaaauguu

SEQ ID NO: 4065224 - RNA, 22 nt, Vaccinia virus
uggagauccauaugaggaguca

SEQ ID NO: 4065225 - RNA, 13 nt, Vaccinia virus
uggagaugaaugc

SEQ ID NO: 4065226 - RNA, 17 nt, Vaccinia virus
uggaggauuauaugaua

SEQ ID NO: 4065227 - RNA, 15 nt, Vaccinia virus
uggaggcucaacaag

SEQ ID NO: 4065228 - RNA, 23 nt, Vaccinia virus
uggauaaaaugcaugacgugaua

SEQ ID NO: 4065229 - RNA, 16 nt, Vaccinia virus
uggauacuaauuguag

SEQ ID NO: 4065230 - RNA, 13 nt, Vaccinia virus
uggauauaugaua

SEQ ID NO: 4065231 - RNA, 22 nt, Vaccinia virus
uggaucuccaucgaugauacau

SEQ ID NO: 4065232 - RNA, 23 nt, Vaccinia virus
uggaugcuauguuuauagauguu

SEQ ID NO: 4065233 - RNA, 16 nt, Vaccinia virus
uggauuaaacauacua

SEQ ID NO: 4065234 - RNA, 20 nt, Vaccinia virus
uggauuaagcaauagugaua

SEQ ID NO: 4065235 - RNA, 15 nt, Vaccinia virus
uggauuaucggaaau

SEQ ID NO: 4065236 - RNA, 19 nt, Vaccinia virus
uggcaaacaauguauacaa

SEQ ID NO: 4065237 - RNA, 16 nt, Vaccinia virus
uauuacguauuauaua

SEQ ID NO: 4065238 - RNA, 17 nt, Vaccinia virus
uauuacguggagaaauc

SEQ ID NO: 4065239 - RNA, 21 nt, Vaccinia virus
uauuagauuugguaaaaugaa

SEQ ID NO: 4065240 - RNA, 15 nt, Vaccinia virus
uauuagguuaucauc

SEQ ID NO: 4065241 - RNA, 17 nt, Vaccinia virus
uauuauacaaaaauuuu

SEQ ID NO: 4065242 - RNA, 15 nt, Vaccinia virus
uauuauauaaacauu

SEQ ID NO: 4065243 - RNA, 20 nt, Vaccinia virus
uauuaucaaaauuuggaaac

SEQ ID NO: 4065244 - RNA, 22 nt, Vaccinia virus
uauuaucauacugucaacuaua

SEQ ID NO: 4065245 - RNA, 21 nt, Vaccinia virus
uauuauuagauaaauuuauca

SEQ ID NO: 4065246 - RNA, 15 nt, Vaccinia virus
uauuauuaugaugau

SEQ ID NO: 4065247 - RNA, 15 nt, Vaccinia virus
uauuauugacuucgu

SEQ ID NO: 4065248 - RNA, 19 nt, Vaccinia virus
uauuauugauccaaucaaa

SEQ ID NO: 4065249 - RNA, 18 nt, Vaccinia virus
uauucauaauccagaguu

SEQ ID NO: 4065250 - RNA, 18 nt, Vaccinia virus
uauucauagauugacuuu

SEQ ID NO: 4065251 - RNA, 14 nt, Vaccinia virus
uauucaucaucaaa

SEQ ID NO: 4065252 - RNA, 16 nt, Vaccinia virus
uauuccaaauuauucu

SEQ ID NO: 4065253 - RNA, 22 nt, Vaccinia virus
uauuccaaucauugauaucuuu

SEQ ID NO: 4065254 - RNA, 14 nt, Vaccinia virus
uauuccauuaaauu

SEQ ID NO: 4065255 - RNA, 15 nt, Vaccinia virus
uauuccauuaaugac

SEQ ID NO: 4065256 - RNA, 13 nt, Vaccinia virus
uauuccuaccaaa

SEQ ID NO: 4065257 - RNA, 16 nt, Vaccinia virus
uauuccuguuaucaua

SEQ ID NO: 4065258 - RNA, 19 nt, Vaccinia virus
uauucgucgucgacuauca

SEQ ID NO: 4065259 - RNA, 13 nt, Vaccinia virus
uauucuacuauca

SEQ ID NO: 4065260 - RNA, 17 nt, Vaccinia virus
uauucuaucaccagauu

SEQ ID NO: 4065261 - RNA, 18 nt, Vaccinia virus
uauucuauccaaggacaa

SEQ ID NO: 4065262 - RNA, 20 nt, Vaccinia virus
uauucucccaccguuauaua

SEQ ID NO: 4065263 - RNA, 23 nt, Vaccinia virus
uauucucuauuuugguggaggau

SEQ ID NO: 4065264 - RNA, 11 nt, Vaccinia virus
uauucucuuuc

SEQ ID NO: 4065265 - RNA, 19 nt, Vaccinia virus
uauucugaaacaguaugau

SEQ ID NO: 4065266 - RNA, 18 nt, Vaccinia virus
uauugaaaauguguauaa

SEQ ID NO: 4065267 - RNA, 19 nt, Vaccinia virus
uauugacuuaauaggcauc

SEQ ID NO: 4065268 - RNA, 20 nt, Vaccinia virus
uauugacuucguuuaucuug

SEQ ID NO: 4065269 - RNA, 18 nt, Vaccinia virus
uauugagaagcauuuagu

SEQ ID NO: 4065270 - RNA, 13 nt, Vaccinia virus
uauugagauuucu

SEQ ID NO: 4065271 - RNA, 22 nt, Vaccinia virus
uauugcggcauauauaaaguug

SEQ ID NO: 4065272 - RNA, 22 nt, Vaccinia virus
uauugcguacacaaucaaucau

SEQ ID NO: 4065273 - RNA, 14 nt, Vaccinia virus
uauuggcuuucaua

SEQ ID NO: 4065274 - RNA, 19 nt, Vaccinia virus
uauugguuacccuugucau

SEQ ID NO: 4065275 - RNA, 13 nt, Vaccinia virus
uauuguuaauaga

SEQ ID NO: 4065276 - RNA, 19 nt, Vaccinia virus
uauuguucuauauuauaua

SEQ ID NO: 4065277 - RNA, 19 nt, Vaccinia virus
uauuguuuagacuguuugu

SEQ ID NO: 4065278 - RNA, 14 nt, Vaccinia virus
uauuucaaagacua

SEQ ID NO: 4065279 - RNA, 17 nt, Vaccinia virus
uauuucaggaacaggau

SEQ ID NO: 4065280 - RNA, 21 nt, Vaccinia virus
uauuuccacauugcuuuaaaa

SEQ ID NO: 4065281 - RNA, 16 nt, Vaccinia virus
uauuucccuauaaaaa

SEQ ID NO: 4065282 - RNA, 12 nt, Vaccinia virus
uauuucuaaaau

SEQ ID NO: 4065283 - RNA, 20 nt, Vaccinia virus
uauuucuccacuacauaucc

SEQ ID NO: 4065284 - RNA, 13 nt, Vaccinia virus
uauuucuuacaua

SEQ ID NO: 4065285 - RNA, 22 nt, Vaccinia virus
uauuucuucgcuuuauauacca

SEQ ID NO: 4065286 - RNA, 21 nt, Vaccinia virus
uauuuggauuuggaaaagaaa

SEQ ID NO: 4065287 - RNA, 16 nt, Vaccinia virus
uauuuguauuuaucua

SEQ ID NO: 4065288 - RNA, 19 nt, Vaccinia virus
uauuuuaaaguuaaucaua

SEQ ID NO: 4065289 - RNA, 22 nt, Vaccinia virus
uauuuuaacaaagcaucgauuu

SEQ ID NO: 4065290 - RNA, 16 nt, Vaccinia virus
uauuuuaauacaugua

SEQ ID NO: 4065291 - RNA, 20 nt, Vaccinia virus
uauuuuacauggauuuauca

SEQ ID NO: 4065292 - RNA, 22 nt, Vaccinia virus
uauuuuacauggauuuaucaua

SEQ ID NO: 4065293 - RNA, 15 nt, Vaccinia virus
uauuuuaccguuugu

SEQ ID NO: 4065294 - RNA, 19 nt, Vaccinia virus
uauuuucuucuacguacau

SEQ ID NO: 4065295 - RNA, 14 nt, Vaccinia virus
uauuuugcaucauu

SEQ ID NO: 4065296 - RNA, 18 nt, Vaccinia virus
uauuuuuuuauacuucua

SEQ ID NO: 4065297 - RNA, 15 nt, Vaccinia virus
uauuuuuuuuaucua

SEQ ID NO: 4065298 - RNA, 15 nt, Vaccinia virus
ucaaaauauguaaua

SEQ ID NO: 4065299 - RNA, 14 nt, Vaccinia virus
ucaaaauauguuau

SEQ ID NO: 4065300 - RNA, 18 nt, Vaccinia virus
ucaaaaucuuaauaucuu

SEQ ID NO: 4065301 - RNA, 12 nt, Vaccinia virus
ucaaaauuauuu

SEQ ID NO: 4065302 - RNA, 18 nt, Vaccinia virus
ucaaaauuguaacaacaa

SEQ ID NO: 4065303 - RNA, 23 nt, Vaccinia virus
ucaaacaaaaaagcucaauaaga

SEQ ID NO: 4065304 - RNA, 18 nt, Vaccinia virus
ucaaacaugacauuuucc

SEQ ID NO: 4065305 - RNA, 24 nt, Vaccinia virus
ucaaagagaacguaguagauuguu

SEQ ID NO: 4065306 - RNA, 13 nt, Vaccinia virus
ucaaagauaauag

SEQ ID NO: 4065307 - RNA, 16 nt, Vaccinia virus
ucaaagauuaauacau

SEQ ID NO: 4065308 - RNA, 13 nt, Vaccinia virus
ucaaagcaucaaa

SEQ ID NO: 4065309 - RNA, 15 nt, Vaccinia virus
ucaaaguauccucua

SEQ ID NO: 4065310 - RNA, 17 nt, Vaccinia virus
ucaaagucacaaagcaa

SEQ ID NO: 4065311 - RNA, 21 nt, Vaccinia virus
ucuaucgaauguagcucugau

SEQ ID NO: 4065312 - RNA, 16 nt, Vaccinia virus
ucuaucuuuuauuuua

SEQ ID NO: 4065313 - RNA, 21 nt, Vaccinia virus
ucuaugagacgauauauagua

SEQ ID NO: 4065314 - RNA, 20 nt, Vaccinia virus
ucuaugagaucgucguacau

SEQ ID NO: 4065315 - RNA, 19 nt, Vaccinia virus
ucuaugaucugucuuuuaa

SEQ ID NO: 4065316 - RNA, 15 nt, Vaccinia virus
ucuauguauuuagua

SEQ ID NO: 4065317 - RNA, 14 nt, Vaccinia virus
ucuauuguuuggaa

SEQ ID NO: 4065318 - RNA, 12 nt, Vaccinia virus
ucucaaaauaug

SEQ ID NO: 4065319 - RNA, 14 nt, Vaccinia virus
ucucaaguuacauu

SEQ ID NO: 4065320 - RNA, 12 nt, Vaccinia virus
ucucaauuucua

SEQ ID NO: 4065321 - RNA, 14 nt, Vaccinia virus
ucucagguacagau

SEQ ID NO: 4065322 - RNA, 17 nt, Vaccinia virus
ucucagguacagauuuu

SEQ ID NO: 4065323 - RNA, 14 nt, Vaccinia virus
ucucaucuaucaaa

SEQ ID NO: 4065324 - RNA, 22 nt, Vaccinia virus
ucucauuaaaugguuagagagu

SEQ ID NO: 4065325 - RNA, 17 nt, Vaccinia virus
ucucauuaauuaaccau

SEQ ID NO: 4065326 - RNA, 20 nt, Vaccinia virus
ucucgaaagacguuguacaa

SEQ ID NO: 4065327 - RNA, 16 nt, Vaccinia virus
ucucuaacuacuauug

SEQ ID NO: 4065328 - RNA, 19 nt, Vaccinia virus
ucucuaaguuaacacaugu

SEQ ID NO: 4065329 - RNA, 15 nt, Vaccinia virus
ucucuaauuaugaaa

SEQ ID NO: 4065330 - RNA, 14 nt, Vaccinia virus
ucucuaguuuuauu

SEQ ID NO: 4065331 - RNA, 16 nt, Vaccinia virus
ucucuauaacaaauau

SEQ ID NO: 4065332 - RNA, 18 nt, Vaccinia virus
ucucuaucuguuuccauu

SEQ ID NO: 4065333 - RNA, 18 nt, Vaccinia virus
ucucuauuucuuaaugaa

SEQ ID NO: 4065334 - RNA, 17 nt, Vaccinia virus
ucucugacauucagaaa

SEQ ID NO: 4065335 - RNA, 14 nt, Vaccinia virus
ucucugauagaaug

SEQ ID NO: 4065336 - RNA, 22 nt, Vaccinia virus
ucucuuuuucagaaauuaguuu

SEQ ID NO: 4065337 - RNA, 21 nt, Vaccinia virus
ucugaaauaacauauagauuu

SEQ ID NO: 4065338 - RNA, 18 nt, Vaccinia virus
ucugaaauaagauuagua

SEQ ID NO: 4065339 - RNA, 13 nt, Vaccinia virus
ucugaaauaauca

SEQ ID NO: 4065340 - RNA, 18 nt, Vaccinia virus
ucugaaauuggaugagua

SEQ ID NO: 4065341 - RNA, 12 nt, Vaccinia virus
ucugaauuauuc

SEQ ID NO: 4065342 - RNA, 15 nt, Vaccinia virus
ucugaguauaguguu

SEQ ID NO: 4065343 - RNA, 15 nt, Vaccinia virus
ucugauaauuuagau

SEQ ID NO: 4065344 - RNA, 18 nt, Vaccinia virus
ucugauccguauccauga

SEQ ID NO: 4065345 - RNA, 19 nt, Vaccinia virus
ucugccugaaauccaaaua

SEQ ID NO: 4065346 - RNA, 13 nt, Vaccinia virus
ucugcucuuaaac

SEQ ID NO: 4065347 - RNA, 22 nt, Vaccinia virus
ucuggaaaaacaacacaaugua

SEQ ID NO: 4065348 - RNA, 19 nt, Vaccinia virus
ucuggaaugacgaauccug

SEQ ID NO: 4065349 - RNA, 16 nt, Vaccinia virus
ucuguguuacauaucu

SEQ ID NO: 4065350 - RNA, 14 nt, Vaccinia virus
ucuguuugaagaaa

SEQ ID NO: 4065351 - RNA, 12 nt, Vaccinia virus
ucuguuuucacc

SEQ ID NO: 4065352 - RNA, 15 nt, Vaccinia virus
ucuuaacuacauuca

SEQ ID NO: 4065353 - RNA, 22 nt, Vaccinia virus
ucuuaagacacauuucuucauu

SEQ ID NO: 4065354 - RNA, 20 nt, Vaccinia virus
ucuuaaggagaaugaaacag

SEQ ID NO: 4065355 - RNA, 14 nt, Vaccinia virus
ucuuaauacagauu

SEQ ID NO: 4065356 - RNA, 17 nt, Vaccinia virus
ucuuaccaucuucuuug

SEQ ID NO: 4065357 - RNA, 20 nt, Vaccinia virus
ucuuaguauugaaaugugua

SEQ ID NO: 4065358 - RNA, 13 nt, Vaccinia virus
ucuuauagaugug

SEQ ID NO: 4065359 - RNA, 14 nt, Vaccinia virus
ucuuauauuuauaa

SEQ ID NO: 4065360 - RNA, 14 nt, Vaccinia virus
ucuuaucaauaaca

SEQ ID NO: 4065361 - RNA, 16 nt, Vaccinia virus
ucuuauccauuucgaa

SEQ ID NO: 4065362 - RNA, 13 nt, Vaccinia virus
ucuuauucuuauu

SEQ ID NO: 4065363 - RNA, 19 nt, Vaccinia virus
ucuuauuggucagaaauau

SEQ ID NO: 4065364 - RNA, 13 nt, Vaccinia virus
ucuucaaauuccg

SEQ ID NO: 4065365 - RNA, 22 nt, Vaccinia virus
ucuucgccgcgacuuucuacau

SEQ ID NO: 4065366 - RNA, 12 nt, Vaccinia virus
ucuucuaucaaa

SEQ ID NO: 4065367 - RNA, 23 nt, Vaccinia virus
ucuucucaaaagaucaaggaaau

SEQ ID NO: 4065368 - RNA, 22 nt, Vaccinia virus
ucuucucgcuaguuuacuaugu

SEQ ID NO: 4065369 - RNA, 22 nt, Vaccinia virus
ucuucuugagaucccacaucau

SEQ ID NO: 4065370 - RNA, 18 nt, Vaccinia virus
ucuucuuugauuaaugau

SEQ ID NO: 4065371 - RNA, 19 nt, Vaccinia virus
ucuugagugcgaauguaau

SEQ ID NO: 4065372 - RNA, 22 nt, Vaccinia virus
ucuugauuaauaaaauuuauaa

SEQ ID NO: 4065373 - RNA, 15 nt, Vaccinia virus
ucuugauuacaaaac

SEQ ID NO: 4065374 - RNA, 22 nt, Vaccinia virus
ucuugccauggacuaagauauc

SEQ ID NO: 4065375 - RNA, 14 nt, Vaccinia virus
ucuugcucaaauaa

SEQ ID NO: 4065376 - RNA, 22 nt, Vaccinia virus
ucuuuaaguauauacgauaaga

SEQ ID NO: 4065377 - RNA, 20 nt, Vaccinia virus
ucuuuaauccaaucuaagaa

SEQ ID NO: 4065378 - RNA, 21 nt, Vaccinia virus
ucuuuaguuuccgccauuuau

SEQ ID NO: 4065379 - RNA, 14 nt, Vaccinia virus
ucuuuauacaauga

SEQ ID NO: 4065380 - RNA, 17 nt, Vaccinia virus
ucuuuauauucuauaau

SEQ ID NO: 4065381 - RNA, 14 nt, Vaccinia virus
ucuuuaucucuuag

SEQ ID NO: 4065382 - RNA, 14 nt, Vaccinia virus
ucuuuauucucuac

SEQ ID NO: 4065383 - RNA, 16 nt, Vaccinia virus
ucuuuccguacaacau

SEQ ID NO: 4065384 - RNA, 23 nt, Vaccinia virus
ucuuucgcagcauaaguaguaug

SEQ ID NO: 4065385 - RNA, 14 nt, Vaccinia virus
ucuuucucucuuug

SEQ ID NO: 4065386 - RNA, 21 nt, Vaccinia virus
ucuuugauuaaugauuuagaa

SEQ ID NO: 4065387 - RNA, 19 nt, Vaccinia virus
ucuuuguccauuauuucua

SEQ ID NO: 4065388 - RNA, 20 nt, Vaccinia virus
ucuuuuauuuuuuguaggaa

SEQ ID NO: 4065389 - RNA, 16 nt, Vaccinia virus
ucuuuuucccagcauu

SEQ ID NO: 4065390 - RNA, 15 nt, Vaccinia virus
ucuuuuuuguaccau

SEQ ID NO: 4065391 - RNA, 14 nt, Vaccinia virus
ucuuuuuuuccaaa

SEQ ID NO: 4065392 - RNA, 19 nt, Vaccinia virus
ugaaaaauuuuccacaucu

SEQ ID NO: 4065393 - RNA, 18 nt, Vaccinia virus
ugaaaacuuuaaauacuu

SEQ ID NO: 4065394 - RNA, 14 nt, Vaccinia virus
ugaaaauaacucuc

SEQ ID NO: 4065395 - RNA, 21 nt, Vaccinia virus
ugaaacuaugucaaaaauugu

SEQ ID NO: 4065396 - RNA, 18 nt, Vaccinia virus
ugaaacuuggaaacaucu

SEQ ID NO: 4065397 - RNA, 13 nt, Vaccinia virus
ugaaauagaagau

SEQ ID NO: 4065398 - RNA, 19 nt, Vaccinia virus
ugaaauagcucguuucuau

SEQ ID NO: 4065399 - RNA, 16 nt, Vaccinia virus
ugaaauaguuaucaag

SEQ ID NO: 4065400 - RNA, 15 nt, Vaccinia virus
ugaaaucgucacaau

SEQ ID NO: 4065401 - RNA, 15 nt, Vaccinia virus
ugaaauugagaagau

SEQ ID NO: 4065402 - RNA, 21 nt, Vaccinia virus
ugaacaagagauauauuggag

SEQ ID NO: 4065403 - RNA, 13 nt, Vaccinia virus
ugaacauucaucu

SEQ ID NO: 4065404 - RNA, 14 nt, Vaccinia virus
ugaaccauuauucg

SEQ ID NO: 4065405 - RNA, 14 nt, Vaccinia virus
ugaacuauuucuug

SEQ ID NO: 4065406 - RNA, 20 nt, Vaccinia virus
ugaacuauuucuugaaugag

SEQ ID NO: 4065407 - RNA, 20 nt, Vaccinia virus
ugaacuccgccguaguuucc

SEQ ID NO: 4065408 - RNA, 18 nt, Vaccinia virus
ugaagaaauaauuucuac

SEQ ID NO: 4065409 - RNA, 20 nt, Vaccinia virus
ugaagagaagggaauuauug

SEQ ID NO: 4065410 - RNA, 13 nt, Vaccinia virus
ugaagagaguucu

SEQ ID NO: 4065411 - RNA, 15 nt, Vaccinia virus
ugaagaggaaacaug

SEQ ID NO: 4065412 - RNA, 13 nt, Vaccinia virus
ugaagaugauguu

SEQ ID NO: 4065413 - RNA, 17 nt, Vaccinia virus
ugaaguuaugacauuca

SEQ ID NO: 4065414 - RNA, 20 nt, Vaccinia virus
ugaaguuggugcauaucuuu

SEQ ID NO: 4065415 - RNA, 13 nt, Vaccinia virus
ugaauaaggaaua

SEQ ID NO: 4065416 - RNA, 14 nt, Vaccinia virus
ugaauacauuauca

SEQ ID NO: 4065417 - RNA, 18 nt, Vaccinia virus
ugaauauagaacaucauu

SEQ ID NO: 4065418 - RNA, 22 nt, Vaccinia virus
ugaaucaaauguaacuauucaa

SEQ ID NO: 4065419 - RNA, 13 nt, Vaccinia virus
ugaaucaucuguu

SEQ ID NO: 4065420 - RNA, 16 nt, Vaccinia virus
ugaaucuaacaaagag

SEQ ID NO: 4065421 - RNA, 15 nt, Vaccinia virus
ugaaugcugaugaac

SEQ ID NO: 4065422 - RNA, 15 nt, Vaccinia virus
ugaauggauuuauca

SEQ ID NO: 4065423 - RNA, 17 nt, Vaccinia virus
ugaaugggaauuucuau

SEQ ID NO: 4065424 - RNA, 17 nt, Vaccinia virus
ugaauucucauuuugca

SEQ ID NO: 4065425 - RNA, 13 nt, Vaccinia virus
ugaauuuacagaa

SEQ ID NO: 4065426 - RNA, 14 nt, Vaccinia virus
ugaauuugauaaga

SEQ ID NO: 4065427 - RNA, 17 nt, Vaccinia virus
ugaauuugauaagacuu

SEQ ID NO: 4065428 - RNA, 22 nt, Vaccinia virus
ugacaaaauuaaaaaagauaaa

SEQ ID NO: 4065429 - RNA, 23 nt, Vaccinia virus
ugacaucauacuagauaaaucgu

SEQ ID NO: 4065430 - RNA, 18 nt, Vaccinia virus
ugacaucuaguauugaua

SEQ ID NO: 4065431 - RNA, 21 nt, Vaccinia virus
ugacaugaugucguuaaauuu

SEQ ID NO: 4065432 - RNA, 23 nt, Vaccinia virus
ugacgauagcuuuacucugaaaa

SEQ ID NO: 4065433 - RNA, 18 nt, Vaccinia virus
ugacgauauuucuggaau

SEQ ID NO: 4065434 - RNA, 23 nt, Vaccinia virus
ugacgaucuuguuauaauuauaa

SEQ ID NO: 4065435 - RNA, 18 nt, Vaccinia virus
uaauaaaaaaauuauuua

SEQ ID NO: 4065436 - RNA, 20 nt, Vaccinia virus
uaauaaagacuucuuucuca

SEQ ID NO: 4065437 - RNA, 15 nt, Vaccinia virus
uaauaagauuucuau

SEQ ID NO: 4065438 - RNA, 15 nt, Vaccinia virus
uaauaauaaacggaa

SEQ ID NO: 4065439 - RNA, 16 nt, Vaccinia virus
uaauaauagaaaccau

SEQ ID NO: 4065440 - RNA, 14 nt, Vaccinia virus
uaauaauccagaau

SEQ ID NO: 4065441 - RNA, 18 nt, Vaccinia virus
uaauaaucuugauuguac

SEQ ID NO: 4065442 - RNA, 13 nt, Vaccinia virus
uaauaaugauuca

SEQ ID NO: 4065443 - RNA, 14 nt, Vaccinia virus
uaauaauuaaccaa

SEQ ID NO: 4065444 - RNA, 20 nt, Vaccinia virus
uaauaauuugguauauacau

SEQ ID NO: 4065445 - RNA, 19 nt, Vaccinia virus
uaauaauuuuuuaaauccu

SEQ ID NO: 4065446 - RNA, 19 nt, Vaccinia virus
uaauacagauggauuaaau

SEQ ID NO: 4065447 - RNA, 18 nt, Vaccinia virus
uaauacaugacaauaaag

SEQ ID NO: 4065448 - RNA, 21 nt, Vaccinia virus
uaauacguuggucuaucuauu

SEQ ID NO: 4065449 - RNA, 12 nt, Vaccinia virus
uaauacuaaaua

SEQ ID NO: 4065450 - RNA, 15 nt, Vaccinia virus
uaauacuuaauucuu

SEQ ID NO: 4065451 - RNA, 15 nt, Vaccinia virus
uaauagauuaaugau

SEQ ID NO: 4065452 - RNA, 14 nt, Vaccinia virus
uaauagauuucuag

SEQ ID NO: 4065453 - RNA, 18 nt, Vaccinia virus
uaauagcgucuacauuga

SEQ ID NO: 4065454 - RNA, 15 nt, Vaccinia virus
uaauaguuuaucaua

SEQ ID NO: 4065455 - RNA, 17 nt, Vaccinia virus
uaauauaaaaauacuua

SEQ ID NO: 4065456 - RNA, 15 nt, Vaccinia virus
uaauauaaacaucuu

SEQ ID NO: 4065457 - RNA, 19 nt, Vaccinia virus
uaauauaaucuagacagau

SEQ ID NO: 4065458 - RNA, 19 nt, Vaccinia virus
uaauaucauagcaucuauu

SEQ ID NO: 4065459 - RNA, 17 nt, Vaccinia virus
uaauauccugaacagca

SEQ ID NO: 4065460 - RNA, 19 nt, Vaccinia virus
uaauaucggucuuauucuu

SEQ ID NO: 4065461 - RNA, 18 nt, Vaccinia virus
uaauaugacucaugaucu

SEQ ID NO: 4065462 - RNA, 19 nt, Vaccinia virus
uaauauucccagaaaagau

SEQ ID NO: 4065463 - RNA, 14 nt, Vaccinia virus
uaauauucuaaaac

SEQ ID NO: 4065464 - RNA, 19 nt, Vaccinia virus
uaauauuucacaugaugua

SEQ ID NO: 4065465 - RNA, 18 nt, Vaccinia virus
uaauauuucuauuucuau

SEQ ID NO: 4065466 - RNA, 20 nt, Vaccinia virus
uaauauuuuauuacaaucau

SEQ ID NO: 4065467 - RNA, 16 nt, Vaccinia virus
uaaucaaaaucuuaau

SEQ ID NO: 4065468 - RNA, 20 nt, Vaccinia virus
uaaucaaauuugguguuguu

SEQ ID NO: 4065469 - RNA, 18 nt, Vaccinia virus
uaaucauaaauuauuuca

SEQ ID NO: 4065470 - RNA, 19 nt, Vaccinia virus
uaaucauauaaauguuuaa

SEQ ID NO: 4065471 - RNA, 12 nt, Vaccinia virus
uaauccaaauau

SEQ ID NO: 4065472 - RNA, 15 nt, Vaccinia virus
uaaucgaguacacca

SEQ ID NO: 4065473 - RNA, 13 nt, Vaccinia virus
uaaucguguauaa

SEQ ID NO: 4065474 - RNA, 18 nt, Vaccinia virus
uaaucuacgauauuauua

SEQ ID NO: 4065475 - RNA, 12 nt, Vaccinia virus
uaaucuauuuua

SEQ ID NO: 4065476 - RNA, 15 nt, Vaccinia virus
uaaucuuacuacgau

SEQ ID NO: 4065477 - RNA, 14 nt, Vaccinia virus
uaaugaaauuauuc

SEQ ID NO: 4065478 - RNA, 15 nt, Vaccinia virus
uaaugaaauuauuca

SEQ ID NO: 4065479 - RNA, 20 nt, Vaccinia virus
uaaugacaauaaaauuauca

SEQ ID NO: 4065480 - RNA, 22 nt, Vaccinia virus
uaaugacaauaaaauuaucaug

SEQ ID NO: 4065481 - RNA, 22 nt, Vaccinia virus
uaaugccuuacucgguguauau

SEQ ID NO: 4065482 - RNA, 12 nt, Vaccinia virus
uaauggaguaau

SEQ ID NO: 4065483 - RNA, 15 nt, Vaccinia virus
uaauggaugucauga

SEQ ID NO: 4065484 - RNA, 19 nt, Vaccinia virus
uaaugguagcaauaugcua

SEQ ID NO: 4065485 - RNA, 12 nt, Vaccinia virus
uaauuaauguaa

SEQ ID NO: 4065486 - RNA, 13 nt, Vaccinia virus
uaauuaaugucca

SEQ ID NO: 4065487 - RNA, 16 nt, Vaccinia virus
uaauuacauccuugga

SEQ ID NO: 4065488 - RNA, 12 nt, Vaccinia virus
uaauuacauguu

SEQ ID NO: 4065489 - RNA, 16 nt, Vaccinia virus
uaauuagguuguuuau

SEQ ID NO: 4065490 - RNA, 16 nt, Vaccinia virus
uaauuaugauuuugau

SEQ ID NO: 4065491 - RNA, 16 nt, Vaccinia virus
uaauucauaagaauuu

SEQ ID NO: 4065492 - RNA, 19 nt, Vaccinia virus
uaauucuauuaauuguuaa

SEQ ID NO: 4065493 - RNA, 17 nt, Vaccinia virus
uaauucucauuaaaugg

SEQ ID NO: 4065494 - RNA, 15 nt, Vaccinia virus
uaauucuccugaaaa

SEQ ID NO: 4065495 - RNA, 18 nt, Vaccinia virus
uaauugcuacacccacua

SEQ ID NO: 4065496 - RNA, 14 nt, Vaccinia virus
uaauugucuuagaa

SEQ ID NO: 4065497 - RNA, 18 nt, Vaccinia virus
uaauuguuuacuguauau

SEQ ID NO: 4065498 - RNA, 21 nt, Vaccinia virus
uaauuucacaacuuuacuguu

SEQ ID NO: 4065499 - RNA, 13 nt, Vaccinia virus
uaauuucacgaau

SEQ ID NO: 4065500 - RNA, 19 nt, Vaccinia virus
uaauuucccaaauacacau

SEQ ID NO: 4065501 - RNA, 20 nt, Vaccinia virus
uaauuucguuaaaacauuca

SEQ ID NO: 4065502 - RNA, 13 nt, Vaccinia virus
uaauuucuagaac

SEQ ID NO: 4065503 - RNA, 22 nt, Vaccinia virus
uaauuugauucuucguucuuca

SEQ ID NO: 4065504 - RNA, 19 nt, Vaccinia virus
uaauuuguaaaccaucuua

SEQ ID NO: 4065505 - RNA, 17 nt, Vaccinia virus
uaauuuuaucaagacau

SEQ ID NO: 4065506 - RNA, 18 nt, Vaccinia virus
uaauuuucauauauugag

SEQ ID NO: 4065507 - RNA, 13 nt, Vaccinia virus
uacaaaaucgauu

SEQ ID NO: 4065508 - RNA, 20 nt, Vaccinia virus
uacaaaauuugcaucuacau

SEQ ID NO: 4065509 - RNA, 16 nt, Vaccinia virus
uacaaccaaauucuug

SEQ ID NO: 4065510 - RNA, 12 nt, Vaccinia virus
uacaacuaguga

SEQ ID NO: 4065511 - RNA, 21 nt, Vaccinia virus
uacaacuguuguaaauuauuu

SEQ ID NO: 4065512 - RNA, 13 nt, Vaccinia virus
uacaauaaauguu

SEQ ID NO: 4065513 - RNA, 17 nt, Vaccinia virus
uacaauaauuacaagua

SEQ ID NO: 4065514 - RNA, 22 nt, Vaccinia virus
uacaauaauucagauaauguaa

SEQ ID NO: 4065515 - RNA, 13 nt, Vaccinia virus
uacaauacaugua

SEQ ID NO: 4065516 - RNA, 17 nt, Vaccinia virus
uacaauacgauaaacau

SEQ ID NO: 4065517 - RNA, 18 nt, Vaccinia virus
uacaauauucauauccuu

SEQ ID NO: 4065518 - RNA, 20 nt, Vaccinia virus
uacaauauuuaaaagacuua

SEQ ID NO: 4065519 - RNA, 19 nt, Vaccinia virus
uacaaucucguuuaauauu

SEQ ID NO: 4065520 - RNA, 21 nt, Vaccinia virus
uacaaugauaaugauacagua

SEQ ID NO: 4065521 - RNA, 20 nt, Vaccinia virus
uacaaugcucaguaaaugua

SEQ ID NO: 4065522 - RNA, 13 nt, Vaccinia virus
uacaauucuguac

SEQ ID NO: 4065523 - RNA, 14 nt, Vaccinia virus
uacacaacacaaug

SEQ ID NO: 4065524 - RNA, 18 nt, Vaccinia virus
uacacaucagcaucuuga

SEQ ID NO: 4065525 - RNA, 22 nt, Vaccinia virus
uacacguaccucucuaaugggg

SEQ ID NO: 4065526 - RNA, 22 nt, Vaccinia virus
uacacuccucagauuuauacau

SEQ ID NO: 4065527 - RNA, 20 nt, Vaccinia virus
uacagauacagauguuacaa

SEQ ID NO: 4065528 - RNA, 19 nt, Vaccinia virus
uacagauguuacaaaugua

SEQ ID NO: 4065529 - RNA, 23 nt, Vaccinia virus
uacaguaaguacaucaucuggaa

SEQ ID NO: 4065530 - RNA, 20 nt, Vaccinia virus
uacaguguaugguacuagau

SEQ ID NO: 4065531 - RNA, 24 nt, Vaccinia virus
uacauaaacauguccaauacguua

SEQ ID NO: 4065532 - RNA, 18 nt, Vaccinia virus
uacauaggcaacauccga

SEQ ID NO: 4065533 - RNA, 19 nt, Vaccinia virus
uacauauaugcaauucgcu

SEQ ID NO: 4065534 - RNA, 16 nt, Vaccinia virus
uacauauuauacagua

SEQ ID NO: 4065535 - RNA, 19 nt, Vaccinia virus
uacauauuuuagaacagaa

SEQ ID NO: 4065536 - RNA, 14 nt, Vaccinia virus
uacaucuguuuccu

SEQ ID NO: 4065537 - RNA, 14 nt, Vaccinia virus
uacaucuugacauu

SEQ ID NO: 4065538 - RNA, 20 nt, Vaccinia virus
uacauggaugauauagauau

SEQ ID NO: 4065539 - RNA, 19 nt, Vaccinia virus
uacauggucucagaaguag

SEQ ID NO: 4065540 - RNA, 22 nt, Vaccinia virus
uacauuaaacguacauuuucca

SEQ ID NO: 4065541 - RNA, 21 nt, Vaccinia virus
uacauuggcuacggcagauau

SEQ ID NO: 4065542 - RNA, 13 nt, Vaccinia virus
uacauuucacaga

SEQ ID NO: 4065543 - RNA, 13 nt, Vaccinia virus
uacauuucaucau

SEQ ID NO: 4065544 - RNA, 17 nt, Vaccinia virus
uaccaaccuacacuauu

SEQ ID NO: 4065545 - RNA, 13 nt, Vaccinia virus
uaccagagauuuu

SEQ ID NO: 4065546 - RNA, 23 nt, Vaccinia virus
uaccaucuucuuugauuaaugau

SEQ ID NO: 4065547 - RNA, 21 nt, Vaccinia virus
uaccauggacggagacaaauu

SEQ ID NO: 4065548 - RNA, 15 nt, Vaccinia virus
uacccaauaaaaugu

SEQ ID NO: 4065549 - RNA, 17 nt, Vaccinia virus
uacccauggaaaaauag

SEQ ID NO: 4065550 - RNA, 15 nt, Vaccinia virus
uacccgcaauuauua

SEQ ID NO: 4065551 - RNA, 14 nt, Vaccinia virus
uaccgcacuuauau

SEQ ID NO: 4065552 - RNA, 21 nt, Vaccinia virus
uaccguaguauauugagagug

SEQ ID NO: 4065553 - RNA, 21 nt, Vaccinia virus
uaccuaauacuaaauacauua

SEQ ID NO: 4065554 - RNA, 21 nt, Vaccinia virus
uaccuagaacgaugucaaaau

SEQ ID NO: 4065555 - RNA, 21 nt, Vaccinia virus
uaccuaucaaggaacaaauau

SEQ ID NO: 4065556 - RNA, 19 nt, Vaccinia virus
uaccuauuaauacaucgua

SEQ ID NO: 4065557 - RNA, 18 nt, Vaccinia virus
uaccuccacaucuaaaaa

SEQ ID NO: 4065558 - RNA, 15 nt, Vaccinia virus
uaccuggaauguaaa

SEQ ID NO: 4065559 - RNA, 18 nt, Vaccinia virus
uaccuuucuacaugaaau

SEQ ID NO: 4065560 - RNA, 21 nt, Vaccinia virus
uacgaaaacgaaaucuguaau

SEQ ID NO: 4065561 - RNA, 11 nt, Vaccinia virus
uacgacgucag

SEQ ID NO: 4065562 - RNA, 23 nt, Vaccinia virus
uaaaauaaucauacaaucuagua

SEQ ID NO: 4065563 - RNA, 16 nt, Vaccinia virus
uaaaauaaucucuuag

SEQ ID NO: 4065564 - RNA, 21 nt, Vaccinia virus
uaaaauacuaaugcaucuauu

SEQ ID NO: 4065565 - RNA, 22 nt, Vaccinia virus
uaaaauagacaauggaauucau

SEQ ID NO: 4065566 - RNA, 23 nt, Vaccinia virus
uaaaauaucuagcaaaaauucua

SEQ ID NO: 4065567 - RNA, 20 nt, Vaccinia virus
uaaaaucaaucguuaucuaa

SEQ ID NO: 4065568 - RNA, 22 nt, Vaccinia virus
uaaaaucaucauuauaauaggu

SEQ ID NO: 4065569 - RNA, 23 nt, Vaccinia virus
uaaaauuauuuaauuuaauacau

SEQ ID NO: 4065570 - RNA, 21 nt, Vaccinia virus
uaaaauugauucuaugaaaac

SEQ ID NO: 4065571 - RNA, 16 nt, Vaccinia virus
uaaaauuuauaacauu

SEQ ID NO: 4065572 - RNA, 18 nt, Vaccinia virus
uaaaauuucauagacuuu

SEQ ID NO: 4065573 - RNA, 12 nt, Vaccinia virus
uaaaauuuccau

SEQ ID NO: 4065574 - RNA, 17 nt, Vaccinia virus
uaaacacauagaaauaa

SEQ ID NO: 4065575 - RNA, 17 nt, Vaccinia virus
uaaacauaagacuuauu

SEQ ID NO: 4065576 - RNA, 17 nt, Vaccinia virus
uaaacauuguuaucuag

SEQ ID NO: 4065577 - RNA, 15 nt, Vaccinia virus
uaaaccagacaaccc

SEQ ID NO: 4065578 - RNA, 14 nt, Vaccinia virus
uaaaccauuuuuca

SEQ ID NO: 4065579 - RNA, 16 nt, Vaccinia virus
uaaacgaaaacuauau

SEQ ID NO: 4065580 - RNA, 23 nt, Vaccinia virus
uaaacgccuuuagaaaaacuuua

SEQ ID NO: 4065581 - RNA, 20 nt, Vaccinia virus
uaaacuacgugaacauaugg

SEQ ID NO: 4065582 - RNA, 19 nt, Vaccinia virus
uaaacuguuuauuaaugau

SEQ ID NO: 4065583 - RNA, 16 nt, Vaccinia virus
uaaacuguuuguauaa

SEQ ID NO: 4065584 - RNA, 14 nt, Vaccinia virus
uaaacuuuaaugau

SEQ ID NO: 4065585 - RNA, 20 nt, Vaccinia virus
uaaacuuuauccauaucucu

SEQ ID NO: 4065586 - RNA, 16 nt, Vaccinia virus
uaaagaacgaauguug

SEQ ID NO: 4065587 - RNA, 16 nt, Vaccinia virus
uaaagaauaucuuugg

SEQ ID NO: 4065588 - RNA, 19 nt, Vaccinia virus
uaaagaauguauaaaccuu

SEQ ID NO: 4065589 - RNA, 18 nt, Vaccinia virus
uaaagauagaaaugaauu

SEQ ID NO: 4065590 - RNA, 13 nt, Vaccinia virus
uaaagauauuucu

SEQ ID NO: 4065591 - RNA, 18 nt, Vaccinia virus
uaaagaugacgaugaaaa

SEQ ID NO: 4065592 - RNA, 16 nt, Vaccinia virus
uaaagcaaaaugguug

SEQ ID NO: 4065593 - RNA, 19 nt, Vaccinia virus
uaaagcccucuauuagcau

SEQ ID NO: 4065594 - RNA, 15 nt, Vaccinia virus
uaaaggaugaguaca

SEQ ID NO: 4065595 - RNA, 17 nt, Vaccinia virus
uaaaguacguaaaucua

SEQ ID NO: 4065596 - RNA, 14 nt, Vaccinia virus
uaaauaaauacuuu

SEQ ID NO: 4065597 - RNA, 18 nt, Vaccinia virus
uaaauacuuuuuauuuac

SEQ ID NO: 4065598 - RNA, 21 nt, Vaccinia virus
uaaauaguuuuuuuguuuccu

SEQ ID NO: 4065599 - RNA, 21 nt, Vaccinia virus
uaaauauauuuacaauuauug

SEQ ID NO: 4065600 - RNA, 13 nt, Vaccinia virus
uaaauaucauaau

SEQ ID NO: 4065601 - RNA, 15 nt, Vaccinia virus
uaaaucaacgucauc

SEQ ID NO: 4065602 - RNA, 17 nt, Vaccinia virus
uaaaucaucgauuuuca

SEQ ID NO: 4065603 - RNA, 14 nt, Vaccinia virus
uaaaucauggauuu

SEQ ID NO: 4065604 - RNA, 16 nt, Vaccinia virus
uaaaucauggauuuua

SEQ ID NO: 4065605 - RNA, 23 nt, Vaccinia virus
uaaauccaaaauaacuaaacauu

SEQ ID NO: 4065606 - RNA, 22 nt, Vaccinia virus
uaaauccaguaauaucaugucu

SEQ ID NO: 4065607 - RNA, 18 nt, Vaccinia virus
uaaaugaaaaaaaacuag

SEQ ID NO: 4065608 - RNA, 16 nt, Vaccinia virus
uaaaugaauucucauu

SEQ ID NO: 4065609 - RNA, 17 nt, Vaccinia virus
uaaauguggcuacaaac

SEQ ID NO: 4065610 - RNA, 18 nt, Vaccinia virus
uaaauguuguaauuguau

SEQ ID NO: 4065611 - RNA, 22 nt, Vaccinia virus
uaaauguuuuuaucaucuugga

SEQ ID NO: 4065612 - RNA, 16 nt, Vaccinia virus
uaaauucgauaucuuu

SEQ ID NO: 4065613 - RNA, 14 nt, Vaccinia virus
uaaauucuguuuaa

SEQ ID NO: 4065614 - RNA, 15 nt, Vaccinia virus
uaaauugaaagcgag

SEQ ID NO: 4065615 - RNA, 18 nt, Vaccinia virus
uaaauuuacgaauuaaga

SEQ ID NO: 4065616 - RNA, 18 nt, Vaccinia virus
uaaauuuuaaacauaaag

SEQ ID NO: 4065617 - RNA, 14 nt, Vaccinia virus
uaaauuuuaucaug

SEQ ID NO: 4065618 - RNA, 13 nt, Vaccinia virus
uaacaaaauuaaa

SEQ ID NO: 4065619 - RNA, 13 nt, Vaccinia virus
uaacaaagaaaga

SEQ ID NO: 4065620 - RNA, 13 nt, Vaccinia virus
uaacaaauuaaag

SEQ ID NO: 4065621 - RNA, 21 nt, Vaccinia virus
uaacaacgacuuauaauuaau

SEQ ID NO: 4065622 - RNA, 21 nt, Vaccinia virus
uaacaagaucgauagacacug

SEQ ID NO: 4065623 - RNA, 19 nt, Vaccinia virus
uaacaauaucaauaaauuu

SEQ ID NO: 4065624 - RNA, 16 nt, Vaccinia virus
uaacacaaaaugugaa

SEQ ID NO: 4065625 - RNA, 13 nt, Vaccinia virus
uaacacauuuuca

SEQ ID NO: 4065626 - RNA, 20 nt, Vaccinia virus
uaacaccuauaagauuauca

SEQ ID NO: 4065627 - RNA, 17 nt, Vaccinia virus
uaacacuauacucauau

SEQ ID NO: 4065628 - RNA, 18 nt, Vaccinia virus
uaacagcaauaguauaau

SEQ ID NO: 4065629 - RNA, 23 nt, Vaccinia virus
uaacagcaauaguauaauuauau

SEQ ID NO: 4065630 - RNA, 17 nt, Vaccinia virus
uaacauaucguuucuuu

SEQ ID NO: 4065631 - RNA, 12 nt, Vaccinia virus
uaacaucauuau

SEQ ID NO: 4065632 - RNA, 19 nt, Vaccinia virus
cuaauaugaggaaaaugau

SEQ ID NO: 4065633 - RNA, 23 nt, Vaccinia virus
cuaauauucccaaacauacaucu

SEQ ID NO: 4065634 - RNA, 15 nt, Vaccinia virus
cuaauauuuuuagau

SEQ ID NO: 4065635 - RNA, 18 nt, Vaccinia virus
cuaaucucuuaacaaaaa

SEQ ID NO: 4065636 - RNA, 16 nt, Vaccinia virus
cuaaucucuucuuuaa

SEQ ID NO: 4065637 - RNA, 17 nt, Vaccinia virus
cuaaugcauguuauaga

SEQ ID NO: 4065638 - RNA, 20 nt, Vaccinia virus
cuaauguauuaguuaaauau

SEQ ID NO: 4065639 - RNA, 22 nt, Vaccinia virus
cuaauguauuaguuaaauauua

SEQ ID NO: 4065640 - RNA, 18 nt, Vaccinia virus
cuaaugugauucucugaa

SEQ ID NO: 4065641 - RNA, 23 nt, Vaccinia virus
cuaauguuuccggagauagauuu

SEQ ID NO: 4065642 - RNA, 19 nt, Vaccinia virus
cuaauucuauauuguuaua

SEQ ID NO: 4065643 - RNA, 17 nt, Vaccinia virus
cuaauuuacuaucugua

SEQ ID NO: 4065644 - RNA, 22 nt, Vaccinia virus
cuaauuuauugcaugguaagga

SEQ ID NO: 4065645 - RNA, 14 nt, Vaccinia virus
cuaauuucuguaua

SEQ ID NO: 4065646 - RNA, 17 nt, Vaccinia virus
cuacaaauagagauaaa

SEQ ID NO: 4065647 - RNA, 13 nt, Vaccinia virus
cuacaacuaguga

SEQ ID NO: 4065648 - RNA, 23 nt, Vaccinia virus
cuacaagacaaagauuuaucaga

SEQ ID NO: 4065649 - RNA, 13 nt, Vaccinia virus
cuacaauauuuca

SEQ ID NO: 4065650 - RNA, 23 nt, Vaccinia virus
cuacaaugaacuaagagaaaucu

SEQ ID NO: 4065651 - RNA, 18 nt, Vaccinia virus
cuacagguugcagcauag

SEQ ID NO: 4065652 - RNA, 23 nt, Vaccinia virus
cuacaguaggcauaccauuagau

SEQ ID NO: 4065653 - RNA, 15 nt, Vaccinia virus
cuacauucucauuaa

SEQ ID NO: 4065654 - RNA, 17 nt, Vaccinia virus
cuacgaaaacgaaaucu

SEQ ID NO: 4065655 - RNA, 19 nt, Vaccinia virus
ccgacuguaacauugacug

SEQ ID NO: 4065656 - RNA, 21 nt, Vaccinia virus
ccgauauauuugcacacauaa

SEQ ID NO: 4065657 - RNA, 20 nt, Vaccinia virus
ccgaucaaagaauuaaugau

SEQ ID NO: 4065658 - RNA, 14 nt, Vaccinia virus
ccgcauuaaaugau

SEQ ID NO: 4065659 - RNA, 18 nt, Vaccinia virus
ccggaguaauugauuaua

SEQ ID NO: 4065660 - RNA, 17 nt, Vaccinia virus
ccggugagaacaugaga

SEQ ID NO: 4065661 - RNA, 14 nt, Vaccinia virus
ccguagaaauacua

SEQ ID NO: 4065662 - RNA, 11 nt, Vaccinia virus
ccguguuuauu

SEQ ID NO: 4065663 - RNA, 11 nt, Vaccinia virus
ccguucucuga

SEQ ID NO: 4065664 - RNA, 19 nt, Vaccinia virus
ccuaacgaugauauguuuu

SEQ ID NO: 4065665 - RNA, 13 nt, Vaccinia virus
ccuaauaucauau

SEQ ID NO: 4065666 - RNA, 22 nt, Vaccinia virus
ccuagaaggucgccguauguua

SEQ ID NO: 4065667 - RNA, 13 nt, Vaccinia virus
ccuagcuuuguua

SEQ ID NO: 4065668 - RNA, 23 nt, Vaccinia virus
ccuauccaauaauccaucaucug

SEQ ID NO: 4065669 - RNA, 19 nt, Vaccinia virus
ccuauuccacauuuuguuu

SEQ ID NO: 4065670 - RNA, 22 nt, Vaccinia virus
ccuauugaucuucauuucguuu

SEQ ID NO: 4065671 - RNA, 17 nt, Vaccinia virus
ccucaaacucuauuuua

SEQ ID NO: 4065672 - RNA, 19 nt, Vaccinia virus
ccucaaucauguacuagcu

SEQ ID NO: 4065673 - RNA, 14 nt, Vaccinia virus
ccucucuuaacaaa

SEQ ID NO: 4065674 - RNA, 19 nt, Vaccinia virus
ccugccauaaauaaaugcu

SEQ ID NO: 4065675 - RNA, 15 nt, Vaccinia virus
ccuggaaaaauacuu

SEQ ID NO: 4065676 - RNA, 23 nt, Vaccinia virus
ccuguacuauaccauuaucuaua

SEQ ID NO: 4065677 - RNA, 12 nt, Vaccinia virus
ccuguguuuaua

SEQ ID NO: 4065678 - RNA, 21 nt, Vaccinia virus
ccuguuucuacuaacuuuuug

SEQ ID NO: 4065679 - RNA, 17 nt, Vaccinia virus
ccuuaaauguaucuuua

SEQ ID NO: 4065680 - RNA, 22 nt, Vaccinia virus
ccuuguccaaugugaauugaau

SEQ ID NO: 4065681 - RNA, 20 nt, Vaccinia virus
ccuuuuccuuaucuucauag

SEQ ID NO: 4065682 - RNA, 22 nt, Vaccinia virus
ccuuuugauaaauuucuucuug

SEQ ID NO: 4065683 - RNA, 15 nt, Vaccinia virus
cgaaaagaaacagau

SEQ ID NO: 4065684 - RNA, 14 nt, Vaccinia virus
cgaaagauguuauu

SEQ ID NO: 4065685 - RNA, 23 nt, Vaccinia virus
cgaaauaaaaaacauaauuuuaa

SEQ ID NO: 4065686 - RNA, 18 nt, Vaccinia virus
cgaaauaaauaaugaauu

SEQ ID NO: 4065687 - RNA, 16 nt, Vaccinia virus
cgaaauacaaaauguu

SEQ ID NO: 4065688 - RNA, 17 nt, Vaccinia virus
cgaaauacaaaauguua

SEQ ID NO: 4065689 - RNA, 21 nt, Vaccinia virus
cgaaauaguuaauaauucugu

SEQ ID NO: 4065690 - RNA, 19 nt, Vaccinia virus
cgaacacuauuagaauuaa

SEQ ID NO: 4065691 - RNA, 22 nt, Vaccinia virus
cgaaccagaaucagugaauaaa

SEQ ID NO: 4065692 - RNA, 22 nt, Vaccinia virus
cgaacccguacccagaaauacc

SEQ ID NO: 4065693 - RNA, 20 nt, Vaccinia virus
cgaagaauuaaaucuaacga

SEQ ID NO: 4065694 - RNA, 18 nt, Vaccinia virus
cgaagagacgauagauuu

SEQ ID NO: 4065695 - RNA, 11 nt, Vaccinia virus
cgaagcaaacg

SEQ ID NO: 4065696 - RNA, 23 nt, Vaccinia virus
cgaagugcguguaacaaaguauu

SEQ ID NO: 4065697 - RNA, 17 nt, Vaccinia virus
cgaauaaagugaacaau

SEQ ID NO: 4065698 - RNA, 13 nt, Vaccinia virus
cgaauaaauagau

SEQ ID NO: 4065699 - RNA, 13 nt, Vaccinia virus
cgaauaacaaaaa

SEQ ID NO: 4065700 - RNA, 16 nt, Vaccinia virus
cgaauaccauggauug

SEQ ID NO: 4065701 - RNA, 16 nt, Vaccinia virus
cgaauauaaaugauuu

SEQ ID NO: 4065702 - RNA, 17 nt, Vaccinia virus
cgaauauaaaugauuuc

SEQ ID NO: 4065703 - RNA, 22 nt, Vaccinia virus
cgaauaucguucucuaaauguc

SEQ ID NO: 4065704 - RNA, 15 nt, Vaccinia virus
cgaauccuguuucua

SEQ ID NO: 4065705 - RNA, 21 nt, Vaccinia virus
cgacaugauuaaguauuguuu

SEQ ID NO: 4065706 - RNA, 21 nt, Vaccinia virus
cgacuaucaacaauuuuguau

SEQ ID NO: 4065707 - RNA, 17 nt, Vaccinia virus
cgacucauaagaaagag

SEQ ID NO: 4065708 - RNA, 22 nt, Vaccinia virus
cgacucuguuggauauggguuu

SEQ ID NO: 4065709 - RNA, 13 nt, Vaccinia virus
cgacuuuuuguuu

SEQ ID NO: 4065710 - RNA, 17 nt, Vaccinia virus
cgagaauaugauagaaa

SEQ ID NO: 4065711 - RNA, 17 nt, Vaccinia virus
cgagauacagaaaagcu

SEQ ID NO: 4065712 - RNA, 17 nt, Vaccinia virus
cgauaacggaauagacu

SEQ ID NO: 4065713 - RNA, 19 nt, Vaccinia virus
cgauaacgugaaauauauu

SEQ ID NO: 4065714 - RNA, 19 nt, Vaccinia virus
cgauaaugugguuacucuu

SEQ ID NO: 4065715 - RNA, 22 nt, Vaccinia virus
cgauaauugucucauauguuuu

SEQ ID NO: 4065716 - RNA, 20 nt, Vaccinia virus
cgauacaaaaugugucaaga

SEQ ID NO: 4065717 - RNA, 13 nt, Vaccinia virus
cgauauagaguau

SEQ ID NO: 4065718 - RNA, 19 nt, Vaccinia virus
cgauaugccuccagaaguu

SEQ ID NO: 4065719 - RNA, 18 nt, Vaccinia virus
cgauauuucuuuucguuu

SEQ ID NO: 4065720 - RNA, 13 nt, Vaccinia virus
cgaucauaucuau

SEQ ID NO: 4065721 - RNA, 21 nt, Vaccinia virus
cgaucuuguuguuuauuuuca

SEQ ID NO: 4065722 - RNA, 21 nt, Vaccinia virus
cgauguggaaauuaaucugua

SEQ ID NO: 4065723 - RNA, 15 nt, Vaccinia virus
cgauuauuucugaau

SEQ ID NO: 4065724 - RNA, 14 nt, Vaccinia virus
cgauucaaaguacu

SEQ ID NO: 4065725 - RNA, 17 nt, Vaccinia virus
cgauucaaauaaaucac

SEQ ID NO: 4065726 - RNA, 14 nt, Vaccinia virus
cgauucaacaaaac

SEQ ID NO: 4065727 - RNA, 13 nt, Vaccinia virus
cgcaaaaaaacug

SEQ ID NO: 4065728 - RNA, 18 nt, Vaccinia virus
cgcaauuauauaauguau

SEQ ID NO: 4065729 - RNA, 14 nt, Vaccinia virus
cgcagaaaauaucu

SEQ ID NO: 4065730 - RNA, 17 nt, Vaccinia virus
cgcaucaggauauaaag

SEQ ID NO: 4065731 - RNA, 12 nt, Vaccinia virus
cgccauggaugg

SEQ ID NO: 4065732 - RNA, 17 nt, Vaccinia virus
cgccauuuauccagucu

SEQ ID NO: 4065733 - RNA, 19 nt, Vaccinia virus
cgccuccguugucauaaac

SEQ ID NO: 4065734 - RNA, 19 nt, Vaccinia virus
cgcggaaaaaacauaauag

SEQ ID NO: 4065735 - RNA, 15 nt, Vaccinia virus
cgcuagucaucacau

SEQ ID NO: 4065736 - RNA, 14 nt, Vaccinia virus
cgcugauuuaacua

SEQ ID NO: 4065737 - RNA, 17 nt, Vaccinia virus
cggaaaugguagaugua

SEQ ID NO: 4065738 - RNA, 13 nt, Vaccinia virus
cggaauagaugua

SEQ ID NO: 4065739 - RNA, 17 nt, Vaccinia virus
cggagaagaauugguaa

SEQ ID NO: 4065740 - RNA, 14 nt, Vaccinia virus
cggaucuucuuaau

SEQ ID NO: 4065741 - RNA, 21 nt, Vaccinia virus
cggaucuucuuaauucaucuu

SEQ ID NO: 4065742 - RNA, 16 nt, Vaccinia virus
cgguguguagaaagug

SEQ ID NO: 4065743 - RNA, 17 nt, Vaccinia virus
cguaagcgcuauacaaa

SEQ ID NO: 4065744 - RNA, 18 nt, Vaccinia virus
cguauaacaguaaaagaa

SEQ ID NO: 4065745 - RNA, 20 nt, Vaccinia virus
cguauauaacauuguuuaug

SEQ ID NO: 4065746 - RNA, 17 nt, Vaccinia virus
cguauucugaugauauu

SEQ ID NO: 4065747 - RNA, 21 nt, Vaccinia virus
cguauucugaugauauuagaa

SEQ ID NO: 4065748 - RNA, 15 nt, Vaccinia virus
cgucagcugcucuag

SEQ ID NO: 4065749 - RNA, 20 nt, Vaccinia virus
cguccaacgaguaacauccg

SEQ ID NO: 4065750 - RNA, 20 nt, Vaccinia virus
cgucgucaaaauauuuacua

SEQ ID NO: 4065751 - RNA, 23 nt, Vaccinia virus
cgucucugccauggauggaaaca

SEQ ID NO: 4065752 - RNA, 14 nt, Vaccinia virus
cguggauuauaaca

SEQ ID NO: 4065753 - RNA, 13 nt, Vaccinia virus
cgugguagauguu

SEQ ID NO: 4065754 - RNA, 19 nt, Vaccinia virus
cgugguaucuucuccauaa

SEQ ID NO: 4065755 - RNA, 14 nt, Vaccinia virus
cgugguuguuuauc

SEQ ID NO: 4065756 - RNA, 23 nt, Vaccinia virus
cguguauuuuugacguaaaugug

SEQ ID NO: 4065757 - RNA, 15 nt, Vaccinia virus
cguguguuucaggau

SEQ ID NO: 4065758 - RNA, 18 nt, Vaccinia virus
cguuaauaguacuacaau

SEQ ID NO: 4065759 - RNA, 20 nt, Vaccinia virus
cguucgcgacaguauguggu

SEQ ID NO: 4065760 - RNA, 13 nt, Vaccinia virus
cguucuacauaaa

SEQ ID NO: 4065761 - RNA, 21 nt, Vaccinia virus
cguuguucuuccaauugcaau

SEQ ID NO: 4065762 - RNA, 12 nt, Vaccinia virus
cguuuauggauc

SEQ ID NO: 4065763 - RNA, 19 nt, Vaccinia virus
cguuuuaaauuuuguauuc

SEQ ID NO: 4065764 - RNA, 23 nt, Vaccinia virus
cuaaaaaauagcgcugaaaauaa

SEQ ID NO: 4065765 - RNA, 16 nt, Vaccinia virus
cuaaaaagaauguaua

SEQ ID NO: 4065766 - RNA, 13 nt, Vaccinia virus
cuaaaauaauguc

SEQ ID NO: 4065767 - RNA, 15 nt, Vaccinia virus
cuaaaauaucgaugu

SEQ ID NO: 4065768 - RNA, 16 nt, Vaccinia virus
cuaaaauauuuucuag

SEQ ID NO: 4065769 - RNA, 14 nt, Vaccinia virus
cuaaaaucugcaua

SEQ ID NO: 4065770 - RNA, 21 nt, Vaccinia virus
cuaaagagauuuagacaacag

SEQ ID NO: 4065771 - RNA, 12 nt, Vaccinia virus
cuaaaguauuug

SEQ ID NO: 4065772 - RNA, 21 nt, Vaccinia virus
cuaaaucuguauaucuuucca

SEQ ID NO: 4065773 - RNA, 15 nt, Vaccinia virus
cuaaauucgauaucu

SEQ ID NO: 4065774 - RNA, 13 nt, Vaccinia virus
cuaacaaaacuau

SEQ ID NO: 4065775 - RNA, 15 nt, Vaccinia virus
cuaacauuguuaauu

SEQ ID NO: 4065776 - RNA, 13 nt, Vaccinia virus
cuaacguauucua

SEQ ID NO: 4065777 - RNA, 20 nt, Vaccinia virus
cuaagcaauagguaauaacu

SEQ ID NO: 4065778 - RNA, 16 nt, Vaccinia virus
cuaagcgguaaauaau

SEQ ID NO: 4065779 - RNA, 14 nt, Vaccinia virus
cuaaggauccagaa

SEQ ID NO: 4065780 - RNA, 23 nt, Vaccinia virus
cuaauaacacuuccaguaucaau

SEQ ID NO: 4065781 - RNA, 14 nt, Vaccinia virus
cuaauauauucuua

SEQ ID NO: 4065782 - RNA, 19 nt, Vaccinia virus
auuauauaauguauaaaug

SEQ ID NO: 4065783 - RNA, 14 nt, Vaccinia virus
auuauauacugaac

SEQ ID NO: 4065784 - RNA, 15 nt, Vaccinia virus
auuauauaguguugc

SEQ ID NO: 4065785 - RNA, 19 nt, Vaccinia virus
auuauaucacaacaucuau

SEQ ID NO: 4065786 - RNA, 14 nt, Vaccinia virus
auuauauguagaag

SEQ ID NO: 4065787 - RNA, 13 nt, Vaccinia virus
auuaucaaaucuu

SEQ ID NO: 4065788 - RNA, 16 nt, Vaccinia virus
auuaucaaauguuguu

SEQ ID NO: 4065789 - RNA, 21 nt, Vaccinia virus
auuaucaagauucugauguau

SEQ ID NO: 4065790 - RNA, 12 nt, Vaccinia virus
auuaucaguaau

SEQ ID NO: 4065791 - RNA, 15 nt, Vaccinia virus
auuaucggaaauacu

SEQ ID NO: 4065792 - RNA, 18 nt, Vaccinia virus
auuaucucagugcaaaga

SEQ ID NO: 4065793 - RNA, 21 nt, Vaccinia virus
auuaugcauucguuuaaagau

SEQ ID NO: 4065794 - RNA, 15 nt, Vaccinia virus
auuauguaucaauau

SEQ ID NO: 4065795 - RNA, 17 nt, Vaccinia virus
auuauuaaauuaugaag

SEQ ID NO: 4065796 - RNA, 18 nt, Vaccinia virus
auuauuaaguauaauaga

SEQ ID NO: 4065797 - RNA, 17 nt, Vaccinia virus
auuauuaaucagaauac

SEQ ID NO: 4065798 - RNA, 16 nt, Vaccinia virus
auuauuacguauccuc

SEQ ID NO: 4065799 - RNA, 12 nt, Vaccinia virus
auuauuagaaau

SEQ ID NO: 4065800 - RNA, 17 nt, Vaccinia virus
auuauuaguugauguga

SEQ ID NO: 4065801 - RNA, 14 nt, Vaccinia virus
auuauuauguugau

SEQ ID NO: 4065802 - RNA, 14 nt, Vaccinia virus
auuauuauuaauaa

SEQ ID NO: 4065803 - RNA, 16 nt, Vaccinia virus
auuauucaguaugaag

SEQ ID NO: 4065804 - RNA, 17 nt, Vaccinia virus
auuauucauaaauaacu

SEQ ID NO: 4065805 - RNA, 20 nt, Vaccinia virus
auuauugcgacguucauaga

SEQ ID NO: 4065806 - RNA, 14 nt, Vaccinia virus
auuauuuaauaaag

SEQ ID NO: 4065807 - RNA, 21 nt, Vaccinia virus
auuauuuugugcaaauagaug

SEQ ID NO: 4065808 - RNA, 12 nt, Vaccinia virus
auucaaaaauug

SEQ ID NO: 4065809 - RNA, 18 nt, Vaccinia virus
auucaaggaaagaauaaa

SEQ ID NO: 4065810 - RNA, 15 nt, Vaccinia virus
auucaaugucucuuu

SEQ ID NO: 4065811 - RNA, 19 nt, Vaccinia virus
auucacagacucucaagau

SEQ ID NO: 4065812 - RNA, 13 nt, Vaccinia virus
auucagaaaucaa

SEQ ID NO: 4065813 - RNA, 14 nt, Vaccinia virus
auucagcugaaaug

SEQ ID NO: 4065814 - RNA, 14 nt, Vaccinia virus
auucaguaaauaga

SEQ ID NO: 4065815 - RNA, 12 nt, Vaccinia virus
auucaguuuaua

SEQ ID NO: 4065816 - RNA, 19 nt, Vaccinia virus
auucauagauugacuuuga

SEQ ID NO: 4065817 - RNA, 13 nt, Vaccinia virus
auucauauagaac

SEQ ID NO: 4065818 - RNA, 15 nt, Vaccinia virus
auucaugaaaaugua

SEQ ID NO: 4065819 - RNA, 21 nt, Vaccinia virus
auuccaacaacaucaacugaa

SEQ ID NO: 4065820 - RNA, 19 nt, Vaccinia virus
auuccaaugaacaagauua

SEQ ID NO: 4065821 - RNA, 15 nt, Vaccinia virus
auuccaucuacuaag

SEQ ID NO: 4065822 - RNA, 15 nt, Vaccinia virus
auuccgccauuuaag

SEQ ID NO: 4065823 - RNA, 17 nt, Vaccinia virus
auuccuccauaauugca

SEQ ID NO: 4065824 - RNA, 14 nt, Vaccinia virus
auuccuugaauaac

SEQ ID NO: 4065825 - RNA, 17 nt, Vaccinia virus
auucgaaaacucuaaga

SEQ ID NO: 4065826 - RNA, 16 nt, Vaccinia virus
auucgaaauuagaaag

SEQ ID NO: 4065827 - RNA, 16 nt, Vaccinia virus
auucgauaagauagau

SEQ ID NO: 4065828 - RNA, 20 nt, Vaccinia virus
auucgcaaacuauucuaaua

SEQ ID NO: 4065829 - RNA, 21 nt, Vaccinia virus
auucgcuuagcgucuucuaua

SEQ ID NO: 4065830 - RNA, 15 nt, Vaccinia virus
auucguaguuuuuac

SEQ ID NO: 4065831 - RNA, 13 nt, Vaccinia virus
auucuaaaugaug

SEQ ID NO: 4065832 - RNA, 13 nt, Vaccinia virus
auucuaaauggau

SEQ ID NO: 4065833 - RNA, 13 nt, Vaccinia virus
auucuaauggaug

SEQ ID NO: 4065834 - RNA, 23 nt, Vaccinia virus
auucuacaagugacaacaaaaaa

SEQ ID NO: 4065835 - RNA, 17 nt, Vaccinia virus
auucuaccauagcaaau

SEQ ID NO: 4065836 - RNA, 13 nt, Vaccinia virus
auucuagcaucga

SEQ ID NO: 4065837 - RNA, 20 nt, Vaccinia virus
auucuauaaucaaugagaca

SEQ ID NO: 4065838 - RNA, 20 nt, Vaccinia virus
auucuaugaugguauugaag

SEQ ID NO: 4065839 - RNA, 16 nt, Vaccinia virus
auucuaugucuauuau

SEQ ID NO: 4065840 - RNA, 18 nt, Vaccinia virus
auucuccguuaguguuug

SEQ ID NO: 4065841 - RNA, 24 nt, Vaccinia virus
auucucucaacaucuucaauggau

SEQ ID NO: 4065842 - RNA, 20 nt, Vaccinia virus
auucucugacauucagaaag

SEQ ID NO: 4065843 - RNA, 21 nt, Vaccinia virus
auucugaauagugaaaaccuu

SEQ ID NO: 4065844 - RNA, 19 nt, Vaccinia virus
auucugaugauauuagaac

SEQ ID NO: 4065845 - RNA, 14 nt, Vaccinia virus
auucugcaauauug

SEQ ID NO: 4065846 - RNA, 18 nt, Vaccinia virus
auucuggcggcuagaaug

SEQ ID NO: 4065847 - RNA, 21 nt, Vaccinia virus
auucuggcuauuucaaaauaa

SEQ ID NO: 4065848 - RNA, 21 nt, Vaccinia virus
auucugguuuaaaaacacaca

SEQ ID NO: 4065849 - RNA, 14 nt, Vaccinia virus
auucuuaaaaucua

SEQ ID NO: 4065850 - RNA, 15 nt, Vaccinia virus
auucuuauucuuauu

SEQ ID NO: 4065851 - RNA, 15 nt, Vaccinia virus
auucuucgguaacuu

SEQ ID NO: 4065852 - RNA, 19 nt, Vaccinia virus
auucuugguaauuaauaga

SEQ ID NO: 4065853 - RNA, 18 nt, Vaccinia virus
auucuuuuauuaauguca

SEQ ID NO: 4065854 - RNA, 14 nt, Vaccinia virus
auucuuuuuaagau

SEQ ID NO: 4065855 - RNA, 14 nt, Vaccinia virus
auugaaaauuauuu

SEQ ID NO: 4065856 - RNA, 18 nt, Vaccinia virus
auugaacacuguucacau

SEQ ID NO: 4065857 - RNA, 14 nt, Vaccinia virus
auugaagaugaugu

SEQ ID NO: 4065858 - RNA, 11 nt, Vaccinia virus
aauaaggaaaa

SEQ ID NO: 4065859 - RNA, 18 nt, Vaccinia virus
aauaaggaauauacuaau

SEQ ID NO: 4065860 - RNA, 17 nt, Vaccinia virus
aauaagugugaugauug

SEQ ID NO: 4065861 - RNA, 21 nt, Vaccinia virus
aauaauaaccagaaaguuacg

SEQ ID NO: 4065862 - RNA, 15 nt, Vaccinia virus
aauaauaagaauaaa

SEQ ID NO: 4065863 - RNA, 23 nt, Vaccinia virus
aauaauaccguuugauauaccau

SEQ ID NO: 4065864 - RNA, 16 nt, Vaccinia virus
aauaauauaacucguu

SEQ ID NO: 4065865 - RNA, 14 nt, Vaccinia virus
aauaaucagaaauu

SEQ ID NO: 4065866 - RNA, 19 nt, Vaccinia virus
aauaaucccgcaauucauu

SEQ ID NO: 4065867 - RNA, 18 nt, Vaccinia virus
aauaaucguuauuaucau

SEQ ID NO: 4065868 - RNA, 14 nt, Vaccinia virus
aauaaucuucauua

SEQ ID NO: 4065869 - RNA, 19 nt, Vaccinia virus
aauaaugauucaacaaugu

SEQ ID NO: 4065870 - RNA, 19 nt, Vaccinia virus
aauaauggauaguauaaau

SEQ ID NO: 4065871 - RNA, 12 nt, Vaccinia virus
aauaauguuauu

SEQ ID NO: 4065872 - RNA, 16 nt, Vaccinia virus
aauaauucauggaaau

SEQ ID NO: 4065873 - RNA, 19 nt, Vaccinia virus
aauaauuguuuugaauuuc

SEQ ID NO: 4065874 - RNA, 14 nt, Vaccinia virus
aauaauuuacaaaa

SEQ ID NO: 4065875 - RNA, 22 nt, Vaccinia virus
aauaauuucuagaacaucaucu

SEQ ID NO: 4065876 - RNA, 16 nt, Vaccinia virus
aauacaaaaguucaua

SEQ ID NO: 4065877 - RNA, 12 nt, Vaccinia virus
aauacaauaauu

SEQ ID NO: 4065878 - RNA, 13 nt, Vaccinia virus
aauacaggaucua

SEQ ID NO: 4065879 - RNA, 20 nt, Vaccinia virus
aauacauauuguuuagcaaa

SEQ ID NO: 4065880 - RNA, 18 nt, Vaccinia virus
aauacaugggaaaugaua

SEQ ID NO: 4065881 - RNA, 20 nt, Vaccinia virus
aauacaugggaaaugauauc

SEQ ID NO: 4065882 - RNA, 15 nt, Vaccinia virus
aauaccauaaauaua

SEQ ID NO: 4065883 - RNA, 15 nt, Vaccinia virus
aauacgaauuaugca

SEQ ID NO: 4065884 - RNA, 22 nt, Vaccinia virus
aauacgauccaagguuagagaa

SEQ ID NO: 4065885 - RNA, 17 nt, Vaccinia virus
aauacggacuucauaau

SEQ ID NO: 4065886 - RNA, 23 nt, Vaccinia virus
aauacgucuugcacguaaucuau

SEQ ID NO: 4065887 - RNA, 13 nt, Vaccinia virus
aauacuaaauuga

SEQ ID NO: 4065888 - RNA, 12 nt, Vaccinia virus
aauacuaauuca

SEQ ID NO: 4065889 - RNA, 12 nt, Vaccinia virus
aauacuaucuau

SEQ ID NO: 4065890 - RNA, 18 nt, Vaccinia virus
aauacugcaauaauuuuc

SEQ ID NO: 4065891 - RNA, 19 nt, Vaccinia virus
aauacugcaauaauuuuca

SEQ ID NO: 4065892 - RNA, 20 nt, Vaccinia virus
aauacuuaccccuugaucgu

SEQ ID NO: 4065893 - RNA, 15 nt, Vaccinia virus
aauacuuaguuucca

SEQ ID NO: 4065894 - RNA, 23 nt, Vaccinia virus
aauacuuccaucaacauuguuuc

SEQ ID NO: 4065895 - RNA, 21 nt, Vaccinia virus
aauacuuugguaguauacaag

SEQ ID NO: 4065896 - RNA, 16 nt, Vaccinia virus
aauagaaaaaacaugu

SEQ ID NO: 4065897 - RNA, 19 nt, Vaccinia virus
aauagauaaugaacauaua

SEQ ID NO: 4065898 - RNA, 21 nt, Vaccinia virus
aauagauuggaugguugacau

SEQ ID NO: 4065899 - RNA, 15 nt, Vaccinia virus
aauagauuuuucaua

SEQ ID NO: 4065900 - RNA, 17 nt, Vaccinia virus
aauagcgcugaaaauaa

SEQ ID NO: 4065901 - RNA, 17 nt, Vaccinia virus
aauagcugaugauagaa

SEQ ID NO: 4065902 - RNA, 13 nt, Vaccinia virus
aauaggaauaauu

SEQ ID NO: 4065903 - RNA, 16 nt, Vaccinia virus
aauagguuguaauauc

SEQ ID NO: 4065904 - RNA, 14 nt, Vaccinia virus
aauagguuuuguuc

SEQ ID NO: 4065905 - RNA, 16 nt, Vaccinia virus
aauaguacauuuucca

SEQ ID NO: 4065906 - RNA, 13 nt, Vaccinia virus
aauaguagaauua

SEQ ID NO: 4065907 - RNA, 22 nt, Vaccinia virus
aauaguuacgcaauaucucaau

SEQ ID NO: 4065908 - RNA, 23 nt, Vaccinia virus
aauaguucccaacccagauaaua

SEQ ID NO: 4065909 - RNA, 23 nt, Vaccinia virus
aauaguucucccuuuuuaaaggu

SEQ ID NO: 4065910 - RNA, 14 nt, Vaccinia virus
aauaguucuguaau

SEQ ID NO: 4065911 - RNA, 14 nt, Vaccinia virus
aauaguuuacagau

SEQ ID NO: 4065912 - RNA, 15 nt, Vaccinia virus
aauaguuuauaacau

SEQ ID NO: 4065913 - RNA, 22 nt, Vaccinia virus
aauauaaaagaauauguauauc

SEQ ID NO: 4065914 - RNA, 22 nt, Vaccinia virus
aauauaaagcacguaggucuua

SEQ ID NO: 4065915 - RNA, 22 nt, Vaccinia virus
aauauaacuugguauaaagaua

SEQ ID NO: 4065916 - RNA, 13 nt, Vaccinia virus
aauauacaaguau

SEQ ID NO: 4065917 - RNA, 16 nt, Vaccinia virus
aauauaccauuaaaaa

SEQ ID NO: 4065918 - RNA, 15 nt, Vaccinia virus
aauauacgucguucu

SEQ ID NO: 4065919 - RNA, 19 nt, Vaccinia virus
aauauacgucguucuuauc

SEQ ID NO: 4065920 - RNA, 18 nt, Vaccinia virus
aauauagaaauaaugaua

SEQ ID NO: 4065921 - RNA, 20 nt, Vaccinia virus
aauauagaacaucauuucca

SEQ ID NO: 4065922 - RNA, 20 nt, Vaccinia virus
aauauagaucgaaaaauaua

SEQ ID NO: 4065923 - RNA, 22 nt, Vaccinia virus
aauauagcaucgauccaugaga

SEQ ID NO: 4065924 - RNA, 18 nt, Vaccinia virus
aauauaguaauaagauuu

SEQ ID NO: 4065925 - RNA, 15 nt, Vaccinia virus
aauauaguuaauagu

SEQ ID NO: 4065926 - RNA, 15 nt, Vaccinia virus
aauauauaaacucuu

SEQ ID NO: 4065927 - RNA, 20 nt, Vaccinia virus
aauauauaaguauaauccca

SEQ ID NO: 4065928 - RNA, 19 nt, Vaccinia virus
aauauauguugauaauauc

SEQ ID NO: 4065929 - RNA, 14 nt, Vaccinia virus
aauauauuaccaug

SEQ ID NO: 4065930 - RNA, 14 nt, Vaccinia virus
aauauauugauaau

SEQ ID NO: 4065931 - RNA, 16 nt, Vaccinia virus
aauaucagaaaggaua

SEQ ID NO: 4065932 - RNA, 19 nt, Vaccinia virus
aauaucaguaucuucuuua

SEQ ID NO: 4065933 - RNA, 14 nt, Vaccinia virus
aauaucauaaucua

SEQ ID NO: 4065934 - RNA, 21 nt, Vaccinia virus
aauaucgauguuuaacuuuug

SEQ ID NO: 4065935 - RNA, 14 nt, Vaccinia virus
aauaucuaauggau

SEQ ID NO: 4065936 - RNA, 17 nt, Vaccinia virus
aauaucuagcaaaaauu

SEQ ID NO: 4065937 - RNA, 14 nt, Vaccinia virus
aauaucuuauucca

SEQ ID NO: 4065938 - RNA, 20 nt, Vaccinia virus
aauaugacacgauuaccaau

SEQ ID NO: 4065939 - RNA, 18 nt, Vaccinia virus
aauaugagaaugaauaug

SEQ ID NO: 4065940 - RNA, 17 nt, Vaccinia virus
aauaugauuagaaguua

SEQ ID NO: 4065941 - RNA, 17 nt, Vaccinia virus
aauaugauuuuuaaaaa

SEQ ID NO: 4065942 - RNA, 15 nt, Vaccinia virus
uaauuaaauguuuga

SEQ ID NO: 4065943 - RNA, 15 nt, Vaccinia virus
uaauuaaucuaaaau

SEQ ID NO: 4065944 - RNA, 21 nt, Vaccinia virus
uaauuaauucuuuauugucau

SEQ ID NO: 4065945 - RNA, 15 nt, Vaccinia virus
uaauuacuaaaucug

SEQ ID NO: 4065946 - RNA, 16 nt, Vaccinia virus
uaauuauaagaaauau

SEQ ID NO: 4065947 - RNA, 14 nt, Vaccinia virus
uaauucauaagaau

SEQ ID NO: 4065948 - RNA, 12 nt, Vaccinia virus
uaauucauuaau

SEQ ID NO: 4065949 - RNA, 17 nt, Vaccinia virus
uaauucguauucuugga

SEQ ID NO: 4065950 - RNA, 14 nt, Vaccinia virus
uaauugacaucuau

SEQ ID NO: 4065951 - RNA, 16 nt, Vaccinia virus
uaauuguaacauccuu

SEQ ID NO: 4065952 - RNA, 14 nt, Vaccinia virus
uaauuguuaaacau

SEQ ID NO: 4065953 - RNA, 19 nt, Vaccinia virus
uaauuguuauuauuucauu

SEQ ID NO: 4065954 - RNA, 20 nt, Vaccinia virus
uaauuuaugaggugaacgau

SEQ ID NO: 4065955 - RNA, 14 nt, Vaccinia virus
uaauuuuacuagau

SEQ ID NO: 4065956 - RNA, 15 nt, Vaccinia virus
uaauuuuauugagau

SEQ ID NO: 4065957 - RNA, 22 nt, Vaccinia virus
uacaaaauguugauaauccuug

SEQ ID NO: 4065958 - RNA, 15 nt, Vaccinia virus
uauaauaucuuugaa

SEQ ID NO: 4065959 - RNA, 20 nt, Vaccinia virus
uauaauccuuauacaucuga

SEQ ID NO: 4065960 - RNA, 21 nt, Vaccinia virus
uauaaucguguauaacaucuu

SEQ ID NO: 4065961 - RNA, 20 nt, Vaccinia virus
uauaaucuucgucuauuaca

SEQ ID NO: 4065962 - RNA, 17 nt, Vaccinia virus
uauaaugucuacauucu

SEQ ID NO: 4065963 - RNA, 16 nt, Vaccinia virus
uauaauuauauguaga

SEQ ID NO: 4065964 - RNA, 20 nt, Vaccinia virus
uauaauucuuuauaacugaa

SEQ ID NO: 4065965 - RNA, 24 nt, Vaccinia virus
uauaauuuaggaaugauuaucaaa

SEQ ID NO: 4065966 - RNA, 18 nt, Vaccinia virus
uauacaaguguagaugau

SEQ ID NO: 4065967 - RNA, 16 nt, Vaccinia virus
uauacaauuuguggaa

SEQ ID NO: 4065968 - RNA, 22 nt, Vaccinia virus
uauacauagauauuaauuauca

SEQ ID NO: 4065969 - RNA, 14 nt, Vaccinia virus
uauacauucuucug

SEQ ID NO: 4065970 - RNA, 18 nt, Vaccinia virus
uauacauucuucuguuaa

SEQ ID NO: 4065971 - RNA, 18 nt, Vaccinia virus
uauaccgccucaaacucu

SEQ ID NO: 4065972 - RNA, 17 nt, Vaccinia virus
uauaccggcauugguaa

SEQ ID NO: 4065973 - RNA, 17 nt, Vaccinia virus
uauacgaaaaaauagca

SEQ ID NO: 4065974 - RNA, 15 nt, Vaccinia virus
uauacggauuucuau

SEQ ID NO: 4065975 - RNA, 21 nt, Vaccinia virus
uauacuauauaguaauaccaa

SEQ ID NO: 4065976 - RNA, 17 nt, Vaccinia virus
uauacugagaaguuauu

SEQ ID NO: 4065977 - RNA, 16 nt, Vaccinia virus
uauacuucauaaaaga

SEQ ID NO: 4065978 - RNA, 16 nt, Vaccinia virus
uauacuugucaucauu

SEQ ID NO: 4065979 - RNA, 21 nt, Vaccinia virus
uauacuuuuagaugacacauu

SEQ ID NO: 4065980 - RNA, 23 nt, Vaccinia virus
uauagagcccacguuuaaacauu

SEQ ID NO: 4065981 - RNA, 19 nt, Vaccinia virus
uauagauaacauaguuugg

SEQ ID NO: 4065982 - RNA, 16 nt, Vaccinia virus
uauagauccuccagua

SEQ ID NO: 4065983 - RNA, 17 nt, Vaccinia virus
uauagaucuuagacauu

SEQ ID NO: 4065984 - RNA, 22 nt, Vaccinia virus
uauagauggaggggauuggcau

SEQ ID NO: 4065985 - RNA, 16 nt, Vaccinia virus
uauagauguucacauu

SEQ ID NO: 4065986 - RNA, 23 nt, Vaccinia virus
uauaggauggcgacgguaacugc

SEQ ID NO: 4065987 - RNA, 13 nt, Vaccinia virus
uauaguuaacauu

SEQ ID NO: 4065988 - RNA, 17 nt, Vaccinia virus
uauauaacuaucaauau

SEQ ID NO: 4065989 - RNA, 19 nt, Vaccinia virus
uauauacacucuauuucaa

SEQ ID NO: 4065990 - RNA, 13 nt, Vaccinia virus
uauauacgaguau

SEQ ID NO: 4065991 - RNA, 17 nt, Vaccinia virus
uauauagauauuaucua

SEQ ID NO: 4065992 - RNA, 13 nt, Vaccinia virus
uauauagauguca

SEQ ID NO: 4065993 - RNA, 14 nt, Vaccinia virus
uauauaguuuuuua

SEQ ID NO: 4065994 - RNA, 13 nt, Vaccinia virus
uauauaucuggag

SEQ ID NO: 4065995 - RNA, 16 nt, Vaccinia virus
uauaucauuuguacau

SEQ ID NO: 4065996 - RNA, 17 nt, Vaccinia virus
uauaucauuuguuuuaa

SEQ ID NO: 4065997 - RNA, 20 nt, Vaccinia virus
uauauccaccaauagaaguu

SEQ ID NO: 4065998 - RNA, 15 nt, Vaccinia virus
uauaucccuuaaaaa

SEQ ID NO: 4065999 - RNA, 22 nt, Vaccinia virus
uauauccuacacccgaagagau

SEQ ID NO: 4066000 - RNA, 22 nt, Vaccinia virus
uauaucgcauauuuauaucgug

SEQ ID NO: 4066001 - RNA, 16 nt, Vaccinia virus
uauaucuaacaucuug

SEQ ID NO: 4066002 - RNA, 16 nt, Vaccinia virus
uauaucuuauaucuua

SEQ ID NO: 4066003 - RNA, 14 nt, Vaccinia virus
uauaucuucuucug

SEQ ID NO: 4066004 - RNA, 17 nt, Vaccinia virus
uauaugauauuccugga

SEQ ID NO: 4066005 - RNA, 20 nt, Vaccinia virus
uauaugguucgcucaaaaau

SEQ ID NO: 4066006 - RNA, 17 nt, Vaccinia virus
uauauguggaaauguca

SEQ ID NO: 4066007 - RNA, 15 nt, Vaccinia virus
uauauuaauacacau

SEQ ID NO: 4066008 - RNA, 14 nt, Vaccinia virus
uauauuaauacuuu

SEQ ID NO: 4066009 - RNA, 17 nt, Vaccinia virus
uauauuagacaauacua

SEQ ID NO: 4066010 - RNA, 23 nt, Vaccinia virus
uauauucaguaaccaaauacaua

SEQ ID NO: 4066011 - RNA, 21 nt, Vaccinia virus
uauauuucauucgucaaggau

SEQ ID NO: 4066012 - RNA, 13 nt, Vaccinia virus
uauauuuuaucua

SEQ ID NO: 4066013 - RNA, 14 nt, Vaccinia virus
uauauuuuuggauu

SEQ ID NO: 4066014 - RNA, 23 nt, Vaccinia virus
uaucaaaacauauagauagacga

SEQ ID NO: 4066015 - RNA, 18 nt, Vaccinia virus
uaucaaaaucuugucugc

SEQ ID NO: 4066016 - RNA, 17 nt, Vaccinia virus
uaucaaacaauccaaaa

SEQ ID NO: 4066017 - RNA, 18 nt, Vaccinia virus
uaucaaauagcucaauau

SEQ ID NO: 4066018 - RNA, 17 nt, Vaccinia virus
uaucaaccacauaucug

SEQ ID NO: 4066019 - RNA, 23 nt, Vaccinia virus
uaucaauaagcauuaugauuugu

SEQ ID NO: 4066020 - RNA, 16 nt, Vaccinia virus
uaucaauaccuuuucu

SEQ ID NO: 4066021 - RNA, 14 nt, Vaccinia virus
uaucaauagcaguu

SEQ ID NO: 4066022 - RNA, 18 nt, Vaccinia virus
uaucaauagcaguuuauu

SEQ ID NO: 4066023 - RNA, 17 nt, Vaccinia virus
uaucaauauuaacaguu

SEQ ID NO: 4066024 - RNA, 15 nt, Vaccinia virus
uaucaauuauaugug

SEQ ID NO: 4066025 - RNA, 14 nt, Vaccinia virus
uaucacagucuguu

SEQ ID NO: 4066026 - RNA, 23 nt, Vaccinia virus
uaucaggcgucuccauguuugau

SEQ ID NO: 4066027 - RNA, 22 nt, Vaccinia virus
uaucagucgaggacuuggaugu

SEQ ID NO: 4066028 - RNA, 18 nt, Vaccinia virus
uaucauaaauaaauaaug

SEQ ID NO: 4066029 - RNA, 14 nt, Vaccinia virus
uaucauaauuaaau

SEQ ID NO: 4066030 - RNA, 15 nt, Vaccinia virus
uaucauccaauauua

SEQ ID NO: 4066031 - RNA, 16 nt, Vaccinia virus
uaucaucuauuagaga

SEQ ID NO: 4066032 - RNA, 21 nt, Vaccinia virus
uaucaucuuaugaggaaugau

SEQ ID NO: 4066033 - RNA, 17 nt, Vaccinia virus
uaucaugaauuagauau

SEQ ID NO: 4066034 - RNA, 17 nt, Vaccinia virus
uaucaugagauguguau

SEQ ID NO: 4066035 - RNA, 15 nt, Vaccinia virus
uaucauuuaaacauu

SEQ ID NO: 4066036 - RNA, 20 nt, Vaccinia virus
uaucauuuugauuaauuguu

SEQ ID NO: 4066037 - RNA, 17 nt, Vaccinia virus
uauccagcuaacuuauu

SEQ ID NO: 4066038 - RNA, 21 nt, Vaccinia virus
uauccgacgacguuacucaaa

SEQ ID NO: 4066039 - RNA, 20 nt, Vaccinia virus
uauccucacaacuuaaugaa

SEQ ID NO: 4066040 - RNA, 14 nt, Vaccinia virus
uauccucagacucu

SEQ ID NO: 4066041 - RNA, 13 nt, Vaccinia virus
uaucgaacaaauu

SEQ ID NO: 4066042 - RNA, 14 nt, Vaccinia virus
uaucgaauuucuac

SEQ ID NO: 4066043 - RNA, 17 nt, Vaccinia virus
uaucgagaucuuuugua

SEQ ID NO: 4066044 - RNA, 18 nt, Vaccinia virus
uaucgccggucaucauaa

SEQ ID NO: 4066045 - RNA, 19 nt, Vaccinia virus
uaucgccggucaucauaag

SEQ ID NO: 4066046 - RNA, 22 nt, Vaccinia virus
uaucgcuaaaauuuucaucaaa

SEQ ID NO: 4066047 - RNA, 12 nt, Vaccinia virus
uaucuaaagcuu

SEQ ID NO: 4066048 - RNA, 15 nt, Vaccinia virus
uaucuaacucguaaa

SEQ ID NO: 4066049 - RNA, 23 nt, Vaccinia virus
uaucuaauuugauauaaugaauu

SEQ ID NO: 4066050 - RNA, 17 nt, Vaccinia virus
uaucuaccucuccaaaa

SEQ ID NO: 4066051 - RNA, 16 nt, Vaccinia virus
uaucuauaaacauaag

SEQ ID NO: 4066052 - RNA, 12 nt, Vaccinia virus
uaucuauacaua

SEQ ID NO: 4066053 - RNA, 16 nt, Vaccinia virus
uaucuauacuauuaaa

SEQ ID NO: 4066054 - RNA, 16 nt, Vaccinia virus
uaucuauguuaucauc

SEQ ID NO: 4066055 - RNA, 12 nt, Vaccinia virus
uaucucagucug

SEQ ID NO: 4066056 - RNA, 16 nt, Vaccinia virus
uaucucauuugagaau

SEQ ID NO: 4066057 - RNA, 14 nt, Vaccinia virus
uaucucuaacaaaa

SEQ ID NO: 4066058 - RNA, 19 nt, Vaccinia virus
uaucuggcucucucugcca

SEQ ID NO: 4066059 - RNA, 11 nt, Vaccinia virus
uaucuguaaaa

SEQ ID NO: 4066060 - RNA, 15 nt, Vaccinia virus
uaucugugaauacuu

SEQ ID NO: 4066061 - RNA, 16 nt, Vaccinia virus
uaucugugaauacuuu

SEQ ID NO: 4066062 - RNA, 21 nt, Vaccinia virus
uaucuucgauauaaaaucauu

SEQ ID NO: 4066063 - RNA, 15 nt, Vaccinia virus
uaucuucuuuaucua

SEQ ID NO: 4066064 - RNA, 19 nt, Vaccinia virus
uaucuuuccauuuaucaug

SEQ ID NO: 4066065 - RNA, 13 nt, Vaccinia virus
uaugaaauuuaag

SEQ ID NO: 4066066 - RNA, 17 nt, Vaccinia virus
uaugaauaaucuucauu

SEQ ID NO: 4066067 - RNA, 13 nt, Vaccinia virus
uaugaauaucuuc

SEQ ID NO: 4066068 - RNA, 21 nt, Vaccinia virus
uaugaauccgaugaucucacu

SEQ ID NO: 4066069 - RNA, 22 nt, Vaccinia virus
uaugaauggauacuuguaugau

SEQ ID NO: 4066070 - RNA, 14 nt, Vaccinia virus
uaugacaaacauug

SEQ ID NO: 4066071 - RNA, 21 nt, Vaccinia virus
uaugaccgguuuaauguuaua

SEQ ID NO: 4066072 - RNA, 18 nt, Vaccinia virus
uaugacucaugaucuauu

SEQ ID NO: 4066073 - RNA, 13 nt, Vaccinia virus
uaugagaaugaau

SEQ ID NO: 4066074 - RNA, 15 nt, Vaccinia virus
uaugaggaaugauug

SEQ ID NO: 4066075 - RNA, 21 nt, Vaccinia virus
uaugagucaauugguagaguu

SEQ ID NO: 4066076 - RNA, 16 nt, Vaccinia virus
uaugauaagauacaua

SEQ ID NO: 4066077 - RNA, 22 nt, Vaccinia virus
uaugauauaauucguggauaau

SEQ ID NO: 4066078 - RNA, 15 nt, Vaccinia virus
uaugauaucucuauu

SEQ ID NO: 4066079 - RNA, 18 nt, Vaccinia virus
uaugauauuccuggagau

SEQ ID NO: 4066080 - RNA, 13 nt, Vaccinia virus
uaugauucaaugu

SEQ ID NO: 4066081 - RNA, 19 nt, Vaccinia virus
uaugauuuuuaaucaagau

SEQ ID NO: 4066082 - RNA, 17 nt, Vaccinia virus
uccauauuuuagaauau

SEQ ID NO: 4066083 - RNA, 17 nt, Vaccinia virus
uccaucagaauguuucc

SEQ ID NO: 4066084 - RNA, 21 nt, Vaccinia virus
uccaucaucgucuuauuucaa

SEQ ID NO: 4066085 - RNA, 20 nt, Vaccinia virus
uccaucaugaucugguuuug

SEQ ID NO: 4066086 - RNA, 15 nt, Vaccinia virus
uccaugucuacauua

SEQ ID NO: 4066087 - RNA, 17 nt, Vaccinia virus
uccauuuuuaauuuaug

SEQ ID NO: 4066088 - RNA, 14 nt, Vaccinia virus
ucccaauaugugua

SEQ ID NO: 4066089 - RNA, 18 nt, Vaccinia virus
ucccacaguguugccauu

SEQ ID NO: 4066090 - RNA, 18 nt, Vaccinia virus
uccgaggauaguaaaaua

SEQ ID NO: 4066091 - RNA, 19 nt, Vaccinia virus
uccgcaauacauuucucaa

SEQ ID NO: 4066092 - RNA, 16 nt, Vaccinia virus
uccggagaucuaaaga

SEQ ID NO: 4066093 - RNA, 18 nt, Vaccinia virus
uccuagauauguaaaaua

SEQ ID NO: 4066094 - RNA, 15 nt, Vaccinia virus
uccuaguacacaaua

SEQ ID NO: 4066095 - RNA, 12 nt, Vaccinia virus
uccucaauaacg

SEQ ID NO: 4066096 - RNA, 24 nt, Vaccinia virus
uccucagauuuauacauauucuaa

SEQ ID NO: 4066097 - RNA, 15 nt, Vaccinia virus
uccucaggauucuaa

SEQ ID NO: 4066098 - RNA, 13 nt, Vaccinia virus
uccucccauaaua

SEQ ID NO: 4066099 - RNA, 12 nt, Vaccinia virus
uccuccuaucaa

SEQ ID NO: 4066100 - RNA, 17 nt, Vaccinia virus
uccuccuguagauaugu

SEQ ID NO: 4066101 - RNA, 19 nt, Vaccinia virus
uccuuaaauguuuucucug

SEQ ID NO: 4066102 - RNA, 20 nt, Vaccinia virus
uccuuaagauguuugagaau

SEQ ID NO: 4066103 - RNA, 13 nt, Vaccinia virus
uccuuaucaaaau

SEQ ID NO: 4066104 - RNA, 17 nt, Vaccinia virus
uccuuaucuucauagaa

SEQ ID NO: 4066105 - RNA, 12 nt, Vaccinia virus
uccuucgucucu

SEQ ID NO: 4066106 - RNA, 21 nt, Vaccinia virus
uccuucuaaaguaaguaugau

SEQ ID NO: 4066107 - RNA, 23 nt, Vaccinia virus
uccuuuaaaauauauucuaauau

SEQ ID NO: 4066108 - RNA, 17 nt, Vaccinia virus
ucgaagauaucauccaa

SEQ ID NO: 4066109 - RNA, 15 nt, Vaccinia virus
ucgaauacaaauuuu

SEQ ID NO: 4066110 - RNA, 17 nt, Vaccinia virus
ucgacguuucucaaagu

SEQ ID NO: 4066111 - RNA, 18 nt, Vaccinia virus
ucgacguuucucaaaguc

SEQ ID NO: 4066112 - RNA, 16 nt, Vaccinia virus
ucgagcuaauuucuaa

SEQ ID NO: 4066113 - RNA, 17 nt, Vaccinia virus
ucgauaacuguagucuu

SEQ ID NO: 4066114 - RNA, 16 nt, Vaccinia virus
ucgauaccuagaagau

SEQ ID NO: 4066115 - RNA, 14 nt, Vaccinia virus
ucgauauuagauuu

SEQ ID NO: 4066116 - RNA, 14 nt, Vaccinia virus
ucgauggucucaca

SEQ ID NO: 4066117 - RNA, 15 nt, Vaccinia virus
ucgauugauuuggaa

SEQ ID NO: 4066118 - RNA, 17 nt, Vaccinia virus
ucgauugugauuguauu

SEQ ID NO: 4066119 - RNA, 19 nt, Vaccinia virus
ucgauuuaccguuacuaau

SEQ ID NO: 4066120 - RNA, 21 nt, Vaccinia virus
ucgcauguucagcaauuuauu

SEQ ID NO: 4066121 - RNA, 17 nt, Vaccinia virus
ucgccgucgcuagauaa

SEQ ID NO: 4066122 - RNA, 14 nt, Vaccinia virus
ucgcgauaauguag

SEQ ID NO: 4066123 - RNA, 12 nt, Vaccinia virus
ucggaauuauuu

SEQ ID NO: 4066124 - RNA, 21 nt, Vaccinia virus
ucggauuauccuccguaagac

SEQ ID NO: 4066125 - RNA, 18 nt, Vaccinia virus
ucgguauaaaaauuauug

SEQ ID NO: 4066126 - RNA, 19 nt, Vaccinia virus
ucgguucuuuaaaagaaac

SEQ ID NO: 4066127 - RNA, 20 nt, Vaccinia virus
ucguacaguagagauauuug

SEQ ID NO: 4066128 - RNA, 15 nt, Vaccinia virus
ucguauacucugccc

SEQ ID NO: 4066129 - RNA, 14 nt, Vaccinia virus
ucguauccacaaau

SEQ ID NO: 4066130 - RNA, 13 nt, Vaccinia virus
ucguauguagaaa

SEQ ID NO: 4066131 - RNA, 19 nt, Vaccinia virus
ucguauuggauucugaaau

SEQ ID NO: 4066132 - RNA, 18 nt, Vaccinia virus
ucgucuccccaaacauug

SEQ ID NO: 4066133 - RNA, 13 nt, Vaccinia virus
ucgucucucuuag

SEQ ID NO: 4066134 - RNA, 12 nt, Vaccinia virus
ucgucuuuagag

SEQ ID NO: 4066135 - RNA, 16 nt, Vaccinia virus
ucgucuuuguuagcau

SEQ ID NO: 4066136 - RNA, 15 nt, Vaccinia virus
ucguuaaaaaguuuu

SEQ ID NO: 4066137 - RNA, 16 nt, Vaccinia virus
ucuaaaaaauccuuaa

SEQ ID NO: 4066138 - RNA, 21 nt, Vaccinia virus
ucuaaacauaagacuuauucu

SEQ ID NO: 4066139 - RNA, 23 nt, Vaccinia virus
ucuaaauaauaucuauuguuugg

SEQ ID NO: 4066140 - RNA, 22 nt, Vaccinia virus
ucuaacaaaaauuaugaaauaa

SEQ ID NO: 4066141 - RNA, 18 nt, Vaccinia virus
ucuaauccuccuauuaca

SEQ ID NO: 4066142 - RNA, 21 nt, Vaccinia virus
ucuacaaaaaggacauguaua

SEQ ID NO: 4066143 - RNA, 14 nt, Vaccinia virus
ucuacaaagucucu

SEQ ID NO: 4066144 - RNA, 19 nt, Vaccinia virus
ucuacagauauuuuaguuu

SEQ ID NO: 4066145 - RNA, 17 nt, Vaccinia virus
ucuacaggcuucucauc

SEQ ID NO: 4066146 - RNA, 20 nt, Vaccinia virus
ucuacaguaauguccaaauc

SEQ ID NO: 4066147 - RNA, 23 nt, Vaccinia virus
ucuacaucuuccuucuuauucuu

SEQ ID NO: 4066148 - RNA, 14 nt, Vaccinia virus
ucuaccauuucauu

SEQ ID NO: 4066149 - RNA, 17 nt, Vaccinia virus
ucuaccguuguuaaaua

SEQ ID NO: 4066150 - RNA, 15 nt, Vaccinia virus
ucuacgaagaaaguu

SEQ ID NO: 4066151 - RNA, 22 nt, Vaccinia virus
ucuacuaagcccaaaaccaaac

SEQ ID NO: 4066152 - RNA, 12 nt, Vaccinia virus
ucuacuaucaaa

SEQ ID NO: 4066153 - RNA, 14 nt, Vaccinia virus
ucuacuauucuauu

SEQ ID NO: 4066154 - RNA, 17 nt, Vaccinia virus
ucuacuguuccuaauau

SEQ ID NO: 4066155 - RNA, 17 nt, Vaccinia virus
ucuagaauaaguuucau

SEQ ID NO: 4066156 - RNA, 23 nt, Vaccinia virus
ucuagaauaucccaauagguguu

SEQ ID NO: 4066157 - RNA, 12 nt, Vaccinia virus
ucuagaaugaag

SEQ ID NO: 4066158 - RNA, 21 nt, Vaccinia virus
ucuagaauucauuagacguag

SEQ ID NO: 4066159 - RNA, 21 nt, Vaccinia virus
ucuagacgauuaguaauauau

SEQ ID NO: 4066160 - RNA, 21 nt, Vaccinia virus
ucuagauagaguauuaaauau

SEQ ID NO: 4066161 - RNA, 20 nt, Vaccinia virus
ucuaggagcaccagaaguau

SEQ ID NO: 4066162 - RNA, 19 nt, Vaccinia virus
ucuaguuaguuuguauaaa

SEQ ID NO: 4066163 - RNA, 21 nt, Vaccinia virus
ucuauaaacgucguauguaga

SEQ ID NO: 4066164 - RNA, 17 nt, Vaccinia virus
ucuauaaauaaaagaca

SEQ ID NO: 4066165 - RNA, 14 nt, Vaccinia virus
ucuauaauaucaga

SEQ ID NO: 4066166 - RNA, 18 nt, Vaccinia virus
ucuauaauaucuuauucu

SEQ ID NO: 4066167 - RNA, 19 nt, Vaccinia virus
ucuauaauaucuuauucug

SEQ ID NO: 4066168 - RNA, 15 nt, Vaccinia virus
ucuauaccaauauua

SEQ ID NO: 4066169 - RNA, 22 nt, Vaccinia virus
ucuauagaaacauauucuauga

SEQ ID NO: 4066170 - RNA, 14 nt, Vaccinia virus
ucuauagucagaau

SEQ ID NO: 4066171 - RNA, 14 nt, Vaccinia virus
ucuaucaaagccuu

SEQ ID NO: 4066172 - RNA, 19 nt, Vaccinia virus
ucuaucuccaguauuuaca

SEQ ID NO: 4066173 - RNA, 16 nt, Vaccinia virus
ucuaugaauaugauuu

SEQ ID NO: 4066174 - RNA, 14 nt, Vaccinia virus
ucuaugauaguuuu

SEQ ID NO: 4066175 - RNA, 23 nt, Vaccinia virus
ucuaugauauuguugauaauaca

SEQ ID NO: 4066176 - RNA, 12 nt, Vaccinia virus
ucuauguaucua

SEQ ID NO: 4066177 - RNA, 17 nt, Vaccinia virus
ucuauguuuuuagauuu

SEQ ID NO: 4066178 - RNA, 18 nt, Vaccinia virus
ucuauuaaaaauccaagu

SEQ ID NO: 4066179 - RNA, 16 nt, Vaccinia virus
ucuauuauuacagagu

SEQ ID NO: 4066180 - RNA, 12 nt, Vaccinia virus
ucuauucaagau

SEQ ID NO: 4066181 - RNA, 15 nt, Vaccinia virus
ucuauuuaauacuuu

SEQ ID NO: 4066182 - RNA, 20 nt, Vaccinia virus
ucuauuucaucguuuuguau

SEQ ID NO: 4066183 - RNA, 19 nt, Vaccinia virus
ucuauuugccaauauguca

SEQ ID NO: 4066184 - RNA, 23 nt, Vaccinia virus
ucuauuuguucugacaauauuua

SEQ ID NO: 4066185 - RNA, 14 nt, Vaccinia virus
ucucaagauuuuaa

SEQ ID NO: 4066186 - RNA, 16 nt, Vaccinia virus
ucucaauauuuggauc

SEQ ID NO: 4066187 - RNA, 14 nt, Vaccinia virus
ucucaauugucugu

SEQ ID NO: 4066188 - RNA, 18 nt, Vaccinia virus
ucucagaaucaaauauag

SEQ ID NO: 4066189 - RNA, 18 nt, Vaccinia virus
ucucauaaaaaaaguuuu

SEQ ID NO: 4066190 - RNA, 24 nt, Vaccinia virus
ucucauaauguaaagauauucuaa

SEQ ID NO: 4066191 - RNA, 15 nt, Vaccinia virus
ucucauauguuuuaa

SEQ ID NO: 4066192 - RNA, 14 nt, Vaccinia virus
ucuccagaaaucug

SEQ ID NO: 4066193 - RNA, 22 nt, Vaccinia virus
ucuccaugauuaaauauuuuaa

SEQ ID NO: 4066194 - RNA, 18 nt, Vaccinia virus
ucucccauaaucuuggua

SEQ ID NO: 4066195 - RNA, 14 nt, Vaccinia virus
ucucccuacgacga

SEQ ID NO: 4066196 - RNA, 14 nt, Vaccinia virus
ucuccgauaucuaa

SEQ ID NO: 4066197 - RNA, 22 nt, Vaccinia virus
ucuccgcaauacauuucucaaa

SEQ ID NO: 4066198 - RNA, 19 nt, Vaccinia virus
ucucguauucaguuucauc

SEQ ID NO: 4066199 - RNA, 15 nt, Vaccinia virus
ucucuaaaggaugac

SEQ ID NO: 4066200 - RNA, 13 nt, Vaccinia virus
ucucuaguuuuau

SEQ ID NO: 4066201 - RNA, 10 nt, Vaccinia virus
ucucuauaga

SEQ ID NO: 4066202 - RNA, 14 nt, Vaccinia virus
ucucuaucaaugau

SEQ ID NO: 4066203 - RNA, 17 nt, Vaccinia virus
ucucuaugauccugaaa

SEQ ID NO: 4066204 - RNA, 18 nt, Vaccinia virus
ucucuauugccaaauuuu

SEQ ID NO: 4066205 - RNA, 19 nt, Vaccinia virus
ucucucaaucacuacaucu

SEQ ID NO: 4066206 - RNA, 13 nt, Vaccinia virus
acucuaaguuugu

SEQ ID NO: 4066207 - RNA, 19 nt, Vaccinia virus
acucuagagacuaugauug

SEQ ID NO: 4066208 - RNA, 15 nt, Vaccinia virus
acucucaaauuauua

SEQ ID NO: 4066209 - RNA, 18 nt, Vaccinia virus
acucucuauuucuuaaug

SEQ ID NO: 4066210 - RNA, 21 nt, Vaccinia virus
acucucuauuucuuaaugaau

SEQ ID NO: 4066211 - RNA, 13 nt, Vaccinia virus
acucuuaauuaug

SEQ ID NO: 4066212 - RNA, 14 nt, Vaccinia virus
acucuuauuauaga

SEQ ID NO: 4066213 - RNA, 12 nt, Vaccinia virus
acucuucuuauu

SEQ ID NO: 4066214 - RNA, 20 nt, Vaccinia virus
acucuuggucuaauacugau

SEQ ID NO: 4066215 - RNA, 18 nt, Vaccinia virus
acucuuucgcuauuucua

SEQ ID NO: 4066216 - RNA, 22 nt, Vaccinia virus
acugaagucugauauucagaaa

SEQ ID NO: 4066217 - RNA, 18 nt, Vaccinia virus
acugaaugcuuucuugga

SEQ ID NO: 4066218 - RNA, 13 nt, Vaccinia virus
acugacuuuagac

SEQ ID NO: 4066219 - RNA, 18 nt, Vaccinia virus
acugagaaguuauuaucu

SEQ ID NO: 4066220 - RNA, 17 nt, Vaccinia virus
acugaguuggcuacuau

SEQ ID NO: 4066221 - RNA, 15 nt, Vaccinia virus
acugauuaacaaaug

SEQ ID NO: 4066222 - RNA, 22 nt, Vaccinia virus
acugauuaaugagaucuucuau

SEQ ID NO: 4066223 - RNA, 13 nt, Vaccinia virus
acugauucagaaa

SEQ ID NO: 4066224 - RNA, 13 nt, Vaccinia virus
acugauucuggac

SEQ ID NO: 4066225 - RNA, 19 nt, Vaccinia virus
acugccgaguuuaaaacuu

SEQ ID NO: 4066226 - RNA, 15 nt, Vaccinia virus
acuggaucguuuaaa

SEQ ID NO: 4066227 - RNA, 14 nt, Vaccinia virus
acuggcgaaauggu

SEQ ID NO: 4066228 - RNA, 22 nt, Vaccinia virus
acuggugaguuaauauucaugu

SEQ ID NO: 4066229 - RNA, 14 nt, Vaccinia virus
acuguaaaaacaaa

SEQ ID NO: 4066230 - RNA, 21 nt, Vaccinia virus
acuguaucaaccggauuuaaa

SEQ ID NO: 4066231 - RNA, 21 nt, Vaccinia virus
acugucuggcaauaaaugaua

SEQ ID NO: 4066232 - RNA, 16 nt, Vaccinia virus
acuguggauacucugu

SEQ ID NO: 4066233 - RNA, 20 nt, Vaccinia virus
acuguugaaguacuuaauga

SEQ ID NO: 4066234 - RNA, 19 nt, Vaccinia virus
acuguugccaaugauguca

SEQ ID NO: 4066235 - RNA, 13 nt, Vaccinia virus
acuguuuaauagc

SEQ ID NO: 4066236 - RNA, 14 nt, Vaccinia virus
acuuaaaaauggau

SEQ ID NO: 4066237 - RNA, 22 nt, Vaccinia virus
acuuaaugaagaucuauuucca

SEQ ID NO: 4066238 - RNA, 20 nt, Vaccinia virus
acuuacauggacacauucuu

SEQ ID NO: 4066239 - RNA, 18 nt, Vaccinia virus
acuuacuaaagucaauaa

SEQ ID NO: 4066240 - RNA, 18 nt, Vaccinia virus
acuuagaacagauuuaac

SEQ ID NO: 4066241 - RNA, 21 nt, Vaccinia virus
auaauucuacacggcaugguu

SEQ ID NO: 4066242 - RNA, 16 nt, Vaccinia virus
auaauucuauucuagu

SEQ ID NO: 4066243 - RNA, 14 nt, Vaccinia virus
auaauuuagauaau

SEQ ID NO: 4066244 - RNA, 22 nt, Vaccinia virus
auaauuucuguaaauucaugau

SEQ ID NO: 4066245 - RNA, 11 nt, Vaccinia virus
auaauuuuacc

SEQ ID NO: 4066246 - RNA, 15 nt, Vaccinia virus
auaauuuucauauau

SEQ ID NO: 4066247 - RNA, 14 nt, Vaccinia virus
auacaaaaaaaugc

SEQ ID NO: 4066248 - RNA, 20 nt, Vaccinia virus
auacaaaauuugcaucuaca

SEQ ID NO: 4066249 - RNA, 16 nt, Vaccinia virus
auacaauaaauguuua

SEQ ID NO: 4066250 - RNA, 21 nt, Vaccinia virus
auacaauaucuucgguaucuu

SEQ ID NO: 4066251 - RNA, 13 nt, Vaccinia virus
auacaauccauga

SEQ ID NO: 4066252 - RNA, 17 nt, Vaccinia virus
auacaauccaugauauu

SEQ ID NO: 4066253 - RNA, 17 nt, Vaccinia virus
auacaauggaugauaug

SEQ ID NO: 4066254 - RNA, 16 nt, Vaccinia virus
auacacauuuaauaaa

SEQ ID NO: 4066255 - RNA, 19 nt, Vaccinia virus
auacacguauaaaaaauau

SEQ ID NO: 4066256 - RNA, 18 nt, Vaccinia virus
auacacuguuuaaaauua

SEQ ID NO: 4066257 - RNA, 20 nt, Vaccinia virus
auacagaagauuuaacuaga

SEQ ID NO: 4066258 - RNA, 17 nt, Vaccinia virus
auacagaaggaaacuuc

SEQ ID NO: 4066259 - RNA, 14 nt, Vaccinia virus
auacagucuuaaau

SEQ ID NO: 4066260 - RNA, 16 nt, Vaccinia virus
auacauaccgaaagca

SEQ ID NO: 4066261 - RNA, 12 nt, Vaccinia virus
auacauauacca

SEQ ID NO: 4066262 - RNA, 17 nt, Vaccinia virus
auacauaugacaaacau

SEQ ID NO: 4066263 - RNA, 23 nt, Vaccinia virus
auacauaugguacgauguuguaa

SEQ ID NO: 4066264 - RNA, 13 nt, Vaccinia virus
auacaucuaaauu

SEQ ID NO: 4066265 - RNA, 16 nt, Vaccinia virus
auacaugaacaugucg

SEQ ID NO: 4066266 - RNA, 19 nt, Vaccinia virus
auacaugucuuagauguuc

SEQ ID NO: 4066267 - RNA, 23 nt, Vaccinia virus
auacauugaauauaaaauaacua

SEQ ID NO: 4066268 - RNA, 15 nt, Vaccinia virus
auacauugaucuaug

SEQ ID NO: 4066269 - RNA, 16 nt, Vaccinia virus
auacauuucucaaaug

SEQ ID NO: 4066270 - RNA, 19 nt, Vaccinia virus
auaccacaccauuuuuuaa

SEQ ID NO: 4066271 - RNA, 21 nt, Vaccinia virus
auaccaguauaccucaaaaau

SEQ ID NO: 4066272 - RNA, 16 nt, Vaccinia virus
auaccaguuauguuua

SEQ ID NO: 4066273 - RNA, 15 nt, Vaccinia virus
auaccguuaaauaua

SEQ ID NO: 4066274 - RNA, 14 nt, Vaccinia virus
auacgaaaauagau

SEQ ID NO: 4066275 - RNA, 22 nt, Vaccinia virus
auacgaauaucguucucuaaau

SEQ ID NO: 4066276 - RNA, 14 nt, Vaccinia virus
auacgagucauuau

SEQ ID NO: 4066277 - RNA, 14 nt, Vaccinia virus
auacgauucuauau

SEQ ID NO: 4066278 - RNA, 17 nt, Vaccinia virus
auacgcauguagaaugu

SEQ ID NO: 4066279 - RNA, 15 nt, Vaccinia virus
auacgccaaggaaag

SEQ ID NO: 4066280 - RNA, 17 nt, Vaccinia virus
auacgcuccuuaucaaa

SEQ ID NO: 4066281 - RNA, 14 nt, Vaccinia virus
auacguaaugaagu

SEQ ID NO: 4066282 - RNA, 20 nt, Vaccinia virus
auacguuuauauucuuuuaa

SEQ ID NO: 4066283 - RNA, 12 nt, Vaccinia virus
auacuaguuuuc

SEQ ID NO: 4066284 - RNA, 14 nt, Vaccinia virus
auacuauuguuuau

SEQ ID NO: 4066285 - RNA, 13 nt, Vaccinia virus
auacucucaucuu

SEQ ID NO: 4066286 - RNA, 12 nt, Vaccinia virus
auacucugaaag

SEQ ID NO: 4066287 - RNA, 21 nt, Vaccinia virus
auacucugcccuuuauuacau

SEQ ID NO: 4066288 - RNA, 22 nt, Vaccinia virus
auacucuucaaaguuucugaaa

SEQ ID NO: 4066289 - RNA, 22 nt, Vaccinia virus
auacugucuaauccuaagaaaa

SEQ ID NO: 4066290 - RNA, 14 nt, Vaccinia virus
auacuuaaaaaaug

SEQ ID NO: 4066291 - RNA, 15 nt, Vaccinia virus
auacuuaaaaaauga

SEQ ID NO: 4066292 - RNA, 20 nt, Vaccinia virus
auacuucaucaguguagaua

SEQ ID NO: 4066293 - RNA, 22 nt, Vaccinia virus
auacuucauuucuaaaauagua

SEQ ID NO: 4066294 - RNA, 15 nt, Vaccinia virus
auacuucuccaacau

SEQ ID NO: 4066295 - RNA, 22 nt, Vaccinia virus
auacuuuaacaucacuaauauc

SEQ ID NO: 4066296 - RNA, 14 nt, Vaccinia virus
auacuuuuaggaaa

SEQ ID NO: 4066297 - RNA, 20 nt, Vaccinia virus
auagaaaacucguuauuaac

SEQ ID NO: 4066298 - RNA, 13 nt, Vaccinia virus
auagaaaaugauu

SEQ ID NO: 4066299 - RNA, 15 nt, Vaccinia virus
auagaaacuauagau

SEQ ID NO: 4066300 - RNA, 13 nt, Vaccinia virus
auagaacaaaauc

SEQ ID NO: 4066301 - RNA, 16 nt, Vaccinia virus
auagaagauaucacau

SEQ ID NO: 4066302 - RNA, 14 nt, Vaccinia virus
auagaagauguuag

SEQ ID NO: 4066303 - RNA, 13 nt, Vaccinia virus
auagaauaaauua

SEQ ID NO: 4066304 - RNA, 21 nt, Vaccinia virus
auagaauucucuucauaucau

SEQ ID NO: 4066305 - RNA, 16 nt, Vaccinia virus
auagaauuuauaacau

SEQ ID NO: 4066306 - RNA, 18 nt, Vaccinia virus
auagaauuuauaacauga

SEQ ID NO: 4066307 - RNA, 22 nt, Vaccinia virus
auagagaauccuccgaauaauu

SEQ ID NO: 4066308 - RNA, 14 nt, Vaccinia virus
auagaggaugaauu

SEQ ID NO: 4066309 - RNA, 18 nt, Vaccinia virus
auagaguauuaaauauua

SEQ ID NO: 4066310 - RNA, 14 nt, Vaccinia virus
auagauaacauagu

SEQ ID NO: 4066311 - RNA, 16 nt, Vaccinia virus
auagauaaugauauau

SEQ ID NO: 4066312 - RNA, 13 nt, Vaccinia virus
auagauagaacua

SEQ ID NO: 4066313 - RNA, 23 nt, Vaccinia virus
auagauagugcuaaacgaauuac

SEQ ID NO: 4066314 - RNA, 16 nt, Vaccinia virus
auagauauaauuuuau

SEQ ID NO: 4066315 - RNA, 22 nt, Vaccinia virus
auagauauuaauuaucacauau

SEQ ID NO: 4066316 - RNA, 12 nt, Vaccinia virus
auagaucaaaua

SEQ ID NO: 4066317 - RNA, 17 nt, Vaccinia virus
auagaucgaaaaauaua

SEQ ID NO: 4066318 - RNA, 15 nt, Vaccinia virus
auagaugaagaucag

SEQ ID NO: 4066319 - RNA, 20 nt, Vaccinia virus
auagaugcaagguauaaccu

SEQ ID NO: 4066320 - RNA, 20 nt, Vaccinia virus
auagauggauaauggaagau

SEQ ID NO: 4066321 - RNA, 21 nt, Vaccinia virus
auagauggcacuguucuauga

SEQ ID NO: 4066322 - RNA, 23 nt, Vaccinia virus
auagauggucgacguuucucaaa

SEQ ID NO: 4066323 - RNA, 18 nt, Vaccinia virus
auagaugugagcuacugu

SEQ ID NO: 4066324 - RNA, 16 nt, Vaccinia virus
auagauuuccaaagau

SEQ ID NO: 4066325 - RNA, 16 nt, Vaccinia virus
auagcaauauguguaa

SEQ ID NO: 4066326 - RNA, 17 nt, Vaccinia virus
auagcauuaauacagua

SEQ ID NO: 4066327 - RNA, 15 nt, Vaccinia virus
auagccaaaagacua

SEQ ID NO: 4066328 - RNA, 17 nt, Vaccinia virus
auagccaucguuaauua

SEQ ID NO: 4066329 - RNA, 14 nt, Vaccinia virus
auagcuacaguaaa

SEQ ID NO: 4066330 - RNA, 18 nt, Vaccinia virus
auagcuuccuucaaucua

SEQ ID NO: 4066331 - RNA, 22 nt, Vaccinia virus
auagcuuuacucugaaaagaaa

SEQ ID NO: 4066332 - RNA, 13 nt, Vaccinia virus
auaggaacauuuc

SEQ ID NO: 4066333 - RNA, 15 nt, Vaccinia virus
auaggaccauacauu

SEQ ID NO: 4066334 - RNA, 17 nt, Vaccinia virus
auaggagcuagaagaac

SEQ ID NO: 4066335 - RNA, 20 nt, Vaccinia virus
auaggauucuuaauaugaua

SEQ ID NO: 4066336 - RNA, 14 nt, Vaccinia virus
auaggcaucauuua

SEQ ID NO: 4066337 - RNA, 14 nt, Vaccinia virus
auaggugaaaagau

SEQ ID NO: 4066338 - RNA, 13 nt, Vaccinia virus
auaguacauuccc

SEQ ID NO: 4066339 - RNA, 13 nt, Vaccinia virus
auaguagaauuaa

SEQ ID NO: 4066340 - RNA, 16 nt, Vaccinia virus
auaguagaauuaaugu

SEQ ID NO: 4066341 - RNA, 19 nt, Vaccinia virus
auaguaguguaguuaaugu

SEQ ID NO: 4066342 - RNA, 20 nt, Vaccinia virus
auaguauacgcagaaaagau

SEQ ID NO: 4066343 - RNA, 16 nt, Vaccinia virus
auaguaucuauauacg

SEQ ID NO: 4066344 - RNA, 19 nt, Vaccinia virus
auaguauucucagaguuga

SEQ ID NO: 4066345 - RNA, 14 nt, Vaccinia virus
auaguguauacaau

SEQ ID NO: 4066346 - RNA, 21 nt, Vaccinia virus
auagugucuccuauguuguaa

SEQ ID NO: 4066347 - RNA, 18 nt, Vaccinia virus
auaguuacauacaaacug

SEQ ID NO: 4066348 - RNA, 17 nt, Vaccinia virus
auaguuccauuaucuaa

SEQ ID NO: 4066349 - RNA, 21 nt, Vaccinia virus
auaguugaucagaaugaaugu

SEQ ID NO: 4066350 - RNA, 22 nt, Vaccinia virus
auaguuguuguccguuaucuaa

SEQ ID NO: 4066351 - RNA, 21 nt, Vaccinia virus
auaguuuccaccgaaagacua

SEQ ID NO: 4066352 - RNA, 22 nt, Vaccinia virus
auaguuuucucuauucugaaau

SEQ ID NO: 4066353 - RNA, 18 nt, Vaccinia virus
auauaaaaacucuaacau

SEQ ID NO: 4066354 - RNA, 21 nt, Vaccinia virus
auauaagacacagaaauacua

SEQ ID NO: 4066355 - RNA, 21 nt, Vaccinia virus
auauaaggccaaaacaaaauu

SEQ ID NO: 4066356 - RNA, 14 nt, Vaccinia virus
auauaagguuguau

SEQ ID NO: 4066357 - RNA, 14 nt, Vaccinia virus
auauaauaacaaga

SEQ ID NO: 4066358 - RNA, 14 nt, Vaccinia virus
auauaauaauacac

SEQ ID NO: 4066359 - RNA, 19 nt, Vaccinia virus
auauaauccgcauauucca

SEQ ID NO: 4066360 - RNA, 14 nt, Vaccinia virus
auauaaucuagaca

SEQ ID NO: 4066361 - RNA, 13 nt, Vaccinia virus
auauacacauaau

SEQ ID NO: 4066362 - RNA, 15 nt, Vaccinia virus
auauacagacucuau

SEQ ID NO: 4066363 - RNA, 14 nt, Vaccinia virus
auauacagucuuaa

SEQ ID NO: 4066364 - RNA, 15 nt, Vaccinia virus
auauacauuguauaa

SEQ ID NO: 4066365 - RNA, 17 nt, Vaccinia virus
auauaccgauauguaca

SEQ ID NO: 4066366 - RNA, 18 nt, Vaccinia virus
aucaacagaaguuaauaa

SEQ ID NO: 4066367 - RNA, 22 nt, Vaccinia virus
aucaacguaacuauauuccaaa

SEQ ID NO: 4066368 - RNA, 21 nt, Vaccinia virus
aucaacguagaaaaaauagaa

SEQ ID NO: 4066369 - RNA, 13 nt, Vaccinia virus
aucaacuauccuc

SEQ ID NO: 4066370 - RNA, 19 nt, Vaccinia virus
aucaagagugauuuaagaa

SEQ ID NO: 4066371 - RNA, 13 nt, Vaccinia virus
aucaaggauuaua

SEQ ID NO: 4066372 - RNA, 20 nt, Vaccinia virus
aucaauaaaugugagaaguu

SEQ ID NO: 4066373 - RNA, 16 nt, Vaccinia virus
aucaauaacuggcaca

SEQ ID NO: 4066374 - RNA, 22 nt, Vaccinia virus
aucaauaagaaaguuaagaauu

SEQ ID NO: 4066375 - RNA, 21 nt, Vaccinia virus
aucaauaccuuuucuggcuaa

SEQ ID NO: 4066376 - RNA, 12 nt, Vaccinia virus
aucaaucauauu

SEQ ID NO: 4066377 - RNA, 13 nt, Vaccinia virus
acaguuaaaacua

SEQ ID NO: 4066378 - RNA, 14 nt, Vaccinia virus
acaguuaacgaaag

SEQ ID NO: 4066379 - RNA, 14 nt, Vaccinia virus
acaguuauauaucu

SEQ ID NO: 4066380 - RNA, 16 nt, Vaccinia virus
acaguucuuuucuagc

SEQ ID NO: 4066381 - RNA, 13 nt, Vaccinia virus
acaguuucuguaa

SEQ ID NO: 4066382 - RNA, 15 nt, Vaccinia virus
acaguuuuacuauau

SEQ ID NO: 4066383 - RNA, 20 nt, Vaccinia virus
acauaaacugaucacuaauu

SEQ ID NO: 4066384 - RNA, 22 nt, Vaccinia virus
acauaaauaauucuagaggaga

SEQ ID NO: 4066385 - RNA, 15 nt, Vaccinia virus
acauaauauauacag

SEQ ID NO: 4066386 - RNA, 16 nt, Vaccinia virus
acauacaauuaaauca

SEQ ID NO: 4066387 - RNA, 16 nt, Vaccinia virus
acauacguauaaucug

SEQ ID NO: 4066388 - RNA, 17 nt, Vaccinia virus
acauacguauauuucua

SEQ ID NO: 4066389 - RNA, 16 nt, Vaccinia virus
acauacuaucuuuaau

SEQ ID NO: 4066390 - RNA, 20 nt, Vaccinia virus
acauacucuuaaaauuggau

SEQ ID NO: 4066391 - RNA, 12 nt, Vaccinia virus
acauagaaauaa

SEQ ID NO: 4066392 - RNA, 18 nt, Vaccinia virus
acauaggauuaaaaauaa

SEQ ID NO: 4066393 - RNA, 15 nt, Vaccinia virus
acauauaguggauua

SEQ ID NO: 4066394 - RNA, 14 nt, Vaccinia virus
acauauuacaaaau

SEQ ID NO: 4066395 - RNA, 15 nt, Vaccinia virus
acauauucaguugau

SEQ ID NO: 4066396 - RNA, 18 nt, Vaccinia virus
acauauuggguacuaguu

SEQ ID NO: 4066397 - RNA, 20 nt, Vaccinia virus
acaucaaaaagcuguuguau

SEQ ID NO: 4066398 - RNA, 21 nt, Vaccinia virus
acaucaaagaacguaaaauac

SEQ ID NO: 4066399 - RNA, 12 nt, Vaccinia virus
acaucaaaugau

SEQ ID NO: 4066400 - RNA, 21 nt, Vaccinia virus
acaucaacuaccuaaggaaua

SEQ ID NO: 4066401 - RNA, 14 nt, Vaccinia virus
acaucauauacaag

SEQ ID NO: 4066402 - RNA, 14 nt, Vaccinia virus
acaucccuuuucca

SEQ ID NO: 4066403 - RNA, 17 nt, Vaccinia virus
acauccgccuuaaaugu

SEQ ID NO: 4066404 - RNA, 18 nt, Vaccinia virus
acauccgccuuaaaugua

SEQ ID NO: 4066405 - RNA, 19 nt, Vaccinia virus
acauccucacuauucaugg

SEQ ID NO: 4066406 - RNA, 23 nt, Vaccinia virus
acaucuaguauugauaaauggaa

SEQ ID NO: 4066407 - RNA, 13 nt, Vaccinia virus
acaucuaguucuu

SEQ ID NO: 4066408 - RNA, 15 nt, Vaccinia virus
acaucuauuaaucau

SEQ ID NO: 4066409 - RNA, 17 nt, Vaccinia virus
acaucucaaugucuuua

SEQ ID NO: 4066410 - RNA, 16 nt, Vaccinia virus
acaucucgcaauaauc

SEQ ID NO: 4066411 - RNA, 20 nt, Vaccinia virus
acaucucugaacuauauaau

SEQ ID NO: 4066412 - RNA, 23 nt, Vaccinia virus
acaucuggccuguucauaaauaa

SEQ ID NO: 4066413 - RNA, 12 nt, Vaccinia virus
acaucuuccuuc

SEQ ID NO: 4066414 - RNA, 23 nt, Vaccinia virus
acaugcgguaaagauauuucuca

SEQ ID NO: 4066415 - RNA, 18 nt, Vaccinia virus
acaugggaaaugaaaugu

SEQ ID NO: 4066416 - RNA, 13 nt, Vaccinia virus
acaugguuaaagu

SEQ ID NO: 4066417 - RNA, 21 nt, Vaccinia virus
acauguaaugauuuaaaaugu

SEQ ID NO: 4066418 - RNA, 14 nt, Vaccinia virus
acauguuaaaugua

SEQ ID NO: 4066419 - RNA, 14 nt, Vaccinia virus
acauguuacagaau

SEQ ID NO: 4066420 - RNA, 14 nt, Vaccinia virus
acauguuuaauaua

SEQ ID NO: 4066421 - RNA, 20 nt, Vaccinia virus
acauuagaccguuuaauaga

SEQ ID NO: 4066422 - RNA, 18 nt, Vaccinia virus
acauuagauacaauggau

SEQ ID NO: 4066423 - RNA, 20 nt, Vaccinia virus
acauuaguagggauagaaug

SEQ ID NO: 4066424 - RNA, 20 nt, Vaccinia virus
acauucaaccacucucgaua

SEQ ID NO: 4066425 - RNA, 17 nt, Vaccinia virus
acauucagaaagaguuu

SEQ ID NO: 4066426 - RNA, 15 nt, Vaccinia virus
acauucuuauaacau

SEQ ID NO: 4066427 - RNA, 15 nt, Vaccinia virus
acauugaaacuaugu

SEQ ID NO: 4066428 - RNA, 14 nt, Vaccinia virus
acauugauuaaauu

SEQ ID NO: 4066429 - RNA, 22 nt, Vaccinia virus
acauugauuaaauuuuaauaua

SEQ ID NO: 4066430 - RNA, 22 nt, Vaccinia virus
acauuguuaauugaaaagggau

SEQ ID NO: 4066431 - RNA, 22 nt, Vaccinia virus
acauuguuauugaucaaacauu

SEQ ID NO: 4066432 - RNA, 19 nt, Vaccinia virus
acauuguuuguauucucca

SEQ ID NO: 4066433 - RNA, 15 nt, Vaccinia virus
acauuuccuacuacu

SEQ ID NO: 4066434 - RNA, 13 nt, Vaccinia virus
acauuuuaaaaua

SEQ ID NO: 4066435 - RNA, 18 nt, Vaccinia virus
acauuuuggcaaauugau

SEQ ID NO: 4066436 - RNA, 16 nt, Vaccinia virus
acauuuuugaaauacc

SEQ ID NO: 4066437 - RNA, 18 nt, Vaccinia virus
acauuuuuuauaaauaga

SEQ ID NO: 4066438 - RNA, 14 nt, Vaccinia virus
acauuuuuuguaaa

SEQ ID NO: 4066439 - RNA, 17 nt, Vaccinia virus
accaaaaaaucguauau

SEQ ID NO: 4066440 - RNA, 19 nt, Vaccinia virus
accaaacuuucagaagaaa

SEQ ID NO: 4066441 - RNA, 15 nt, Vaccinia virus
accaaauuaaugaau

SEQ ID NO: 4066442 - RNA, 16 nt, Vaccinia virus
accaaauuaaugaaua

SEQ ID NO: 4066443 - RNA, 17 nt, Vaccinia virus
accaacacuuaucaauu

SEQ ID NO: 4066444 - RNA, 15 nt, Vaccinia virus
accaacggaaauggu

SEQ ID NO: 4066445 - RNA, 16 nt, Vaccinia virus
accaacgguauaugaa

SEQ ID NO: 4066446 - RNA, 18 nt, Vaccinia virus
accaauaauaguagaauu

SEQ ID NO: 4066447 - RNA, 23 nt, Vaccinia virus
accaauauuggaauuauaauaua

SEQ ID NO: 4066448 - RNA, 22 nt, Vaccinia virus
accaauuaucuuuggagaaucg

SEQ ID NO: 4066449 - RNA, 21 nt, Vaccinia virus
accacaauaaaaaaaauugau

SEQ ID NO: 4066450 - RNA, 15 nt, Vaccinia virus
accacaggagaaugg

SEQ ID NO: 4066451 - RNA, 15 nt, Vaccinia virus
accacgaaacaauau

SEQ ID NO: 4066452 - RNA, 16 nt, Vaccinia virus
accagcacaacaucua

SEQ ID NO: 4066453 - RNA, 15 nt, Vaccinia virus
accagucaagucaau

SEQ ID NO: 4066454 - RNA, 22 nt, Vaccinia virus
accaguucauucaagauaagca

SEQ ID NO: 4066455 - RNA, 22 nt, Vaccinia virus
accauaacuguauaaaauggag

SEQ ID NO: 4066456 - RNA, 16 nt, Vaccinia virus
accauacuucuacaga

SEQ ID NO: 4066457 - RNA, 14 nt, Vaccinia virus
accauauacguguu

SEQ ID NO: 4066458 - RNA, 15 nt, Vaccinia virus
accauauacguguuu

SEQ ID NO: 4066459 - RNA, 19 nt, Vaccinia virus
accauaucgccguaaugua

SEQ ID NO: 4066460 - RNA, 21 nt, Vaccinia virus
accauaucgccguaauguaag

SEQ ID NO: 4066461 - RNA, 22 nt, Vaccinia virus
accauauuuucuggaaguggau

SEQ ID NO: 4066462 - RNA, 13 nt, Vaccinia virus
accaucaaaagca

SEQ ID NO: 4066463 - RNA, 15 nt, Vaccinia virus
accauuaaagaauuc

SEQ ID NO: 4066464 - RNA, 17 nt, Vaccinia virus
accauuacguuaacaga

SEQ ID NO: 4066465 - RNA, 16 nt, Vaccinia virus
accauuaucuuuguuu

SEQ ID NO: 4066466 - RNA, 21 nt, Vaccinia virus
accauuauucgccuguaucag

SEQ ID NO: 4066467 - RNA, 21 nt, Vaccinia virus
acccaaguuugagauuucaua

SEQ ID NO: 4066468 - RNA, 15 nt, Vaccinia virus
acccagcauacuuga

SEQ ID NO: 4066469 - RNA, 19 nt, Vaccinia virus
acccgcauacuuuaacaaa

SEQ ID NO: 4066470 - RNA, 14 nt, Vaccinia virus
acccuauaguuuua

SEQ ID NO: 4066471 - RNA, 19 nt, Vaccinia virus
acccuucuacgucaucaaa

SEQ ID NO: 4066472 - RNA, 15 nt, Vaccinia virus
accgggaaagagaag

SEQ ID NO: 4066473 - RNA, 22 nt, Vaccinia virus
accuagagacaaugaaaaaguu

SEQ ID NO: 4066474 - RNA, 18 nt, Vaccinia virus
accuauagcaucaauaau

SEQ ID NO: 4066475 - RNA, 22 nt, Vaccinia virus
accuauaugcccuauuaucaua

SEQ ID NO: 4066476 - RNA, 22 nt, Vaccinia virus
accuauggauacgguacacgua

SEQ ID NO: 4066477 - RNA, 17 nt, Vaccinia virus
accucuaguuucagaau

SEQ ID NO: 4066478 - RNA, 19 nt, Vaccinia virus
accucuggcacuuauuuca

SEQ ID NO: 4066479 - RNA, 20 nt, Vaccinia virus
accucuuauuggucagaaau

SEQ ID NO: 4066480 - RNA, 17 nt, Vaccinia virus
accuguaguuuuaacug

SEQ ID NO: 4066481 - RNA, 14 nt, Vaccinia virus
accuucuacauaua

SEQ ID NO: 4066482 - RNA, 12 nt, Vaccinia virus
acgaaacaaugu

SEQ ID NO: 4066483 - RNA, 17 nt, Vaccinia virus
acgaaagcaaagaauga

SEQ ID NO: 4066484 - RNA, 21 nt, Vaccinia virus
acgaaccagaaagugcaaaug

SEQ ID NO: 4066485 - RNA, 19 nt, Vaccinia virus
acgaaguauuuauacuuuu

SEQ ID NO: 4066486 - RNA, 17 nt, Vaccinia virus
acgagaagccauuuuau

SEQ ID NO: 4066487 - RNA, 21 nt, Vaccinia virus
acgagaauggcguuugauaua

SEQ ID NO: 4066488 - RNA, 22 nt, Vaccinia virus
acgagaauggcguuugauauau

SEQ ID NO: 4066489 - RNA, 17 nt, Vaccinia virus
acgagcuauuaaacugu

SEQ ID NO: 4066490 - RNA, 15 nt, Vaccinia virus
acgaggaaacaaugc

SEQ ID NO: 4066491 - RNA, 22 nt, Vaccinia virus
acgaggaaacaaugcgcuacau

SEQ ID NO: 4066492 - RNA, 18 nt, Vaccinia virus
acgauagucuguuaauaa

SEQ ID NO: 4066493 - RNA, 12 nt, Vaccinia virus
acgauaucacau

SEQ ID NO: 4066494 - RNA, 18 nt, Vaccinia virus
acgauccaaauuccggaa

SEQ ID NO: 4066495 - RNA, 14 nt, Vaccinia virus
acgaucuauuagaa

SEQ ID NO: 4066496 - RNA, 14 nt, Vaccinia virus
acgaugauauguuu

SEQ ID NO: 4066497 - RNA, 18 nt, Vaccinia virus
acgaugcugaguauuuca

SEQ ID NO: 4066498 - RNA, 13 nt, Vaccinia virus
acgauuacuacau

SEQ ID NO: 4066499 - RNA, 22 nt, Vaccinia virus
acgcagaaaagauaccacgagu

SEQ ID NO: 4066500 - RNA, 22 nt, Vaccinia virus
acgcauaaaaauaucuuccaau

SEQ ID NO: 4066501 - RNA, 15 nt, Vaccinia virus
acgcauccauccaaa

SEQ ID NO: 4066502 - RNA, 18 nt, Vaccinia virus
acgcauuauauaguuuuu

SEQ ID NO: 4066503 - RNA, 17 nt, Vaccinia virus
acgcuagauauacaguc

SEQ ID NO: 4066504 - RNA, 21 nt, Vaccinia virus
acgcuauaaaaagaguuucaa

SEQ ID NO: 4066505 - RNA, 15 nt, Vaccinia virus
acgcuauuaaucuuu

SEQ ID NO: 4066506 - RNA, 14 nt, Vaccinia virus
acggagauauuaaa

SEQ ID NO: 4066507 - RNA, 14 nt, Vaccinia virus
acggauacugucuu

SEQ ID NO: 4066508 - RNA, 20 nt, Vaccinia virus
acggcaaaccaaaaacauuu

SEQ ID NO: 4066509 - RNA, 13 nt, Vaccinia virus
acggcuauucugg

SEQ ID NO: 4066510 - RNA, 23 nt, Vaccinia virus
acggguuguauuguuauuuuaca

SEQ ID NO: 4066511 - RNA, 14 nt, Vaccinia virus
acgguauaugaaua

SEQ ID NO: 4066512 - RNA, 19 nt, Vaccinia virus
acguaaauacaaaacagag

SEQ ID NO: 4066513 - RNA, 12 nt, Vaccinia virus
acguaacaaugu

SEQ ID NO: 4066514 - RNA, 20 nt, Vaccinia virus
acguaguuaaugaaacauuu

SEQ ID NO: 4066515 - RNA, 17 nt, Vaccinia virus
acguaucucgucuaaau

SEQ ID NO: 4066516 - RNA, 14 nt, Vaccinia virus
acgucaaacaaugu

SEQ ID NO: 4066517 - RNA, 21 nt, Vaccinia virus
acguccugcaggguauuguuu

SEQ ID NO: 4066518 - RNA, 14 nt, Vaccinia virus
acgugcuguaccaa

SEQ ID NO: 4066519 - RNA, 13 nt, Vaccinia virus
acguuaacagaga

SEQ ID NO: 4066520 - RNA, 15 nt, Vaccinia virus
acguuacucaaacac

SEQ ID NO: 4066521 - RNA, 14 nt, Vaccinia virus
acguucauuaaaaa

SEQ ID NO: 4066522 - RNA, 18 nt, Vaccinia virus
acguuguacguuaaagca

SEQ ID NO: 4066523 - RNA, 19 nt, Vaccinia virus
acguuucuauuuucuauuu

SEQ ID NO: 4066524 - RNA, 22 nt, Vaccinia virus
acuaaacuaugugaugucuugg

SEQ ID NO: 4066525 - RNA, 19 nt, Vaccinia virus
acuaaaggcaacaaagaaa

SEQ ID NO: 4066526 - RNA, 19 nt, Vaccinia virus
acuaacgaaauuaauauga

SEQ ID NO: 4066527 - RNA, 18 nt, Vaccinia virus
acuaacgcaacuauauag

SEQ ID NO: 4066528 - RNA, 16 nt, Vaccinia virus
acuaacuuuaucacaa

SEQ ID NO: 4066529 - RNA, 19 nt, Vaccinia virus
acuaauauuuuauuucaaa

SEQ ID NO: 4066530 - RNA, 15 nt, Vaccinia virus
acuaaucaauaauca

SEQ ID NO: 4066531 - RNA, 20 nt, Vaccinia virus
acuaaucucuucuuuaacag

SEQ ID NO: 4066532 - RNA, 16 nt, Vaccinia virus
acuaauuaaagacuua

SEQ ID NO: 4066533 - RNA, 17 nt, Vaccinia virus
acuaauuguuaaccauu

SEQ ID NO: 4066534 - RNA, 16 nt, Vaccinia virus
acuacaacuagugaag

SEQ ID NO: 4066535 - RNA, 21 nt, Vaccinia virus
acuacaaugaacuaagagaaa

SEQ ID NO: 4066536 - RNA, 20 nt, Vaccinia virus
acuacaauugucuaaugaua

SEQ ID NO: 4066537 - RNA, 17 nt, Vaccinia virus
acuacacuuuuuaucau

SEQ ID NO: 4066538 - RNA, 20 nt, Vaccinia virus
acuacaguaguaauuaauga

SEQ ID NO: 4066539 - RNA, 14 nt, Vaccinia virus
acuacaguuugaaa

SEQ ID NO: 4066540 - RNA, 11 nt, Vaccinia virus
acuacauaucc

SEQ ID NO: 4066541 - RNA, 20 nt, Vaccinia virus
acuacauucucauuaauuaa

SEQ ID NO: 4066542 - RNA, 18 nt, Vaccinia virus
acuacugccauuaauauc

SEQ ID NO: 4066543 - RNA, 18 nt, Vaccinia virus
acuacuuacauggacaca

SEQ ID NO: 4066544 - RNA, 16 nt, Vaccinia virus
acuacuuuguuaauaa

SEQ ID NO: 4066545 - RNA, 13 nt, Vaccinia virus
acuagaagaaagu

SEQ ID NO: 4066546 - RNA, 23 nt, Vaccinia virus
acuagacuauuaauaagacugau

SEQ ID NO: 4066547 - RNA, 17 nt, Vaccinia virus
acuagacugauuucucu

SEQ ID NO: 4066548 - RNA, 15 nt, Vaccinia virus
acuagaguuguuaaa

SEQ ID NO: 4066549 - RNA, 14 nt, Vaccinia virus
acuagauaaacuau

SEQ ID NO: 4066550 - RNA, 16 nt, Vaccinia virus
acuagauuauacaaug

SEQ ID NO: 4066551 - RNA, 19 nt, Vaccinia virus
acuagcucgagaaugaaua

SEQ ID NO: 4066552 - RNA, 16 nt, Vaccinia virus
acuagcuuaaacagau

SEQ ID NO: 4066553 - RNA, 21 nt, Vaccinia virus
acuagugauagcauuaauaca

SEQ ID NO: 4066554 - RNA, 24 nt, Vaccinia virus
acuauagaagaacucaagcagaaa

SEQ ID NO: 4066555 - RNA, 20 nt, Vaccinia virus
acuauauaccuauuaauaca

SEQ ID NO: 4066556 - RNA, 19 nt, Vaccinia virus
acuauaucgacauauuuca

SEQ ID NO: 4066557 - RNA, 18 nt, Vaccinia virus
acuauauguuccaguaau

SEQ ID NO: 4066558 - RNA, 20 nt, Vaccinia virus
acuaucaaucgauaacaaga

SEQ ID NO: 4066559 - RNA, 21 nt, Vaccinia virus
acuaucaguaaguuuuauaga

SEQ ID NO: 4066560 - RNA, 12 nt, Vaccinia virus
acuaucuaaaug

SEQ ID NO: 4066561 - RNA, 17 nt, Vaccinia virus
acuaucugacauaaaca

SEQ ID NO: 4066562 - RNA, 14 nt, Vaccinia virus
acuaucuuuaacau

SEQ ID NO: 4066563 - RNA, 15 nt, Vaccinia virus
acuaucuuuaauaga

SEQ ID NO: 4066564 - RNA, 23 nt, Vaccinia virus
acuaugcgucgaaguaaaaauug

SEQ ID NO: 4066565 - RNA, 12 nt, Vaccinia virus
acuauuaaaacu

SEQ ID NO: 4066566 - RNA, 17 nt, Vaccinia virus
acuauuacuaggagaau

SEQ ID NO: 4066567 - RNA, 19 nt, Vaccinia virus
acuauuauuuauaacugau

SEQ ID NO: 4066568 - RNA, 17 nt, Vaccinia virus
acuauugccaucgaaug

SEQ ID NO: 4066569 - RNA, 11 nt, Vaccinia virus
acuauuucauu

SEQ ID NO: 4066570 - RNA, 13 nt, Vaccinia virus
acuauuugucuua

SEQ ID NO: 4066571 - RNA, 15 nt, Vaccinia virus
acuauuuucaguaau

SEQ ID NO: 4066572 - RNA, 15 nt, Vaccinia virus
acuauuuuuuacauu

SEQ ID NO: 4066573 - RNA, 16 nt, Vaccinia virus
acucauccuaucugga

SEQ ID NO: 4066574 - RNA, 22 nt, Vaccinia virus
acucaugaaucuaaaagaauug

SEQ ID NO: 4066575 - RNA, 16 nt, Vaccinia virus
acucaugauuaaaccu

SEQ ID NO: 4066576 - RNA, 23 nt, Vaccinia virus
acucauuucauuauaauaguuua

SEQ ID NO: 4066577 - RNA, 22 nt, Vaccinia virus
acuccaaugacugaauacauua

SEQ ID NO: 4066578 - RNA, 19 nt, Vaccinia virus
acuccuagagaauuaauau

SEQ ID NO: 4066579 - RNA, 23 nt, Vaccinia virus
acuccuuauuuuuagacauuaga

SEQ ID NO: 4066580 - RNA, 14 nt, Vaccinia virus
acuccuugacuauc

SEQ ID NO: 4066581 - RNA, 18 nt, Vaccinia virus
acucgaacagauaguuua

SEQ ID NO: 4066582 - RNA, 15 nt, Vaccinia virus
acucgcguuuagagg

SEQ ID NO: 4066583 - RNA, 22 nt, Vaccinia virus
acucuaaacaauuggacaaauu

SEQ ID NO: 4066584 - RNA, 23 nt, Vaccinia virus
acucuaaacaauuggacaaauuc

SEQ ID NO: 4066585 - RNA, 14 nt, Vaccinia virus
acucuaaaucgcuu

SEQ ID NO: 4066586 - RNA, 23 nt, Vaccinia virus
gagagucaauguuuuugaaacua

SEQ ID NO: 4066587 - RNA, 16 nt, Vaccinia virus
gagauaaucuauauca

SEQ ID NO: 4066588 - RNA, 15 nt, Vaccinia virus
gagaucuaaauacaa

SEQ ID NO: 4066589 - RNA, 13 nt, Vaccinia virus
gagauuaaugcua

SEQ ID NO: 4066590 - RNA, 21 nt, Vaccinia virus
gagauuuguuuuguuaaacaa

SEQ ID NO: 4066591 - RNA, 15 nt, Vaccinia virus
gaggaagacacauua

SEQ ID NO: 4066592 - RNA, 20 nt, Vaccinia virus
gaggaaguauaaaaauuaaa

SEQ ID NO: 4066593 - RNA, 22 nt, Vaccinia virus
gaggacuguuuuccugaaggaa

SEQ ID NO: 4066594 - RNA, 14 nt, Vaccinia virus
gagggaaaagucau

SEQ ID NO: 4066595 - RNA, 16 nt, Vaccinia virus
gagguauauaucauga

SEQ ID NO: 4066596 - RNA, 22 nt, Vaccinia virus
gaguaguaaacgcguacauaac

SEQ ID NO: 4066597 - RNA, 14 nt, Vaccinia virus
gagucucaucuuua

SEQ ID NO: 4066598 - RNA, 21 nt, Vaccinia virus
gagucuuuaucaauaaacaau

SEQ ID NO: 4066599 - RNA, 21 nt, Vaccinia virus
gaguuaggccaauagaaauau

SEQ ID NO: 4066600 - RNA, 14 nt, Vaccinia virus
gaguugacauaucg

SEQ ID NO: 4066601 - RNA, 17 nt, Vaccinia virus
gauaaaauuaaugagau

SEQ ID NO: 4066602 - RNA, 16 nt, Vaccinia virus
gauaacaaauuaaaga

SEQ ID NO: 4066603 - RNA, 21 nt, Vaccinia virus
gauaacuagaaucagaaucua

SEQ ID NO: 4066604 - RNA, 21 nt, Vaccinia virus
gauaacucucuucuauaaaaa

SEQ ID NO: 4066605 - RNA, 15 nt, Vaccinia virus
gauaacuguuuaaaa

SEQ ID NO: 4066606 - RNA, 13 nt, Vaccinia virus
gauaauaaacaaa

SEQ ID NO: 4066607 - RNA, 17 nt, Vaccinia virus
gauaauagauuaaugau

SEQ ID NO: 4066608 - RNA, 15 nt, Vaccinia virus
gauaaugaacauaua

SEQ ID NO: 4066609 - RNA, 13 nt, Vaccinia virus
gauaauuauccau

SEQ ID NO: 4066610 - RNA, 18 nt, Vaccinia virus
gauaauuucguuaaaaca

SEQ ID NO: 4066611 - RNA, 13 nt, Vaccinia virus
gauaauuucuugu

SEQ ID NO: 4066612 - RNA, 20 nt, Vaccinia virus
gauacaaucagauauaucua

SEQ ID NO: 4066613 - RNA, 20 nt, Vaccinia virus
gauacacucucaauauacua

SEQ ID NO: 4066614 - RNA, 14 nt, Vaccinia virus
gauacucuauuaau

SEQ ID NO: 4066615 - RNA, 17 nt, Vaccinia virus
gauagacuagaagaaag

SEQ ID NO: 4066616 - RNA, 16 nt, Vaccinia virus
gauagaugauccagau

SEQ ID NO: 4066617 - RNA, 13 nt, Vaccinia virus
gauagcaaaacaa

SEQ ID NO: 4066618 - RNA, 22 nt, Vaccinia virus
gauagcuuuaguuagauugcau

SEQ ID NO: 4066619 - RNA, 16 nt, Vaccinia virus
gauagguuauugacau

SEQ ID NO: 4066620 - RNA, 13 nt, Vaccinia virus
gauaguaaugcau

SEQ ID NO: 4066621 - RNA, 22 nt, Vaccinia virus
gauaguauaccaacuauauuac

SEQ ID NO: 4066622 - RNA, 19 nt, Vaccinia virus
gauaguauucaagucaaag

SEQ ID NO: 4066623 - RNA, 12 nt, Vaccinia virus
gauaguuucauu

SEQ ID NO: 4066624 - RNA, 20 nt, Vaccinia virus
gauauaauauauuagauauu

SEQ ID NO: 4066625 - RNA, 21 nt, Vaccinia virus
gauauaauucguggauaauca

SEQ ID NO: 4066626 - RNA, 17 nt, Vaccinia virus
gauauaauuuuauuaau

SEQ ID NO: 4066627 - RNA, 21 nt, Vaccinia virus
gauauacccgaagauauacac

SEQ ID NO: 4066628 - RNA, 18 nt, Vaccinia virus
gauauagaacacauaacc

SEQ ID NO: 4066629 - RNA, 22 nt, Vaccinia virus
gauauagacgaaauauuagaaa

SEQ ID NO: 4066630 - RNA, 20 nt, Vaccinia virus
gauauauaguaaugaagaga

SEQ ID NO: 4066631 - RNA, 23 nt, Vaccinia virus
gauauauauggucuuaugaaaga

SEQ ID NO: 4066632 - RNA, 22 nt, Vaccinia virus
gauauauauuguacgauaaugu

SEQ ID NO: 4066633 - RNA, 15 nt, Vaccinia virus
gauauauuaaacaag

SEQ ID NO: 4066634 - RNA, 20 nt, Vaccinia virus
gauaucaguagaugcacaau

SEQ ID NO: 4066635 - RNA, 19 nt, Vaccinia virus
gauauccaaaauuuuguau

SEQ ID NO: 4066636 - RNA, 15 nt, Vaccinia virus
cgacauucagaaaga

SEQ ID NO: 4066637 - RNA, 20 nt, Vaccinia virus
cgacgauaacgaaguauuua

SEQ ID NO: 4066638 - RNA, 20 nt, Vaccinia virus
cgagaaauaauaagaauaaa

SEQ ID NO: 4066639 - RNA, 12 nt, Vaccinia virus
cgagacuauuau

SEQ ID NO: 4066640 - RNA, 21 nt, Vaccinia virus
cgagagaaugaauaacccugg

SEQ ID NO: 4066641 - RNA, 13 nt, Vaccinia virus
cgaggauuuugau

SEQ ID NO: 4066642 - RNA, 19 nt, Vaccinia virus
cgaguugaguuuauccuua

SEQ ID NO: 4066643 - RNA, 16 nt, Vaccinia virus
cgaguuuaaaacuucu

SEQ ID NO: 4066644 - RNA, 21 nt, Vaccinia virus
cgauaaaauccuccuaucaau

SEQ ID NO: 4066645 - RNA, 21 nt, Vaccinia virus
cgauaacauguuaauuuccga

SEQ ID NO: 4066646 - RNA, 23 nt, Vaccinia virus
cgauaacauucuaggaauguugu

SEQ ID NO: 4066647 - RNA, 14 nt, Vaccinia virus
cgauagaucgaugg

SEQ ID NO: 4066648 - RNA, 19 nt, Vaccinia virus
cgauauagugaaacaaaau

SEQ ID NO: 4066649 - RNA, 19 nt, Vaccinia virus
cgauauuaaccuaaaagag

SEQ ID NO: 4066650 - RNA, 20 nt, Vaccinia virus
cgauauuauccgaagacaga

SEQ ID NO: 4066651 - RNA, 18 nt, Vaccinia virus
cgaugaucaaugacgaua

SEQ ID NO: 4066652 - RNA, 15 nt, Vaccinia virus
cgaugauggaguaau

SEQ ID NO: 4066653 - RNA, 20 nt, Vaccinia virus
cgaugauucgucuacauguu

SEQ ID NO: 4066654 - RNA, 16 nt, Vaccinia virus
cgaugcuguagcaucu

SEQ ID NO: 4066655 - RNA, 17 nt, Vaccinia virus
cgaugugucuacauaaa

SEQ ID NO: 4066656 - RNA, 16 nt, Vaccinia virus
cgauuagagauacaau

SEQ ID NO: 4066657 - RNA, 15 nt, Vaccinia virus
cgauuauuauaaaau

SEQ ID NO: 4066658 - RNA, 19 nt, Vaccinia virus
cgauucuauauauacucuu

SEQ ID NO: 4066659 - RNA, 18 nt, Vaccinia virus
cgauucuggcuauuucaa

SEQ ID NO: 4066660 - RNA, 18 nt, Vaccinia virus
cgauuguauaguuaauaa

SEQ ID NO: 4066661 - RNA, 14 nt, Vaccinia virus
cgauuucuacauau

SEQ ID NO: 4066662 - RNA, 16 nt, Vaccinia virus
cgauuuuuagauuuca

SEQ ID NO: 4066663 - RNA, 13 nt, Vaccinia virus
cgcaccaacaauu

SEQ ID NO: 4066664 - RNA, 15 nt, Vaccinia virus
cgcccaaaauagacg

SEQ ID NO: 4066665 - RNA, 16 nt, Vaccinia virus
cgcuuaauaucuucug

SEQ ID NO: 4066666 - RNA, 15 nt, Vaccinia virus
cggaacaucaauuau

SEQ ID NO: 4066667 - RNA, 21 nt, Vaccinia virus
cggauaaugauagacaagaua

SEQ ID NO: 4066668 - RNA, 23 nt, Vaccinia virus
cggauauucuaacgaaaacugua

SEQ ID NO: 4066669 - RNA, 23 nt, Vaccinia virus
cggcauuucuuuuuaaugauaua

SEQ ID NO: 4066670 - RNA, 15 nt, Vaccinia virus
cggcuacuaaaagau

SEQ ID NO: 4066671 - RNA, 18 nt, Vaccinia virus
cggcuaucgacuuaauau

SEQ ID NO: 4066672 - RNA, 22 nt, Vaccinia virus
cgggaagauuagucagaccauu

SEQ ID NO: 4066673 - RNA, 15 nt, Vaccinia virus
cgguacaacauucca

SEQ ID NO: 4066674 - RNA, 18 nt, Vaccinia virus
cggucgaugucaauaaua

SEQ ID NO: 4066675 - RNA, 11 nt, Vaccinia virus
cgguuguacau

SEQ ID NO: 4066676 - RNA, 23 nt, Vaccinia virus
cguaaaccauuuuucagaaagua

SEQ ID NO: 4066677 - RNA, 13 nt, Vaccinia virus
cguaaacuauuac

SEQ ID NO: 4066678 - RNA, 15 nt, Vaccinia virus
cguacuuaacaucua

SEQ ID NO: 4066679 - RNA, 13 nt, Vaccinia virus
cguagaaguugaa

SEQ ID NO: 4066680 - RNA, 18 nt, Vaccinia virus
cguagauaauauuucuag

SEQ ID NO: 4066681 - RNA, 19 nt, Vaccinia virus
cguauaaaguuauauaauu

SEQ ID NO: 4066682 - RNA, 12 nt, Vaccinia virus
cguauaaauuuu

SEQ ID NO: 4066683 - RNA, 12 nt, Vaccinia virus
cguauacucuac

SEQ ID NO: 4066684 - RNA, 12 nt, Vaccinia virus
cguauacucuau

SEQ ID NO: 4066685 - RNA, 15 nt, Vaccinia virus
cguaucuaaaguauu

SEQ ID NO: 4066686 - RNA, 17 nt, Vaccinia virus
cguaucuauaaucaucu

SEQ ID NO: 4066687 - RNA, 18 nt, Vaccinia virus
cguaucuauaaucaucug

SEQ ID NO: 4066688 - RNA, 15 nt, Vaccinia virus
cguauuagaauguau

SEQ ID NO: 4066689 - RNA, 20 nt, Vaccinia virus
cgucacagaaucuaccacag

SEQ ID NO: 4066690 - RNA, 12 nt, Vaccinia virus
cgucaguauuua

SEQ ID NO: 4066691 - RNA, 22 nt, Vaccinia virus
cgucuaaaacaauaaaugcauu

SEQ ID NO: 4066692 - RNA, 13 nt, Vaccinia virus
cgucuacaaaaaa

SEQ ID NO: 4066693 - RNA, 21 nt, Vaccinia virus
cgucuaccgaaacaucguuua

SEQ ID NO: 4066694 - RNA, 18 nt, Vaccinia virus
cgucucagaauucuaaau

SEQ ID NO: 4066695 - RNA, 17 nt, Vaccinia virus
cgucucugccauggaug

SEQ ID NO: 4066696 - RNA, 18 nt, Vaccinia virus
cgucuucccaaaauguua

SEQ ID NO: 4066697 - RNA, 14 nt, Vaccinia virus
cgugaaauaaaguc

SEQ ID NO: 4066698 - RNA, 14 nt, Vaccinia virus
cgugaauguauguu

SEQ ID NO: 4066699 - RNA, 20 nt, Vaccinia virus
cguggagaucauuaaauguu

SEQ ID NO: 4066700 - RNA, 18 nt, Vaccinia virus
cgugguuguuuaucacaa

SEQ ID NO: 4066701 - RNA, 14 nt, Vaccinia virus
cguguacaaaaaug

SEQ ID NO: 4066702 - RNA, 16 nt, Vaccinia virus
cguugacgcuguaaaa

SEQ ID NO: 4066703 - RNA, 13 nt, Vaccinia virus
cguuguuaagaua

SEQ ID NO: 4066704 - RNA, 22 nt, Vaccinia virus
cguuuaauaaacugaguguaaa

SEQ ID NO: 4066705 - RNA, 19 nt, Vaccinia virus
cguuuacaaacugaauaau

SEQ ID NO: 4066706 - RNA, 17 nt, Vaccinia virus
cguuuauccuuuuguug

SEQ ID NO: 4066707 - RNA, 19 nt, Vaccinia virus
cguuuuuaaguucuggaau

SEQ ID NO: 4066708 - RNA, 14 nt, Vaccinia virus
cuaaaaaauguaga

SEQ ID NO: 4066709 - RNA, 13 nt, Vaccinia virus
cuaaaaaugccac

SEQ ID NO: 4066710 - RNA, 22 nt, Vaccinia virus
cuaaaacuacguucgaugaauu

SEQ ID NO: 4066711 - RNA, 16 nt, Vaccinia virus
cuaaaauauacaaaca

SEQ ID NO: 4066712 - RNA, 19 nt, Vaccinia virus
cuaaaauauuuuuauucuc

SEQ ID NO: 4066713 - RNA, 12 nt, Vaccinia virus
cuaaacuagugg

SEQ ID NO: 4066714 - RNA, 15 nt, Vaccinia virus
cuaaacuuauuuaga

SEQ ID NO: 4066715 - RNA, 20 nt, Vaccinia virus
cuaaagacucuaaaugguug

SEQ ID NO: 4066716 - RNA, 20 nt, Vaccinia virus
cuaaagccgguguaacauuc

SEQ ID NO: 4066717 - RNA, 21 nt, Vaccinia virus
cuaaaggagcaaauguuaaug

SEQ ID NO: 4066718 - RNA, 14 nt, Vaccinia virus
cuaaaggaugagua

SEQ ID NO: 4066719 - RNA, 23 nt, Vaccinia virus
cuaaagggauuuuauaugauauc

SEQ ID NO: 4066720 - RNA, 10 nt, Vaccinia virus
cuaaauuaac

SEQ ID NO: 4066721 - RNA, 10 nt, Vaccinia virus
cuaaauuaau

SEQ ID NO: 4066722 - RNA, 22 nt, Vaccinia virus
cuaaauuuuguugauuacucuu

SEQ ID NO: 4066723 - RNA, 15 nt, Vaccinia virus
cuaacacauuucaac

SEQ ID NO: 4066724 - RNA, 14 nt, Vaccinia virus
cuaacucuguuuua

SEQ ID NO: 4066725 - RNA, 14 nt, Vaccinia virus
cuaacuuuaaacaa

SEQ ID NO: 4066726 - RNA, 15 nt, Vaccinia virus
cuaacuuuaaacaag

SEQ ID NO: 4066727 - RNA, 13 nt, Vaccinia virus
cuaagaaaacucu

SEQ ID NO: 4066728 - RNA, 19 nt, Vaccinia virus
cuaagagaaaucuuuagac

SEQ ID NO: 4066729 - RNA, 19 nt, Vaccinia virus
cuaagauuccauuaucuaa

SEQ ID NO: 4066730 - RNA, 21 nt, Vaccinia virus
cuaaguagaccguuaaugaaa

SEQ ID NO: 4066731 - RNA, 17 nt, Vaccinia virus
cuaauaaauuagauauu

SEQ ID NO: 4066732 - RNA, 14 nt, Vaccinia virus
cuaauaauaauuau

SEQ ID NO: 4066733 - RNA, 13 nt, Vaccinia virus
cuaauacucuggg

SEQ ID NO: 4066734 - RNA, 12 nt, Vaccinia virus
cuaauauacaau

SEQ ID NO: 4066735 - RNA, 22 nt, Vaccinia virus
cuaauauucccaaacauacauc

SEQ ID NO: 4066736 - RNA, 16 nt, Vaccinia virus
cuaauucaaauuguua

SEQ ID NO: 4066737 - RNA, 23 nt, Vaccinia virus
cuaauucacaauacgauuuagau

SEQ ID NO: 4066738 - RNA, 17 nt, Vaccinia virus
cuaauucgacuaucgaa

SEQ ID NO: 4066739 - RNA, 13 nt, Vaccinia virus
cuaauucuuuaau

SEQ ID NO: 4066740 - RNA, 16 nt, Vaccinia virus
cuaauuguuuaaauaa

SEQ ID NO: 4066741 - RNA, 12 nt, Vaccinia virus
cuaauuucugaa

SEQ ID NO: 4066742 - RNA, 20 nt, Vaccinia virus
cuaauuugauauaaugaauu

SEQ ID NO: 4066743 - RNA, 20 nt, Vaccinia virus
cuaauuuuguagcauuagua

SEQ ID NO: 4066744 - RNA, 16 nt, Vaccinia virus
cuacaaaagaaucugu

SEQ ID NO: 4066745 - RNA, 21 nt, Vaccinia virus
cuacaaaagcaauuauuacaa

SEQ ID NO: 4066746 - RNA, 19 nt, Vaccinia virus
cuacaaaauguugauaauc

SEQ ID NO: 4066747 - RNA, 20 nt, Vaccinia virus
cuacaaauuuggauauucua

SEQ ID NO: 4066748 - RNA, 22 nt, Vaccinia virus
cuacaucaguuuuguauuccaa

SEQ ID NO: 4066749 - RNA, 17 nt, Vaccinia virus
cuaccacacuucuagau

SEQ ID NO: 4066750 - RNA, 12 nt, Vaccinia virus
cuaccuauuuca

SEQ ID NO: 4066751 - RNA, 20 nt, Vaccinia virus
cuaccuuacccauaaacaau

SEQ ID NO: 4066752 - RNA, 16 nt, Vaccinia virus
cuacucauagaaaggu

SEQ ID NO: 4066753 - RNA, 15 nt, Vaccinia virus
cuacugcaucacuga

SEQ ID NO: 4066754 - RNA, 21 nt, Vaccinia virus
cuacugggauaagauuuccaa

SEQ ID NO: 4066755 - RNA, 18 nt, Vaccinia virus
cuacuucgguuagauguu

SEQ ID NO: 4066756 - RNA, 13 nt, Vaccinia virus
cuacuuuuacagu

SEQ ID NO: 4066757 - RNA, 18 nt, Vaccinia virus
cuagaaaacgaaaacauc

SEQ ID NO: 4066758 - RNA, 17 nt, Vaccinia virus
cuagaaugaagauauca

SEQ ID NO: 4066759 - RNA, 22 nt, Vaccinia virus
cuagacaccuuuucaauguuua

SEQ ID NO: 4066760 - RNA, 19 nt, Vaccinia virus
cuagacguuuauucucaaa

SEQ ID NO: 4066761 - RNA, 15 nt, Vaccinia virus
cucuucucugcauuu

SEQ ID NO: 4066762 - RNA, 14 nt, Vaccinia virus
cucuuggaauuaau

SEQ ID NO: 4066763 - RNA, 14 nt, Vaccinia virus
cucuuucuuuugau

SEQ ID NO: 4066764 - RNA, 23 nt, Vaccinia virus
cucuuuugaugauaaauuuccaa

SEQ ID NO: 4066765 - RNA, 16 nt, Vaccinia virus
cugaaaagaagugagu

SEQ ID NO: 4066766 - RNA, 14 nt, Vaccinia virus
cugaaaauaaagau

SEQ ID NO: 4066767 - RNA, 12 nt, Vaccinia virus
cugaaaauuaaa

SEQ ID NO: 4066768 - RNA, 15 nt, Vaccinia virus
cugaaagagaugaga

SEQ ID NO: 4066769 - RNA, 16 nt, Vaccinia virus
cugaaauaaucaugua

SEQ ID NO: 4066770 - RNA, 21 nt, Vaccinia virus
cugaaauccguagaaacaucu

SEQ ID NO: 4066771 - RNA, 21 nt, Vaccinia virus
cugaaauggugguaaaacuaa

SEQ ID NO: 4066772 - RNA, 20 nt, Vaccinia virus
cugaauaaucguuauuauca

SEQ ID NO: 4066773 - RNA, 15 nt, Vaccinia virus
cugaauuauuucaua

SEQ ID NO: 4066774 - RNA, 23 nt, Vaccinia virus
cugacauaaacauaucaaaagaa

SEQ ID NO: 4066775 - RNA, 17 nt, Vaccinia virus
cugacauucagaaagag

SEQ ID NO: 4066776 - RNA, 21 nt, Vaccinia virus
cugacuacuaacgaaauuaau

SEQ ID NO: 4066777 - RNA, 15 nt, Vaccinia virus
cugacuuauuuccua

SEQ ID NO: 4066778 - RNA, 13 nt, Vaccinia virus
cugaguaaaugug

SEQ ID NO: 4066779 - RNA, 15 nt, Vaccinia virus
cugauaauguagaag

SEQ ID NO: 4066780 - RNA, 16 nt, Vaccinia virus
cugauagcaguuucaa

SEQ ID NO: 4066781 - RNA, 19 nt, Vaccinia virus
cugaucuuaacuccucuau

SEQ ID NO: 4066782 - RNA, 18 nt, Vaccinia virus
cugaucuucuuuugucgu

SEQ ID NO: 4066783 - RNA, 23 nt, Vaccinia virus
cugauguaacccacguaacauug

SEQ ID NO: 4066784 - RNA, 16 nt, Vaccinia virus
cugauguuuguuuucg

SEQ ID NO: 4066785 - RNA, 14 nt, Vaccinia virus
cugauuaacaaaug

SEQ ID NO: 4066786 - RNA, 14 nt, Vaccinia virus
cugauuuauguuuu

SEQ ID NO: 4066787 - RNA, 17 nt, Vaccinia virus
cugauuuuuuaacuuca

SEQ ID NO: 4066788 - RNA, 21 nt, Vaccinia virus
cugauuuuuuaugauuuugug

SEQ ID NO: 4066789 - RNA, 16 nt, Vaccinia virus
cugcaaauguaguauu

SEQ ID NO: 4066790 - RNA, 18 nt, Vaccinia virus
cugcaaauguaguauuua

SEQ ID NO: 4066791 - RNA, 13 nt, Vaccinia virus
cugcaauaaaaca

SEQ ID NO: 4066792 - RNA, 19 nt, Vaccinia virus
cugcagcaaaggcaauaag

SEQ ID NO: 4066793 - RNA, 19 nt, Vaccinia virus
cugcagcaacuugugcacu

SEQ ID NO: 4066794 - RNA, 12 nt, Vaccinia virus
cugcagcauuuu

SEQ ID NO: 4066795 - RNA, 13 nt, Vaccinia virus
cugcaucacugac

SEQ ID NO: 4066796 - RNA, 14 nt, Vaccinia virus
cugccauggaugga

SEQ ID NO: 4066797 - RNA, 21 nt, Vaccinia virus
cugccauggauggaaacauug

SEQ ID NO: 4066798 - RNA, 21 nt, Vaccinia virus
cugcggacgcggaugcucagu

SEQ ID NO: 4066799 - RNA, 17 nt, Vaccinia virus
cugcguuaucaauaaau

SEQ ID NO: 4066800 - RNA, 12 nt, Vaccinia virus
cugcuauuucug

SEQ ID NO: 4066801 - RNA, 18 nt, Vaccinia virus
cugcuugggaauuuuuua

SEQ ID NO: 4066802 - RNA, 20 nt, Vaccinia virus
cuggaaaauaaaucacugac

SEQ ID NO: 4066803 - RNA, 18 nt, Vaccinia virus
cuggaagcaaaaaaucug

SEQ ID NO: 4066804 - RNA, 23 nt, Vaccinia virus
cuggaauuaguuagauauauaga

SEQ ID NO: 4066805 - RNA, 16 nt, Vaccinia virus
cuggauaauauauacg

SEQ ID NO: 4066806 - RNA, 22 nt, Vaccinia virus
cugguuugauaaacuguuuauu

SEQ ID NO: 4066807 - RNA, 12 nt, Vaccinia virus
cuguaaacauuu

SEQ ID NO: 4066808 - RNA, 16 nt, Vaccinia virus
cuguacaaauguuaaa

SEQ ID NO: 4066809 - RNA, 21 nt, Vaccinia virus
cuguaggaaauggaagauauu

SEQ ID NO: 4066810 - RNA, 18 nt, Vaccinia virus
cuguauaucuauaauauu

SEQ ID NO: 4066811 - RNA, 18 nt, Vaccinia virus
cuguaucauccaguuuuc

SEQ ID NO: 4066812 - RNA, 14 nt, Vaccinia virus
cugugaauacuuua

SEQ ID NO: 4066813 - RNA, 15 nt, Vaccinia virus
cuguuaauaacucua

SEQ ID NO: 4066814 - RNA, 16 nt, Vaccinia virus
cuguuaucuaaugaau

SEQ ID NO: 4066815 - RNA, 13 nt, Vaccinia virus
cuguucuauuuug

SEQ ID NO: 4066816 - RNA, 15 nt, Vaccinia virus
cuguuguacauacag

SEQ ID NO: 4066817 - RNA, 21 nt, Vaccinia virus
cuguuguuuauucaacaugua

SEQ ID NO: 4066818 - RNA, 15 nt, Vaccinia virus
cuguuuauuaaugau

SEQ ID NO: 4066819 - RNA, 20 nt, Vaccinia virus
cuuaaaaaguucgaguuucu

SEQ ID NO: 4066820 - RNA, 21 nt, Vaccinia virus
cuuaaaauuuaaaaugauauu

SEQ ID NO: 4066821 - RNA, 13 nt, Vaccinia virus
cuuaacaauaaau

SEQ ID NO: 4066822 - RNA, 18 nt, Vaccinia virus
cuuaaccauauauccaau

SEQ ID NO: 4066823 - RNA, 14 nt, Vaccinia virus
cuuaacuauuuccg

SEQ ID NO: 4066824 - RNA, 16 nt, Vaccinia virus
cuuaauagacaaacug

SEQ ID NO: 4066825 - RNA, 18 nt, Vaccinia virus
cuuaauauugccauaauu

SEQ ID NO: 4066826 - RNA, 16 nt, Vaccinia virus
cuuaaucauaucacau

SEQ ID NO: 4066827 - RNA, 23 nt, Vaccinia virus
cuuaaugaagaucuauuuccaga

SEQ ID NO: 4066828 - RNA, 15 nt, Vaccinia virus
cuuaaugucuguauc

SEQ ID NO: 4066829 - RNA, 14 nt, Vaccinia virus
cuuaauuauuuugc

SEQ ID NO: 4066830 - RNA, 14 nt, Vaccinia virus
cuuacauaaaugaa

SEQ ID NO: 4066831 - RNA, 14 nt, Vaccinia virus
cuuacuaucuuuuu

SEQ ID NO: 4066832 - RNA, 15 nt, Vaccinia virus
cuuagaaauaaacga

SEQ ID NO: 4066833 - RNA, 15 nt, Vaccinia virus
cuuaguaaacagucc

SEQ ID NO: 4066834 - RNA, 22 nt, Vaccinia virus
cuuauaaaacuauauuuggaau

SEQ ID NO: 4066835 - RNA, 16 nt, Vaccinia virus
cuuauauugaugaugu

SEQ ID NO: 4066836 - RNA, 16 nt, Vaccinia virus
cuuaucguugaagacu

SEQ ID NO: 4066837 - RNA, 13 nt, Vaccinia virus
cuuauuaacauuu

SEQ ID NO: 4066838 - RNA, 17 nt, Vaccinia virus
cuuauuacuuuuggaau

SEQ ID NO: 4066839 - RNA, 15 nt, Vaccinia virus
cuuauuauauuuccc

SEQ ID NO: 4066840 - RNA, 16 nt, Vaccinia virus
cuuauucuuaaaaucu

SEQ ID NO: 4066841 - RNA, 17 nt, Vaccinia virus
cuuauuuuuaaaaauug

SEQ ID NO: 4066842 - RNA, 21 nt, Vaccinia virus
cuucagaaaagucaaauauug

SEQ ID NO: 4066843 - RNA, 23 nt, Vaccinia virus
cuucagaauacaaucuguauuuc

SEQ ID NO: 4066844 - RNA, 16 nt, Vaccinia virus
cuucagacaacaucuc

SEQ ID NO: 4066845 - RNA, 18 nt, Vaccinia virus
cuucauuaaucuuuucug

SEQ ID NO: 4066846 - RNA, 12 nt, Vaccinia virus
cuucauuauuuu

SEQ ID NO: 4066847 - RNA, 20 nt, Vaccinia virus
cuuccacuguccaaaaugau

SEQ ID NO: 4066848 - RNA, 14 nt, Vaccinia virus
cuuccaguucugga

SEQ ID NO: 4066849 - RNA, 20 nt, Vaccinia virus
cuuccuaggauagcuuuagu

SEQ ID NO: 4066850 - RNA, 23 nt, Vaccinia virus
cuuccugguugguauugcgcuac

SEQ ID NO: 4066851 - RNA, 15 nt, Vaccinia virus
cuucgacaaaucguu

SEQ ID NO: 4066852 - RNA, 15 nt, Vaccinia virus
cuucgauaaaaugac

SEQ ID NO: 4066853 - RNA, 19 nt, Vaccinia virus
cuucgauauaaaaucauuu

SEQ ID NO: 4066854 - RNA, 22 nt, Vaccinia virus
cuucgauauuagauuuuguauu

SEQ ID NO: 4066855 - RNA, 22 nt, Vaccinia virus
cuucgaugagauugaucaugua

SEQ ID NO: 4066856 - RNA, 12 nt, Vaccinia virus
cuucuaaaacug

SEQ ID NO: 4066857 - RNA, 21 nt, Vaccinia virus
cuucuaaugagcaaguagaaa

SEQ ID NO: 4066858 - RNA, 14 nt, Vaccinia virus
cuucuacaauaucu

SEQ ID NO: 4066859 - RNA, 22 nt, Vaccinia virus
cuucuacaucuuccuucuuauu

SEQ ID NO: 4066860 - RNA, 17 nt, Vaccinia virus
cuucucaucucuuucag

SEQ ID NO: 4066861 - RNA, 16 nt, Vaccinia virus
cuucucuccuuucaaa

SEQ ID NO: 4066862 - RNA, 17 nt, Vaccinia virus
cuucucuguuuaaugaa

SEQ ID NO: 4066863 - RNA, 17 nt, Vaccinia virus
cuugacuacauucucau

SEQ ID NO: 4066864 - RNA, 14 nt, Vaccinia virus
cuugagaauaucca

SEQ ID NO: 4066865 - RNA, 20 nt, Vaccinia virus
cuugauacagccaaguaucu

SEQ ID NO: 4066866 - RNA, 21 nt, Vaccinia virus
cuugauuaccuuacucaugau

SEQ ID NO: 4066867 - RNA, 14 nt, Vaccinia virus
cuuggaaauuauuu

SEQ ID NO: 4066868 - RNA, 13 nt, Vaccinia virus
cuuguauuuugau

SEQ ID NO: 4066869 - RNA, 19 nt, Vaccinia virus
cuugucaaaucuauauacc

SEQ ID NO: 4066870 - RNA, 13 nt, Vaccinia virus
cuugugcauuuuc

SEQ ID NO: 4066871 - RNA, 22 nt, Vaccinia virus
cuuuaacgcccuuguauguuuu

SEQ ID NO: 4066872 - RNA, 17 nt, Vaccinia virus
cuuuaaguauauacgau

SEQ ID NO: 4066873 - RNA, 19 nt, Vaccinia virus
cuuuaauaacaaagaaaga

SEQ ID NO: 4066874 - RNA, 22 nt, Vaccinia virus
cuuuaauaggaguaauagaacu

SEQ ID NO: 4066875 - RNA, 18 nt, Vaccinia virus
cuuuaauagugucauuag

SEQ ID NO: 4066876 - RNA, 14 nt, Vaccinia virus
cuuuaaucuauauu

SEQ ID NO: 4066877 - RNA, 22 nt, Vaccinia virus
cuuuacaguuucuguaaugaug

SEQ ID NO: 4066878 - RNA, 17 nt, Vaccinia virus
cuuuagaaauuguauuc

SEQ ID NO: 4066879 - RNA, 16 nt, Vaccinia virus
cuuuagaagaauaucu

SEQ ID NO: 4066880 - RNA, 14 nt, Vaccinia virus
cuuuagaguauuuc

SEQ ID NO: 4066881 - RNA, 17 nt, Vaccinia virus
cuuuagaugaauuauua

SEQ ID NO: 4066882 - RNA, 19 nt, Vaccinia virus
cuuuauuauuauugacuuc

SEQ ID NO: 4066883 - RNA, 14 nt, Vaccinia virus
cuuucaagaauaaa

SEQ ID NO: 4066884 - RNA, 20 nt, Vaccinia virus
cuuuccguacaacauacugu

SEQ ID NO: 4066885 - RNA, 17 nt, Vaccinia virus
cuuuccugggaaacucu

SEQ ID NO: 4066886 - RNA, 12 nt, Vaccinia virus
cuuucuauuuuu

SEQ ID NO: 4066887 - RNA, 15 nt, Vaccinia virus
cuuucucacaaaaau

SEQ ID NO: 4066888 - RNA, 11 nt, Vaccinia virus
cuuucucucuu

SEQ ID NO: 4066889 - RNA, 18 nt, Vaccinia virus
cuuucuguauccagguag

SEQ ID NO: 4066890 - RNA, 13 nt, Vaccinia virus
cuuugauuaauga

SEQ ID NO: 4066891 - RNA, 20 nt, Vaccinia virus
cuuugguaaugaaauuauuc

SEQ ID NO: 4066892 - RNA, 16 nt, Vaccinia virus
cuuugguguaaaguua

SEQ ID NO: 4066893 - RNA, 19 nt, Vaccinia virus
cuuugugaugucuaguuuc

SEQ ID NO: 4066894 - RNA, 16 nt, Vaccinia virus
cuuuguguugugcauu

SEQ ID NO: 4066895 - RNA, 16 nt, Vaccinia virus
cuuuucuaaauucaua

SEQ ID NO: 4066896 - RNA, 18 nt, Vaccinia virus
cuuuucuauaaucaucuu

SEQ ID NO: 4066897 - RNA, 22 nt, Vaccinia virus
cuuuugauuugcuuugaaugau

SEQ ID NO: 4066898 - RNA, 14 nt, Vaccinia virus
gaaaaaaauaucua

SEQ ID NO: 4066899 - RNA, 16 nt, Vaccinia virus
gaaaaacacauaucua

SEQ ID NO: 4066900 - RNA, 15 nt, Vaccinia virus
gaaaaaguaaaugau

SEQ ID NO: 4066901 - RNA, 13 nt, Vaccinia virus
gaaaaauauuaaa

SEQ ID NO: 4066902 - RNA, 17 nt, Vaccinia virus
gaaaacauuuuuaucau

SEQ ID NO: 4066903 - RNA, 20 nt, Vaccinia virus
gaaaacgagccaguaaucuu

SEQ ID NO: 4066904 - RNA, 18 nt, Vaccinia virus
gaaaacuuuaaauacuua

SEQ ID NO: 4066905 - RNA, 13 nt, Vaccinia virus
gaaaagauaacua

SEQ ID NO: 4066906 - RNA, 16 nt, Vaccinia virus
gaaaagauauccagag

SEQ ID NO: 4066907 - RNA, 17 nt, Vaccinia virus
gaaaaguauaauucuuu

SEQ ID NO: 4066908 - RNA, 12 nt, Vaccinia virus
gaaaauaauaaa

SEQ ID NO: 4066909 - RNA, 19 nt, Vaccinia virus
gaaaauacaaguauagaua

SEQ ID NO: 4066910 - RNA, 21 nt, Vaccinia virus
gaaaauaccauccaagucaau

SEQ ID NO: 4066911 - RNA, 16 nt, Vaccinia virus
gaaaauagcagcugau

SEQ ID NO: 4066912 - RNA, 22 nt, Vaccinia virus
gaaaaucuacuaccgaugaugu

SEQ ID NO: 4066913 - RNA, 21 nt, Vaccinia virus
gaaaaucuuucuucuacuaua

SEQ ID NO: 4066914 - RNA, 19 nt, Vaccinia virus
gaaaauuauaaugaauauu

SEQ ID NO: 4066915 - RNA, 17 nt, Vaccinia virus
gaaacgauaucaugaac

SEQ ID NO: 4066916 - RNA, 15 nt, Vaccinia virus
gaaacgauguaguua

SEQ ID NO: 4066917 - RNA, 18 nt, Vaccinia virus
gaaacuauagauaaugau

SEQ ID NO: 4066918 - RNA, 22 nt, Vaccinia virus
gaaacugacggaugauucuagu

SEQ ID NO: 4066919 - RNA, 13 nt, Vaccinia virus
gaaacugauacaa

SEQ ID NO: 4066920 - RNA, 17 nt, Vaccinia virus
gaaacuguaaagaacag

SEQ ID NO: 4066921 - RNA, 17 nt, Vaccinia virus
gaaagaacugauugcag

SEQ ID NO: 4066922 - RNA, 14 nt, Vaccinia virus
gaaagaauaagaac

SEQ ID NO: 4066923 - RNA, 20 nt, Vaccinia virus
gaaagaaucaaaagaaugau

SEQ ID NO: 4066924 - RNA, 17 nt, Vaccinia virus
gaaagcgugauuuuaau

SEQ ID NO: 4066925 - RNA, 23 nt, Vaccinia virus
gaaagcugggggauguucugguu

SEQ ID NO: 4066926 - RNA, 15 nt, Vaccinia virus
gaaaguaaauaauau

SEQ ID NO: 4066927 - RNA, 21 nt, Vaccinia virus
gaaauaauaggagguaaugau

SEQ ID NO: 4066928 - RNA, 20 nt, Vaccinia virus
gaaauaaucauaaauuauuu

SEQ ID NO: 4066929 - RNA, 16 nt, Vaccinia virus
gaaauaauuuuuaguu

SEQ ID NO: 4066930 - RNA, 16 nt, Vaccinia virus
gaaauacaaaauguua

SEQ ID NO: 4066931 - RNA, 10 nt, Vaccinia virus
gaaauacuua

SEQ ID NO: 4066932 - RNA, 21 nt, Vaccinia virus
gaaauauaugagauguaguua

SEQ ID NO: 4066933 - RNA, 18 nt, Vaccinia virus
gaaauauauuaagaaauc

SEQ ID NO: 4066934 - RNA, 19 nt, Vaccinia virus
gaaaucauguuauaguguu

SEQ ID NO: 4066935 - RNA, 16 nt, Vaccinia virus
gaaaugagaaacuguu

SEQ ID NO: 4066936 - RNA, 20 nt, Vaccinia virus
gaaauguuuuucgauuacaa

SEQ ID NO: 4066937 - RNA, 15 nt, Vaccinia virus
gaaauugauaaugag

SEQ ID NO: 4066938 - RNA, 19 nt, Vaccinia virus
gaaauuuggguacugugaa

SEQ ID NO: 4066939 - RNA, 15 nt, Vaccinia virus
gaaauuuguaaucau

SEQ ID NO: 4066940 - RNA, 16 nt, Vaccinia virus
gaacaacgucaacaac

SEQ ID NO: 4066941 - RNA, 17 nt, Vaccinia virus
gaacaaguaucaaaaga

SEQ ID NO: 4066942 - RNA, 14 nt, Vaccinia virus
gaacaauaaaagag

SEQ ID NO: 4066943 - RNA, 21 nt, Vaccinia virus
gaacacacgaugaaaauguac

SEQ ID NO: 4066944 - RNA, 13 nt, Vaccinia virus
gaacacuacagua

SEQ ID NO: 4066945 - RNA, 13 nt, Vaccinia virus
gaacagaugauau

SEQ ID NO: 4066946 - RNA, 17 nt, Vaccinia virus
gaacagguuauccagaa

SEQ ID NO: 4066947 - RNA, 17 nt, Vaccinia virus
gaacauaaaacuaauau

SEQ ID NO: 4066948 - RNA, 19 nt, Vaccinia virus
gaacauagaacuaguucuc

SEQ ID NO: 4066949 - RNA, 15 nt, Vaccinia virus
gaacauauaaaugua

SEQ ID NO: 4066950 - RNA, 20 nt, Vaccinia virus
gaacauauuuauauaauuau

SEQ ID NO: 4066951 - RNA, 22 nt, Vaccinia virus
gaacaucuugauuauaauauaa

SEQ ID NO: 4066952 - RNA, 17 nt, Vaccinia virus
gaacauuauaauaauca

SEQ ID NO: 4066953 - RNA, 14 nt, Vaccinia virus
gaacauuuaagaga

SEQ ID NO: 4066954 - RNA, 16 nt, Vaccinia virus
gaaccuucuacauaua

SEQ ID NO: 4066955 - RNA, 22 nt, Vaccinia virus
gaacguaguaguaaguauuuau

SEQ ID NO: 4066956 - RNA, 19 nt, Vaccinia virus
gaacuaacuauuacuauga

SEQ ID NO: 4066957 - RNA, 17 nt, Vaccinia virus
gaacuagacgauaaugu

SEQ ID NO: 4066958 - RNA, 14 nt, Vaccinia virus
gaacugaugccuau

SEQ ID NO: 4066959 - RNA, 23 nt, Vaccinia virus
gaagaacguguauuaaauagaau

SEQ ID NO: 4066960 - RNA, 14 nt, Vaccinia virus
gaagaagaugaugg

SEQ ID NO: 4066961 - RNA, 13 nt, Vaccinia virus
gaagaaguuaaua

SEQ ID NO: 4066962 - RNA, 19 nt, Vaccinia virus
gaagaaugccuacauauca

SEQ ID NO: 4066963 - RNA, 16 nt, Vaccinia virus
gaagaauggaugauau

SEQ ID NO: 4066964 - RNA, 15 nt, Vaccinia virus
gaagacugaagagga

SEQ ID NO: 4066965 - RNA, 13 nt, Vaccinia virus
gaagagguuauau

SEQ ID NO: 4066966 - RNA, 13 nt, Vaccinia virus
gaagauagauaug

SEQ ID NO: 4066967 - RNA, 17 nt, Vaccinia virus
gaagauuaccucuaguu

SEQ ID NO: 4066968 - RNA, 19 nt, Vaccinia virus
gaagauucccaaauaauca

SEQ ID NO: 4066969 - RNA, 19 nt, Vaccinia virus
gaagcacgcugcuaauaaa

SEQ ID NO: 4066970 - RNA, 14 nt, Vaccinia virus
gaaggaucuguaca

SEQ ID NO: 4066971 - RNA, 17 nt, Vaccinia virus
gaagguuggguagaugg

SEQ ID NO: 4066972 - RNA, 17 nt, Vaccinia virus
gaaguacuauuaaaacc

SEQ ID NO: 4066973 - RNA, 17 nt, Vaccinia virus
gaaguaggauuauguaa

SEQ ID NO: 4066974 - RNA, 18 nt, Vaccinia virus
gaauaaacaaaauaaugu

SEQ ID NO: 4066975 - RNA, 14 nt, Vaccinia virus
gaauaaauauccuu

SEQ ID NO: 4066976 - RNA, 17 nt, Vaccinia virus
gaauaacgaacauaacu

SEQ ID NO: 4066977 - RNA, 11 nt, Vaccinia virus
gaauaagaaca

SEQ ID NO: 4066978 - RNA, 23 nt, Vaccinia virus
gaauaagugguuugauauuucau

SEQ ID NO: 4066979 - RNA, 20 nt, Vaccinia virus
gaauaaguuuauuagacacg

SEQ ID NO: 4066980 - RNA, 16 nt, Vaccinia virus
gaauaauccuauauca

SEQ ID NO: 4066981 - RNA, 13 nt, Vaccinia virus
gaauaauguuucu

SEQ ID NO: 4066982 - RNA, 20 nt, Vaccinia virus
gaauacaaucuguauuucau

SEQ ID NO: 4066983 - RNA, 22 nt, Vaccinia virus
gaauacacuccucagauuuaua

SEQ ID NO: 4066984 - RNA, 17 nt, Vaccinia virus
gaauaccauuaaacaau

SEQ ID NO: 4066985 - RNA, 15 nt, Vaccinia virus
gaauacgauaauuau

SEQ ID NO: 4066986 - RNA, 14 nt, Vaccinia virus
gaauacucccaaac

SEQ ID NO: 4066987 - RNA, 15 nt, Vaccinia virus
gaauagauuacucau

SEQ ID NO: 4066988 - RNA, 23 nt, Vaccinia virus
gaauagccgccggaaacuuucua

SEQ ID NO: 4066989 - RNA, 18 nt, Vaccinia virus
gaauagugccaucagaau

SEQ ID NO: 4066990 - RNA, 17 nt, Vaccinia virus
gaauauaaaaaaaugau

SEQ ID NO: 4066991 - RNA, 16 nt, Vaccinia virus
gaauauaaaauaacua

SEQ ID NO: 4066992 - RNA, 15 nt, Vaccinia virus
gaauauaauaaucua

SEQ ID NO: 4066993 - RNA, 20 nt, Vaccinia virus
gaauauagaucgaaaaauau

SEQ ID NO: 4066994 - RNA, 23 nt, Vaccinia virus
gaauaucaucgacuguugccaau

SEQ ID NO: 4066995 - RNA, 15 nt, Vaccinia virus
gaauaucuacaaauu

SEQ ID NO: 4066996 - RNA, 21 nt, Vaccinia virus
gaauaugaauucuaugaugaa

SEQ ID NO: 4066997 - RNA, 21 nt, Vaccinia virus
gaauauuagguaaagauauuu

SEQ ID NO: 4066998 - RNA, 13 nt, Vaccinia virus
gaauauuauaauu

SEQ ID NO: 4066999 - RNA, 13 nt, Vaccinia virus
gaauauuucuauu

SEQ ID NO: 4067000 - RNA, 12 nt, Vaccinia virus
gaaucaaaaagu

SEQ ID NO: 4067001 - RNA, 13 nt, Vaccinia virus
gaaucacaaacau

SEQ ID NO: 4067002 - RNA, 15 nt, Vaccinia virus
gaaucauaaagaaca

SEQ ID NO: 4067003 - RNA, 15 nt, Vaccinia virus
gaaucauaguuuuua

SEQ ID NO: 4067004 - RNA, 14 nt, Vaccinia virus
gaaucauuuuugca

SEQ ID NO: 4067005 - RNA, 16 nt, Vaccinia virus
gaauccgcuacauauu

SEQ ID NO: 4067006 - RNA, 14 nt, Vaccinia virus
gaauccuauacucu

SEQ ID NO: 4067007 - RNA, 18 nt, Vaccinia virus
gaaucgauuuuguaauau

SEQ ID NO: 4067008 - RNA, 17 nt, Vaccinia virus
gaaucgguucaaaaauu

SEQ ID NO: 4067009 - RNA, 22 nt, Vaccinia virus
gaaucguauaaugucccuucaa

SEQ ID NO: 4067010 - RNA, 20 nt, Vaccinia virus
ugagcucauaugauuucagu

SEQ ID NO: 4067011 - RNA, 15 nt, Vaccinia virus
ucaaaguuucugaaa

SEQ ID NO: 4067012 - RNA, 18 nt, Vaccinia virus
ucaaaguuucugaaauaa

SEQ ID NO: 4067013 - RNA, 19 nt, Vaccinia virus
ucaaauacaucuauuagua

SEQ ID NO: 4067014 - RNA, 23 nt, Vaccinia virus
ucaaaucgcccaucuauuacaaa

SEQ ID NO: 4067015 - RNA, 18 nt, Vaccinia virus
ucaaaugguaaauacugu

SEQ ID NO: 4067016 - RNA, 15 nt, Vaccinia virus
ucaaauuagauuucg

SEQ ID NO: 4067017 - RNA, 17 nt, Vaccinia virus
ucaaauuuuuucuuuaa

SEQ ID NO: 4067018 - RNA, 11 nt, Vaccinia virus
ucaacaaacua

SEQ ID NO: 4067019 - RNA, 20 nt, Vaccinia virus
ucaacaaguaggauuuuucc

SEQ ID NO: 4067020 - RNA, 21 nt, Vaccinia virus
ucaacaaucguuaauaaaucu

SEQ ID NO: 4067021 - RNA, 19 nt, Vaccinia virus
ucaacacuacccaauaaau

SEQ ID NO: 4067022 - RNA, 18 nt, Vaccinia virus
ucaacauacuauguuuug

SEQ ID NO: 4067023 - RNA, 20 nt, Vaccinia virus
ucaacgaucgucgauacaaa

SEQ ID NO: 4067024 - RNA, 13 nt, Vaccinia virus
ucaacuacauaau

SEQ ID NO: 4067025 - RNA, 16 nt, Vaccinia virus
ucaacuuauuaacauu

SEQ ID NO: 4067026 - RNA, 16 nt, Vaccinia virus
ucaagaagauaucaga

SEQ ID NO: 4067027 - RNA, 16 nt, Vaccinia virus
ucaagacccauccagu

SEQ ID NO: 4067028 - RNA, 20 nt, Vaccinia virus
ucaagacguggcaaacaaug

SEQ ID NO: 4067029 - RNA, 15 nt, Vaccinia virus
ucaagaguggagaau

SEQ ID NO: 4067030 - RNA, 20 nt, Vaccinia virus
ucaagccggcuauauauucu

SEQ ID NO: 4067031 - RNA, 22 nt, Vaccinia virus
ucaagccggcuauauauucugc

SEQ ID NO: 4067032 - RNA, 13 nt, Vaccinia virus
ucaagucaaugau

SEQ ID NO: 4067033 - RNA, 19 nt, Vaccinia virus
ucaaguuaucgucuguauu

SEQ ID NO: 4067034 - RNA, 15 nt, Vaccinia virus
ucaauaaaugauuca

SEQ ID NO: 4067035 - RNA, 19 nt, Vaccinia virus
ucaauaacuggcacaacaa

SEQ ID NO: 4067036 - RNA, 24 nt, Vaccinia virus
ucaauaauuguggcuauauauuca

SEQ ID NO: 4067037 - RNA, 12 nt, Vaccinia virus
ucaauagaauau

SEQ ID NO: 4067038 - RNA, 18 nt, Vaccinia virus
ucaaucaaacaaaaaagc

SEQ ID NO: 4067039 - RNA, 16 nt, Vaccinia virus
ucaaucacuacaucuu

SEQ ID NO: 4067040 - RNA, 17 nt, Vaccinia virus
ucaaucacuacaucuuu

SEQ ID NO: 4067041 - RNA, 14 nt, Vaccinia virus
ucaaucuuauucaa

SEQ ID NO: 4067042 - RNA, 22 nt, Vaccinia virus
ucaauucguucgaugaguauau

SEQ ID NO: 4067043 - RNA, 19 nt, Vaccinia virus
ucacaaaucacacaagcca

SEQ ID NO: 4067044 - RNA, 19 nt, Vaccinia virus
ucacaacaucuauaaaagu

SEQ ID NO: 4067045 - RNA, 23 nt, Vaccinia virus
ucacaugauguagugauagauau

SEQ ID NO: 4067046 - RNA, 14 nt, Vaccinia virus
ucacuaacuaaugu

SEQ ID NO: 4067047 - RNA, 18 nt, Vaccinia virus
ucacuacggacacaaagu

SEQ ID NO: 4067048 - RNA, 20 nt, Vaccinia virus
ucacuauaagaaaucagaau

SEQ ID NO: 4067049 - RNA, 15 nt, Vaccinia virus
ucacuauagaaaaug

SEQ ID NO: 4067050 - RNA, 15 nt, Vaccinia virus
ucacucaucgauuca

SEQ ID NO: 4067051 - RNA, 16 nt, Vaccinia virus
ucacuguuguacauac

SEQ ID NO: 4067052 - RNA, 21 nt, Vaccinia virus
ucacuguuguacauacaggua

SEQ ID NO: 4067053 - RNA, 12 nt, Vaccinia virus
ucacuucagaaa

SEQ ID NO: 4067054 - RNA, 18 nt, Vaccinia virus
ucagaaaacccaaacacu

SEQ ID NO: 4067055 - RNA, 18 nt, Vaccinia virus
ucagaaaauaccauccaa

SEQ ID NO: 4067056 - RNA, 21 nt, Vaccinia virus
ucagaaagaguuuccacaugu

SEQ ID NO: 4067057 - RNA, 23 nt, Vaccinia virus
ucagaacuuccaauaaaauuacu

SEQ ID NO: 4067058 - RNA, 14 nt, Vaccinia virus
ucagaaucguauau

SEQ ID NO: 4067059 - RNA, 22 nt, Vaccinia virus
ucagacgacccaaaacauagag

SEQ ID NO: 4067060 - RNA, 17 nt, Vaccinia virus
ucagacuacuuauucua

SEQ ID NO: 4067061 - RNA, 20 nt, Vaccinia virus
ucagacucugauuugaacaa

SEQ ID NO: 4067062 - RNA, 16 nt, Vaccinia virus
ucagauauaaaaaucu

SEQ ID NO: 4067063 - RNA, 22 nt, Vaccinia virus
auauacgaaauaaaauagacaa

SEQ ID NO: 4067064 - RNA, 20 nt, Vaccinia virus
auauacgaagggauuaaaaa

SEQ ID NO: 4067065 - RNA, 22 nt, Vaccinia virus
auauacucuaaucuuuaauaga

SEQ ID NO: 4067066 - RNA, 20 nt, Vaccinia virus
auauagauagcguauaucuc

SEQ ID NO: 4067067 - RNA, 22 nt, Vaccinia virus
auauagcggaugaaaaauuugu

SEQ ID NO: 4067068 - RNA, 16 nt, Vaccinia virus
auauaggugcaaaaaa

SEQ ID NO: 4067069 - RNA, 17 nt, Vaccinia virus
auauaguauauagaugu

SEQ ID NO: 4067070 - RNA, 18 nt, Vaccinia virus
auauaguguauaauaaag

SEQ ID NO: 4067071 - RNA, 13 nt, Vaccinia virus
auauaguuauuaa

SEQ ID NO: 4067072 - RNA, 14 nt, Vaccinia virus
auauaucugauagu

SEQ ID NO: 4067073 - RNA, 15 nt, Vaccinia virus
auauaugacauaaua

SEQ ID NO: 4067074 - RNA, 20 nt, Vaccinia virus
auauauggauaaugcuguau

SEQ ID NO: 4067075 - RNA, 15 nt, Vaccinia virus
auauauuaacucaga

SEQ ID NO: 4067076 - RNA, 20 nt, Vaccinia virus
auauauuaauacacauaaug

SEQ ID NO: 4067077 - RNA, 16 nt, Vaccinia virus
auauauuaauccacua

SEQ ID NO: 4067078 - RNA, 20 nt, Vaccinia virus
auauauuccuugaauaaccu

SEQ ID NO: 4067079 - RNA, 22 nt, Vaccinia virus
auauauuuuucauaaauacacu

SEQ ID NO: 4067080 - RNA, 21 nt, Vaccinia virus
auaucaacaacguggaauugu

SEQ ID NO: 4067081 - RNA, 17 nt, Vaccinia virus
auaucaacaucugaugc

SEQ ID NO: 4067082 - RNA, 18 nt, Vaccinia virus
auaucaauaagcauuaug

SEQ ID NO: 4067083 - RNA, 20 nt, Vaccinia virus
auaucacauaucuaaaugaa

SEQ ID NO: 4067084 - RNA, 15 nt, Vaccinia virus
auaucacuguuguac

SEQ ID NO: 4067085 - RNA, 20 nt, Vaccinia virus
auaucagauaaguaugaaga

SEQ ID NO: 4067086 - RNA, 15 nt, Vaccinia virus
auaucauacaugaua

SEQ ID NO: 4067087 - RNA, 17 nt, Vaccinia virus
auaucaucaucugaaau

SEQ ID NO: 4067088 - RNA, 14 nt, Vaccinia virus
auaucaucuacaua

SEQ ID NO: 4067089 - RNA, 13 nt, Vaccinia virus
auaucaugaugau

SEQ ID NO: 4067090 - RNA, 20 nt, Vaccinia virus
auaucauuaaguucacuaga

SEQ ID NO: 4067091 - RNA, 23 nt, Vaccinia virus
auaucauuaaguucacuagaaua

SEQ ID NO: 4067092 - RNA, 14 nt, Vaccinia virus
auaucauuaaugau

SEQ ID NO: 4067093 - RNA, 21 nt, Vaccinia virus
auaucauugaaugagauacua

SEQ ID NO: 4067094 - RNA, 18 nt, Vaccinia virus
auaucauugucuaauaga

SEQ ID NO: 4067095 - RNA, 12 nt, Vaccinia virus
auauccaaaauu

SEQ ID NO: 4067096 - RNA, 19 nt, Vaccinia virus
auaucgaacaaauuccaag

SEQ ID NO: 4067097 - RNA, 19 nt, Vaccinia virus
auaucgccuuuauuuccac

SEQ ID NO: 4067098 - RNA, 20 nt, Vaccinia virus
auaucggacgcagaaauugg

SEQ ID NO: 4067099 - RNA, 21 nt, Vaccinia virus
auaucgguaccguuaaagaug

SEQ ID NO: 4067100 - RNA, 16 nt, Vaccinia virus
auaucgguaguuguau

SEQ ID NO: 4067101 - RNA, 14 nt, Vaccinia virus
auaucguguucauu

SEQ ID NO: 4067102 - RNA, 16 nt, Vaccinia virus
auaucguucucuaaau

SEQ ID NO: 4067103 - RNA, 19 nt, Vaccinia virus
auaucuacugauaaaacug

SEQ ID NO: 4067104 - RNA, 16 nt, Vaccinia virus
auaucuagcaaaaauu

SEQ ID NO: 4067105 - RNA, 22 nt, Vaccinia virus
auaucuaguguuuuugugguau

SEQ ID NO: 4067106 - RNA, 20 nt, Vaccinia virus
auaucucauucaaauccaua

SEQ ID NO: 4067107 - RNA, 14 nt, Vaccinia virus
auaucucuaauaga

SEQ ID NO: 4067108 - RNA, 13 nt, Vaccinia virus
auaucucuagaua

SEQ ID NO: 4067109 - RNA, 18 nt, Vaccinia virus
auaucugagcuaucuaga

SEQ ID NO: 4067110 - RNA, 17 nt, Vaccinia virus
auaucugugaauacuuu

SEQ ID NO: 4067111 - RNA, 12 nt, Vaccinia virus
auaucuuaacuu

SEQ ID NO: 4067112 - RNA, 21 nt, Vaccinia virus
auaucuuagugcaaaaguaua

SEQ ID NO: 4067113 - RNA, 20 nt, Vaccinia virus
auaucuuauucugguuuaaa

SEQ ID NO: 4067114 - RNA, 18 nt, Vaccinia virus
auaucuugcaaaauagua

SEQ ID NO: 4067115 - RNA, 17 nt, Vaccinia virus
auaugaaaaaacauuau

SEQ ID NO: 4067116 - RNA, 20 nt, Vaccinia virus
auaugaaccuucuacauaua

SEQ ID NO: 4067117 - RNA, 14 nt, Vaccinia virus
auaugacaaacauu

SEQ ID NO: 4067118 - RNA, 12 nt, Vaccinia virus
auaugacauaau

SEQ ID NO: 4067119 - RNA, 19 nt, Vaccinia virus
auaugaccgauaagagacg

SEQ ID NO: 4067120 - RNA, 15 nt, Vaccinia virus
auaugauagaaauga

SEQ ID NO: 4067121 - RNA, 14 nt, Vaccinia virus
auaugauuacuaga

SEQ ID NO: 4067122 - RNA, 21 nt, Vaccinia virus
auaugccggagaguaaacauu

SEQ ID NO: 4067123 - RNA, 13 nt, Vaccinia virus
auaugccuauaaa

SEQ ID NO: 4067124 - RNA, 14 nt, Vaccinia virus
auaugcuacaagau

SEQ ID NO: 4067125 - RNA, 17 nt, Vaccinia virus
auaugcuaguuaauagu

SEQ ID NO: 4067126 - RNA, 11 nt, Vaccinia virus
auauggaugag

SEQ ID NO: 4067127 - RNA, 19 nt, Vaccinia virus
auaugugguguuacaguca

SEQ ID NO: 4067128 - RNA, 14 nt, Vaccinia virus
auauguuccaguaa

SEQ ID NO: 4067129 - RNA, 19 nt, Vaccinia virus
auauuaaaaaaaaauacuu

SEQ ID NO: 4067130 - RNA, 19 nt, Vaccinia virus
auauuaaaaauucacacau

SEQ ID NO: 4067131 - RNA, 18 nt, Vaccinia virus
auauuaacaucuaaacau

SEQ ID NO: 4067132 - RNA, 22 nt, Vaccinia virus
auauuaacgcguuuuaugaaug

SEQ ID NO: 4067133 - RNA, 15 nt, Vaccinia virus
auauuaaugcauuua

SEQ ID NO: 4067134 - RNA, 13 nt, Vaccinia virus
auauuacaaaaua

SEQ ID NO: 4067135 - RNA, 18 nt, Vaccinia virus
auauuacugaauuaauaa

SEQ ID NO: 4067136 - RNA, 16 nt, Vaccinia virus
auauuacuguuaauaa

SEQ ID NO: 4067137 - RNA, 14 nt, Vaccinia virus
auauuagaaauaca

SEQ ID NO: 4067138 - RNA, 14 nt, Vaccinia virus
auauuagaaucuac

SEQ ID NO: 4067139 - RNA, 15 nt, Vaccinia virus
auauuauauaaacau

SEQ ID NO: 4067140 - RNA, 15 nt, Vaccinia virus
auauuaucaccuauu

SEQ ID NO: 4067141 - RNA, 14 nt, Vaccinia virus
auauuauguuuuau

SEQ ID NO: 4067142 - RNA, 14 nt, Vaccinia virus
auauuauuaaauca

SEQ ID NO: 4067143 - RNA, 13 nt, Vaccinia virus
auauuauuaauaa

SEQ ID NO: 4067144 - RNA, 23 nt, Vaccinia virus
auauuauugggugguaaacuaga

SEQ ID NO: 4067145 - RNA, 17 nt, Vaccinia virus
auauucaagcgaauuac

SEQ ID NO: 4067146 - RNA, 14 nt, Vaccinia virus
auauucaucagaua

SEQ ID NO: 4067147 - RNA, 15 nt, Vaccinia virus
auauuccauuaauga

SEQ ID NO: 4067148 - RNA, 14 nt, Vaccinia virus
auauucccaaacau

SEQ ID NO: 4067149 - RNA, 15 nt, Vaccinia virus
auauucuaaaauggu

SEQ ID NO: 4067150 - RNA, 18 nt, Vaccinia virus
auauucucuauuaaauac

SEQ ID NO: 4067151 - RNA, 14 nt, Vaccinia virus
auauucugaauaua

SEQ ID NO: 4067152 - RNA, 11 nt, Vaccinia virus
auauucuguau

SEQ ID NO: 4067153 - RNA, 21 nt, Vaccinia virus
auauucuuaaaagguuucaua

SEQ ID NO: 4067154 - RNA, 14 nt, Vaccinia virus
auauucuuucuugu

SEQ ID NO: 4067155 - RNA, 14 nt, Vaccinia virus
auauugcuacauaa

SEQ ID NO: 4067156 - RNA, 19 nt, Vaccinia virus
auauugguacgugucuaua

SEQ ID NO: 4067157 - RNA, 18 nt, Vaccinia virus
auauuguagauaagaaug

SEQ ID NO: 4067158 - RNA, 15 nt, Vaccinia virus
auauuguagcauuac

SEQ ID NO: 4067159 - RNA, 14 nt, Vaccinia virus
auauuguuaaauaa

SEQ ID NO: 4067160 - RNA, 19 nt, Vaccinia virus
auauuguugauaauacaac

SEQ ID NO: 4067161 - RNA, 16 nt, Vaccinia virus
auauuuaccaaagcaa

SEQ ID NO: 4067162 - RNA, 13 nt, Vaccinia virus
auauuucaaucau

SEQ ID NO: 4067163 - RNA, 14 nt, Vaccinia virus
auauuuccauuuau

SEQ ID NO: 4067164 - RNA, 13 nt, Vaccinia virus
auauuucuggaau

SEQ ID NO: 4067165 - RNA, 19 nt, Vaccinia virus
auauuugagaguauuggua

SEQ ID NO: 4067166 - RNA, 14 nt, Vaccinia virus
auauuuuaguuuug

SEQ ID NO: 4067167 - RNA, 14 nt, Vaccinia virus
auauuuuuaauagc

SEQ ID NO: 4067168 - RNA, 20 nt, Vaccinia virus
auauuuuuauucagcauuac

SEQ ID NO: 4067169 - RNA, 22 nt, Vaccinia virus
auauuuuuuaucuaaaaaacua

SEQ ID NO: 4067170 - RNA, 21 nt, Vaccinia virus
auauuuuuuuaguaauguuua

SEQ ID NO: 4067171 - RNA, 22 nt, Vaccinia virus
aucaaaauaucucccggaauug

SEQ ID NO: 4067172 - RNA, 16 nt, Vaccinia virus
aucaaacaacugaaaa

SEQ ID NO: 4067173 - RNA, 12 nt, Vaccinia virus
aucaaacacaag

SEQ ID NO: 4067174 - RNA, 11 nt, Vaccinia virus
aucaaacauua

SEQ ID NO: 4067175 - RNA, 14 nt, Vaccinia virus
aucaaagaauaugu

SEQ ID NO: 4067176 - RNA, 23 nt, Vaccinia virus
aucaaaguggaaagaugcuguug

SEQ ID NO: 4067177 - RNA, 17 nt, Vaccinia virus
aucaaauagcucaauau

SEQ ID NO: 4067178 - RNA, 18 nt, Vaccinia virus
aucaacaauuacaaauga

SEQ ID NO: 4067179 - RNA, 16 nt, Vaccinia virus
aucaacaauuuuguau

SEQ ID NO: 4067180 - RNA, 17 nt, Vaccinia virus
aucuaacaccaaaaaua

SEQ ID NO: 4067181 - RNA, 21 nt, Vaccinia virus
aucuaacaucuugauuaauaa

SEQ ID NO: 4067182 - RNA, 15 nt, Vaccinia virus
aucuaauauacuuug

SEQ ID NO: 4067183 - RNA, 23 nt, Vaccinia virus
aucuagacaccagcgucuacaug

SEQ ID NO: 4067184 - RNA, 17 nt, Vaccinia virus
aucuagauaauuaauaa

SEQ ID NO: 4067185 - RNA, 21 nt, Vaccinia virus
aucuagcgucgacaucuauau

SEQ ID NO: 4067186 - RNA, 20 nt, Vaccinia virus
aucuagucaccgagggaaaa

SEQ ID NO: 4067187 - RNA, 15 nt, Vaccinia virus
aucuagucuuaaaug

SEQ ID NO: 4067188 - RNA, 21 nt, Vaccinia virus
aucuauaaaacgauuaaacaa

SEQ ID NO: 4067189 - RNA, 15 nt, Vaccinia virus
aucuauaaugucuac

SEQ ID NO: 4067190 - RNA, 15 nt, Vaccinia virus
aucuauauauguauu

SEQ ID NO: 4067191 - RNA, 20 nt, Vaccinia virus
aucuaucagaguccauguau

SEQ ID NO: 4067192 - RNA, 16 nt, Vaccinia virus
aucuauccauaugcau

SEQ ID NO: 4067193 - RNA, 17 nt, Vaccinia virus
aucuaucuuaaaaacua

SEQ ID NO: 4067194 - RNA, 22 nt, Vaccinia virus
aucuaucuuuagcuucugaaau

SEQ ID NO: 4067195 - RNA, 18 nt, Vaccinia virus
aucuauggaauuaccacu

SEQ ID NO: 4067196 - RNA, 17 nt, Vaccinia virus
aucuauguaaucauaug

SEQ ID NO: 4067197 - RNA, 13 nt, Vaccinia virus
aucuauucaaaau

SEQ ID NO: 4067198 - RNA, 18 nt, Vaccinia virus
cuagacuugauuauucua

SEQ ID NO: 4067199 - RNA, 16 nt, Vaccinia virus
cuagagacaaugaaaa

SEQ ID NO: 4067200 - RNA, 21 nt, Vaccinia virus
cuagauaaaauacugaaucaa

SEQ ID NO: 4067201 - RNA, 21 nt, Vaccinia virus
cuagauagaaagauguagcua

SEQ ID NO: 4067202 - RNA, 14 nt, Vaccinia virus
cuagauauguauuu

SEQ ID NO: 4067203 - RNA, 17 nt, Vaccinia virus
cuagauauuaguauuuu

SEQ ID NO: 4067204 - RNA, 12 nt, Vaccinia virus
cuagauccucau

SEQ ID NO: 4067205 - RNA, 17 nt, Vaccinia virus
cuagaucgucaguagua

SEQ ID NO: 4067206 - RNA, 16 nt, Vaccinia virus
cuagaugaugauuuuc

SEQ ID NO: 4067207 - RNA, 18 nt, Vaccinia virus
cuagcauccccuuucaau

SEQ ID NO: 4067208 - RNA, 18 nt, Vaccinia virus
cuaggaguaucuauuuua

SEQ ID NO: 4067209 - RNA, 20 nt, Vaccinia virus
cuaggauacauaaaauuuaa

SEQ ID NO: 4067210 - RNA, 19 nt, Vaccinia virus
cuaguaaaucaacugauag

SEQ ID NO: 4067211 - RNA, 20 nt, Vaccinia virus
cuaguauagaucaaauacuu

SEQ ID NO: 4067212 - RNA, 16 nt, Vaccinia virus
cuaguaucauuucuac

SEQ ID NO: 4067213 - RNA, 22 nt, Vaccinia virus
cuaguccaaagacuuacaggaa

SEQ ID NO: 4067214 - RNA, 18 nt, Vaccinia virus
cuagugcucaaacaaaau

SEQ ID NO: 4067215 - RNA, 18 nt, Vaccinia virus
cuaguuuucuaaguucua

SEQ ID NO: 4067216 - RNA, 13 nt, Vaccinia virus
cuaguuuugagaa

SEQ ID NO: 4067217 - RNA, 20 nt, Vaccinia virus
cuauaaaaaaaauaauaauu

SEQ ID NO: 4067218 - RNA, 16 nt, Vaccinia virus
cuauaaaaaacauaau

SEQ ID NO: 4067219 - RNA, 20 nt, Vaccinia virus
cuauaaaaagauuauacaaa

SEQ ID NO: 4067220 - RNA, 19 nt, Vaccinia virus
cuauaacauuaauaucaaa

SEQ ID NO: 4067221 - RNA, 13 nt, Vaccinia virus
cuauaauaaugaa

SEQ ID NO: 4067222 - RNA, 15 nt, Vaccinia virus
cuauaauauauucua

SEQ ID NO: 4067223 - RNA, 22 nt, Vaccinia virus
cuauacagcgaauagauucaga

SEQ ID NO: 4067224 - RNA, 21 nt, Vaccinia virus
cuauacauuguugcaucgugu

SEQ ID NO: 4067225 - RNA, 22 nt, Vaccinia virus
cuauacgaaauaaauauucaga

SEQ ID NO: 4067226 - RNA, 14 nt, Vaccinia virus
cuauacuaugaugu

SEQ ID NO: 4067227 - RNA, 14 nt, Vaccinia virus
cuauagauaaugac

SEQ ID NO: 4067228 - RNA, 22 nt, Vaccinia virus
cuauaguacacggaauaaugau

SEQ ID NO: 4067229 - RNA, 11 nt, Vaccinia virus
cuauaguucuc

SEQ ID NO: 4067230 - RNA, 21 nt, Vaccinia virus
cuauauaaagguccuauucca

SEQ ID NO: 4067231 - RNA, 21 nt, Vaccinia virus
cuauauagcuauucuucuuua

SEQ ID NO: 4067232 - RNA, 14 nt, Vaccinia virus
cuauauaguucaaa

SEQ ID NO: 4067233 - RNA, 15 nt, Vaccinia virus
cuauauaucuguauu

SEQ ID NO: 4067234 - RNA, 17 nt, Vaccinia virus
cuauauauucugcuaua

SEQ ID NO: 4067235 - RNA, 14 nt, Vaccinia virus
cuauauauuuugau

SEQ ID NO: 4067236 - RNA, 18 nt, Vaccinia virus
cuauaucaucuacauaau

SEQ ID NO: 4067237 - RNA, 15 nt, Vaccinia virus
cuauaucuaacaucu

SEQ ID NO: 4067238 - RNA, 15 nt, Vaccinia virus
cuauaucuauguuuu

SEQ ID NO: 4067239 - RNA, 12 nt, Vaccinia virus
cuauaucuucuu

SEQ ID NO: 4067240 - RNA, 13 nt, Vaccinia virus
cuauauuaauagg

SEQ ID NO: 4067241 - RNA, 20 nt, Vaccinia virus
cuauauuacgcggucgaugu

SEQ ID NO: 4067242 - RNA, 17 nt, Vaccinia virus
cuauauucuugauguag

SEQ ID NO: 4067243 - RNA, 15 nt, Vaccinia virus
cuauauuuaucacag

SEQ ID NO: 4067244 - RNA, 15 nt, Vaccinia virus
cuaucagaaucaguu

SEQ ID NO: 4067245 - RNA, 18 nt, Vaccinia virus
cuaucaugucuauucucc

SEQ ID NO: 4067246 - RNA, 15 nt, Vaccinia virus
cuaucuuguuuagau

SEQ ID NO: 4067247 - RNA, 12 nt, Vaccinia virus
cuaucuuuagag

SEQ ID NO: 4067248 - RNA, 15 nt, Vaccinia virus
cuauggccaaauguu

SEQ ID NO: 4067249 - RNA, 16 nt, Vaccinia virus
cuauggccaaauguuc

SEQ ID NO: 4067250 - RNA, 17 nt, Vaccinia virus
cuaugguauugauaaaa

SEQ ID NO: 4067251 - RNA, 13 nt, Vaccinia virus
cuauguaaaugau

SEQ ID NO: 4067252 - RNA, 16 nt, Vaccinia virus
cuauguuucaguuuaa

SEQ ID NO: 4067253 - RNA, 13 nt, Vaccinia virus
cuauuaaaguauc

SEQ ID NO: 4067254 - RNA, 17 nt, Vaccinia virus
augauuuuacugcaaua

SEQ ID NO: 4067255 - RNA, 23 nt, Vaccinia virus
augauuuucugggacuauuggaa

SEQ ID NO: 4067256 - RNA, 13 nt, Vaccinia virus
augcaaaauaaua

SEQ ID NO: 4067257 - RNA, 20 nt, Vaccinia virus
augcaaacuaucuaaaugua

SEQ ID NO: 4067258 - RNA, 21 nt, Vaccinia virus
augcaaagauguuuaaugaua

SEQ ID NO: 4067259 - RNA, 16 nt, Vaccinia virus
augcaaagucuaaaua

SEQ ID NO: 4067260 - RNA, 22 nt, Vaccinia virus
augcaaccguaucaaaaaauua

SEQ ID NO: 4067261 - RNA, 16 nt, Vaccinia virus
augcaccuagagaauu

SEQ ID NO: 4067262 - RNA, 17 nt, Vaccinia virus
augcacguaaacauuau

SEQ ID NO: 4067263 - RNA, 14 nt, Vaccinia virus
augcagaaaugauu

SEQ ID NO: 4067264 - RNA, 15 nt, Vaccinia virus
augcagaaguaauga

SEQ ID NO: 4067265 - RNA, 15 nt, Vaccinia virus
augcaucauuaauuu

SEQ ID NO: 4067266 - RNA, 17 nt, Vaccinia virus
augcaucgaacgaccau

SEQ ID NO: 4067267 - RNA, 17 nt, Vaccinia virus
augcaucgguaaauaua

SEQ ID NO: 4067268 - RNA, 14 nt, Vaccinia virus
augccaaaaucaua

SEQ ID NO: 4067269 - RNA, 18 nt, Vaccinia virus
augccauacucagaauua

SEQ ID NO: 4067270 - RNA, 15 nt, Vaccinia virus
augccuauaaaguaa

SEQ ID NO: 4067271 - RNA, 14 nt, Vaccinia virus
augcgauucaaaaa

SEQ ID NO: 4067272 - RNA, 15 nt, Vaccinia virus
augcgauuggauaag

SEQ ID NO: 4067273 - RNA, 20 nt, Vaccinia virus
augcggaaccucgagaaugu

SEQ ID NO: 4067274 - RNA, 23 nt, Vaccinia virus
augcggugccauucaugaaaaug

SEQ ID NO: 4067275 - RNA, 18 nt, Vaccinia virus
augcuauaccuaauacua

SEQ ID NO: 4067276 - RNA, 23 nt, Vaccinia virus
augcuauccaucagaauguuucc

SEQ ID NO: 4067277 - RNA, 20 nt, Vaccinia virus
augcuccaauugaaugucau

SEQ ID NO: 4067278 - RNA, 20 nt, Vaccinia virus
augcucgcaacauuaacauc

SEQ ID NO: 4067279 - RNA, 15 nt, Vaccinia virus
uacaaaauguuugac

SEQ ID NO: 4067280 - RNA, 13 nt, Vaccinia virus
uacaaacugaaaa

SEQ ID NO: 4067281 - RNA, 20 nt, Vaccinia virus
uacaaaggauccgacccuaa

SEQ ID NO: 4067282 - RNA, 12 nt, Vaccinia virus
uacaaaugacua

SEQ ID NO: 4067283 - RNA, 18 nt, Vaccinia virus
uacaacauuccaaagauc

SEQ ID NO: 4067284 - RNA, 22 nt, Vaccinia virus
uacaagaaauauuuccauccga

SEQ ID NO: 4067285 - RNA, 17 nt, Vaccinia virus
uacaaguuauacgucau

SEQ ID NO: 4067286 - RNA, 20 nt, Vaccinia virus
uacaauaaacuccguagaga

SEQ ID NO: 4067287 - RNA, 14 nt, Vaccinia virus
uacaauaacuacau

SEQ ID NO: 4067288 - RNA, 16 nt, Vaccinia virus
uacaauacacacaaua

SEQ ID NO: 4067289 - RNA, 15 nt, Vaccinia virus
uacaauauuuacauu

SEQ ID NO: 4067290 - RNA, 17 nt, Vaccinia virus
uacaaucagauauaucu

SEQ ID NO: 4067291 - RNA, 22 nt, Vaccinia virus
uacaauuuguggaauuaauauu

SEQ ID NO: 4067292 - RNA, 15 nt, Vaccinia virus
uacacauaauuauuc

SEQ ID NO: 4067293 - RNA, 19 nt, Vaccinia virus
uacacauaguguuacaaaa

SEQ ID NO: 4067294 - RNA, 20 nt, Vaccinia virus
uacagaaacuguaaagaaca

SEQ ID NO: 4067295 - RNA, 13 nt, Vaccinia virus
uacagacauuaag

SEQ ID NO: 4067296 - RNA, 20 nt, Vaccinia virus
uacagagacuuuaucuaaau

SEQ ID NO: 4067297 - RNA, 20 nt, Vaccinia virus
uacagagauguacagcuucc

SEQ ID NO: 4067298 - RNA, 13 nt, Vaccinia virus
uacagauguuaca

SEQ ID NO: 4067299 - RNA, 20 nt, Vaccinia virus
uacagauguuacaaauguag

SEQ ID NO: 4067300 - RNA, 17 nt, Vaccinia virus
uacaguaaaaauaacua

SEQ ID NO: 4067301 - RNA, 13 nt, Vaccinia virus
uacaguucuuggc

SEQ ID NO: 4067302 - RNA, 15 nt, Vaccinia virus
uacaguucuuuucua

SEQ ID NO: 4067303 - RNA, 18 nt, Vaccinia virus
uacauacgaauaacaaaa

SEQ ID NO: 4067304 - RNA, 19 nt, Vaccinia virus
uacauaugacaaacauugu

SEQ ID NO: 4067305 - RNA, 15 nt, Vaccinia virus
uacauauucuaauga

SEQ ID NO: 4067306 - RNA, 20 nt, Vaccinia virus
uacauauucuccauaauggu

SEQ ID NO: 4067307 - RNA, 19 nt, Vaccinia virus
uacaucaugaaaugaugau

SEQ ID NO: 4067308 - RNA, 17 nt, Vaccinia virus
uacauccgaaauacaaa

SEQ ID NO: 4067309 - RNA, 19 nt, Vaccinia virus
uacauccgauuaucaagau

SEQ ID NO: 4067310 - RNA, 17 nt, Vaccinia virus
uacaucgucucaucugu

SEQ ID NO: 4067311 - RNA, 20 nt, Vaccinia virus
uacaucuaaauuuuuacuau

SEQ ID NO: 4067312 - RNA, 18 nt, Vaccinia virus
uacaucuaguucuuugaa

SEQ ID NO: 4067313 - RNA, 16 nt, Vaccinia virus
uacaucuguuuccuau

SEQ ID NO: 4067314 - RNA, 17 nt, Vaccinia virus
uacaugauauuaucaug

SEQ ID NO: 4067315 - RNA, 15 nt, Vaccinia virus
uacaugcuacaugug

SEQ ID NO: 4067316 - RNA, 14 nt, Vaccinia virus
uacaugucuaaugu

SEQ ID NO: 4067317 - RNA, 22 nt, Vaccinia virus
uaccaaagacuuugaaauauag

SEQ ID NO: 4067318 - RNA, 14 nt, Vaccinia virus
uaccaaucauuuau

SEQ ID NO: 4067319 - RNA, 14 nt, Vaccinia virus
uaccacauacaaaa

SEQ ID NO: 4067320 - RNA, 14 nt, Vaccinia virus
uaccacuagcaaaa

SEQ ID NO: 4067321 - RNA, 12 nt, Vaccinia virus
uaccauacauua

SEQ ID NO: 4067322 - RNA, 18 nt, Vaccinia virus
uaccaucaacuacuguag

SEQ ID NO: 4067323 - RNA, 12 nt, Vaccinia virus
uaccaucauuau

SEQ ID NO: 4067324 - RNA, 13 nt, Vaccinia virus
uaccauuauuaau

SEQ ID NO: 4067325 - RNA, 19 nt, Vaccinia virus
uacccaaaucugaaaauaa

SEQ ID NO: 4067326 - RNA, 13 nt, Vaccinia virus
uacccaucaugua

SEQ ID NO: 4067327 - RNA, 16 nt, Vaccinia virus
uacccauccaauacua

SEQ ID NO: 4067328 - RNA, 21 nt, Vaccinia virus
uaccccucauaguauuaauau

SEQ ID NO: 4067329 - RNA, 13 nt, Vaccinia virus
uaccuacacuauu

SEQ ID NO: 4067330 - RNA, 23 nt, Vaccinia virus
uaccuaucaaggaacaaauauug

SEQ ID NO: 4067331 - RNA, 15 nt, Vaccinia virus
uaccucuacacuauu

SEQ ID NO: 4067332 - RNA, 16 nt, Vaccinia virus
uaccucuucugauauc

SEQ ID NO: 4067333 - RNA, 12 nt, Vaccinia virus
uaccuuaaugua

SEQ ID NO: 4067334 - RNA, 15 nt, Vaccinia virus
uaccuuuaaaauaua

SEQ ID NO: 4067335 - RNA, 21 nt, Vaccinia virus
uacgagaaauuaauuauugua

SEQ ID NO: 4067336 - RNA, 15 nt, Vaccinia virus
uacgcgcacacaaua

SEQ ID NO: 4067337 - RNA, 18 nt, Vaccinia virus
uacgguugauucaaaaau

SEQ ID NO: 4067338 - RNA, 12 nt, Vaccinia virus
uacguaaaaaag

SEQ ID NO: 4067339 - RNA, 16 nt, Vaccinia virus
uacguaucauaucuuc

SEQ ID NO: 4067340 - RNA, 14 nt, Vaccinia virus
uacguaucuauaau

SEQ ID NO: 4067341 - RNA, 19 nt, Vaccinia virus
uacguauuucguaccugua

SEQ ID NO: 4067342 - RNA, 20 nt, Vaccinia virus
uacgucucagaauucuaaau

SEQ ID NO: 4067343 - RNA, 16 nt, Vaccinia virus
uacguugauuucuagc

SEQ ID NO: 4067344 - RNA, 17 nt, Vaccinia virus
uacguuuacacaauugu

SEQ ID NO: 4067345 - RNA, 23 nt, Vaccinia virus
uacuaaaaaauguagaaauugaa

SEQ ID NO: 4067346 - RNA, 20 nt, Vaccinia virus
uacuaaaucuguauaucuuu

SEQ ID NO: 4067347 - RNA, 12 nt, Vaccinia virus
uacuaagaaagu

SEQ ID NO: 4067348 - RNA, 23 nt, Vaccinia virus
uacuaagaggaugaucuguauua

SEQ ID NO: 4067349 - RNA, 14 nt, Vaccinia virus
uacuaauagaugua

SEQ ID NO: 4067350 - RNA, 18 nt, Vaccinia virus
uacuaauaggucuaaaaa

SEQ ID NO: 4067351 - RNA, 22 nt, Vaccinia virus
uacuaauaggucuaaaaaccaa

SEQ ID NO: 4067352 - RNA, 14 nt, Vaccinia virus
uacuaaucaauaau

SEQ ID NO: 4067353 - RNA, 23 nt, Vaccinia virus
uacuacugaguauaaauaauuca

SEQ ID NO: 4067354 - RNA, 15 nt, Vaccinia virus
uacuagcucucaagu

SEQ ID NO: 4067355 - RNA, 14 nt, Vaccinia virus
uacuauacgcaaug

SEQ ID NO: 4067356 - RNA, 16 nt, Vaccinia virus
uacuauauguauucuu

SEQ ID NO: 4067357 - RNA, 12 nt, Vaccinia virus
uacuaucaaaau

SEQ ID NO: 4067358 - RNA, 13 nt, Vaccinia virus
uacuaucuuuaau

SEQ ID NO: 4067359 - RNA, 16 nt, Vaccinia virus
uacuauuuauuucuau

SEQ ID NO: 4067360 - RNA, 23 nt, Vaccinia virus
uacuauuuuuuacauuacuacau

SEQ ID NO: 4067361 - RNA, 17 nt, Vaccinia virus
uacucaaucaauagcaa

SEQ ID NO: 4067362 - RNA, 19 nt, Vaccinia virus
uacucuagauaaaaucacu

SEQ ID NO: 4067363 - RNA, 19 nt, Vaccinia virus
uacucuauaaaauacuaau

SEQ ID NO: 4067364 - RNA, 23 nt, Vaccinia virus
uacucuauagucagaauuuucau

SEQ ID NO: 4067365 - RNA, 23 nt, Vaccinia virus
uacugagaauugacgaaacaaug

SEQ ID NO: 4067366 - RNA, 19 nt, Vaccinia virus
uacugauaacaaaauauua

SEQ ID NO: 4067367 - RNA, 16 nt, Vaccinia virus
uacuggauucauacau

SEQ ID NO: 4067368 - RNA, 21 nt, Vaccinia virus
uacuguauguugcuacaugua

SEQ ID NO: 4067369 - RNA, 17 nt, Vaccinia virus
uacuuaaagauagaaau

SEQ ID NO: 4067370 - RNA, 13 nt, Vaccinia virus
uacuuacaucauu

SEQ ID NO: 4067371 - RNA, 15 nt, Vaccinia virus
uacuuaugacaaagu

SEQ ID NO: 4067372 - RNA, 17 nt, Vaccinia virus
uacuucaccacccuugu

SEQ ID NO: 4067373 - RNA, 13 nt, Vaccinia virus
uacuucuguacaa

SEQ ID NO: 4067374 - RNA, 22 nt, Vaccinia virus
uacuucuuccacuguccaaaau

SEQ ID NO: 4067375 - RNA, 19 nt, Vaccinia virus
uacuucuuuacgguaucua

SEQ ID NO: 4067376 - RNA, 17 nt, Vaccinia virus
uacuugaaauucuccag

SEQ ID NO: 4067377 - RNA, 21 nt, Vaccinia virus
uacuugacaaaaauugucacu

SEQ ID NO: 4067378 - RNA, 18 nt, Vaccinia virus
uacuuuacaaacgaugua

SEQ ID NO: 4067379 - RNA, 13 nt, Vaccinia virus
uacuuuacauaua

SEQ ID NO: 4067380 - RNA, 16 nt, Vaccinia virus
uacuuuauuacuccau

SEQ ID NO: 4067381 - RNA, 13 nt, Vaccinia virus
uacuuucuaauau

SEQ ID NO: 4067382 - RNA, 18 nt, Vaccinia virus
uacuuuuaguucuuuuag

SEQ ID NO: 4067383 - RNA, 16 nt, Vaccinia virus
uacuuuuguuacuaau

SEQ ID NO: 4067384 - RNA, 17 nt, Vaccinia virus
uagaaaaaaugaugcug

SEQ ID NO: 4067385 - RNA, 18 nt, Vaccinia virus
uagaaaauggauuuauug

SEQ ID NO: 4067386 - RNA, 20 nt, Vaccinia virus
uagaaaauucaucuaaacaa

SEQ ID NO: 4067387 - RNA, 18 nt, Vaccinia virus
uagaaacuggagaaauca

SEQ ID NO: 4067388 - RNA, 17 nt, Vaccinia virus
uagaaagaaaauaucua

SEQ ID NO: 4067389 - RNA, 13 nt, Vaccinia virus
uagaacaacucuc

SEQ ID NO: 4067390 - RNA, 14 nt, Vaccinia virus
uagaacguggauau

SEQ ID NO: 4067391 - RNA, 21 nt, Vaccinia virus
uagaacuuacugacaaaguua

SEQ ID NO: 4067392 - RNA, 16 nt, Vaccinia virus
uagaagccaauaucug

SEQ ID NO: 4067393 - RNA, 19 nt, Vaccinia virus
uagaagguucauauguugu

SEQ ID NO: 4067394 - RNA, 20 nt, Vaccinia virus
uagaaguuuuaaaaauacuu

SEQ ID NO: 4067395 - RNA, 14 nt, Vaccinia virus
uagaauaaauuagc

SEQ ID NO: 4067396 - RNA, 14 nt, Vaccinia virus
uagaaugaagaaug

SEQ ID NO: 4067397 - RNA, 13 nt, Vaccinia virus
uagaauggaugaa

SEQ ID NO: 4067398 - RNA, 22 nt, Vaccinia virus
uagaauguugagcuaauuuuug

SEQ ID NO: 4067399 - RNA, 21 nt, Vaccinia virus
uagaauucucuucauaucauu

SEQ ID NO: 4067400 - RNA, 16 nt, Vaccinia virus
uagaauuucauuuugu

SEQ ID NO: 4067401 - RNA, 23 nt, Vaccinia virus
uagacauaccggaucuacguucu

SEQ ID NO: 4067402 - RNA, 16 nt, Vaccinia virus
uagacauuuuuagaga

SEQ ID NO: 4067403 - RNA, 16 nt, Vaccinia virus
uaugcauguuucauaa

SEQ ID NO: 4067404 - RNA, 19 nt, Vaccinia virus
uaugccgugggaugauguc

SEQ ID NO: 4067405 - RNA, 17 nt, Vaccinia virus
uaugcgucgaauuaaau

SEQ ID NO: 4067406 - RNA, 16 nt, Vaccinia virus
uaugcucaugaacauu

SEQ ID NO: 4067407 - RNA, 19 nt, Vaccinia virus
uauggaaacuauaauuuug

SEQ ID NO: 4067408 - RNA, 21 nt, Vaccinia virus
uauggaugccaacguaguauc

SEQ ID NO: 4067409 - RNA, 20 nt, Vaccinia virus
uauggauuaccauggaugac

SEQ ID NO: 4067410 - RNA, 15 nt, Vaccinia virus
uauguaucaaagaua

SEQ ID NO: 4067411 - RNA, 14 nt, Vaccinia virus
uauguauucagaau

SEQ ID NO: 4067412 - RNA, 15 nt, Vaccinia virus
uauguguuuacagua

SEQ ID NO: 4067413 - RNA, 21 nt, Vaccinia virus
uauguuuauuagcguacacau

SEQ ID NO: 4067414 - RNA, 14 nt, Vaccinia virus
uauguuucaaucau

SEQ ID NO: 4067415 - RNA, 16 nt, Vaccinia virus
uauguuuuaaauauca

SEQ ID NO: 4067416 - RNA, 19 nt, Vaccinia virus
uauuaaaguacguaaaucu

SEQ ID NO: 4067417 - RNA, 14 nt, Vaccinia virus
uauuaaaucaugaa

SEQ ID NO: 4067418 - RNA, 17 nt, Vaccinia virus
uauuaacccaagcagca

SEQ ID NO: 4067419 - RNA, 18 nt, Vaccinia virus
uauuaacgcaccuauaaa

SEQ ID NO: 4067420 - RNA, 14 nt, Vaccinia virus
uauuaagauuaacu

SEQ ID NO: 4067421 - RNA, 15 nt, Vaccinia virus
uauuaagauuaucua

SEQ ID NO: 4067422 - RNA, 12 nt, Vaccinia virus
uauuaagcaaua

SEQ ID NO: 4067423 - RNA, 23 nt, Vaccinia virus
uauuaagccgccauuaauuacuu

SEQ ID NO: 4067424 - RNA, 19 nt, Vaccinia virus
uauuacaaaauauuuugag

SEQ ID NO: 4067425 - RNA, 14 nt, Vaccinia virus
uauuacaaccaaug

SEQ ID NO: 4067426 - RNA, 22 nt, Vaccinia virus
uauuacaauuugcauguugcau

SEQ ID NO: 4067427 - RNA, 19 nt, Vaccinia virus
uauuacgcuuaccaucaaa

SEQ ID NO: 4067428 - RNA, 14 nt, Vaccinia virus
uauuacuaaacauu

SEQ ID NO: 4067429 - RNA, 12 nt, Vaccinia virus
uauuagaauuaa

SEQ ID NO: 4067430 - RNA, 17 nt, Vaccinia virus
uauuagagauaccaaag

SEQ ID NO: 4067431 - RNA, 16 nt, Vaccinia virus
uauuagagguaaugau

SEQ ID NO: 4067432 - RNA, 17 nt, Vaccinia virus
uauuagagugucaauau

SEQ ID NO: 4067433 - RNA, 19 nt, Vaccinia virus
uauuagauaaauuuaucaa

SEQ ID NO: 4067434 - RNA, 15 nt, Vaccinia virus
uauuaguguuuagau

SEQ ID NO: 4067435 - RNA, 19 nt, Vaccinia virus
uauuaguugaugugacugu

SEQ ID NO: 4067436 - RNA, 13 nt, Vaccinia virus
uauuauacaugug

SEQ ID NO: 4067437 - RNA, 22 nt, Vaccinia virus
uauuaucaaagucacaaagcaa

SEQ ID NO: 4067438 - RNA, 16 nt, Vaccinia virus
uauuauccaauacaga

SEQ ID NO: 4067439 - RNA, 18 nt, Vaccinia virus
uauuauccaauuauuaua

SEQ ID NO: 4067440 - RNA, 18 nt, Vaccinia virus
uauuaucguuuguaacau

SEQ ID NO: 4067441 - RNA, 13 nt, Vaccinia virus
uauuauguuuauc

SEQ ID NO: 4067442 - RNA, 14 nt, Vaccinia virus
uauuauuacguguu

SEQ ID NO: 4067443 - RNA, 17 nt, Vaccinia virus
uauuauucauuuucuau

SEQ ID NO: 4067444 - RNA, 14 nt, Vaccinia virus
uauucaacauaucu

SEQ ID NO: 4067445 - RNA, 22 nt, Vaccinia virus
uauucaaugauccauuaucaua

SEQ ID NO: 4067446 - RNA, 21 nt, Vaccinia virus
uauucacaagaugaauucagu

SEQ ID NO: 4067447 - RNA, 15 nt, Vaccinia virus
uauucacuuaacagu

SEQ ID NO: 4067448 - RNA, 15 nt, Vaccinia virus
uauucaguuuauaga

SEQ ID NO: 4067449 - RNA, 19 nt, Vaccinia virus
uauucauaaaacauaauca

SEQ ID NO: 4067450 - RNA, 16 nt, Vaccinia virus
uauucauauucuuaaa

SEQ ID NO: 4067451 - RNA, 14 nt, Vaccinia virus
uauucauucaaugu

SEQ ID NO: 4067452 - RNA, 12 nt, Vaccinia virus
uauuccaaucau

SEQ ID NO: 4067453 - RNA, 24 nt, Vaccinia virus
uauuccaugaauaagugugaugau

SEQ ID NO: 4067454 - RNA, 16 nt, Vaccinia virus
uauucccaaacauaca

SEQ ID NO: 4067455 - RNA, 23 nt, Vaccinia virus
uauucggagcgcgcaauuuuuaa

SEQ ID NO: 4067456 - RNA, 19 nt, Vaccinia virus
uauucgucccuacuauaaa

SEQ ID NO: 4067457 - RNA, 21 nt, Vaccinia virus
uauucgucgucgacuaucaac

SEQ ID NO: 4067458 - RNA, 21 nt, Vaccinia virus
uauucguuguauucauucuaa

SEQ ID NO: 4067459 - RNA, 20 nt, Vaccinia virus
uauucuaccauagcaaaucu

SEQ ID NO: 4067460 - RNA, 22 nt, Vaccinia virus
uauucugacgucguucuacaua

SEQ ID NO: 4067461 - RNA, 16 nt, Vaccinia virus
uauucugauucuucua

SEQ ID NO: 4067462 - RNA, 19 nt, Vaccinia virus
uauucuuaaaagguuucau

SEQ ID NO: 4067463 - RNA, 17 nt, Vaccinia virus
uauucuuaaauuucaua

SEQ ID NO: 4067464 - RNA, 22 nt, Vaccinia virus
uauugaaugacguuuucucaua

SEQ ID NO: 4067465 - RNA, 15 nt, Vaccinia virus
uauugagauuucuga

SEQ ID NO: 4067466 - RNA, 14 nt, Vaccinia virus
uauugaguggaaag

SEQ ID NO: 4067467 - RNA, 18 nt, Vaccinia virus
uauugauaaaauuaauga

SEQ ID NO: 4067468 - RNA, 19 nt, Vaccinia virus
uauugccauaauuuucaua

SEQ ID NO: 4067469 - RNA, 14 nt, Vaccinia virus
uauugcuacauaau

SEQ ID NO: 4067470 - RNA, 20 nt, Vaccinia virus
uauugcuuuccuuuaucauu

SEQ ID NO: 4067471 - RNA, 20 nt, Vaccinia virus
uauuggaaaggcguuaucua

SEQ ID NO: 4067472 - RNA, 17 nt, Vaccinia virus
uauuggugcauuaauaa

SEQ ID NO: 4067473 - RNA, 14 nt, Vaccinia virus
uauugucgagcaua

SEQ ID NO: 4067474 - RNA, 17 nt, Vaccinia virus
uauugucucgucaaugu

SEQ ID NO: 4067475 - RNA, 15 nt, Vaccinia virus
uauugucuucuacau

SEQ ID NO: 4067476 - RNA, 13 nt, Vaccinia virus
uauuguuaucgua

SEQ ID NO: 4067477 - RNA, 14 nt, Vaccinia virus
uauuguuugagaac

SEQ ID NO: 4067478 - RNA, 14 nt, Vaccinia virus
uauuuaaaugacuu

SEQ ID NO: 4067479 - RNA, 22 nt, Vaccinia virus
uauuuaagaguggauucuucua

SEQ ID NO: 4067480 - RNA, 16 nt, Vaccinia virus
uauuuacaaaauucau

SEQ ID NO: 4067481 - RNA, 20 nt, Vaccinia virus
uauuuaccgaacaggcauuu

SEQ ID NO: 4067482 - RNA, 15 nt, Vaccinia virus
uauuuagauacagau

SEQ ID NO: 4067483 - RNA, 21 nt, Vaccinia virus
uauuuauaaacuuuauccaua

SEQ ID NO: 4067484 - RNA, 13 nt, Vaccinia virus
uauuuauacuacu

SEQ ID NO: 4067485 - RNA, 19 nt, Vaccinia virus
uauuuauccguaaaaaugu

SEQ ID NO: 4067486 - RNA, 20 nt, Vaccinia virus
uauuucaaaauuauuuacca

SEQ ID NO: 4067487 - RNA, 17 nt, Vaccinia virus
uauuuccagaugaugau

SEQ ID NO: 4067488 - RNA, 17 nt, Vaccinia virus
uauuuccaucaugaucu

SEQ ID NO: 4067489 - RNA, 21 nt, Vaccinia virus
uauuuccuguuccguuaacau

SEQ ID NO: 4067490 - RNA, 19 nt, Vaccinia virus
uauuucuucgcuuuauaua

SEQ ID NO: 4067491 - RNA, 22 nt, Vaccinia virus
uauuugagaaauauguauacau

SEQ ID NO: 4067492 - RNA, 16 nt, Vaccinia virus
uauuugauauacuaag

SEQ ID NO: 4067493 - RNA, 17 nt, Vaccinia virus
uauuuuaauacauguau

SEQ ID NO: 4067494 - RNA, 12 nt, Vaccinia virus
uauuuuacacau

SEQ ID NO: 4067495 - RNA, 13 nt, Vaccinia virus
uauuuuacuaaau

SEQ ID NO: 4067496 - RNA, 12 nt, Vaccinia virus
uauuuucuucua

SEQ ID NO: 4067497 - RNA, 21 nt, Vaccinia virus
uauuuugauaggaucuauaau

SEQ ID NO: 4067498 - RNA, 19 nt, Vaccinia virus
uauuuuuccauucuguuuu

SEQ ID NO: 4067499 - RNA, 14 nt, Vaccinia virus
uauuuuuuaugaua

SEQ ID NO: 4067500 - RNA, 17 nt, Vaccinia virus
ucaaaaaguaagauauu

SEQ ID NO: 4067501 - RNA, 16 nt, Vaccinia virus
ucaaaauauguuaugu

SEQ ID NO: 4067502 - RNA, 17 nt, Vaccinia virus
ucaaaauauguuauguu

SEQ ID NO: 4067503 - RNA, 16 nt, Vaccinia virus
ucaaacacgauauuca

SEQ ID NO: 4067504 - RNA, 13 nt, Vaccinia virus
ucaaacaguuugg

SEQ ID NO: 4067505 - RNA, 15 nt, Vaccinia virus
ucaaacucgauauau

SEQ ID NO: 4067506 - RNA, 12 nt, Vaccinia virus
ucaaagaaauaa

SEQ ID NO: 4067507 - RNA, 19 nt, Vaccinia virus
ucaaaggaugaaagaaagc

SEQ ID NO: 4067508 - RNA, 19 nt, Vaccinia virus
ucaaagggaccuaaaucua

SEQ ID NO: 4067509 - RNA, 19 nt, Vaccinia virus
ucaaaguccggauguauua

SEQ ID NO: 4067510 - RNA, 16 nt, Vaccinia virus
ucaaagucguuuauau

SEQ ID NO: 4067511 - RNA, 14 nt, Vaccinia virus
ucaaauacuucaaa

SEQ ID NO: 4067512 - RNA, 16 nt, Vaccinia virus
ucaaauuagauuucga

SEQ ID NO: 4067513 - RNA, 16 nt, Vaccinia virus
ucaaauuguccuauau

SEQ ID NO: 4067514 - RNA, 19 nt, Vaccinia virus
ucaaauuuauauccuauau

SEQ ID NO: 4067515 - RNA, 21 nt, Vaccinia virus
ucaacaauguuugucauaugu

SEQ ID NO: 4067516 - RNA, 23 nt, Vaccinia virus
ucaacaauguuugucauauguau

SEQ ID NO: 4067517 - RNA, 22 nt, Vaccinia virus
ucaacaucugaugcgcuaagac

SEQ ID NO: 4067518 - RNA, 18 nt, Vaccinia virus
ucaacauguuuaauauau

SEQ ID NO: 4067519 - RNA, 17 nt, Vaccinia virus
ucaaccaccgaugaugc

SEQ ID NO: 4067520 - RNA, 20 nt, Vaccinia virus
ucaacgaucuaauacaaaau

SEQ ID NO: 4067521 - RNA, 18 nt, Vaccinia virus
ucaacguagaaaaaauag

SEQ ID NO: 4067522 - RNA, 16 nt, Vaccinia virus
ucaacgucuaauguau

SEQ ID NO: 4067523 - RNA, 20 nt, Vaccinia virus
ucaacuaucguuggaaaaug

SEQ ID NO: 4067524 - RNA, 17 nt, Vaccinia virus
ucaagccggcuauauau

SEQ ID NO: 4067525 - RNA, 18 nt, Vaccinia virus
ucaaggaagaagaugcua

SEQ ID NO: 4067526 - RNA, 17 nt, Vaccinia virus
ucaaguaaagauuucaa

SEQ ID NO: 4067527 - RNA, 22 nt, Vaccinia virus
ucucugaauauagaacaucauu

SEQ ID NO: 4067528 - RNA, 15 nt, Vaccinia virus
ucucugguuugcuac

SEQ ID NO: 4067529 - RNA, 22 nt, Vaccinia virus
ucugaaauaacguauuuaaaca

SEQ ID NO: 4067530 - RNA, 20 nt, Vaccinia virus
ucugaaccaguuaauguaua

SEQ ID NO: 4067531 - RNA, 18 nt, Vaccinia virus
ucugacaauauuuaguuu

SEQ ID NO: 4067532 - RNA, 14 nt, Vaccinia virus
ucugacauaaacau

SEQ ID NO: 4067533 - RNA, 13 nt, Vaccinia virus
ucugagaauggau

SEQ ID NO: 4067534 - RNA, 23 nt, Vaccinia virus
ucugaucuuaacuccucuauuaa

SEQ ID NO: 4067535 - RNA, 20 nt, Vaccinia virus
ucugauuagaagccacuaua

SEQ ID NO: 4067536 - RNA, 12 nt, Vaccinia virus
ucugauuccacc

SEQ ID NO: 4067537 - RNA, 20 nt, Vaccinia virus
ucugcaaacuuaacagcucu

SEQ ID NO: 4067538 - RNA, 19 nt, Vaccinia virus
ucugcguguaaaaaguugu

SEQ ID NO: 4067539 - RNA, 17 nt, Vaccinia virus
ucuggaacaauuacaga

SEQ ID NO: 4067540 - RNA, 20 nt, Vaccinia virus
ucuggaaugacgaauccugu

SEQ ID NO: 4067541 - RNA, 14 nt, Vaccinia virus
ucuguaaaaguugu

SEQ ID NO: 4067542 - RNA, 19 nt, Vaccinia virus
ucuguacuucuguacaaaa

SEQ ID NO: 4067543 - RNA, 18 nt, Vaccinia virus
ucuguauuucauuguaaa

SEQ ID NO: 4067544 - RNA, 15 nt, Vaccinia virus
ucugucagaaaauac

SEQ ID NO: 4067545 - RNA, 16 nt, Vaccinia virus
ucugucauauuuagau

SEQ ID NO: 4067546 - RNA, 18 nt, Vaccinia virus
ucuguccaauuaaaugua

SEQ ID NO: 4067547 - RNA, 16 nt, Vaccinia virus
ucugugacuaugaauu

SEQ ID NO: 4067548 - RNA, 16 nt, Vaccinia virus
ucuguuaauuuuacua

SEQ ID NO: 4067549 - RNA, 18 nt, Vaccinia virus
ucuguuaccauaauuccu

SEQ ID NO: 4067550 - RNA, 17 nt, Vaccinia virus
ucuuaaaagguuucaua

SEQ ID NO: 4067551 - RNA, 18 nt, Vaccinia virus
ucuuaacacucucugcca

SEQ ID NO: 4067552 - RNA, 21 nt, Vaccinia virus
ucuuaacuacauucacaaaaa

SEQ ID NO: 4067553 - RNA, 22 nt, Vaccinia virus
ucuuaauagacacaucugccau

SEQ ID NO: 4067554 - RNA, 12 nt, Vaccinia virus
ucuuacaauguu

SEQ ID NO: 4067555 - RNA, 22 nt, Vaccinia virus
ucuuacauauuuuuuucuuauu

SEQ ID NO: 4067556 - RNA, 14 nt, Vaccinia virus
ucuuagaacaacau

SEQ ID NO: 4067557 - RNA, 14 nt, Vaccinia virus
ucuuagcgaaugau

SEQ ID NO: 4067558 - RNA, 23 nt, Vaccinia virus
ucuuaguuaauggagaaauacuu

SEQ ID NO: 4067559 - RNA, 21 nt, Vaccinia virus
ucuuauaauuguaacauccuu

SEQ ID NO: 4067560 - RNA, 16 nt, Vaccinia virus
ucuuauccauuuauaa

SEQ ID NO: 4067561 - RNA, 23 nt, Vaccinia virus
ucuucaaaguuucugaaauaaga

SEQ ID NO: 4067562 - RNA, 14 nt, Vaccinia virus
ucuucaucaaacag

SEQ ID NO: 4067563 - RNA, 21 nt, Vaccinia virus
ucuuccagcauccguuucuaa

SEQ ID NO: 4067564 - RNA, 19 nt, Vaccinia virus
ucuuccauguccaauauga

SEQ ID NO: 4067565 - RNA, 22 nt, Vaccinia virus
ucuuccggagaccccauaaaua

SEQ ID NO: 4067566 - RNA, 20 nt, Vaccinia virus
ucuuccugguauauuucuau

SEQ ID NO: 4067567 - RNA, 14 nt, Vaccinia virus
ucuuccuucuuauu

SEQ ID NO: 4067568 - RNA, 15 nt, Vaccinia virus
ucuucgaaaagaaac

SEQ ID NO: 4067569 - RNA, 20 nt, Vaccinia virus
ucuucgaaaagaaacagaua

SEQ ID NO: 4067570 - RNA, 20 nt, Vaccinia virus
ucuucggcgguuuucaugga

SEQ ID NO: 4067571 - RNA, 15 nt, Vaccinia virus
ucuucuauucuagaa

SEQ ID NO: 4067572 - RNA, 21 nt, Vaccinia virus
ucuucugaauucgaggaagau

SEQ ID NO: 4067573 - RNA, 16 nt, Vaccinia virus
ucuucugucaauugau

SEQ ID NO: 4067574 - RNA, 22 nt, Vaccinia virus
ucuucuuauaagauuguagaau

SEQ ID NO: 4067575 - RNA, 23 nt, Vaccinia virus
ucuucuugagaucccacaucauu

SEQ ID NO: 4067576 - RNA, 19 nt, Vaccinia virus
ucuugaagccauacauucg

SEQ ID NO: 4067577 - RNA, 23 nt, Vaccinia virus
ucuugacugucgcuaauaucuaa

SEQ ID NO: 4067578 - RNA, 18 nt, Vaccinia virus
ucuugcacgcguacauuu

SEQ ID NO: 4067579 - RNA, 14 nt, Vaccinia virus
ucuugcuacaaaau

SEQ ID NO: 4067580 - RNA, 19 nt, Vaccinia virus
ucuuggauaaaagcaucca

SEQ ID NO: 4067581 - RNA, 18 nt, Vaccinia virus
ucuuuaaaauuucauaga

SEQ ID NO: 4067582 - RNA, 23 nt, Vaccinia virus
ucuuuaauaucgacaauuucaua

SEQ ID NO: 4067583 - RNA, 13 nt, Vaccinia virus
ucuuuaauccaau

SEQ ID NO: 4067584 - RNA, 22 nt, Vaccinia virus
ucuuuacccauccaauacuacu

SEQ ID NO: 4067585 - RNA, 20 nt, Vaccinia virus
ucuuuaguaaacauaucaua

SEQ ID NO: 4067586 - RNA, 16 nt, Vaccinia virus
ucuuuaucucuuagua

SEQ ID NO: 4067587 - RNA, 16 nt, Vaccinia virus
ucuuuccauaguacau

SEQ ID NO: 4067588 - RNA, 18 nt, Vaccinia virus
ucuuucuccgccuauuaa

SEQ ID NO: 4067589 - RNA, 21 nt, Vaccinia virus
ucuuugaccaacgauuuagaa

SEQ ID NO: 4067590 - RNA, 18 nt, Vaccinia virus
ucuuuuaguuuaucaaaa

SEQ ID NO: 4067591 - RNA, 20 nt, Vaccinia virus
ucuuuuggguaauuguacaa

SEQ ID NO: 4067592 - RNA, 18 nt, Vaccinia virus
ucuuuuucucaaauccau

SEQ ID NO: 4067593 - RNA, 13 nt, Vaccinia virus
ugaaaaaacauua

SEQ ID NO: 4067594 - RNA, 12 nt, Vaccinia virus
ugaaaauacuuu

SEQ ID NO: 4067595 - RNA, 16 nt, Vaccinia virus
ugaaaauuaugauaca

SEQ ID NO: 4067596 - RNA, 12 nt, Vaccinia virus
ugaaaauuggag

SEQ ID NO: 4067597 - RNA, 14 nt, Vaccinia virus
ugaaacuaagucac

SEQ ID NO: 4067598 - RNA, 18 nt, Vaccinia virus
ugaaacuaagucuagaau

SEQ ID NO: 4067599 - RNA, 13 nt, Vaccinia virus
ugaaacuaucuuu

SEQ ID NO: 4067600 - RNA, 16 nt, Vaccinia virus
ugaaagcgagaaauaa

SEQ ID NO: 4067601 - RNA, 14 nt, Vaccinia virus
ugaaauaaagucau

SEQ ID NO: 4067602 - RNA, 17 nt, Vaccinia virus
ugaaauaauuagaacua

SEQ ID NO: 4067603 - RNA, 15 nt, Vaccinia virus
ugaaauauaguaaua

SEQ ID NO: 4067604 - RNA, 14 nt, Vaccinia virus
ugaaauauauacau

SEQ ID NO: 4067605 - RNA, 21 nt, Vaccinia virus
ugaaaucacuucaauaaauga

SEQ ID NO: 4067606 - RNA, 16 nt, Vaccinia virus
ugaaaugauaacuguu

SEQ ID NO: 4067607 - RNA, 19 nt, Vaccinia virus
ugaacaauaauuaauucuu

SEQ ID NO: 4067608 - RNA, 18 nt, Vaccinia virus
ugaacauaaaacuaauau

SEQ ID NO: 4067609 - RNA, 22 nt, Vaccinia virus
ugaaccguauuacucuacagua

SEQ ID NO: 4067610 - RNA, 23 nt, Vaccinia virus
ugaacgcugcccaccucauacau

SEQ ID NO: 4067611 - RNA, 18 nt, Vaccinia virus
ugaacugagauauauaca

SEQ ID NO: 4067612 - RNA, 15 nt, Vaccinia virus
ugaagaaaaauguug

SEQ ID NO: 4067613 - RNA, 21 nt, Vaccinia virus
ugaagaagagguaagauaucu

SEQ ID NO: 4067614 - RNA, 13 nt, Vaccinia virus
ugaagauacuguu

SEQ ID NO: 4067615 - RNA, 20 nt, Vaccinia virus
ugaagauauuauuaaaucau

SEQ ID NO: 4067616 - RNA, 18 nt, Vaccinia virus
ugaagaucuauuuccaga

SEQ ID NO: 4067617 - RNA, 21 nt, Vaccinia virus
ugaagaugugacguacaaaaa

SEQ ID NO: 4067618 - RNA, 22 nt, Vaccinia virus
ugaagcauucuuuccagaacua

SEQ ID NO: 4067619 - RNA, 20 nt, Vaccinia virus
ugaauaucuacaaauuggag

SEQ ID NO: 4067620 - RNA, 21 nt, Vaccinia virus
ugaaucaaauguaacuauuca

SEQ ID NO: 4067621 - RNA, 19 nt, Vaccinia virus
ugaaucauauauguauuca

SEQ ID NO: 4067622 - RNA, 20 nt, Vaccinia virus
ugaaucgauaacucuauuca

SEQ ID NO: 4067623 - RNA, 15 nt, Vaccinia virus
ugaaugaaucagaua

SEQ ID NO: 4067624 - RNA, 21 nt, Vaccinia virus
ugaauggaucaccguguuuau

SEQ ID NO: 4067625 - RNA, 13 nt, Vaccinia virus
ugaauuguuucuu

SEQ ID NO: 4067626 - RNA, 23 nt, Vaccinia virus
ugaauuuauuucagaaauuauuc

SEQ ID NO: 4067627 - RNA, 20 nt, Vaccinia virus
ugaauuucgagauuaaaugc

SEQ ID NO: 4067628 - RNA, 22 nt, Vaccinia virus
ugaauuugauuauuuugaagac

SEQ ID NO: 4067629 - RNA, 17 nt, Vaccinia virus
ugacaacucaaacaucu

SEQ ID NO: 4067630 - RNA, 17 nt, Vaccinia virus
ugacacauuuuacgaua

SEQ ID NO: 4067631 - RNA, 18 nt, Vaccinia virus
ugacaccagaaaacgacg

SEQ ID NO: 4067632 - RNA, 17 nt, Vaccinia virus
ugacagaccagaccuag

SEQ ID NO: 4067633 - RNA, 19 nt, Vaccinia virus
ugacauacauacuaucuuu

SEQ ID NO: 4067634 - RNA, 13 nt, Vaccinia virus
ugacauauuacaa

SEQ ID NO: 4067635 - RNA, 14 nt, Vaccinia virus
ugacauauuacaaa

SEQ ID NO: 4067636 - RNA, 17 nt, Vaccinia virus
ugacaucgcauuuauau

SEQ ID NO: 4067637 - RNA, 16 nt, Vaccinia virus
ugacaucuuguagaac

SEQ ID NO: 4067638 - RNA, 15 nt, Vaccinia virus
ugacauucaaagauc

SEQ ID NO: 4067639 - RNA, 18 nt, Vaccinia virus
ugaccuggaaaaauacuu

SEQ ID NO: 4067640 - RNA, 21 nt, Vaccinia virus
ugacgaaguaacgucauuaaa

SEQ ID NO: 4067641 - RNA, 13 nt, Vaccinia virus
ugacgauauuucu

SEQ ID NO: 4067642 - RNA, 21 nt, Vaccinia virus
ugacggagcccaauuuuggug

SEQ ID NO: 4067643 - RNA, 16 nt, Vaccinia virus
ugacgggauacagauu

SEQ ID NO: 4067644 - RNA, 20 nt, Vaccinia virus
ugacucauggauucauuaau

SEQ ID NO: 4067645 - RNA, 23 nt, Vaccinia virus
ugacuguagauauuauauagaua

SEQ ID NO: 4067646 - RNA, 17 nt, Vaccinia virus
ugacuuucaaaccaauu

SEQ ID NO: 4067647 - RNA, 18 nt, Vaccinia virus
ugagaaugagauucaaaa

SEQ ID NO: 4067648 - RNA, 12 nt, Vaccinia virus
ugagagcaucca

SEQ ID NO: 4067649 - RNA, 15 nt, Vaccinia virus
ugagaguagauauca

SEQ ID NO: 4067650 - RNA, 19 nt, Vaccinia virus
acuuguuggugaaauggua

SEQ ID NO: 4067651 - RNA, 16 nt, Vaccinia virus
acuuuaaacagaaaua

SEQ ID NO: 4067652 - RNA, 11 nt, Vaccinia virus
acuuuaaacau

SEQ ID NO: 4067653 - RNA, 19 nt, Vaccinia virus
acuuuaaauaauuuacaaa

SEQ ID NO: 4067654 - RNA, 14 nt, Vaccinia virus
acuuuaacaaucuc

SEQ ID NO: 4067655 - RNA, 19 nt, Vaccinia virus
acuuuaaccuauacaugau

SEQ ID NO: 4067656 - RNA, 21 nt, Vaccinia virus
acuuuacgcuauuaaucuuua

SEQ ID NO: 4067657 - RNA, 18 nt, Vaccinia virus
acuuuacuuuucuaaauu

SEQ ID NO: 4067658 - RNA, 14 nt, Vaccinia virus
acuuuauauuuccu

SEQ ID NO: 4067659 - RNA, 20 nt, Vaccinia virus
acuuuaucaucuuauauaga

SEQ ID NO: 4067660 - RNA, 19 nt, Vaccinia virus
acuuucagaagaaauggua

SEQ ID NO: 4067661 - RNA, 18 nt, Vaccinia virus
acuuucgaauaaguuugc

SEQ ID NO: 4067662 - RNA, 17 nt, Vaccinia virus
acuuuguggaugaugau

SEQ ID NO: 4067663 - RNA, 14 nt, Vaccinia virus
acuuuguuaauaau

SEQ ID NO: 4067664 - RNA, 19 nt, Vaccinia virus
acuuuuauuuuuagaaagu

SEQ ID NO: 4067665 - RNA, 15 nt, Vaccinia virus
acuuuuguuacuaau

SEQ ID NO: 4067666 - RNA, 13 nt, Vaccinia virus
acuuuuucauaau

SEQ ID NO: 4067667 - RNA, 23 nt, Vaccinia virus
acuuuuugguaggacaaagugaa

SEQ ID NO: 4067668 - RNA, 11 nt, Vaccinia virus
agaaaaacaac

SEQ ID NO: 4067669 - RNA, 11 nt, Vaccinia virus
agaaaacauua

SEQ ID NO: 4067670 - RNA, 15 nt, Vaccinia virus
agaaaacuagauaca

SEQ ID NO: 4067671 - RNA, 16 nt, Vaccinia virus
agaaaacuagauacaa

SEQ ID NO: 4067672 - RNA, 15 nt, Vaccinia virus
agaaaaggauguauu

SEQ ID NO: 4067673 - RNA, 18 nt, Vaccinia virus
agaaaaggauguauuauu

SEQ ID NO: 4067674 - RNA, 23 nt, Vaccinia virus
agaaaauaucuucuccuguaaua

SEQ ID NO: 4067675 - RNA, 11 nt, Vaccinia virus
agaaaauggau

SEQ ID NO: 4067676 - RNA, 22 nt, Vaccinia virus
agaaaaugucucucauaauaaa

SEQ ID NO: 4067677 - RNA, 15 nt, Vaccinia virus
agaaacagaacuauu

SEQ ID NO: 4067678 - RNA, 23 nt, Vaccinia virus
agaaacugacuugauaaaaaugg

SEQ ID NO: 4067679 - RNA, 14 nt, Vaccinia virus
agaaacuuaaagua

SEQ ID NO: 4067680 - RNA, 15 nt, Vaccinia virus
agaaacuuaguacua

SEQ ID NO: 4067681 - RNA, 19 nt, Vaccinia virus
agaaagaaaauaucuauau

SEQ ID NO: 4067682 - RNA, 13 nt, Vaccinia virus
agaaagauuaaau

SEQ ID NO: 4067683 - RNA, 22 nt, Vaccinia virus
agaaaguaugauacaauacuua

SEQ ID NO: 4067684 - RNA, 16 nt, Vaccinia virus
agaaagucagaaucua

SEQ ID NO: 4067685 - RNA, 21 nt, Vaccinia virus
agaaauaaaucagacaauaag

SEQ ID NO: 4067686 - RNA, 23 nt, Vaccinia virus
agaaauaagagacuuaaacaacg

SEQ ID NO: 4067687 - RNA, 16 nt, Vaccinia virus
agaaauaauaagaaua

SEQ ID NO: 4067688 - RNA, 12 nt, Vaccinia virus
agaaauacuuag

SEQ ID NO: 4067689 - RNA, 22 nt, Vaccinia virus
agaaauauauacuucaauugau

SEQ ID NO: 4067690 - RNA, 22 nt, Vaccinia virus
agaaaucauauaugauauuccu

SEQ ID NO: 4067691 - RNA, 19 nt, Vaccinia virus
agaaaucauccguuguuau

SEQ ID NO: 4067692 - RNA, 21 nt, Vaccinia virus
agaaaucauguuauaguguuu

SEQ ID NO: 4067693 - RNA, 21 nt, Vaccinia virus
agaaauccaaauaaaauggau

SEQ ID NO: 4067694 - RNA, 20 nt, Vaccinia virus
agaaaugaaguuaugacauu

SEQ ID NO: 4067695 - RNA, 23 nt, Vaccinia virus
agaaauggaagaguuaaugaaua

SEQ ID NO: 4067696 - RNA, 14 nt, Vaccinia virus
agaaauuaauagaa

SEQ ID NO: 4067697 - RNA, 17 nt, Vaccinia virus
agaaauucuuguucaau

SEQ ID NO: 4067698 - RNA, 23 nt, Vaccinia virus
agaaauuuuugguucuucucuaa

SEQ ID NO: 4067699 - RNA, 13 nt, Vaccinia virus
agaacaaauaaua

SEQ ID NO: 4067700 - RNA, 22 nt, Vaccinia virus
agaacaacgaaauuauacuaga

SEQ ID NO: 4067701 - RNA, 16 nt, Vaccinia virus
agaacacacuuuucuc

SEQ ID NO: 4067702 - RNA, 17 nt, Vaccinia virus
agaacacacuuuucuca

SEQ ID NO: 4067703 - RNA, 21 nt, Vaccinia virus
agaacacuacaguaguaauua

SEQ ID NO: 4067704 - RNA, 21 nt, Vaccinia virus
agaacagaauaaacaaaauaa

SEQ ID NO: 4067705 - RNA, 18 nt, Vaccinia virus
agaacaucauuuccaaau

SEQ ID NO: 4067706 - RNA, 20 nt, Vaccinia virus
agaacaugugugaaaauauu

SEQ ID NO: 4067707 - RNA, 17 nt, Vaccinia virus
agaaccacgaaacuaau

SEQ ID NO: 4067708 - RNA, 21 nt, Vaccinia virus
agaaccgucauucauuuagaa

SEQ ID NO: 4067709 - RNA, 18 nt, Vaccinia virus
agaacggagaauaucuau

SEQ ID NO: 4067710 - RNA, 21 nt, Vaccinia virus
agaacguaaaauacauaugac

SEQ ID NO: 4067711 - RNA, 18 nt, Vaccinia virus
agaacuaauguauauucu

SEQ ID NO: 4067712 - RNA, 14 nt, Vaccinia virus
agaacuuaacaaua

SEQ ID NO: 4067713 - RNA, 16 nt, Vaccinia virus
agaacuuauuaaugaa

SEQ ID NO: 4067714 - RNA, 13 nt, Vaccinia virus
agaagaauaugau

SEQ ID NO: 4067715 - RNA, 16 nt, Vaccinia virus
agaagauuaaacauau

SEQ ID NO: 4067716 - RNA, 13 nt, Vaccinia virus
agaagcaacuuau

SEQ ID NO: 4067717 - RNA, 22 nt, Vaccinia virus
agaagcacucguuauuaauaca

SEQ ID NO: 4067718 - RNA, 17 nt, Vaccinia virus
agaaggaguguuuucuu

SEQ ID NO: 4067719 - RNA, 23 nt, Vaccinia virus
agaaggaguugauuaagaauaua

SEQ ID NO: 4067720 - RNA, 17 nt, Vaccinia virus
agaagugugaauaugau

SEQ ID NO: 4067721 - RNA, 16 nt, Vaccinia virus
agaauaaucagaaauu

SEQ ID NO: 4067722 - RNA, 16 nt, Vaccinia virus
agaauacaaucuguau

SEQ ID NO: 4067723 - RNA, 15 nt, Vaccinia virus
agaauacgaugauau

SEQ ID NO: 4067724 - RNA, 16 nt, Vaccinia virus
agaauacgaugauauu

SEQ ID NO: 4067725 - RNA, 18 nt, Vaccinia virus
agaauacgccaaggaaag

SEQ ID NO: 4067726 - RNA, 21 nt, Vaccinia virus
agaauagcguuuacauauucu

SEQ ID NO: 4067727 - RNA, 23 nt, Vaccinia virus
agaauaguauuugagaaauaugu

SEQ ID NO: 4067728 - RNA, 15 nt, Vaccinia virus
agaauauaaaaaauu

SEQ ID NO: 4067729 - RNA, 16 nt, Vaccinia virus
agaauauaaaaacucu

SEQ ID NO: 4067730 - RNA, 20 nt, Vaccinia virus
agaauauacucaauagaauu

SEQ ID NO: 4067731 - RNA, 13 nt, Vaccinia virus
agaauauauguau

SEQ ID NO: 4067732 - RNA, 21 nt, Vaccinia virus
agaauaugauccguaacauau

SEQ ID NO: 4067733 - RNA, 18 nt, Vaccinia virus
agaaucaauacaaaaauu

SEQ ID NO: 4067734 - RNA, 19 nt, Vaccinia virus
agaaucaauugagaugucu

SEQ ID NO: 4067735 - RNA, 22 nt, Vaccinia virus
agaaucagugaauaaauucaag

SEQ ID NO: 4067736 - RNA, 19 nt, Vaccinia virus
agaaucauaaagaacagua

SEQ ID NO: 4067737 - RNA, 20 nt, Vaccinia virus
agaaucccauagggcuaaau

SEQ ID NO: 4067738 - RNA, 15 nt, Vaccinia virus
agaauccgaaauauu

SEQ ID NO: 4067739 - RNA, 16 nt, Vaccinia virus
agaaucuaaugaugac

SEQ ID NO: 4067740 - RNA, 14 nt, Vaccinia virus
agaaugaaacagua

SEQ ID NO: 4067741 - RNA, 11 nt, Vaccinia virus
agaaugauaug

SEQ ID NO: 4067742 - RNA, 20 nt, Vaccinia virus
agaaugcucuuaaauaaugu

SEQ ID NO: 4067743 - RNA, 12 nt, Vaccinia virus
agaaugcuguua

SEQ ID NO: 4067744 - RNA, 15 nt, Vaccinia virus
agaauggaaauauau

SEQ ID NO: 4067745 - RNA, 15 nt, Vaccinia virus
agaauggaugauauu

SEQ ID NO: 4067746 - RNA, 15 nt, Vaccinia virus
agaauguauaaaccu

SEQ ID NO: 4067747 - RNA, 17 nt, Vaccinia virus
agaaugugauaagaucg

SEQ ID NO: 4067748 - RNA, 12 nt, Vaccinia virus
agaauuagaaca

SEQ ID NO: 4067749 - RNA, 21 nt, Vaccinia virus
agaauuauaccgauagauaau

SEQ ID NO: 4067750 - RNA, 22 nt, Vaccinia virus
agaauucaagucaggaacuauu

SEQ ID NO: 4067751 - RNA, 15 nt, Vaccinia virus
agaauucagauguug

SEQ ID NO: 4067752 - RNA, 22 nt, Vaccinia virus
agaauucuuaguuaauggagaa

SEQ ID NO: 4067753 - RNA, 22 nt, Vaccinia virus
agaauugauaauauaaauauga

SEQ ID NO: 4067754 - RNA, 13 nt, Vaccinia virus
agaauugucuauc

SEQ ID NO: 4067755 - RNA, 15 nt, Vaccinia virus
agaauuuuagacacu

SEQ ID NO: 4067756 - RNA, 16 nt, Vaccinia virus
agaauuuuuauaaauu

SEQ ID NO: 4067757 - RNA, 22 nt, Vaccinia virus
agacaaaacuauuccaauguuu

SEQ ID NO: 4067758 - RNA, 23 nt, Vaccinia virus
agacaagcggguaaaugauuauu

SEQ ID NO: 4067759 - RNA, 20 nt, Vaccinia virus
agacaaucauuuacuaagga

SEQ ID NO: 4067760 - RNA, 22 nt, Vaccinia virus
agacacauaugguuucuaaauc

SEQ ID NO: 4067761 - RNA, 15 nt, Vaccinia virus
agacacgcauguguu

SEQ ID NO: 4067762 - RNA, 12 nt, Vaccinia virus
agacagauuaug

SEQ ID NO: 4067763 - RNA, 13 nt, Vaccinia virus
agacauaaauaaa

SEQ ID NO: 4067764 - RNA, 21 nt, Vaccinia virus
agacauuguugaauucuguga

SEQ ID NO: 4067765 - RNA, 13 nt, Vaccinia virus
agaccagaaaugc

SEQ ID NO: 4067766 - RNA, 17 nt, Vaccinia virus
agacccaaaugucuguu

SEQ ID NO: 4067767 - RNA, 19 nt, Vaccinia virus
agacccuaauuauguagau

SEQ ID NO: 4067768 - RNA, 15 nt, Vaccinia virus
agacgaacaaaauca

SEQ ID NO: 4067769 - RNA, 23 nt, Vaccinia virus
agacgacgacaauaguguucuaa

SEQ ID NO: 4067770 - RNA, 15 nt, Vaccinia virus
agacgacguauuaua

SEQ ID NO: 4067771 - RNA, 16 nt, Vaccinia virus
agacgagauaguuuuc

SEQ ID NO: 4067772 - RNA, 14 nt, Vaccinia virus
agacgcccaaaaua

SEQ ID NO: 4067773 - RNA, 13 nt, Vaccinia virus
agacgcuuauuau

SEQ ID NO: 4067774 - RNA, 17 nt, Vaccinia virus
aguacauggaugauaua

SEQ ID NO: 4067775 - RNA, 17 nt, Vaccinia virus
aguaccgauucuagaua

SEQ ID NO: 4067776 - RNA, 14 nt, Vaccinia virus
aguacgguaauaga

SEQ ID NO: 4067777 - RNA, 23 nt, Vaccinia virus
aguacguacuaugccaaaugaau

SEQ ID NO: 4067778 - RNA, 17 nt, Vaccinia virus
aguacuacuagguagaa

SEQ ID NO: 4067779 - RNA, 16 nt, Vaccinia virus
aguacuaucauaauua

SEQ ID NO: 4067780 - RNA, 14 nt, Vaccinia virus
aguagaaaauauau

SEQ ID NO: 4067781 - RNA, 16 nt, Vaccinia virus
aguagacgacauagaa

SEQ ID NO: 4067782 - RNA, 22 nt, Vaccinia virus
aguagauacauggcuaucgcaa

SEQ ID NO: 4067783 - RNA, 16 nt, Vaccinia virus
aguagauuuuauucca

SEQ ID NO: 4067784 - RNA, 19 nt, Vaccinia virus
aguagcuauaauauauucu

SEQ ID NO: 4067785 - RNA, 20 nt, Vaccinia virus
aguaguucugcgcaaugcau

SEQ ID NO: 4067786 - RNA, 22 nt, Vaccinia virus
aguauaaacgccauaauacuca

SEQ ID NO: 4067787 - RNA, 21 nt, Vaccinia virus
aguauacaucaugaaaugaug

SEQ ID NO: 4067788 - RNA, 16 nt, Vaccinia virus
aguauaccaacuauau

SEQ ID NO: 4067789 - RNA, 24 nt, Vaccinia virus
aguauacgaagaaaaaguaaauac

SEQ ID NO: 4067790 - RNA, 17 nt, Vaccinia virus
aguauagaucaaaagaa

SEQ ID NO: 4067791 - RNA, 19 nt, Vaccinia virus
aguauaucuacacauguau

SEQ ID NO: 4067792 - RNA, 16 nt, Vaccinia virus
aguauaugaacaaacg

SEQ ID NO: 4067793 - RNA, 18 nt, Vaccinia virus
aguauaugauaauauuaa

SEQ ID NO: 4067794 - RNA, 15 nt, Vaccinia virus
aguaucaugaacucu

SEQ ID NO: 4067795 - RNA, 22 nt, Vaccinia virus
aguauccaucgcuucuaucuug

SEQ ID NO: 4067796 - RNA, 19 nt, Vaccinia virus
aguauccauuuuacauuau

SEQ ID NO: 4067797 - RNA, 17 nt, Vaccinia virus
aguaucuucuuuaucua

SEQ ID NO: 4067798 - RNA, 20 nt, Vaccinia virus
aguaucuuuuguucuagaug

SEQ ID NO: 4067799 - RNA, 18 nt, Vaccinia virus
aguaugaagauaaacacu

SEQ ID NO: 4067800 - RNA, 16 nt, Vaccinia virus
aguaugaauaaucuuc

SEQ ID NO: 4067801 - RNA, 18 nt, Vaccinia virus
aguaugauacaauacuua

SEQ ID NO: 4067802 - RNA, 17 nt, Vaccinia virus
aguaugcuaaacuuuau

SEQ ID NO: 4067803 - RNA, 21 nt, Vaccinia virus
aguauggaagaggauuuucua

SEQ ID NO: 4067804 - RNA, 14 nt, Vaccinia virus
aguaugucaugaau

SEQ ID NO: 4067805 - RNA, 12 nt, Vaccinia virus
aguauuaaugau

SEQ ID NO: 4067806 - RNA, 14 nt, Vaccinia virus
aguauucaagucaa

SEQ ID NO: 4067807 - RNA, 15 nt, Vaccinia virus
aguauucaagucaaa

SEQ ID NO: 4067808 - RNA, 16 nt, Vaccinia virus
aguauuccaauaucug

SEQ ID NO: 4067809 - RNA, 23 nt, Vaccinia virus
aguauucuucuugucaucuuguu

SEQ ID NO: 4067810 - RNA, 23 nt, Vaccinia virus
aguauugguaauauauaaacucu

SEQ ID NO: 4067811 - RNA, 13 nt, Vaccinia virus
aguauuuaacaag

SEQ ID NO: 4067812 - RNA, 18 nt, Vaccinia virus
aguauuuauacuacuaau

SEQ ID NO: 4067813 - RNA, 22 nt, Vaccinia virus
aguauuucuguguauuaauaga

SEQ ID NO: 4067814 - RNA, 16 nt, Vaccinia virus
aguauuugauaaaaca

SEQ ID NO: 4067815 - RNA, 19 nt, Vaccinia virus
aguauuuuaauacauguau

SEQ ID NO: 4067816 - RNA, 13 nt, Vaccinia virus
aguauuuuucuaa

SEQ ID NO: 4067817 - RNA, 21 nt, Vaccinia virus
agucaacaaugaaaauggaua

SEQ ID NO: 4067818 - RNA, 19 nt, Vaccinia virus
agucaauauauuaagaagu

SEQ ID NO: 4067819 - RNA, 13 nt, Vaccinia virus
agucaauaucuuu

SEQ ID NO: 4067820 - RNA, 17 nt, Vaccinia virus
agucacgaauaacgaua

SEQ ID NO: 4067821 - RNA, 19 nt, Vaccinia virus
agucagaaccuauuaacga

SEQ ID NO: 4067822 - RNA, 15 nt, Vaccinia virus
agucauaaaaggaua

SEQ ID NO: 4067823 - RNA, 19 nt, Vaccinia virus
agucauaaaaggauacuaa

SEQ ID NO: 4067824 - RNA, 17 nt, Vaccinia virus
agucauacguaaugaag

SEQ ID NO: 4067825 - RNA, 13 nt, Vaccinia virus
agucauaucuaga

SEQ ID NO: 4067826 - RNA, 16 nt, Vaccinia virus
agucauaucuagaaug

SEQ ID NO: 4067827 - RNA, 16 nt, Vaccinia virus
agucauguuaaaaaug

SEQ ID NO: 4067828 - RNA, 23 nt, Vaccinia virus
agucauuugacuagauaaacuau

SEQ ID NO: 4067829 - RNA, 17 nt, Vaccinia virus
aguccuaaauuuucuaa

SEQ ID NO: 4067830 - RNA, 16 nt, Vaccinia virus
aguccuauauauuuga

SEQ ID NO: 4067831 - RNA, 16 nt, Vaccinia virus
agucgaacaaucuuaa

SEQ ID NO: 4067832 - RNA, 18 nt, Vaccinia virus
agucgaacaaucuuaaug

SEQ ID NO: 4067833 - RNA, 17 nt, Vaccinia virus
agucgagauacagaaaa

SEQ ID NO: 4067834 - RNA, 20 nt, Vaccinia virus
agucguucucguucagaauc

SEQ ID NO: 4067835 - RNA, 16 nt, Vaccinia virus
agucuagguucacaau

SEQ ID NO: 4067836 - RNA, 23 nt, Vaccinia virus
agucuauaugaucaaaaagagau

SEQ ID NO: 4067837 - RNA, 22 nt, Vaccinia virus
agucuccuucgauggucucaca

SEQ ID NO: 4067838 - RNA, 19 nt, Vaccinia virus
agucucgcguucaagauua

SEQ ID NO: 4067839 - RNA, 19 nt, Vaccinia virus
agucucgugaguaauucca

SEQ ID NO: 4067840 - RNA, 18 nt, Vaccinia virus
agucugucaaaucaucuu

SEQ ID NO: 4067841 - RNA, 20 nt, Vaccinia virus
agucugugguggaugauguc

SEQ ID NO: 4067842 - RNA, 15 nt, Vaccinia virus
agugaauccaucuca

SEQ ID NO: 4067843 - RNA, 17 nt, Vaccinia virus
agugaaucgacuauaga

SEQ ID NO: 4067844 - RNA, 17 nt, Vaccinia virus
agugaauuccaccauga

SEQ ID NO: 4067845 - RNA, 18 nt, Vaccinia virus
agugacuuuguagcucuc

SEQ ID NO: 4067846 - RNA, 20 nt, Vaccinia virus
agugauacccgcaauuauua

SEQ ID NO: 4067847 - RNA, 23 nt, Vaccinia virus
agugauauagaucccaaaucuuc

SEQ ID NO: 4067848 - RNA, 12 nt, Vaccinia virus
agugauuuuaca

SEQ ID NO: 4067849 - RNA, 13 nt, Vaccinia virus
agugcaaugaaua

SEQ ID NO: 4067850 - RNA, 17 nt, Vaccinia virus
agugccacaaaacagaa

SEQ ID NO: 4067851 - RNA, 15 nt, Vaccinia virus
aguggaguugaagau

SEQ ID NO: 4067852 - RNA, 15 nt, Vaccinia virus
aguguaguuaaugua

SEQ ID NO: 4067853 - RNA, 13 nt, Vaccinia virus
aguguucuaaauu

SEQ ID NO: 4067854 - RNA, 13 nt, Vaccinia virus
aguguuugauucu

SEQ ID NO: 4067855 - RNA, 21 nt, Vaccinia virus
aguuaaaaaagaccaguucau

SEQ ID NO: 4067856 - RNA, 16 nt, Vaccinia virus
aguuaaaacuuuauca

SEQ ID NO: 4067857 - RNA, 13 nt, Vaccinia virus
aguuaaaaugaua

SEQ ID NO: 4067858 - RNA, 17 nt, Vaccinia virus
aguuaaauauuaaaacu

SEQ ID NO: 4067859 - RNA, 18 nt, Vaccinia virus
aguuaaguuuuuuaagaa

SEQ ID NO: 4067860 - RNA, 18 nt, Vaccinia virus
aguuaaugcgucuaaaac

SEQ ID NO: 4067861 - RNA, 16 nt, Vaccinia virus
aguuagaaaguauuuu

SEQ ID NO: 4067862 - RNA, 22 nt, Vaccinia virus
aguuaggguucuuguuccauua

SEQ ID NO: 4067863 - RNA, 21 nt, Vaccinia virus
aguuauacgucauuucaucug

SEQ ID NO: 4067864 - RNA, 17 nt, Vaccinia virus
aguuauccgaucuaaaa

SEQ ID NO: 4067865 - RNA, 16 nt, Vaccinia virus
aguuauuaagcaauau

SEQ ID NO: 4067866 - RNA, 14 nt, Vaccinia virus
aguuauuaaugaug

SEQ ID NO: 4067867 - RNA, 15 nt, Vaccinia virus
aguuauuuacuuuga

SEQ ID NO: 4067868 - RNA, 15 nt, Vaccinia virus
aguucauaacagaua

SEQ ID NO: 4067869 - RNA, 19 nt, Vaccinia virus
aguucaucgcuuucuagaa

SEQ ID NO: 4067870 - RNA, 15 nt, Vaccinia virus
aguuccagaaaaugu

SEQ ID NO: 4067871 - RNA, 18 nt, Vaccinia virus
aguucccgcauuaaauaa

SEQ ID NO: 4067872 - RNA, 19 nt, Vaccinia virus
aguuccgcauuaaaugaug

SEQ ID NO: 4067873 - RNA, 16 nt, Vaccinia virus
aguuccuuaugaugac

SEQ ID NO: 4067874 - RNA, 23 nt, Vaccinia virus
aguucucuuuucauguucgaaaa

SEQ ID NO: 4067875 - RNA, 20 nt, Vaccinia virus
aguucuucggcgguuuucau

SEQ ID NO: 4067876 - RNA, 13 nt, Vaccinia virus
aguucuucuagaa

SEQ ID NO: 4067877 - RNA, 17 nt, Vaccinia virus
aguucuuuuaugucaag

SEQ ID NO: 4067878 - RNA, 23 nt, Vaccinia virus
aguugacacguuuauuucauaua

SEQ ID NO: 4067879 - RNA, 16 nt, Vaccinia virus
aguugauaauaauaca

SEQ ID NO: 4067880 - RNA, 17 nt, Vaccinia virus
aguugauuguaaauaca

SEQ ID NO: 4067881 - RNA, 16 nt, Vaccinia virus
aguuggccauuaucga

SEQ ID NO: 4067882 - RNA, 20 nt, Vaccinia virus
aguuguggaagacuguacaa

SEQ ID NO: 4067883 - RNA, 15 nt, Vaccinia virus
aguuuaauaauacaa

SEQ ID NO: 4067884 - RNA, 15 nt, Vaccinia virus
aguuuauacuauuaa

SEQ ID NO: 4067885 - RNA, 18 nt, Vaccinia virus
aguuuauaucaauaagaa

SEQ ID NO: 4067886 - RNA, 16 nt, Vaccinia virus
aguuuauuauccacua

SEQ ID NO: 4067887 - RNA, 19 nt, Vaccinia virus
aguuucaucgauaaaggau

SEQ ID NO: 4067888 - RNA, 19 nt, Vaccinia virus
aguuuccgccauuuaucca

SEQ ID NO: 4067889 - RNA, 16 nt, Vaccinia virus
aguuucuauacugucu

SEQ ID NO: 4067890 - RNA, 17 nt, Vaccinia virus
aguuucugguuuucuau

SEQ ID NO: 4067891 - RNA, 14 nt, Vaccinia virus
aguuucuguaauga

SEQ ID NO: 4067892 - RNA, 19 nt, Vaccinia virus
aguuucuguaaugauggac

SEQ ID NO: 4067893 - RNA, 21 nt, Vaccinia virus
aguuugauuaguauaacuaga

SEQ ID NO: 4067894 - RNA, 16 nt, Vaccinia virus
aguuuggauuaucgua

SEQ ID NO: 4067895 - RNA, 15 nt, Vaccinia virus
aguuuguuuuggaaa

SEQ ID NO: 4067896 - RNA, 21 nt, Vaccinia virus
aguuuuauuauaaguuaaaau

SEQ ID NO: 4067897 - RNA, 21 nt, Vaccinia virus
aguuuucagaagauaauuauc

SEQ ID NO: 4067898 - RNA, 19 nt, Vaccinia virus
ccuaauacaucucuggaaa

SEQ ID NO: 4067899 - RNA, 18 nt, Vaccinia virus
ccuacaggaauaucuuua

SEQ ID NO: 4067900 - RNA, 17 nt, Vaccinia virus
ccuagauacuguauaua

SEQ ID NO: 4067901 - RNA, 22 nt, Vaccinia virus
ccuauguuuccccuauaaucuu

SEQ ID NO: 4067902 - RNA, 18 nt, Vaccinia virus
ccuauuccacauuuuguu

SEQ ID NO: 4067903 - RNA, 16 nt, Vaccinia virus
ccuauucuaaauggau

SEQ ID NO: 4067904 - RNA, 18 nt, Vaccinia virus
ccucagaggauauguuug

SEQ ID NO: 4067905 - RNA, 20 nt, Vaccinia virus
ccucgacugauguggaauca

SEQ ID NO: 4067906 - RNA, 23 nt, Vaccinia virus
ccucggauaaauaggaucaucua

SEQ ID NO: 4067907 - RNA, 15 nt, Vaccinia virus
ccugauuauuuacua

SEQ ID NO: 4067908 - RNA, 19 nt, Vaccinia virus
ccuguauucuuuuuaagau

SEQ ID NO: 4067909 - RNA, 19 nt, Vaccinia virus
ccuuaaauguuuucucugu

SEQ ID NO: 4067910 - RNA, 16 nt, Vaccinia virus
ccuuaccaugcaauaa

SEQ ID NO: 4067911 - RNA, 15 nt, Vaccinia virus
ccuuacucaugauua

SEQ ID NO: 4067912 - RNA, 17 nt, Vaccinia virus
ccuuauaaagaaugaau

SEQ ID NO: 4067913 - RNA, 20 nt, Vaccinia virus
ccuucacaucucgcaauaau

SEQ ID NO: 4067914 - RNA, 20 nt, Vaccinia virus
ccuuccacauccaugagauu

SEQ ID NO: 4067915 - RNA, 19 nt, Vaccinia virus
ccuugaaaaugaauacagu

SEQ ID NO: 4067916 - RNA, 16 nt, Vaccinia virus
ccuugcguuucucuga

SEQ ID NO: 4067917 - RNA, 20 nt, Vaccinia virus
ccuugggaguaguuuaugau

SEQ ID NO: 4067918 - RNA, 13 nt, Vaccinia virus
ccuuguauccauu

SEQ ID NO: 4067919 - RNA, 15 nt, Vaccinia virus
ccuuguauguuuuua

SEQ ID NO: 4067920 - RNA, 16 nt, Vaccinia virus
ccuuuacaguggauaa

SEQ ID NO: 4067921 - RNA, 20 nt, Vaccinia virus
cgaaaaaaaagcuauuauca

SEQ ID NO: 4067922 - RNA, 21 nt, Vaccinia virus
cgaaagaacugauugcagugu

SEQ ID NO: 4067923 - RNA, 15 nt, Vaccinia virus
cgaaaucuuaaauac

SEQ ID NO: 4067924 - RNA, 22 nt, Vaccinia virus
cgaacacuaacgcgcaugauuu

SEQ ID NO: 4067925 - RNA, 14 nt, Vaccinia virus
cgaaccagaaagug

SEQ ID NO: 4067926 - RNA, 17 nt, Vaccinia virus
cgaagaacuaauaaacu

SEQ ID NO: 4067927 - RNA, 12 nt, Vaccinia virus
cgaauaaaagau

SEQ ID NO: 4067928 - RNA, 13 nt, Vaccinia virus
cgaauaacaaaau

SEQ ID NO: 4067929 - RNA, 16 nt, Vaccinia virus
cgaauauauaaaagac

SEQ ID NO: 4067930 - RNA, 20 nt, Vaccinia virus
cgaaucaagugauucagaaa

SEQ ID NO: 4067931 - RNA, 15 nt, Vaccinia virus
cgaaucuaugauauu

SEQ ID NO: 4067932 - RNA, 14 nt, Vaccinia virus
cgaaugaauguuuu

SEQ ID NO: 4067933 - RNA, 22 nt, Vaccinia virus
cgaauuuacucgcauuucuaau

SEQ ID NO: 4067934 - RNA, 17 nt, Vaccinia virus
cgacaaaaagauauaaa

SEQ ID NO: 4067935 - RNA, 16 nt, Vaccinia virus
cgacgacaauaguguu

SEQ ID NO: 4067936 - RNA, 18 nt, Vaccinia virus
cgacugugauaauaauac

SEQ ID NO: 4067937 - RNA, 14 nt, Vaccinia virus
cgagauacagaaaa

SEQ ID NO: 4067938 - RNA, 13 nt, Vaccinia virus
cgagcaagagaau

SEQ ID NO: 4067939 - RNA, 21 nt, Vaccinia virus
cgaggagauuuagaaauguug

SEQ ID NO: 4067940 - RNA, 23 nt, Vaccinia virus
cgaggauaauauuagauuuacug

SEQ ID NO: 4067941 - RNA, 21 nt, Vaccinia virus
cgaguaaauaacuauagaagu

SEQ ID NO: 4067942 - RNA, 17 nt, Vaccinia virus
cgaguuuaaaacuucua

SEQ ID NO: 4067943 - RNA, 17 nt, Vaccinia virus
cgauaacauucuaaaga

SEQ ID NO: 4067944 - RNA, 21 nt, Vaccinia virus
cgauacauccuucuauguuga

SEQ ID NO: 4067945 - RNA, 16 nt, Vaccinia virus
cgauacuaauuacaaa

SEQ ID NO: 4067946 - RNA, 11 nt, Vaccinia virus
cgauagaaaaa

SEQ ID NO: 4067947 - RNA, 13 nt, Vaccinia virus
cgauauacauaaa

SEQ ID NO: 4067948 - RNA, 10 nt, Vaccinia virus
cgauauuaau

SEQ ID NO: 4067949 - RNA, 18 nt, Vaccinia virus
cgaugaccauuuaaaaac

SEQ ID NO: 4067950 - RNA, 21 nt, Vaccinia virus
cgaugacucuaccugaugaau

SEQ ID NO: 4067951 - RNA, 21 nt, Vaccinia virus
cgaugguuuuuauauguguuu

SEQ ID NO: 4067952 - RNA, 19 nt, Vaccinia virus
cgauguuuaacuuuuguuc

SEQ ID NO: 4067953 - RNA, 19 nt, Vaccinia virus
cgauuuguuuaauuuuuag

SEQ ID NO: 4067954 - RNA, 13 nt, Vaccinia virus
cgcauaaacauua

SEQ ID NO: 4067955 - RNA, 11 nt, Vaccinia virus
cgcauacuuug

SEQ ID NO: 4067956 - RNA, 13 nt, Vaccinia virus
cgcauaucaugaa

SEQ ID NO: 4067957 - RNA, 13 nt, Vaccinia virus
cgcauuaaaugau

SEQ ID NO: 4067958 - RNA, 15 nt, Vaccinia virus
cgccgcguucucugu

SEQ ID NO: 4067959 - RNA, 14 nt, Vaccinia virus
cgccuuuauuucca

SEQ ID NO: 4067960 - RNA, 16 nt, Vaccinia virus
cgcgauaaauucguaa

SEQ ID NO: 4067961 - RNA, 13 nt, Vaccinia virus
cgcgucuguuuua

SEQ ID NO: 4067962 - RNA, 17 nt, Vaccinia virus
cgcuacaauaacucuau

SEQ ID NO: 4067963 - RNA, 21 nt, Vaccinia virus
cgcuauugcacaauuuuguuu

SEQ ID NO: 4067964 - RNA, 15 nt, Vaccinia virus
cgcucuuuugaugau

SEQ ID NO: 4067965 - RNA, 13 nt, Vaccinia virus
cggaaaguauuuu

SEQ ID NO: 4067966 - RNA, 18 nt, Vaccinia virus
cggaauuauuggcuuuca

SEQ ID NO: 4067967 - RNA, 15 nt, Vaccinia virus
cggagauaagacuag

SEQ ID NO: 4067968 - RNA, 13 nt, Vaccinia virus
cggauacgacauc

SEQ ID NO: 4067969 - RNA, 14 nt, Vaccinia virus
cggcacauauuaau

SEQ ID NO: 4067970 - RNA, 18 nt, Vaccinia virus
cggcuauagaaaaguaua

SEQ ID NO: 4067971 - RNA, 22 nt, Vaccinia virus
cgggaacaauauuaguauguua

SEQ ID NO: 4067972 - RNA, 15 nt, Vaccinia virus
cgguaacaaauguuc

SEQ ID NO: 4067973 - RNA, 15 nt, Vaccinia virus
cgguaccuuugucca

SEQ ID NO: 4067974 - RNA, 18 nt, Vaccinia virus
cggugcuguaacauucug

SEQ ID NO: 4067975 - RNA, 15 nt, Vaccinia virus
cgguguaauauuaau

SEQ ID NO: 4067976 - RNA, 16 nt, Vaccinia virus
cgguucuuuaaaagaa

SEQ ID NO: 4067977 - RNA, 16 nt, Vaccinia virus
cguaaaccauuuuuca

SEQ ID NO: 4067978 - RNA, 14 nt, Vaccinia virus
cguaaauacauguc

SEQ ID NO: 4067979 - RNA, 18 nt, Vaccinia virus
cguaagauaaaguuuaua

SEQ ID NO: 4067980 - RNA, 22 nt, Vaccinia virus
cguaauaugcggucuaauuguc

SEQ ID NO: 4067981 - RNA, 17 nt, Vaccinia virus
cguacaaggauuucaag

SEQ ID NO: 4067982 - RNA, 22 nt, Vaccinia virus
cguagaaaguaucuuauauaca

SEQ ID NO: 4067983 - RNA, 21 nt, Vaccinia virus
cguagagaaauaucuauaauu

SEQ ID NO: 4067984 - RNA, 13 nt, Vaccinia virus
cguaguaacucua

SEQ ID NO: 4067985 - RNA, 15 nt, Vaccinia virus
cguaguguauaacaa

SEQ ID NO: 4067986 - RNA, 20 nt, Vaccinia virus
cguauaauucuuuauaacug

SEQ ID NO: 4067987 - RNA, 13 nt, Vaccinia virus
cguauauauuguu

SEQ ID NO: 4067988 - RNA, 18 nt, Vaccinia virus
cguauaucucauuaagcu

SEQ ID NO: 4067989 - RNA, 12 nt, Vaccinia virus
cguauauguuuc

SEQ ID NO: 4067990 - RNA, 16 nt, Vaccinia virus
cguccgguaguauaau

SEQ ID NO: 4067991 - RNA, 17 nt, Vaccinia virus
cgucuauauaguauuuu

SEQ ID NO: 4067992 - RNA, 14 nt, Vaccinia virus
cgucucaaucuuua

SEQ ID NO: 4067993 - RNA, 17 nt, Vaccinia virus
cgucucaucuguuuaag

SEQ ID NO: 4067994 - RNA, 15 nt, Vaccinia virus
cgucuguuuuuguuu

SEQ ID NO: 4067995 - RNA, 13 nt, Vaccinia virus
cgugaaauaaagu

SEQ ID NO: 4067996 - RNA, 14 nt, Vaccinia virus
cgugauagcucccg

SEQ ID NO: 4067997 - RNA, 19 nt, Vaccinia virus
cgugcacccaacguauuua

SEQ ID NO: 4067998 - RNA, 16 nt, Vaccinia virus
cgugcguaauauuguu

SEQ ID NO: 4067999 - RNA, 16 nt, Vaccinia virus
cguggaaucaauaauu

SEQ ID NO: 4068000 - RNA, 22 nt, Vaccinia virus
cguguauuaaauagaauauuua

SEQ ID NO: 4068001 - RNA, 20 nt, Vaccinia virus
cguguucguuugaaugccac

SEQ ID NO: 4068002 - RNA, 17 nt, Vaccinia virus
cguuaaauauaacuggu

SEQ ID NO: 4068003 - RNA, 22 nt, Vaccinia virus
cguuaauaggagcuagaagaac

SEQ ID NO: 4068004 - RNA, 18 nt, Vaccinia virus
cguuagaguuuauacacu

SEQ ID NO: 4068005 - RNA, 16 nt, Vaccinia virus
cguuagaucuauuuua

SEQ ID NO: 4068006 - RNA, 20 nt, Vaccinia virus
cguuagccaccacuucucua

SEQ ID NO: 4068007 - RNA, 16 nt, Vaccinia virus
cguucuuugaugugga

SEQ ID NO: 4068008 - RNA, 11 nt, Vaccinia virus
cguugaugaau

SEQ ID NO: 4068009 - RNA, 15 nt, Vaccinia virus
cguuuaaacagaauu

SEQ ID NO: 4068010 - RNA, 18 nt, Vaccinia virus
cguuuaaaguaaacuucg

SEQ ID NO: 4068011 - RNA, 20 nt, Vaccinia virus
cguuuaaaguaaacuucgua

SEQ ID NO: 4068012 - RNA, 22 nt, Vaccinia virus
cguuucauaaagagaucaggaa

SEQ ID NO: 4068013 - RNA, 13 nt, Vaccinia virus
cguuucuauuuuc

SEQ ID NO: 4068014 - RNA, 14 nt, Vaccinia virus
cguuugaaugccac

SEQ ID NO: 4068015 - RNA, 20 nt, Vaccinia virus
cuaaaaaauagcgcugaaaa

SEQ ID NO: 4068016 - RNA, 13 nt, Vaccinia virus
cuaaaaaauguag

SEQ ID NO: 4068017 - RNA, 16 nt, Vaccinia virus
cuaaaaaauguagaaa

SEQ ID NO: 4068018 - RNA, 12 nt, Vaccinia virus
cuaaaaacugua

SEQ ID NO: 4068019 - RNA, 21 nt, Vaccinia virus
cuaaaacuggagagacugauu

SEQ ID NO: 4068020 - RNA, 23 nt, Vaccinia virus
cuaaaauaguucuguaauauguc

SEQ ID NO: 4068021 - RNA, 20 nt, Vaccinia virus
cuaaaauauuuuuauucuca

SEQ ID NO: 4068022 - RNA, 20 nt, Vaccinia virus
cuaaaauauuuuuuauucuc

SEQ ID NO: 4068023 - RNA, 16 nt, Vaccinia virus
gaagaugcuauaucaa

SEQ ID NO: 4068024 - RNA, 15 nt, Vaccinia virus
gaagauuauauucua

SEQ ID NO: 4068025 - RNA, 21 nt, Vaccinia virus
gaagauuauuauggaaaucaa

SEQ ID NO: 4068026 - RNA, 21 nt, Vaccinia virus
gaagcaacuaaacuaugugau

SEQ ID NO: 4068027 - RNA, 18 nt, Vaccinia virus
gaagcaaugaaaucacuu

SEQ ID NO: 4068028 - RNA, 20 nt, Vaccinia virus
gaagcguauguucccggaca

SEQ ID NO: 4068029 - RNA, 18 nt, Vaccinia virus
gaagcugguaaaguaaau

SEQ ID NO: 4068030 - RNA, 15 nt, Vaccinia virus
gaagugguuaaucuu

SEQ ID NO: 4068031 - RNA, 16 nt, Vaccinia virus
gaaguuaaacugugaa

SEQ ID NO: 4068032 - RNA, 17 nt, Vaccinia virus
gaaguuguauacuauca

SEQ ID NO: 4068033 - RNA, 13 nt, Vaccinia virus
gaaguuuuaaaaa

SEQ ID NO: 4068034 - RNA, 18 nt, Vaccinia virus
gaauaaaacucuacuaua

SEQ ID NO: 4068035 - RNA, 19 nt, Vaccinia virus
gaauaaauuaucaacgaau

SEQ ID NO: 4068036 - RNA, 14 nt, Vaccinia virus
gaauaaauuauuau

SEQ ID NO: 4068037 - RNA, 19 nt, Vaccinia virus
gaauaagaguguaguauca

SEQ ID NO: 4068038 - RNA, 16 nt, Vaccinia virus
gaauaagugugaugau

SEQ ID NO: 4068039 - RNA, 18 nt, Vaccinia virus
gaauaaucguuauuauca

SEQ ID NO: 4068040 - RNA, 18 nt, Vaccinia virus
gaauaauguuucuauguu

SEQ ID NO: 4068041 - RNA, 21 nt, Vaccinia virus
gaauacaaucuguauuucauu

SEQ ID NO: 4068042 - RNA, 18 nt, Vaccinia virus
gaauacgaugauauuaaa

SEQ ID NO: 4068043 - RNA, 17 nt, Vaccinia virus
gaauacgcauguuuuaa

SEQ ID NO: 4068044 - RNA, 23 nt, Vaccinia virus
gaauagccgauauagauauuaaa

SEQ ID NO: 4068045 - RNA, 17 nt, Vaccinia virus
gaauaguaguagcucua

SEQ ID NO: 4068046 - RNA, 16 nt, Vaccinia virus
gaauagugccaucaga

SEQ ID NO: 4068047 - RNA, 20 nt, Vaccinia virus
gaauauaaaauaacuacagu

SEQ ID NO: 4068048 - RNA, 15 nt, Vaccinia virus
gaauauaaaccauau

SEQ ID NO: 4068049 - RNA, 13 nt, Vaccinia virus
gaauauaaaucau

SEQ ID NO: 4068050 - RNA, 19 nt, Vaccinia virus
gaauauaaccacuacauca

SEQ ID NO: 4068051 - RNA, 14 nt, Vaccinia virus
gaauauacaaguau

SEQ ID NO: 4068052 - RNA, 17 nt, Vaccinia virus
gaauauacaaguauuau

SEQ ID NO: 4068053 - RNA, 19 nt, Vaccinia virus
gaauauacuaaucaauaau

SEQ ID NO: 4068054 - RNA, 16 nt, Vaccinia virus
gaauauaucuauaauu

SEQ ID NO: 4068055 - RNA, 22 nt, Vaccinia virus
gaauauauugugacuccagaua

SEQ ID NO: 4068056 - RNA, 13 nt, Vaccinia virus
gaauaucauugcu

SEQ ID NO: 4068057 - RNA, 17 nt, Vaccinia virus
gaauaucugcaauauau

SEQ ID NO: 4068058 - RNA, 22 nt, Vaccinia virus
gaauaucugucuuauauuuaua

SEQ ID NO: 4068059 - RNA, 16 nt, Vaccinia virus
gaauaucuuuauucau

SEQ ID NO: 4068060 - RNA, 15 nt, Vaccinia virus
gaauaugguaugauu

SEQ ID NO: 4068061 - RNA, 17 nt, Vaccinia virus
gaauauguuauaauaga

SEQ ID NO: 4068062 - RNA, 18 nt, Vaccinia virus
gaauauuauuaugaugau

SEQ ID NO: 4068063 - RNA, 11 nt, Vaccinia virus
gaaucagcauc

SEQ ID NO: 4068064 - RNA, 18 nt, Vaccinia virus
gaauccauagaacaaaau

SEQ ID NO: 4068065 - RNA, 15 nt, Vaccinia virus
gaauccgaaauuaga

SEQ ID NO: 4068066 - RNA, 16 nt, Vaccinia virus
gaaucggauaguuuaa

SEQ ID NO: 4068067 - RNA, 20 nt, Vaccinia virus
gaaucugaaaacguauaaau

SEQ ID NO: 4068068 - RNA, 16 nt, Vaccinia virus
gaaugaaauauauaca

SEQ ID NO: 4068069 - RNA, 13 nt, Vaccinia virus
gaaugacauaacu

SEQ ID NO: 4068070 - RNA, 23 nt, Vaccinia virus
gaaugccacgguuccaaguauau

SEQ ID NO: 4068071 - RNA, 20 nt, Vaccinia virus
gaauguaauuuuuguuuccg

SEQ ID NO: 4068072 - RNA, 21 nt, Vaccinia virus
gaaugucauuuguauuuuaua

SEQ ID NO: 4068073 - RNA, 19 nt, Vaccinia virus
gaauguucucaagaacuac

SEQ ID NO: 4068074 - RNA, 17 nt, Vaccinia virus
gaauuaacgagauauau

SEQ ID NO: 4068075 - RNA, 13 nt, Vaccinia virus
gaauuaauaauau

SEQ ID NO: 4068076 - RNA, 17 nt, Vaccinia virus
gaauuaauuaauguuuu

SEQ ID NO: 4068077 - RNA, 15 nt, Vaccinia virus
gaauuagucaaucuu

SEQ ID NO: 4068078 - RNA, 14 nt, Vaccinia virus
gaauucaguaauau

SEQ ID NO: 4068079 - RNA, 17 nt, Vaccinia virus
gaauucauuugauguau

SEQ ID NO: 4068080 - RNA, 15 nt, Vaccinia virus
gaauuccucugaaaa

SEQ ID NO: 4068081 - RNA, 18 nt, Vaccinia virus
gaauucuucaauaaaaug

SEQ ID NO: 4068082 - RNA, 18 nt, Vaccinia virus
gaauugaugaguuguaca

SEQ ID NO: 4068083 - RNA, 18 nt, Vaccinia virus
gaauugguggaaaaagug

SEQ ID NO: 4068084 - RNA, 14 nt, Vaccinia virus
gaauuguaacuuga

SEQ ID NO: 4068085 - RNA, 22 nt, Vaccinia virus
gaauuguacccaaaucugaaaa

SEQ ID NO: 4068086 - RNA, 16 nt, Vaccinia virus
gaauuguuucuuuuag

SEQ ID NO: 4068087 - RNA, 14 nt, Vaccinia virus
gaauuuauaucuaa

SEQ ID NO: 4068088 - RNA, 14 nt, Vaccinia virus
gaauuugauacugu

SEQ ID NO: 4068089 - RNA, 18 nt, Vaccinia virus
gaauuuguuguuucuauu

SEQ ID NO: 4068090 - RNA, 16 nt, Vaccinia virus
gaauuuuaguuauuac

SEQ ID NO: 4068091 - RNA, 19 nt, Vaccinia virus
gaauuuuuaaaaucauuau

SEQ ID NO: 4068092 - RNA, 11 nt, Vaccinia virus
gacaaauguag

SEQ ID NO: 4068093 - RNA, 22 nt, Vaccinia virus
gacaagagacguaaauauucua

SEQ ID NO: 4068094 - RNA, 16 nt, Vaccinia virus
gacaauacuguauuau

SEQ ID NO: 4068095 - RNA, 16 nt, Vaccinia virus
gacaaugaauugcaua

SEQ ID NO: 4068096 - RNA, 15 nt, Vaccinia virus
gacacaaauuauggc

SEQ ID NO: 4068097 - RNA, 15 nt, Vaccinia virus
gacacaucugccaua

SEQ ID NO: 4068098 - RNA, 20 nt, Vaccinia virus
gacacauucuuuagaacuuc

SEQ ID NO: 4068099 - RNA, 22 nt, Vaccinia virus
gacacuaugcgacuuaauacaa

SEQ ID NO: 4068100 - RNA, 15 nt, Vaccinia virus
gacacucuauaucua

SEQ ID NO: 4068101 - RNA, 22 nt, Vaccinia virus
gacacugaacacguuaacgaua

SEQ ID NO: 4068102 - RNA, 13 nt, Vaccinia virus
gacagaaaaaugc

SEQ ID NO: 4068103 - RNA, 18 nt, Vaccinia virus
gacagaaccuugugucau

SEQ ID NO: 4068104 - RNA, 19 nt, Vaccinia virus
gacagacuacguagacugu

SEQ ID NO: 4068105 - RNA, 17 nt, Vaccinia virus
gacagcuauguuaucau

SEQ ID NO: 4068106 - RNA, 24 nt, Vaccinia virus
gacaggcagaacacgucaugcaau

SEQ ID NO: 4068107 - RNA, 23 nt, Vaccinia virus
gacauguucgugguguuaugaaa

SEQ ID NO: 4068108 - RNA, 19 nt, Vaccinia virus
gacauuuggaauguuauau

SEQ ID NO: 4068109 - RNA, 17 nt, Vaccinia virus
gaccaucguuugucaua

SEQ ID NO: 4068110 - RNA, 12 nt, Vaccinia virus
gacccauagaga

SEQ ID NO: 4068111 - RNA, 15 nt, Vaccinia virus
gaccgaauacauaac

SEQ ID NO: 4068112 - RNA, 17 nt, Vaccinia virus
gaccggcaaucaugaau

SEQ ID NO: 4068113 - RNA, 12 nt, Vaccinia virus
gaccguguuucu

SEQ ID NO: 4068114 - RNA, 16 nt, Vaccinia virus
gaccuauuaauaauua

SEQ ID NO: 4068115 - RNA, 22 nt, Vaccinia virus
gaccuauuaauaauuacuuauc

SEQ ID NO: 4068116 - RNA, 15 nt, Vaccinia virus
gacgaacguauugcu

SEQ ID NO: 4068117 - RNA, 16 nt, Vaccinia virus
gacgaguguaaacacu

SEQ ID NO: 4068118 - RNA, 15 nt, Vaccinia virus
gacgauaauaauuua

SEQ ID NO: 4068119 - RNA, 17 nt, Vaccinia virus
gacgcauuuaauagaga

SEQ ID NO: 4068120 - RNA, 17 nt, Vaccinia virus
gacgcguucauuggaaa

SEQ ID NO: 4068121 - RNA, 20 nt, Vaccinia virus
gacgcuauggcacgaaauau

SEQ ID NO: 4068122 - RNA, 13 nt, Vaccinia virus
gacgguaucaugc

SEQ ID NO: 4068123 - RNA, 21 nt, Vaccinia virus
gacguauaagucuauuugaaa

SEQ ID NO: 4068124 - RNA, 20 nt, Vaccinia virus
gacgucaauggcaaaaauau

SEQ ID NO: 4068125 - RNA, 13 nt, Vaccinia virus
gacguuaguucuu

SEQ ID NO: 4068126 - RNA, 14 nt, Vaccinia virus
gacuacgauugcac

SEQ ID NO: 4068127 - RNA, 14 nt, Vaccinia virus
gacuacuuauucua

SEQ ID NO: 4068128 - RNA, 22 nt, Vaccinia virus
gacuauuggaauguguuaaaaa

SEQ ID NO: 4068129 - RNA, 19 nt, Vaccinia virus
gacucaucaacgaugaaaa

SEQ ID NO: 4068130 - RNA, 21 nt, Vaccinia virus
gacucgcguuuagaggaguga

SEQ ID NO: 4068131 - RNA, 15 nt, Vaccinia virus
gacucuagaugaaau

SEQ ID NO: 4068132 - RNA, 19 nt, Vaccinia virus
gacucuauaucuauuucug

SEQ ID NO: 4068133 - RNA, 15 nt, Vaccinia virus
gacucugguauuuau

SEQ ID NO: 4068134 - RNA, 17 nt, Vaccinia virus
gacuguuauaaaaaugc

SEQ ID NO: 4068135 - RNA, 23 nt, Vaccinia virus
gacuuaugucacgaugauggaau

SEQ ID NO: 4068136 - RNA, 22 nt, Vaccinia virus
gacuugucaaaucuauauacca

SEQ ID NO: 4068137 - RNA, 23 nt, Vaccinia virus
gacuuguuagauagagaugagau

SEQ ID NO: 4068138 - RNA, 22 nt, Vaccinia virus
gacuuuaucuaaauuucuagua

SEQ ID NO: 4068139 - RNA, 20 nt, Vaccinia virus
gacuuugucaacuuuguaaa

SEQ ID NO: 4068140 - RNA, 12 nt, Vaccinia virus
gacuuuguuaau

SEQ ID NO: 4068141 - RNA, 17 nt, Vaccinia virus
gagaaaccgaugauuau

SEQ ID NO: 4068142 - RNA, 19 nt, Vaccinia virus
gagaacuaacacaaccagc

SEQ ID NO: 4068143 - RNA, 19 nt, Vaccinia virus
gagaagaagcuaauacccu

SEQ ID NO: 4068144 - RNA, 18 nt, Vaccinia virus
gagaaguaauaaaacgaa

SEQ ID NO: 4068145 - RNA, 17 nt, Vaccinia virus
gagaauaaaaauguuuu

SEQ ID NO: 4068146 - RNA, 14 nt, Vaccinia virus
gagaauuaaaagag

SEQ ID NO: 4068147 - RNA, 14 nt, Vaccinia virus
ucaucuaugugauu

SEQ ID NO: 4068148 - RNA, 16 nt, Vaccinia virus
ucaucucuagauaugu

SEQ ID NO: 4068149 - RNA, 15 nt, Vaccinia virus
ucaucuucuauauaa

SEQ ID NO: 4068150 - RNA, 22 nt, Vaccinia virus
ucaucuuuaguaaacauaucau

SEQ ID NO: 4068151 - RNA, 16 nt, Vaccinia virus
ucaugaaaugaugaua

SEQ ID NO: 4068152 - RNA, 15 nt, Vaccinia virus
ucaugaagagauguu

SEQ ID NO: 4068153 - RNA, 17 nt, Vaccinia virus
ucaugccuuuccuggaa

SEQ ID NO: 4068154 - RNA, 20 nt, Vaccinia virus
ucauguaaccuacuagaaug

SEQ ID NO: 4068155 - RNA, 12 nt, Vaccinia virus
ucauuaaauguu

SEQ ID NO: 4068156 - RNA, 17 nt, Vaccinia virus
ucauuaauaauuucuag

SEQ ID NO: 4068157 - RNA, 12 nt, Vaccinia virus
ucauuagauguu

SEQ ID NO: 4068158 - RNA, 18 nt, Vaccinia virus
ucauucauggaguuagaa

SEQ ID NO: 4068159 - RNA, 22 nt, Vaccinia virus
ucauuccaucauuuaagaaggc

SEQ ID NO: 4068160 - RNA, 14 nt, Vaccinia virus
ucauucuauuaaug

SEQ ID NO: 4068161 - RNA, 14 nt, Vaccinia virus
ucauucucuucuau

SEQ ID NO: 4068162 - RNA, 20 nt, Vaccinia virus
ucauugacagcgguagaugu

SEQ ID NO: 4068163 - RNA, 20 nt, Vaccinia virus
ucauugguugcgucaagaac

SEQ ID NO: 4068164 - RNA, 16 nt, Vaccinia virus
ucauuugcguacccaa

SEQ ID NO: 4068165 - RNA, 23 nt, Vaccinia virus
ucauuuuccagaugauauguaug

SEQ ID NO: 4068166 - RNA, 16 nt, Vaccinia virus
uccaacaauagcuuua

SEQ ID NO: 4068167 - RNA, 22 nt, Vaccinia virus
uccaauaaauuaucaaauacuu

SEQ ID NO: 4068168 - RNA, 15 nt, Vaccinia virus
uccaauaaauuauuu

SEQ ID NO: 4068169 - RNA, 13 nt, Vaccinia virus
uccaaucauauag

SEQ ID NO: 4068170 - RNA, 20 nt, Vaccinia virus
uccaauugaaugucaugaua

SEQ ID NO: 4068171 - RNA, 22 nt, Vaccinia virus
uccaauuuuucagauuuuugaa

SEQ ID NO: 4068172 - RNA, 15 nt, Vaccinia virus
uccacaucaucuagu

SEQ ID NO: 4068173 - RNA, 19 nt, Vaccinia virus
uccaccaucugccauaauc

SEQ ID NO: 4068174 - RNA, 18 nt, Vaccinia virus
uccacguucuuuaauuuu

SEQ ID NO: 4068175 - RNA, 15 nt, Vaccinia virus
uccacuauacauucu

SEQ ID NO: 4068176 - RNA, 13 nt, Vaccinia virus
uccagauauauau

SEQ ID NO: 4068177 - RNA, 15 nt, Vaccinia virus
uccagaugucauaau

SEQ ID NO: 4068178 - RNA, 19 nt, Vaccinia virus
uccaggccguuuguuuccu

SEQ ID NO: 4068179 - RNA, 22 nt, Vaccinia virus
uccagggaaauuaaagaagaag

SEQ ID NO: 4068180 - RNA, 14 nt, Vaccinia virus
uccauaaauuuaua

SEQ ID NO: 4068181 - RNA, 19 nt, Vaccinia virus
uccauaaauuuauaauguu

SEQ ID NO: 4068182 - RNA, 22 nt, Vaccinia virus
uccauauguuuggagcaaauau

SEQ ID NO: 4068183 - RNA, 21 nt, Vaccinia virus
uccauauuuucugguaguguu

SEQ ID NO: 4068184 - RNA, 18 nt, Vaccinia virus
uccaucagaauguuuccc

SEQ ID NO: 4068185 - RNA, 17 nt, Vaccinia virus
uccaucucgcccaucuc

SEQ ID NO: 4068186 - RNA, 20 nt, Vaccinia virus
uccaugacauauuacaaaau

SEQ ID NO: 4068187 - RNA, 15 nt, Vaccinia virus
uccaugaucaagaag

SEQ ID NO: 4068188 - RNA, 15 nt, Vaccinia virus
uccauuaauguggaa

SEQ ID NO: 4068189 - RNA, 22 nt, Vaccinia virus
uccauuauauauuccuugaaua

SEQ ID NO: 4068190 - RNA, 16 nt, Vaccinia virus
uccauuauuaauaaga

SEQ ID NO: 4068191 - RNA, 18 nt, Vaccinia virus
uccauugauaaagaaguu

SEQ ID NO: 4068192 - RNA, 20 nt, Vaccinia virus
uccauuuaaggcuuuaaaau

SEQ ID NO: 4068193 - RNA, 14 nt, Vaccinia virus
uccauuuuacauua

SEQ ID NO: 4068194 - RNA, 14 nt, Vaccinia virus
ucccaaauaucuuu

SEQ ID NO: 4068195 - RNA, 17 nt, Vaccinia virus
ucccaauuccaaagauc

SEQ ID NO: 4068196 - RNA, 11 nt, Vaccinia virus
ucccagcauua

SEQ ID NO: 4068197 - RNA, 17 nt, Vaccinia virus
ucccauauauuccauga

SEQ ID NO: 4068198 - RNA, 23 nt, Vaccinia virus
ucccauggaaugacccaauaagu

SEQ ID NO: 4068199 - RNA, 23 nt, Vaccinia virus
uccgaaaaaguugacuauguuca

SEQ ID NO: 4068200 - RNA, 22 nt, Vaccinia virus
uccgaaauuagaaauucccaag

SEQ ID NO: 4068201 - RNA, 16 nt, Vaccinia virus
uccgaaugaauguuuu

SEQ ID NO: 4068202 - RNA, 18 nt, Vaccinia virus
uccggagacgucaucugu

SEQ ID NO: 4068203 - RNA, 22 nt, Vaccinia virus
uccgggaacauacgcuuccaga

SEQ ID NO: 4068204 - RNA, 16 nt, Vaccinia virus
uccgucaccaaaaaag

SEQ ID NO: 4068205 - RNA, 14 nt, Vaccinia virus
uccguuuacuacaa

SEQ ID NO: 4068206 - RNA, 18 nt, Vaccinia virus
uccguuuauccacaauua

SEQ ID NO: 4068207 - RNA, 15 nt, Vaccinia virus
uccuauacucugaaa

SEQ ID NO: 4068208 - RNA, 21 nt, Vaccinia virus
uccuauauauuugaaaaucgu

SEQ ID NO: 4068209 - RNA, 18 nt, Vaccinia virus
uccuauucccaacaaugu

SEQ ID NO: 4068210 - RNA, 18 nt, Vaccinia virus
uccucauuacguuucauu

SEQ ID NO: 4068211 - RNA, 16 nt, Vaccinia virus
uccucggccauuuuaa

SEQ ID NO: 4068212 - RNA, 16 nt, Vaccinia virus
uccugcguuagauguu

SEQ ID NO: 4068213 - RNA, 15 nt, Vaccinia virus
uccuguacuauacca

SEQ ID NO: 4068214 - RNA, 14 nt, Vaccinia virus
uccuguuaauaacu

SEQ ID NO: 4068215 - RNA, 11 nt, Vaccinia virus
uccuguuucau

SEQ ID NO: 4068216 - RNA, 13 nt, Vaccinia virus
uccuuaaaguaac

SEQ ID NO: 4068217 - RNA, 16 nt, Vaccinia virus
uccuucauucauuaga

SEQ ID NO: 4068218 - RNA, 16 nt, Vaccinia virus
uccuuccaacauaaua

SEQ ID NO: 4068219 - RNA, 13 nt, Vaccinia virus
uccuuccaaugau

SEQ ID NO: 4068220 - RNA, 13 nt, Vaccinia virus
uccuuucuaaaau

SEQ ID NO: 4068221 - RNA, 16 nt, Vaccinia virus
uccuuugauuaucauc

SEQ ID NO: 4068222 - RNA, 20 nt, Vaccinia virus
ucgaaaauugcuauuucaga

SEQ ID NO: 4068223 - RNA, 20 nt, Vaccinia virus
ucgaaaucgcgacuccggaa

SEQ ID NO: 4068224 - RNA, 11 nt, Vaccinia virus
ucgaauacagu

SEQ ID NO: 4068225 - RNA, 12 nt, Vaccinia virus
ucgaauacuuau

SEQ ID NO: 4068226 - RNA, 14 nt, Vaccinia virus
ucgacaguguauac

SEQ ID NO: 4068227 - RNA, 12 nt, Vaccinia virus
ucgacauauuaa

SEQ ID NO: 4068228 - RNA, 22 nt, Vaccinia virus
ucgacauccgucaaaaccaauu

SEQ ID NO: 4068229 - RNA, 19 nt, Vaccinia virus
ucgacaucuggauuucaga

SEQ ID NO: 4068230 - RNA, 14 nt, Vaccinia virus
ucgacgacauuaag

SEQ ID NO: 4068231 - RNA, 12 nt, Vaccinia virus
ucgacuguuacu

SEQ ID NO: 4068232 - RNA, 16 nt, Vaccinia virus
ucgauaacucuauuca

SEQ ID NO: 4068233 - RNA, 11 nt, Vaccinia virus
ucgauacuuuu

SEQ ID NO: 4068234 - RNA, 12 nt, Vaccinia virus
ucgauauacaaa

SEQ ID NO: 4068235 - RNA, 20 nt, Vaccinia virus
ucgaucaaaagacuauacau

SEQ ID NO: 4068236 - RNA, 21 nt, Vaccinia virus
ucgaucaaaagacuauacauu

SEQ ID NO: 4068237 - RNA, 20 nt, Vaccinia virus
ucgaugaaauaucugauguu

SEQ ID NO: 4068238 - RNA, 20 nt, Vaccinia virus
ucgauuccguccaagaugau

SEQ ID NO: 4068239 - RNA, 12 nt, Vaccinia virus
ucgcaaauuccg

SEQ ID NO: 4068240 - RNA, 19 nt, Vaccinia virus
ucgcaacauuaacaucuug

SEQ ID NO: 4068241 - RNA, 20 nt, Vaccinia virus
ucgcauaaacauuacuaaaa

SEQ ID NO: 4068242 - RNA, 17 nt, Vaccinia virus
ucgcauauaacaacaaa

SEQ ID NO: 4068243 - RNA, 20 nt, Vaccinia virus
ucgcauuguacgauguagua

SEQ ID NO: 4068244 - RNA, 21 nt, Vaccinia virus
ucgcuuucugguaacaugaua

SEQ ID NO: 4068245 - RNA, 17 nt, Vaccinia virus
ucggauccuuuguacag

SEQ ID NO: 4068246 - RNA, 12 nt, Vaccinia virus
ucggcucaaaga

SEQ ID NO: 4068247 - RNA, 21 nt, Vaccinia virus
ucgguaucuagaucucuagaa

SEQ ID NO: 4068248 - RNA, 16 nt, Vaccinia virus
ucgguucuuuaaaaga

SEQ ID NO: 4068249 - RNA, 17 nt, Vaccinia virus
ucguaagauaaaguuua

SEQ ID NO: 4068250 - RNA, 15 nt, Vaccinia virus
ucguacuauauacaa

SEQ ID NO: 4068251 - RNA, 12 nt, Vaccinia virus
ucguagaaagua

SEQ ID NO: 4068252 - RNA, 14 nt, Vaccinia virus
ucguauaaaguuau

SEQ ID NO: 4068253 - RNA, 19 nt, Vaccinia virus
ucgucaaaauauuuacuaa

SEQ ID NO: 4068254 - RNA, 14 nt, Vaccinia virus
ucguccuuaaccaa

SEQ ID NO: 4068255 - RNA, 13 nt, Vaccinia virus
ucgucuacuauuc

SEQ ID NO: 4068256 - RNA, 13 nt, Vaccinia virus
ucgucucaucugu

SEQ ID NO: 4068257 - RNA, 19 nt, Vaccinia virus
ucgucugugaaacaucacg

SEQ ID NO: 4068258 - RNA, 18 nt, Vaccinia virus
ucgugaaauaggaauaau

SEQ ID NO: 4068259 - RNA, 14 nt, Vaccinia virus
ucgugaauaauguu

SEQ ID NO: 4068260 - RNA, 13 nt, Vaccinia virus
ucgugaauacuug

SEQ ID NO: 4068261 - RNA, 20 nt, Vaccinia virus
ucgugcagaggauaguuguu

SEQ ID NO: 4068262 - RNA, 20 nt, Vaccinia virus
ucguggauaaucauucuuaa

SEQ ID NO: 4068263 - RNA, 13 nt, Vaccinia virus
ucguguucuacau

SEQ ID NO: 4068264 - RNA, 14 nt, Vaccinia virus
ucguuaaaaaguuu

SEQ ID NO: 4068265 - RNA, 11 nt, Vaccinia virus
ucguuaaugaa

SEQ ID NO: 4068266 - RNA, 16 nt, Vaccinia virus
ucguucaaauuuuuaa

SEQ ID NO: 4068267 - RNA, 23 nt, Vaccinia virus
ucguuccaagucauaucuagaau

SEQ ID NO: 4068268 - RNA, 17 nt, Vaccinia virus
ucguuccgccaaauuuu

SEQ ID NO: 4068269 - RNA, 22 nt, Vaccinia virus
ucguugacaucuaguauugaua

SEQ ID NO: 4068270 - RNA, 12 nt, Vaccinia virus
ucguuguagaaa

SEQ ID NO: 4068271 - RNA, 16 nt, Vaccinia virus
ucguuguccuuuacau

SEQ ID NO: 4068272 - RNA, 23 nt, Vaccinia virus
ugcacaauccaaacuuuuucaca

SEQ ID NO: 4068273 - RNA, 13 nt, Vaccinia virus
ugcaccagaauua

SEQ ID NO: 4068274 - RNA, 17 nt, Vaccinia virus
ugcacguuuacauaucu

SEQ ID NO: 4068275 - RNA, 18 nt, Vaccinia virus
ugcacuuaaagucuacau

SEQ ID NO: 4068276 - RNA, 14 nt, Vaccinia virus
ugcagaauauuucu

SEQ ID NO: 4068277 - RNA, 16 nt, Vaccinia virus
ugcauaaucagauucu

SEQ ID NO: 4068278 - RNA, 23 nt, Vaccinia virus
ugcauacaauacuagucuagaaa

SEQ ID NO: 4068279 - RNA, 18 nt, Vaccinia virus
ugcauaucuuuuucaaca

SEQ ID NO: 4068280 - RNA, 22 nt, Vaccinia virus
ugcaucaacaauuacaaaugag

SEQ ID NO: 4068281 - RNA, 15 nt, Vaccinia virus
ugcauguuucauaac

SEQ ID NO: 4068282 - RNA, 14 nt, Vaccinia virus
ugcauguuugcucu

SEQ ID NO: 4068283 - RNA, 20 nt, Vaccinia virus
ugcauugacuuuguuaguga

SEQ ID NO: 4068284 - RNA, 14 nt, Vaccinia virus
ugcauuucuacaaa

SEQ ID NO: 4068285 - RNA, 19 nt, Vaccinia virus
ugccaaaucuauaagaaaa

SEQ ID NO: 4068286 - RNA, 12 nt, Vaccinia virus
ugccacaaauga

SEQ ID NO: 4068287 - RNA, 22 nt, Vaccinia virus
ugccauaauuuucauauauuga

SEQ ID NO: 4068288 - RNA, 18 nt, Vaccinia virus
ugccuauuaggacagaua

SEQ ID NO: 4068289 - RNA, 14 nt, Vaccinia virus
ugcgaucaauaaau

SEQ ID NO: 4068290 - RNA, 21 nt, Vaccinia virus
ugcggauaugauccaagaggg

SEQ ID NO: 4068291 - RNA, 17 nt, Vaccinia virus
ugcuaauacgaauauua

SEQ ID NO: 4068292 - RNA, 15 nt, Vaccinia virus
ugcucggcaauaacu

SEQ ID NO: 4068293 - RNA, 22 nt, Vaccinia virus
ugcucuacaugcgguaaagaua

SEQ ID NO: 4068294 - RNA, 15 nt, Vaccinia virus
ugcuuaauguuucca

SEQ ID NO: 4068295 - RNA, 15 nt, Vaccinia virus
ugcuuacuagauguu

SEQ ID NO: 4068296 - RNA, 17 nt, Vaccinia virus
ugcuuccgaucccaaau

SEQ ID NO: 4068297 - RNA, 23 nt, Vaccinia virus
ugcuuuccuuguugaugaaggau

SEQ ID NO: 4068298 - RNA, 22 nt, Vaccinia virus
ugcuuuuaucaggauaaauaca

SEQ ID NO: 4068299 - RNA, 21 nt, Vaccinia virus
ugcuuuucuauaaucaucuua

SEQ ID NO: 4068300 - RNA, 18 nt, Vaccinia virus
uggaaaagauaacuauug

SEQ ID NO: 4068301 - RNA, 16 nt, Vaccinia virus
uggaaaggaaauuaug

SEQ ID NO: 4068302 - RNA, 21 nt, Vaccinia virus
uggaaauacuuccaucaacau

SEQ ID NO: 4068303 - RNA, 13 nt, Vaccinia virus
uggaaaugucaua

SEQ ID NO: 4068304 - RNA, 12 nt, Vaccinia virus
uggaaauuauuu

SEQ ID NO: 4068305 - RNA, 23 nt, Vaccinia virus
uggaacuccuauuggaauuauuu

SEQ ID NO: 4068306 - RNA, 23 nt, Vaccinia virus
uggaagacagccgucucuacaua

SEQ ID NO: 4068307 - RNA, 20 nt, Vaccinia virus
uggaagcugaacacauuaaa

SEQ ID NO: 4068308 - RNA, 19 nt, Vaccinia virus
uggaauagaugaaggaaua

SEQ ID NO: 4068309 - RNA, 14 nt, Vaccinia virus
uggaauuaacuauc

SEQ ID NO: 4068310 - RNA, 19 nt, Vaccinia virus
uggagaaucgucuaucuuu

SEQ ID NO: 4068311 - RNA, 21 nt, Vaccinia virus
uggagaucauuaaauguuuca

SEQ ID NO: 4068312 - RNA, 17 nt, Vaccinia virus
uggagcgaguguuacaa

SEQ ID NO: 4068313 - RNA, 22 nt, Vaccinia virus
uggaguugauucauaacgaaaa

SEQ ID NO: 4068314 - RNA, 16 nt, Vaccinia virus
uggauauggguuucca

SEQ ID NO: 4068315 - RNA, 19 nt, Vaccinia virus
uggauauguggaaaaguau

SEQ ID NO: 4068316 - RNA, 14 nt, Vaccinia virus
uggaugaggaauga

SEQ ID NO: 4068317 - RNA, 22 nt, Vaccinia virus
uggaugaggaaugagagugaua

SEQ ID NO: 4068318 - RNA, 19 nt, Vaccinia virus
uggauguacggcuuuacau

SEQ ID NO: 4068319 - RNA, 21 nt, Vaccinia virus
uggaugucaucaauguagaaa

SEQ ID NO: 4068320 - RNA, 21 nt, Vaccinia virus
uggauuauaaauauugauguu

SEQ ID NO: 4068321 - RNA, 12 nt, Vaccinia virus
uggauuuggauu

SEQ ID NO: 4068322 - RNA, 13 nt, Vaccinia virus
uggcaaauuauuu

SEQ ID NO: 4068323 - RNA, 20 nt, Vaccinia virus
uggcauagacuuauacugug

SEQ ID NO: 4068324 - RNA, 13 nt, Vaccinia virus
uggccgacgucag

SEQ ID NO: 4068325 - RNA, 22 nt, Vaccinia virus
uggcggaguaaguguugagcuc

SEQ ID NO: 4068326 - RNA, 15 nt, Vaccinia virus
uggcggcuagaaugg

SEQ ID NO: 4068327 - RNA, 15 nt, Vaccinia virus
uggcuauuucaaaau

SEQ ID NO: 4068328 - RNA, 21 nt, Vaccinia virus
uggcuucuuccauaguuagaa

SEQ ID NO: 4068329 - RNA, 20 nt, Vaccinia virus
uggcuuuguagauuuggaua

SEQ ID NO: 4068330 - RNA, 18 nt, Vaccinia virus
ugggaauauauuuggauu

SEQ ID NO: 4068331 - RNA, 21 nt, Vaccinia virus
ugggacuauuggaauguguua

SEQ ID NO: 4068332 - RNA, 22 nt, Vaccinia virus
ugggauaaaaauuauguuuuua

SEQ ID NO: 4068333 - RNA, 16 nt, Vaccinia virus
ugggguuacucuaaau

SEQ ID NO: 4068334 - RNA, 10 nt, Vaccinia virus
ugguaaaaua

SEQ ID NO: 4068335 - RNA, 14 nt, Vaccinia virus
ugguaauuaaauau

SEQ ID NO: 4068336 - RNA, 19 nt, Vaccinia virus
ugguacaaaaaauaucaug

SEQ ID NO: 4068337 - RNA, 17 nt, Vaccinia virus
ugguacgaaauauauug

SEQ ID NO: 4068338 - RNA, 22 nt, Vaccinia virus
uggucaauagcgauaugugauu

SEQ ID NO: 4068339 - RNA, 21 nt, Vaccinia virus
uggucuagauguaaaaaaugu

SEQ ID NO: 4068340 - RNA, 12 nt, Vaccinia virus
uggugaaagagu

SEQ ID NO: 4068341 - RNA, 23 nt, Vaccinia virus
ugguguccuaguacacaauauca

SEQ ID NO: 4068342 - RNA, 18 nt, Vaccinia virus
ugguuccacaauucauuu

SEQ ID NO: 4068343 - RNA, 14 nt, Vaccinia virus
ugguuuaauuauuu

SEQ ID NO: 4068344 - RNA, 15 nt, Vaccinia virus
ugguuuauauuacca

SEQ ID NO: 4068345 - RNA, 15 nt, Vaccinia virus
ugguuucuaaaucua

SEQ ID NO: 4068346 - RNA, 16 nt, Vaccinia virus
uguaaaaucaugauuc

SEQ ID NO: 4068347 - RNA, 13 nt, Vaccinia virus
uguaaauaucuuu

SEQ ID NO: 4068348 - RNA, 19 nt, Vaccinia virus
uguaaaugauuuuguagau

SEQ ID NO: 4068349 - RNA, 19 nt, Vaccinia virus
uguaaauuaggagaaacaa

SEQ ID NO: 4068350 - RNA, 20 nt, Vaccinia virus
uguaaauuuuaucaugugua

SEQ ID NO: 4068351 - RNA, 24 nt, Vaccinia virus
uguaacgcgucuguuuuauacauu

SEQ ID NO: 4068352 - RNA, 20 nt, Vaccinia virus
uguaacugcuacuugggaua

SEQ ID NO: 4068353 - RNA, 19 nt, Vaccinia virus
uguaaucuuauuaacuguu

SEQ ID NO: 4068354 - RNA, 17 nt, Vaccinia virus
uguaauugugacaucau

SEQ ID NO: 4068355 - RNA, 15 nt, Vaccinia virus
uguaauuuuaacaua

SEQ ID NO: 4068356 - RNA, 15 nt, Vaccinia virus
uguacacauaguguu

SEQ ID NO: 4068357 - RNA, 18 nt, Vaccinia virus
uguacgauacauaauguu

SEQ ID NO: 4068358 - RNA, 19 nt, Vaccinia virus
uguacgauggauucauccu

SEQ ID NO: 4068359 - RNA, 22 nt, Vaccinia virus
uguacgauggauucauccuguu

SEQ ID NO: 4068360 - RNA, 22 nt, Vaccinia virus
uguacgauguaguaguaacugu

SEQ ID NO: 4068361 - RNA, 17 nt, Vaccinia virus
uguagaugguucuuuaa

SEQ ID NO: 4068362 - RNA, 20 nt, Vaccinia virus
uguagcucucccagauuucu

SEQ ID NO: 4068363 - RNA, 19 nt, Vaccinia virus
uguauaaaccuuuuucaga

SEQ ID NO: 4068364 - RNA, 18 nt, Vaccinia virus
uguauaacagagccaucu

SEQ ID NO: 4068365 - RNA, 19 nt, Vaccinia virus
uguauaacaugacauuuau

SEQ ID NO: 4068366 - RNA, 16 nt, Vaccinia virus
uguauaaucaacucua

SEQ ID NO: 4068367 - RNA, 18 nt, Vaccinia virus
uguauacaccaacaguau

SEQ ID NO: 4068368 - RNA, 19 nt, Vaccinia virus
uguauagacaauuauguaa

SEQ ID NO: 4068369 - RNA, 23 nt, Vaccinia virus
uguauauuauaaagauauguacg

SEQ ID NO: 4068370 - RNA, 19 nt, Vaccinia virus
uguaucaaacaguuuggua

SEQ ID NO: 4068371 - RNA, 23 nt, Vaccinia virus
uguaucaaagacauuaauacuuu

SEQ ID NO: 4068372 - RNA, 16 nt, Vaccinia virus
uguaucagacgauaau

SEQ ID NO: 4068373 - RNA, 15 nt, Vaccinia virus
uguaucaguuucgua

SEQ ID NO: 4068374 - RNA, 20 nt, Vaccinia virus
uguaucauaauauuaaucau

SEQ ID NO: 4068375 - RNA, 20 nt, Vaccinia virus
uguaucauuuagcgauucaa

SEQ ID NO: 4068376 - RNA, 22 nt, Vaccinia virus
uguauccacuuuaauaauauca

SEQ ID NO: 4068377 - RNA, 14 nt, Vaccinia virus
uguaugaaaugcuu

SEQ ID NO: 4068378 - RNA, 18 nt, Vaccinia virus
uguaugauaaaauucuua

SEQ ID NO: 4068379 - RNA, 19 nt, Vaccinia virus
uguaugcaaccguaucaaa

SEQ ID NO: 4068380 - RNA, 17 nt, Vaccinia virus
uguaugucucaauacua

SEQ ID NO: 4068381 - RNA, 22 nt, Vaccinia virus
uguaugugcauucuuuaugaca

SEQ ID NO: 4068382 - RNA, 17 nt, Vaccinia virus
uguauucaacaugcuuu

SEQ ID NO: 4068383 - RNA, 18 nt, Vaccinia virus
uguauucacuuaacaguu

SEQ ID NO: 4068384 - RNA, 13 nt, Vaccinia virus
uguauuccaaauu

SEQ ID NO: 4068385 - RNA, 15 nt, Vaccinia virus
uguauucucuuacaa

SEQ ID NO: 4068386 - RNA, 17 nt, Vaccinia virus
uguauucuuuuuaagau

SEQ ID NO: 4068387 - RNA, 19 nt, Vaccinia virus
uguauugauuacaguguau

SEQ ID NO: 4068388 - RNA, 15 nt, Vaccinia virus
uguauugcacauguu

SEQ ID NO: 4068389 - RNA, 21 nt, Vaccinia virus
uguauuggauccuuugacuau

SEQ ID NO: 4068390 - RNA, 17 nt, Vaccinia virus
uguauuuauaaccuuuu

SEQ ID NO: 4068391 - RNA, 11 nt, Vaccinia virus
uguauuuccau

SEQ ID NO: 4068392 - RNA, 12 nt, Vaccinia virus
ugucaacaaugu

SEQ ID NO: 4068393 - RNA, 22 nt, Vaccinia virus
ugucagagcacaagauuuccaa

SEQ ID NO: 4068394 - RNA, 15 nt, Vaccinia virus
ugucauuuauacguu

SEQ ID NO: 4068395 - RNA, 17 nt, Vaccinia virus
aaacucaauuauacucu

SEQ ID NO: 4068396 - RNA, 16 nt, Vaccinia virus
aaacucgcuuaauauc

SEQ ID NO: 4068397 - RNA, 18 nt, Vaccinia virus
aaacucguaaaaagauua

SEQ ID NO: 4068398 - RNA, 14 nt, Vaccinia virus
aaacucuuuucaaa

SEQ ID NO: 4068399 - RNA, 16 nt, Vaccinia virus
aaacugcugugaauac

SEQ ID NO: 4068400 - RNA, 14 nt, Vaccinia virus
aaacugugaauguc

SEQ ID NO: 4068401 - RNA, 15 nt, Vaccinia virus
aaacuguuuauucca

SEQ ID NO: 4068402 - RNA, 19 nt, Vaccinia virus
aaacuuccauggaaaaacg

SEQ ID NO: 4068403 - RNA, 14 nt, Vaccinia virus
aaacuugacauuua

SEQ ID NO: 4068404 - RNA, 21 nt, Vaccinia virus
aaacuugguauuuuuugguuc

SEQ ID NO: 4068405 - RNA, 19 nt, Vaccinia virus
aaacuuguaagaaguaaau

SEQ ID NO: 4068406 - RNA, 22 nt, Vaccinia virus
aaacuuuagaagaauaucucaa

SEQ ID NO: 4068407 - RNA, 11 nt, Vaccinia virus
aaacuuuaucc

SEQ ID NO: 4068408 - RNA, 13 nt, Vaccinia virus
aaacuuuuagaaa

SEQ ID NO: 4068409 - RNA, 15 nt, Vaccinia virus
aaagaaaaacacauu

SEQ ID NO: 4068410 - RNA, 14 nt, Vaccinia virus
aaagaaaucuuaug

SEQ ID NO: 4068411 - RNA, 16 nt, Vaccinia virus
aaagaggaucguacau

SEQ ID NO: 4068412 - RNA, 20 nt, Vaccinia virus
aaagaguacaaccucauacu

SEQ ID NO: 4068413 - RNA, 22 nt, Vaccinia virus
aaagaguauggugaaugacucu

SEQ ID NO: 4068414 - RNA, 14 nt, Vaccinia virus
aaagauagaaauga

SEQ ID NO: 4068415 - RNA, 15 nt, Vaccinia virus
aaagaucaaggaaau

SEQ ID NO: 4068416 - RNA, 12 nt, Vaccinia virus
aaagaucauauu

SEQ ID NO: 4068417 - RNA, 19 nt, Vaccinia virus
aaagaugcuauguauauau

SEQ ID NO: 4068418 - RNA, 15 nt, Vaccinia virus
aaagauggcugaaau

SEQ ID NO: 4068419 - RNA, 16 nt, Vaccinia virus
aaagauggucuaaaau

SEQ ID NO: 4068420 - RNA, 12 nt, Vaccinia virus
aaagauguuaug

SEQ ID NO: 4068421 - RNA, 16 nt, Vaccinia virus
aaagauuaauacauua

SEQ ID NO: 4068422 - RNA, 20 nt, Vaccinia virus
aaagauuaccguaugauaug

SEQ ID NO: 4068423 - RNA, 20 nt, Vaccinia virus
aaagauucuauaauaaugaa

SEQ ID NO: 4068424 - RNA, 18 nt, Vaccinia virus
aaagcaauacgauuuaug

SEQ ID NO: 4068425 - RNA, 18 nt, Vaccinia virus
aaagcaguuaccaaagag

SEQ ID NO: 4068426 - RNA, 15 nt, Vaccinia virus
aaagcaucauacgaa

SEQ ID NO: 4068427 - RNA, 20 nt, Vaccinia virus
aaagcauuaauacaguuaug

SEQ ID NO: 4068428 - RNA, 16 nt, Vaccinia virus
aaagcccauauauguu

SEQ ID NO: 4068429 - RNA, 19 nt, Vaccinia virus
aaagcggggucgaucuugu

SEQ ID NO: 4068430 - RNA, 19 nt, Vaccinia virus
aaagcugggggauguucug

SEQ ID NO: 4068431 - RNA, 20 nt, Vaccinia virus
aaaggaagaauaucauauua

SEQ ID NO: 4068432 - RNA, 23 nt, Vaccinia virus
aaaggcggucacgucgucaaaau

SEQ ID NO: 4068433 - RNA, 24 nt, Vaccinia virus
aaaggggugagaauguuccagagu

SEQ ID NO: 4068434 - RNA, 14 nt, Vaccinia virus
aaaguaaaaaagaa

SEQ ID NO: 4068435 - RNA, 19 nt, Vaccinia virus
aaaguauccucuacucauu

SEQ ID NO: 4068436 - RNA, 20 nt, Vaccinia virus
aaagucguuuauaucacauu

SEQ ID NO: 4068437 - RNA, 14 nt, Vaccinia virus
aaagugcaaaugag

SEQ ID NO: 4068438 - RNA, 22 nt, Vaccinia virus
aaaguuaggguucuuguuccau

SEQ ID NO: 4068439 - RNA, 16 nt, Vaccinia virus
aaaguuaguacagaag

SEQ ID NO: 4068440 - RNA, 14 nt, Vaccinia virus
aaaguucaacauga

SEQ ID NO: 4068441 - RNA, 15 nt, Vaccinia virus
aaaguuucacaugaa

SEQ ID NO: 4068442 - RNA, 23 nt, Vaccinia virus
aaauaaaauauaaaauauuggaa

SEQ ID NO: 4068443 - RNA, 13 nt, Vaccinia virus
aaauaaaaugagu

SEQ ID NO: 4068444 - RNA, 18 nt, Vaccinia virus
aaauaacaguaucauuua

SEQ ID NO: 4068445 - RNA, 16 nt, Vaccinia virus
aaauaaguaaaaagug

SEQ ID NO: 4068446 - RNA, 15 nt, Vaccinia virus
aaauaaguaguuaug

SEQ ID NO: 4068447 - RNA, 22 nt, Vaccinia virus
aaauaauccugaauauauugau

SEQ ID NO: 4068448 - RNA, 15 nt, Vaccinia virus
aaauaauuauuagaa

SEQ ID NO: 4068449 - RNA, 17 nt, Vaccinia virus
aaauacgaaaacgauau

SEQ ID NO: 4068450 - RNA, 15 nt, Vaccinia virus
aaauacuuccaucaa

SEQ ID NO: 4068451 - RNA, 15 nt, Vaccinia virus
aaauacuucuuggaa

SEQ ID NO: 4068452 - RNA, 13 nt, Vaccinia virus
aaauagaacuuau

SEQ ID NO: 4068453 - RNA, 16 nt, Vaccinia virus
aaauagagagcuauau

SEQ ID NO: 4068454 - RNA, 14 nt, Vaccinia virus
aaauagauuauuua

SEQ ID NO: 4068455 - RNA, 19 nt, Vaccinia virus
aaauagcggacagcuauau

SEQ ID NO: 4068456 - RNA, 21 nt, Vaccinia virus
aaauagcucuuaguaugggaa

SEQ ID NO: 4068457 - RNA, 22 nt, Vaccinia virus
aaauaggaguuagaauaauaau

SEQ ID NO: 4068458 - RNA, 16 nt, Vaccinia virus
aaauaggguuguguau

SEQ ID NO: 4068459 - RNA, 17 nt, Vaccinia virus
aaauaggguuguguaua

SEQ ID NO: 4068460 - RNA, 18 nt, Vaccinia virus
aaauagguuuuguucuau

SEQ ID NO: 4068461 - RNA, 20 nt, Vaccinia virus
aaauauauaguauuaaugau

SEQ ID NO: 4068462 - RNA, 14 nt, Vaccinia virus
aaauaucgauguuu

SEQ ID NO: 4068463 - RNA, 16 nt, Vaccinia virus
aaauaucuauaugauu

SEQ ID NO: 4068464 - RNA, 11 nt, Vaccinia virus
aaauaucucau

SEQ ID NO: 4068465 - RNA, 22 nt, Vaccinia virus
aaauaucuuaaggagaaugaaa

SEQ ID NO: 4068466 - RNA, 17 nt, Vaccinia virus
aaauauguaauaaucau

SEQ ID NO: 4068467 - RNA, 12 nt, Vaccinia virus
aaauauucauua

SEQ ID NO: 4068468 - RNA, 20 nt, Vaccinia virus
aaauauuuagaaauugaaau

SEQ ID NO: 4068469 - RNA, 14 nt, Vaccinia virus
aaaucaauccacua

SEQ ID NO: 4068470 - RNA, 21 nt, Vaccinia virus
aaaucagauaucgauguuaua

SEQ ID NO: 4068471 - RNA, 22 nt, Vaccinia virus
aaaucauuaacggauagcaaaa

SEQ ID NO: 4068472 - RNA, 23 nt, Vaccinia virus
aaaucauuauauaguguugcuau

SEQ ID NO: 4068473 - RNA, 16 nt, Vaccinia virus
aaaucauuguguuuau

SEQ ID NO: 4068474 - RNA, 21 nt, Vaccinia virus
aaauccuuguuugauaaaugu

SEQ ID NO: 4068475 - RNA, 19 nt, Vaccinia virus
aaaucguuaguagauguuu

SEQ ID NO: 4068476 - RNA, 17 nt, Vaccinia virus
aaaucuaacagauacaa

SEQ ID NO: 4068477 - RNA, 19 nt, Vaccinia virus
aaaucuaacagauacaaau

SEQ ID NO: 4068478 - RNA, 16 nt, Vaccinia virus
aaaucuagagguagaa

SEQ ID NO: 4068479 - RNA, 12 nt, Vaccinia virus
aaaucuugugaa

SEQ ID NO: 4068480 - RNA, 18 nt, Vaccinia virus
aaaugaaucccaaacauu

SEQ ID NO: 4068481 - RNA, 21 nt, Vaccinia virus
aaaugauaacuagauagaaag

SEQ ID NO: 4068482 - RNA, 17 nt, Vaccinia virus
aaaugauagaaauauau

SEQ ID NO: 4068483 - RNA, 20 nt, Vaccinia virus
aaaugaucauacucauuuau

SEQ ID NO: 4068484 - RNA, 18 nt, Vaccinia virus
aaaugauuaucaaacaca

SEQ ID NO: 4068485 - RNA, 14 nt, Vaccinia virus
aaaugauuuuggaa

SEQ ID NO: 4068486 - RNA, 20 nt, Vaccinia virus
aaaugcaagcaucuuguuaa

SEQ ID NO: 4068487 - RNA, 16 nt, Vaccinia virus
aaaugcgucaaucaua

SEQ ID NO: 4068488 - RNA, 15 nt, Vaccinia virus
aaaugcuaaauaugc

SEQ ID NO: 4068489 - RNA, 17 nt, Vaccinia virus
aaaugcugaagcaauaa

SEQ ID NO: 4068490 - RNA, 15 nt, Vaccinia virus
aaauggauauuucca

SEQ ID NO: 4068491 - RNA, 16 nt, Vaccinia virus
aaauguauaaaaaacu

SEQ ID NO: 4068492 - RNA, 21 nt, Vaccinia virus
aaauguauaacaaauacagaa

SEQ ID NO: 4068493 - RNA, 19 nt, Vaccinia virus
aaaugucacuauuaaagau

SEQ ID NO: 4068494 - RNA, 18 nt, Vaccinia virus
aaauguccguuauauaau

SEQ ID NO: 4068495 - RNA, 14 nt, Vaccinia virus
aaauguguaauaau

SEQ ID NO: 4068496 - RNA, 19 nt, Vaccinia virus
aaauguuaccggauuuaug

SEQ ID NO: 4068497 - RNA, 14 nt, Vaccinia virus
aaauguuugaucaa

SEQ ID NO: 4068498 - RNA, 14 nt, Vaccinia virus
aaauuaaaaaagau

SEQ ID NO: 4068499 - RNA, 22 nt, Vaccinia virus
aaauuaacagauaaaaagacuu

SEQ ID NO: 4068500 - RNA, 16 nt, Vaccinia virus
aaauuaauuauuguau

SEQ ID NO: 4068501 - RNA, 14 nt, Vaccinia virus
aaauuauccuauca

SEQ ID NO: 4068502 - RNA, 18 nt, Vaccinia virus
aaauuaugaaaaaaagau

SEQ ID NO: 4068503 - RNA, 18 nt, Vaccinia virus
aaauuauggcguuuguau

SEQ ID NO: 4068504 - RNA, 21 nt, Vaccinia virus
aaauuauucauucuagaacua

SEQ ID NO: 4068505 - RNA, 16 nt, Vaccinia virus
aaauucccauucuaau

SEQ ID NO: 4068506 - RNA, 18 nt, Vaccinia virus
aaauucuaggcucaguau

SEQ ID NO: 4068507 - RNA, 21 nt, Vaccinia virus
aaauucuuaguuauauauacu

SEQ ID NO: 4068508 - RNA, 13 nt, Vaccinia virus
aaauugaaaauaa

SEQ ID NO: 4068509 - RNA, 13 nt, Vaccinia virus
aaauugcaaaaua

SEQ ID NO: 4068510 - RNA, 21 nt, Vaccinia virus
aaauuggaaggauauacaaag

SEQ ID NO: 4068511 - RNA, 19 nt, Vaccinia virus
aaauuugcaucuacaucau

SEQ ID NO: 4068512 - RNA, 21 nt, Vaccinia virus
aaauuuuacccgccuucgaau

SEQ ID NO: 4068513 - RNA, 23 nt, Vaccinia virus
aaauuuuguugauuacucuuuuu

SEQ ID NO: 4068514 - RNA, 16 nt, Vaccinia virus
aaauuuuuuucauuga

SEQ ID NO: 4068515 - RNA, 17 nt, Vaccinia virus
aaauuuuuuuucaguua

SEQ ID NO: 4068516 - RNA, 13 nt, Vaccinia virus
aacaaaaauugau

SEQ ID NO: 4068517 - RNA, 12 nt, Vaccinia virus
aacaaacagcaa

SEQ ID NO: 4068518 - RNA, 15 nt, Vaccinia virus
aacaaaguuauucau

SEQ ID NO: 4068519 - RNA, 18 nt, Vaccinia virus
aacaacaaauaaaaaggu

SEQ ID NO: 4068520 - RNA, 22 nt, Vaccinia virus
aacaagcaucaugaauacagua

SEQ ID NO: 4068521 - RNA, 16 nt, Vaccinia virus
aacaaggcuuugauau

SEQ ID NO: 4068522 - RNA, 15 nt, Vaccinia virus
aacauaaucaaggau

SEQ ID NO: 4068523 - RNA, 19 nt, Vaccinia virus
aacauauauaauaaauaac

SEQ ID NO: 4068524 - RNA, 15 nt, Vaccinia virus
aacauauuuuucuau

SEQ ID NO: 4068525 - RNA, 14 nt, Vaccinia virus
aacaucaaaaaauu

SEQ ID NO: 4068526 - RNA, 18 nt, Vaccinia virus
aacauccuuuaaugguuu

SEQ ID NO: 4068527 - RNA, 20 nt, Vaccinia virus
aacaucgaagaugaaucaaa

SEQ ID NO: 4068528 - RNA, 17 nt, Vaccinia virus
aacaucucaaugucuuu

SEQ ID NO: 4068529 - RNA, 15 nt, Vaccinia virus
aacaugagacugacu

SEQ ID NO: 4068530 - RNA, 16 nt, Vaccinia virus
aacaugcuuuucuaua

SEQ ID NO: 4068531 - RNA, 20 nt, Vaccinia virus
aacaugucuucuauucuaga

SEQ ID NO: 4068532 - RNA, 17 nt, Vaccinia virus
aacaugugugaaaauau

SEQ ID NO: 4068533 - RNA, 13 nt, Vaccinia virus
aacauuaguucca

SEQ ID NO: 4068534 - RNA, 19 nt, Vaccinia virus
aacauuauucuauuucgaa

SEQ ID NO: 4068535 - RNA, 11 nt, Vaccinia virus
aacauucucca

SEQ ID NO: 4068536 - RNA, 19 nt, Vaccinia virus
aacauugauuuuaaaauua

SEQ ID NO: 4068537 - RNA, 17 nt, Vaccinia virus
aacauuuuauaaauaua

SEQ ID NO: 4068538 - RNA, 13 nt, Vaccinia virus
aacauuuuuguug

SEQ ID NO: 4068539 - RNA, 14 nt, Vaccinia virus
aacauuuuuuguuu

SEQ ID NO: 4068540 - RNA, 13 nt, Vaccinia virus
aaccaaauacaua

SEQ ID NO: 4068541 - RNA, 18 nt, Vaccinia virus
aaccagaaguuuuauccu

SEQ ID NO: 4068542 - RNA, 20 nt, Vaccinia virus
aaccagguaggcaguuuuau

SEQ ID NO: 4068543 - RNA, 13 nt, Vaccinia virus
aaccauaaauaca

SEQ ID NO: 4068544 - RNA, 21 nt, Vaccinia virus
aaccauucauuaauuucugau

SEQ ID NO: 4068545 - RNA, 22 nt, Vaccinia virus
aaccauugucuccuagcaauua

SEQ ID NO: 4068546 - RNA, 19 nt, Vaccinia virus
aaccugaucuggaaaauaa

SEQ ID NO: 4068547 - RNA, 15 nt, Vaccinia virus
aacgacgcauuaucu

SEQ ID NO: 4068548 - RNA, 21 nt, Vaccinia virus
aacgaguacuuuaaagaagua

SEQ ID NO: 4068549 - RNA, 17 nt, Vaccinia virus
aacgauaccaucuucug

SEQ ID NO: 4068550 - RNA, 14 nt, Vaccinia virus
aacgaugucaaaau

SEQ ID NO: 4068551 - RNA, 17 nt, Vaccinia virus
aacgauuuacuguggcu

SEQ ID NO: 4068552 - RNA, 16 nt, Vaccinia virus
aacgggauauaugaau

SEQ ID NO: 4068553 - RNA, 15 nt, Vaccinia virus
aacguaaaauacaua

SEQ ID NO: 4068554 - RNA, 17 nt, Vaccinia virus
aacgucguauguagaaa

SEQ ID NO: 4068555 - RNA, 12 nt, Vaccinia virus
aacguggauaaa

SEQ ID NO: 4068556 - RNA, 19 nt, Vaccinia virus
aacguucaccaaugucucu

SEQ ID NO: 4068557 - RNA, 18 nt, Vaccinia virus
aacguucacguaaauaca

SEQ ID NO: 4068558 - RNA, 21 nt, Vaccinia virus
aacguuucccaaugaaauggu

SEQ ID NO: 4068559 - RNA, 15 nt, Vaccinia virus
aacuaaauuaacaau

SEQ ID NO: 4068560 - RNA, 20 nt, Vaccinia virus
aacuaaccaacuaacuauau

SEQ ID NO: 4068561 - RNA, 14 nt, Vaccinia virus
aacuaacuauugaa

SEQ ID NO: 4068562 - RNA, 14 nt, Vaccinia virus
aacuacaauauuuc

SEQ ID NO: 4068563 - RNA, 17 nt, Vaccinia virus
aacuauauaauucuauu

SEQ ID NO: 4068564 - RNA, 20 nt, Vaccinia virus
aacuauaugucuguagaaaa

SEQ ID NO: 4068565 - RNA, 13 nt, Vaccinia virus
aacuaucaaacaa

SEQ ID NO: 4068566 - RNA, 20 nt, Vaccinia virus
aacuauuaacuauuuugucu

SEQ ID NO: 4068567 - RNA, 16 nt, Vaccinia virus
aacuauuucagaacau

SEQ ID NO: 4068568 - RNA, 15 nt, Vaccinia virus
aacuauuuuaccguu

SEQ ID NO: 4068569 - RNA, 18 nt, Vaccinia virus
aacuccaagauaccagua

SEQ ID NO: 4068570 - RNA, 20 nt, Vaccinia virus
aacuccaauaaaaagaugau

SEQ ID NO: 4068571 - RNA, 20 nt, Vaccinia virus
aacuccguguuuaugaugcc

SEQ ID NO: 4068572 - RNA, 21 nt, Vaccinia virus
aacucgccggcgcaucaguau

SEQ ID NO: 4068573 - RNA, 17 nt, Vaccinia virus
aacucgguaaaaaaauu

SEQ ID NO: 4068574 - RNA, 23 nt, Vaccinia virus
aacucuaguaaaauaaucauaca

SEQ ID NO: 4068575 - RNA, 16 nt, Vaccinia virus
aacucucaaaaugcug

SEQ ID NO: 4068576 - RNA, 18 nt, Vaccinia virus
aacucucguauagucaua

SEQ ID NO: 4068577 - RNA, 18 nt, Vaccinia virus
aacucucucauuuucuuu

SEQ ID NO: 4068578 - RNA, 18 nt, Vaccinia virus
aacucuugcuacaaaaug

SEQ ID NO: 4068579 - RNA, 18 nt, Vaccinia virus
aacucuuuagucgagaua

SEQ ID NO: 4068580 - RNA, 19 nt, Vaccinia virus
aacucuuucgcuauuucua

SEQ ID NO: 4068581 - RNA, 14 nt, Vaccinia virus
aacugaaucuaaca

SEQ ID NO: 4068582 - RNA, 19 nt, Vaccinia virus
aacugaggaugauugauua

SEQ ID NO: 4068583 - RNA, 20 nt, Vaccinia virus
aacugaguguaaaacucuau

SEQ ID NO: 4068584 - RNA, 17 nt, Vaccinia virus
aacugauucaauacgaa

SEQ ID NO: 4068585 - RNA, 22 nt, Vaccinia virus
aacugauuuuagcagaauauau

SEQ ID NO: 4068586 - RNA, 17 nt, Vaccinia virus
aacugcauauuauacac

SEQ ID NO: 4068587 - RNA, 21 nt, Vaccinia virus
aacugcauccuucuaagauua

SEQ ID NO: 4068588 - RNA, 14 nt, Vaccinia virus
aacuguauaaaaug

SEQ ID NO: 4068589 - RNA, 21 nt, Vaccinia virus
aacuguccacuguucuagaca

SEQ ID NO: 4068590 - RNA, 11 nt, Vaccinia virus
aacugucuaua

SEQ ID NO: 4068591 - RNA, 18 nt, Vaccinia virus
aacuguggauacucugua

SEQ ID NO: 4068592 - RNA, 15 nt, Vaccinia virus
aacuguuguaaauua

SEQ ID NO: 4068593 - RNA, 12 nt, Vaccinia virus
aacuuaaaagaa

SEQ ID NO: 4068594 - RNA, 16 nt, Vaccinia virus
aacuuaaaagaauuac

SEQ ID NO: 4068595 - RNA, 15 nt, Vaccinia virus
aacuuaaacaaaaua

SEQ ID NO: 4068596 - RNA, 12 nt, Vaccinia virus
aacuuacaaaau

SEQ ID NO: 4068597 - RNA, 15 nt, Vaccinia virus
aacuuaucaaaacau

SEQ ID NO: 4068598 - RNA, 19 nt, Vaccinia virus
aacuuauuuuauacagacu

SEQ ID NO: 4068599 - RNA, 18 nt, Vaccinia virus
aacuucauccguuuccuu

SEQ ID NO: 4068600 - RNA, 22 nt, Vaccinia virus
aacuucuagucuagaaauaaua

SEQ ID NO: 4068601 - RNA, 17 nt, Vaccinia virus
aacuucucuaaaugagu

SEQ ID NO: 4068602 - RNA, 17 nt, Vaccinia virus
aacuugaggucaaggau

SEQ ID NO: 4068603 - RNA, 20 nt, Vaccinia virus
aacuuggggagaaugauaca

SEQ ID NO: 4068604 - RNA, 12 nt, Vaccinia virus
aacuuuaaauac

SEQ ID NO: 4068605 - RNA, 16 nt, Vaccinia virus
aacuuuaucacaauau

SEQ ID NO: 4068606 - RNA, 14 nt, Vaccinia virus
aacuuuaucaucuu

SEQ ID NO: 4068607 - RNA, 14 nt, Vaccinia virus
aacuuuauuagaua

SEQ ID NO: 4068608 - RNA, 13 nt, Vaccinia virus
aacuuucuagaca

SEQ ID NO: 4068609 - RNA, 23 nt, Vaccinia virus
aacuuugaaauuguuuuuuauuu

SEQ ID NO: 4068610 - RNA, 15 nt, Vaccinia virus
aacuuuguucauuua

SEQ ID NO: 4068611 - RNA, 18 nt, Vaccinia virus
aacuuuuucacaaaacua

SEQ ID NO: 4068612 - RNA, 13 nt, Vaccinia virus
aagaaaaaugauu

SEQ ID NO: 4068613 - RNA, 14 nt, Vaccinia virus
aagaaaacaaacau

SEQ ID NO: 4068614 - RNA, 21 nt, Vaccinia virus
aagaaauauaaaacuacuguc

SEQ ID NO: 4068615 - RNA, 23 nt, Vaccinia virus
aagaaaugguaaauaaauacuuu

SEQ ID NO: 4068616 - RNA, 22 nt, Vaccinia virus
aagaagaaauacuaaaaaaugu

SEQ ID NO: 4068617 - RNA, 13 nt, Vaccinia virus
aagaagaugaugg

SEQ ID NO: 4068618 - RNA, 19 nt, Vaccinia virus
aagaagugucuauaaaugu

SEQ ID NO: 4068619 - RNA, 19 nt, Vaccinia virus
aagaauaugugacaaaguc

SEQ ID NO: 4068620 - RNA, 15 nt, Vaccinia virus
aagaaucauccaagu

SEQ ID NO: 4068621 - RNA, 20 nt, Vaccinia virus
aagaaugcuguuaugugcau

SEQ ID NO: 4068622 - RNA, 18 nt, Vaccinia virus
aagaauguauauacaugu

SEQ ID NO: 4068623 - RNA, 12 nt, Vaccinia virus
aagaauuacuua

SEQ ID NO: 4068624 - RNA, 19 nt, Vaccinia virus
auaauugaguaaaugaaug

SEQ ID NO: 4068625 - RNA, 14 nt, Vaccinia virus
auaauugcuuuucu

SEQ ID NO: 4068626 - RNA, 19 nt, Vaccinia virus
auaauuguaacauccuucu

SEQ ID NO: 4068627 - RNA, 18 nt, Vaccinia virus
auaauuguacuuuguaau

SEQ ID NO: 4068628 - RNA, 13 nt, Vaccinia virus
auaauuguuguau

SEQ ID NO: 4068629 - RNA, 14 nt, Vaccinia virus
auaauuguuuugaa

SEQ ID NO: 4068630 - RNA, 15 nt, Vaccinia virus
auaauuuaacauuuu

SEQ ID NO: 4068631 - RNA, 13 nt, Vaccinia virus
auaauuuaauaau

SEQ ID NO: 4068632 - RNA, 17 nt, Vaccinia virus
auaauuucccaaauaca

SEQ ID NO: 4068633 - RNA, 21 nt, Vaccinia virus
auaauuugaccugauuacauu

SEQ ID NO: 4068634 - RNA, 18 nt, Vaccinia virus
auaauuugguauauacau

SEQ ID NO: 4068635 - RNA, 19 nt, Vaccinia virus
auaauuuuugaugcuguug

SEQ ID NO: 4068636 - RNA, 18 nt, Vaccinia virus
auaauuuuuuuaguuuuu

SEQ ID NO: 4068637 - RNA, 15 nt, Vaccinia virus
auacaaaauaauaga

SEQ ID NO: 4068638 - RNA, 21 nt, Vaccinia virus
auacaaaugacuacguuguua

SEQ ID NO: 4068639 - RNA, 16 nt, Vaccinia virus
auacaaauuuuaagaa

SEQ ID NO: 4068640 - RNA, 14 nt, Vaccinia virus
auacaaauuuuacu

SEQ ID NO: 4068641 - RNA, 17 nt, Vaccinia virus
auacaagcgagugcuuc

SEQ ID NO: 4068642 - RNA, 13 nt, Vaccinia virus
auacaauaucuuc

SEQ ID NO: 4068643 - RNA, 14 nt, Vaccinia virus
auacacaaaaagaa

SEQ ID NO: 4068644 - RNA, 15 nt, Vaccinia virus
auacacauuuucaaa

SEQ ID NO: 4068645 - RNA, 21 nt, Vaccinia virus
auacaccaucaauagauaaaa

SEQ ID NO: 4068646 - RNA, 23 nt, Vaccinia virus
auacacguuagauuauucucaaa

SEQ ID NO: 4068647 - RNA, 21 nt, Vaccinia virus
auacagaguauguaaaaaugu

SEQ ID NO: 4068648 - RNA, 21 nt, Vaccinia virus
auacauagucgugaucaacau

SEQ ID NO: 4068649 - RNA, 15 nt, Vaccinia virus
auacauaucaauauc

SEQ ID NO: 4068650 - RNA, 19 nt, Vaccinia virus
auacauccgcauacagcca

SEQ ID NO: 4068651 - RNA, 21 nt, Vaccinia virus
auacaucuauuaguaugguuu

SEQ ID NO: 4068652 - RNA, 20 nt, Vaccinia virus
auacauguauuaaaauacuu

SEQ ID NO: 4068653 - RNA, 14 nt, Vaccinia virus
auacauuaaguaaa

SEQ ID NO: 4068654 - RNA, 20 nt, Vaccinia virus
auacauuaucaaaaagaacg

SEQ ID NO: 4068655 - RNA, 16 nt, Vaccinia virus
auacauucuucuguua

SEQ ID NO: 4068656 - RNA, 16 nt, Vaccinia virus
auacauuugaguuacu

SEQ ID NO: 4068657 - RNA, 12 nt, Vaccinia virus
auaccaaacaua

SEQ ID NO: 4068658 - RNA, 18 nt, Vaccinia virus
auaccacauacaaaacua

SEQ ID NO: 4068659 - RNA, 16 nt, Vaccinia virus
auaccaucuucuggaa

SEQ ID NO: 4068660 - RNA, 13 nt, Vaccinia virus
auaccauguguau

SEQ ID NO: 4068661 - RNA, 20 nt, Vaccinia virus
auacccaaucucucucaaau

SEQ ID NO: 4068662 - RNA, 22 nt, Vaccinia virus
auaccguucgaugauauaguac

SEQ ID NO: 4068663 - RNA, 16 nt, Vaccinia virus
auaccuuguaauuaaa

SEQ ID NO: 4068664 - RNA, 21 nt, Vaccinia virus
auacgaaauaaauaaugaauu

SEQ ID NO: 4068665 - RNA, 21 nt, Vaccinia virus
auacgaaccgggaaagagaag

SEQ ID NO: 4068666 - RNA, 17 nt, Vaccinia virus
auacgaagacuauagau

SEQ ID NO: 4068667 - RNA, 16 nt, Vaccinia virus
auacgaggaugaugaa

SEQ ID NO: 4068668 - RNA, 16 nt, Vaccinia virus
auacgauaagauaugu

SEQ ID NO: 4068669 - RNA, 22 nt, Vaccinia virus
auacgauaguuuguuucuggaa

SEQ ID NO: 4068670 - RNA, 16 nt, Vaccinia virus
auacgauggugaaaga

SEQ ID NO: 4068671 - RNA, 15 nt, Vaccinia virus
auacggaauaaacau

SEQ ID NO: 4068672 - RNA, 16 nt, Vaccinia virus
auacguacugucuaua

SEQ ID NO: 4068673 - RNA, 17 nt, Vaccinia virus
auacuaagcaaguacau

SEQ ID NO: 4068674 - RNA, 21 nt, Vaccinia virus
auacuaccaaccuacacuauu

SEQ ID NO: 4068675 - RNA, 15 nt, Vaccinia virus
auacuagaguacuua

SEQ ID NO: 4068676 - RNA, 19 nt, Vaccinia virus
auacuaguagcuucacaaa

SEQ ID NO: 4068677 - RNA, 11 nt, Vaccinia virus
auacuaucaaa

SEQ ID NO: 4068678 - RNA, 13 nt, Vaccinia virus
auacuaucaaaau

SEQ ID NO: 4068679 - RNA, 21 nt, Vaccinia virus
auacucccuugcaucauauac

SEQ ID NO: 4068680 - RNA, 14 nt, Vaccinia virus
auacucuaugaaug

SEQ ID NO: 4068681 - RNA, 14 nt, Vaccinia virus
auacucuauuaaug

SEQ ID NO: 4068682 - RNA, 23 nt, Vaccinia virus
auacucuccgaguguaaauauua

SEQ ID NO: 4068683 - RNA, 15 nt, Vaccinia virus
auacuggagaacuua

SEQ ID NO: 4068684 - RNA, 17 nt, Vaccinia virus
auacugguuaaaauccu

SEQ ID NO: 4068685 - RNA, 21 nt, Vaccinia virus
auacugucuguaacucugaua

SEQ ID NO: 4068686 - RNA, 14 nt, Vaccinia virus
auacuuaaaaaugg

SEQ ID NO: 4068687 - RNA, 13 nt, Vaccinia virus
auacuuuaacauc

SEQ ID NO: 4068688 - RNA, 23 nt, Vaccinia virus
auacuuucgguucuuuaaaagaa

SEQ ID NO: 4068689 - RNA, 23 nt, Vaccinia virus
agaaaaucuuucuucuacuauau

SEQ ID NO: 4068690 - RNA, 23 nt, Vaccinia virus
agaaaauuagaucugauaauauu

SEQ ID NO: 4068691 - RNA, 21 nt, Vaccinia virus
agaaacaccuagaauacucau

SEQ ID NO: 4068692 - RNA, 23 nt, Vaccinia virus
agaaacacugaagcuaacgauga

SEQ ID NO: 4068693 - RNA, 13 nt, Vaccinia virus
agaaacauauucu

SEQ ID NO: 4068694 - RNA, 20 nt, Vaccinia virus
agaaacuauagauaaugaua

SEQ ID NO: 4068695 - RNA, 18 nt, Vaccinia virus
agaaauacuaaaaaaugu

SEQ ID NO: 4068696 - RNA, 18 nt, Vaccinia virus
agaaauagauaaugaaca

SEQ ID NO: 4068697 - RNA, 17 nt, Vaccinia virus
agaaauauacagcaaug

SEQ ID NO: 4068698 - RNA, 18 nt, Vaccinia virus
agaaauauguuaacaaua

SEQ ID NO: 4068699 - RNA, 19 nt, Vaccinia virus
agaaaucaacgaucuaaua

SEQ ID NO: 4068700 - RNA, 21 nt, Vaccinia virus
agaaaucaacgaucuaauaca

SEQ ID NO: 4068701 - RNA, 22 nt, Vaccinia virus
agaaaucccaccuuauuauauu

SEQ ID NO: 4068702 - RNA, 12 nt, Vaccinia virus
agaaaugauauc

SEQ ID NO: 4068703 - RNA, 22 nt, Vaccinia virus
agaaauggauuaucggaaauac

SEQ ID NO: 4068704 - RNA, 16 nt, Vaccinia virus
agaaauuaucaaaugu

SEQ ID NO: 4068705 - RNA, 23 nt, Vaccinia virus
agaaauuauuuuuacuaauagaa

SEQ ID NO: 4068706 - RNA, 18 nt, Vaccinia virus
agaacaaaaucuaacaga

SEQ ID NO: 4068707 - RNA, 20 nt, Vaccinia virus
agaacagaauaaacaaaaua

SEQ ID NO: 4068708 - RNA, 18 nt, Vaccinia virus
agaacagaccaaauauau

SEQ ID NO: 4068709 - RNA, 15 nt, Vaccinia virus
agaacaguaaauguu

SEQ ID NO: 4068710 - RNA, 19 nt, Vaccinia virus
agaacauacauuuguaaaa

SEQ ID NO: 4068711 - RNA, 22 nt, Vaccinia virus
aagauaugguaaaauuaaauag

SEQ ID NO: 4068712 - RNA, 21 nt, Vaccinia virus
aagauauuaucggguuuaaga

SEQ ID NO: 4068713 - RNA, 22 nt, Vaccinia virus
aagauccaaacgaggaggaaau

SEQ ID NO: 4068714 - RNA, 19 nt, Vaccinia virus
aagauuauuauggaaauca

SEQ ID NO: 4068715 - RNA, 20 nt, Vaccinia virus
aagauuguguuauauaacgg

SEQ ID NO: 4068716 - RNA, 13 nt, Vaccinia virus
aagauuguucucu

SEQ ID NO: 4068717 - RNA, 15 nt, Vaccinia virus
aagauuuaaauccua

SEQ ID NO: 4068718 - RNA, 20 nt, Vaccinia virus
aagauuuuugagaugucuca

SEQ ID NO: 4068719 - RNA, 23 nt, Vaccinia virus
aagcaugugucacuaugauaaac

SEQ ID NO: 4068720 - RNA, 21 nt, Vaccinia virus
aagccauuguugucugaaaua

SEQ ID NO: 4068721 - RNA, 15 nt, Vaccinia virus
aagcccaaaaccaaa

SEQ ID NO: 4068722 - RNA, 17 nt, Vaccinia virus
aagcgaauuacucuguc

SEQ ID NO: 4068723 - RNA, 17 nt, Vaccinia virus
aagcguguuauauauac

SEQ ID NO: 4068724 - RNA, 19 nt, Vaccinia virus
aagcuauuaucaaauacug

SEQ ID NO: 4068725 - RNA, 15 nt, Vaccinia virus
aagcuuuuagaauau

SEQ ID NO: 4068726 - RNA, 12 nt, Vaccinia virus
aaggaacuagaa

SEQ ID NO: 4068727 - RNA, 16 nt, Vaccinia virus
aaggaauugaugaagu

SEQ ID NO: 4068728 - RNA, 12 nt, Vaccinia virus
aaggacaaaguu

SEQ ID NO: 4068729 - RNA, 18 nt, Vaccinia virus
aaggacagaaaaaugcua

SEQ ID NO: 4068730 - RNA, 15 nt, Vaccinia virus
aaggacuuuguagaa

SEQ ID NO: 4068731 - RNA, 16 nt, Vaccinia virus
aaggagauauugaaac

SEQ ID NO: 4068732 - RNA, 17 nt, Vaccinia virus
aaggauacuaaacauug

SEQ ID NO: 4068733 - RNA, 19 nt, Vaccinia virus
aaggccaaagaaaugagua

SEQ ID NO: 4068734 - RNA, 23 nt, Vaccinia virus
aaggcggauguugugaaugacau

SEQ ID NO: 4068735 - RNA, 15 nt, Vaccinia virus
aagguaagaguuaug

SEQ ID NO: 4068736 - RNA, 18 nt, Vaccinia virus
aagguguuaaaauuagaa

SEQ ID NO: 4068737 - RNA, 14 nt, Vaccinia virus
aaguaaauacugaa

SEQ ID NO: 4068738 - RNA, 13 nt, Vaccinia virus
aaguaaugguaug

SEQ ID NO: 4068739 - RNA, 16 nt, Vaccinia virus
aaguacuauugucuaa

SEQ ID NO: 4068740 - RNA, 20 nt, Vaccinia virus
aaguagaaauuaucaaaugu

SEQ ID NO: 4068741 - RNA, 20 nt, Vaccinia virus
aaguagaucaucugaaaauc

SEQ ID NO: 4068742 - RNA, 20 nt, Vaccinia virus
aaguagaugguauuucugaa

SEQ ID NO: 4068743 - RNA, 18 nt, Vaccinia virus
aaguaggauuauguaaca

SEQ ID NO: 4068744 - RNA, 19 nt, Vaccinia virus
aaguauacauguuagagaa

SEQ ID NO: 4068745 - RNA, 19 nt, Vaccinia virus
aaguauauaauaaauacuu

SEQ ID NO: 4068746 - RNA, 17 nt, Vaccinia virus
aaguaucaaaucuucua

SEQ ID NO: 4068747 - RNA, 23 nt, Vaccinia virus
aaguaucuacgauuuuuacaaaa

SEQ ID NO: 4068748 - RNA, 23 nt, Vaccinia virus
aaguaugaucaacgaugauacuc

SEQ ID NO: 4068749 - RNA, 21 nt, Vaccinia virus
aaguauucuccagaugaaugg

SEQ ID NO: 4068750 - RNA, 18 nt, Vaccinia virus
aagucauagaaaaauaua

SEQ ID NO: 4068751 - RNA, 18 nt, Vaccinia virus
aagucauaucuagaauga

SEQ ID NO: 4068752 - RNA, 17 nt, Vaccinia virus
aagucauuugaauccau

SEQ ID NO: 4068753 - RNA, 18 nt, Vaccinia virus
aagucgacaaccaaacgu

SEQ ID NO: 4068754 - RNA, 16 nt, Vaccinia virus
aagucugucaaaucau

SEQ ID NO: 4068755 - RNA, 18 nt, Vaccinia virus
aagugaaggauugauaac

SEQ ID NO: 4068756 - RNA, 21 nt, Vaccinia virus
aagugacauuauaauuuuacc

SEQ ID NO: 4068757 - RNA, 20 nt, Vaccinia virus
aagugaguauacuugucauc

SEQ ID NO: 4068758 - RNA, 17 nt, Vaccinia virus
aagugcuuaaauauuuc

SEQ ID NO: 4068759 - RNA, 14 nt, Vaccinia virus
aaguguguagauau

SEQ ID NO: 4068760 - RNA, 18 nt, Vaccinia virus
aaguuaacacaugucaca

SEQ ID NO: 4068761 - RNA, 18 nt, Vaccinia virus
aaguuaauucagauacua

SEQ ID NO: 4068762 - RNA, 14 nt, Vaccinia virus
aaguuauagaaugu

SEQ ID NO: 4068763 - RNA, 17 nt, Vaccinia virus
aaguuauuguacuaucg

SEQ ID NO: 4068764 - RNA, 13 nt, Vaccinia virus
aaguucuggaaua

SEQ ID NO: 4068765 - RNA, 23 nt, Vaccinia virus
aaguuuauuaguguuuagauaau

SEQ ID NO: 4068766 - RNA, 18 nt, Vaccinia virus
aaguuucguacaaauaca

SEQ ID NO: 4068767 - RNA, 20 nt, Vaccinia virus
aaguuucugaaauaagauua

SEQ ID NO: 4068768 - RNA, 19 nt, Vaccinia virus
aaguuugagauuucauaau

SEQ ID NO: 4068769 - RNA, 17 nt, Vaccinia virus
aaguuuuaaaaauacuu

SEQ ID NO: 4068770 - RNA, 14 nt, Vaccinia virus
aaguuuuacauaag

SEQ ID NO: 4068771 - RNA, 18 nt, Vaccinia virus
aaguuuucccauacuaau

SEQ ID NO: 4068772 - RNA, 22 nt, Vaccinia virus
aaguuuucuuucaaaauagcua

SEQ ID NO: 4068773 - RNA, 22 nt, Vaccinia virus
aaguuuuuccaauuauauggua

SEQ ID NO: 4068774 - RNA, 11 nt, Vaccinia virus
aauaaaaauua

SEQ ID NO: 4068775 - RNA, 12 nt, Vaccinia virus
aauaaaacauuu

SEQ ID NO: 4068776 - RNA, 19 nt, Vaccinia virus
aauaaaaguggaagucauu

SEQ ID NO: 4068777 - RNA, 19 nt, Vaccinia virus
aauaaacuaaacaaaacug

SEQ ID NO: 4068778 - RNA, 18 nt, Vaccinia virus
aauaaacuagagaaacuu

SEQ ID NO: 4068779 - RNA, 16 nt, Vaccinia virus
aauaaacuauuucuaa

SEQ ID NO: 4068780 - RNA, 19 nt, Vaccinia virus
aauaaagaaaaugcagaaa

SEQ ID NO: 4068781 - RNA, 20 nt, Vaccinia virus
aauaaaguauauauaaguua

SEQ ID NO: 4068782 - RNA, 12 nt, Vaccinia virus
aauaaauagcuu

SEQ ID NO: 4068783 - RNA, 16 nt, Vaccinia virus
aauaaaucacuuuuua

SEQ ID NO: 4068784 - RNA, 22 nt, Vaccinia virus
aauaaauggagaauaauuggaa

SEQ ID NO: 4068785 - RNA, 20 nt, Vaccinia virus
aauaaauguuuugauuucaa

SEQ ID NO: 4068786 - RNA, 21 nt, Vaccinia virus
aauaaauuuagugagaauaau

SEQ ID NO: 4068787 - RNA, 14 nt, Vaccinia virus
aauaacaauguuuc

SEQ ID NO: 4068788 - RNA, 18 nt, Vaccinia virus
aauaacuaaaaauguaaa

SEQ ID NO: 4068789 - RNA, 19 nt, Vaccinia virus
aauaacuauguuuuaaaaa

SEQ ID NO: 4068790 - RNA, 14 nt, Vaccinia virus
aauaacucuagacg

SEQ ID NO: 4068791 - RNA, 17 nt, Vaccinia virus
aauaacuuguuagauaa

SEQ ID NO: 4068792 - RNA, 12 nt, Vaccinia virus
aauaagaauaaa

SEQ ID NO: 4068793 - RNA, 21 nt, Vaccinia virus
aauaagaucguccguaacaaa

SEQ ID NO: 4068794 - RNA, 23 nt, Vaccinia virus
aauaagaucguccguaacaaagu

SEQ ID NO: 4068795 - RNA, 20 nt, Vaccinia virus
aauaaggaagguguuaaaau

SEQ ID NO: 4068796 - RNA, 19 nt, Vaccinia virus
aauaauaaacggaagagau

SEQ ID NO: 4068797 - RNA, 16 nt, Vaccinia virus
aauaauaguagaauua

SEQ ID NO: 4068798 - RNA, 19 nt, Vaccinia virus
aauaaucggagaauguuuc

SEQ ID NO: 4068799 - RNA, 18 nt, Vaccinia virus
aauaaucuaguaaaacuu

SEQ ID NO: 4068800 - RNA, 20 nt, Vaccinia virus
aauaaucucgucgauguaaa

SEQ ID NO: 4068801 - RNA, 20 nt, Vaccinia virus
aauaauggaucagauguaga

SEQ ID NO: 4068802 - RNA, 23 nt, Vaccinia virus
aauaauggcuguuuguauaauag

SEQ ID NO: 4068803 - RNA, 18 nt, Vaccinia virus
aauaauugcgaauguuuu

SEQ ID NO: 4068804 - RNA, 14 nt, Vaccinia virus
aauaauuuaacaau

SEQ ID NO: 4068805 - RNA, 14 nt, Vaccinia virus
aauacaaaauaaua

SEQ ID NO: 4068806 - RNA, 14 nt, Vaccinia virus
aauacaaaauguua

SEQ ID NO: 4068807 - RNA, 15 nt, Vaccinia virus
aauacacauaaugaa

SEQ ID NO: 4068808 - RNA, 19 nt, Vaccinia virus
aauacacgauuuaauccau

SEQ ID NO: 4068809 - RNA, 12 nt, Vaccinia virus
aauacagcaucu

SEQ ID NO: 4068810 - RNA, 13 nt, Vaccinia virus
aauacaugggaaa

SEQ ID NO: 4068811 - RNA, 20 nt, Vaccinia virus
aauacauguaacaaaguuuc

SEQ ID NO: 4068812 - RNA, 14 nt, Vaccinia virus
aauacauguacaaa

SEQ ID NO: 4068813 - RNA, 13 nt, Vaccinia virus
aauaccaauuuuu

SEQ ID NO: 4068814 - RNA, 22 nt, Vaccinia virus
aauaccauaaauauauuucuaa

SEQ ID NO: 4068815 - RNA, 18 nt, Vaccinia virus
aauacguuagguauguac

SEQ ID NO: 4068816 - RNA, 22 nt, Vaccinia virus
aauacucuauaaggucagaaaa

SEQ ID NO: 4068817 - RNA, 12 nt, Vaccinia virus
aauacugaauuc

SEQ ID NO: 4068818 - RNA, 23 nt, Vaccinia virus
aauacugaucuucuuuugucgua

SEQ ID NO: 4068819 - RNA, 14 nt, Vaccinia virus
aauacuguauuaug

SEQ ID NO: 4068820 - RNA, 12 nt, Vaccinia virus
aauacuuaaaaa

SEQ ID NO: 4068821 - RNA, 23 nt, Vaccinia virus
uccauugauaaagaaguuauaga

SEQ ID NO: 4068822 - RNA, 19 nt, Vaccinia virus
uccauuuauacauugaaua

SEQ ID NO: 4068823 - RNA, 14 nt, Vaccinia virus
uccauuuucuguaa

SEQ ID NO: 4068824 - RNA, 17 nt, Vaccinia virus
uccauuuuguucaucuc

SEQ ID NO: 4068825 - RNA, 23 nt, Vaccinia virus
ucccaauuaccaacuagaagucu

SEQ ID NO: 4068826 - RNA, 14 nt, Vaccinia virus
ucccaauuccaaag

SEQ ID NO: 4068827 - RNA, 11 nt, Vaccinia virus
ucccugaauac

SEQ ID NO: 4068828 - RNA, 23 nt, Vaccinia virus
uccgacaucaaaugguacaaaaa

SEQ ID NO: 4068829 - RNA, 20 nt, Vaccinia virus
uccgagauaauuucuccaga

SEQ ID NO: 4068830 - RNA, 17 nt, Vaccinia virus
uccgagucagauccaga

SEQ ID NO: 4068831 - RNA, 21 nt, Vaccinia virus
uccgcugccaaguuccuauua

SEQ ID NO: 4068832 - RNA, 16 nt, Vaccinia virus
uccggauccuuuucuu

SEQ ID NO: 4068833 - RNA, 20 nt, Vaccinia virus
uccggauccuuuucuucaga

SEQ ID NO: 4068834 - RNA, 20 nt, Vaccinia virus
uccggugcccagucuaaaag

SEQ ID NO: 4068835 - RNA, 15 nt, Vaccinia virus
uccgguugaugauga

SEQ ID NO: 4068836 - RNA, 22 nt, Vaccinia virus
uccguguaauccauaauccagu

SEQ ID NO: 4068837 - RNA, 15 nt, Vaccinia virus
uccguucucugaaua

SEQ ID NO: 4068838 - RNA, 19 nt, Vaccinia virus
uccguuuauuauuauacau

SEQ ID NO: 4068839 - RNA, 16 nt, Vaccinia virus
uccuaacuuuaaacaa

SEQ ID NO: 4068840 - RNA, 20 nt, Vaccinia virus
uccuagcaucagcaaaacag

SEQ ID NO: 4068841 - RNA, 17 nt, Vaccinia virus
uccuauaacuucuaauc

SEQ ID NO: 4068842 - RNA, 19 nt, Vaccinia virus
uccuauauuuuuuuauucu

SEQ ID NO: 4068843 - RNA, 13 nt, Vaccinia virus
uccuauuaugaaa

SEQ ID NO: 4068844 - RNA, 15 nt, Vaccinia virus
uccuauuucacgaaa

SEQ ID NO: 4068845 - RNA, 11 nt, Vaccinia virus
uccucauuaac

SEQ ID NO: 4068846 - RNA, 16 nt, Vaccinia virus
uccuuauacaauuugu

SEQ ID NO: 4068847 - RNA, 19 nt, Vaccinia virus
uccuuaucuucauagaaua

SEQ ID NO: 4068848 - RNA, 21 nt, Vaccinia virus
uccuuccaagaagaagacuua

SEQ ID NO: 4068849 - RNA, 17 nt, Vaccinia virus
uccuuggaauugauaga

SEQ ID NO: 4068850 - RNA, 20 nt, Vaccinia virus
uccuugugcuuaauguuucc

SEQ ID NO: 4068851 - RNA, 20 nt, Vaccinia virus
ucgaaugccauagaauaaau

SEQ ID NO: 4068852 - RNA, 21 nt, Vaccinia virus
ucgacauuuggaauguuauau

SEQ ID NO: 4068853 - RNA, 15 nt, Vaccinia virus
ucgagacgucaauau

SEQ ID NO: 4068854 - RNA, 23 nt, Vaccinia virus
ucgagauggguccguucucugaa

SEQ ID NO: 4068855 - RNA, 14 nt, Vaccinia virus
ucgagcgugauguu

SEQ ID NO: 4068856 - RNA, 17 nt, Vaccinia virus
ucgauacauuaacucuc

SEQ ID NO: 4068857 - RNA, 15 nt, Vaccinia virus
ucgauacauuuugca

SEQ ID NO: 4068858 - RNA, 21 nt, Vaccinia virus
ucgauaccguauuguucuaaa

SEQ ID NO: 4068859 - RNA, 12 nt, Vaccinia virus
ucgauauucuca

SEQ ID NO: 4068860 - RNA, 16 nt, Vaccinia virus
ucgaugcauguuagau

SEQ ID NO: 4068861 - RNA, 20 nt, Vaccinia virus
ucgauuacauuuaugggaua

SEQ ID NO: 4068862 - RNA, 20 nt, Vaccinia virus
ucgcaagaauuuauuucuaa

SEQ ID NO: 4068863 - RNA, 23 nt, Vaccinia virus
ucgcaauauucaucaauuuagau

SEQ ID NO: 4068864 - RNA, 17 nt, Vaccinia virus
ucgcauagcauaguuuu

SEQ ID NO: 4068865 - RNA, 17 nt, Vaccinia virus
ucgcgauuaguguauac

SEQ ID NO: 4068866 - RNA, 16 nt, Vaccinia virus
ucgcgcuuuacauucu

SEQ ID NO: 4068867 - RNA, 15 nt, Vaccinia virus
ucgcuaaaauuuuca

SEQ ID NO: 4068868 - RNA, 16 nt, Vaccinia virus
ucgcuauuucuauaga

SEQ ID NO: 4068869 - RNA, 17 nt, Vaccinia virus
ucggaguaucaucuauu

SEQ ID NO: 4068870 - RNA, 15 nt, Vaccinia virus
ucguaaaaaaguuuu

SEQ ID NO: 4068871 - RNA, 17 nt, Vaccinia virus
ucguaaaaagauucuug

SEQ ID NO: 4068872 - RNA, 12 nt, Vaccinia virus
ucguaaauacuc

SEQ ID NO: 4068873 - RNA, 21 nt, Vaccinia virus
ucguaacaaaacuauuucaga

SEQ ID NO: 4068874 - RNA, 22 nt, Vaccinia virus
ucguaauuggaaaaauaguguu

SEQ ID NO: 4068875 - RNA, 13 nt, Vaccinia virus
ucguacauccagg

SEQ ID NO: 4068876 - RNA, 13 nt, Vaccinia virus
ucguagauuuuaa

SEQ ID NO: 4068877 - RNA, 14 nt, Vaccinia virus
ucguauacuagaaa

SEQ ID NO: 4068878 - RNA, 20 nt, Vaccinia virus
ucguauuuuuguuagaguau

SEQ ID NO: 4068879 - RNA, 20 nt, Vaccinia virus
ucgucaacaaguuggaugau

SEQ ID NO: 4068880 - RNA, 18 nt, Vaccinia virus
ucguguauaacaucuuug

SEQ ID NO: 4068881 - RNA, 14 nt, Vaccinia virus
ucguguuaaauuuu

SEQ ID NO: 4068882 - RNA, 12 nt, Vaccinia virus
ucguuaaauuuu

SEQ ID NO: 4068883 - RNA, 15 nt, Vaccinia virus
ucguuaacuauaaga

SEQ ID NO: 4068884 - RNA, 13 nt, Vaccinia virus
ucguucaaauuuu

SEQ ID NO: 4068885 - RNA, 16 nt, Vaccinia virus
ucguucgaccuaaaau

SEQ ID NO: 4068886 - RNA, 13 nt, Vaccinia virus
ucguucucuaaau

SEQ ID NO: 4068887 - RNA, 19 nt, Vaccinia virus
ucguuuauaucacauugua

SEQ ID NO: 4068888 - RNA, 14 nt, Vaccinia virus
ucguuuucuacaau

SEQ ID NO: 4068889 - RNA, 22 nt, Vaccinia virus
ucuaaagaacggagaauaucua

SEQ ID NO: 4068890 - RNA, 20 nt, Vaccinia virus
ucuaaauagaauucucuuca

SEQ ID NO: 4068891 - RNA, 22 nt, Vaccinia virus
ucuaaaugaugauauaccuguu

SEQ ID NO: 4068892 - RNA, 15 nt, Vaccinia virus
ucuaacgguuucuuc

SEQ ID NO: 4068893 - RNA, 21 nt, Vaccinia virus
ucuaacuggugaguuaauauu

SEQ ID NO: 4068894 - RNA, 19 nt, Vaccinia virus
ucuaagagaaugagaguag

SEQ ID NO: 4068895 - RNA, 23 nt, Vaccinia virus
ucuaauaaguagaguccucauga

SEQ ID NO: 4068896 - RNA, 14 nt, Vaccinia virus
ucuaauacauaauu

SEQ ID NO: 4068897 - RNA, 15 nt, Vaccinia virus
ucuaauauuaauauu

SEQ ID NO: 4068898 - RNA, 17 nt, Vaccinia virus
ucuaauucuacauaugg

SEQ ID NO: 4068899 - RNA, 16 nt, Vaccinia virus
ucuacaagaugucaga

SEQ ID NO: 4068900 - RNA, 16 nt, Vaccinia virus
ucuacacauguaugua

SEQ ID NO: 4068901 - RNA, 16 nt, Vaccinia virus
ucuacacuauugaacg

SEQ ID NO: 4068902 - RNA, 15 nt, Vaccinia virus
ucuacagauggagua

SEQ ID NO: 4068903 - RNA, 21 nt, Vaccinia virus
ucuaccagccuacauuuugcu

SEQ ID NO: 4068904 - RNA, 19 nt, Vaccinia virus
ucuacgauuuuuacaaaag

SEQ ID NO: 4068905 - RNA, 19 nt, Vaccinia virus
ucuacuuacuggaaaauag

SEQ ID NO: 4068906 - RNA, 17 nt, Vaccinia virus
ucuacuuuaucuauuca

SEQ ID NO: 4068907 - RNA, 14 nt, Vaccinia virus
ucuagaacuaacaa

SEQ ID NO: 4068908 - RNA, 18 nt, Vaccinia virus
ucuagacagauagaugau

SEQ ID NO: 4068909 - RNA, 22 nt, Vaccinia virus
ucuagacuugauuuaaaaccga

SEQ ID NO: 4068910 - RNA, 15 nt, Vaccinia virus
ucuagauaaaaucac

SEQ ID NO: 4068911 - RNA, 19 nt, Vaccinia virus
ucuagauacuagaguagua

SEQ ID NO: 4068912 - RNA, 20 nt, Vaccinia virus
ucuagauacuagaguaguau

SEQ ID NO: 4068913 - RNA, 14 nt, Vaccinia virus
ucuagauauccaga

SEQ ID NO: 4068914 - RNA, 17 nt, Vaccinia virus
ucuagauccucucuuca

SEQ ID NO: 4068915 - RNA, 13 nt, Vaccinia virus
ucuagcauuucua

SEQ ID NO: 4068916 - RNA, 16 nt, Vaccinia virus
ucuagcuuucacuuaa

SEQ ID NO: 4068917 - RNA, 22 nt, Vaccinia virus
ucuaggagguggauauuucuga

SEQ ID NO: 4068918 - RNA, 18 nt, Vaccinia virus
ucuagucgcaucucuuaa

SEQ ID NO: 4068919 - RNA, 14 nt, Vaccinia virus
ucuauaaaauacua

SEQ ID NO: 4068920 - RNA, 21 nt, Vaccinia virus
ucuauaaacgaugguuuaauu

SEQ ID NO: 4068921 - RNA, 14 nt, Vaccinia virus
ucuauacguuucua

SEQ ID NO: 4068922 - RNA, 15 nt, Vaccinia virus
ucuauacguuucuau

SEQ ID NO: 4068923 - RNA, 15 nt, Vaccinia virus
ucuauaguucucauc

SEQ ID NO: 4068924 - RNA, 15 nt, Vaccinia virus
ucuauauauacucuu

SEQ ID NO: 4068925 - RNA, 19 nt, Vaccinia virus
ucuauaugugcgagaauau

SEQ ID NO: 4068926 - RNA, 13 nt, Vaccinia virus
ucuaucuuugcau

SEQ ID NO: 4068927 - RNA, 22 nt, Vaccinia virus
ucuaugaaaggagagaauguau

SEQ ID NO: 4068928 - RNA, 22 nt, Vaccinia virus
ucuaugacuaaagcuauuacaa

SEQ ID NO: 4068929 - RNA, 13 nt, Vaccinia virus
ucuaugcuauaaa

SEQ ID NO: 4068930 - RNA, 16 nt, Vaccinia virus
ucuauguugacaugua

SEQ ID NO: 4068931 - RNA, 20 nt, Vaccinia virus
ucuauuagaguauugcauuu

SEQ ID NO: 4068932 - RNA, 15 nt, Vaccinia virus
ucuauuagaugugua

SEQ ID NO: 4068933 - RNA, 13 nt, Vaccinia virus
ucuauucaucuga

SEQ ID NO: 4068934 - RNA, 18 nt, Vaccinia virus
ucuauucugaaauaauua

SEQ ID NO: 4068935 - RNA, 22 nt, Vaccinia virus
ucuauuguuuagacuguuugua

SEQ ID NO: 4068936 - RNA, 17 nt, Vaccinia virus
ucuauuuuuuaaauuuu

SEQ ID NO: 4068937 - RNA, 21 nt, Vaccinia virus
ucucaaaugaauaaguuuauu

SEQ ID NO: 4068938 - RNA, 12 nt, Vaccinia virus
ucucaauacuaa

SEQ ID NO: 4068939 - RNA, 15 nt, Vaccinia virus
ucucaauaguuucau

SEQ ID NO: 4068940 - RNA, 22 nt, Vaccinia virus
ucucacuaacuaauguuucuuu

SEQ ID NO: 4068941 - RNA, 12 nt, Vaccinia virus
aacgauucuaga

SEQ ID NO: 4068942 - RNA, 22 nt, Vaccinia virus
aacgauuuuccaaaucaguaac

SEQ ID NO: 4068943 - RNA, 16 nt, Vaccinia virus
aacgcaacaaaugauu

SEQ ID NO: 4068944 - RNA, 15 nt, Vaccinia virus
aacgccuuuagaaaa

SEQ ID NO: 4068945 - RNA, 16 nt, Vaccinia virus
aacgcuacaacagaua

SEQ ID NO: 4068946 - RNA, 17 nt, Vaccinia virus
aacgcucuuuugaugau

SEQ ID NO: 4068947 - RNA, 19 nt, Vaccinia virus
aacggcguuucggaaaaug

SEQ ID NO: 4068948 - RNA, 21 nt, Vaccinia virus
aacgguuacuaucaauauuau

SEQ ID NO: 4068949 - RNA, 22 nt, Vaccinia virus
aacguaguuaugauaaaugauu

SEQ ID NO: 4068950 - RNA, 16 nt, Vaccinia virus
aacgucauaaaaaugu

SEQ ID NO: 4068951 - RNA, 16 nt, Vaccinia virus
aacguguauuaaauag

SEQ ID NO: 4068952 - RNA, 16 nt, Vaccinia virus
aacguuuuaaaaaaag

SEQ ID NO: 4068953 - RNA, 12 nt, Vaccinia virus
aacuaaaaaugu

SEQ ID NO: 4068954 - RNA, 17 nt, Vaccinia virus
aacuaaacagucuauca

SEQ ID NO: 4068955 - RNA, 23 nt, Vaccinia virus
aacuaacguccaucauuacagaa

SEQ ID NO: 4068956 - RNA, 13 nt, Vaccinia virus
aacuaauaaacau

SEQ ID NO: 4068957 - RNA, 15 nt, Vaccinia virus
aacuaauaugauccu

SEQ ID NO: 4068958 - RNA, 14 nt, Vaccinia virus
aacuacaaaaaugc

SEQ ID NO: 4068959 - RNA, 18 nt, Vaccinia virus
aacuacugauaacaaaau

SEQ ID NO: 4068960 - RNA, 15 nt, Vaccinia virus
aacuacuugaaauuc

SEQ ID NO: 4068961 - RNA, 13 nt, Vaccinia virus
aacuacuugcaua

SEQ ID NO: 4068962 - RNA, 17 nt, Vaccinia virus
aacuagaagucugaucu

SEQ ID NO: 4068963 - RNA, 18 nt, Vaccinia virus
aacuagaaucagaaucua

SEQ ID NO: 4068964 - RNA, 18 nt, Vaccinia virus
aacuauaucuauguugau

SEQ ID NO: 4068965 - RNA, 20 nt, Vaccinia virus
aacuaucgauaguaaugcau

SEQ ID NO: 4068966 - RNA, 16 nt, Vaccinia virus
aacuaucguuggaaaa

SEQ ID NO: 4068967 - RNA, 14 nt, Vaccinia virus
aacuaucuguaaaa

SEQ ID NO: 4068968 - RNA, 15 nt, Vaccinia virus
aacuaugucaaaaau

SEQ ID NO: 4068969 - RNA, 18 nt, Vaccinia virus
aacuaugucaaaaauugu

SEQ ID NO: 4068970 - RNA, 14 nt, Vaccinia virus
aacuauuuagcaaa

SEQ ID NO: 4068971 - RNA, 15 nt, Vaccinia virus
uucuuggauaaaagc

SEQ ID NO: 4068972 - RNA, 21 nt, Vaccinia virus
uucuuggcaaaagaauaccaa

SEQ ID NO: 4068973 - RNA, 13 nt, Vaccinia virus
uucuuguuauaua

SEQ ID NO: 4068974 - RNA, 14 nt, Vaccinia virus
uucuuuuuauucuc

SEQ ID NO: 4068975 - RNA, 16 nt, Vaccinia virus
uugaaauuauauucuu

SEQ ID NO: 4068976 - RNA, 20 nt, Vaccinia virus
uugaaauuguuuuuuauuuu

SEQ ID NO: 4068977 - RNA, 14 nt, Vaccinia virus
uugaaccaaacauu

SEQ ID NO: 4068978 - RNA, 13 nt, Vaccinia virus
uugaagaaaucaa

SEQ ID NO: 4068979 - RNA, 21 nt, Vaccinia virus
uugaauuaaugguguuccauu

SEQ ID NO: 4068980 - RNA, 17 nt, Vaccinia virus
uugacaaaaucuuuaau

SEQ ID NO: 4068981 - RNA, 14 nt, Vaccinia virus
uugacaucuaguau

SEQ ID NO: 4068982 - RNA, 14 nt, Vaccinia virus
uugagaaaacauuu

SEQ ID NO: 4068983 - RNA, 21 nt, Vaccinia virus
uugagaaagaccaguaguauu

SEQ ID NO: 4068984 - RNA, 18 nt, Vaccinia virus
uugagaugcugcuccugg

SEQ ID NO: 4068985 - RNA, 20 nt, Vaccinia virus
uugaguuugucgcauacuuu

SEQ ID NO: 4068986 - RNA, 19 nt, Vaccinia virus
uugaguuuuccguuagaaa

SEQ ID NO: 4068987 - RNA, 18 nt, Vaccinia virus
uugauauauaauuuacag

SEQ ID NO: 4068988 - RNA, 16 nt, Vaccinia virus
uugauaucuuuagaua

SEQ ID NO: 4068989 - RNA, 21 nt, Vaccinia virus
uugaucauauaguuauguaua

SEQ ID NO: 4068990 - RNA, 16 nt, Vaccinia virus
uugaucuuauuauaca

SEQ ID NO: 4068991 - RNA, 19 nt, Vaccinia virus
uugaugacgucaaacaaug

SEQ ID NO: 4068992 - RNA, 19 nt, Vaccinia virus
uugaugucuacacauccuu

SEQ ID NO: 4068993 - RNA, 13 nt, Vaccinia virus
uugauucuagcau

SEQ ID NO: 4068994 - RNA, 13 nt, Vaccinia virus
uugauucuaguau

SEQ ID NO: 4068995 - RNA, 12 nt, Vaccinia virus
uugauugccaua

SEQ ID NO: 4068996 - RNA, 19 nt, Vaccinia virus
uugauuuaaagucuagagu

SEQ ID NO: 4068997 - RNA, 14 nt, Vaccinia virus
uugccaaugauguc

SEQ ID NO: 4068998 - RNA, 23 nt, Vaccinia virus
uugccacauccuuuauuaaauca

SEQ ID NO: 4068999 - RNA, 23 nt, Vaccinia virus
uugccaccuauagcaucaauaau

SEQ ID NO: 4069000 - RNA, 17 nt, Vaccinia virus
uugccguugucuguauu

SEQ ID NO: 4069001 - RNA, 13 nt, Vaccinia virus
uugcgacacuauu

SEQ ID NO: 4069002 - RNA, 13 nt, Vaccinia virus
uugcuaaaaucug

SEQ ID NO: 4069003 - RNA, 13 nt, Vaccinia virus
uugcuaauuauuu

SEQ ID NO: 4069004 - RNA, 19 nt, Vaccinia virus
uugcuauccauuauucuuu

SEQ ID NO: 4069005 - RNA, 15 nt, Vaccinia virus
uugcucucugaaucu

SEQ ID NO: 4069006 - RNA, 14 nt, Vaccinia virus
uuggaagaaucuca

SEQ ID NO: 4069007 - RNA, 18 nt, Vaccinia virus
uuggaaucacaaacauua

SEQ ID NO: 4069008 - RNA, 21 nt, Vaccinia virus
uuggagaugaucauagauuca

SEQ ID NO: 4069009 - RNA, 20 nt, Vaccinia virus
uuggauaggcugucugcugg

SEQ ID NO: 4069010 - RNA, 15 nt, Vaccinia virus
uuggaugaaccauug

SEQ ID NO: 4069011 - RNA, 22 nt, Vaccinia virus
uuggcauuuaacagauucacaa

SEQ ID NO: 4069012 - RNA, 22 nt, Vaccinia virus
uugggcggaucuguaaacauuu

SEQ ID NO: 4069013 - RNA, 20 nt, Vaccinia virus
uugguauaaauguuguaauu

SEQ ID NO: 4069014 - RNA, 13 nt, Vaccinia virus
uuggugaauccau

SEQ ID NO: 4069015 - RNA, 13 nt, Vaccinia virus
uugguguaaaucu

SEQ ID NO: 4069016 - RNA, 14 nt, Vaccinia virus
uuguacagaaauca

SEQ ID NO: 4069017 - RNA, 20 nt, Vaccinia virus
uuguacauuaauaaaugaaa

SEQ ID NO: 4069018 - RNA, 14 nt, Vaccinia virus
uuguauaugauguu

SEQ ID NO: 4069019 - RNA, 14 nt, Vaccinia virus
uuguauuuaucuaa

SEQ ID NO: 4069020 - RNA, 21 nt, Vaccinia virus
uugucguaaauacaugucuaa

SEQ ID NO: 4069021 - RNA, 21 nt, Vaccinia virus
uugucugacugaauacauccu

SEQ ID NO: 4069022 - RNA, 13 nt, Vaccinia virus
uuguguuagauga

SEQ ID NO: 4069023 - RNA, 17 nt, Vaccinia virus
uuguuaagacaaucgua

SEQ ID NO: 4069024 - RNA, 21 nt, Vaccinia virus
uuguuacccaugaucuauaaa

SEQ ID NO: 4069025 - RNA, 15 nt, Vaccinia virus
uuguuccuguagaua

SEQ ID NO: 4069026 - RNA, 17 nt, Vaccinia virus
uuguucuacacauguau

SEQ ID NO: 4069027 - RNA, 18 nt, Vaccinia virus
uuguucuuccaauugcaa

SEQ ID NO: 4069028 - RNA, 14 nt, Vaccinia virus
uuguugcucccaug

SEQ ID NO: 4069029 - RNA, 14 nt, Vaccinia virus
uuuaaaaaguuauc

SEQ ID NO: 4069030 - RNA, 15 nt, Vaccinia virus
uuuaaaacagaugau

SEQ ID NO: 4069031 - RNA, 17 nt, Vaccinia virus
uuuaaaagucaacaucu

SEQ ID NO: 4069032 - RNA, 11 nt, Vaccinia virus
uuuaaaaucau

SEQ ID NO: 4069033 - RNA, 13 nt, Vaccinia virus
uuuaaagaaguag

SEQ ID NO: 4069034 - RNA, 18 nt, Vaccinia virus
uuuaaaucccaauucaga

SEQ ID NO: 4069035 - RNA, 16 nt, Vaccinia virus
uuuaaccuauacauga

SEQ ID NO: 4069036 - RNA, 14 nt, Vaccinia virus
uuuaacuuuucauu

SEQ ID NO: 4069037 - RNA, 23 nt, Vaccinia virus
uuuaauauccaaucuuauuacuu

SEQ ID NO: 4069038 - RNA, 20 nt, Vaccinia virus
uuuaauccaaauauaaugau

SEQ ID NO: 4069039 - RNA, 19 nt, Vaccinia virus
uuuaaucucgaaauucaga

SEQ ID NO: 4069040 - RNA, 16 nt, Vaccinia virus
uuuaaugacuacuaua

SEQ ID NO: 4069041 - RNA, 21 nt, Vaccinia virus
uuuaauuacagaguuuucaga

SEQ ID NO: 4069042 - RNA, 16 nt, Vaccinia virus
uuuaauucuagacuau

SEQ ID NO: 4069043 - RNA, 16 nt, Vaccinia virus
uuuaauuuccuaguau

SEQ ID NO: 4069044 - RNA, 23 nt, Vaccinia virus
uuuaauuuuguuauaguagauau

SEQ ID NO: 4069045 - RNA, 21 nt, Vaccinia virus
uuuaauuuuuucuacagauau

SEQ ID NO: 4069046 - RNA, 14 nt, Vaccinia virus
uuuacaaaacuggu

SEQ ID NO: 4069047 - RNA, 23 nt, Vaccinia virus
uuuacacaguaaccaaaaugaaa

SEQ ID NO: 4069048 - RNA, 16 nt, Vaccinia virus
uuuacagauauauuca

SEQ ID NO: 4069049 - RNA, 21 nt, Vaccinia virus
uuuacauggcucguaccaaca

SEQ ID NO: 4069050 - RNA, 21 nt, Vaccinia virus
uuuaccaugggaugcuaauau

SEQ ID NO: 4069051 - RNA, 16 nt, Vaccinia virus
uuuaccggcaucauaa

SEQ ID NO: 4069052 - RNA, 20 nt, Vaccinia virus
uuuaccggcaucauaaacac

SEQ ID NO: 4069053 - RNA, 17 nt, Vaccinia virus
uuuacugucuaccuaaa

SEQ ID NO: 4069054 - RNA, 18 nt, Vaccinia virus
uuuacuguggcuagauac

SEQ ID NO: 4069055 - RNA, 18 nt, Vaccinia virus
uuuacuuucgguuucaua

SEQ ID NO: 4069056 - RNA, 15 nt, Vaccinia virus
uuuacuuuucuaaau

SEQ ID NO: 4069057 - RNA, 14 nt, Vaccinia virus
uuuagaauuuccaa

SEQ ID NO: 4069058 - RNA, 15 nt, Vaccinia virus
uuuagacguagaaaa

SEQ ID NO: 4069059 - RNA, 16 nt, Vaccinia virus
uuuagaguauuucuca

SEQ ID NO: 4069060 - RNA, 20 nt, Vaccinia virus
uuuagcaaggucccuaauau

SEQ ID NO: 4069061 - RNA, 16 nt, Vaccinia virus
uuuaguugucuaguau

SEQ ID NO: 4069062 - RNA, 12 nt, Vaccinia virus
uuuaguuucuuc

SEQ ID NO: 4069063 - RNA, 20 nt, Vaccinia virus
uuuauaaacaugaaaccacu

SEQ ID NO: 4069064 - RNA, 19 nt, Vaccinia virus
uuuauaaacuuaacccauu

SEQ ID NO: 4069065 - RNA, 18 nt, Vaccinia virus
uuuauaauuuuaccaucu

SEQ ID NO: 4069066 - RNA, 16 nt, Vaccinia virus
aaguaugaugucuaug

SEQ ID NO: 4069067 - RNA, 20 nt, Vaccinia virus
aagucacaaagcaagaccaa

SEQ ID NO: 4069068 - RNA, 14 nt, Vaccinia virus
aagucauaaaucau

SEQ ID NO: 4069069 - RNA, 16 nt, Vaccinia virus
aagucauaugugguau

SEQ ID NO: 4069070 - RNA, 19 nt, Vaccinia virus
aagucgaauauaaaugauu

SEQ ID NO: 4069071 - RNA, 21 nt, Vaccinia virus
aagugccacaaaacagaaaua

SEQ ID NO: 4069072 - RNA, 19 nt, Vaccinia virus
aaguggugccgucaaacaa

SEQ ID NO: 4069073 - RNA, 20 nt, Vaccinia virus
aagugugguguuuggucgau

SEQ ID NO: 4069074 - RNA, 17 nt, Vaccinia virus
aaguuaagaagauaccu

SEQ ID NO: 4069075 - RNA, 17 nt, Vaccinia virus
aaguuaguuauuuuacg

SEQ ID NO: 4069076 - RNA, 13 nt, Vaccinia virus
aaguuauagaaug

SEQ ID NO: 4069077 - RNA, 19 nt, Vaccinia virus
aaguucuggcaauguuuca

SEQ ID NO: 4069078 - RNA, 19 nt, Vaccinia virus
aaguucuucgacaaaucgu

SEQ ID NO: 4069079 - RNA, 16 nt, Vaccinia virus
aaguugauacaacaua

SEQ ID NO: 4069080 - RNA, 13 nt, Vaccinia virus
aaguugaucucaa

SEQ ID NO: 4069081 - RNA, 22 nt, Vaccinia virus
aaguugcgaugaaauaggagau

SEQ ID NO: 4069082 - RNA, 11 nt, Vaccinia virus
aaguuguacag

SEQ ID NO: 4069083 - RNA, 20 nt, Vaccinia virus
aaguugugacacguuucaau

SEQ ID NO: 4069084 - RNA, 18 nt, Vaccinia virus
aaguuuauagcagaauuc

SEQ ID NO: 4069085 - RNA, 14 nt, Vaccinia virus
aaguuucugaaaua

SEQ ID NO: 4069086 - RNA, 22 nt, Vaccinia virus
aaguuugaaacgagugaagaaa

SEQ ID NO: 4069087 - RNA, 19 nt, Vaccinia virus
aaguuuggguaaauaacua

SEQ ID NO: 4069088 - RNA, 22 nt, Vaccinia virus
aaguuuuaucucuuucucucuu

SEQ ID NO: 4069089 - RNA, 22 nt, Vaccinia virus
aaguuuuucacccauaaauaau

SEQ ID NO: 4069090 - RNA, 12 nt, Vaccinia virus
aauaaaauggau

SEQ ID NO: 4069091 - RNA, 13 nt, Vaccinia virus
aauaaauaauaac

SEQ ID NO: 4069092 - RNA, 18 nt, Vaccinia virus
aauaaauagauauaaaau

SEQ ID NO: 4069093 - RNA, 17 nt, Vaccinia virus
aauaaauauccuuggaa

SEQ ID NO: 4069094 - RNA, 12 nt, Vaccinia virus
aauaaaucaugg

SEQ ID NO: 4069095 - RNA, 11 nt, Vaccinia virus
aauaaauggau

SEQ ID NO: 4069096 - RNA, 16 nt, Vaccinia virus
aauaacaauuaacaau

SEQ ID NO: 4069097 - RNA, 17 nt, Vaccinia virus
aauaacaggcuaaaaug

SEQ ID NO: 4069098 - RNA, 22 nt, Vaccinia virus
aauaacauuuuuuguaaaugua

SEQ ID NO: 4069099 - RNA, 14 nt, Vaccinia virus
aauaacuagaucau

SEQ ID NO: 4069100 - RNA, 17 nt, Vaccinia virus
aauaacuaguauaaaau

SEQ ID NO: 4069101 - RNA, 15 nt, Vaccinia virus
aauaacuaugauauc

SEQ ID NO: 4069102 - RNA, 21 nt, Vaccinia virus
aauaacuggcacaacaauaac

SEQ ID NO: 4069103 - RNA, 12 nt, Vaccinia virus
uuugcacacaua

SEQ ID NO: 4069104 - RNA, 15 nt, Vaccinia virus
uuugcacguaaccau

SEQ ID NO: 4069105 - RNA, 14 nt, Vaccinia virus
uuuggaucuaguau

SEQ ID NO: 4069106 - RNA, 17 nt, Vaccinia virus
uuuguaaauaacuaucu

SEQ ID NO: 4069107 - RNA, 19 nt, Vaccinia virus
uuuguagcucucccagauu

SEQ ID NO: 4069108 - RNA, 14 nt, Vaccinia virus
uuuguauugcacau

SEQ ID NO: 4069109 - RNA, 17 nt, Vaccinia virus
uuugucaacuuuguaaa

SEQ ID NO: 4069110 - RNA, 21 nt, Vaccinia virus
uuugucuuagaacaacauuuu

SEQ ID NO: 4069111 - RNA, 14 nt, Vaccinia virus
uuuguuagaguaua

SEQ ID NO: 4069112 - RNA, 17 nt, Vaccinia virus
uuuguuauuguaguaua

SEQ ID NO: 4069113 - RNA, 19 nt, Vaccinia virus
uuuuaacaccuccacaguu

SEQ ID NO: 4069114 - RNA, 22 nt, Vaccinia virus
uuuuaacuaguguagaaaacag

SEQ ID NO: 4069115 - RNA, 17 nt, Vaccinia virus
uuuuacaauuucaucca

SEQ ID NO: 4069116 - RNA, 23 nt, Vaccinia virus
uuuuacacaaggcauuguuucua

SEQ ID NO: 4069117 - RNA, 17 nt, Vaccinia virus
uuuuaccaacacaaagg

SEQ ID NO: 4069118 - RNA, 23 nt, Vaccinia virus
uuuuacgacacgcauuugaugca

SEQ ID NO: 4069119 - RNA, 14 nt, Vaccinia virus
uuuuacucuauaaa

SEQ ID NO: 4069120 - RNA, 19 nt, Vaccinia virus
uuuuagguacucaucuacu

SEQ ID NO: 4069121 - RNA, 14 nt, Vaccinia virus
uuuucaguuaucua

SEQ ID NO: 4069122 - RNA, 23 nt, Vaccinia virus
uuuucaguuccccuacguaucua

SEQ ID NO: 4069123 - RNA, 19 nt, Vaccinia virus
uuuuccagaucuauugacu

SEQ ID NO: 4069124 - RNA, 15 nt, Vaccinia virus
uuuuccauccuuugu

SEQ ID NO: 4069125 - RNA, 11 nt, Vaccinia virus
uuuucuguaaa

SEQ ID NO: 4069126 - RNA, 17 nt, Vaccinia virus
uuuucuuaugcauguuu

SEQ ID NO: 4069127 - RNA, 19 nt, Vaccinia virus
uuuugaauuguuucuuuua

SEQ ID NO: 4069128 - RNA, 13 nt, Vaccinia virus
uuuuguauucaau

SEQ ID NO: 4069129 - RNA, 21 nt, Vaccinia virus
uuuugucgauaaaaauuaaaa

SEQ ID NO: 4069130 - RNA, 24 nt, Vaccinia virus
uuuuguggauuaguguacucucuu

SEQ ID NO: 4069131 - RNA, 23 nt, Vaccinia virus
uuuuguucacaaaaauacauaaa

SEQ ID NO: 4069132 - RNA, 23 nt, Vaccinia virus
uuuuuaaaaauugccacauccuu

SEQ ID NO: 4069133 - RNA, 19 nt, Vaccinia virus
uuuuuaaaaucauuauaua

SEQ ID NO: 4069134 - RNA, 17 nt, Vaccinia virus
uuuuuacaaacaucacu

SEQ ID NO: 4069135 - RNA, 13 nt, Vaccinia virus
uuuuuaguaugac

SEQ ID NO: 4069136 - RNA, 21 nt, Vaccinia virus
uuuuucgcgggauacaucauc

SEQ ID NO: 4069137 - RNA, 22 nt, Vaccinia virus
uuuuugugggaagcgauucaaa

SEQ ID NO: 4069138 - RNA, 18 nt, Vaccinia virus
acgagugaagaaauaauu

SEQ ID NO: 4069139 - RNA, 16 nt, Vaccinia virus
acgaguugacauaucg

SEQ ID NO: 4069140 - RNA, 21 nt, Vaccinia virus
acgauaaaaauaauauuguuu

SEQ ID NO: 4069141 - RNA, 21 nt, Vaccinia virus
acgauaaugugguuacucuuc

SEQ ID NO: 4069142 - RNA, 20 nt, Vaccinia virus
acgauaguuuguuucuggaa

SEQ ID NO: 4069143 - RNA, 17 nt, Vaccinia virus
acgauauaaauugauua

SEQ ID NO: 4069144 - RNA, 14 nt, Vaccinia virus
acgauauuagaauu

SEQ ID NO: 4069145 - RNA, 17 nt, Vaccinia virus
acgaucuaauacaaaau

SEQ ID NO: 4069146 - RNA, 14 nt, Vaccinia virus
acgaugaaaaccag

SEQ ID NO: 4069147 - RNA, 15 nt, Vaccinia virus
acgaugaaaauggua

SEQ ID NO: 4069148 - RNA, 15 nt, Vaccinia virus
acgaugauauggaug

SEQ ID NO: 4069149 - RNA, 22 nt, Vaccinia virus
acgauuacaucaccucuaacau

SEQ ID NO: 4069150 - RNA, 16 nt, Vaccinia virus
acgauuacuacauuau

SEQ ID NO: 4069151 - RNA, 19 nt, Vaccinia virus
acgauuaguucuuuaaaga

SEQ ID NO: 4069152 - RNA, 21 nt, Vaccinia virus
acgauuuuuagugaaacauuc

SEQ ID NO: 4069153 - RNA, 15 nt, Vaccinia virus
acgcaauaucucaau

SEQ ID NO: 4069154 - RNA, 14 nt, Vaccinia virus
acgcauccauccaa

SEQ ID NO: 4069155 - RNA, 18 nt, Vaccinia virus
acgccguaauaauuuccu

SEQ ID NO: 4069156 - RNA, 14 nt, Vaccinia virus
acgcguauauguuu

SEQ ID NO: 4069157 - RNA, 15 nt, Vaccinia virus
acgcugauaaauaua

SEQ ID NO: 4069158 - RNA, 14 nt, Vaccinia virus
acgcuuguuaauaa

SEQ ID NO: 4069159 - RNA, 12 nt, Vaccinia virus
acggaauuauug

SEQ ID NO: 4069160 - RNA, 22 nt, Vaccinia virus
acggaguuuauuuuauaugucu

SEQ ID NO: 4069161 - RNA, 19 nt, Vaccinia virus
acggauaucuaauauuaau

SEQ ID NO: 4069162 - RNA, 18 nt, Vaccinia virus
acggcaugauaaaaugaa

SEQ ID NO: 4069163 - RNA, 20 nt, Vaccinia virus
acggcuuuuaaacagucucc

SEQ ID NO: 4069164 - RNA, 21 nt, Vaccinia virus
acggggauuucguagaaguug

SEQ ID NO: 4069165 - RNA, 15 nt, Vaccinia virus
acgguaauaaaaugu

SEQ ID NO: 4069166 - RNA, 19 nt, Vaccinia virus
acggugcugaccuggaaaa

SEQ ID NO: 4069167 - RNA, 20 nt, Vaccinia virus
acguaaauacaaaacagaga

SEQ ID NO: 4069168 - RNA, 15 nt, Vaccinia virus
acguacauuuuccau

SEQ ID NO: 4069169 - RNA, 22 nt, Vaccinia virus
acguacccaucaauauaaauaa

SEQ ID NO: 4069170 - RNA, 22 nt, Vaccinia virus
acguagucgaacguuaguucca

SEQ ID NO: 4069171 - RNA, 18 nt, Vaccinia virus
acguauauaacauuguuu

SEQ ID NO: 4069172 - RNA, 22 nt, Vaccinia virus
acguaucaccaacggaaauggu

SEQ ID NO: 4069173 - RNA, 22 nt, Vaccinia virus
acguaucucgucguccaauauu

SEQ ID NO: 4069174 - RNA, 21 nt, Vaccinia virus
acgucaaaauuggaaggauau

SEQ ID NO: 4069175 - RNA, 18 nt, Vaccinia virus
acgucauaaaaauguuua

SEQ ID NO: 4069176 - RNA, 16 nt, Vaccinia virus
acgucaucaaaaauag

SEQ ID NO: 4069177 - RNA, 21 nt, Vaccinia virus
acgucaucgcuucaucuauca

SEQ ID NO: 4069178 - RNA, 15 nt, Vaccinia virus
acgucauucuaaaag

SEQ ID NO: 4069179 - RNA, 23 nt, Vaccinia virus
acgucuagaguuuauaucaauaa

SEQ ID NO: 4069180 - RNA, 23 nt, Vaccinia virus
acgucuuuucaccacagcacugu

SEQ ID NO: 4069181 - RNA, 13 nt, Vaccinia virus
acgugauagcucc

SEQ ID NO: 4069182 - RNA, 16 nt, Vaccinia virus
acguggauauguguuu

SEQ ID NO: 4069183 - RNA, 23 nt, Vaccinia virus
acgugucaacggcaguauuggga

SEQ ID NO: 4069184 - RNA, 16 nt, Vaccinia virus
acguuuaaacauucuu

SEQ ID NO: 4069185 - RNA, 14 nt, Vaccinia virus
acguuuacguguau

SEQ ID NO: 4069186 - RNA, 16 nt, Vaccinia virus
acguuuauucucaaau

SEQ ID NO: 4069187 - RNA, 12 nt, Vaccinia virus
acguuuuaucca

SEQ ID NO: 4069188 - RNA, 17 nt, Vaccinia virus
acuaaaaauaaacauug

SEQ ID NO: 4069189 - RNA, 10 nt, Vaccinia virus
acuaaacaaa

SEQ ID NO: 4069190 - RNA, 20 nt, Vaccinia virus
acuaaacacacauuauucag

SEQ ID NO: 4069191 - RNA, 15 nt, Vaccinia virus
acuaacacauuucaa

SEQ ID NO: 4069192 - RNA, 15 nt, Vaccinia virus
acuaacauuguuaau

SEQ ID NO: 4069193 - RNA, 16 nt, Vaccinia virus
acuaacuaauguuucu

SEQ ID NO: 4069194 - RNA, 12 nt, Vaccinia virus
acuaagaaaguu

SEQ ID NO: 4069195 - RNA, 22 nt, Vaccinia virus
acuaagugaacgaaagguauac

SEQ ID NO: 4069196 - RNA, 17 nt, Vaccinia virus
acuaaucgauuuugcau

SEQ ID NO: 4069197 - RNA, 23 nt, Vaccinia virus
acuaaucgauuuugcauacucua

SEQ ID NO: 4069198 - RNA, 17 nt, Vaccinia virus
acuaauggaguauucca

SEQ ID NO: 4069199 - RNA, 19 nt, Vaccinia virus
acuaauucucauuaaaugg

SEQ ID NO: 4069200 - RNA, 16 nt, Vaccinia virus
acuaauucuuucucau

SEQ ID NO: 4069201 - RNA, 17 nt, Vaccinia virus
acuaauuguuuaaauaa

SEQ ID NO: 4069202 - RNA, 22 nt, Vaccinia virus
acuacaaaaguuuucuuucaaa

SEQ ID NO: 4069203 - RNA, 12 nt, Vaccinia virus
acuacaauaauu

SEQ ID NO: 4069204 - RNA, 22 nt, Vaccinia virus
acuacaguaguaauuaaugaaa

SEQ ID NO: 4069205 - RNA, 22 nt, Vaccinia virus
acuacauaauccucaucuggaa

SEQ ID NO: 4069206 - RNA, 22 nt, Vaccinia virus
acuacauaguuaucuaucuuaa

SEQ ID NO: 4069207 - RNA, 15 nt, Vaccinia virus
acuacccaucacauu

SEQ ID NO: 4069208 - RNA, 14 nt, Vaccinia virus
acuacguuuaauaa

SEQ ID NO: 4069209 - RNA, 15 nt, Vaccinia virus
acuacuaacauggau

SEQ ID NO: 4069210 - RNA, 21 nt, Vaccinia virus
acuagacguuuauucucaaau

SEQ ID NO: 4069211 - RNA, 16 nt, Vaccinia virus
acuagacuauuaauaa

SEQ ID NO: 4069212 - RNA, 14 nt, Vaccinia virus
acuagaguauauaa

SEQ ID NO: 4069213 - RNA, 15 nt, Vaccinia virus
acuagauacaaaauu

SEQ ID NO: 4069214 - RNA, 21 nt, Vaccinia virus
acuaguauaaaaucuguaucg

SEQ ID NO: 4069215 - RNA, 17 nt, Vaccinia virus
acuauaauaguacuaga

SEQ ID NO: 4069216 - RNA, 24 nt, Vaccinia virus
acuauaggugcguuguauacacau

SEQ ID NO: 4069217 - RNA, 22 nt, Vaccinia virus
acuauaguuagcacucuuccau

SEQ ID NO: 4069218 - RNA, 21 nt, Vaccinia virus
acuauauaaaccgcuauugaa

SEQ ID NO: 4069219 - RNA, 17 nt, Vaccinia virus
acuauauauagaaacuu

SEQ ID NO: 4069220 - RNA, 12 nt, Vaccinia virus
acuauauccaug

SEQ ID NO: 4069221 - RNA, 19 nt, Vaccinia virus
acuauauuaacaucuaaac

SEQ ID NO: 4069222 - RNA, 20 nt, Vaccinia virus
acuaucaaccgcauaauaca

SEQ ID NO: 4069223 - RNA, 16 nt, Vaccinia virus
acuaucugauaagaua

SEQ ID NO: 4069224 - RNA, 13 nt, Vaccinia virus
acuaucuguaaaa

SEQ ID NO: 4069225 - RNA, 18 nt, Vaccinia virus
acuaugggaucaugcauu

SEQ ID NO: 4069226 - RNA, 21 nt, Vaccinia virus
acuauguuuuguauacauaaa

SEQ ID NO: 4069227 - RNA, 18 nt, Vaccinia virus
acuauucaacgcagaggu

SEQ ID NO: 4069228 - RNA, 18 nt, Vaccinia virus
acuauuccguaucuaucu

SEQ ID NO: 4069229 - RNA, 18 nt, Vaccinia virus
acucaacggaaaacauuu

SEQ ID NO: 4069230 - RNA, 21 nt, Vaccinia virus
acucaagcagaaacuuagauu

SEQ ID NO: 4069231 - RNA, 21 nt, Vaccinia virus
acucaauaucuagacuuucug

SEQ ID NO: 4069232 - RNA, 22 nt, Vaccinia virus
acucagauaauagcaauauuag

SEQ ID NO: 4069233 - RNA, 18 nt, Vaccinia virus
acucauaagaaagagaau

SEQ ID NO: 4069234 - RNA, 22 nt, Vaccinia virus
acucauuauuucccaaaauuug

SEQ ID NO: 4069235 - RNA, 13 nt, Vaccinia virus
acucauuguuuac

SEQ ID NO: 4069236 - RNA, 17 nt, Vaccinia virus
acuccaauuaucuuuac

SEQ ID NO: 4069237 - RNA, 18 nt, Vaccinia virus
acuccagaacaucuucca

SEQ ID NO: 4069238 - RNA, 19 nt, Vaccinia virus
acuccaugauaaauuauuu

SEQ ID NO: 4069239 - RNA, 18 nt, Vaccinia virus
acuccauuaaauaauuua

SEQ ID NO: 4069240 - RNA, 18 nt, Vaccinia virus
acuccccgaagauuuguu

SEQ ID NO: 4069241 - RNA, 20 nt, Vaccinia virus
acuccuagagaauuaauauc

SEQ ID NO: 4069242 - RNA, 21 nt, Vaccinia virus
acuccucuauuuaauacuuua

SEQ ID NO: 4069243 - RNA, 19 nt, Vaccinia virus
acuccugguaauacugaug

SEQ ID NO: 4069244 - RNA, 14 nt, Vaccinia virus
acuccuuuaauagg

SEQ ID NO: 4069245 - RNA, 16 nt, Vaccinia virus
acucgagucauuuuac

SEQ ID NO: 4069246 - RNA, 23 nt, Vaccinia virus
acucgauaacacauuuucaucua

SEQ ID NO: 4069247 - RNA, 22 nt, Vaccinia virus
acucgcauuucuaauacaugac

SEQ ID NO: 4069248 - RNA, 22 nt, Vaccinia virus
acucuaagaacuuauuaaugaa

SEQ ID NO: 4069249 - RNA, 14 nt, Vaccinia virus
acucuaauuuauug

SEQ ID NO: 4069250 - RNA, 22 nt, Vaccinia virus
acucuauaaaauacuaaugcau

SEQ ID NO: 4069251 - RNA, 14 nt, Vaccinia virus
acucucaaaaugcu

SEQ ID NO: 4069252 - RNA, 15 nt, Vaccinia virus
acucucaaaaugcug

SEQ ID NO: 4069253 - RNA, 13 nt, Vaccinia virus
acucucgauaaau

SEQ ID NO: 4069254 - RNA, 15 nt, Vaccinia virus
acucugaaaagaaag

SEQ ID NO: 4069255 - RNA, 16 nt, Vaccinia virus
acucugaaaagaaagu

SEQ ID NO: 4069256 - RNA, 17 nt, Vaccinia virus
acucugggucauauuau

SEQ ID NO: 4069257 - RNA, 20 nt, Vaccinia virus
acucuguuguuuuucuuaua

SEQ ID NO: 4069258 - RNA, 19 nt, Vaccinia virus
acucuguuuuauuaaccga

SEQ ID NO: 4069259 - RNA, 18 nt, Vaccinia virus
acucuuccacuauugcca

SEQ ID NO: 4069260 - RNA, 18 nt, Vaccinia virus
acucuuggaauuaauagu

SEQ ID NO: 4069261 - RNA, 12 nt, Vaccinia virus
acugaauuauua

SEQ ID NO: 4069262 - RNA, 18 nt, Vaccinia virus
acugaguuuuuaggaaau

SEQ ID NO: 4069263 - RNA, 22 nt, Vaccinia virus
acugauaaaguagauuaugaag

SEQ ID NO: 4069264 - RNA, 12 nt, Vaccinia virus
aaucauugauau

SEQ ID NO: 4069265 - RNA, 22 nt, Vaccinia virus
aaucauuguccagauugaacau

SEQ ID NO: 4069266 - RNA, 13 nt, Vaccinia virus
aaucauuuaucau

SEQ ID NO: 4069267 - RNA, 13 nt, Vaccinia virus
aauccaaauauga

SEQ ID NO: 4069268 - RNA, 14 nt, Vaccinia virus
aauccaaucuaaga

SEQ ID NO: 4069269 - RNA, 19 nt, Vaccinia virus
aauccagcuagugaauaua

SEQ ID NO: 4069270 - RNA, 17 nt, Vaccinia virus
aaucccgucucagaaag

SEQ ID NO: 4069271 - RNA, 22 nt, Vaccinia virus
aaucccuacauauuuuagaaca

SEQ ID NO: 4069272 - RNA, 16 nt, Vaccinia virus
aauccgguaaauggaa

SEQ ID NO: 4069273 - RNA, 18 nt, Vaccinia virus
aaucgauaacucuauuca

SEQ ID NO: 4069274 - RNA, 16 nt, Vaccinia virus
aaucggagaauguuuc

SEQ ID NO: 4069275 - RNA, 15 nt, Vaccinia virus
aaucgguaacagucc

SEQ ID NO: 4069276 - RNA, 15 nt, Vaccinia virus
aaucguauaaauacg

SEQ ID NO: 4069277 - RNA, 12 nt, Vaccinia virus
aaucguauauaa

SEQ ID NO: 4069278 - RNA, 16 nt, Vaccinia virus
aaucguuaagaaguuu

SEQ ID NO: 4069279 - RNA, 16 nt, Vaccinia virus
aaucuaaaagaauugg

SEQ ID NO: 4069280 - RNA, 13 nt, Vaccinia virus
aaucuaaugauga

SEQ ID NO: 4069281 - RNA, 22 nt, Vaccinia virus
aaucuacauccaauuuuagaaa

SEQ ID NO: 4069282 - RNA, 19 nt, Vaccinia virus
aaucuagccauuauaaagu

SEQ ID NO: 4069283 - RNA, 20 nt, Vaccinia virus
aaucuagccauugucuuaua

SEQ ID NO: 4069284 - RNA, 15 nt, Vaccinia virus
aaucuaguaaaacuu

SEQ ID NO: 4069285 - RNA, 21 nt, Vaccinia virus
aaucuaucuuaucgaaugaua

SEQ ID NO: 4069286 - RNA, 12 nt, Vaccinia virus
aaucugaaaaua

SEQ ID NO: 4069287 - RNA, 14 nt, Vaccinia virus
aaucugaagaaagu

SEQ ID NO: 4069288 - RNA, 15 nt, Vaccinia virus
aaucugauaaauaua

SEQ ID NO: 4069289 - RNA, 18 nt, Vaccinia virus
aaucuguauaucuuucca

SEQ ID NO: 4069290 - RNA, 20 nt, Vaccinia virus
aaucuucaguuuuugauauc

SEQ ID NO: 4069291 - RNA, 16 nt, Vaccinia virus
aaucuugauuacaaaa

SEQ ID NO: 4069292 - RNA, 13 nt, Vaccinia virus
aaucuuuaccaua

SEQ ID NO: 4069293 - RNA, 22 nt, Vaccinia virus
aaucuuuguuggaucagucucu

SEQ ID NO: 4069294 - RNA, 17 nt, Vaccinia virus
aaucuuuuucaucuugu

SEQ ID NO: 4069295 - RNA, 18 nt, Vaccinia virus
aaugaaauaacauaggau

SEQ ID NO: 4069296 - RNA, 12 nt, Vaccinia virus
aaugaacucauc

SEQ ID NO: 4069297 - RNA, 15 nt, Vaccinia virus
aaugaagauccaaga

SEQ ID NO: 4069298 - RNA, 19 nt, Vaccinia virus
aaugaaggauuugaaucau

SEQ ID NO: 4069299 - RNA, 16 nt, Vaccinia virus
aaugaauuuuuaaaau

SEQ ID NO: 4069300 - RNA, 22 nt, Vaccinia virus
aaugacaucgaagauuguccaa

SEQ ID NO: 4069301 - RNA, 22 nt, Vaccinia virus
aaugaccaguuugcaauaugca

SEQ ID NO: 4069302 - RNA, 22 nt, Vaccinia virus
aaugacuacguuguuaugagug

SEQ ID NO: 4069303 - RNA, 22 nt, Vaccinia virus
aaugacuucguaaaaaauaaua

SEQ ID NO: 4069304 - RNA, 19 nt, Vaccinia virus
aaugagaugcauaaaacuu

SEQ ID NO: 4069305 - RNA, 23 nt, Vaccinia virus
aaugaggcguuuaucauaucugu

SEQ ID NO: 4069306 - RNA, 17 nt, Vaccinia virus
aaugaguucuguguaga

SEQ ID NO: 4069307 - RNA, 15 nt, Vaccinia virus
aaugauaauaggaau

SEQ ID NO: 4069308 - RNA, 20 nt, Vaccinia virus
aaugauacaaaaacgaaaua

SEQ ID NO: 4069309 - RNA, 21 nt, Vaccinia virus
aaugauauuucauugacagau

SEQ ID NO: 4069310 - RNA, 14 nt, Vaccinia virus
aaugaucauccaga

SEQ ID NO: 4069311 - RNA, 17 nt, Vaccinia virus
aaugaugucaggaaaua

SEQ ID NO: 4069312 - RNA, 23 nt, Vaccinia virus
aaugauuacuaacgcaacuauau

SEQ ID NO: 4069313 - RNA, 17 nt, Vaccinia virus
aaugauugcauagugaa

SEQ ID NO: 4069314 - RNA, 17 nt, Vaccinia virus
aaugauuuagaaaugaa

SEQ ID NO: 4069315 - RNA, 18 nt, Vaccinia virus
aaugcaauaacaaagauu

SEQ ID NO: 4069316 - RNA, 15 nt, Vaccinia virus
aaugcaaucaaugau

SEQ ID NO: 4069317 - RNA, 17 nt, Vaccinia virus
aaugcuagaauuagaaa

SEQ ID NO: 4069318 - RNA, 18 nt, Vaccinia virus
aaugcuagaauuagaaaa

SEQ ID NO: 4069319 - RNA, 13 nt, Vaccinia virus
aaugcucaguaaa

SEQ ID NO: 4069320 - RNA, 17 nt, Vaccinia virus
aaugcucaguaaaugua

SEQ ID NO: 4069321 - RNA, 18 nt, Vaccinia virus
aaugcuucagaauuagaa

SEQ ID NO: 4069322 - RNA, 17 nt, Vaccinia virus
aaugcuugaaaauggac

SEQ ID NO: 4069323 - RNA, 16 nt, Vaccinia virus
aaugcuuuagugaaau

SEQ ID NO: 4069324 - RNA, 15 nt, Vaccinia virus
aauggaaucuagauc

SEQ ID NO: 4069325 - RNA, 20 nt, Vaccinia virus
aauggacuccaauacgaaau

SEQ ID NO: 4069326 - RNA, 17 nt, Vaccinia virus
aauggauuaucggaaau

SEQ ID NO: 4069327 - RNA, 22 nt, Vaccinia virus
aauggcaauaacuaaaaaugua

SEQ ID NO: 4069328 - RNA, 16 nt, Vaccinia virus
aauggcauacauagaa

SEQ ID NO: 4069329 - RNA, 16 nt, Vaccinia virus
aauggcugcuucuaua

SEQ ID NO: 4069330 - RNA, 19 nt, Vaccinia virus
aauggucgauuauagaaau

SEQ ID NO: 4069331 - RNA, 15 nt, Vaccinia virus
aauguaaagucuaua

SEQ ID NO: 4069332 - RNA, 17 nt, Vaccinia virus
aauguaaucauauaaau

SEQ ID NO: 4069333 - RNA, 14 nt, Vaccinia virus
aauguagaaauuga

SEQ ID NO: 4069334 - RNA, 16 nt, Vaccinia virus
aauguagacaaauaua

SEQ ID NO: 4069335 - RNA, 16 nt, Vaccinia virus
aauguagauaaucauu

SEQ ID NO: 4069336 - RNA, 20 nt, Vaccinia virus
aauguagauaaucauuuaau

SEQ ID NO: 4069337 - RNA, 20 nt, Vaccinia virus
aauguauaacaaauacagaa

SEQ ID NO: 4069338 - RNA, 16 nt, Vaccinia virus
aauguauacaaaugua

SEQ ID NO: 4069339 - RNA, 14 nt, Vaccinia virus
aaugucaugauaca

SEQ ID NO: 4069340 - RNA, 15 nt, Vaccinia virus
acauugauugccaua

SEQ ID NO: 4069341 - RNA, 19 nt, Vaccinia virus
acauuguccaauccaggac

SEQ ID NO: 4069342 - RNA, 16 nt, Vaccinia virus
acauuguuuauggaug

SEQ ID NO: 4069343 - RNA, 22 nt, Vaccinia virus
acauuguuuauggaugccacug

SEQ ID NO: 4069344 - RNA, 13 nt, Vaccinia virus
acauuguuucaua

SEQ ID NO: 4069345 - RNA, 12 nt, Vaccinia virus
acauuuaaugau

SEQ ID NO: 4069346 - RNA, 20 nt, Vaccinia virus
acauuuauuaucaugaugac

SEQ ID NO: 4069347 - RNA, 22 nt, Vaccinia virus
acauuugggccauuauaccucu

SEQ ID NO: 4069348 - RNA, 21 nt, Vaccinia virus
acauuuuauaaauauauaaug

SEQ ID NO: 4069349 - RNA, 19 nt, Vaccinia virus
acauuuuccauuuauaaca

SEQ ID NO: 4069350 - RNA, 13 nt, Vaccinia virus
acauuuuuaaaga

SEQ ID NO: 4069351 - RNA, 15 nt, Vaccinia virus
acauuuuuauaaaca

SEQ ID NO: 4069352 - RNA, 19 nt, Vaccinia virus
acauuuuuuauaaauagau

SEQ ID NO: 4069353 - RNA, 16 nt, Vaccinia virus
acauuuuuuguuuugg

SEQ ID NO: 4069354 - RNA, 15 nt, Vaccinia virus
accaaauuaucauca

SEQ ID NO: 4069355 - RNA, 22 nt, Vaccinia virus
accaacguuaguaaucauauaa

SEQ ID NO: 4069356 - RNA, 13 nt, Vaccinia virus
accaauaaacuau

SEQ ID NO: 4069357 - RNA, 21 nt, Vaccinia virus
accaauagaaguuuucccaaa

SEQ ID NO: 4069358 - RNA, 19 nt, Vaccinia virus
accaauuacugauaaugua

SEQ ID NO: 4069359 - RNA, 23 nt, Vaccinia virus
accaauuacugauaauguagaag

SEQ ID NO: 4069360 - RNA, 20 nt, Vaccinia virus
accacacggagaacagauga

SEQ ID NO: 4069361 - RNA, 19 nt, Vaccinia virus
accaccuccuauaucaaug

SEQ ID NO: 4069362 - RNA, 16 nt, Vaccinia virus
accaccucucuggaag

SEQ ID NO: 4069363 - RNA, 21 nt, Vaccinia virus
accaccucucuggaagacagc

SEQ ID NO: 4069364 - RNA, 17 nt, Vaccinia virus
accacgaauuaaaaaag

SEQ ID NO: 4069365 - RNA, 13 nt, Vaccinia virus
accacuucucuau

SEQ ID NO: 4069366 - RNA, 20 nt, Vaccinia virus
accacuucucuaucaaugau

SEQ ID NO: 4069367 - RNA, 16 nt, Vaccinia virus
accagcggcuacuaaa

SEQ ID NO: 4069368 - RNA, 16 nt, Vaccinia virus
accauagaagauguua

SEQ ID NO: 4069369 - RNA, 20 nt, Vaccinia virus
accauauauccaauaaagcu

SEQ ID NO: 4069370 - RNA, 16 nt, Vaccinia virus
accauauuuucuggaa

SEQ ID NO: 4069371 - RNA, 22 nt, Vaccinia virus
accauccuuuaaaaaaaaugau

SEQ ID NO: 4069372 - RNA, 20 nt, Vaccinia virus
accaucggaugauauuaaug

SEQ ID NO: 4069373 - RNA, 21 nt, Vaccinia virus
accaucucauaaaauaguucu

SEQ ID NO: 4069374 - RNA, 14 nt, Vaccinia virus
accaugaaagaaag

SEQ ID NO: 4069375 - RNA, 13 nt, Vaccinia virus
accaugaaauaua

SEQ ID NO: 4069376 - RNA, 19 nt, Vaccinia virus
accaugucguuaacuauaa

SEQ ID NO: 4069377 - RNA, 19 nt, Vaccinia virus
accauuagauaaaguugau

SEQ ID NO: 4069378 - RNA, 14 nt, Vaccinia virus
accauuauuaauaa

SEQ ID NO: 4069379 - RNA, 17 nt, Vaccinia virus
accauugauugcauaau

SEQ ID NO: 4069380 - RNA, 18 nt, Vaccinia virus
acccauggagauacuuua

SEQ ID NO: 4069381 - RNA, 16 nt, Vaccinia virus
accccauauaauuuua

SEQ ID NO: 4069382 - RNA, 15 nt, Vaccinia virus
acccgcgucuguuuu

SEQ ID NO: 4069383 - RNA, 19 nt, Vaccinia virus
acccuggauaaaaaguaaa

SEQ ID NO: 4069384 - RNA, 23 nt, Vaccinia virus
acccuuccuuaaacgugaaugau

SEQ ID NO: 4069385 - RNA, 13 nt, Vaccinia virus
accgaaagacuau

SEQ ID NO: 4069386 - RNA, 14 nt, Vaccinia virus
accgaccuguauac

SEQ ID NO: 4069387 - RNA, 18 nt, Vaccinia virus
accgacucauuauuuccc

SEQ ID NO: 4069388 - RNA, 14 nt, Vaccinia virus
accgagggaaaauc

SEQ ID NO: 4069389 - RNA, 17 nt, Vaccinia virus
accgauaaacuacuacu

SEQ ID NO: 4069390 - RNA, 12 nt, Vaccinia virus
accgauuucaca

SEQ ID NO: 4069391 - RNA, 22 nt, Vaccinia virus
accggacgacauauuaaucuuu

SEQ ID NO: 4069392 - RNA, 17 nt, Vaccinia virus
accggagauauagcuuc

SEQ ID NO: 4069393 - RNA, 15 nt, Vaccinia virus
accgguaaucuuguc

SEQ ID NO: 4069394 - RNA, 19 nt, Vaccinia virus
accguauuacucuacagua

SEQ ID NO: 4069395 - RNA, 15 nt, Vaccinia virus
accgucauucauuua

SEQ ID NO: 4069396 - RNA, 16 nt, Vaccinia virus
accgugaccaauaagu

SEQ ID NO: 4069397 - RNA, 21 nt, Vaccinia virus
accuaccucucuuaaaauggu

SEQ ID NO: 4069398 - RNA, 15 nt, Vaccinia virus
accuauuuacuggug

SEQ ID NO: 4069399 - RNA, 12 nt, Vaccinia virus
accuccuucaug

SEQ ID NO: 4069400 - RNA, 18 nt, Vaccinia virus
accucuccuauaugaaua

SEQ ID NO: 4069401 - RNA, 14 nt, Vaccinia virus
accuguauguacaa

SEQ ID NO: 4069402 - RNA, 23 nt, Vaccinia virus
accuucuauagaucugagaaugg

SEQ ID NO: 4069403 - RNA, 14 nt, Vaccinia virus
accuucuucauuuc

SEQ ID NO: 4069404 - RNA, 14 nt, Vaccinia virus
accuuuuucagaga

SEQ ID NO: 4069405 - RNA, 14 nt, Vaccinia virus
acgaaagcaaagaa

SEQ ID NO: 4069406 - RNA, 15 nt, Vaccinia virus
acgaaauagcuauau

SEQ ID NO: 4069407 - RNA, 20 nt, Vaccinia virus
acgaaauaucucaucaagaa

SEQ ID NO: 4069408 - RNA, 20 nt, Vaccinia virus
acgaacauuuauaucauuug

SEQ ID NO: 4069409 - RNA, 18 nt, Vaccinia virus
acgaagaauggaaauaua

SEQ ID NO: 4069410 - RNA, 19 nt, Vaccinia virus
acgaagaccuaauccauca

SEQ ID NO: 4069411 - RNA, 23 nt, Vaccinia virus
acgaauauaaaucauauuuagaa

SEQ ID NO: 4069412 - RNA, 15 nt, Vaccinia virus
acgaauauuacuaau

SEQ ID NO: 4069413 - RNA, 18 nt, Vaccinia virus
acgaauuuccucagagga

SEQ ID NO: 4069414 - RNA, 18 nt, Vaccinia virus
auuucguuucuuaaauau

SEQ ID NO: 4069415 - RNA, 22 nt, Vaccinia virus
auuucugaaccaguuaauguau

SEQ ID NO: 4069416 - RNA, 23 nt, Vaccinia virus
auuucuggaaugacgaauccugu

SEQ ID NO: 4069417 - RNA, 16 nt, Vaccinia virus
auuucuucauaugaug

SEQ ID NO: 4069418 - RNA, 14 nt, Vaccinia virus
auuugaacuuaacu

SEQ ID NO: 4069419 - RNA, 15 nt, Vaccinia virus
auuugcacacauaau

SEQ ID NO: 4069420 - RNA, 15 nt, Vaccinia virus
auuugcauuucuaua

SEQ ID NO: 4069421 - RNA, 20 nt, Vaccinia virus
auuuggaauuuauuaauaca

SEQ ID NO: 4069422 - RNA, 21 nt, Vaccinia virus
auuuggcauaaagagauagau

SEQ ID NO: 4069423 - RNA, 20 nt, Vaccinia virus
auuuggcuauuaaacaguau

SEQ ID NO: 4069424 - RNA, 19 nt, Vaccinia virus
auuugggccauuauaccuc

SEQ ID NO: 4069425 - RNA, 20 nt, Vaccinia virus
auuugguaaaucauuaucua

SEQ ID NO: 4069426 - RNA, 21 nt, Vaccinia virus
auuuguaauaauccuaucuaa

SEQ ID NO: 4069427 - RNA, 20 nt, Vaccinia virus
auuuguauagauaauuacga

SEQ ID NO: 4069428 - RNA, 15 nt, Vaccinia virus
auuugucuucuuucu

SEQ ID NO: 4069429 - RNA, 18 nt, Vaccinia virus
auuugugaguuuuccuua

SEQ ID NO: 4069430 - RNA, 13 nt, Vaccinia virus
auuuguuaaaaga

SEQ ID NO: 4069431 - RNA, 19 nt, Vaccinia virus
auuuguucguaugucauaa

SEQ ID NO: 4069432 - RNA, 19 nt, Vaccinia virus
auuuguuuuacucuauaaa

SEQ ID NO: 4069433 - RNA, 20 nt, Vaccinia virus
auuuguuuuguuuauuaaca

SEQ ID NO: 4069434 - RNA, 14 nt, Vaccinia virus
auuuuaacacuaau

SEQ ID NO: 4069435 - RNA, 19 nt, Vaccinia virus
auuuuaacgacgacauauu

SEQ ID NO: 4069436 - RNA, 20 nt, Vaccinia virus
auuuuaauaggaucuauaug

SEQ ID NO: 4069437 - RNA, 19 nt, Vaccinia virus
auuuuaauucuagacuauu

SEQ ID NO: 4069438 - RNA, 13 nt, Vaccinia virus
auuuuacaaaaaa

SEQ ID NO: 4069439 - RNA, 21 nt, Vaccinia virus
auuuuacuacauaguuaucua

SEQ ID NO: 4069440 - RNA, 12 nt, Vaccinia virus
auuuuagaauuu

SEQ ID NO: 4069441 - RNA, 14 nt, Vaccinia virus
auuuuaguuuuggc

SEQ ID NO: 4069442 - RNA, 13 nt, Vaccinia virus
auuuuaucaaacu

SEQ ID NO: 4069443 - RNA, 15 nt, Vaccinia virus
auuuuaucaagacau

SEQ ID NO: 4069444 - RNA, 18 nt, Vaccinia virus
auuuuauucuagaauuga

SEQ ID NO: 4069445 - RNA, 13 nt, Vaccinia virus
auuuuauugcuaa

SEQ ID NO: 4069446 - RNA, 18 nt, Vaccinia virus
auuuuccaaauacaucca

SEQ ID NO: 4069447 - RNA, 18 nt, Vaccinia virus
auuuuccauuauuaauaa

SEQ ID NO: 4069448 - RNA, 23 nt, Vaccinia virus
auuuucgaaacucguaaaaagau

SEQ ID NO: 4069449 - RNA, 14 nt, Vaccinia virus
auuuucuaacguga

SEQ ID NO: 4069450 - RNA, 21 nt, Vaccinia virus
auuuucugacgaaacgaugaa

SEQ ID NO: 4069451 - RNA, 22 nt, Vaccinia virus
auuuucuuacaauuaacgagaa

SEQ ID NO: 4069452 - RNA, 15 nt, Vaccinia virus
auuuucuuucuaaua

SEQ ID NO: 4069453 - RNA, 21 nt, Vaccinia virus
auuuugauauugugaauggua

SEQ ID NO: 4069454 - RNA, 19 nt, Vaccinia virus
auuuugcauuagauuuacu

SEQ ID NO: 4069455 - RNA, 15 nt, Vaccinia virus
auuuugucauuaacu

SEQ ID NO: 4069456 - RNA, 14 nt, Vaccinia virus
auuuuguucaucuc

SEQ ID NO: 4069457 - RNA, 19 nt, Vaccinia virus
auuuuuaaccaauacuauu

SEQ ID NO: 4069458 - RNA, 16 nt, Vaccinia virus
auuuuuaauagcugcu

SEQ ID NO: 4069459 - RNA, 16 nt, Vaccinia virus
auuuuuaguuacagaa

SEQ ID NO: 4069460 - RNA, 17 nt, Vaccinia virus
auuuuuauaguuuuuac

SEQ ID NO: 4069461 - RNA, 20 nt, Vaccinia virus
auuuuuauauacauuacuga

SEQ ID NO: 4069462 - RNA, 21 nt, Vaccinia virus
auuuuucuaccuuuucaauuu

SEQ ID NO: 4069463 - RNA, 16 nt, Vaccinia virus
auuuuucuucauuuau

SEQ ID NO: 4069464 - RNA, 20 nt, Vaccinia virus
auuuuugacuuacauaaaug

SEQ ID NO: 4069465 - RNA, 16 nt, Vaccinia virus
auuuuuggauuacaag

SEQ ID NO: 4069466 - RNA, 18 nt, Vaccinia virus
auuuuuguacauuaauaa

SEQ ID NO: 4069467 - RNA, 13 nt, Vaccinia virus
auuuuuuaucaua

SEQ ID NO: 4069468 - RNA, 23 nt, Vaccinia virus
auuuuuuuaaaaaggaaauacuu

SEQ ID NO: 4069469 - RNA, 16 nt, Vaccinia virus
auuuuuuuaguaaugu

SEQ ID NO: 4069470 - RNA, 13 nt, Vaccinia virus
auuuuuuugaaau

SEQ ID NO: 4069471 - RNA, 15 nt, Vaccinia virus
auuuuuuuucaucuc

SEQ ID NO: 4069472 - RNA, 19 nt, Vaccinia virus
caaaaaacgacgauuggaa

SEQ ID NO: 4069473 - RNA, 19 nt, Vaccinia virus
caaaaaagcucaauaagau

SEQ ID NO: 4069474 - RNA, 12 nt, Vaccinia virus
caaaaaauaaua

SEQ ID NO: 4069475 - RNA, 13 nt, Vaccinia virus
caaaaaauacaau

SEQ ID NO: 4069476 - RNA, 13 nt, Vaccinia virus
caaaaaaugaauu

SEQ ID NO: 4069477 - RNA, 19 nt, Vaccinia virus
caaaaagagagucaauguu

SEQ ID NO: 4069478 - RNA, 13 nt, Vaccinia virus
caaaaauaaugac

SEQ ID NO: 4069479 - RNA, 16 nt, Vaccinia virus
caaaaauuacgauauu

SEQ ID NO: 4069480 - RNA, 18 nt, Vaccinia virus
caaaaauuuuuuauuuca

SEQ ID NO: 4069481 - RNA, 17 nt, Vaccinia virus
cauuauuuuuuuggaau

SEQ ID NO: 4069482 - RNA, 13 nt, Vaccinia virus
cauucaaauguug

SEQ ID NO: 4069483 - RNA, 18 nt, Vaccinia virus
cauucaaauguuguuaaa

SEQ ID NO: 4069484 - RNA, 16 nt, Vaccinia virus
cauucaccagaaacua

SEQ ID NO: 4069485 - RNA, 23 nt, Vaccinia virus
cauucacuauuccgucacuggcu

SEQ ID NO: 4069486 - RNA, 21 nt, Vaccinia virus
cauucacugcagcauuuugag

SEQ ID NO: 4069487 - RNA, 21 nt, Vaccinia virus
cauucaugggugcugaauaau

SEQ ID NO: 4069488 - RNA, 23 nt, Vaccinia virus
cauucgacuuaguauacaaaaaa

SEQ ID NO: 4069489 - RNA, 23 nt, Vaccinia virus
cauucgcggaacuacauaguaaa

SEQ ID NO: 4069490 - RNA, 19 nt, Vaccinia virus
cauucuaauguucauaauu

SEQ ID NO: 4069491 - RNA, 20 nt, Vaccinia virus
cauucucuucucugcauuua

SEQ ID NO: 4069492 - RNA, 17 nt, Vaccinia virus
cauucugcaauauuguu

SEQ ID NO: 4069493 - RNA, 12 nt, Vaccinia virus
cauucuuggaug

SEQ ID NO: 4069494 - RNA, 22 nt, Vaccinia virus
cauugaugucguuauucugaaa

SEQ ID NO: 4069495 - RNA, 16 nt, Vaccinia virus
cauugcuuauauuuuc

SEQ ID NO: 4069496 - RNA, 17 nt, Vaccinia virus
cauugggaaacauuaca

SEQ ID NO: 4069497 - RNA, 17 nt, Vaccinia virus
cauuggugcuauccauu

SEQ ID NO: 4069498 - RNA, 13 nt, Vaccinia virus
cauuguaaauuua

SEQ ID NO: 4069499 - RNA, 11 nt, Vaccinia virus
cauuuaaacau

SEQ ID NO: 4069500 - RNA, 12 nt, Vaccinia virus
cauuuaaacauu

SEQ ID NO: 4069501 - RNA, 13 nt, Vaccinia virus
cauuuagacagug

SEQ ID NO: 4069502 - RNA, 22 nt, Vaccinia virus
cauuuaucgcuaacaugcauuu

SEQ ID NO: 4069503 - RNA, 22 nt, Vaccinia virus
cauuuauggguaucaaaaacuu

SEQ ID NO: 4069504 - RNA, 22 nt, Vaccinia virus
cauuuccaaaucuaacuucuag

SEQ ID NO: 4069505 - RNA, 17 nt, Vaccinia virus
cauuucucaaaugaaua

SEQ ID NO: 4069506 - RNA, 12 nt, Vaccinia virus
cauuugaugcac

SEQ ID NO: 4069507 - RNA, 13 nt, Vaccinia virus
cauuuguaauaau

SEQ ID NO: 4069508 - RNA, 15 nt, Vaccinia virus
cauuuuuuuaaaacu

SEQ ID NO: 4069509 - RNA, 17 nt, Vaccinia virus
cauuuuuuuuaaaaaaa

SEQ ID NO: 4069510 - RNA, 11 nt, Vaccinia virus
ccaaaaugaaa

SEQ ID NO: 4069511 - RNA, 18 nt, Vaccinia virus
ccaaagagaaaacaaaac

SEQ ID NO: 4069512 - RNA, 16 nt, Vaccinia virus
ccaaagucgauaacga

SEQ ID NO: 4069513 - RNA, 13 nt, Vaccinia virus
ccaaauaucuuua

SEQ ID NO: 4069514 - RNA, 21 nt, Vaccinia virus
ccaaaucaguaacuauguuca

SEQ ID NO: 4069515 - RNA, 18 nt, Vaccinia virus
ccaaaucuauauuguuua

SEQ ID NO: 4069516 - RNA, 23 nt, Vaccinia virus
ccaaauuuuuuuuacaaacauca

SEQ ID NO: 4069517 - RNA, 16 nt, Vaccinia virus
ccaacggaaaugguag

SEQ ID NO: 4069518 - RNA, 16 nt, Vaccinia virus
ccaacucauuuaaaua

SEQ ID NO: 4069519 - RNA, 18 nt, Vaccinia virus
ccaagaaacagucagcug

SEQ ID NO: 4069520 - RNA, 16 nt, Vaccinia virus
ccaagacgaacaaaau

SEQ ID NO: 4069521 - RNA, 17 nt, Vaccinia virus
ccaaggaucuucuauca

SEQ ID NO: 4069522 - RNA, 14 nt, Vaccinia virus
ccaaguagauaucc

SEQ ID NO: 4069523 - RNA, 17 nt, Vaccinia virus
ccaauauagucuguguu

SEQ ID NO: 4069524 - RNA, 17 nt, Vaccinia virus
ccaauuacaaaaacuac

SEQ ID NO: 4069525 - RNA, 19 nt, Vaccinia virus
ccaauuacugauaauguag

SEQ ID NO: 4069526 - RNA, 17 nt, Vaccinia virus
ccaauucguauaaauau

SEQ ID NO: 4069527 - RNA, 19 nt, Vaccinia virus
ccaauuuuucuuaacaaac

SEQ ID NO: 4069528 - RNA, 20 nt, Vaccinia virus
ccacacgaggacuauguuug

SEQ ID NO: 4069529 - RNA, 12 nt, Vaccinia virus
ccacaucaucua

SEQ ID NO: 4069530 - RNA, 14 nt, Vaccinia virus
ccaccguauccaua

SEQ ID NO: 4069531 - RNA, 17 nt, Vaccinia virus
ccacgaugauaaauauc

SEQ ID NO: 4069532 - RNA, 21 nt, Vaccinia virus
ccagaaacuaguucugagaaa

SEQ ID NO: 4069533 - RNA, 21 nt, Vaccinia virus
ccaguagguguaggaguacau

SEQ ID NO: 4069534 - RNA, 16 nt, Vaccinia virus
ccaguggcuaagauac

SEQ ID NO: 4069535 - RNA, 14 nt, Vaccinia virus
ccaguuauaaaaca

SEQ ID NO: 4069536 - RNA, 15 nt, Vaccinia virus
ccauagauucuuuga

SEQ ID NO: 4069537 - RNA, 21 nt, Vaccinia virus
ccauauaccauuaauuguuua

SEQ ID NO: 4069538 - RNA, 17 nt, Vaccinia virus
ccauauaucuguaucau

SEQ ID NO: 4069539 - RNA, 21 nt, Vaccinia virus
ccauaucuaaagcuauguuua

SEQ ID NO: 4069540 - RNA, 14 nt, Vaccinia virus
ccauauuuuuugca

SEQ ID NO: 4069541 - RNA, 14 nt, Vaccinia virus
ccaucaaaagcauu

SEQ ID NO: 4069542 - RNA, 22 nt, Vaccinia virus
ccaucaaaagcauuaauacagu

SEQ ID NO: 4069543 - RNA, 14 nt, Vaccinia virus
ccaucguuaauuau

SEQ ID NO: 4069544 - RNA, 17 nt, Vaccinia virus
ccaucucuauguuucag

SEQ ID NO: 4069545 - RNA, 16 nt, Vaccinia virus
ccaucugguuuaauau

SEQ ID NO: 4069546 - RNA, 14 nt, Vaccinia virus
ccaugauaaauuau

SEQ ID NO: 4069547 - RNA, 15 nt, Vaccinia virus
ccaugaucuauaaag

SEQ ID NO: 4069548 - RNA, 22 nt, Vaccinia virus
ccauggacuaagauaucugaaa

SEQ ID NO: 4069549 - RNA, 19 nt, Vaccinia virus
ccauggacucauaaucucu

SEQ ID NO: 4069550 - RNA, 20 nt, Vaccinia virus
ccaugucaauugaguuuaua

SEQ ID NO: 4069551 - RNA, 18 nt, Vaccinia virus
ccauguugucuauuucca

SEQ ID NO: 4069552 - RNA, 16 nt, Vaccinia virus
ccauuaaaaauuguua

SEQ ID NO: 4069553 - RNA, 21 nt, Vaccinia virus
ccauuauaaaacuuaugauua

SEQ ID NO: 4069554 - RNA, 14 nt, Vaccinia virus
ccauugaaaacuau

SEQ ID NO: 4069555 - RNA, 17 nt, Vaccinia virus
ccauuuauccagucuga

SEQ ID NO: 4069556 - RNA, 13 nt, Vaccinia virus
ccauuuuuccaua

SEQ ID NO: 4069557 - RNA, 18 nt, Vaccinia virus
cccaagcagcauccccgu

SEQ ID NO: 4069558 - RNA, 22 nt, Vaccinia virus
cccaauagaauaguauucucag

SEQ ID NO: 4069559 - RNA, 16 nt, Vaccinia virus
cccacugaugagaugu

SEQ ID NO: 4069560 - RNA, 12 nt, Vaccinia virus
cccauaacuggu

SEQ ID NO: 4069561 - RNA, 23 nt, Vaccinia virus
cccgucuguuuaauuuuuucuac

SEQ ID NO: 4069562 - RNA, 13 nt, Vaccinia virus
ccgacgaaaagau

SEQ ID NO: 4069563 - RNA, 17 nt, Vaccinia virus
augcuauuagaaaugga

SEQ ID NO: 4069564 - RNA, 21 nt, Vaccinia virus
auggaaacaaaugaaacagga

SEQ ID NO: 4069565 - RNA, 12 nt, Vaccinia virus
auggaaauacuu

SEQ ID NO: 4069566 - RNA, 23 nt, Vaccinia virus
auggaauauaauaaucuauuuua

SEQ ID NO: 4069567 - RNA, 16 nt, Vaccinia virus
auggaauuggagaaac

SEQ ID NO: 4069568 - RNA, 13 nt, Vaccinia virus
auggaguauauau

SEQ ID NO: 4069569 - RNA, 22 nt, Vaccinia virus
auggaguauuccaagaguuuua

SEQ ID NO: 4069570 - RNA, 22 nt, Vaccinia virus
auggauucauccuguugucuaa

SEQ ID NO: 4069571 - RNA, 24 nt, Vaccinia virus
auggauuuggucauaauagaaugu

SEQ ID NO: 4069572 - RNA, 22 nt, Vaccinia virus
auggauuuuuuuaaaaaggaaa

SEQ ID NO: 4069573 - RNA, 15 nt, Vaccinia virus
auggcacgaaauauc

SEQ ID NO: 4069574 - RNA, 13 nt, Vaccinia virus
augguaaaaagac

SEQ ID NO: 4069575 - RNA, 13 nt, Vaccinia virus
augguaaauacug

SEQ ID NO: 4069576 - RNA, 22 nt, Vaccinia virus
augguaacgauaacacaaaaug

SEQ ID NO: 4069577 - RNA, 21 nt, Vaccinia virus
augguacguaaccgaaucuuc

SEQ ID NO: 4069578 - RNA, 14 nt, Vaccinia virus
auggucauguuuau

SEQ ID NO: 4069579 - RNA, 12 nt, Vaccinia virus
auguaaaacaaa

SEQ ID NO: 4069580 - RNA, 14 nt, Vaccinia virus
auguaaucauauaa

SEQ ID NO: 4069581 - RNA, 15 nt, Vaccinia virus
auguagaaaauggau

SEQ ID NO: 4069582 - RNA, 16 nt, Vaccinia virus
auguagaauccaucag

SEQ ID NO: 4069583 - RNA, 16 nt, Vaccinia virus
auguagacaaaaugaa

SEQ ID NO: 4069584 - RNA, 18 nt, Vaccinia virus
auguagauaaaaaagaua

SEQ ID NO: 4069585 - RNA, 16 nt, Vaccinia virus
auguagcaaacaugau

SEQ ID NO: 4069586 - RNA, 18 nt, Vaccinia virus
auguagccuugacuacau

SEQ ID NO: 4069587 - RNA, 14 nt, Vaccinia virus
auguagcuauauag

SEQ ID NO: 4069588 - RNA, 13 nt, Vaccinia virus
auguauaaaccuu

SEQ ID NO: 4069589 - RNA, 16 nt, Vaccinia virus
auguaugauucaaugu

SEQ ID NO: 4069590 - RNA, 14 nt, Vaccinia virus
auguauuagacaaa

SEQ ID NO: 4069591 - RNA, 17 nt, Vaccinia virus
auguauuuugaggaaau

SEQ ID NO: 4069592 - RNA, 19 nt, Vaccinia virus
auguauuuuuuaugauaua

SEQ ID NO: 4069593 - RNA, 18 nt, Vaccinia virus
augucaaaaauuguagaa

SEQ ID NO: 4069594 - RNA, 16 nt, Vaccinia virus
augucauauaggaaac

SEQ ID NO: 4069595 - RNA, 17 nt, Vaccinia virus
augucggaguuaauagc

SEQ ID NO: 4069596 - RNA, 21 nt, Vaccinia virus
augucuaaaaacagaaauagc

SEQ ID NO: 4069597 - RNA, 23 nt, Vaccinia virus
augucuuauuaaaaaacauauau

SEQ ID NO: 4069598 - RNA, 18 nt, Vaccinia virus
auguguaaaaaguuuuaa

SEQ ID NO: 4069599 - RNA, 15 nt, Vaccinia virus
auguguuaaaaagaa

SEQ ID NO: 4069600 - RNA, 23 nt, Vaccinia virus
auguguuuaauuuucacaaguau

SEQ ID NO: 4069601 - RNA, 21 nt, Vaccinia virus
auguguuuacaguaguaauga

SEQ ID NO: 4069602 - RNA, 23 nt, Vaccinia virus
auguguuuuagaauauauauacg

SEQ ID NO: 4069603 - RNA, 12 nt, Vaccinia virus
auguuaaauaua

SEQ ID NO: 4069604 - RNA, 22 nt, Vaccinia virus
auguuaauugggguauuaauaa

SEQ ID NO: 4069605 - RNA, 12 nt, Vaccinia virus
auguuacaaaug

SEQ ID NO: 4069606 - RNA, 17 nt, Vaccinia virus
auguuaccauacauuau

SEQ ID NO: 4069607 - RNA, 21 nt, Vaccinia virus
auguuagcgcuuccuaaauaa

SEQ ID NO: 4069608 - RNA, 16 nt, Vaccinia virus
auguuauauauaccuu

SEQ ID NO: 4069609 - RNA, 20 nt, Vaccinia virus
auguuaucaugaaauguuug

SEQ ID NO: 4069610 - RNA, 20 nt, Vaccinia virus
auguuccauuuauaagaaau

SEQ ID NO: 4069611 - RNA, 19 nt, Vaccinia virus
auguucgugguguuaugaa

SEQ ID NO: 4069612 - RNA, 20 nt, Vaccinia virus
auguucuuaaucaauguaca

SEQ ID NO: 4069613 - RNA, 22 nt, Vaccinia virus
auguugcaugaaauaauaugca

SEQ ID NO: 4069614 - RNA, 22 nt, Vaccinia virus
auguuguaauauuucacaugau

SEQ ID NO: 4069615 - RNA, 16 nt, Vaccinia virus
auguuuccgagaaaua

SEQ ID NO: 4069616 - RNA, 18 nt, Vaccinia virus
auguuuccgagaaauaua

SEQ ID NO: 4069617 - RNA, 20 nt, Vaccinia virus
auguuucuguuuucaaacac

SEQ ID NO: 4069618 - RNA, 20 nt, Vaccinia virus
auguuugcaucgugcuuuaa

SEQ ID NO: 4069619 - RNA, 17 nt, Vaccinia virus
auguuuuaaaaaucaca

SEQ ID NO: 4069620 - RNA, 12 nt, Vaccinia virus
auuaaaaaagau

SEQ ID NO: 4069621 - RNA, 23 nt, Vaccinia virus
auuaaaaacaaacuuuuuauccu

SEQ ID NO: 4069622 - RNA, 14 nt, Vaccinia virus
auuaaaaccuaauu

SEQ ID NO: 4069623 - RNA, 14 nt, Vaccinia virus
auuaaaauacuuuc

SEQ ID NO: 4069624 - RNA, 17 nt, Vaccinia virus
auuaaaccuaaauaauu

SEQ ID NO: 4069625 - RNA, 19 nt, Vaccinia virus
auuaaacguacauuuucca

SEQ ID NO: 4069626 - RNA, 16 nt, Vaccinia virus
auuaaacuuuaaugau

SEQ ID NO: 4069627 - RNA, 20 nt, Vaccinia virus
auuaaagauuguuuaagaag

SEQ ID NO: 4069628 - RNA, 16 nt, Vaccinia virus
auuaaaggauguacuc

SEQ ID NO: 4069629 - RNA, 18 nt, Vaccinia virus
auuaaaggcuuuaaaagu

SEQ ID NO: 4069630 - RNA, 21 nt, Vaccinia virus
auuaaaggcuuuuuauaucau

SEQ ID NO: 4069631 - RNA, 19 nt, Vaccinia virus
auuaaauauagguauauuu

SEQ ID NO: 4069632 - RNA, 16 nt, Vaccinia virus
auuaaaucauuaaaug

SEQ ID NO: 4069633 - RNA, 19 nt, Vaccinia virus
auuaaaugauuguauuaac

SEQ ID NO: 4069634 - RNA, 15 nt, Vaccinia virus
auuaaauuuagagau

SEQ ID NO: 4069635 - RNA, 19 nt, Vaccinia virus
auuaacaaauuuuaaacaa

SEQ ID NO: 4069636 - RNA, 15 nt, Vaccinia virus
auuaacagaaaaaac

SEQ ID NO: 4069637 - RNA, 16 nt, Vaccinia virus
auuaacgaguuaaaaa

SEQ ID NO: 4069638 - RNA, 22 nt, Vaccinia virus
auuaacgaucuuuauaauauau

SEQ ID NO: 4069639 - RNA, 20 nt, Vaccinia virus
auuaacgcaccuauaaagac

SEQ ID NO: 4069640 - RNA, 22 nt, Vaccinia virus
auuaacuacugauaacaaaaua

SEQ ID NO: 4069641 - RNA, 18 nt, Vaccinia virus
auuaacuaucuguaaaag

SEQ ID NO: 4069642 - RNA, 22 nt, Vaccinia virus
auuaacuccgaggcacauacau

SEQ ID NO: 4069643 - RNA, 12 nt, Vaccinia virus
auuaacugucuu

SEQ ID NO: 4069644 - RNA, 16 nt, Vaccinia virus
auuaagcaacaugucu

SEQ ID NO: 4069645 - RNA, 23 nt, Vaccinia virus
auuaaggagauagcuucaucuau

SEQ ID NO: 4069646 - RNA, 16 nt, Vaccinia virus
acugaucccuaauuuc

SEQ ID NO: 4069647 - RNA, 17 nt, Vaccinia virus
acugauuaacaaauggu

SEQ ID NO: 4069648 - RNA, 20 nt, Vaccinia virus
acugcaaaacucaaauguua

SEQ ID NO: 4069649 - RNA, 17 nt, Vaccinia virus
acugcaauaaaacauuu

SEQ ID NO: 4069650 - RNA, 18 nt, Vaccinia virus
acugcguucaagucauaa

SEQ ID NO: 4069651 - RNA, 20 nt, Vaccinia virus
acugcugaauguaucuucca

SEQ ID NO: 4069652 - RNA, 19 nt, Vaccinia virus
acugcugcguuaaacauuc

SEQ ID NO: 4069653 - RNA, 14 nt, Vaccinia virus
acuggagagacuga

SEQ ID NO: 4069654 - RNA, 17 nt, Vaccinia virus
acuguacgauacauaau

SEQ ID NO: 4069655 - RNA, 17 nt, Vaccinia virus
acuguauccucaaacau

SEQ ID NO: 4069656 - RNA, 21 nt, Vaccinia virus
acugucacuggaaagaugaua

SEQ ID NO: 4069657 - RNA, 22 nt, Vaccinia virus
acuguuaguauaacgugaaugu

SEQ ID NO: 4069658 - RNA, 21 nt, Vaccinia virus
acuuacagauggauaaaacuu

SEQ ID NO: 4069659 - RNA, 19 nt, Vaccinia virus
acuuaucgcauagagacua

SEQ ID NO: 4069660 - RNA, 20 nt, Vaccinia virus
acuuauggacaacagaggau

SEQ ID NO: 4069661 - RNA, 16 nt, Vaccinia virus
acuucaauaaaugauu

SEQ ID NO: 4069662 - RNA, 18 nt, Vaccinia virus
acuucacucuauuaaaaa

SEQ ID NO: 4069663 - RNA, 22 nt, Vaccinia virus
acuucauaauuuaauaauguag

SEQ ID NO: 4069664 - RNA, 21 nt, Vaccinia virus
acuucaucaugaguuaaauau

SEQ ID NO: 4069665 - RNA, 13 nt, Vaccinia virus
acuuccauggaaa

SEQ ID NO: 4069666 - RNA, 14 nt, Vaccinia virus
acuucgcaauaauu

SEQ ID NO: 4069667 - RNA, 21 nt, Vaccinia virus
acuucuacgaagaaaguuagu

SEQ ID NO: 4069668 - RNA, 19 nt, Vaccinia virus
acuucuccguucuuaauaa

SEQ ID NO: 4069669 - RNA, 21 nt, Vaccinia virus
acuugacuaaaucuuaauagu

SEQ ID NO: 4069670 - RNA, 14 nt, Vaccinia virus
acuugauaaaaaug

SEQ ID NO: 4069671 - RNA, 16 nt, Vaccinia virus
acuugauaauuaauaa

SEQ ID NO: 4069672 - RNA, 21 nt, Vaccinia virus
acuugauacgcucauuaauaa

SEQ ID NO: 4069673 - RNA, 17 nt, Vaccinia virus
acuugcgggguuaauuu

SEQ ID NO: 4069674 - RNA, 16 nt, Vaccinia virus
acuuggcgauucuaua

SEQ ID NO: 4069675 - RNA, 15 nt, Vaccinia virus
acuuggggagaauga

SEQ ID NO: 4069676 - RNA, 22 nt, Vaccinia virus
acuugguauuuggaaauuagug

SEQ ID NO: 4069677 - RNA, 14 nt, Vaccinia virus
acuuguaauaauug

SEQ ID NO: 4069678 - RNA, 16 nt, Vaccinia virus
acuuguauaauuuccc

SEQ ID NO: 4069679 - RNA, 14 nt, Vaccinia virus
acuuguuagauaga

SEQ ID NO: 4069680 - RNA, 17 nt, Vaccinia virus
acuuguuuaacaaaguu

SEQ ID NO: 4069681 - RNA, 13 nt, Vaccinia virus
acuuguuuuguuc

SEQ ID NO: 4069682 - RNA, 15 nt, Vaccinia virus
acuuuaagcuaaaau

SEQ ID NO: 4069683 - RNA, 15 nt, Vaccinia virus
auaaauuuauucucu

SEQ ID NO: 4069684 - RNA, 13 nt, Vaccinia virus
auaacaaagaaag

SEQ ID NO: 4069685 - RNA, 22 nt, Vaccinia virus
auaacaaccucuuuaauagccg

SEQ ID NO: 4069686 - RNA, 19 nt, Vaccinia virus
auaacacaaccaaauacuu

SEQ ID NO: 4069687 - RNA, 15 nt, Vaccinia virus
auaacaguuauauau

SEQ ID NO: 4069688 - RNA, 13 nt, Vaccinia virus
auaacaucauauu

SEQ ID NO: 4069689 - RNA, 23 nt, Vaccinia virus
auaacaucuuucaucaucugaca

SEQ ID NO: 4069690 - RNA, 17 nt, Vaccinia virus
auaacaugguaacugga

SEQ ID NO: 4069691 - RNA, 13 nt, Vaccinia virus
auaacauucuuaa

SEQ ID NO: 4069692 - RNA, 14 nt, Vaccinia virus
auaacauugcuagu

SEQ ID NO: 4069693 - RNA, 16 nt, Vaccinia virus
auaacauuuuuuguaa

SEQ ID NO: 4069694 - RNA, 18 nt, Vaccinia virus
auaacauuuuuuguaaau

SEQ ID NO: 4069695 - RNA, 20 nt, Vaccinia virus
auaacgaauccaauguuaug

SEQ ID NO: 4069696 - RNA, 15 nt, Vaccinia virus
auaacgucuucuaug

SEQ ID NO: 4069697 - RNA, 20 nt, Vaccinia virus
auaacguuaucguuuucuac

SEQ ID NO: 4069698 - RNA, 13 nt, Vaccinia virus
auaacuaaagaaa

SEQ ID NO: 4069699 - RNA, 17 nt, Vaccinia virus
auaacuaaauuaacaau

SEQ ID NO: 4069700 - RNA, 18 nt, Vaccinia virus
auaacugguucaaaauua

SEQ ID NO: 4069701 - RNA, 15 nt, Vaccinia virus
auaacuuacuuucca

SEQ ID NO: 4069702 - RNA, 19 nt, Vaccinia virus
auaacuucuaaucuuguaa

SEQ ID NO: 4069703 - RNA, 22 nt, Vaccinia virus
auaacuuuaccccaaucagaua

SEQ ID NO: 4069704 - RNA, 13 nt, Vaccinia virus
auaagaaacaauu

SEQ ID NO: 4069705 - RNA, 19 nt, Vaccinia virus
auaagaacgggucauuuau

SEQ ID NO: 4069706 - RNA, 19 nt, Vaccinia virus
auaagaagaggacaaaguu

SEQ ID NO: 4069707 - RNA, 15 nt, Vaccinia virus
auaagacuaaugcuu

SEQ ID NO: 4069708 - RNA, 19 nt, Vaccinia virus
auaagacuuuacuuuucua

SEQ ID NO: 4069709 - RNA, 18 nt, Vaccinia virus
auaagagaggauaaaacg

SEQ ID NO: 4069710 - RNA, 20 nt, Vaccinia virus
auaagaggcauaaucaaugu

SEQ ID NO: 4069711 - RNA, 15 nt, Vaccinia virus
auaagaguguaguau

SEQ ID NO: 4069712 - RNA, 19 nt, Vaccinia virus
auaagaugucuaugaauau

SEQ ID NO: 4069713 - RNA, 13 nt, Vaccinia virus
auaagauuuccaa

SEQ ID NO: 4069714 - RNA, 15 nt, Vaccinia virus
auaagccaaagcauu

SEQ ID NO: 4069715 - RNA, 19 nt, Vaccinia virus
auaaggaacuagaaucgua

SEQ ID NO: 4069716 - RNA, 14 nt, Vaccinia virus
auaaguaaaugaaa

SEQ ID NO: 4069717 - RNA, 17 nt, Vaccinia virus
auaagucuauuugaaau

SEQ ID NO: 4069718 - RNA, 19 nt, Vaccinia virus
auaauaacgauuuguuuaa

SEQ ID NO: 4069719 - RNA, 18 nt, Vaccinia virus
auaauaagaugcaaacau

SEQ ID NO: 4069720 - RNA, 16 nt, Vaccinia virus
auaauaaugaaugcag

SEQ ID NO: 4069721 - RNA, 15 nt, Vaccinia virus
auaauacgaauauau

SEQ ID NO: 4069722 - RNA, 15 nt, Vaccinia virus
auaauacuaucugga

SEQ ID NO: 4069723 - RNA, 22 nt, Vaccinia virus
auaauacucggccgacauaaug

SEQ ID NO: 4069724 - RNA, 16 nt, Vaccinia virus
auaauacucuguuguu

SEQ ID NO: 4069725 - RNA, 19 nt, Vaccinia virus
auaauacuggagaacuuau

SEQ ID NO: 4069726 - RNA, 18 nt, Vaccinia virus
auaauauauuagauauuu

SEQ ID NO: 4069727 - RNA, 15 nt, Vaccinia virus
auaauauauucuaug

SEQ ID NO: 4069728 - RNA, 18 nt, Vaccinia virus
auaauaucucuaauagau

SEQ ID NO: 4069729 - RNA, 17 nt, Vaccinia virus
auaauaucuuuaaucca

SEQ ID NO: 4069730 - RNA, 20 nt, Vaccinia virus
auaauaugcaccugaaacau

SEQ ID NO: 4069731 - RNA, 14 nt, Vaccinia virus
auaauauuaauauu

SEQ ID NO: 4069732 - RNA, 13 nt, Vaccinia virus
auaaucaaaauug

SEQ ID NO: 4069733 - RNA, 16 nt, Vaccinia virus
auaaucaauacggcca

SEQ ID NO: 4069734 - RNA, 17 nt, Vaccinia virus
auaaucagaaaacuuau

SEQ ID NO: 4069735 - RNA, 19 nt, Vaccinia virus
auaaucaucgaauacuucg

SEQ ID NO: 4069736 - RNA, 14 nt, Vaccinia virus
auaaucauguugau

SEQ ID NO: 4069737 - RNA, 20 nt, Vaccinia virus
auaaucauuacuaacuuuau

SEQ ID NO: 4069738 - RNA, 22 nt, Vaccinia virus
auaaucauuacuaacuuuauca

SEQ ID NO: 4069739 - RNA, 14 nt, Vaccinia virus
auaauccugugcau

SEQ ID NO: 4069740 - RNA, 17 nt, Vaccinia virus
auaaucgcuuuguuguu

SEQ ID NO: 4069741 - RNA, 16 nt, Vaccinia virus
auaaucguauacuuca

SEQ ID NO: 4069742 - RNA, 18 nt, Vaccinia virus
auaaucguauuuguguga

SEQ ID NO: 4069743 - RNA, 22 nt, Vaccinia virus
auaaucuucgucuauuacacca

SEQ ID NO: 4069744 - RNA, 21 nt, Vaccinia virus
auaaucuucucuccuguuaau

SEQ ID NO: 4069745 - RNA, 14 nt, Vaccinia virus
auaaugaacauagu

SEQ ID NO: 4069746 - RNA, 17 nt, Vaccinia virus
auaaugacgauaacauu

SEQ ID NO: 4069747 - RNA, 20 nt, Vaccinia virus
auaaugauacgauacuauau

SEQ ID NO: 4069748 - RNA, 16 nt, Vaccinia virus
auaaugauagaauaga

SEQ ID NO: 4069749 - RNA, 14 nt, Vaccinia virus
auaaugauauauau

SEQ ID NO: 4069750 - RNA, 17 nt, Vaccinia virus
auaauggcuguuuguau

SEQ ID NO: 4069751 - RNA, 23 nt, Vaccinia virus
auaauggcuguuuguauaauaga

SEQ ID NO: 4069752 - RNA, 16 nt, Vaccinia virus
auaauggugcuuguau

SEQ ID NO: 4069753 - RNA, 20 nt, Vaccinia virus
auaauggugcuuguaucgaa

SEQ ID NO: 4069754 - RNA, 17 nt, Vaccinia virus
auaaugucugacuagau

SEQ ID NO: 4069755 - RNA, 21 nt, Vaccinia virus
auaauguuauuacuuguggua

SEQ ID NO: 4069756 - RNA, 22 nt, Vaccinia virus
auaauguuguccauuguaguau

SEQ ID NO: 4069757 - RNA, 22 nt, Vaccinia virus
auaauguuucuauguuuucuac

SEQ ID NO: 4069758 - RNA, 13 nt, Vaccinia virus
auaauuaguuuuu

SEQ ID NO: 4069759 - RNA, 23 nt, Vaccinia virus
auaauuauaauauaaaaauacuu

SEQ ID NO: 4069760 - RNA, 18 nt, Vaccinia virus
auaauuauauaaauaugu

SEQ ID NO: 4069761 - RNA, 14 nt, Vaccinia virus
auaauuauuuccag

SEQ ID NO: 4069762 - RNA, 15 nt, Vaccinia virus
auaauuauuuuguaa

SEQ ID NO: 4069763 - RNA, 19 nt, Vaccinia virus
auaauucauaagaauuuac

SEQ ID NO: 4069764 - RNA, 21 nt, Vaccinia virus
auaauucauuaauauguacau

SEQ ID NO: 4069765 - RNA, 21 nt, Vaccinia virus
auaauucuauucuaguauuac

SEQ ID NO: 4069766 - RNA, 19 nt, Vaccinia virus
auaauucuuuauaacugaa

SEQ ID NO: 4069767 - RNA, 15 nt, Vaccinia virus
auaauugcuuuucua

SEQ ID NO: 4069768 - RNA, 17 nt, Vaccinia virus
auaauuguacuuuguaa

SEQ ID NO: 4069769 - RNA, 22 nt, Vaccinia virus
auaauuguuuaagacugucaau

SEQ ID NO: 4069770 - RNA, 12 nt, Vaccinia virus
auaauuuaagag

SEQ ID NO: 4069771 - RNA, 14 nt, Vaccinia virus
auaauuuacagcua

SEQ ID NO: 4069772 - RNA, 16 nt, Vaccinia virus
auaauuuagauacuuu

SEQ ID NO: 4069773 - RNA, 13 nt, Vaccinia virus
auaauuuaggaau

SEQ ID NO: 4069774 - RNA, 12 nt, Vaccinia virus
auaauuucuaga

SEQ ID NO: 4069775 - RNA, 13 nt, Vaccinia virus
auaauuugaucca

SEQ ID NO: 4069776 - RNA, 12 nt, Vaccinia virus
auaauuuuacca

SEQ ID NO: 4069777 - RNA, 18 nt, Vaccinia virus
auaauuuuaccagaauac

SEQ ID NO: 4069778 - RNA, 20 nt, Vaccinia virus
auaauuuuaccagaauacua

SEQ ID NO: 4069779 - RNA, 18 nt, Vaccinia virus
auaauuuuuggacaaaug

SEQ ID NO: 4069780 - RNA, 23 nt, Vaccinia virus
auacaaaaucaucugauaauuua

SEQ ID NO: 4069781 - RNA, 20 nt, Vaccinia virus
auacaaauaugucuuuguua

SEQ ID NO: 4069782 - RNA, 20 nt, Vaccinia virus
auacaaauuuuaagaaaugg

SEQ ID NO: 4069783 - RNA, 21 nt, Vaccinia virus
auacaauaauucagauaaugu

SEQ ID NO: 4069784 - RNA, 16 nt, Vaccinia virus
auacaauuaucauuuu

SEQ ID NO: 4069785 - RNA, 20 nt, Vaccinia virus
auacacaucaaaauaauaaa

SEQ ID NO: 4069786 - RNA, 16 nt, Vaccinia virus
auacacaugauugaca

SEQ ID NO: 4069787 - RNA, 22 nt, Vaccinia virus
auacacauuuucaaauaauaaa

SEQ ID NO: 4069788 - RNA, 21 nt, Vaccinia virus
auacacgcuaaaauaacuagu

SEQ ID NO: 4069789 - RNA, 16 nt, Vaccinia virus
auacacuaaaauuaaa

SEQ ID NO: 4069790 - RNA, 20 nt, Vaccinia virus
auacagcuggagauuaucau

SEQ ID NO: 4069791 - RNA, 16 nt, Vaccinia virus
auacauaauuuuguaa

SEQ ID NO: 4069792 - RNA, 21 nt, Vaccinia virus
auacauaccugauuagaauuc

SEQ ID NO: 4069793 - RNA, 22 nt, Vaccinia virus
auacauagucgugaucaacauu

SEQ ID NO: 4069794 - RNA, 16 nt, Vaccinia virus
auacauauuuucagua

SEQ ID NO: 4069795 - RNA, 15 nt, Vaccinia virus
auacauccuucuaug

SEQ ID NO: 4069796 - RNA, 21 nt, Vaccinia virus
auacaucgguaaauaaaacua

SEQ ID NO: 4069797 - RNA, 18 nt, Vaccinia virus
auacaucucuggaaauag

SEQ ID NO: 4069798 - RNA, 14 nt, Vaccinia virus
auacauuguugcau

SEQ ID NO: 4069799 - RNA, 15 nt, Vaccinia virus
auacauuuauuguau

SEQ ID NO: 4069800 - RNA, 14 nt, Vaccinia virus
auacauuuuucuau

SEQ ID NO: 4069801 - RNA, 14 nt, Vaccinia virus
auaccaaucauuua

SEQ ID NO: 4069802 - RNA, 22 nt, Vaccinia virus
auaccacuuaaugacaaaauca

SEQ ID NO: 4069803 - RNA, 14 nt, Vaccinia virus
auaccauuucuagu

SEQ ID NO: 4069804 - RNA, 16 nt, Vaccinia virus
auaccucuacacuauu

SEQ ID NO: 4069805 - RNA, 21 nt, Vaccinia virus
auaccuuaccgccuucauaag

SEQ ID NO: 4069806 - RNA, 13 nt, Vaccinia virus
acuaacuauugaa

SEQ ID NO: 4069807 - RNA, 18 nt, Vaccinia virus
acuaacucucuaauggau

SEQ ID NO: 4069808 - RNA, 15 nt, Vaccinia virus
acuaauacaucugaa

SEQ ID NO: 4069809 - RNA, 17 nt, Vaccinia virus
acuaauacucaauccuu

SEQ ID NO: 4069810 - RNA, 14 nt, Vaccinia virus
acuaaucaauaauc

SEQ ID NO: 4069811 - RNA, 18 nt, Vaccinia virus
acuaaucguaauauucua

SEQ ID NO: 4069812 - RNA, 16 nt, Vaccinia virus
acuaaucucauuguuu

SEQ ID NO: 4069813 - RNA, 20 nt, Vaccinia virus
acuaauguauacauuuucca

SEQ ID NO: 4069814 - RNA, 17 nt, Vaccinia virus
acuaauucauuuucaau

SEQ ID NO: 4069815 - RNA, 20 nt, Vaccinia virus
acuaauucuuucucaucaac

SEQ ID NO: 4069816 - RNA, 16 nt, Vaccinia virus
acuacugaaaaaagug

SEQ ID NO: 4069817 - RNA, 16 nt, Vaccinia virus
acuacugaagaacuac

SEQ ID NO: 4069818 - RNA, 14 nt, Vaccinia virus
acuacuucauuaau

SEQ ID NO: 4069819 - RNA, 20 nt, Vaccinia virus
acuagauacaaaauuugcau

SEQ ID NO: 4069820 - RNA, 23 nt, Vaccinia virus
acuagauuaauuuuugugggaag

SEQ ID NO: 4069821 - RNA, 19 nt, Vaccinia virus
acuagcauccccuuucaau

SEQ ID NO: 4069822 - RNA, 18 nt, Vaccinia virus
aauaugcuaguuaauagu

SEQ ID NO: 4069823 - RNA, 22 nt, Vaccinia virus
aauauggagagguguauuucca

SEQ ID NO: 4069824 - RNA, 23 nt, Vaccinia virus
aauaugucucuuaacuauuuccg

SEQ ID NO: 4069825 - RNA, 15 nt, Vaccinia virus
aauauguguauuauc

SEQ ID NO: 4069826 - RNA, 12 nt, Vaccinia virus
aauauuaaacaa

SEQ ID NO: 4069827 - RNA, 12 nt, Vaccinia virus
aauauuaaauau

SEQ ID NO: 4069828 - RNA, 20 nt, Vaccinia virus
aauauuaguggaagaaagau

SEQ ID NO: 4069829 - RNA, 16 nt, Vaccinia virus
aauauuauuaugaaga

SEQ ID NO: 4069830 - RNA, 19 nt, Vaccinia virus
aauauuauucuuugauucg

SEQ ID NO: 4069831 - RNA, 13 nt, Vaccinia virus
aauauuauuuccc

SEQ ID NO: 4069832 - RNA, 12 nt, Vaccinia virus
aauauucagagu

SEQ ID NO: 4069833 - RNA, 17 nt, Vaccinia virus
aauauucauauccuugu

SEQ ID NO: 4069834 - RNA, 13 nt, Vaccinia virus
aauauucuguucu

SEQ ID NO: 4069835 - RNA, 17 nt, Vaccinia virus
aauauuggcuuuucuuu

SEQ ID NO: 4069836 - RNA, 21 nt, Vaccinia virus
aauauuguuuugcugucucaa

SEQ ID NO: 4069837 - RNA, 20 nt, Vaccinia virus
aauauuuaacucaugaugaa

SEQ ID NO: 4069838 - RNA, 12 nt, Vaccinia virus
aauauuuagaaa

SEQ ID NO: 4069839 - RNA, 16 nt, Vaccinia virus
aauauuuauuagaaca

SEQ ID NO: 4069840 - RNA, 11 nt, Vaccinia virus
aauauuucauu

SEQ ID NO: 4069841 - RNA, 17 nt, Vaccinia virus
aauauuucgauaaugaa

SEQ ID NO: 4069842 - RNA, 17 nt, Vaccinia virus
aauauuucgaugauaua

SEQ ID NO: 4069843 - RNA, 12 nt, Vaccinia virus
aauauuuucuau

SEQ ID NO: 4069844 - RNA, 13 nt, Vaccinia virus
aaucaaaaaauaa

SEQ ID NO: 4069845 - RNA, 18 nt, Vaccinia virus
aaucaacagaaguuaaua

SEQ ID NO: 4069846 - RNA, 14 nt, Vaccinia virus
aaucaagaaugaua

SEQ ID NO: 4069847 - RNA, 12 nt, Vaccinia virus
aaucacaaacau

SEQ ID NO: 4069848 - RNA, 16 nt, Vaccinia virus
aaucacacaagccauu

SEQ ID NO: 4069849 - RNA, 22 nt, Vaccinia virus
aaucaccaaauuuuacaaaaaa

SEQ ID NO: 4069850 - RNA, 19 nt, Vaccinia virus
aaucaccauccuuuaaaaa

SEQ ID NO: 4069851 - RNA, 18 nt, Vaccinia virus
aaucacucaauaucuaga

SEQ ID NO: 4069852 - RNA, 15 nt, Vaccinia virus
aaucagaacuuccaa

SEQ ID NO: 4069853 - RNA, 14 nt, Vaccinia virus
aaucagaguuuuua

SEQ ID NO: 4069854 - RNA, 19 nt, Vaccinia virus
aaucagauagacuguuguu

SEQ ID NO: 4069855 - RNA, 22 nt, Vaccinia virus
aaucaggguuaucaaaguguuu

SEQ ID NO: 4069856 - RNA, 21 nt, Vaccinia virus
aaucaguacguucuucauuua

SEQ ID NO: 4069857 - RNA, 22 nt, Vaccinia virus
aaucaguuacaaaacguuuaua

SEQ ID NO: 4069858 - RNA, 21 nt, Vaccinia virus
aaucauaguuuuuacacauag

SEQ ID NO: 4069859 - RNA, 20 nt, Vaccinia virus
aaucaucaauccuucagaua

SEQ ID NO: 4069860 - RNA, 18 nt, Vaccinia virus
aaucaugaauuuacagaa

SEQ ID NO: 4069861 - RNA, 16 nt, Vaccinia virus
aaucauggacuuuaua

SEQ ID NO: 4069862 - RNA, 14 nt, Vaccinia virus
aaucauuaaaugau

SEQ ID NO: 4069863 - RNA, 20 nt, Vaccinia virus
aaucauucucuucuaucuuu

SEQ ID NO: 4069864 - RNA, 22 nt, Vaccinia virus
aaucauugauacauuuaaaagu

SEQ ID NO: 4069865 - RNA, 23 nt, Vaccinia virus
uuuacccgccuucgaauaaauaa

SEQ ID NO: 4069866 - RNA, 13 nt, Vaccinia virus
uuuacccuagaau

SEQ ID NO: 4069867 - RNA, 22 nt, Vaccinia virus
uuuacgcaaaacauuauaauaa

SEQ ID NO: 4069868 - RNA, 17 nt, Vaccinia virus
uuuacgguaucuaauau

SEQ ID NO: 4069869 - RNA, 14 nt, Vaccinia virus
uuuacuggaauuag

SEQ ID NO: 4069870 - RNA, 23 nt, Vaccinia virus
uuuagaaaacucucuauuucuua

SEQ ID NO: 4069871 - RNA, 17 nt, Vaccinia virus
uuuagacgguugagaaa

SEQ ID NO: 4069872 - RNA, 14 nt, Vaccinia virus
uuuagauauaucua

SEQ ID NO: 4069873 - RNA, 19 nt, Vaccinia virus
uuuaggaaugauuaucaaa

SEQ ID NO: 4069874 - RNA, 16 nt, Vaccinia virus
uuuaguccuauuucaa

SEQ ID NO: 4069875 - RNA, 14 nt, Vaccinia virus
uuuaguuuaucaaa

SEQ ID NO: 4069876 - RNA, 16 nt, Vaccinia virus
uuuaguuuauucauaa

SEQ ID NO: 4069877 - RNA, 24 nt, Vaccinia virus
uuuauaaagaaauacauaucgcac

SEQ ID NO: 4069878 - RNA, 15 nt, Vaccinia virus
uuuauaaaguuuagu

SEQ ID NO: 4069879 - RNA, 12 nt, Vaccinia virus
uuuauaaauuuu

SEQ ID NO: 4069880 - RNA, 15 nt, Vaccinia virus
uuuauacuucuaaug

SEQ ID NO: 4069881 - RNA, 19 nt, Vaccinia virus
uuuauaggcgguguauuua

SEQ ID NO: 4069882 - RNA, 15 nt, Vaccinia virus
uuuauaucaauaaga

SEQ ID NO: 4069883 - RNA, 14 nt, Vaccinia virus
uuuauauuaaauau

SEQ ID NO: 4069884 - RNA, 16 nt, Vaccinia virus
uuuaucgcacagauau

SEQ ID NO: 4069885 - RNA, 22 nt, Vaccinia virus
uuuaucguggaaaauauggaca

SEQ ID NO: 4069886 - RNA, 12 nt, Vaccinia virus
uuuaucuauacu

SEQ ID NO: 4069887 - RNA, 21 nt, Vaccinia virus
uuuaucuuucccccuagauac

SEQ ID NO: 4069888 - RNA, 16 nt, Vaccinia virus
uuuauggaauaguuuu

SEQ ID NO: 4069889 - RNA, 23 nt, Vaccinia virus
uuuauuauauucaguaaccaaau

SEQ ID NO: 4069890 - RNA, 13 nt, Vaccinia virus
uuuauucuagaau

SEQ ID NO: 4069891 - RNA, 12 nt, Vaccinia virus
uuuauucucaaa

SEQ ID NO: 4069892 - RNA, 19 nt, Vaccinia virus
uuuauugucguacuuuaua

SEQ ID NO: 4069893 - RNA, 13 nt, Vaccinia virus
uuuauuucuaauu

SEQ ID NO: 4069894 - RNA, 14 nt, Vaccinia virus
uuucaaagaaugag

SEQ ID NO: 4069895 - RNA, 13 nt, Vaccinia virus
uuucaaauaccag

SEQ ID NO: 4069896 - RNA, 21 nt, Vaccinia virus
uuucaauauugaaaauacuaa

SEQ ID NO: 4069897 - RNA, 17 nt, Vaccinia virus
uuucaauuuauuguaaa

SEQ ID NO: 4069898 - RNA, 21 nt, Vaccinia virus
uuucagcguggauuucucaua

SEQ ID NO: 4069899 - RNA, 12 nt, Vaccinia virus
uuucaucaagau

SEQ ID NO: 4069900 - RNA, 16 nt, Vaccinia virus
uuucaucuauaucauu

SEQ ID NO: 4069901 - RNA, 20 nt, Vaccinia virus
uuucauucgaagacgcuaua

SEQ ID NO: 4069902 - RNA, 19 nt, Vaccinia virus
uuuccaaauuaguuagccg

SEQ ID NO: 4069903 - RNA, 19 nt, Vaccinia virus
uuuccaucaucgucuuauu

SEQ ID NO: 4069904 - RNA, 15 nt, Vaccinia virus
uuuccauuuuuaauu

SEQ ID NO: 4069905 - RNA, 15 nt, Vaccinia virus
uuucccauacuaauu

SEQ ID NO: 4069906 - RNA, 12 nt, Vaccinia virus
uuuccuagauac

SEQ ID NO: 4069907 - RNA, 16 nt, Vaccinia virus
uuucgaagaucuucuu

SEQ ID NO: 4069908 - RNA, 14 nt, Vaccinia virus
uuucgaauaaguuu

SEQ ID NO: 4069909 - RNA, 17 nt, Vaccinia virus
uuucgauuucuggauau

SEQ ID NO: 4069910 - RNA, 17 nt, Vaccinia virus
uuucgcgggauacauca

SEQ ID NO: 4069911 - RNA, 16 nt, Vaccinia virus
uuucguacauuuuuaa

SEQ ID NO: 4069912 - RNA, 17 nt, Vaccinia virus
uuucguaccaacucauu

SEQ ID NO: 4069913 - RNA, 17 nt, Vaccinia virus
uuucguauaauuuuuaa

SEQ ID NO: 4069914 - RNA, 20 nt, Vaccinia virus
uuucguuaaaacauucaaau

SEQ ID NO: 4069915 - RNA, 16 nt, Vaccinia virus
uuucguugguagauau

SEQ ID NO: 4069916 - RNA, 20 nt, Vaccinia virus
uuucuaacucgguaaaaaaa

SEQ ID NO: 4069917 - RNA, 17 nt, Vaccinia virus
uuucuaccuuuucaauu

SEQ ID NO: 4069918 - RNA, 15 nt, Vaccinia virus
uuucuagaacaucau

SEQ ID NO: 4069919 - RNA, 14 nt, Vaccinia virus
uuucuagacaucuu

SEQ ID NO: 4069920 - RNA, 16 nt, Vaccinia virus
uuucuaucgaauguag

SEQ ID NO: 4069921 - RNA, 18 nt, Vaccinia virus
uuucucaaccauagauau

SEQ ID NO: 4069922 - RNA, 13 nt, Vaccinia virus
uuucucauaauaa

SEQ ID NO: 4069923 - RNA, 19 nt, Vaccinia virus
uuucucucauguauaauaa

SEQ ID NO: 4069924 - RNA, 18 nt, Vaccinia virus
uuucugaauuauuucaua

SEQ ID NO: 4069925 - RNA, 21 nt, Vaccinia virus
uuucugguuuucuauaaauaa

SEQ ID NO: 4069926 - RNA, 20 nt, Vaccinia virus
uuucuguaaauucaugauug

SEQ ID NO: 4069927 - RNA, 13 nt, Vaccinia virus
uuucuguaaugau

SEQ ID NO: 4069928 - RNA, 21 nt, Vaccinia virus
uuucuuaaucaguccaucauu

SEQ ID NO: 4069929 - RNA, 14 nt, Vaccinia virus
uuucuucauaugau

SEQ ID NO: 4069930 - RNA, 15 nt, Vaccinia virus
uuucuuggcaaaaga

SEQ ID NO: 4069931 - RNA, 15 nt, Vaccinia virus
uuucuuguuaaugau

SEQ ID NO: 4069932 - RNA, 20 nt, Vaccinia virus
uuugaaauaucuuaugauga

SEQ ID NO: 4069933 - RNA, 14 nt, Vaccinia virus
uuugaacauguaga

SEQ ID NO: 4069934 - RNA, 13 nt, Vaccinia virus
uuugacuagauaa

SEQ ID NO: 4069935 - RNA, 16 nt, Vaccinia virus
uuugacuuacauaaau

SEQ ID NO: 4069936 - RNA, 23 nt, Vaccinia virus
uuugauagcuaacucgguaucua

SEQ ID NO: 4069937 - RNA, 21 nt, Vaccinia virus
uuugcucuauaaacugaauau

SEQ ID NO: 4069938 - RNA, 16 nt, Vaccinia virus
uuuggcaauaaaguuu

SEQ ID NO: 4069939 - RNA, 15 nt, Vaccinia virus
uuuggcuaaacuaua

SEQ ID NO: 4069940 - RNA, 15 nt, Vaccinia virus
uuuggcuuugugcau

SEQ ID NO: 4069941 - RNA, 20 nt, Vaccinia virus
uuugguacguugauuucuag

SEQ ID NO: 4069942 - RNA, 18 nt, Vaccinia virus
uuugguguaaaucuaauu

SEQ ID NO: 4069943 - RNA, 16 nt, Vaccinia virus
uuuguaauugugacau

SEQ ID NO: 4069944 - RNA, 12 nt, Vaccinia virus
uuuguacauuuu

SEQ ID NO: 4069945 - RNA, 20 nt, Vaccinia virus
uuuguaccaacaaacuguuc

SEQ ID NO: 4069946 - RNA, 17 nt, Vaccinia virus
uuuguacgucacaucuu

SEQ ID NO: 4069947 - RNA, 22 nt, Vaccinia virus
uuuguagucuuucaacauccuu

SEQ ID NO: 4069948 - RNA, 20 nt, Vaccinia virus
uuuguccacguucuuuaauu

SEQ ID NO: 4069949 - RNA, 21 nt, Vaccinia virus
uuuguccauuauuucuauauu

SEQ ID NO: 4069950 - RNA, 20 nt, Vaccinia virus
uuugucuccuucuccguaaa

SEQ ID NO: 4069951 - RNA, 19 nt, Vaccinia virus
uuugucuuccuuaacuaua

SEQ ID NO: 4069952 - RNA, 18 nt, Vaccinia virus
uuugugaaaacagauaac

SEQ ID NO: 4069953 - RNA, 17 nt, Vaccinia virus
uuuguuaaaaauuuaga

SEQ ID NO: 4069954 - RNA, 16 nt, Vaccinia virus
uuuguucuuguagaua

SEQ ID NO: 4069955 - RNA, 18 nt, Vaccinia virus
uuuuaaacaacuaaacag

SEQ ID NO: 4069956 - RNA, 17 nt, Vaccinia virus
uuuuaaaguuaaucaua

SEQ ID NO: 4069957 - RNA, 13 nt, Vaccinia virus
uuuuaacaucuuu

SEQ ID NO: 4069958 - RNA, 17 nt, Vaccinia virus
uuuuaacgauaguaaac

SEQ ID NO: 4069959 - RNA, 21 nt, Vaccinia virus
uuuuaacgcgucugaauguau

SEQ ID NO: 4069960 - RNA, 12 nt, Vaccinia virus
uuuuacauuacu

SEQ ID NO: 4069961 - RNA, 22 nt, Vaccinia virus
uuuuacccucaaucauguacua

SEQ ID NO: 4069962 - RNA, 16 nt, Vaccinia virus
uuuuagaaauauacag

SEQ ID NO: 4069963 - RNA, 17 nt, Vaccinia virus
uuuuagauuuuagcaua

SEQ ID NO: 4069964 - RNA, 12 nt, Vaccinia virus
uuuuauaaacaa

SEQ ID NO: 4069965 - RNA, 20 nt, Vaccinia virus
uuuuauauccaauguauuua

SEQ ID NO: 4069966 - RNA, 20 nt, Vaccinia virus
uuuuauauguguuugaucua

SEQ ID NO: 4069967 - RNA, 20 nt, Vaccinia virus
uuuuaucgauucaucuaauu

SEQ ID NO: 4069968 - RNA, 17 nt, Vaccinia virus
uuuucaauuauguauca

SEQ ID NO: 4069969 - RNA, 16 nt, Vaccinia virus
uuuucauaaauacacu

SEQ ID NO: 4069970 - RNA, 14 nt, Vaccinia virus
uuuucauguaucga

SEQ ID NO: 4069971 - RNA, 15 nt, Vaccinia virus
uuuuccaaaguuuua

SEQ ID NO: 4069972 - RNA, 12 nt, Vaccinia virus
uuuuccaugaua

SEQ ID NO: 4069973 - RNA, 21 nt, Vaccinia virus
uuuuccucagacaucuaaaaa

SEQ ID NO: 4069974 - RNA, 22 nt, Vaccinia virus
uuuucuacugaugcauguauuu

SEQ ID NO: 4069975 - RNA, 20 nt, Vaccinia virus
uuuucuauaaauaaaagaca

SEQ ID NO: 4069976 - RNA, 23 nt, Vaccinia virus
uuuugaagacgaugauucgucua

SEQ ID NO: 4069977 - RNA, 20 nt, Vaccinia virus
uuuugguggagguguaacug

SEQ ID NO: 4069978 - RNA, 17 nt, Vaccinia virus
uuuuuaaaaucaucauu

SEQ ID NO: 4069979 - RNA, 22 nt, Vaccinia virus
uuuuucauccuugcuaucaaag

SEQ ID NO: 4069980 - RNA, 15 nt, Vaccinia virus
uuuuuguuuaaccac

SEQ ID NO: 4069981 - RNA, 16 nt, Vaccinia virus
ucgauuuucuacagau

SEQ ID NO: 4069982 - RNA, 13 nt, Vaccinia virus
ucgcagaugauga

SEQ ID NO: 4069983 - RNA, 19 nt, Vaccinia virus
ucgcauuaauacuguuuuc

SEQ ID NO: 4069984 - RNA, 17 nt, Vaccinia virus
ucgcccaucucauacau

SEQ ID NO: 4069985 - RNA, 20 nt, Vaccinia virus
ucgcuaauguauagauuguu

SEQ ID NO: 4069986 - RNA, 14 nt, Vaccinia virus
ucgcuuucuagaau

SEQ ID NO: 4069987 - RNA, 17 nt, Vaccinia virus
ucggauaauauguaaaa

SEQ ID NO: 4069988 - RNA, 16 nt, Vaccinia virus
ucggauacucuauuaa

SEQ ID NO: 4069989 - RNA, 18 nt, Vaccinia virus
ucgggacgcguauauguu

SEQ ID NO: 4069990 - RNA, 19 nt, Vaccinia virus
ucguaauuauaguucuuaa

SEQ ID NO: 4069991 - RNA, 17 nt, Vaccinia virus
ucguacaaggauuucaa

SEQ ID NO: 4069992 - RNA, 19 nt, Vaccinia virus
ucguacauaaguuguacag

SEQ ID NO: 4069993 - RNA, 19 nt, Vaccinia virus
ucguacgauccaaauuccg

SEQ ID NO: 4069994 - RNA, 18 nt, Vaccinia virus
ucguacuauaccacauac

SEQ ID NO: 4069995 - RNA, 17 nt, Vaccinia virus
ucguacuuuauaucgug

SEQ ID NO: 4069996 - RNA, 17 nt, Vaccinia virus
ucguauguagaaauuuu

SEQ ID NO: 4069997 - RNA, 20 nt, Vaccinia virus
ucguauuucauaaaaguuau

SEQ ID NO: 4069998 - RNA, 14 nt, Vaccinia virus
ucgucuaaaguuua

SEQ ID NO: 4069999 - RNA, 18 nt, Vaccinia virus
ucgucuagcguugcuucu

SEQ ID NO: 4070000 - RNA, 15 nt, Vaccinia virus
ucgucuuucugaaug

SEQ ID NO: 4070001 - RNA, 19 nt, Vaccinia virus
ucguuaaacgccuuuagaa

SEQ ID NO: 4070002 - RNA, 12 nt, Vaccinia virus
ucguuacaaaag

SEQ ID NO: 4070003 - RNA, 15 nt, Vaccinia virus
ucguuauagaaugca

SEQ ID NO: 4070004 - RNA, 14 nt, Vaccinia virus
ucguuaucucagaa

SEQ ID NO: 4070005 - RNA, 21 nt, Vaccinia virus
ucguuccgccaaauuuucauu

SEQ ID NO: 4070006 - RNA, 16 nt, Vaccinia virus
ucguugacaucuugaa

SEQ ID NO: 4070007 - RNA, 16 nt, Vaccinia virus
ucguuuaauacuacau

SEQ ID NO: 4070008 - RNA, 16 nt, Vaccinia virus
ucguuugaugaucaua

SEQ ID NO: 4070009 - RNA, 13 nt, Vaccinia virus
ucguuuucaucuu

SEQ ID NO: 4070010 - RNA, 16 nt, Vaccinia virus
ucguuuuucuuaagaa

SEQ ID NO: 4070011 - RNA, 21 nt, Vaccinia virus
ucuaaaaauguuaauuuugaa

SEQ ID NO: 4070012 - RNA, 19 nt, Vaccinia virus
ucuaaacaagcgauuuaga

SEQ ID NO: 4070013 - RNA, 18 nt, Vaccinia virus
ucuaaacaguauguugua

SEQ ID NO: 4070014 - RNA, 16 nt, Vaccinia virus
ucuaaaccuucuuauu

SEQ ID NO: 4070015 - RNA, 16 nt, Vaccinia virus
ucuaaacgauuuagua

SEQ ID NO: 4070016 - RNA, 21 nt, Vaccinia virus
ucuaaaguuaagagauuuaga

SEQ ID NO: 4070017 - RNA, 22 nt, Vaccinia virus
ucuaaaguuaagagauuuagaa

SEQ ID NO: 4070018 - RNA, 19 nt, Vaccinia virus
ucuaacgccgaucucugaa

SEQ ID NO: 4070019 - RNA, 14 nt, Vaccinia virus
ucuaagauguugua

SEQ ID NO: 4070020 - RNA, 20 nt, Vaccinia virus
ucuaauagaucugauuagua

SEQ ID NO: 4070021 - RNA, 21 nt, Vaccinia virus
ucuaauugucggaauuauuuu

SEQ ID NO: 4070022 - RNA, 22 nt, Vaccinia virus
ucuacaaauagagauaaaacaa

SEQ ID NO: 4070023 - RNA, 23 nt, Vaccinia virus
ucuaccaaagaaagaguuugauu

SEQ ID NO: 4070024 - RNA, 16 nt, Vaccinia virus
ucuaccggaguuauau

SEQ ID NO: 4070025 - RNA, 18 nt, Vaccinia virus
ucuaccguuguuaaauac

SEQ ID NO: 4070026 - RNA, 19 nt, Vaccinia virus
ucuacuagacuauuaauaa

SEQ ID NO: 4070027 - RNA, 14 nt, Vaccinia virus
ucuacucuagauaa

SEQ ID NO: 4070028 - RNA, 16 nt, Vaccinia virus
ucuacugauaaaacug

SEQ ID NO: 4070029 - RNA, 14 nt, Vaccinia virus
ucuagauauuagua

SEQ ID NO: 4070030 - RNA, 18 nt, Vaccinia virus
ucuagaucucuagaauau

SEQ ID NO: 4070031 - RNA, 14 nt, Vaccinia virus
ucuagauguagaag

SEQ ID NO: 4070032 - RNA, 23 nt, Vaccinia virus
ucuagcaaaaauucuaugucuaa

SEQ ID NO: 4070033 - RNA, 15 nt, Vaccinia virus
ucuagccauaucuaa

SEQ ID NO: 4070034 - RNA, 18 nt, Vaccinia virus
ucuagccauaucuaaagc

SEQ ID NO: 4070035 - RNA, 21 nt, Vaccinia virus
ucuagccucgguaaucuguac

SEQ ID NO: 4070036 - RNA, 15 nt, Vaccinia virus
ucuauaagguuucuu

SEQ ID NO: 4070037 - RNA, 12 nt, Vaccinia virus
ucuauaggaaag

SEQ ID NO: 4070038 - RNA, 18 nt, Vaccinia virus
ucuauauacuauauagua

SEQ ID NO: 4070039 - RNA, 21 nt, Vaccinia virus
ucuaucaaaaguuaauuucua

SEQ ID NO: 4070040 - RNA, 22 nt, Vaccinia virus
ucuaucaaaaguuaauuucuau

SEQ ID NO: 4070041 - RNA, 13 nt, Vaccinia virus
ucuaucaauaacu

SEQ ID NO: 4070042 - RNA, 18 nt, Vaccinia virus
ucuaucagaguccaugua

SEQ ID NO: 4070043 - RNA, 17 nt, Vaccinia virus
ucuauccaagauacuua

SEQ ID NO: 4070044 - RNA, 16 nt, Vaccinia virus
ugacgcuuucaagaau

SEQ ID NO: 4070045 - RNA, 13 nt, Vaccinia virus
ugacguaaaugua

SEQ ID NO: 4070046 - RNA, 16 nt, Vaccinia virus
ugacguauuggaugau

SEQ ID NO: 4070047 - RNA, 19 nt, Vaccinia virus
ugacgucguucuacauaaa

SEQ ID NO: 4070048 - RNA, 14 nt, Vaccinia virus
ugacuaaaaugcug

SEQ ID NO: 4070049 - RNA, 17 nt, Vaccinia virus
ugacuagacugauuucu

SEQ ID NO: 4070050 - RNA, 19 nt, Vaccinia virus
ugacuaguccaaagacuua

SEQ ID NO: 4070051 - RNA, 20 nt, Vaccinia virus
ugacuaucuuuugaaaauau

SEQ ID NO: 4070052 - RNA, 14 nt, Vaccinia virus
ugacuauugagacg

SEQ ID NO: 4070053 - RNA, 21 nt, Vaccinia virus
ugacuauugcguguagaguau

SEQ ID NO: 4070054 - RNA, 17 nt, Vaccinia virus
ugacuccuauguuuccc

SEQ ID NO: 4070055 - RNA, 23 nt, Vaccinia virus
ugacuguauccacgcuagagaua

SEQ ID NO: 4070056 - RNA, 12 nt, Vaccinia virus
ugacuguuuucu

SEQ ID NO: 4070057 - RNA, 17 nt, Vaccinia virus
ugacuuaugaauacuaa

SEQ ID NO: 4070058 - RNA, 23 nt, Vaccinia virus
ugacuuuuugguccauuuuucca

SEQ ID NO: 4070059 - RNA, 23 nt, Vaccinia virus
ugagaaaagguucuaucaacaau

SEQ ID NO: 4070060 - RNA, 14 nt, Vaccinia virus
ugagaauauguucc

SEQ ID NO: 4070061 - RNA, 18 nt, Vaccinia virus
ugagaauggaaaggaaac

SEQ ID NO: 4070062 - RNA, 12 nt, Vaccinia virus
ugagacauaucc

SEQ ID NO: 4070063 - RNA, 23 nt, Vaccinia virus
ugagacgggucaaacaauuuuaa

SEQ ID NO: 4070064 - RNA, 20 nt, Vaccinia virus
ugagaguuuuauauguagca

SEQ ID NO: 4070065 - RNA, 22 nt, Vaccinia virus
ugagauacuaacacauuucaac

SEQ ID NO: 4070066 - RNA, 13 nt, Vaccinia virus
ugagauucuccau

SEQ ID NO: 4070067 - RNA, 19 nt, Vaccinia virus
ugagcauaaacauaauaaa

SEQ ID NO: 4070068 - RNA, 21 nt, Vaccinia virus
ugaggaaugauugccuucauc

SEQ ID NO: 4070069 - RNA, 22 nt, Vaccinia virus
ugaguaguuggaagaaucucau

SEQ ID NO: 4070070 - RNA, 19 nt, Vaccinia virus
ugaguuccauuacaaauau

SEQ ID NO: 4070071 - RNA, 20 nt, Vaccinia virus
ugauaaagauauuuauccuu

SEQ ID NO: 4070072 - RNA, 14 nt, Vaccinia virus
ugauaaauauacaa

SEQ ID NO: 4070073 - RNA, 21 nt, Vaccinia virus
ugauaaguucuuuauacaguu

SEQ ID NO: 4070074 - RNA, 20 nt, Vaccinia virus
ugauacggcgaugguuuuua

SEQ ID NO: 4070075 - RNA, 11 nt, Vaccinia virus
ugauagaaaau

SEQ ID NO: 4070076 - RNA, 20 nt, Vaccinia virus
ugauagaacugguaugaaca

SEQ ID NO: 4070077 - RNA, 16 nt, Vaccinia virus
ugauagaauagaugcu

SEQ ID NO: 4070078 - RNA, 20 nt, Vaccinia virus
ugauagugaaugaaucagau

SEQ ID NO: 4070079 - RNA, 17 nt, Vaccinia virus
ugauauacagucuuaaa

SEQ ID NO: 4070080 - RNA, 23 nt, Vaccinia virus
ugauauacagucuuaaauaguua

SEQ ID NO: 4070081 - RNA, 13 nt, Vaccinia virus
ugauauagaucuu

SEQ ID NO: 4070082 - RNA, 17 nt, Vaccinia virus
ugauauauauuuucacu

SEQ ID NO: 4070083 - RNA, 21 nt, Vaccinia virus
ugauauauccagauuacuaac

SEQ ID NO: 4070084 - RNA, 21 nt, Vaccinia virus
ugauaucaaacggauauugcc

SEQ ID NO: 4070085 - RNA, 17 nt, Vaccinia virus
ugauauccgcuauuaca

SEQ ID NO: 4070086 - RNA, 20 nt, Vaccinia virus
ugauaucgacggaagaaguu

SEQ ID NO: 4070087 - RNA, 17 nt, Vaccinia virus
ugauaucuuuagauaua

SEQ ID NO: 4070088 - RNA, 18 nt, Vaccinia virus
ugauauguauauuauuca

SEQ ID NO: 4070089 - RNA, 16 nt, Vaccinia virus
ugauauguuuucagcu

SEQ ID NO: 4070090 - RNA, 19 nt, Vaccinia virus
ugauauuucauauacuauu

SEQ ID NO: 4070091 - RNA, 22 nt, Vaccinia virus
ugaucucgccguagcuaccaug

SEQ ID NO: 4070092 - RNA, 18 nt, Vaccinia virus
ugaugaauaauuuagaua

SEQ ID NO: 4070093 - RNA, 13 nt, Vaccinia virus
ugaugaauuauua

SEQ ID NO: 4070094 - RNA, 14 nt, Vaccinia virus
ugaugaguuguaca

SEQ ID NO: 4070095 - RNA, 18 nt, Vaccinia virus
ugaugcaaauagcagaua

SEQ ID NO: 4070096 - RNA, 14 nt, Vaccinia virus
ugaugccaauaagc

SEQ ID NO: 4070097 - RNA, 14 nt, Vaccinia virus
ugauggaugagaua

SEQ ID NO: 4070098 - RNA, 21 nt, Vaccinia virus
ugaugguagucaauugauguu

SEQ ID NO: 4070099 - RNA, 15 nt, Vaccinia virus
ugaugucuauguacg

SEQ ID NO: 4070100 - RNA, 14 nt, Vaccinia virus
ugaugugaauuuag

SEQ ID NO: 4070101 - RNA, 23 nt, Vaccinia virus
ugauuaacagaaaaaacaauguu

SEQ ID NO: 4070102 - RNA, 20 nt, Vaccinia virus
ugauuagaaaauauaaauua

SEQ ID NO: 4070103 - RNA, 20 nt, Vaccinia virus
ugauuauccuaaucaggaau

SEQ ID NO: 4070104 - RNA, 23 nt, Vaccinia virus
ugauucgaauuuaguuucuucga

SEQ ID NO: 4070105 - RNA, 13 nt, Vaccinia virus
ugauucuacagua

SEQ ID NO: 4070106 - RNA, 23 nt, Vaccinia virus
ugauucuagucccgaagaauuuc

SEQ ID NO: 4070107 - RNA, 14 nt, Vaccinia virus
ugauugaaaaugaa

SEQ ID NO: 4070108 - RNA, 15 nt, Vaccinia virus
ugauuucuugaacau

SEQ ID NO: 4070109 - RNA, 17 nt, Vaccinia virus
ugcaaagucuaaauauu

SEQ ID NO: 4070110 - RNA, 17 nt, Vaccinia virus
ucagcauccacucauau

SEQ ID NO: 4070111 - RNA, 17 nt, Vaccinia virus
ucagcauuacuugauau

SEQ ID NO: 4070112 - RNA, 21 nt, Vaccinia virus
ucagccgcuacagaaacauau

SEQ ID NO: 4070113 - RNA, 13 nt, Vaccinia virus
ucagcuuuaguuu

SEQ ID NO: 4070114 - RNA, 14 nt, Vaccinia virus
ucaggaacauaaac

SEQ ID NO: 4070115 - RNA, 21 nt, Vaccinia virus
ucaggacgaauaauucuaaua

SEQ ID NO: 4070116 - RNA, 20 nt, Vaccinia virus
ucagguuaucaucauccauu

SEQ ID NO: 4070117 - RNA, 22 nt, Vaccinia virus
ucagguucaucgaucucuauaa

SEQ ID NO: 4070118 - RNA, 13 nt, Vaccinia virus
ucaguaucuucag

SEQ ID NO: 4070119 - RNA, 15 nt, Vaccinia virus
ucaguaucuucuuua

SEQ ID NO: 4070120 - RNA, 13 nt, Vaccinia virus
ucauaaaaaccau

SEQ ID NO: 4070121 - RNA, 23 nt, Vaccinia virus
ucauaaacaagcccgucaauaau

SEQ ID NO: 4070122 - RNA, 23 nt, Vaccinia virus
ucauaaacucauccuaucuggag

SEQ ID NO: 4070123 - RNA, 13 nt, Vaccinia virus
ucauaagaacuau

SEQ ID NO: 4070124 - RNA, 13 nt, Vaccinia virus
ucauaauaaauuu

SEQ ID NO: 4070125 - RNA, 15 nt, Vaccinia virus
ucauaauaucuuuaa

SEQ ID NO: 4070126 - RNA, 18 nt, Vaccinia virus
ucauaauguaaucucuaa

SEQ ID NO: 4070127 - RNA, 18 nt, Vaccinia virus
ucauaauuguuagcuguu

SEQ ID NO: 4070128 - RNA, 13 nt, Vaccinia virus
ucauagaacagac

SEQ ID NO: 4070129 - RNA, 16 nt, Vaccinia virus
ucauagaugaaauacu

SEQ ID NO: 4070130 - RNA, 20 nt, Vaccinia virus
ucauagccgcucuuagaguu

SEQ ID NO: 4070131 - RNA, 16 nt, Vaccinia virus
ucauagcugagaauau

SEQ ID NO: 4070132 - RNA, 13 nt, Vaccinia virus
ucauauaaauguu

SEQ ID NO: 4070133 - RNA, 17 nt, Vaccinia virus
ucauauaccauuucuag

SEQ ID NO: 4070134 - RNA, 21 nt, Vaccinia virus
ucauauacguucgucaccaga

SEQ ID NO: 4070135 - RNA, 19 nt, Vaccinia virus
ucauauaucugcucuuaaa

SEQ ID NO: 4070136 - RNA, 23 nt, Vaccinia virus
ucauaucuagaaugaagauauca

SEQ ID NO: 4070137 - RNA, 15 nt, Vaccinia virus
ucauaugauuucagu

SEQ ID NO: 4070138 - RNA, 21 nt, Vaccinia virus
ucauaugugcuaaaaaguuuu

SEQ ID NO: 4070139 - RNA, 13 nt, Vaccinia virus
ucauauuaaacau

SEQ ID NO: 4070140 - RNA, 14 nt, Vaccinia virus
ucauauucauacac

SEQ ID NO: 4070141 - RNA, 12 nt, Vaccinia virus
ucauauuuagac

SEQ ID NO: 4070142 - RNA, 19 nt, Vaccinia virus
ucaucaaaagacuuaugau

SEQ ID NO: 4070143 - RNA, 16 nt, Vaccinia virus
ucaucaacuagacguu

SEQ ID NO: 4070144 - RNA, 20 nt, Vaccinia virus
ucaucaacuagacguuuauu

SEQ ID NO: 4070145 - RNA, 20 nt, Vaccinia virus
ucaucauaguuacgauuuua

SEQ ID NO: 4070146 - RNA, 21 nt, Vaccinia virus
ucaucauccucuggugguucg

SEQ ID NO: 4070147 - RNA, 14 nt, Vaccinia virus
ucaucauuaucauu

SEQ ID NO: 4070148 - RNA, 13 nt, Vaccinia virus
ucaucauuucuaa

SEQ ID NO: 4070149 - RNA, 15 nt, Vaccinia virus
ucauccaguugaaug

SEQ ID NO: 4070150 - RNA, 15 nt, Vaccinia virus
ucauccaugguuuua

SEQ ID NO: 4070151 - RNA, 16 nt, Vaccinia virus
ucaucuaccaauucau

SEQ ID NO: 4070152 - RNA, 22 nt, Vaccinia virus
ucaucugggaauaaaauacuac

SEQ ID NO: 4070153 - RNA, 17 nt, Vaccinia virus
ucaugagauguguauac

SEQ ID NO: 4070154 - RNA, 20 nt, Vaccinia virus
ucaugauugccggucauaaa

SEQ ID NO: 4070155 - RNA, 15 nt, Vaccinia virus
ucaugauuucauuau

SEQ ID NO: 4070156 - RNA, 20 nt, Vaccinia virus
ucaugccauuaagaaacuag

SEQ ID NO: 4070157 - RNA, 22 nt, Vaccinia virus
ucaugccuuuccuggaauauca

SEQ ID NO: 4070158 - RNA, 15 nt, Vaccinia virus
ucauggcaucauaga

SEQ ID NO: 4070159 - RNA, 20 nt, Vaccinia virus
ucaugguuauacaggcauua

SEQ ID NO: 4070160 - RNA, 19 nt, Vaccinia virus
ucauguauuugagaguuuu

SEQ ID NO: 4070161 - RNA, 16 nt, Vaccinia virus
ucauguguagaugcua

SEQ ID NO: 4070162 - RNA, 15 nt, Vaccinia virus
ucauguuauaguguu

SEQ ID NO: 4070163 - RNA, 13 nt, Vaccinia virus
ucauuaaacaucu

SEQ ID NO: 4070164 - RNA, 17 nt, Vaccinia virus
ucauuaaguucacuaga

SEQ ID NO: 4070165 - RNA, 14 nt, Vaccinia virus
ucauuaauuucuga

SEQ ID NO: 4070166 - RNA, 12 nt, Vaccinia virus
ucauuagaauau

SEQ ID NO: 4070167 - RNA, 17 nt, Vaccinia virus
ucauuauaacucuagaa

SEQ ID NO: 4070168 - RNA, 18 nt, Vaccinia virus
ucauucaaauccauaaau

SEQ ID NO: 4070169 - RNA, 22 nt, Vaccinia virus
ucauucaaauccauaaauaaag

SEQ ID NO: 4070170 - RNA, 18 nt, Vaccinia virus
ucauucgcggaacuacau

SEQ ID NO: 4070171 - RNA, 15 nt, Vaccinia virus
ucauucguaaaucuu

SEQ ID NO: 4070172 - RNA, 15 nt, Vaccinia virus
ucauucuagaacuau

SEQ ID NO: 4070173 - RNA, 16 nt, Vaccinia virus
ucauugaugaaaauac

SEQ ID NO: 4070174 - RNA, 12 nt, Vaccinia virus
ucauugauuuua

SEQ ID NO: 4070175 - RNA, 12 nt, Vaccinia virus
ucauugauuuuu

SEQ ID NO: 4070176 - RNA, 23 nt, Vaccinia virus
ucauuuaacagauguaguaguau

SEQ ID NO: 4070177 - RNA, 16 nt, Vaccinia virus
ucauuucacaauucau

SEQ ID NO: 4070178 - RNA, 11 nt, Vaccinia virus
ucauuucaguu

SEQ ID NO: 4070179 - RNA, 22 nt, Vaccinia virus
ucauuugcucggcaguaaucaa

SEQ ID NO: 4070180 - RNA, 12 nt, Vaccinia virus
ucauuuguacau

SEQ ID NO: 4070181 - RNA, 19 nt, Vaccinia virus
uccaaguucuauaguuucu

SEQ ID NO: 4070182 - RNA, 23 nt, Vaccinia virus
uccaaucuaagaaauuuaaaauu

SEQ ID NO: 4070183 - RNA, 12 nt, Vaccinia virus
uccaauguuuaa

SEQ ID NO: 4070184 - RNA, 19 nt, Vaccinia virus
uccacaguuuuuaauuucu

SEQ ID NO: 4070185 - RNA, 17 nt, Vaccinia virus
uccacguucuacaaaag

SEQ ID NO: 4070186 - RNA, 22 nt, Vaccinia virus
uccaggaucguuucuacaaaau

SEQ ID NO: 4070187 - RNA, 17 nt, Vaccinia virus
uccagguuuuuuaucuc

SEQ ID NO: 4070188 - RNA, 15 nt, Vaccinia virus
uccagugcauuucua

SEQ ID NO: 4070189 - RNA, 18 nt, Vaccinia virus
uccaucuguggaaaauaa

SEQ ID NO: 4070190 - RNA, 18 nt, Vaccinia virus
uccaugauagaaagaaaa

SEQ ID NO: 4070191 - RNA, 12 nt, Vaccinia virus
uccauuaaugug

SEQ ID NO: 4070192 - RNA, 18 nt, Vaccinia virus
uccauuagccuuuccacu

SEQ ID NO: 4070193 - RNA, 23 nt, Vaccinia virus
uccauuagccuuuccacuucugc

SEQ ID NO: 4070194 - RNA, 19 nt, Vaccinia virus
uccauuauuuauuuacaga

SEQ ID NO: 4070195 - RNA, 22 nt, Vaccinia virus
uccauucucucaaucacuacau

SEQ ID NO: 4070196 - RNA, 14 nt, Vaccinia virus
ucccacauuauuuu

SEQ ID NO: 4070197 - RNA, 12 nt, Vaccinia virus
ucccauguuuca

SEQ ID NO: 4070198 - RNA, 17 nt, Vaccinia virus
ucccauucuaauacuuu

SEQ ID NO: 4070199 - RNA, 13 nt, Vaccinia virus
ucccauugaucau

SEQ ID NO: 4070200 - RNA, 21 nt, Vaccinia virus
uccccaaaaguaaaauaauca

SEQ ID NO: 4070201 - RNA, 15 nt, Vaccinia virus
ucccucguucaucua

SEQ ID NO: 4070202 - RNA, 19 nt, Vaccinia virus
uccgaaacgauaucaugaa

SEQ ID NO: 4070203 - RNA, 17 nt, Vaccinia virus
uccgauuguuguguaca

SEQ ID NO: 4070204 - RNA, 17 nt, Vaccinia virus
uccggagauagauuucc

SEQ ID NO: 4070205 - RNA, 12 nt, Vaccinia virus
uccuacaaccau

SEQ ID NO: 4070206 - RNA, 18 nt, Vaccinia virus
uccuacaggaauaucuuu

SEQ ID NO: 4070207 - RNA, 16 nt, Vaccinia virus
uccuagguuucucuau

SEQ ID NO: 4070208 - RNA, 19 nt, Vaccinia virus
uccuauaccgaguacugua

SEQ ID NO: 4070209 - RNA, 13 nt, Vaccinia virus
uccuaucucugac

SEQ ID NO: 4070210 - RNA, 22 nt, Vaccinia virus
uccucagcgauagcucuucuau

SEQ ID NO: 4070211 - RNA, 11 nt, Vaccinia virus
uccucaucugu

SEQ ID NO: 4070212 - RNA, 17 nt, Vaccinia virus
uccuccaguaaaugacg

SEQ ID NO: 4070213 - RNA, 12 nt, Vaccinia virus
uccuggugauau

SEQ ID NO: 4070214 - RNA, 13 nt, Vaccinia virus
uccuguaauaucu

SEQ ID NO: 4070215 - RNA, 17 nt, Vaccinia virus
uccuucaguuugagaaa

SEQ ID NO: 4070216 - RNA, 13 nt, Vaccinia virus
ucgaauaaaguau

SEQ ID NO: 4070217 - RNA, 22 nt, Vaccinia virus
ucgaauaaguuugcagacaaac

SEQ ID NO: 4070218 - RNA, 14 nt, Vaccinia virus
ucgaauaaugagua

SEQ ID NO: 4070219 - RNA, 14 nt, Vaccinia virus
ucgaauaauguaua

SEQ ID NO: 4070220 - RNA, 17 nt, Vaccinia virus
ucgaauuucuacaaaag

SEQ ID NO: 4070221 - RNA, 16 nt, Vaccinia virus
ucgacaucacaaccua

SEQ ID NO: 4070222 - RNA, 21 nt, Vaccinia virus
ucgacuaucaacaauuuugua

SEQ ID NO: 4070223 - RNA, 19 nt, Vaccinia virus
ucgacuauuuuaaauagca

SEQ ID NO: 4070224 - RNA, 20 nt, Vaccinia virus
ucgacuauuuuaaauagcau

SEQ ID NO: 4070225 - RNA, 23 nt, Vaccinia virus
ucgacucauaagaaagagaauag

SEQ ID NO: 4070226 - RNA, 22 nt, Vaccinia virus
ucgagagacuuuguagaaacaa

SEQ ID NO: 4070227 - RNA, 20 nt, Vaccinia virus
ucgagaugaacauucaucug

SEQ ID NO: 4070228 - RNA, 17 nt, Vaccinia virus
ucgaggacuuggauguu

SEQ ID NO: 4070229 - RNA, 17 nt, Vaccinia virus
ucgauaacacauuuuca

SEQ ID NO: 4070230 - RNA, 21 nt, Vaccinia virus
ucgauaauaacagaauguaga

SEQ ID NO: 4070231 - RNA, 13 nt, Vaccinia virus
ucgauaauuauuu

SEQ ID NO: 4070232 - RNA, 14 nt, Vaccinia virus
ucgauccaauaaau

SEQ ID NO: 4070233 - RNA, 14 nt, Vaccinia virus
ucgaugauguagug

SEQ ID NO: 4070234 - RNA, 17 nt, Vaccinia virus
ucgauguaaaauuuuug

SEQ ID NO: 4070235 - RNA, 19 nt, Vaccinia virus
ucgaugucgauagccauau

SEQ ID NO: 4070236 - RNA, 19 nt, Vaccinia virus
ucgauucccauaugauguu

SEQ ID NO: 4070237 - RNA, 22 nt, Vaccinia virus
ucgauucuggcuauuucaaaau

SEQ ID NO: 4070238 - RNA, 17 nt, Vaccinia virus
uaacaugugucauuuau

SEQ ID NO: 4070239 - RNA, 13 nt, Vaccinia virus
uaacauugagaau

SEQ ID NO: 4070240 - RNA, 21 nt, Vaccinia virus
uaacauuuuuuguaaauguaa

SEQ ID NO: 4070241 - RNA, 20 nt, Vaccinia virus
uaaccaaaaugaaaauacuu

SEQ ID NO: 4070242 - RNA, 21 nt, Vaccinia virus
uaaccaaaaugaaaauacuuu

SEQ ID NO: 4070243 - RNA, 23 nt, Vaccinia virus
uaacccauuauaaaacuuaugau

SEQ ID NO: 4070244 - RNA, 16 nt, Vaccinia virus
uaaccuccugaaaaug

SEQ ID NO: 4070245 - RNA, 21 nt, Vaccinia virus
uaaccuuuuccuuaucuucau

SEQ ID NO: 4070246 - RNA, 12 nt, Vaccinia virus
uaacgaaaauau

SEQ ID NO: 4070247 - RNA, 17 nt, Vaccinia virus
uaacgaggauaaacuau

SEQ ID NO: 4070248 - RNA, 19 nt, Vaccinia virus
uaacgagugaucaaaucau

SEQ ID NO: 4070249 - RNA, 15 nt, Vaccinia virus
uaacgaugauauguu

SEQ ID NO: 4070250 - RNA, 16 nt, Vaccinia virus
uaacgcauaauuauua

SEQ ID NO: 4070251 - RNA, 13 nt, Vaccinia virus
uaacggacaacaa

SEQ ID NO: 4070252 - RNA, 21 nt, Vaccinia virus
uaacggaugaaaauaagaaaa

SEQ ID NO: 4070253 - RNA, 17 nt, Vaccinia virus
uaacgucgguauuauau

SEQ ID NO: 4070254 - RNA, 13 nt, Vaccinia virus
uaacuaaauguca

SEQ ID NO: 4070255 - RNA, 20 nt, Vaccinia virus
uaacuaugcgauuauuuuca

SEQ ID NO: 4070256 - RNA, 21 nt, Vaccinia virus
uaacuaugcgauuauuuucau

SEQ ID NO: 4070257 - RNA, 21 nt, Vaccinia virus
uaacucuuucgaauacuuauu

SEQ ID NO: 4070258 - RNA, 15 nt, Vaccinia virus
uaacugguucaaaau

SEQ ID NO: 4070259 - RNA, 20 nt, Vaccinia virus
uaacuuaaaagaauuacuua

SEQ ID NO: 4070260 - RNA, 21 nt, Vaccinia virus
uaacuuccacauuaauacagc

SEQ ID NO: 4070261 - RNA, 22 nt, Vaccinia virus
uaacuucgugaauaauguuucu

SEQ ID NO: 4070262 - RNA, 13 nt, Vaccinia virus
uaacuucugauuu

SEQ ID NO: 4070263 - RNA, 21 nt, Vaccinia virus
uaacuuucuucugcaaacuua

SEQ ID NO: 4070264 - RNA, 15 nt, Vaccinia virus
uaacuuugauagcaa

SEQ ID NO: 4070265 - RNA, 22 nt, Vaccinia virus
uaacuuugauagcaaggaugaa

SEQ ID NO: 4070266 - RNA, 22 nt, Vaccinia virus
uaagaaaguaauucagacacuu

SEQ ID NO: 4070267 - RNA, 23 nt, Vaccinia virus
uaagaaagugaguuacgaagaua

SEQ ID NO: 4070268 - RNA, 22 nt, Vaccinia virus
uaagaaauccaaauaaaaugga

SEQ ID NO: 4070269 - RNA, 18 nt, Vaccinia virus
uaagaagauuauauucua

SEQ ID NO: 4070270 - RNA, 15 nt, Vaccinia virus
uaagaagucauaugu

SEQ ID NO: 4070271 - RNA, 21 nt, Vaccinia virus
uaagaaucgcgauucuaaaac

SEQ ID NO: 4070272 - RNA, 12 nt, Vaccinia virus
uaagaauuauuu

SEQ ID NO: 4070273 - RNA, 21 nt, Vaccinia virus
uaagacacagaaauacuauau

SEQ ID NO: 4070274 - RNA, 19 nt, Vaccinia virus
uaagaccuaccucucuuaa

SEQ ID NO: 4070275 - RNA, 13 nt, Vaccinia virus
uaagacuuauucu

SEQ ID NO: 4070276 - RNA, 21 nt, Vaccinia virus
uaagacuuuacuuuucuaaau

SEQ ID NO: 4070277 - RNA, 23 nt, Vaccinia virus
uaagagagauuagaguuuguaca

SEQ ID NO: 4070278 - RNA, 16 nt, Vaccinia virus
uaagagaucaaagcau

SEQ ID NO: 4070279 - RNA, 24 nt, Vaccinia virus
uaagagauuuagaaaacauuauau

SEQ ID NO: 4070280 - RNA, 16 nt, Vaccinia virus
uaagagccagauuucg

SEQ ID NO: 4070281 - RNA, 21 nt, Vaccinia virus
uaagaggcauaaucaauguug

SEQ ID NO: 4070282 - RNA, 21 nt, Vaccinia virus
uaagaguguaguaucauagau

SEQ ID NO: 4070283 - RNA, 12 nt, Vaccinia virus
uaagauacugug

SEQ ID NO: 4070284 - RNA, 16 nt, Vaccinia virus
uaagauaguauauucu

SEQ ID NO: 4070285 - RNA, 18 nt, Vaccinia virus
uaagauguuugagaauau

SEQ ID NO: 4070286 - RNA, 14 nt, Vaccinia virus
uaagcaacaugucu

SEQ ID NO: 4070287 - RNA, 19 nt, Vaccinia virus
uaaggacauuggauaugug

SEQ ID NO: 4070288 - RNA, 19 nt, Vaccinia virus
uaaguaauaaaucaacuau

SEQ ID NO: 4070289 - RNA, 14 nt, Vaccinia virus
uaagucacacuaag

SEQ ID NO: 4070290 - RNA, 18 nt, Vaccinia virus
uaagugauauaaaacuau

SEQ ID NO: 4070291 - RNA, 15 nt, Vaccinia virus
uaaguucauaaucau

SEQ ID NO: 4070292 - RNA, 19 nt, Vaccinia virus
uaaguucauuaucugaaau

SEQ ID NO: 4070293 - RNA, 20 nt, Vaccinia virus
uaaguuuaugagcuuuuaua

SEQ ID NO: 4070294 - RNA, 13 nt, Vaccinia virus
gucgucaaaauau

SEQ ID NO: 4070295 - RNA, 15 nt, Vaccinia virus
gucgucuauauuaac

SEQ ID NO: 4070296 - RNA, 15 nt, Vaccinia virus
gucuaacauuuuuaa

SEQ ID NO: 4070297 - RNA, 20 nt, Vaccinia virus
gucuaaguauagaucaaaag

SEQ ID NO: 4070298 - RNA, 19 nt, Vaccinia virus
gucuacaaccgcuacauaa

SEQ ID NO: 4070299 - RNA, 18 nt, Vaccinia virus
gucuaccauuguuucgua

SEQ ID NO: 4070300 - RNA, 13 nt, Vaccinia virus
gucuaucuauaug

SEQ ID NO: 4070301 - RNA, 23 nt, Vaccinia virus
gucucauaccggacgacauauua

SEQ ID NO: 4070302 - RNA, 20 nt, Vaccinia virus
gucucgucaaugucuauagu

SEQ ID NO: 4070303 - RNA, 13 nt, Vaccinia virus
gucucuaucuuua

SEQ ID NO: 4070304 - RNA, 19 nt, Vaccinia virus
gucucuuccgcagauaaau

SEQ ID NO: 4070305 - RNA, 14 nt, Vaccinia virus
gucuguaaaccaca

SEQ ID NO: 4070306 - RNA, 13 nt, Vaccinia virus
gucuuaauagaca

SEQ ID NO: 4070307 - RNA, 22 nt, Vaccinia virus
gucuuauaugaagucuauacag

SEQ ID NO: 4070308 - RNA, 19 nt, Vaccinia virus
gucuucuaaaaauaaaagu

SEQ ID NO: 4070309 - RNA, 15 nt, Vaccinia virus
gucuuuaucucuuag

SEQ ID NO: 4070310 - RNA, 13 nt, Vaccinia virus
gucuuucacuaau

SEQ ID NO: 4070311 - RNA, 14 nt, Vaccinia virus
gugaaaaauauuaa

SEQ ID NO: 4070312 - RNA, 22 nt, Vaccinia virus
gugaaaauuacauacuuaaaaa

SEQ ID NO: 4070313 - RNA, 17 nt, Vaccinia virus
gugaaaugguacaaaaa

SEQ ID NO: 4070314 - RNA, 17 nt, Vaccinia virus
gugaauaugaucuucau

SEQ ID NO: 4070315 - RNA, 19 nt, Vaccinia virus
gugacuuugauaauaacau

SEQ ID NO: 4070316 - RNA, 15 nt, Vaccinia virus
gugcaaggaaucauc

SEQ ID NO: 4070317 - RNA, 13 nt, Vaccinia virus
gugcacugguguc

SEQ ID NO: 4070318 - RNA, 15 nt, Vaccinia virus
gugcaguauuagaau

SEQ ID NO: 4070319 - RNA, 23 nt, Vaccinia virus
gugcauccaugcagcauuuccua

SEQ ID NO: 4070320 - RNA, 16 nt, Vaccinia virus
gugcaucgucuauucu

SEQ ID NO: 4070321 - RNA, 21 nt, Vaccinia virus
gugccguguuucaaauauucu

SEQ ID NO: 4070322 - RNA, 14 nt, Vaccinia virus
gugcuauuagaauu

SEQ ID NO: 4070323 - RNA, 18 nt, Vaccinia virus
gugcucaaacaaaaugug

SEQ ID NO: 4070324 - RNA, 16 nt, Vaccinia virus
guggaugguuaaaaag

SEQ ID NO: 4070325 - RNA, 19 nt, Vaccinia virus
gugggggacuggcugauga

SEQ ID NO: 4070326 - RNA, 20 nt, Vaccinia virus
guguagaugcuacuucaucu

SEQ ID NO: 4070327 - RNA, 23 nt, Vaccinia virus
guguauacaccaacaguaugaaa

SEQ ID NO: 4070328 - RNA, 23 nt, Vaccinia virus
guguauauuuaucucuucauuau

SEQ ID NO: 4070329 - RNA, 16 nt, Vaccinia virus
guguauuaauagauuu

SEQ ID NO: 4070330 - RNA, 13 nt, Vaccinia virus
guguauucaucgu

SEQ ID NO: 4070331 - RNA, 21 nt, Vaccinia virus
gugucaaacuguguagcuaga

SEQ ID NO: 4070332 - RNA, 16 nt, Vaccinia virus
guguggguacaaauau

SEQ ID NO: 4070333 - RNA, 22 nt, Vaccinia virus
guguucauccaaggaucuucua

SEQ ID NO: 4070334 - RNA, 13 nt, Vaccinia virus
guuaaauguuuua

SEQ ID NO: 4070335 - RNA, 11 nt, Vaccinia virus
guuaaauuaau

SEQ ID NO: 4070336 - RNA, 11 nt, Vaccinia virus
guuaauguuug

SEQ ID NO: 4070337 - RNA, 23 nt, Vaccinia virus
guuaauguuugcuccauaaucua

SEQ ID NO: 4070338 - RNA, 17 nt, Vaccinia virus
guuaauuaucuaaauaa

SEQ ID NO: 4070339 - RNA, 12 nt, Vaccinia virus
guuaauuuuacu

SEQ ID NO: 4070340 - RNA, 20 nt, Vaccinia virus
guuacauuaguaaucuuuuu

SEQ ID NO: 4070341 - RNA, 18 nt, Vaccinia virus
guuaccucguuuauucag

SEQ ID NO: 4070342 - RNA, 22 nt, Vaccinia virus
guuacguggaucgucacaauga

SEQ ID NO: 4070343 - RNA, 22 nt, Vaccinia virus
guuagauauuuagcaauugcau

SEQ ID NO: 4070344 - RNA, 13 nt, Vaccinia virus
guuauaaauuagg

SEQ ID NO: 4070345 - RNA, 16 nt, Vaccinia virus
guuauaagauuacuua

SEQ ID NO: 4070346 - RNA, 17 nt, Vaccinia virus
guuauaagauuacuuau

SEQ ID NO: 4070347 - RNA, 14 nt, Vaccinia virus
guuauauaauuauc

SEQ ID NO: 4070348 - RNA, 15 nt, Vaccinia virus
guuauauuuuuuucu

SEQ ID NO: 4070349 - RNA, 20 nt, Vaccinia virus
guuaucaucguauaaauuaa

SEQ ID NO: 4070350 - RNA, 22 nt, Vaccinia virus
guuaucaucguauaaauuaaag

SEQ ID NO: 4070351 - RNA, 15 nt, Vaccinia virus
guuaucuauuucaaa

SEQ ID NO: 4070352 - RNA, 16 nt, Vaccinia virus
guuaucugaugaaaga

SEQ ID NO: 4070353 - RNA, 17 nt, Vaccinia virus
guuauggcacucuuauu

SEQ ID NO: 4070354 - RNA, 22 nt, Vaccinia virus
guuauguauuucauuguucauc

SEQ ID NO: 4070355 - RNA, 21 nt, Vaccinia virus
guuauuacuaaggauguauua

SEQ ID NO: 4070356 - RNA, 23 nt, Vaccinia virus
guuauugcuuugguuuaauuauu

SEQ ID NO: 4070357 - RNA, 20 nt, Vaccinia virus
guuauugguauuucuuacau

SEQ ID NO: 4070358 - RNA, 15 nt, Vaccinia virus
guuauuuaugucaua

SEQ ID NO: 4070359 - RNA, 20 nt, Vaccinia virus
guuauuuggcaguacucauu

SEQ ID NO: 4070360 - RNA, 19 nt, Vaccinia virus
guucagaggaugaaauaga

SEQ ID NO: 4070361 - RNA, 15 nt, Vaccinia virus
guucauaaauaaaaa

SEQ ID NO: 4070362 - RNA, 15 nt, Vaccinia virus
guucauuuauaaucu

SEQ ID NO: 4070363 - RNA, 14 nt, Vaccinia virus
guuccaacaucaua

SEQ ID NO: 4070364 - RNA, 12 nt, Vaccinia virus
guuccauauuau

SEQ ID NO: 4070365 - RNA, 19 nt, Vaccinia virus
guuccggaucuauagaaga

SEQ ID NO: 4070366 - RNA, 19 nt, Vaccinia virus
guuccguguguaauaaccu

SEQ ID NO: 4070367 - RNA, 20 nt, Vaccinia virus
guuccucuguaaauaaaucu

SEQ ID NO: 4070368 - RNA, 13 nt, Vaccinia virus
guucgauagaaac

SEQ ID NO: 4070369 - RNA, 17 nt, Vaccinia virus
guucguugaugaggaau

SEQ ID NO: 4070370 - RNA, 23 nt, Vaccinia virus
guucuauguaucuaaaauaaugu

SEQ ID NO: 4070371 - RNA, 12 nt, Vaccinia virus
guucugauuuua

SEQ ID NO: 4070372 - RNA, 17 nt, Vaccinia virus
guucuuaacaucuauua

SEQ ID NO: 4070373 - RNA, 23 nt, Vaccinia virus
guucuuauaauuguaacauccuu

SEQ ID NO: 4070374 - RNA, 18 nt, Vaccinia virus
gaauuaauuauucauaau

SEQ ID NO: 4070375 - RNA, 17 nt, Vaccinia virus
gaauuaggagaacuuau

SEQ ID NO: 4070376 - RNA, 17 nt, Vaccinia virus
gaauuaguuagauauau

SEQ ID NO: 4070377 - RNA, 14 nt, Vaccinia virus
gaauugacaaauaa

SEQ ID NO: 4070378 - RNA, 20 nt, Vaccinia virus
gaauuggaacuaguauuuau

SEQ ID NO: 4070379 - RNA, 19 nt, Vaccinia virus
gaauuuauuucuaaaucua

SEQ ID NO: 4070380 - RNA, 16 nt, Vaccinia virus
gaauuuauuucuaauu

SEQ ID NO: 4070381 - RNA, 14 nt, Vaccinia virus
gaauuucuauguca

SEQ ID NO: 4070382 - RNA, 15 nt, Vaccinia virus
gaauuugauacuguc

SEQ ID NO: 4070383 - RNA, 14 nt, Vaccinia virus
gaauuuucauggau

SEQ ID NO: 4070384 - RNA, 15 nt, Vaccinia virus
gaauuuuuauacauu

SEQ ID NO: 4070385 - RNA, 20 nt, Vaccinia virus
gacaaacgcugauagaugau

SEQ ID NO: 4070386 - RNA, 22 nt, Vaccinia virus
gacaaaggguaauauuuugcau

SEQ ID NO: 4070387 - RNA, 18 nt, Vaccinia virus
gacaaaguccuaguugua

SEQ ID NO: 4070388 - RNA, 13 nt, Vaccinia virus
gacaaauacucua

SEQ ID NO: 4070389 - RNA, 13 nt, Vaccinia virus
gacaaauuauucu

SEQ ID NO: 4070390 - RNA, 15 nt, Vaccinia virus
gacaacaaaaaauga

SEQ ID NO: 4070391 - RNA, 22 nt, Vaccinia virus
gacaacaaggcuuugauaucua

SEQ ID NO: 4070392 - RNA, 15 nt, Vaccinia virus
gacaacgaauacaaa

SEQ ID NO: 4070393 - RNA, 20 nt, Vaccinia virus
gacaacuuaaucugaugaau

SEQ ID NO: 4070394 - RNA, 16 nt, Vaccinia virus
gacaaguauaaugaca

SEQ ID NO: 4070395 - RNA, 14 nt, Vaccinia virus
gacaauauuuaguu

SEQ ID NO: 4070396 - RNA, 15 nt, Vaccinia virus
gacaaugaauugcau

SEQ ID NO: 4070397 - RNA, 23 nt, Vaccinia virus
gacacgcucuuaggagauuaaag

SEQ ID NO: 4070398 - RNA, 17 nt, Vaccinia virus
gacacguuuauuucaua

SEQ ID NO: 4070399 - RNA, 19 nt, Vaccinia virus
gacagaucuucguuaaaaa

SEQ ID NO: 4070400 - RNA, 17 nt, Vaccinia virus
gacagcgugaauaaugu

SEQ ID NO: 4070401 - RNA, 22 nt, Vaccinia virus
gacaguaguugcgggaacaaua

SEQ ID NO: 4070402 - RNA, 16 nt, Vaccinia virus
gacauaccaucuauca

SEQ ID NO: 4070403 - RNA, 21 nt, Vaccinia virus
gacauacuguauguaaacaau

SEQ ID NO: 4070404 - RNA, 23 nt, Vaccinia virus
gacauccaugguggaauaaacua

SEQ ID NO: 4070405 - RNA, 18 nt, Vaccinia virus
gacauggcuucuuccaua

SEQ ID NO: 4070406 - RNA, 23 nt, Vaccinia virus
gacauuaugcuaccgucaugaau

SEQ ID NO: 4070407 - RNA, 20 nt, Vaccinia virus
gacauuauguuguuaaaaua

SEQ ID NO: 4070408 - RNA, 19 nt, Vaccinia virus
gaccaaauauauuauuaau

SEQ ID NO: 4070409 - RNA, 13 nt, Vaccinia virus
gaccaauaauaaa

SEQ ID NO: 4070410 - RNA, 23 nt, Vaccinia virus
gaccgauuaucgaguuuaaauca

SEQ ID NO: 4070411 - RNA, 20 nt, Vaccinia virus
gacgaccuuuggauuuucac

SEQ ID NO: 4070412 - RNA, 19 nt, Vaccinia virus
gacgaucuuguuauaauua

SEQ ID NO: 4070413 - RNA, 17 nt, Vaccinia virus
gacgauuccaacaaacg

SEQ ID NO: 4070414 - RNA, 12 nt, Vaccinia virus
gacgcauuuaau

SEQ ID NO: 4070415 - RNA, 22 nt, Vaccinia virus
gacgcauuuaauagagauauac

SEQ ID NO: 4070416 - RNA, 14 nt, Vaccinia virus
gacgcuacacuauc

SEQ ID NO: 4070417 - RNA, 23 nt, Vaccinia virus
gacggcuacucuaacucguacuc

SEQ ID NO: 4070418 - RNA, 23 nt, Vaccinia virus
gacguagucgaacguuaguucca

SEQ ID NO: 4070419 - RNA, 14 nt, Vaccinia virus
gacguguuauuaca

SEQ ID NO: 4070420 - RNA, 18 nt, Vaccinia virus
gacguuagaaucaagaau

SEQ ID NO: 4070421 - RNA, 20 nt, Vaccinia virus
gacguuggcacaugaugaau

SEQ ID NO: 4070422 - RNA, 22 nt, Vaccinia virus
gacuaagucuacaaauagagau

SEQ ID NO: 4070423 - RNA, 22 nt, Vaccinia virus
gacuaauaaauuagauauuaau

SEQ ID NO: 4070424 - RNA, 22 nt, Vaccinia virus
gacuaauuccuaguuucaucau

SEQ ID NO: 4070425 - RNA, 16 nt, Vaccinia virus
gacuacgaaacugaua

SEQ ID NO: 4070426 - RNA, 14 nt, Vaccinia virus
gacuacucuaggua

SEQ ID NO: 4070427 - RNA, 13 nt, Vaccinia virus
gacuauaaaauau

SEQ ID NO: 4070428 - RNA, 17 nt, Vaccinia virus
gacuauaaaauauucua

SEQ ID NO: 4070429 - RNA, 19 nt, Vaccinia virus
gacucauaagaaagagaau

SEQ ID NO: 4070430 - RNA, 13 nt, Vaccinia virus
gacucauaaucuc

SEQ ID NO: 4070431 - RNA, 21 nt, Vaccinia virus
gacuccaucaucgaucuaaua

SEQ ID NO: 4070432 - RNA, 21 nt, Vaccinia virus
gacucgcaaaaaauacaauau

SEQ ID NO: 4070433 - RNA, 23 nt, Vaccinia virus
gacucuucgucuucccaaaaugu

SEQ ID NO: 4070434 - RNA, 15 nt, Vaccinia virus
gacuggaguguauau

SEQ ID NO: 4070435 - RNA, 14 nt, Vaccinia virus
gacuguuauaaaaa

SEQ ID NO: 4070436 - RNA, 21 nt, Vaccinia virus
gacuucuggcgguugccauag

SEQ ID NO: 4070437 - RNA, 11 nt, Vaccinia virus
gacuuguuaau

SEQ ID NO: 4070438 - RNA, 18 nt, Vaccinia virus
gacuuguuaguuaaaaug

SEQ ID NO: 4070439 - RNA, 16 nt, Vaccinia virus
gacuuuguagaaauau

SEQ ID NO: 4070440 - RNA, 15 nt, Vaccinia virus
gagaaauaauaagaa

SEQ ID NO: 4070441 - RNA, 16 nt, Vaccinia virus
gagaauggaugauucu

SEQ ID NO: 4070442 - RNA, 16 nt, Vaccinia virus
gagaauguaauucuuu

SEQ ID NO: 4070443 - RNA, 12 nt, Vaccinia virus
gagaauguuucc

SEQ ID NO: 4070444 - RNA, 15 nt, Vaccinia virus
gagaauuaauaucua

SEQ ID NO: 4070445 - RNA, 20 nt, Vaccinia virus
gagacgguagaauaagugua

SEQ ID NO: 4070446 - RNA, 14 nt, Vaccinia virus
gagacuuaaacaac

SEQ ID NO: 4070447 - RNA, 17 nt, Vaccinia virus
gagagaacuaacacaac

SEQ ID NO: 4070448 - RNA, 16 nt, Vaccinia virus
gagagaauguauucau

SEQ ID NO: 4070449 - RNA, 23 nt, Vaccinia virus
gagagacccugcgcuuucucuau

SEQ ID NO: 4070450 - RNA, 21 nt, Vaccinia virus
gagauaucccguuagaaauau

SEQ ID NO: 4070451 - RNA, 16 nt, Vaccinia virus
gagaugagauaagaac

SEQ ID NO: 4070452 - RNA, 16 nt, Vaccinia virus
gagauuuaaucuguaa

SEQ ID NO: 4070453 - RNA, 14 nt, Vaccinia virus
gagauuuagaaaac

SEQ ID NO: 4070454 - RNA, 15 nt, Vaccinia virus
gagauuuaguuuauc

SEQ ID NO: 4070455 - RNA, 20 nt, Vaccinia virus
gagcaaucagaaaugaugcu

SEQ ID NO: 4070456 - RNA, 22 nt, Vaccinia virus
gagcauacaguaagcauagaua

SEQ ID NO: 4070457 - RNA, 23 nt, Vaccinia virus
gagcuaauuuuuguaaauaacua

SEQ ID NO: 4070458 - RNA, 16 nt, Vaccinia virus
gagcuauuaaacuguu

SEQ ID NO: 4070459 - RNA, 18 nt, Vaccinia virus
gagcuguuccaauaaauu

SEQ ID NO: 4070460 - RNA, 14 nt, Vaccinia virus
gaggaagaagaugg

SEQ ID NO: 4070461 - RNA, 20 nt, Vaccinia virus
gaggaguuauugauauuaac

SEQ ID NO: 4070462 - RNA, 15 nt, Vaccinia virus
gaggcaauagaaaag

SEQ ID NO: 4070463 - RNA, 21 nt, Vaccinia virus
gaguaacuguugguaguucuu

SEQ ID NO: 4070464 - RNA, 21 nt, Vaccinia virus
gaguacauuucacagaaacac

SEQ ID NO: 4070465 - RNA, 17 nt, Vaccinia virus
gaguagggauucaucau

SEQ ID NO: 4070466 - RNA, 23 nt, Vaccinia virus
gaguaguaaacgcguacauaacu

SEQ ID NO: 4070467 - RNA, 12 nt, Vaccinia virus
gaguaguacaag

SEQ ID NO: 4070468 - RNA, 21 nt, Vaccinia virus
gaguagugaugguuuucuaaa

SEQ ID NO: 4070469 - RNA, 17 nt, Vaccinia virus
gaguauuaaauauuaau

SEQ ID NO: 4070470 - RNA, 14 nt, Vaccinia virus
gagugaagaaauaa

SEQ ID NO: 4070471 - RNA, 13 nt, Vaccinia virus
gaguguagaaaac

SEQ ID NO: 4070472 - RNA, 12 nt, Vaccinia virus
gaguuuaaaacu

SEQ ID NO: 4070473 - RNA, 21 nt, Vaccinia virus
gauaaaaaccacuuaucgcau

SEQ ID NO: 4070474 - RNA, 21 nt, Vaccinia virus
gauaaaaauuuuuuagaugua

SEQ ID NO: 4070475 - RNA, 22 nt, Vaccinia virus
gauaaaagaugcauauauuaga

SEQ ID NO: 4070476 - RNA, 24 nt, Vaccinia virus
gauaaaaguuccagaaaauguaga

SEQ ID NO: 4070477 - RNA, 15 nt, Vaccinia virus
gauaaaaucaaacuu

SEQ ID NO: 4070478 - RNA, 15 nt, Vaccinia virus
gauaaaauuaaugag

SEQ ID NO: 4070479 - RNA, 17 nt, Vaccinia virus
gauaaauuaaugaucua

SEQ ID NO: 4070480 - RNA, 15 nt, Vaccinia virus
gauaacaaauuaaag

SEQ ID NO: 4070481 - RNA, 16 nt, Vaccinia virus
gauaacacauuuucau

SEQ ID NO: 4070482 - RNA, 11 nt, Vaccinia virus
gauaacuguau

SEQ ID NO: 4070483 - RNA, 15 nt, Vaccinia virus
gauaacuuuaaacau

SEQ ID NO: 4070484 - RNA, 20 nt, Vaccinia virus
gauaagaagaggacaaaguu

SEQ ID NO: 4070485 - RNA, 16 nt, Vaccinia virus
gauaagauaaaaucua

SEQ ID NO: 4070486 - RNA, 23 nt, Vaccinia virus
gauaagcuauaauaauaaaugua

SEQ ID NO: 4070487 - RNA, 18 nt, Vaccinia virus
gauaaguuagaucagugu

SEQ ID NO: 4070488 - RNA, 22 nt, Vaccinia virus
gauaauaauguuauuauaucua

SEQ ID NO: 4070489 - RNA, 19 nt, Vaccinia virus
gauaauagggagaaaugac

SEQ ID NO: 4070490 - RNA, 14 nt, Vaccinia virus
gauaauauuauuau

SEQ ID NO: 4070491 - RNA, 20 nt, Vaccinia virus
gauaauauuauuuauaugau

SEQ ID NO: 4070492 - RNA, 17 nt, Vaccinia virus
gauaauauuuguaaugg

SEQ ID NO: 4070493 - RNA, 17 nt, Vaccinia virus
gauaaucuauggggaga

SEQ ID NO: 4070494 - RNA, 19 nt, Vaccinia virus
gauaauuuuuuuauuacau

SEQ ID NO: 4070495 - RNA, 11 nt, Vaccinia virus
gauacaaauaa

SEQ ID NO: 4070496 - RNA, 16 nt, Vaccinia virus
gauacaacaaauuaaa

SEQ ID NO: 4070497 - RNA, 13 nt, Vaccinia virus
gauacaauacuua

SEQ ID NO: 4070498 - RNA, 16 nt, Vaccinia virus
gauacacguauaaaaa

SEQ ID NO: 4070499 - RNA, 21 nt, Vaccinia virus
gauacacuagacauuuuuuaa

SEQ ID NO: 4070500 - RNA, 17 nt, Vaccinia virus
auugaauaggaguuuga

SEQ ID NO: 4070501 - RNA, 17 nt, Vaccinia virus
auugaauuuauaucuaa

SEQ ID NO: 4070502 - RNA, 19 nt, Vaccinia virus
auugacgaaacaauguuuc

SEQ ID NO: 4070503 - RNA, 17 nt, Vaccinia virus
auugacgauucgucucu

SEQ ID NO: 4070504 - RNA, 15 nt, Vaccinia virus
auugaguaaauccuu

SEQ ID NO: 4070505 - RNA, 18 nt, Vaccinia virus
auugauaaaauuaaugag

SEQ ID NO: 4070506 - RNA, 22 nt, Vaccinia virus
auugauaaagaucuaaaaauua

SEQ ID NO: 4070507 - RNA, 19 nt, Vaccinia virus
auugauaucgcauagaaau

SEQ ID NO: 4070508 - RNA, 19 nt, Vaccinia virus
auugauccuagaacuagau

SEQ ID NO: 4070509 - RNA, 16 nt, Vaccinia virus
auugauuuuggaaacg

SEQ ID NO: 4070510 - RNA, 20 nt, Vaccinia virus
auugcaauugguaagaugac

SEQ ID NO: 4070511 - RNA, 18 nt, Vaccinia virus
auugcacaauccaaacuu

SEQ ID NO: 4070512 - RNA, 17 nt, Vaccinia virus
auugcauagugaauaua

SEQ ID NO: 4070513 - RNA, 15 nt, Vaccinia virus
auugcauuugaucag

SEQ ID NO: 4070514 - RNA, 15 nt, Vaccinia virus
auuggaacauaagau

SEQ ID NO: 4070515 - RNA, 14 nt, Vaccinia virus
auuggucagaaaua

SEQ ID NO: 4070516 - RNA, 17 nt, Vaccinia virus
auuggucagaaauauug

SEQ ID NO: 4070517 - RNA, 21 nt, Vaccinia virus
auugguucauacaugaaauga

SEQ ID NO: 4070518 - RNA, 19 nt, Vaccinia virus
auuguaaaagacaaauaua

SEQ ID NO: 4070519 - RNA, 16 nt, Vaccinia virus
auuguacuaucgaugu

SEQ ID NO: 4070520 - RNA, 16 nt, Vaccinia virus
auuguaguauaugaua

SEQ ID NO: 4070521 - RNA, 11 nt, Vaccinia virus
auuguauauag

SEQ ID NO: 4070522 - RNA, 19 nt, Vaccinia virus
auuguaugguuuuaaauau

SEQ ID NO: 4070523 - RNA, 16 nt, Vaccinia virus
auuguuuuaacuauaa

SEQ ID NO: 4070524 - RNA, 12 nt, Vaccinia virus
auuuaaauccua

SEQ ID NO: 4070525 - RNA, 17 nt, Vaccinia virus
auuuaaggcuuuaaaau

SEQ ID NO: 4070526 - RNA, 21 nt, Vaccinia virus
auuuaauacguucauuaaaaa

SEQ ID NO: 4070527 - RNA, 21 nt, Vaccinia virus
auuuaauuuuguaguuaauuu

SEQ ID NO: 4070528 - RNA, 22 nt, Vaccinia virus
auuuacagauuuaguuguuuaa

SEQ ID NO: 4070529 - RNA, 15 nt, Vaccinia virus
auuuacgcgcacaca

SEQ ID NO: 4070530 - RNA, 17 nt, Vaccinia virus
auuuacuuuuucauaau

SEQ ID NO: 4070531 - RNA, 20 nt, Vaccinia virus
auuuacuuuuucaucuuuac

SEQ ID NO: 4070532 - RNA, 18 nt, Vaccinia virus
auuuagauacaucuauau

SEQ ID NO: 4070533 - RNA, 14 nt, Vaccinia virus
auuuagauuaucaa

SEQ ID NO: 4070534 - RNA, 14 nt, Vaccinia virus
auuuagcaaaauuc

SEQ ID NO: 4070535 - RNA, 22 nt, Vaccinia virus
auuuaggaaugauuaucaaaug

SEQ ID NO: 4070536 - RNA, 14 nt, Vaccinia virus
auuuaguuaacaua

SEQ ID NO: 4070537 - RNA, 13 nt, Vaccinia virus
auuuauaaaaaug

SEQ ID NO: 4070538 - RNA, 19 nt, Vaccinia virus
auuuauagucgcgcuuuac

SEQ ID NO: 4070539 - RNA, 16 nt, Vaccinia virus
auuuauauaaaucauu

SEQ ID NO: 4070540 - RNA, 18 nt, Vaccinia virus
auuuaucauauuucucca

SEQ ID NO: 4070541 - RNA, 14 nt, Vaccinia virus
auuuauuaaauacu

SEQ ID NO: 4070542 - RNA, 14 nt, Vaccinia virus
auuuauuucuucuu

SEQ ID NO: 4070543 - RNA, 14 nt, Vaccinia virus
auuuauuugaugaa

SEQ ID NO: 4070544 - RNA, 16 nt, Vaccinia virus
auuucaaauauauuua

SEQ ID NO: 4070545 - RNA, 14 nt, Vaccinia virus
auuucaacaaacug

SEQ ID NO: 4070546 - RNA, 21 nt, Vaccinia virus
auuucauagacuuuaucuaga

SEQ ID NO: 4070547 - RNA, 22 nt, Vaccinia virus
auuucaucugugguauucuugu

SEQ ID NO: 4070548 - RNA, 21 nt, Vaccinia virus
auuuccaaucuuugacaauuu

SEQ ID NO: 4070549 - RNA, 18 nt, Vaccinia virus
auuucggcgccuauuuua

SEQ ID NO: 4070550 - RNA, 15 nt, Vaccinia virus
auuucguuuaucauu

SEQ ID NO: 4070551 - RNA, 14 nt, Vaccinia virus
auuucguuucuuaa

SEQ ID NO: 4070552 - RNA, 13 nt, Vaccinia virus
auacgaagacuau

SEQ ID NO: 4070553 - RNA, 19 nt, Vaccinia virus
auacgaauguaucaaacag

SEQ ID NO: 4070554 - RNA, 13 nt, Vaccinia virus
auacgauaaacau

SEQ ID NO: 4070555 - RNA, 20 nt, Vaccinia virus
auacgcaucucuaacuacua

SEQ ID NO: 4070556 - RNA, 22 nt, Vaccinia virus
auacguacugucuauaaugaca

SEQ ID NO: 4070557 - RNA, 19 nt, Vaccinia virus
auacguuucuauuuucuau

SEQ ID NO: 4070558 - RNA, 13 nt, Vaccinia virus
auacuaaacauug

SEQ ID NO: 4070559 - RNA, 13 nt, Vaccinia virus
auacuaaagaaac

SEQ ID NO: 4070560 - RNA, 21 nt, Vaccinia virus
auacuaaaggcaacaaagaaa

SEQ ID NO: 4070561 - RNA, 17 nt, Vaccinia virus
auacuaauucaaauugu

SEQ ID NO: 4070562 - RNA, 16 nt, Vaccinia virus
auacuaccuguuauau

SEQ ID NO: 4070563 - RNA, 15 nt, Vaccinia virus
auacuacuaaugaca

SEQ ID NO: 4070564 - RNA, 18 nt, Vaccinia virus
auacuacuucuccaacau

SEQ ID NO: 4070565 - RNA, 22 nt, Vaccinia virus
auacuagaguuguuaaaguuaa

SEQ ID NO: 4070566 - RNA, 23 nt, Vaccinia virus
auacuaguagcuucacaaagaug

SEQ ID NO: 4070567 - RNA, 17 nt, Vaccinia virus
auacuaguauagucacu

SEQ ID NO: 4070568 - RNA, 13 nt, Vaccinia virus
auacuagucuuag

SEQ ID NO: 4070569 - RNA, 15 nt, Vaccinia virus
auacuaguuuucuaa

SEQ ID NO: 4070570 - RNA, 23 nt, Vaccinia virus
auacuauaccguugugucuacaa

SEQ ID NO: 4070571 - RNA, 17 nt, Vaccinia virus
auacuaucuauaaacau

SEQ ID NO: 4070572 - RNA, 21 nt, Vaccinia virus
auacuaucuuuaauagaacuc

SEQ ID NO: 4070573 - RNA, 19 nt, Vaccinia virus
auacuauuaauuguaaaug

SEQ ID NO: 4070574 - RNA, 18 nt, Vaccinia virus
auacucccacaaauacug

SEQ ID NO: 4070575 - RNA, 20 nt, Vaccinia virus
auacucccacaaauacugac

SEQ ID NO: 4070576 - RNA, 17 nt, Vaccinia virus
auacucuauugagaaaa

SEQ ID NO: 4070577 - RNA, 14 nt, Vaccinia virus
auacucucaaccau

SEQ ID NO: 4070578 - RNA, 17 nt, Vaccinia virus
auacugaagucugauau

SEQ ID NO: 4070579 - RNA, 14 nt, Vaccinia virus
auacugagaauuga

SEQ ID NO: 4070580 - RNA, 21 nt, Vaccinia virus
auacuguagaugguucuuuaa

SEQ ID NO: 4070581 - RNA, 15 nt, Vaccinia virus
auacuguauauacua

SEQ ID NO: 4070582 - RNA, 16 nt, Vaccinia virus
auacugucaacuauag

SEQ ID NO: 4070583 - RNA, 22 nt, Vaccinia virus
auacuuagauauauuguagaua

SEQ ID NO: 4070584 - RNA, 17 nt, Vaccinia virus
auacuuauucugauucu

SEQ ID NO: 4070585 - RNA, 14 nt, Vaccinia virus
auacuucaaaauuu

SEQ ID NO: 4070586 - RNA, 23 nt, Vaccinia virus
auacuucauaaaagaaaauucua

SEQ ID NO: 4070587 - RNA, 21 nt, Vaccinia virus
auacuuuguaaucuagacaua

SEQ ID NO: 4070588 - RNA, 17 nt, Vaccinia virus
auacuuuucuaauucua

SEQ ID NO: 4070589 - RNA, 21 nt, Vaccinia virus
auagaaaauaacagauauuac

SEQ ID NO: 4070590 - RNA, 19 nt, Vaccinia virus
auagaacaaaauacauaau

SEQ ID NO: 4070591 - RNA, 16 nt, Vaccinia virus
auagacaauuauguaa

SEQ ID NO: 4070592 - RNA, 17 nt, Vaccinia virus
auagacuuucucuaaau

SEQ ID NO: 4070593 - RNA, 14 nt, Vaccinia virus
auagagaacauaau

SEQ ID NO: 4070594 - RNA, 15 nt, Vaccinia virus
auagagaacauaaug

SEQ ID NO: 4070595 - RNA, 17 nt, Vaccinia virus
auagagauauuauuacu

SEQ ID NO: 4070596 - RNA, 16 nt, Vaccinia virus
auagagcaaaauaauu

SEQ ID NO: 4070597 - RNA, 16 nt, Vaccinia virus
auagaggauauuucau

SEQ ID NO: 4070598 - RNA, 23 nt, Vaccinia virus
auagagguguuuuauuauguuua

SEQ ID NO: 4070599 - RNA, 17 nt, Vaccinia virus
auagauacgcauuuucu

SEQ ID NO: 4070600 - RNA, 20 nt, Vaccinia virus
auagauagcguauaucucua

SEQ ID NO: 4070601 - RNA, 15 nt, Vaccinia virus
auagaucaaauacuu

SEQ ID NO: 4070602 - RNA, 15 nt, Vaccinia virus
auagaucaagagaac

SEQ ID NO: 4070603 - RNA, 15 nt, Vaccinia virus
auagaugaaauacuc

SEQ ID NO: 4070604 - RNA, 22 nt, Vaccinia virus
auagaugaacaaggaaauccua

SEQ ID NO: 4070605 - RNA, 16 nt, Vaccinia virus
auagauggaguaagua

SEQ ID NO: 4070606 - RNA, 16 nt, Vaccinia virus
auagauguaucgauga

SEQ ID NO: 4070607 - RNA, 21 nt, Vaccinia virus
auagauguauuugauauacua

SEQ ID NO: 4070608 - RNA, 23 nt, Vaccinia virus
auagauucauucguuauagaaug

SEQ ID NO: 4070609 - RNA, 15 nt, Vaccinia virus
auagauucuugguaa

SEQ ID NO: 4070610 - RNA, 12 nt, Vaccinia virus
auagauuugcau

SEQ ID NO: 4070611 - RNA, 17 nt, Vaccinia virus
auagauuuuccauccac

SEQ ID NO: 4070612 - RNA, 16 nt, Vaccinia virus
auagauuuuucauauu

SEQ ID NO: 4070613 - RNA, 20 nt, Vaccinia virus
auagcaaggaugaaaaagga

SEQ ID NO: 4070614 - RNA, 15 nt, Vaccinia virus
auagcaguauuuccc

SEQ ID NO: 4070615 - RNA, 20 nt, Vaccinia virus
auagcguacaauacauguac

SEQ ID NO: 4070616 - RNA, 21 nt, Vaccinia virus
auagcguucgucaacauacua

SEQ ID NO: 4070617 - RNA, 22 nt, Vaccinia virus
auagcuacaguaaaaauaacua

SEQ ID NO: 4070618 - RNA, 18 nt, Vaccinia virus
auagcuauucuucuuuaa

SEQ ID NO: 4070619 - RNA, 20 nt, Vaccinia virus
auaggauacucuaugaaugg

SEQ ID NO: 4070620 - RNA, 16 nt, Vaccinia virus
auaggaucuauaaugu

SEQ ID NO: 4070621 - RNA, 13 nt, Vaccinia virus
auaggaucuauau

SEQ ID NO: 4070622 - RNA, 22 nt, Vaccinia virus
auaggaucuccgaaucugaaaa

SEQ ID NO: 4070623 - RNA, 16 nt, Vaccinia virus
auagggaaucauauau

SEQ ID NO: 4070624 - RNA, 23 nt, Vaccinia virus
auaguaccuagaacgaugucaaa

SEQ ID NO: 4070625 - RNA, 18 nt, Vaccinia virus
auaguauuaaugauugcc

SEQ ID NO: 4070626 - RNA, 15 nt, Vaccinia virus
auaguauucuuguau

SEQ ID NO: 4070627 - RNA, 17 nt, Vaccinia virus
auagucgaauacaguau

SEQ ID NO: 4070628 - RNA, 18 nt, Vaccinia virus
auagucgugaucaacauu

SEQ ID NO: 4070629 - RNA, 21 nt, Vaccinia virus
auaguggacaacauuaauaca

SEQ ID NO: 4070630 - RNA, 16 nt, Vaccinia virus
auaguggauuaauaua

SEQ ID NO: 4070631 - RNA, 17 nt, Vaccinia virus
auaguuaaaaaaauaca

SEQ ID NO: 4070632 - RNA, 18 nt, Vaccinia virus
auaguuaccgcaaagaaa

SEQ ID NO: 4070633 - RNA, 19 nt, Vaccinia virus
auaguuaccgcaaagaaac

SEQ ID NO: 4070634 - RNA, 18 nt, Vaccinia virus
auaguuauuacuuuucuc

SEQ ID NO: 4070635 - RNA, 21 nt, Vaccinia virus
auaguucguguacuagucaua

SEQ ID NO: 4070636 - RNA, 22 nt, Vaccinia virus
auaguucguguacuagucauaa

SEQ ID NO: 4070637 - RNA, 17 nt, Vaccinia virus
auaguuguuauaaagga

SEQ ID NO: 4070638 - RNA, 15 nt, Vaccinia virus
auaguuucuauuuuu

SEQ ID NO: 4070639 - RNA, 18 nt, Vaccinia virus
auaguuugggaaaagaaa

SEQ ID NO: 4070640 - RNA, 17 nt, Vaccinia virus
auaguuuuuuaauucca

SEQ ID NO: 4070641 - RNA, 13 nt, Vaccinia virus
auauaaaaaauuu

SEQ ID NO: 4070642 - RNA, 13 nt, Vaccinia virus
auauaaaaacauu

SEQ ID NO: 4070643 - RNA, 16 nt, Vaccinia virus
auauaaaauaacuaca

SEQ ID NO: 4070644 - RNA, 22 nt, Vaccinia virus
auauaaaauagaaaauaacaga

SEQ ID NO: 4070645 - RNA, 18 nt, Vaccinia virus
auauaaaccgcuauugaa

SEQ ID NO: 4070646 - RNA, 12 nt, Vaccinia virus
auauaaagaaau

SEQ ID NO: 4070647 - RNA, 22 nt, Vaccinia virus
auauaaauccguuaaaauaauu

SEQ ID NO: 4070648 - RNA, 15 nt, Vaccinia virus
auauaaccauuuucu

SEQ ID NO: 4070649 - RNA, 21 nt, Vaccinia virus
auauaaugauauauauuuuca

SEQ ID NO: 4070650 - RNA, 22 nt, Vaccinia virus
auauaauguacuagaugauauu

SEQ ID NO: 4070651 - RNA, 14 nt, Vaccinia virus
auauacaugugcaa

SEQ ID NO: 4070652 - RNA, 20 nt, Vaccinia virus
auauaccacuuaaugacaaa

SEQ ID NO: 4070653 - RNA, 21 nt, Vaccinia virus
auauaccgccucaaacucuau

SEQ ID NO: 4070654 - RNA, 19 nt, Vaccinia virus
auauaccgccuuucaaaau

SEQ ID NO: 4070655 - RNA, 19 nt, Vaccinia virus
auauaccuagcaaacgauu

SEQ ID NO: 4070656 - RNA, 20 nt, Vaccinia virus
auauacgaaauaaaauagac

SEQ ID NO: 4070657 - RNA, 20 nt, Vaccinia virus
auauacgaagaacaaugucc

SEQ ID NO: 4070658 - RNA, 23 nt, Vaccinia virus
auauacuaagcaaguacauggau

SEQ ID NO: 4070659 - RNA, 13 nt, Vaccinia virus
auauacuauauag

SEQ ID NO: 4070660 - RNA, 23 nt, Vaccinia virus
auauagagagcuucaucaauaga

SEQ ID NO: 4070661 - RNA, 21 nt, Vaccinia virus
auauagagaucgaaaaaagag

SEQ ID NO: 4070662 - RNA, 15 nt, Vaccinia virus
auauagaucaaacaa

SEQ ID NO: 4070663 - RNA, 15 nt, Vaccinia virus
auauagaucaaucau

SEQ ID NO: 4070664 - RNA, 23 nt, Vaccinia virus
auauagauggcuuguaugucaaa

SEQ ID NO: 4070665 - RNA, 18 nt, Vaccinia virus
auauagauuuuaucgauu

SEQ ID NO: 4070666 - RNA, 18 nt, Vaccinia virus
auauagccacaauuauug

SEQ ID NO: 4070667 - RNA, 13 nt, Vaccinia virus
auauaguaauaag

SEQ ID NO: 4070668 - RNA, 15 nt, Vaccinia virus
auauaguaaugaaga

SEQ ID NO: 4070669 - RNA, 14 nt, Vaccinia virus
auauaguagaugcu

SEQ ID NO: 4070670 - RNA, 20 nt, Vaccinia virus
auauagucuuggaucaaaua

SEQ ID NO: 4070671 - RNA, 23 nt, Vaccinia virus
auauagucuuggaucaaauagau

SEQ ID NO: 4070672 - RNA, 14 nt, Vaccinia virus
auauaguuaaaggu

SEQ ID NO: 4070673 - RNA, 22 nt, Vaccinia virus
gucauaaaaauguuuaaaucaa

SEQ ID NO: 4070674 - RNA, 16 nt, Vaccinia virus
gucauagaugaaauac

SEQ ID NO: 4070675 - RNA, 21 nt, Vaccinia virus
gucaucgaaaugguagauaua

SEQ ID NO: 4070676 - RNA, 23 nt, Vaccinia virus
guccaugacuugguauuuggaaa

SEQ ID NO: 4070677 - RNA, 13 nt, Vaccinia virus
gucccuaauaacu

SEQ ID NO: 4070678 - RNA, 23 nt, Vaccinia virus
guccguuauauaaucuacaaaac

SEQ ID NO: 4070679 - RNA, 22 nt, Vaccinia virus
guccuauaugcaugauagauuu

SEQ ID NO: 4070680 - RNA, 23 nt, Vaccinia virus
gucgcagcaugguaguucguaga

SEQ ID NO: 4070681 - RNA, 16 nt, Vaccinia virus
gucguccaauauuuua

SEQ ID NO: 4070682 - RNA, 21 nt, Vaccinia virus
gucgucguuuuuugaucuuua

SEQ ID NO: 4070683 - RNA, 21 nt, Vaccinia virus
gucuaaauccaacuauagaca

SEQ ID NO: 4070684 - RNA, 14 nt, Vaccinia virus
gucuaacaucucuc

SEQ ID NO: 4070685 - RNA, 12 nt, Vaccinia virus
gucuagaaauaa

SEQ ID NO: 4070686 - RNA, 22 nt, Vaccinia virus
gucuaucgccuuagauacuuuu

SEQ ID NO: 4070687 - RNA, 15 nt, Vaccinia virus
gucuauguauguacg

SEQ ID NO: 4070688 - RNA, 19 nt, Vaccinia virus
gucucgcauguucagcaau

SEQ ID NO: 4070689 - RNA, 13 nt, Vaccinia virus
gucucuuaaagga

SEQ ID NO: 4070690 - RNA, 19 nt, Vaccinia virus
gucugauauucgaaaaucu

SEQ ID NO: 4070691 - RNA, 21 nt, Vaccinia virus
gucuguaacucugauaaucuc

SEQ ID NO: 4070692 - RNA, 15 nt, Vaccinia virus
gucugucucagaauc

SEQ ID NO: 4070693 - RNA, 16 nt, Vaccinia virus
gucuguuuuauacauu

SEQ ID NO: 4070694 - RNA, 17 nt, Vaccinia virus
gucuuccuuauguagag

SEQ ID NO: 4070695 - RNA, 18 nt, Vaccinia virus
gugaaaauuacauacuua

SEQ ID NO: 4070696 - RNA, 14 nt, Vaccinia virus
gugaaauuauuccu

SEQ ID NO: 4070697 - RNA, 23 nt, Vaccinia virus
gugacuauuucauucucugaaaa

SEQ ID NO: 4070698 - RNA, 21 nt, Vaccinia virus
gugacuuaacuuguaauaauu

SEQ ID NO: 4070699 - RNA, 19 nt, Vaccinia virus
gugagaacuuguuaaagaa

SEQ ID NO: 4070700 - RNA, 17 nt, Vaccinia virus
gugauaaguaauaacua

SEQ ID NO: 4070701 - RNA, 13 nt, Vaccinia virus
gugauaguuuaua

SEQ ID NO: 4070702 - RNA, 18 nt, Vaccinia virus
gugauaucgaauauuuua

SEQ ID NO: 4070703 - RNA, 16 nt, Vaccinia virus
gugaugucuuggaauc

SEQ ID NO: 4070704 - RNA, 20 nt, Vaccinia virus
gugauucucugaaaauguaa

SEQ ID NO: 4070705 - RNA, 16 nt, Vaccinia virus
uggauccuaacaauga

SEQ ID NO: 4070706 - RNA, 13 nt, Vaccinia virus
uggaugaaccauu

SEQ ID NO: 4070707 - RNA, 17 nt, Vaccinia virus
uggaugaggaagugaua

SEQ ID NO: 4070708 - RNA, 19 nt, Vaccinia virus
uggaugaugucauucacaa

SEQ ID NO: 4070709 - RNA, 15 nt, Vaccinia virus
uggauggaaacauug

SEQ ID NO: 4070710 - RNA, 13 nt, Vaccinia virus
uggauguagauuu

SEQ ID NO: 4070711 - RNA, 15 nt, Vaccinia virus
uggauucuguuacaa

SEQ ID NO: 4070712 - RNA, 14 nt, Vaccinia virus
uggauugaagguua

SEQ ID NO: 4070713 - RNA, 15 nt, Vaccinia virus
uggauuuuuuguaca

SEQ ID NO: 4070714 - RNA, 17 nt, Vaccinia virus
uggcauaguagaauaau

SEQ ID NO: 4070715 - RNA, 21 nt, Vaccinia virus
uggcguguggauuugguaaga

SEQ ID NO: 4070716 - RNA, 18 nt, Vaccinia virus
ugggacuauauaauuuug

SEQ ID NO: 4070717 - RNA, 16 nt, Vaccinia virus
ugggcucaaugucuua

SEQ ID NO: 4070718 - RNA, 20 nt, Vaccinia virus
ugggugugguuaaacgaaag

SEQ ID NO: 4070719 - RNA, 19 nt, Vaccinia virus
ugguaaguucauuaucuga

SEQ ID NO: 4070720 - RNA, 21 nt, Vaccinia virus
ugguauaaaguauuuggcuau

SEQ ID NO: 4070721 - RNA, 16 nt, Vaccinia virus
ugguaucaagaaguau

SEQ ID NO: 4070722 - RNA, 13 nt, Vaccinia virus
ugguauguaucua

SEQ ID NO: 4070723 - RNA, 19 nt, Vaccinia virus
ugguauuagaaucaaggau

SEQ ID NO: 4070724 - RNA, 23 nt, Vaccinia virus
ugguauucuugucauugaaggau

SEQ ID NO: 4070725 - RNA, 17 nt, Vaccinia virus
uggucaauuacaaauaa

SEQ ID NO: 4070726 - RNA, 15 nt, Vaccinia virus
uggucauuaaaucuu

SEQ ID NO: 4070727 - RNA, 19 nt, Vaccinia virus
ugguccaaacugccacuga

SEQ ID NO: 4070728 - RNA, 14 nt, Vaccinia virus
uggugcauaucuuu

SEQ ID NO: 4070729 - RNA, 15 nt, Vaccinia virus
uggugcuaauuauuc

SEQ ID NO: 4070730 - RNA, 19 nt, Vaccinia virus
ugguuaaaaccuuugcaaa

SEQ ID NO: 4070731 - RNA, 17 nt, Vaccinia virus
ugguuaacaauauggaa

SEQ ID NO: 4070732 - RNA, 15 nt, Vaccinia virus
ugguuauuuacuaac

SEQ ID NO: 4070733 - RNA, 19 nt, Vaccinia virus
ugguuguagcgguuggaua

SEQ ID NO: 4070734 - RNA, 18 nt, Vaccinia virus
uguaaaaagauaaacuuu

SEQ ID NO: 4070735 - RNA, 19 nt, Vaccinia virus
uguaaaaagauaaacuuua

SEQ ID NO: 4070736 - RNA, 18 nt, Vaccinia virus
uguaaaaguaaaaaagaa

SEQ ID NO: 4070737 - RNA, 15 nt, Vaccinia virus
uguaaagaacaguga

SEQ ID NO: 4070738 - RNA, 21 nt, Vaccinia virus
uguaaaggauaugauauguug

SEQ ID NO: 4070739 - RNA, 21 nt, Vaccinia virus
uguaaauguaacauauuuaga

SEQ ID NO: 4070740 - RNA, 22 nt, Vaccinia virus
uguaaauucagcgguaaagaua

SEQ ID NO: 4070741 - RNA, 20 nt, Vaccinia virus
uguaacauugaguaaauccu

SEQ ID NO: 4070742 - RNA, 18 nt, Vaccinia virus
uguaacccacguaacauu

SEQ ID NO: 4070743 - RNA, 19 nt, Vaccinia virus
uguaacccacguaacauug

SEQ ID NO: 4070744 - RNA, 21 nt, Vaccinia virus
uguaauacuagcgugaacaac

SEQ ID NO: 4070745 - RNA, 20 nt, Vaccinia virus
uguaauauucuaguuuggua

SEQ ID NO: 4070746 - RNA, 20 nt, Vaccinia virus
uguaaucgguguccaccugg

SEQ ID NO: 4070747 - RNA, 19 nt, Vaccinia virus
uguaauggaugucaugaac

SEQ ID NO: 4070748 - RNA, 13 nt, Vaccinia virus
uguaauuaaauuu

SEQ ID NO: 4070749 - RNA, 14 nt, Vaccinia virus
uguacagaaaucau

SEQ ID NO: 4070750 - RNA, 14 nt, Vaccinia virus
uguacauuauuaca

SEQ ID NO: 4070751 - RNA, 15 nt, Vaccinia virus
uguaccuuauacguu

SEQ ID NO: 4070752 - RNA, 16 nt, Vaccinia virus
uguacuaucuagagau

SEQ ID NO: 4070753 - RNA, 23 nt, Vaccinia virus
uguacuucgaugagauugaucau

SEQ ID NO: 4070754 - RNA, 14 nt, Vaccinia virus
uguacuucuuccag

SEQ ID NO: 4070755 - RNA, 23 nt, Vaccinia virus
uguacuucuuccaguucuggaua

SEQ ID NO: 4070756 - RNA, 15 nt, Vaccinia virus
uguagauaugugaua

SEQ ID NO: 4070757 - RNA, 17 nt, Vaccinia virus
uguagauggauguagca

SEQ ID NO: 4070758 - RNA, 16 nt, Vaccinia virus
uguagccgauaaacaa

SEQ ID NO: 4070759 - RNA, 16 nt, Vaccinia virus
uguagguaguaguaca

SEQ ID NO: 4070760 - RNA, 16 nt, Vaccinia virus
uguaguaguaacuguu

SEQ ID NO: 4070761 - RNA, 18 nt, Vaccinia virus
uguagucgacagaagaau

SEQ ID NO: 4070762 - RNA, 20 nt, Vaccinia virus
uguauaauaagaugcaaaca

SEQ ID NO: 4070763 - RNA, 14 nt, Vaccinia virus
uguauaauuuggua

SEQ ID NO: 4070764 - RNA, 19 nt, Vaccinia virus
uguauacaucgguaaauaa

SEQ ID NO: 4070765 - RNA, 20 nt, Vaccinia virus
uguauauacuaacucucuaa

SEQ ID NO: 4070766 - RNA, 17 nt, Vaccinia virus
uguauauauauuucuua

SEQ ID NO: 4070767 - RNA, 15 nt, Vaccinia virus
uguauauuuuuucau

SEQ ID NO: 4070768 - RNA, 13 nt, Vaccinia virus
uguaucaaagaua

SEQ ID NO: 4070769 - RNA, 19 nt, Vaccinia virus
uguaucauccaguuuucca

SEQ ID NO: 4070770 - RNA, 19 nt, Vaccinia virus
uguaugcguugauauuaca

SEQ ID NO: 4070771 - RNA, 18 nt, Vaccinia virus
uguauguacggucugaua

SEQ ID NO: 4070772 - RNA, 17 nt, Vaccinia virus
uguaugucuuauguaua

SEQ ID NO: 4070773 - RNA, 15 nt, Vaccinia virus
uguauguuugggaga

SEQ ID NO: 4070774 - RNA, 12 nt, Vaccinia virus
uguauuaaauag

SEQ ID NO: 4070775 - RNA, 20 nt, Vaccinia virus
uguauuaaauagaauauuua

SEQ ID NO: 4070776 - RNA, 23 nt, Vaccinia virus
uguauucagaauuaauagauaua

SEQ ID NO: 4070777 - RNA, 14 nt, Vaccinia virus
uguauuuuggcaua

SEQ ID NO: 4070778 - RNA, 22 nt, Vaccinia virus
ugucaucuucgucuauuucuau

SEQ ID NO: 4070779 - RNA, 22 nt, Vaccinia virus
ugucaucuuguucagaaauaua

SEQ ID NO: 4070780 - RNA, 14 nt, Vaccinia virus
ugucauuuguauuu

SEQ ID NO: 4070781 - RNA, 21 nt, Vaccinia virus
uguccagcguguccccaggac

SEQ ID NO: 4070782 - RNA, 23 nt, Vaccinia virus
uguccauuguaguauaaaaauua

SEQ ID NO: 4070783 - RNA, 18 nt, Vaccinia virus
uguccgaugaucaaugac

SEQ ID NO: 4070784 - RNA, 14 nt, Vaccinia virus
uguccugcauguag

SEQ ID NO: 4070785 - RNA, 13 nt, Vaccinia virus
ugucuaaaucucu

SEQ ID NO: 4070786 - RNA, 23 nt, Vaccinia virus
ugucuaaugaugaacacaaaugg

SEQ ID NO: 4070787 - RNA, 20 nt, Vaccinia virus
ugucuacacauccuuuugua

SEQ ID NO: 4070788 - RNA, 19 nt, Vaccinia virus
ugucuacauaaauaugcaa

SEQ ID NO: 4070789 - RNA, 18 nt, Vaccinia virus
ugucuaugaauaugauuu

SEQ ID NO: 4070790 - RNA, 16 nt, Vaccinia virus
ugucucauauguuuua

SEQ ID NO: 4070791 - RNA, 19 nt, Vaccinia virus
ugucucuuaacuauuuccg

SEQ ID NO: 4070792 - RNA, 17 nt, Vaccinia virus
ugucugauuuuucuuca

SEQ ID NO: 4070793 - RNA, 17 nt, Vaccinia virus
ugucuguccgaauguau

SEQ ID NO: 4070794 - RNA, 17 nt, Vaccinia virus
ugucuuaaaguuuauua

SEQ ID NO: 4070795 - RNA, 23 nt, Vaccinia virus
ugucuuaaaguuuauuaauuaau

SEQ ID NO: 4070796 - RNA, 22 nt, Vaccinia virus
ugucuuagaaggaguguuuucu

SEQ ID NO: 4070797 - RNA, 21 nt, Vaccinia virus
ugucuuuaaguauauacgaua

SEQ ID NO: 4070798 - RNA, 18 nt, Vaccinia virus
ugugaagguuuagauguc

SEQ ID NO: 4070799 - RNA, 14 nt, Vaccinia virus
ugugacaugauguc

SEQ ID NO: 4070800 - RNA, 14 nt, Vaccinia virus
ugugacuguuuucu

SEQ ID NO: 4070801 - RNA, 13 nt, Vaccinia virus
ugugaguaguguu

SEQ ID NO: 4070802 - RNA, 20 nt, Vaccinia virus
ugugauagucgauacguuau

SEQ ID NO: 4070803 - RNA, 14 nt, Vaccinia virus
ugugauauaaacaa

SEQ ID NO: 4070804 - RNA, 13 nt, Vaccinia virus
ugugauauugaua

SEQ ID NO: 4070805 - RNA, 16 nt, Vaccinia virus
ugugaugauuguacac

SEQ ID NO: 4070806 - RNA, 23 nt, Vaccinia virus
ugugcucuuccagaguugggaua

SEQ ID NO: 4070807 - RNA, 15 nt, Vaccinia virus
uguguaaaaaguuuu

SEQ ID NO: 4070808 - RNA, 19 nt, Vaccinia virus
uguguagaaaguguuacau

SEQ ID NO: 4070809 - RNA, 18 nt, Vaccinia virus
uguuaaaaauaugugcuc

SEQ ID NO: 4070810 - RNA, 18 nt, Vaccinia virus
uguuaauaaguaaaugaa

SEQ ID NO: 4070811 - RNA, 15 nt, Vaccinia virus
uguuaauacaucaau

SEQ ID NO: 4070812 - RNA, 13 nt, Vaccinia virus
uguuaauuuugaa

SEQ ID NO: 4070813 - RNA, 14 nt, Vaccinia virus
uguuaguuuccuua

SEQ ID NO: 4070814 - RNA, 13 nt, Vaccinia virus
uguuauagaugug

SEQ ID NO: 4070815 - RNA, 17 nt, Vaccinia virus
uguuauuacgaaucauu

SEQ ID NO: 4070816 - RNA, 20 nt, Vaccinia virus
uguuauuacuacugaagaac

SEQ ID NO: 4070817 - RNA, 16 nt, Vaccinia virus
uguuauuguauacugu

SEQ ID NO: 4070818 - RNA, 12 nt, Vaccinia virus
uguucagaaaua

SEQ ID NO: 4070819 - RNA, 20 nt, Vaccinia virus
uguucauuaauaguauacac

SEQ ID NO: 4070820 - RNA, 15 nt, Vaccinia virus
uguucuaucaacgau

SEQ ID NO: 4070821 - RNA, 22 nt, Vaccinia virus
uguucuaucaacgauucuagaa

SEQ ID NO: 4070822 - RNA, 18 nt, Vaccinia virus
uguucuuaacuacauuca

SEQ ID NO: 4070823 - RNA, 17 nt, Vaccinia virus
uguugaugauaucuaca

SEQ ID NO: 4070824 - RNA, 18 nt, Vaccinia virus
uguuguaaggauccuggu

SEQ ID NO: 4070825 - RNA, 23 nt, Vaccinia virus
uguuuaaauaacccgaguauuga

SEQ ID NO: 4070826 - RNA, 15 nt, Vaccinia virus
uguuuaaaucaaaau

SEQ ID NO: 4070827 - RNA, 15 nt, Vaccinia virus
uguuuaacuuuuguu

SEQ ID NO: 4070828 - RNA, 18 nt, Vaccinia virus
uguuuaagaagagaauua

SEQ ID NO: 4070829 - RNA, 21 nt, Vaccinia virus
uuccguuggaugguaauaaac

SEQ ID NO: 4070830 - RNA, 23 nt, Vaccinia virus
uuccuagauauguaaaauaaucc

SEQ ID NO: 4070831 - RNA, 20 nt, Vaccinia virus
uuccuauaaucguuaaauuu

SEQ ID NO: 4070832 - RNA, 19 nt, Vaccinia virus
uuccugauuauuuacuaua

SEQ ID NO: 4070833 - RNA, 15 nt, Vaccinia virus
uuccuggagauaucc

SEQ ID NO: 4070834 - RNA, 12 nt, Vaccinia virus
uuccuuguguag

SEQ ID NO: 4070835 - RNA, 20 nt, Vaccinia virus
uucgaauauaucaaaaucau

SEQ ID NO: 4070836 - RNA, 23 nt, Vaccinia virus
uucgagauuaaaugcaauaacaa

SEQ ID NO: 4070837 - RNA, 16 nt, Vaccinia virus
uucgauagauauucuu

SEQ ID NO: 4070838 - RNA, 18 nt, Vaccinia virus
uucgcaaacuauucuaau

SEQ ID NO: 4070839 - RNA, 14 nt, Vaccinia virus
uucgcaucguauuu

SEQ ID NO: 4070840 - RNA, 12 nt, Vaccinia virus
uucgcugcuaug

SEQ ID NO: 4070841 - RNA, 19 nt, Vaccinia virus
uucgguauaaaaauuauug

SEQ ID NO: 4070842 - RNA, 16 nt, Vaccinia virus
uucguaaaauauucuu

SEQ ID NO: 4070843 - RNA, 20 nt, Vaccinia virus
uucgucaacaaguuggauga

SEQ ID NO: 4070844 - RNA, 16 nt, Vaccinia virus
uucuaagguagaaucu

SEQ ID NO: 4070845 - RNA, 20 nt, Vaccinia virus
uucuaauggaugauguucua

SEQ ID NO: 4070846 - RNA, 15 nt, Vaccinia virus
uucuaauucucagag

SEQ ID NO: 4070847 - RNA, 20 nt, Vaccinia virus
uucuacaaaagcaauuauua

SEQ ID NO: 4070848 - RNA, 13 nt, Vaccinia virus
uucuacaauaacu

SEQ ID NO: 4070849 - RNA, 21 nt, Vaccinia virus
uucuacaucuuccuucuuauu

SEQ ID NO: 4070850 - RNA, 21 nt, Vaccinia virus
uucuacaugcuccaauugaau

SEQ ID NO: 4070851 - RNA, 21 nt, Vaccinia virus
uucuaccuuacccauaaacaa

SEQ ID NO: 4070852 - RNA, 15 nt, Vaccinia virus
uucuacuuacuuauu

SEQ ID NO: 4070853 - RNA, 19 nt, Vaccinia virus
uucuagaacuaacaaacua

SEQ ID NO: 4070854 - RNA, 22 nt, Vaccinia virus
uucuagaaguugauacaacaua

SEQ ID NO: 4070855 - RNA, 16 nt, Vaccinia virus
uucuagaucaagaaac

SEQ ID NO: 4070856 - RNA, 18 nt, Vaccinia virus
uucuagucuuaaccaaaa

SEQ ID NO: 4070857 - RNA, 18 nt, Vaccinia virus
uucuaguucucuuuugua

SEQ ID NO: 4070858 - RNA, 21 nt, Vaccinia virus
uucuauaccaauauuauucuu

SEQ ID NO: 4070859 - RNA, 22 nt, Vaccinia virus
uucuauaccuuucgaaauuagu

SEQ ID NO: 4070860 - RNA, 16 nt, Vaccinia virus
uucuaucguaguguau

SEQ ID NO: 4070861 - RNA, 13 nt, Vaccinia virus
uucuauuauuaca

SEQ ID NO: 4070862 - RNA, 14 nt, Vaccinia virus
uucuauucuagaaa

SEQ ID NO: 4070863 - RNA, 15 nt, Vaccinia virus
uucuauucuuauucu

SEQ ID NO: 4070864 - RNA, 14 nt, Vaccinia virus
uucuauuuaauuuu

SEQ ID NO: 4070865 - RNA, 21 nt, Vaccinia virus
uucucaaaagaucaaggaaau

SEQ ID NO: 4070866 - RNA, 21 nt, Vaccinia virus
uucuccaccaaacauauucuu

SEQ ID NO: 4070867 - RNA, 18 nt, Vaccinia virus
uucuccguucuuaauaag

SEQ ID NO: 4070868 - RNA, 22 nt, Vaccinia virus
uucugacgucguucuacauaaa

SEQ ID NO: 4070869 - RNA, 21 nt, Vaccinia virus
uucugauauggaaucuguauu

SEQ ID NO: 4070870 - RNA, 13 nt, Vaccinia virus
uucugaugaaaca

SEQ ID NO: 4070871 - RNA, 17 nt, Vaccinia virus
uucugcgcaaugcauaa

SEQ ID NO: 4070872 - RNA, 21 nt, Vaccinia virus
uucuggaauaggauaauaauu

SEQ ID NO: 4070873 - RNA, 16 nt, Vaccinia virus
uucuggacauagcuuu

SEQ ID NO: 4070874 - RNA, 16 nt, Vaccinia virus
uucuggauauguuuuu

SEQ ID NO: 4070875 - RNA, 18 nt, Vaccinia virus
uucuggugcuaauuauuc

SEQ ID NO: 4070876 - RNA, 12 nt, Vaccinia virus
uucuguuuucaa

SEQ ID NO: 4070877 - RNA, 18 nt, Vaccinia virus
uucuuaaaagguuucaua

SEQ ID NO: 4070878 - RNA, 20 nt, Vaccinia virus
uucuuaacuuacaaaaugua

SEQ ID NO: 4070879 - RNA, 23 nt, Vaccinia virus
uucuuacaguacacaguauugac

SEQ ID NO: 4070880 - RNA, 20 nt, Vaccinia virus
uucuuacauauuuuuuucuu

SEQ ID NO: 4070881 - RNA, 19 nt, Vaccinia virus
uucuuaucaauaacauauu

SEQ ID NO: 4070882 - RNA, 23 nt, Vaccinia virus
uucuucauuuauggguaucaaaa

SEQ ID NO: 4070883 - RNA, 21 nt, Vaccinia virus
uucuucuauaguccugucuuu

SEQ ID NO: 4070884 - RNA, 20 nt, Vaccinia virus
uucuuggauauagaauccaa

SEQ ID NO: 4070885 - RNA, 14 nt, Vaccinia virus
uucuuguuaucaga

SEQ ID NO: 4070886 - RNA, 13 nt, Vaccinia virus
uugaaaauuauuu

SEQ ID NO: 4070887 - RNA, 10 nt, Vaccinia virus
uugaaagaga

SEQ ID NO: 4070888 - RNA, 22 nt, Vaccinia virus
uugaaccaguccauggaaaaga

SEQ ID NO: 4070889 - RNA, 16 nt, Vaccinia virus
uugaacuccucuagau

SEQ ID NO: 4070890 - RNA, 21 nt, Vaccinia virus
uugaagaauuuauauaaauca

SEQ ID NO: 4070891 - RNA, 20 nt, Vaccinia virus
uugacuacauucucauuaau

SEQ ID NO: 4070892 - RNA, 18 nt, Vaccinia virus
uugagacgggucaaacaa

SEQ ID NO: 4070893 - RNA, 17 nt, Vaccinia virus
uugagauggauucacug

SEQ ID NO: 4070894 - RNA, 20 nt, Vaccinia virus
uugagcaaucagaaaugaug

SEQ ID NO: 4070895 - RNA, 14 nt, Vaccinia virus
uugauaauaaauca

SEQ ID NO: 4070896 - RNA, 13 nt, Vaccinia virus
uugauaauaaucc

SEQ ID NO: 4070897 - RNA, 19 nt, Vaccinia virus
uugauacuuuuucuagaaa

SEQ ID NO: 4070898 - RNA, 21 nt, Vaccinia virus
uugauaguuguuccuagauau

SEQ ID NO: 4070899 - RNA, 15 nt, Vaccinia virus
uugauauauuauuua

SEQ ID NO: 4070900 - RNA, 20 nt, Vaccinia virus
uugauaucgcauagaaauac

SEQ ID NO: 4070901 - RNA, 13 nt, Vaccinia virus
uugaucaacuaua

SEQ ID NO: 4070902 - RNA, 18 nt, Vaccinia virus
uugaucaucguaauuaau

SEQ ID NO: 4070903 - RNA, 17 nt, Vaccinia virus
uugauccaguggaugau

SEQ ID NO: 4070904 - RNA, 18 nt, Vaccinia virus
uugauccguaauaacauu

SEQ ID NO: 4070905 - RNA, 20 nt, Vaccinia virus
uugauccuagaacuagauau

SEQ ID NO: 4070906 - RNA, 22 nt, Vaccinia virus
uugaucucaucauuccauaauu

SEQ ID NO: 4070907 - RNA, 20 nt, Vaccinia virus
uugaugauaucuacaucguu

SEQ ID NO: 4070908 - RNA, 15 nt, Vaccinia virus
uugauggaaaaauuc

SEQ ID NO: 4070909 - RNA, 17 nt, Vaccinia virus
uugaugucguuauucug

SEQ ID NO: 4070910 - RNA, 20 nt, Vaccinia virus
uugauuaccacgucuggaua

SEQ ID NO: 4070911 - RNA, 13 nt, Vaccinia virus
uugauuauuuuga

SEQ ID NO: 4070912 - RNA, 17 nt, Vaccinia virus
uugauucgcuucuuuaa

SEQ ID NO: 4070913 - RNA, 13 nt, Vaccinia virus
uugauuuuggaua

SEQ ID NO: 4070914 - RNA, 21 nt, Vaccinia virus
uugcagacaaacgaagaaaga

SEQ ID NO: 4070915 - RNA, 13 nt, Vaccinia virus
uugccaaguuauc

SEQ ID NO: 4070916 - RNA, 19 nt, Vaccinia virus
uugccaucacucucauaau

SEQ ID NO: 4070917 - RNA, 19 nt, Vaccinia virus
uugcguggagaucauuaaa

SEQ ID NO: 4070918 - RNA, 14 nt, Vaccinia virus
uugcuaacgguauu

SEQ ID NO: 4070919 - RNA, 21 nt, Vaccinia virus
uugcucggcgucaacgcugga

SEQ ID NO: 4070920 - RNA, 14 nt, Vaccinia virus
uugcucguaaaaga

SEQ ID NO: 4070921 - RNA, 20 nt, Vaccinia virus
uugcuuugguuuaauuauuu

SEQ ID NO: 4070922 - RNA, 13 nt, Vaccinia virus
uugcuuuucuaau

SEQ ID NO: 4070923 - RNA, 14 nt, Vaccinia virus
uugcuuuucuaauc

SEQ ID NO: 4070924 - RNA, 16 nt, Vaccinia virus
uuggaaccggcugugg

SEQ ID NO: 4070925 - RNA, 16 nt, Vaccinia virus
uuggaaucaauuacag

SEQ ID NO: 4070926 - RNA, 22 nt, Vaccinia virus
uuggagaaacugcaacuggaaa

SEQ ID NO: 4070927 - RNA, 17 nt, Vaccinia virus
uugguagauuuucaauu

SEQ ID NO: 4070928 - RNA, 16 nt, Vaccinia virus
uugguauuucuuacau

SEQ ID NO: 4070929 - RNA, 13 nt, Vaccinia virus
uugguuucuaaau

SEQ ID NO: 4070930 - RNA, 18 nt, Vaccinia virus
uuguaaaguuaaaauugu

SEQ ID NO: 4070931 - RNA, 21 nt, Vaccinia virus
uuguaacaucgguacggguau

SEQ ID NO: 4070932 - RNA, 18 nt, Vaccinia virus
uuguaauaaaaagggaaa

SEQ ID NO: 4070933 - RNA, 14 nt, Vaccinia virus
uuguacaaauuccu

SEQ ID NO: 4070934 - RNA, 15 nt, Vaccinia virus
uuguagaacguggau

SEQ ID NO: 4070935 - RNA, 16 nt, Vaccinia virus
uuguagauuuaucaua

SEQ ID NO: 4070936 - RNA, 11 nt, Vaccinia virus
uuguagucuuu

SEQ ID NO: 4070937 - RNA, 14 nt, Vaccinia virus
uuguaguuaaaaac

SEQ ID NO: 4070938 - RNA, 18 nt, Vaccinia virus
uuguauagaaacuguaua

SEQ ID NO: 4070939 - RNA, 16 nt, Vaccinia virus
uuguauauuucuucuu

SEQ ID NO: 4070940 - RNA, 14 nt, Vaccinia virus
uugucauuaucuac

SEQ ID NO: 4070941 - RNA, 20 nt, Vaccinia virus
uuguccagauugaacauaca

SEQ ID NO: 4070942 - RNA, 15 nt, Vaccinia virus
uuguccuauauauca

SEQ ID NO: 4070943 - RNA, 11 nt, Vaccinia virus
uugucuagaau

SEQ ID NO: 4070944 - RNA, 24 nt, Vaccinia virus
uugucuuuaaguauauacgauaag

SEQ ID NO: 4070945 - RNA, 16 nt, Vaccinia virus
uugugaaugacaucau

SEQ ID NO: 4070946 - RNA, 16 nt, Vaccinia virus
uuguucauuggaugag

SEQ ID NO: 4070947 - RNA, 16 nt, Vaccinia virus
uuguucuaaagccagu

SEQ ID NO: 4070948 - RNA, 14 nt, Vaccinia virus
uuguucuuggaugu

SEQ ID NO: 4070949 - RNA, 22 nt, Vaccinia virus
uuguugagaugcugcuccugga

SEQ ID NO: 4070950 - RNA, 17 nt, Vaccinia virus
uuguuguccguuaucua

SEQ ID NO: 4070951 - RNA, 22 nt, Vaccinia virus
uuguuuacacggugacuguauc

SEQ ID NO: 4070952 - RNA, 17 nt, Vaccinia virus
uuuaaaaacgaaucaga

SEQ ID NO: 4070953 - RNA, 11 nt, Vaccinia virus
gccaaauguac

SEQ ID NO: 4070954 - RNA, 14 nt, Vaccinia virus
gccaacuauacauc

SEQ ID NO: 4070955 - RNA, 14 nt, Vaccinia virus
gccaagauagcuuc

SEQ ID NO: 4070956 - RNA, 20 nt, Vaccinia virus
gccacaaaacagaaauaugu

SEQ ID NO: 4070957 - RNA, 13 nt, Vaccinia virus
gccagaaucaugg

SEQ ID NO: 4070958 - RNA, 16 nt, Vaccinia virus
gccagagauaauuucu

SEQ ID NO: 4070959 - RNA, 15 nt, Vaccinia virus
gccagaucuucuucu

SEQ ID NO: 4070960 - RNA, 20 nt, Vaccinia virus
gccauacucagaauuaugau

SEQ ID NO: 4070961 - RNA, 15 nt, Vaccinia virus
gccauuaauuacuuu

SEQ ID NO: 4070962 - RNA, 14 nt, Vaccinia virus
gccauuacaagaua

SEQ ID NO: 4070963 - RNA, 20 nt, Vaccinia virus
gccauugaaaacuauuucuu

SEQ ID NO: 4070964 - RNA, 22 nt, Vaccinia virus
gccccgcuucuauuuacucccg

SEQ ID NO: 4070965 - RNA, 17 nt, Vaccinia virus
gcccucaauuucccaaa

SEQ ID NO: 4070966 - RNA, 19 nt, Vaccinia virus
gcccucuauuagcauaaac

SEQ ID NO: 4070967 - RNA, 18 nt, Vaccinia virus
gccgaguuuaaaacuucu

SEQ ID NO: 4070968 - RNA, 15 nt, Vaccinia virus
gccgauaaacaaauc

SEQ ID NO: 4070969 - RNA, 17 nt, Vaccinia virus
gccgcuauaaugaugau

SEQ ID NO: 4070970 - RNA, 19 nt, Vaccinia virus
gccgguugccgcaaauaga

SEQ ID NO: 4070971 - RNA, 22 nt, Vaccinia virus
gccguauggaccauuauuuuua

SEQ ID NO: 4070972 - RNA, 22 nt, Vaccinia virus
gccuaaacccgacuuaguuaua

SEQ ID NO: 4070973 - RNA, 19 nt, Vaccinia virus
gccuauaaaguaauaaucu

SEQ ID NO: 4070974 - RNA, 20 nt, Vaccinia virus
gccucaucuucuauauccug

SEQ ID NO: 4070975 - RNA, 18 nt, Vaccinia virus
gccuccacuagaagagaa

SEQ ID NO: 4070976 - RNA, 14 nt, Vaccinia virus
gccugaaguuuauu

SEQ ID NO: 4070977 - RNA, 16 nt, Vaccinia virus
gccuguacuuggauuu

SEQ ID NO: 4070978 - RNA, 22 nt, Vaccinia virus
gccuuauucucuggagaaaaga

SEQ ID NO: 4070979 - RNA, 15 nt, Vaccinia virus
gccuuuuuauacaug

SEQ ID NO: 4070980 - RNA, 16 nt, Vaccinia virus
gcgaaccgauuaaaca

SEQ ID NO: 4070981 - RNA, 17 nt, Vaccinia virus
gcgaauaaauagauaua

SEQ ID NO: 4070982 - RNA, 19 nt, Vaccinia virus
gcgacaguaugugguacau

SEQ ID NO: 4070983 - RNA, 13 nt, Vaccinia virus
gcgauugauuuug

SEQ ID NO: 4070984 - RNA, 11 nt, Vaccinia virus
gcgcaugauuu

SEQ ID NO: 4070985 - RNA, 14 nt, Vaccinia virus
gcgcuaguagauuu

SEQ ID NO: 4070986 - RNA, 19 nt, Vaccinia virus
gcgcuauagaguagacauu

SEQ ID NO: 4070987 - RNA, 13 nt, Vaccinia virus
gcgcuaucuuuca

SEQ ID NO: 4070988 - RNA, 16 nt, Vaccinia virus
gcggaacaauaaacaa

SEQ ID NO: 4070989 - RNA, 15 nt, Vaccinia virus
gcggacuuuaaacag

SEQ ID NO: 4070990 - RNA, 20 nt, Vaccinia virus
gcggagauaauaucagaaag

SEQ ID NO: 4070991 - RNA, 16 nt, Vaccinia virus
gcggcaucuaaauuaa

SEQ ID NO: 4070992 - RNA, 12 nt, Vaccinia virus
gcgguguauuua

SEQ ID NO: 4070993 - RNA, 17 nt, Vaccinia virus
gcguacuucagguuucu

SEQ ID NO: 4070994 - RNA, 17 nt, Vaccinia virus
gcgucauuguaaaggaa

SEQ ID NO: 4070995 - RNA, 20 nt, Vaccinia virus
gcgugaacaacuuacagaug

SEQ ID NO: 4070996 - RNA, 16 nt, Vaccinia virus
gcuaaaaaauuaguag

SEQ ID NO: 4070997 - RNA, 12 nt, Vaccinia virus
gcuaacaucaua

SEQ ID NO: 4070998 - RNA, 17 nt, Vaccinia virus
gcuaaggaguuuaagaa

SEQ ID NO: 4070999 - RNA, 15 nt, Vaccinia virus
gcuaauaucuaaaua

SEQ ID NO: 4071000 - RNA, 21 nt, Vaccinia virus
gcuaauuuuuguaaauaacua

SEQ ID NO: 4071001 - RNA, 14 nt, Vaccinia virus
gcuacuaucuugua

SEQ ID NO: 4071002 - RNA, 15 nt, Vaccinia virus
gcuaguuauuaaaca

SEQ ID NO: 4071003 - RNA, 19 nt, Vaccinia virus
gcuauaauaauaaauguau

SEQ ID NO: 4071004 - RNA, 20 nt, Vaccinia virus
gcuauaauccgauauaugau

SEQ ID NO: 4071005 - RNA, 11 nt, Vaccinia virus
gcuauaaugau

SEQ ID NO: 4071006 - RNA, 14 nt, Vaccinia virus
gcuauaaugaugau

SEQ ID NO: 4071007 - RNA, 19 nt, Vaccinia virus
gcuaugauaaucagaucau

SEQ ID NO: 4071008 - RNA, 17 nt, Vaccinia virus
gcuauuaaaauauuuua

SEQ ID NO: 4071009 - RNA, 13 nt, Vaccinia virus
gcucauaaacuca

SEQ ID NO: 4071010 - RNA, 18 nt, Vaccinia virus
gcuccuacaggaauaucu

SEQ ID NO: 4071011 - RNA, 13 nt, Vaccinia virus
gcucgauaaucaa

SEQ ID NO: 4071012 - RNA, 23 nt, Vaccinia virus
gcucuacaugcgguaaagauauu

SEQ ID NO: 4071013 - RNA, 12 nt, Vaccinia virus
gcucuagauauu

SEQ ID NO: 4071014 - RNA, 18 nt, Vaccinia virus
gcucuguaaagcauauuc

SEQ ID NO: 4071015 - RNA, 18 nt, Vaccinia virus
gcugaacacauuaaacaa

SEQ ID NO: 4071016 - RNA, 15 nt, Vaccinia virus
gcugacuagcauauu

SEQ ID NO: 4071017 - RNA, 16 nt, Vaccinia virus
gcugauuaacuuccac

SEQ ID NO: 4071018 - RNA, 18 nt, Vaccinia virus
gcugauuauuuauuucuu

SEQ ID NO: 4071019 - RNA, 17 nt, Vaccinia virus
gcuguaaacaaguuugg

SEQ ID NO: 4071020 - RNA, 12 nt, Vaccinia virus
gcugucauguau

SEQ ID NO: 4071021 - RNA, 23 nt, Vaccinia virus
gcuuaaaggaagaauaucauauu

SEQ ID NO: 4071022 - RNA, 17 nt, Vaccinia virus
gcuucuuuaauuuuuua

SEQ ID NO: 4071023 - RNA, 16 nt, Vaccinia virus
gcuugugauuuuuucu

SEQ ID NO: 4071024 - RNA, 18 nt, Vaccinia virus
gcuuucaagaauaaacga

SEQ ID NO: 4071025 - RNA, 22 nt, Vaccinia virus
ggaaaaucgucuucacaaagaa

SEQ ID NO: 4071026 - RNA, 19 nt, Vaccinia virus
ggaaaaucugaagaagaua

SEQ ID NO: 4071027 - RNA, 16 nt, Vaccinia virus
ggaaacaauucauaau

SEQ ID NO: 4071028 - RNA, 23 nt, Vaccinia virus
ggaaagcuagacuugauuauucu

SEQ ID NO: 4071029 - RNA, 22 nt, Vaccinia virus
ggaaauacaccucuacauaacu

SEQ ID NO: 4071030 - RNA, 14 nt, Vaccinia virus
ggaaauggaagaaa

SEQ ID NO: 4071031 - RNA, 23 nt, Vaccinia virus
ggaagcaacuaaacuaugugaug

SEQ ID NO: 4071032 - RNA, 15 nt, Vaccinia virus
ggaaucuguauucuc

SEQ ID NO: 4071033 - RNA, 12 nt, Vaccinia virus
agauaaaacaag

SEQ ID NO: 4071034 - RNA, 13 nt, Vaccinia virus
agauaaacuaaau

SEQ ID NO: 4071035 - RNA, 16 nt, Vaccinia virus
agauaaagaguucuaa

SEQ ID NO: 4071036 - RNA, 21 nt, Vaccinia virus
agauaaauccaucuuccagaa

SEQ ID NO: 4071037 - RNA, 12 nt, Vaccinia virus
agauaauacaaa

SEQ ID NO: 4071038 - RNA, 16 nt, Vaccinia virus
agauaaugcuaaugua

SEQ ID NO: 4071039 - RNA, 16 nt, Vaccinia virus
agauacaauauuuaca

SEQ ID NO: 4071040 - RNA, 17 nt, Vaccinia virus
agauacagauacagaua

SEQ ID NO: 4071041 - RNA, 20 nt, Vaccinia virus
agauaccaacauuaaaaugu

SEQ ID NO: 4071042 - RNA, 21 nt, Vaccinia virus
agauacguaguuauguagagg

SEQ ID NO: 4071043 - RNA, 15 nt, Vaccinia virus
agauacgucuauaca

SEQ ID NO: 4071044 - RNA, 14 nt, Vaccinia virus
agauacuguauaua

SEQ ID NO: 4071045 - RNA, 18 nt, Vaccinia virus
agauagauaaucaaaauu

SEQ ID NO: 4071046 - RNA, 19 nt, Vaccinia virus
agauagcuuuagcuaauau

SEQ ID NO: 4071047 - RNA, 20 nt, Vaccinia virus
agauaguaaauagauaguuu

SEQ ID NO: 4071048 - RNA, 20 nt, Vaccinia virus
agauaguagcuauaauauau

SEQ ID NO: 4071049 - RNA, 16 nt, Vaccinia virus
agauaguuuucucuau

SEQ ID NO: 4071050 - RNA, 14 nt, Vaccinia virus
agauauauagaauu

SEQ ID NO: 4071051 - RNA, 16 nt, Vaccinia virus
agauauaucuacuucu

SEQ ID NO: 4071052 - RNA, 17 nt, Vaccinia virus
agauauauuauaauucu

SEQ ID NO: 4071053 - RNA, 22 nt, Vaccinia virus
agauaucauaaaugaaauagau

SEQ ID NO: 4071054 - RNA, 16 nt, Vaccinia virus
agauaugccaaaauca

SEQ ID NO: 4071055 - RNA, 22 nt, Vaccinia virus
agauaugguguagcauauguuu

SEQ ID NO: 4071056 - RNA, 15 nt, Vaccinia virus
agauauguuuauuca

SEQ ID NO: 4071057 - RNA, 13 nt, Vaccinia virus
agauauuaaugag

SEQ ID NO: 4071058 - RNA, 22 nt, Vaccinia virus
agauauuaucauuagucauguu

SEQ ID NO: 4071059 - RNA, 13 nt, Vaccinia virus
agaucaaaacaaa

SEQ ID NO: 4071060 - RNA, 18 nt, Vaccinia virus
agaucaaccaaaaaggag

SEQ ID NO: 4071061 - RNA, 17 nt, Vaccinia virus
agaucauuaaauguuuc

SEQ ID NO: 4071062 - RNA, 18 nt, Vaccinia virus
agauccaacauuaaucaa

SEQ ID NO: 4071063 - RNA, 21 nt, Vaccinia virus
agauccacugucacuggaaag

SEQ ID NO: 4071064 - RNA, 20 nt, Vaccinia virus
agauccucucuuaaaugaau

SEQ ID NO: 4071065 - RNA, 16 nt, Vaccinia virus
agauccucucuucaac

SEQ ID NO: 4071066 - RNA, 13 nt, Vaccinia virus
agaucuaaauaca

SEQ ID NO: 4071067 - RNA, 15 nt, Vaccinia virus
agaucuaaauacaaa

SEQ ID NO: 4071068 - RNA, 17 nt, Vaccinia virus
agaucuaauaaauggag

SEQ ID NO: 4071069 - RNA, 19 nt, Vaccinia virus
agaucuaauaaauggagaa

SEQ ID NO: 4071070 - RNA, 19 nt, Vaccinia virus
agaucuaauuuuucauuga

SEQ ID NO: 4071071 - RNA, 21 nt, Vaccinia virus
agaucuacuggcgaaauggua

SEQ ID NO: 4071072 - RNA, 18 nt, Vaccinia virus
agaucuaugauaucuucu

SEQ ID NO: 4071073 - RNA, 19 nt, Vaccinia virus
agaucuauuuuaaaguuaa

SEQ ID NO: 4071074 - RNA, 16 nt, Vaccinia virus
agaucuuugauauacu

SEQ ID NO: 4071075 - RNA, 22 nt, Vaccinia virus
agaugaguccaugacuugguau

SEQ ID NO: 4071076 - RNA, 15 nt, Vaccinia virus
agaugauacaaauaa

SEQ ID NO: 4071077 - RNA, 14 nt, Vaccinia virus
agaugaucauagau

SEQ ID NO: 4071078 - RNA, 21 nt, Vaccinia virus
agaugccauaucauacaugau

SEQ ID NO: 4071079 - RNA, 15 nt, Vaccinia virus
agaugcucaauggau

SEQ ID NO: 4071080 - RNA, 17 nt, Vaccinia virus
agaugcuggaagacaag

SEQ ID NO: 4071081 - RNA, 19 nt, Vaccinia virus
agauggaagggucaaacuu

SEQ ID NO: 4071082 - RNA, 18 nt, Vaccinia virus
agauggcguauuuaagag

SEQ ID NO: 4071083 - RNA, 14 nt, Vaccinia virus
agaugguaaacucu

SEQ ID NO: 4071084 - RNA, 14 nt, Vaccinia virus
agauguaaaaaaug

SEQ ID NO: 4071085 - RNA, 18 nt, Vaccinia virus
agauguauuugauauacu

SEQ ID NO: 4071086 - RNA, 16 nt, Vaccinia virus
agauguguauaauucu

SEQ ID NO: 4071087 - RNA, 18 nt, Vaccinia virus
agauguuagaaaaaauga

SEQ ID NO: 4071088 - RNA, 16 nt, Vaccinia virus
agauguuuaaugauac

SEQ ID NO: 4071089 - RNA, 18 nt, Vaccinia virus
agauguuugagaauauau

SEQ ID NO: 4071090 - RNA, 18 nt, Vaccinia virus
agauuaaaucauuaaaug

SEQ ID NO: 4071091 - RNA, 15 nt, Vaccinia virus
agauuaaaugcaaua

SEQ ID NO: 4071092 - RNA, 17 nt, Vaccinia virus
agauuaagauuaaacau

SEQ ID NO: 4071093 - RNA, 18 nt, Vaccinia virus
agauuagcuucgauguuu

SEQ ID NO: 4071094 - RNA, 22 nt, Vaccinia virus
agauuagguguagaucuagaug

SEQ ID NO: 4071095 - RNA, 14 nt, Vaccinia virus
agauuauaacuuau

SEQ ID NO: 4071096 - RNA, 18 nt, Vaccinia virus
agauuauggagcaaacau

SEQ ID NO: 4071097 - RNA, 19 nt, Vaccinia virus
agauuauuauggaaaucaa

SEQ ID NO: 4071098 - RNA, 16 nt, Vaccinia virus
agauuauucuuaaaug

SEQ ID NO: 4071099 - RNA, 19 nt, Vaccinia virus
agauucauguuaacacucu

SEQ ID NO: 4071100 - RNA, 16 nt, Vaccinia virus
agauuccuauuuacaa

SEQ ID NO: 4071101 - RNA, 24 nt, Vaccinia virus
agauucgaugguuugucaucguau

SEQ ID NO: 4071102 - RNA, 14 nt, Vaccinia virus
agauucuaauggau

SEQ ID NO: 4071103 - RNA, 14 nt, Vaccinia virus
agauucugauguau

SEQ ID NO: 4071104 - RNA, 16 nt, Vaccinia virus
agauugauuauuuccu

SEQ ID NO: 4071105 - RNA, 18 nt, Vaccinia virus
agauugguacgaaauaua

SEQ ID NO: 4071106 - RNA, 16 nt, Vaccinia virus
agauuuauaauacuuu

SEQ ID NO: 4071107 - RNA, 15 nt, Vaccinia virus
agauuucaaagaugu

SEQ ID NO: 4071108 - RNA, 19 nt, Vaccinia virus
agauuucagaaucuagauu

SEQ ID NO: 4071109 - RNA, 22 nt, Vaccinia virus
agauuucuuuuugggaaaaauu

SEQ ID NO: 4071110 - RNA, 22 nt, Vaccinia virus
agauuugguaaaaugaaauauc

SEQ ID NO: 4071111 - RNA, 18 nt, Vaccinia virus
agauuuucaauuauguau

SEQ ID NO: 4071112 - RNA, 20 nt, Vaccinia virus
agauuuuugacuuacauaaa

SEQ ID NO: 4071113 - RNA, 13 nt, Vaccinia virus
agcaaaaaaccau

SEQ ID NO: 4071114 - RNA, 14 nt, Vaccinia virus
agcaaaaaaugaua

SEQ ID NO: 4071115 - RNA, 16 nt, Vaccinia virus
agcaaaauuauuaauu

SEQ ID NO: 4071116 - RNA, 18 nt, Vaccinia virus
agcaaaucuaguaaauca

SEQ ID NO: 4071117 - RNA, 19 nt, Vaccinia virus
agcaacaugucucuaaaug

SEQ ID NO: 4071118 - RNA, 13 nt, Vaccinia virus
agcaacuaaucaa

SEQ ID NO: 4071119 - RNA, 21 nt, Vaccinia virus
agcaacuaaucaauagcuuaa

SEQ ID NO: 4071120 - RNA, 13 nt, Vaccinia virus
agcaagaaagaua

SEQ ID NO: 4071121 - RNA, 14 nt, Vaccinia virus
agcaauaaauacag

SEQ ID NO: 4071122 - RNA, 19 nt, Vaccinia virus
agcaauaguauaauuauau

SEQ ID NO: 4071123 - RNA, 14 nt, Vaccinia virus
agcaaugaaaucac

SEQ ID NO: 4071124 - RNA, 17 nt, Vaccinia virus
agcacauccaucaaaga

SEQ ID NO: 4071125 - RNA, 22 nt, Vaccinia virus
agcagauuaguaugaagauaaa

SEQ ID NO: 4071126 - RNA, 21 nt, Vaccinia virus
agcagcaucugcgauguuaua

SEQ ID NO: 4071127 - RNA, 21 nt, Vaccinia virus
agcauacgccaaauaucucaa

SEQ ID NO: 4071128 - RNA, 15 nt, Vaccinia virus
agcauagaggaugaa

SEQ ID NO: 4071129 - RNA, 19 nt, Vaccinia virus
agcauaucacgaacuauau

SEQ ID NO: 4071130 - RNA, 19 nt, Vaccinia virus
agcauauuccauuaaugac

SEQ ID NO: 4071131 - RNA, 17 nt, Vaccinia virus
agcaucagcaucuggcu

SEQ ID NO: 4071132 - RNA, 16 nt, Vaccinia virus
agcaucauaaaaauga

SEQ ID NO: 4071133 - RNA, 20 nt, Vaccinia virus
agcaucauacgaaaauagau

SEQ ID NO: 4071134 - RNA, 22 nt, Vaccinia virus
agcauccccuuucaauaguucu

SEQ ID NO: 4071135 - RNA, 21 nt, Vaccinia virus
agcauccguauaaaaaucgau

SEQ ID NO: 4071136 - RNA, 14 nt, Vaccinia virus
agcaucuaguugau

SEQ ID NO: 4071137 - RNA, 12 nt, Vaccinia virus
agcauguagaag

SEQ ID NO: 4071138 - RNA, 22 nt, Vaccinia virus
agcaugugaauauaauaauaca

SEQ ID NO: 4071139 - RNA, 16 nt, Vaccinia virus
agcauucaaauccgaa

SEQ ID NO: 4071140 - RNA, 19 nt, Vaccinia virus
agcauugaaaauacguucu

SEQ ID NO: 4071141 - RNA, 15 nt, Vaccinia virus
agcauuguuauguau

SEQ ID NO: 4071142 - RNA, 17 nt, Vaccinia virus
agcauuguuauguauuu

SEQ ID NO: 4071143 - RNA, 23 nt, Vaccinia virus
agcauuucugucgauauagcuuu

SEQ ID NO: 4071144 - RNA, 18 nt, Vaccinia virus
agcauuuguaauaauccu

SEQ ID NO: 4071145 - RNA, 19 nt, Vaccinia virus
agcauuuuggaaacauaaa

SEQ ID NO: 4071146 - RNA, 14 nt, Vaccinia virus
agccaacaaauaua

SEQ ID NO: 4071147 - RNA, 20 nt, Vaccinia virus
agccacuauagaguuucuaa

SEQ ID NO: 4071148 - RNA, 15 nt, Vaccinia virus
agccugaaaaagaua

SEQ ID NO: 4071149 - RNA, 19 nt, Vaccinia virus
agccugugaaugcaaucaa

SEQ ID NO: 4071150 - RNA, 20 nt, Vaccinia virus
agccuuaagaaaacuagaua

SEQ ID NO: 4071151 - RNA, 18 nt, Vaccinia virus
agcgacggggaugaugaa

SEQ ID NO: 4071152 - RNA, 19 nt, Vaccinia virus
auacuuuguaaucuagaca

SEQ ID NO: 4071153 - RNA, 18 nt, Vaccinia virus
auacuuugucggauuauc

SEQ ID NO: 4071154 - RNA, 20 nt, Vaccinia virus
auacuuuuaauuaacaaaag

SEQ ID NO: 4071155 - RNA, 19 nt, Vaccinia virus
auacuuuuacggaaaaaug

SEQ ID NO: 4071156 - RNA, 17 nt, Vaccinia virus
auacuuuuaggaaauca

SEQ ID NO: 4071157 - RNA, 19 nt, Vaccinia virus
auagaaauaaaaauuauua

SEQ ID NO: 4071158 - RNA, 14 nt, Vaccinia virus
auagaaauauauau

SEQ ID NO: 4071159 - RNA, 23 nt, Vaccinia virus
auagaacacccguagaaauacua

SEQ ID NO: 4071160 - RNA, 13 nt, Vaccinia virus
auagaagauagau

SEQ ID NO: 4071161 - RNA, 19 nt, Vaccinia virus
auagaagauagauaugcca

SEQ ID NO: 4071162 - RNA, 12 nt, Vaccinia virus
auagaagauuac

SEQ ID NO: 4071163 - RNA, 22 nt, Vaccinia virus
auagaaguuaaacugugaaugu

SEQ ID NO: 4071164 - RNA, 21 nt, Vaccinia virus
auagaaucggacgucugauau

SEQ ID NO: 4071165 - RNA, 19 nt, Vaccinia virus
auagacaaugcuaauauau

SEQ ID NO: 4071166 - RNA, 23 nt, Vaccinia virus
auagagagaaagaagaaauacua

SEQ ID NO: 4071167 - RNA, 17 nt, Vaccinia virus
auagagguaauacuuuu

SEQ ID NO: 4071168 - RNA, 16 nt, Vaccinia virus
auagauaaucaaaauu

SEQ ID NO: 4071169 - RNA, 14 nt, Vaccinia virus
auagauagaacuac

SEQ ID NO: 4071170 - RNA, 16 nt, Vaccinia virus
auagaucucucauuau

SEQ ID NO: 4071171 - RNA, 21 nt, Vaccinia virus
auagaugugguaauaucugac

SEQ ID NO: 4071172 - RNA, 19 nt, Vaccinia virus
auagauguucaucauauaa

SEQ ID NO: 4071173 - RNA, 16 nt, Vaccinia virus
auagauuuugaauauu

SEQ ID NO: 4071174 - RNA, 16 nt, Vaccinia virus
auagcaaaauaaaguu

SEQ ID NO: 4071175 - RNA, 17 nt, Vaccinia virus
auagcaaaaucuuuacu

SEQ ID NO: 4071176 - RNA, 17 nt, Vaccinia virus
auagcaaccaguguuug

SEQ ID NO: 4071177 - RNA, 15 nt, Vaccinia virus
auagcaauguaaugg

SEQ ID NO: 4071178 - RNA, 15 nt, Vaccinia virus
auagcaucaauaauu

SEQ ID NO: 4071179 - RNA, 15 nt, Vaccinia virus
auagcgaugauuauc

SEQ ID NO: 4071180 - RNA, 12 nt, Vaccinia virus
auagcuaucaag

SEQ ID NO: 4071181 - RNA, 22 nt, Vaccinia virus
auagcugaaucugauaaauaua

SEQ ID NO: 4071182 - RNA, 15 nt, Vaccinia virus
auaggagauauauau

SEQ ID NO: 4071183 - RNA, 16 nt, Vaccinia virus
auaggauacuuuguaa

SEQ ID NO: 4071184 - RNA, 14 nt, Vaccinia virus
auaggaucaucuau

SEQ ID NO: 4071185 - RNA, 21 nt, Vaccinia virus
auaggauuaaaaauaaaguua

SEQ ID NO: 4071186 - RNA, 23 nt, Vaccinia virus
auagguguaaaucuaggaauuac

SEQ ID NO: 4071187 - RNA, 22 nt, Vaccinia virus
auagguuacuagauuaaaaaug

SEQ ID NO: 4071188 - RNA, 20 nt, Vaccinia virus
auagguuuuuuaaaacagau

SEQ ID NO: 4071189 - RNA, 13 nt, Vaccinia virus
auaguaaaaucua

SEQ ID NO: 4071190 - RNA, 23 nt, Vaccinia virus
auaguaguacacagcauguuaua

SEQ ID NO: 4071191 - RNA, 24 nt, Vaccinia virus
auaguauacacgcuaaaauaacua

SEQ ID NO: 4071192 - RNA, 13 nt, Vaccinia virus
auaguaucaaacu

SEQ ID NO: 4071193 - RNA, 23 nt, Vaccinia virus
auagucagaauuuucauggaugu

SEQ ID NO: 4071194 - RNA, 16 nt, Vaccinia virus
auagucuccagaaauc

SEQ ID NO: 4071195 - RNA, 16 nt, Vaccinia virus
auagugaaacaaaaua

SEQ ID NO: 4071196 - RNA, 15 nt, Vaccinia virus
auaguggacaacauu

SEQ ID NO: 4071197 - RNA, 22 nt, Vaccinia virus
auaguuaccacgugcuguacca

SEQ ID NO: 4071198 - RNA, 22 nt, Vaccinia virus
auaguuagcgucaacuuucaua

SEQ ID NO: 4071199 - RNA, 20 nt, Vaccinia virus
auaguuaucuaucuuaaaaa

SEQ ID NO: 4071200 - RNA, 17 nt, Vaccinia virus
auaguuguuccuagaua

SEQ ID NO: 4071201 - RNA, 18 nt, Vaccinia virus
auaguuuuuuucauuacu

SEQ ID NO: 4071202 - RNA, 21 nt, Vaccinia virus
auauaacguaaccagaauugu

SEQ ID NO: 4071203 - RNA, 18 nt, Vaccinia virus
auauaacuaucaauauua

SEQ ID NO: 4071204 - RNA, 18 nt, Vaccinia virus
auauaauacuuaaaaaug

SEQ ID NO: 4071205 - RNA, 23 nt, Vaccinia virus
auauaauccgcauauuccauaua

SEQ ID NO: 4071206 - RNA, 21 nt, Vaccinia virus
auauacaacucuuuaauacga

SEQ ID NO: 4071207 - RNA, 17 nt, Vaccinia virus
auauacacauuuaauaa

SEQ ID NO: 4071208 - RNA, 16 nt, Vaccinia virus
auauacauuacugaau

SEQ ID NO: 4071209 - RNA, 20 nt, Vaccinia virus
auauaccuguuuuuauuuca

SEQ ID NO: 4071210 - RNA, 17 nt, Vaccinia virus
auauacguguacuguau

SEQ ID NO: 4071211 - RNA, 16 nt, Vaccinia virus
auauacguguuuaaaa

SEQ ID NO: 4071212 - RNA, 23 nt, Vaccinia virus
auauagaugcagaaguaaugaag

SEQ ID NO: 4071213 - RNA, 13 nt, Vaccinia virus
aaaugauuuugua

SEQ ID NO: 4071214 - RNA, 22 nt, Vaccinia virus
aaauggaagauauuuccauuua

SEQ ID NO: 4071215 - RNA, 22 nt, Vaccinia virus
aaauggauaauauccauauuga

SEQ ID NO: 4071216 - RNA, 15 nt, Vaccinia virus
aaauggauguuaaug

SEQ ID NO: 4071217 - RNA, 15 nt, Vaccinia virus
aaaugguauauuuua

SEQ ID NO: 4071218 - RNA, 14 nt, Vaccinia virus
aaaugguguaacuc

SEQ ID NO: 4071219 - RNA, 21 nt, Vaccinia virus
aaauguauuuuuuaugauaua

SEQ ID NO: 4071220 - RNA, 20 nt, Vaccinia virus
aaaugucuagcgauauuucu

SEQ ID NO: 4071221 - RNA, 22 nt, Vaccinia virus
aaauguuugauaaaaauaugua

SEQ ID NO: 4071222 - RNA, 14 nt, Vaccinia virus
aaauuaagauacaa

SEQ ID NO: 4071223 - RNA, 22 nt, Vaccinia virus
aaauuaauuuaccaucguguau

SEQ ID NO: 4071224 - RNA, 15 nt, Vaccinia virus
aaauuauaaugaaua

SEQ ID NO: 4071225 - RNA, 12 nt, Vaccinia virus
aaauuauauucu

SEQ ID NO: 4071226 - RNA, 18 nt, Vaccinia virus
aaauuaucaaauacuuca

SEQ ID NO: 4071227 - RNA, 15 nt, Vaccinia virus
aaauuaucaaauguu

SEQ ID NO: 4071228 - RNA, 20 nt, Vaccinia virus
aaauuaucuaucuacaucau

SEQ ID NO: 4071229 - RNA, 20 nt, Vaccinia virus
aaauuauuccuaauuaagaa

SEQ ID NO: 4071230 - RNA, 14 nt, Vaccinia virus
aaauuauucguuua

SEQ ID NO: 4071231 - RNA, 19 nt, Vaccinia virus
aaauucaguugcuggaauu

SEQ ID NO: 4071232 - RNA, 21 nt, Vaccinia virus
aaauuccaaauuuuuuucauu

SEQ ID NO: 4071233 - RNA, 18 nt, Vaccinia virus
aaauucggacuuggauuc

SEQ ID NO: 4071234 - RNA, 14 nt, Vaccinia virus
aaauucguaauaau

SEQ ID NO: 4071235 - RNA, 16 nt, Vaccinia virus
aaauucguuagcaaaa

SEQ ID NO: 4071236 - RNA, 18 nt, Vaccinia virus
aaauuguaagguuguaaa

SEQ ID NO: 4071237 - RNA, 21 nt, Vaccinia virus
aaauugucuagauaaaauacu

SEQ ID NO: 4071238 - RNA, 12 nt, Vaccinia virus
aaauugucuaua

SEQ ID NO: 4071239 - RNA, 21 nt, Vaccinia virus
aaauugucugaugaagaauua

SEQ ID NO: 4071240 - RNA, 14 nt, Vaccinia virus
aaauuguuaaauua

SEQ ID NO: 4071241 - RNA, 12 nt, Vaccinia virus
aaauuuagauua

SEQ ID NO: 4071242 - RNA, 14 nt, Vaccinia virus
aaauuugucauuua

SEQ ID NO: 4071243 - RNA, 21 nt, Vaccinia virus
aaauuuuaaagaguacacaau

SEQ ID NO: 4071244 - RNA, 13 nt, Vaccinia virus
aaauuuucauuca

SEQ ID NO: 4071245 - RNA, 22 nt, Vaccinia virus
aaauuuuuugagguaaucuucu

SEQ ID NO: 4071246 - RNA, 20 nt, Vaccinia virus
aaauuuuuuuuacaaacauc

SEQ ID NO: 4071247 - RNA, 20 nt, Vaccinia virus
aacaaaugcgccaaaguuau

SEQ ID NO: 4071248 - RNA, 22 nt, Vaccinia virus
aacaaaugcgccaaaguuauau

SEQ ID NO: 4071249 - RNA, 16 nt, Vaccinia virus
aacaacaccaugagau

SEQ ID NO: 4071250 - RNA, 17 nt, Vaccinia virus
aacaaccgcuuagaaau

SEQ ID NO: 4071251 - RNA, 19 nt, Vaccinia virus
aacaaggcgauuauaaagu

SEQ ID NO: 4071252 - RNA, 23 nt, Vaccinia virus
aacaagugauacguaagaauaua

SEQ ID NO: 4071253 - RNA, 16 nt, Vaccinia virus
aacaaguguguagaua

SEQ ID NO: 4071254 - RNA, 17 nt, Vaccinia virus
aacaaguuggaugauau

SEQ ID NO: 4071255 - RNA, 15 nt, Vaccinia virus
aacaauaguuauuac

SEQ ID NO: 4071256 - RNA, 17 nt, Vaccinia virus
aacaauauauacgagua

SEQ ID NO: 4071257 - RNA, 16 nt, Vaccinia virus
aacaaucaacuaaugu

SEQ ID NO: 4071258 - RNA, 13 nt, Vaccinia virus
aacaaucaagaag

SEQ ID NO: 4071259 - RNA, 14 nt, Vaccinia virus
aacaaugaaguuau

SEQ ID NO: 4071260 - RNA, 14 nt, Vaccinia virus
aacaauuguagaua

SEQ ID NO: 4071261 - RNA, 22 nt, Vaccinia virus
aacacaaauaguaauacaugua

SEQ ID NO: 4071262 - RNA, 12 nt, Vaccinia virus
aacacaaccaaa

SEQ ID NO: 4071263 - RNA, 16 nt, Vaccinia virus
aacaccacgaacaugu

SEQ ID NO: 4071264 - RNA, 16 nt, Vaccinia virus
aacacgauaggucaga

SEQ ID NO: 4071265 - RNA, 22 nt, Vaccinia virus
aacacuaaaaaauaaacacaua

SEQ ID NO: 4071266 - RNA, 13 nt, Vaccinia virus
aacacuauuagaa

SEQ ID NO: 4071267 - RNA, 17 nt, Vaccinia virus
aacacucgacacaauau

SEQ ID NO: 4071268 - RNA, 15 nt, Vaccinia virus
aacacucuuucugaa

SEQ ID NO: 4071269 - RNA, 19 nt, Vaccinia virus
aacacuuuggauacaaaau

SEQ ID NO: 4071270 - RNA, 15 nt, Vaccinia virus
aacagaaaaaacaau

SEQ ID NO: 4071271 - RNA, 20 nt, Vaccinia virus
aacagaugguagaacaaugu

SEQ ID NO: 4071272 - RNA, 15 nt, Vaccinia virus
aacaggaaagaagua

SEQ ID NO: 4071273 - RNA, 23 nt, Vaccinia virus
aacagugagaggaucgacuccau

SEQ ID NO: 4071274 - RNA, 15 nt, Vaccinia virus
aacagugaguuuauc

SEQ ID NO: 4071275 - RNA, 13 nt, Vaccinia virus
aacauaaaaauau

SEQ ID NO: 4071276 - RNA, 21 nt, Vaccinia virus
aacauaauuacgacgagcaua

SEQ ID NO: 4071277 - RNA, 17 nt, Vaccinia virus
aacauaauuuucuaaua

SEQ ID NO: 4071278 - RNA, 22 nt, Vaccinia virus
aacauacuauuguuuauuaucu

SEQ ID NO: 4071279 - RNA, 17 nt, Vaccinia virus
aacauauaauuauaaga

SEQ ID NO: 4071280 - RNA, 19 nt, Vaccinia virus
aacauauucuaugaauuua

SEQ ID NO: 4071281 - RNA, 15 nt, Vaccinia virus
aacaucagaaaaugu

SEQ ID NO: 4071282 - RNA, 15 nt, Vaccinia virus
aacaucuaacuauau

SEQ ID NO: 4071283 - RNA, 16 nt, Vaccinia virus
aacaucucucauaaga

SEQ ID NO: 4071284 - RNA, 15 nt, Vaccinia virus
aacaucuuaaaaauu

SEQ ID NO: 4071285 - RNA, 20 nt, Vaccinia virus
aacaucuugauacuuuuucu

SEQ ID NO: 4071286 - RNA, 21 nt, Vaccinia virus
aacaucuuuguaaacagauau

SEQ ID NO: 4071287 - RNA, 19 nt, Vaccinia virus
aacaugaauuuauuucuaa

SEQ ID NO: 4071288 - RNA, 14 nt, Vaccinia virus
aacauguagauuua

SEQ ID NO: 4071289 - RNA, 17 nt, Vaccinia virus
aacaugucuucuauucu

SEQ ID NO: 4071290 - RNA, 13 nt, Vaccinia virus
aacauguuaaaau

SEQ ID NO: 4071291 - RNA, 18 nt, Vaccinia virus
aacauuaaccguuucauc

SEQ ID NO: 4071292 - RNA, 21 nt, Vaccinia virus
aacauuauaauaaucaauaau

SEQ ID NO: 4071293 - RNA, 16 nt, Vaccinia virus
aacauuuccuacuacu

SEQ ID NO: 4071294 - RNA, 17 nt, Vaccinia virus
aacauuuuauuucuaga

SEQ ID NO: 4071295 - RNA, 20 nt, Vaccinia virus
aacauuuugcagaaaaaagu

SEQ ID NO: 4071296 - RNA, 16 nt, Vaccinia virus
aaccaccgaugaugcg

SEQ ID NO: 4071297 - RNA, 15 nt, Vaccinia virus
aaccagaaguuuuau

SEQ ID NO: 4071298 - RNA, 22 nt, Vaccinia virus
aaccaguaucucuuaacgaugu

SEQ ID NO: 4071299 - RNA, 21 nt, Vaccinia virus
aaccauccguuaucgaagaau

SEQ ID NO: 4071300 - RNA, 14 nt, Vaccinia virus
aaccuagaaaauau

SEQ ID NO: 4071301 - RNA, 16 nt, Vaccinia virus
aaccugaucuggaaaa

SEQ ID NO: 4071302 - RNA, 18 nt, Vaccinia virus
aaccugauuauauagaua

SEQ ID NO: 4071303 - RNA, 16 nt, Vaccinia virus
aacgaaaaauuaucgu

SEQ ID NO: 4071304 - RNA, 14 nt, Vaccinia virus
aacgaaauuauacu

SEQ ID NO: 4071305 - RNA, 20 nt, Vaccinia virus
aacgaacgaggugugaaugu

SEQ ID NO: 4071306 - RNA, 15 nt, Vaccinia virus
aacgaauaaacaauu

SEQ ID NO: 4071307 - RNA, 13 nt, Vaccinia virus
aacgaauuaucgu

SEQ ID NO: 4071308 - RNA, 18 nt, Vaccinia virus
aacgacguagauaguaau

SEQ ID NO: 4071309 - RNA, 18 nt, Vaccinia virus
aacgauaacacaaaaugu

SEQ ID NO: 4071310 - RNA, 22 nt, Vaccinia virus
uuaguucaaucuacgaauguau

SEQ ID NO: 4071311 - RNA, 18 nt, Vaccinia virus
uuaguuuuuuucucucaa

SEQ ID NO: 4071312 - RNA, 20 nt, Vaccinia virus
uuauaaaaaaaucauuucga

SEQ ID NO: 4071313 - RNA, 19 nt, Vaccinia virus
uuauaaacggguguaaaca

SEQ ID NO: 4071314 - RNA, 22 nt, Vaccinia virus
uuauaaagaccgaauacauaac

SEQ ID NO: 4071315 - RNA, 18 nt, Vaccinia virus
uuauaaaguuuagucucu

SEQ ID NO: 4071316 - RNA, 15 nt, Vaccinia virus
uuauaacucuagaau

SEQ ID NO: 4071317 - RNA, 21 nt, Vaccinia virus
uuauaauagguguaaaucuag

SEQ ID NO: 4071318 - RNA, 18 nt, Vaccinia virus
uuauaaugaauauuauua

SEQ ID NO: 4071319 - RNA, 14 nt, Vaccinia virus
uuauacacugguua

SEQ ID NO: 4071320 - RNA, 18 nt, Vaccinia virus
uuauacagaguauguaaa

SEQ ID NO: 4071321 - RNA, 17 nt, Vaccinia virus
uuauacauccuguucua

SEQ ID NO: 4071322 - RNA, 23 nt, Vaccinia virus
uuauacgaauaucguucucuaaa

SEQ ID NO: 4071323 - RNA, 20 nt, Vaccinia virus
uuauacgcauaaauuguaaa

SEQ ID NO: 4071324 - RNA, 21 nt, Vaccinia virus
uuauacggcuacaauuucaua

SEQ ID NO: 4071325 - RNA, 16 nt, Vaccinia virus
uuauacuauuacuauu

SEQ ID NO: 4071326 - RNA, 16 nt, Vaccinia virus
uuauaguuaacauuuu

SEQ ID NO: 4071327 - RNA, 13 nt, Vaccinia virus
uuauauaauguau

SEQ ID NO: 4071328 - RNA, 15 nt, Vaccinia virus
uuauauaauuuuugg

SEQ ID NO: 4071329 - RNA, 19 nt, Vaccinia virus
aaaauuuauaacauugucc

SEQ ID NO: 4071330 - RNA, 20 nt, Vaccinia virus
aaaauuuuuuagauguagua

SEQ ID NO: 4071331 - RNA, 12 nt, Vaccinia virus
aaacaaaaaacu

SEQ ID NO: 4071332 - RNA, 16 nt, Vaccinia virus
aaacaaaauuagaaag

SEQ ID NO: 4071333 - RNA, 18 nt, Vaccinia virus
aaacaaguuuucauauua

SEQ ID NO: 4071334 - RNA, 13 nt, Vaccinia virus
aaacaauguuaug

SEQ ID NO: 4071335 - RNA, 14 nt, Vaccinia virus
aaacauaaaaaaca

SEQ ID NO: 4071336 - RNA, 14 nt, Vaccinia virus
aaacauaaaauaac

SEQ ID NO: 4071337 - RNA, 13 nt, Vaccinia virus
aaacauaugccau

SEQ ID NO: 4071338 - RNA, 13 nt, Vaccinia virus
aaacaugugguau

SEQ ID NO: 4071339 - RNA, 12 nt, Vaccinia virus
aaacauuacaaa

SEQ ID NO: 4071340 - RNA, 21 nt, Vaccinia virus
aaacauugacggauaaaacaa

SEQ ID NO: 4071341 - RNA, 19 nt, Vaccinia virus
aaacauuguucaugauaua

SEQ ID NO: 4071342 - RNA, 22 nt, Vaccinia virus
aaacauuuuauauacuuuucua

SEQ ID NO: 4071343 - RNA, 11 nt, Vaccinia virus
aaaccaaaucu

SEQ ID NO: 4071344 - RNA, 14 nt, Vaccinia virus
aaaccaaaucuuga

SEQ ID NO: 4071345 - RNA, 21 nt, Vaccinia virus
aaaccaaggacuuuguagaaa

SEQ ID NO: 4071346 - RNA, 22 nt, Vaccinia virus
aaaccauguugugaaagaguuu

SEQ ID NO: 4071347 - RNA, 23 nt, Vaccinia virus
aaaccuuugacuaguuguagaau

SEQ ID NO: 4071348 - RNA, 14 nt, Vaccinia virus
aaacgaaagacugu

SEQ ID NO: 4071349 - RNA, 13 nt, Vaccinia virus
aaacgaacuauau

SEQ ID NO: 4071350 - RNA, 18 nt, Vaccinia virus
aaacgauuauuucugaau

SEQ ID NO: 4071351 - RNA, 19 nt, Vaccinia virus
aaacgauuuaauuacagag

SEQ ID NO: 4071352 - RNA, 20 nt, Vaccinia virus
aaacgcguuaguaaaacaug

SEQ ID NO: 4071353 - RNA, 19 nt, Vaccinia virus
aaacgcuauaaaaaacaua

SEQ ID NO: 4071354 - RNA, 18 nt, Vaccinia virus
aaacgcucuacgaauauc

SEQ ID NO: 4071355 - RNA, 17 nt, Vaccinia virus
aaacgucguauguagaa

SEQ ID NO: 4071356 - RNA, 19 nt, Vaccinia virus
aaacguuuggaaacuauac

SEQ ID NO: 4071357 - RNA, 14 nt, Vaccinia virus
aaacuaaacuuauu

SEQ ID NO: 4071358 - RNA, 15 nt, Vaccinia virus
aaacuaauucauuuu

SEQ ID NO: 4071359 - RNA, 14 nt, Vaccinia virus
aaacuaauucuguc

SEQ ID NO: 4071360 - RNA, 20 nt, Vaccinia virus
aaacuagagaaacuuaguac

SEQ ID NO: 4071361 - RNA, 12 nt, Vaccinia virus
aaacuaguagaa

SEQ ID NO: 4071362 - RNA, 21 nt, Vaccinia virus
aaacuaucuuuuuaggaaugu

SEQ ID NO: 4071363 - RNA, 20 nt, Vaccinia virus
aaacucuguuguauaucuac

SEQ ID NO: 4071364 - RNA, 12 nt, Vaccinia virus
aaacugaauaua

SEQ ID NO: 4071365 - RNA, 20 nt, Vaccinia virus
aaacugaaucuaacaaagag

SEQ ID NO: 4071366 - RNA, 14 nt, Vaccinia virus
aaacugguaaucca

SEQ ID NO: 4071367 - RNA, 24 nt, Vaccinia virus
aaacugguaauccacauaguugua

SEQ ID NO: 4071368 - RNA, 18 nt, Vaccinia virus
aaacugguuaaaacagua

SEQ ID NO: 4071369 - RNA, 16 nt, Vaccinia virus
aaacuguuuaagaaaa

SEQ ID NO: 4071370 - RNA, 19 nt, Vaccinia virus
aaacuuaaucuuauuagaa

SEQ ID NO: 4071371 - RNA, 20 nt, Vaccinia virus
aaacuuauacauccuguucu

SEQ ID NO: 4071372 - RNA, 19 nt, Vaccinia virus
aaacuucguaaaauauucu

SEQ ID NO: 4071373 - RNA, 14 nt, Vaccinia virus
aaacuuuaauaaca

SEQ ID NO: 4071374 - RNA, 17 nt, Vaccinia virus
aaagaaaauaucuauau

SEQ ID NO: 4071375 - RNA, 15 nt, Vaccinia virus
aaagaaaauauggaa

SEQ ID NO: 4071376 - RNA, 18 nt, Vaccinia virus
aaagaaacugucaucuau

SEQ ID NO: 4071377 - RNA, 21 nt, Vaccinia virus
aaagaagaagaucauacaguc

SEQ ID NO: 4071378 - RNA, 14 nt, Vaccinia virus
aaagaaguauacua

SEQ ID NO: 4071379 - RNA, 16 nt, Vaccinia virus
aaagaaguuguaucau

SEQ ID NO: 4071380 - RNA, 16 nt, Vaccinia virus
aaagacuaugcaaaga

SEQ ID NO: 4071381 - RNA, 16 nt, Vaccinia virus
aaagagaauuauauau

SEQ ID NO: 4071382 - RNA, 18 nt, Vaccinia virus
aaagauaauacauuuucu

SEQ ID NO: 4071383 - RNA, 12 nt, Vaccinia virus
aaagauguuauu

SEQ ID NO: 4071384 - RNA, 16 nt, Vaccinia virus
aaagauuaauuauccg

SEQ ID NO: 4071385 - RNA, 22 nt, Vaccinia virus
aaagauucuauaauaaugaaug

SEQ ID NO: 4071386 - RNA, 13 nt, Vaccinia virus
aaagcaaaauggu

SEQ ID NO: 4071387 - RNA, 19 nt, Vaccinia virus
aaagcaagaccaaacaccg

SEQ ID NO: 4071388 - RNA, 16 nt, Vaccinia virus
aaagcaauuauuacaa

SEQ ID NO: 4071389 - RNA, 16 nt, Vaccinia virus
aaagcaucacagaauc

SEQ ID NO: 4071390 - RNA, 22 nt, Vaccinia virus
aaagcggauauaccuagcaaac

SEQ ID NO: 4071391 - RNA, 19 nt, Vaccinia virus
aaaggauacuaaacauugu

SEQ ID NO: 4071392 - RNA, 13 nt, Vaccinia virus
aaaggauauuaug

SEQ ID NO: 4071393 - RNA, 16 nt, Vaccinia virus
aaagggauaacauguu

SEQ ID NO: 4071394 - RNA, 18 nt, Vaccinia virus
aaagggauauauauugua

SEQ ID NO: 4071395 - RNA, 15 nt, Vaccinia virus
aaagguauacgaaug

SEQ ID NO: 4071396 - RNA, 14 nt, Vaccinia virus
aaaguaauaaucuu

SEQ ID NO: 4071397 - RNA, 14 nt, Vaccinia virus
aaaguaauucauua

SEQ ID NO: 4071398 - RNA, 22 nt, Vaccinia virus
aaaguaguucaacauaauauua

SEQ ID NO: 4071399 - RNA, 13 nt, Vaccinia virus
aaagucaucucuu

SEQ ID NO: 4071400 - RNA, 23 nt, Vaccinia virus
aaagucguuuauaucacauugua

SEQ ID NO: 4071401 - RNA, 22 nt, Vaccinia virus
aaagugaucacgaguuuguaaa

SEQ ID NO: 4071402 - RNA, 12 nt, Vaccinia virus
aaaguuaaaagu

SEQ ID NO: 4071403 - RNA, 14 nt, Vaccinia virus
aaaguuaagaucug

SEQ ID NO: 4071404 - RNA, 23 nt, Vaccinia virus
aaaguuaauauuuucuaugagcu

SEQ ID NO: 4071405 - RNA, 16 nt, Vaccinia virus
aaaguuaaucauauag

SEQ ID NO: 4071406 - RNA, 23 nt, Vaccinia virus
aaaguuuuuccaauuauauggua

SEQ ID NO: 4071407 - RNA, 22 nt, Vaccinia virus
aaauaaaacagggauucguuua

SEQ ID NO: 4071408 - RNA, 22 nt, Vaccinia virus
aaauaaaauauaaaauauugga

SEQ ID NO: 4071409 - RNA, 20 nt, Vaccinia virus
aaauaacauauagauuuuau

SEQ ID NO: 4071410 - RNA, 12 nt, Vaccinia virus
aaauaacauuua

SEQ ID NO: 4071411 - RNA, 21 nt, Vaccinia virus
aaauaacgucuucuauguauu

SEQ ID NO: 4071412 - RNA, 20 nt, Vaccinia virus
aaauaaguaguaauaaugau

SEQ ID NO: 4071413 - RNA, 19 nt, Vaccinia virus
aaauaauacgaauauauca

SEQ ID NO: 4071414 - RNA, 22 nt, Vaccinia virus
aaauaauagggauaaaguucau

SEQ ID NO: 4071415 - RNA, 21 nt, Vaccinia virus
aaauaauagguuguaauauca

SEQ ID NO: 4071416 - RNA, 16 nt, Vaccinia virus
aaauacaccaaauaua

SEQ ID NO: 4071417 - RNA, 20 nt, Vaccinia virus
aaauacauaugacaaacauu

SEQ ID NO: 4071418 - RNA, 17 nt, Vaccinia virus
aaauaccauaaauauau

SEQ ID NO: 4071419 - RNA, 18 nt, Vaccinia virus
aaauaccuuuaacuauau

SEQ ID NO: 4071420 - RNA, 19 nt, Vaccinia virus
aaauacguucuauugugua

SEQ ID NO: 4071421 - RNA, 16 nt, Vaccinia virus
aaauagauagaaucua

SEQ ID NO: 4071422 - RNA, 12 nt, Vaccinia virus
aaauagauguua

SEQ ID NO: 4071423 - RNA, 18 nt, Vaccinia virus
aaauaggaucaucuauca

SEQ ID NO: 4071424 - RNA, 14 nt, Vaccinia virus
aaauagggauguuu

SEQ ID NO: 4071425 - RNA, 21 nt, Vaccinia virus
aaauauaaaacuugucuguau

SEQ ID NO: 4071426 - RNA, 15 nt, Vaccinia virus
aaauauaauaacgau

SEQ ID NO: 4071427 - RNA, 15 nt, Vaccinia virus
aaauauacagcaaug

SEQ ID NO: 4071428 - RNA, 22 nt, Vaccinia virus
aaauauaguagaauuucauuuu

SEQ ID NO: 4071429 - RNA, 18 nt, Vaccinia virus
aaauauaugcucauauau

SEQ ID NO: 4071430 - RNA, 21 nt, Vaccinia virus
aaauauauuaauccacuauau

SEQ ID NO: 4071431 - RNA, 15 nt, Vaccinia virus
aaauaucaauuauau

SEQ ID NO: 4071432 - RNA, 14 nt, Vaccinia virus
aaauauguaauaau

SEQ ID NO: 4071433 - RNA, 13 nt, Vaccinia virus
aaauauguagaaa

SEQ ID NO: 4071434 - RNA, 13 nt, Vaccinia virus
aaaauauuuuacu

SEQ ID NO: 4071435 - RNA, 19 nt, Vaccinia virus
aaaaucaggguuaucaaag

SEQ ID NO: 4071436 - RNA, 22 nt, Vaccinia virus
aaaaucuucaagagugcauuga

SEQ ID NO: 4071437 - RNA, 15 nt, Vaccinia virus
aaaaugauagaaaua

SEQ ID NO: 4071438 - RNA, 23 nt, Vaccinia virus
aaaaugcccaacaggaucauuug

SEQ ID NO: 4071439 - RNA, 15 nt, Vaccinia virus
aaaaugcuaauauua

SEQ ID NO: 4071440 - RNA, 17 nt, Vaccinia virus
aaaaugguaaacuuuug

SEQ ID NO: 4071441 - RNA, 20 nt, Vaccinia virus
aaaauguucuuaauagucua

SEQ ID NO: 4071442 - RNA, 13 nt, Vaccinia virus
aaaauuaguagaa

SEQ ID NO: 4071443 - RNA, 16 nt, Vaccinia virus
aaaauuaguagaauca

SEQ ID NO: 4071444 - RNA, 18 nt, Vaccinia virus
aaaauuauugauauguau

SEQ ID NO: 4071445 - RNA, 16 nt, Vaccinia virus
aaaauucguuagaaua

SEQ ID NO: 4071446 - RNA, 15 nt, Vaccinia virus
aaaauugauggauga

SEQ ID NO: 4071447 - RNA, 12 nt, Vaccinia virus
aauucuuucuca

SEQ ID NO: 4071448 - RNA, 22 nt, Vaccinia virus
aauugaacaaaguauucuuaug

SEQ ID NO: 4071449 - RNA, 16 nt, Vaccinia virus
aauugaaucuuaguaa

SEQ ID NO: 4071450 - RNA, 15 nt, Vaccinia virus
aauugaauugaugau

SEQ ID NO: 4071451 - RNA, 16 nt, Vaccinia virus
aauugauaauauaaau

SEQ ID NO: 4071452 - RNA, 14 nt, Vaccinia virus
aauugauucuauga

SEQ ID NO: 4071453 - RNA, 22 nt, Vaccinia virus
aauugauucuuauucacuauau

SEQ ID NO: 4071454 - RNA, 15 nt, Vaccinia virus
aauugcaguaucuau

SEQ ID NO: 4071455 - RNA, 15 nt, Vaccinia virus
aauugcgaauguuuu

SEQ ID NO: 4071456 - RNA, 19 nt, Vaccinia virus
aauuguauuauugauacaa

SEQ ID NO: 4071457 - RNA, 15 nt, Vaccinia virus
aauuguuguauuuau

SEQ ID NO: 4071458 - RNA, 19 nt, Vaccinia virus
aauuguuuacuguauauac

SEQ ID NO: 4071459 - RNA, 15 nt, Vaccinia virus
aauuguuugagauau

SEQ ID NO: 4071460 - RNA, 13 nt, Vaccinia virus
aauuuaaaauaua

SEQ ID NO: 4071461 - RNA, 14 nt, Vaccinia virus
aauuuaaagaaugu

SEQ ID NO: 4071462 - RNA, 17 nt, Vaccinia virus
aauuuaugaagauguua

SEQ ID NO: 4071463 - RNA, 18 nt, Vaccinia virus
aauuuauuaauacaggau

SEQ ID NO: 4071464 - RNA, 12 nt, Vaccinia virus
aauuuauuucuu

SEQ ID NO: 4071465 - RNA, 18 nt, Vaccinia virus
aauuuauuugauaaagga

SEQ ID NO: 4071466 - RNA, 15 nt, Vaccinia virus
aauuucauuuuguuu

SEQ ID NO: 4071467 - RNA, 23 nt, Vaccinia virus
aauuucucucaucuguaggauau

SEQ ID NO: 4071468 - RNA, 11 nt, Vaccinia virus
aauuuguacau

SEQ ID NO: 4071469 - RNA, 13 nt, Vaccinia virus
aauuuguuaaaaa

SEQ ID NO: 4071470 - RNA, 15 nt, Vaccinia virus
aauuuguucaaaaua

SEQ ID NO: 4071471 - RNA, 17 nt, Vaccinia virus
aauuuuaagaaauggug

SEQ ID NO: 4071472 - RNA, 20 nt, Vaccinia virus
aauuuucacaaguaugaaga

SEQ ID NO: 4071473 - RNA, 14 nt, Vaccinia virus
aauuuugaagcauu

SEQ ID NO: 4071474 - RNA, 12 nt, Vaccinia virus
aauuuuuagagg

SEQ ID NO: 4071475 - RNA, 15 nt, Vaccinia virus
aauuuuuaguuuaua

SEQ ID NO: 4071476 - RNA, 16 nt, Vaccinia virus
aauuuuuguuuccguu

SEQ ID NO: 4071477 - RNA, 18 nt, Vaccinia virus
aauuuuuucuacagauau

SEQ ID NO: 4071478 - RNA, 13 nt, Vaccinia virus
acaaaaaaguuau

SEQ ID NO: 4071479 - RNA, 15 nt, Vaccinia virus
acaaaaauacauaaa

SEQ ID NO: 4071480 - RNA, 21 nt, Vaccinia virus
acaaaaauugucacuuuguua

SEQ ID NO: 4071481 - RNA, 13 nt, Vaccinia virus
acaaaagugaaua

SEQ ID NO: 4071482 - RNA, 13 nt, Vaccinia virus
acaaaauacauaa

SEQ ID NO: 4071483 - RNA, 14 nt, Vaccinia virus
acaaaauacauaau

SEQ ID NO: 4071484 - RNA, 19 nt, Vaccinia virus
acaaaaucaacuacauaau

SEQ ID NO: 4071485 - RNA, 20 nt, Vaccinia virus
acaaaaucaucugauaauuu

SEQ ID NO: 4071486 - RNA, 15 nt, Vaccinia virus
acaaaaucuaaacaa

SEQ ID NO: 4071487 - RNA, 21 nt, Vaccinia virus
acaaaauucaaggaaagaaua

SEQ ID NO: 4071488 - RNA, 17 nt, Vaccinia virus
acaaaauucagauucua

SEQ ID NO: 4071489 - RNA, 20 nt, Vaccinia virus
acaaacaagcaucaugaaua

SEQ ID NO: 4071490 - RNA, 18 nt, Vaccinia virus
acaaacgcuacuauauau

SEQ ID NO: 4071491 - RNA, 13 nt, Vaccinia virus
acaaacuauacaa

SEQ ID NO: 4071492 - RNA, 22 nt, Vaccinia virus
acaaacuguucucuuaugaauc

SEQ ID NO: 4071493 - RNA, 17 nt, Vaccinia virus
acaaagauaaaaaccac

SEQ ID NO: 4071494 - RNA, 18 nt, Vaccinia virus
acaaagauggucuaaaau

SEQ ID NO: 4071495 - RNA, 18 nt, Vaccinia virus
acaaagcacucaauaaau

SEQ ID NO: 4071496 - RNA, 17 nt, Vaccinia virus
acaaauaguaaaugaga

SEQ ID NO: 4071497 - RNA, 16 nt, Vaccinia virus
acaaauaguaauacau

SEQ ID NO: 4071498 - RNA, 18 nt, Vaccinia virus
acaaaucuauuuggauuu

SEQ ID NO: 4071499 - RNA, 14 nt, Vaccinia virus
acaaaucuggaaaa

SEQ ID NO: 4071500 - RNA, 17 nt, Vaccinia virus
acaaauggucaaugaua

SEQ ID NO: 4071501 - RNA, 19 nt, Vaccinia virus
acaaauuaaacucuggaau

SEQ ID NO: 4071502 - RNA, 19 nt, Vaccinia virus
acaaauucuauauauguuu

SEQ ID NO: 4071503 - RNA, 14 nt, Vaccinia virus
acaacaaaauaaua

SEQ ID NO: 4071504 - RNA, 21 nt, Vaccinia virus
acaacaacgaaccaaaaugaa

SEQ ID NO: 4071505 - RNA, 18 nt, Vaccinia virus
acaacaaugucucgaaau

SEQ ID NO: 4071506 - RNA, 22 nt, Vaccinia virus
acaacaccuaugauaaaggaga

SEQ ID NO: 4071507 - RNA, 18 nt, Vaccinia virus
acaacaggaugaauccau

SEQ ID NO: 4071508 - RNA, 16 nt, Vaccinia virus
acaacauuccaaagau

SEQ ID NO: 4071509 - RNA, 18 nt, Vaccinia virus
acaaccgcuuagaaauaa

SEQ ID NO: 4071510 - RNA, 16 nt, Vaccinia virus
acaaccucauacuacu

SEQ ID NO: 4071511 - RNA, 16 nt, Vaccinia virus
uauaagauuguagaau

SEQ ID NO: 4071512 - RNA, 14 nt, Vaccinia virus
uauaaguagauguu

SEQ ID NO: 4071513 - RNA, 19 nt, Vaccinia virus
uauaauaaacuuuaaugau

SEQ ID NO: 4071514 - RNA, 15 nt, Vaccinia virus
uauaauaaauacuuu

SEQ ID NO: 4071515 - RNA, 20 nt, Vaccinia virus
uauaauacggacuucauaau

SEQ ID NO: 4071516 - RNA, 12 nt, Vaccinia virus
uauaauauccuc

SEQ ID NO: 4071517 - RNA, 16 nt, Vaccinia virus
uauaaucugaugaaca

SEQ ID NO: 4071518 - RNA, 18 nt, Vaccinia virus
uauaaucugaugaacaau

SEQ ID NO: 4071519 - RNA, 22 nt, Vaccinia virus
uauaaucuuuuucaucuuguga

SEQ ID NO: 4071520 - RNA, 12 nt, Vaccinia virus
uauaauguuucc

SEQ ID NO: 4071521 - RNA, 13 nt, Vaccinia virus
uauaauguuuccu

SEQ ID NO: 4071522 - RNA, 18 nt, Vaccinia virus
uauaauuauauguagaag

SEQ ID NO: 4071523 - RNA, 15 nt, Vaccinia virus
uauaauucuuuggua

SEQ ID NO: 4071524 - RNA, 21 nt, Vaccinia virus
uauaauuuacagcuauagcau

SEQ ID NO: 4071525 - RNA, 15 nt, Vaccinia virus
uauaauuuuuggaca

SEQ ID NO: 4071526 - RNA, 20 nt, Vaccinia virus
uauacaaugaacuaauauga

SEQ ID NO: 4071527 - RNA, 16 nt, Vaccinia virus
uauacaauuguuugua

SEQ ID NO: 4071528 - RNA, 20 nt, Vaccinia virus
uauacacguuagauuauucu

SEQ ID NO: 4071529 - RNA, 23 nt, Vaccinia virus
uauacagugaacacacaauaagc

SEQ ID NO: 4071530 - RNA, 22 nt, Vaccinia virus
uauacauguuagagaauauuca

SEQ ID NO: 4071531 - RNA, 17 nt, Vaccinia virus
uauaccaauauuauucu

SEQ ID NO: 4071532 - RNA, 17 nt, Vaccinia virus
uauaccugccuagaaau

SEQ ID NO: 4071533 - RNA, 19 nt, Vaccinia virus
uauacgaaauaaauauuca

SEQ ID NO: 4071534 - RNA, 16 nt, Vaccinia virus
uauacguacuuaacau

SEQ ID NO: 4071535 - RNA, 15 nt, Vaccinia virus
uauacuaucgaugau

SEQ ID NO: 4071536 - RNA, 18 nt, Vaccinia virus
uauacuccucauuaacau

SEQ ID NO: 4071537 - RNA, 16 nt, Vaccinia virus
uauacucuuauuauca

SEQ ID NO: 4071538 - RNA, 13 nt, Vaccinia virus
uauacuucuccaa

SEQ ID NO: 4071539 - RNA, 23 nt, Vaccinia virus
uauagauaaagaguccuauauau

SEQ ID NO: 4071540 - RNA, 17 nt, Vaccinia virus
uauagaucaaacaacac

SEQ ID NO: 4071541 - RNA, 20 nt, Vaccinia virus
gaaguuuaauaauacaauau

SEQ ID NO: 4071542 - RNA, 19 nt, Vaccinia virus
gaaguuuuaaaaauacuua

SEQ ID NO: 4071543 - RNA, 21 nt, Vaccinia virus
gaauaaggaauauacuaauca

SEQ ID NO: 4071544 - RNA, 13 nt, Vaccinia virus
gaauaaguuuauu

SEQ ID NO: 4071545 - RNA, 16 nt, Vaccinia virus
gaauaaucguuauuau

SEQ ID NO: 4071546 - RNA, 18 nt, Vaccinia virus
gaauaauuggaacacaag

SEQ ID NO: 4071547 - RNA, 14 nt, Vaccinia virus
gaauagauaauaau

SEQ ID NO: 4071548 - RNA, 22 nt, Vaccinia virus
gaauagucucuguaaucacugc

SEQ ID NO: 4071549 - RNA, 19 nt, Vaccinia virus
gaauaguuuguuuuggaaa

SEQ ID NO: 4071550 - RNA, 18 nt, Vaccinia virus
gaauauaaaaaauuuaua

SEQ ID NO: 4071551 - RNA, 20 nt, Vaccinia virus
gaauauacaaaguuaguaca

SEQ ID NO: 4071552 - RNA, 19 nt, Vaccinia virus
gaauauacuucauaaaaga

SEQ ID NO: 4071553 - RNA, 20 nt, Vaccinia virus
gaauauacuucauaaaagaa

SEQ ID NO: 4071554 - RNA, 18 nt, Vaccinia virus
gaauauagaaauaaugau

SEQ ID NO: 4071555 - RNA, 15 nt, Vaccinia virus
gaauauauguuuaua

SEQ ID NO: 4071556 - RNA, 18 nt, Vaccinia virus
gaauaucauuaacgauau

SEQ ID NO: 4071557 - RNA, 17 nt, Vaccinia virus
gaauauguuauaaauuu

SEQ ID NO: 4071558 - RNA, 12 nt, Vaccinia virus
gaauauugauuu

SEQ ID NO: 4071559 - RNA, 18 nt, Vaccinia virus
gaauauugauuuacuaaa

SEQ ID NO: 4071560 - RNA, 22 nt, Vaccinia virus
gaauauuuaauuuggucauuau

SEQ ID NO: 4071561 - RNA, 18 nt, Vaccinia virus
gaauauuucgauaaugaa

SEQ ID NO: 4071562 - RNA, 19 nt, Vaccinia virus
gaauauuucgauaaugaac

SEQ ID NO: 4071563 - RNA, 13 nt, Vaccinia virus
gaaucaguauaua

SEQ ID NO: 4071564 - RNA, 15 nt, Vaccinia virus
gaauccgugauuuug

SEQ ID NO: 4071565 - RNA, 16 nt, Vaccinia virus
gaaucgauaacucuau

SEQ ID NO: 4071566 - RNA, 13 nt, Vaccinia virus
gaaucguauauau

SEQ ID NO: 4071567 - RNA, 15 nt, Vaccinia virus
gaaucuaaugaugac

SEQ ID NO: 4071568 - RNA, 19 nt, Vaccinia virus
gaaucuagauuccaaucau

SEQ ID NO: 4071569 - RNA, 13 nt, Vaccinia virus
gaaucuucccaua

SEQ ID NO: 4071570 - RNA, 14 nt, Vaccinia virus
gaaugaauaugaau

SEQ ID NO: 4071571 - RNA, 16 nt, Vaccinia virus
gaaugacgaauccugu

SEQ ID NO: 4071572 - RNA, 21 nt, Vaccinia virus
gaaugcucggcaauaacuaau

SEQ ID NO: 4071573 - RNA, 18 nt, Vaccinia virus
gaauggcguuugauauau

SEQ ID NO: 4071574 - RNA, 15 nt, Vaccinia virus
gaauguaucaagaau

SEQ ID NO: 4071575 - RNA, 15 nt, Vaccinia virus
gaauguguacuaucu

SEQ ID NO: 4071576 - RNA, 17 nt, Vaccinia virus
gaauguuuuacucugga

SEQ ID NO: 4071577 - RNA, 12 nt, Vaccinia virus
gaauuaauacau

SEQ ID NO: 4071578 - RNA, 17 nt, Vaccinia virus
gaauuaauguaaucauu

SEQ ID NO: 4071579 - RNA, 16 nt, Vaccinia virus
gaauuacauagaugau

SEQ ID NO: 4071580 - RNA, 20 nt, Vaccinia virus
gaauuagucgucgaauauau

SEQ ID NO: 4071581 - RNA, 23 nt, Vaccinia virus
gaauuauaccgauagauaauggu

SEQ ID NO: 4071582 - RNA, 19 nt, Vaccinia virus
gaauuauuauuaauuauau

SEQ ID NO: 4071583 - RNA, 16 nt, Vaccinia virus
gaauuauuuacaaaau

SEQ ID NO: 4071584 - RNA, 17 nt, Vaccinia virus
gaauucgaggaagaugu

SEQ ID NO: 4071585 - RNA, 21 nt, Vaccinia virus
gaauucuuuuucgacuuuuug

SEQ ID NO: 4071586 - RNA, 19 nt, Vaccinia virus
gaauuggaauaccaaauau

SEQ ID NO: 4071587 - RNA, 15 nt, Vaccinia virus
gaauuuauuaauaca

SEQ ID NO: 4071588 - RNA, 12 nt, Vaccinia virus
gaauuucccaaa

SEQ ID NO: 4071589 - RNA, 20 nt, Vaccinia virus
gaauuugaucuauugcccua

SEQ ID NO: 4071590 - RNA, 17 nt, Vaccinia virus
gacaacaaaaaaugaau

SEQ ID NO: 4071591 - RNA, 21 nt, Vaccinia virus
gacaauaguuucuauacuguc

SEQ ID NO: 4071592 - RNA, 18 nt, Vaccinia virus
gacaccuaaaaagaaugu

SEQ ID NO: 4071593 - RNA, 17 nt, Vaccinia virus
gacacuaguuaagaaca

SEQ ID NO: 4071594 - RNA, 17 nt, Vaccinia virus
gacacuauuauuauuga

SEQ ID NO: 4071595 - RNA, 17 nt, Vaccinia virus
gacacuauucauguaau

SEQ ID NO: 4071596 - RNA, 22 nt, Vaccinia virus
gacacucuauaucuagaaauaa

SEQ ID NO: 4071597 - RNA, 15 nt, Vaccinia virus
gacagaaaaaugcua

SEQ ID NO: 4071598 - RNA, 19 nt, Vaccinia virus
gacagaagaauaugaugau

SEQ ID NO: 4071599 - RNA, 15 nt, Vaccinia virus
gacauagauauucua

SEQ ID NO: 4071600 - RNA, 22 nt, Vaccinia virus
gacaucgacgccuuagaaauaa

SEQ ID NO: 4071601 - RNA, 15 nt, Vaccinia virus
gacaugcaaaaaugc

SEQ ID NO: 4071602 - RNA, 17 nt, Vaccinia virus
gacaugcaauaaaucua

SEQ ID NO: 4071603 - RNA, 23 nt, Vaccinia virus
gacauucccacaguguugccauu

SEQ ID NO: 4071604 - RNA, 21 nt, Vaccinia virus
gacauuguaaaagacaaauau

SEQ ID NO: 4071605 - RNA, 20 nt, Vaccinia virus
gacauuguauuaugaugaau

SEQ ID NO: 4071606 - RNA, 22 nt, Vaccinia virus
gaccacacggagaacagaugac

SEQ ID NO: 4071607 - RNA, 20 nt, Vaccinia virus
gaccgaugaccauuuaaaaa

SEQ ID NO: 4071608 - RNA, 13 nt, Vaccinia virus
gaccuauaauuga

SEQ ID NO: 4071609 - RNA, 15 nt, Vaccinia virus
gaccuguugcacaau

SEQ ID NO: 4071610 - RNA, 22 nt, Vaccinia virus
gacgaguuucggcacauauuaa

SEQ ID NO: 4071611 - RNA, 20 nt, Vaccinia virus
gacgauauauaguaaugaag

SEQ ID NO: 4071612 - RNA, 22 nt, Vaccinia virus
gacgauauuagaugauaauuua

SEQ ID NO: 4071613 - RNA, 14 nt, Vaccinia virus
gacgauuucugaau

SEQ ID NO: 4071614 - RNA, 19 nt, Vaccinia virus
gacgcauuuaauagagaua

SEQ ID NO: 4071615 - RNA, 15 nt, Vaccinia virus
gacgcugucaguuau

SEQ ID NO: 4071616 - RNA, 12 nt, Vaccinia virus
gacguagaaaac

SEQ ID NO: 4071617 - RNA, 15 nt, Vaccinia virus
gacgucaaacaaugu

SEQ ID NO: 4071618 - RNA, 22 nt, Vaccinia virus
gacuaaauuagauuaugaggau

SEQ ID NO: 4071619 - RNA, 19 nt, Vaccinia virus
gacuacaaagaauguucua

SEQ ID NO: 4071620 - RNA, 19 nt, Vaccinia virus
gacuagauccguuaguuua

SEQ ID NO: 4071621 - RNA, 14 nt, Vaccinia virus
gacuagcauauuau

SEQ ID NO: 4071622 - RNA, 14 nt, Vaccinia virus
gacuauaacagaua

SEQ ID NO: 4071623 - RNA, 20 nt, Vaccinia virus
gacuaucaacaauuuuguau

SEQ ID NO: 4071624 - RNA, 15 nt, Vaccinia virus
gacuccuuucuaaua

SEQ ID NO: 4071625 - RNA, 23 nt, Vaccinia virus
gacucucaguaagaguuaugaau

SEQ ID NO: 4071626 - RNA, 16 nt, Vaccinia virus
gacuucuaacaaacau

SEQ ID NO: 4071627 - RNA, 19 nt, Vaccinia virus
gacuugucaaaucuauaua

SEQ ID NO: 4071628 - RNA, 18 nt, Vaccinia virus
gacuuuaaacagaaauau

SEQ ID NO: 4071629 - RNA, 24 nt, Vaccinia virus
guguuaaaugguucgauauaaagg

SEQ ID NO: 4071630 - RNA, 13 nt, Vaccinia virus
guguuauuuuuua

SEQ ID NO: 4071631 - RNA, 18 nt, Vaccinia virus
guuaaaauaucaugguua

SEQ ID NO: 4071632 - RNA, 13 nt, Vaccinia virus
guuaaaauuccua

SEQ ID NO: 4071633 - RNA, 18 nt, Vaccinia virus
guuaaacaauagauggau

SEQ ID NO: 4071634 - RNA, 17 nt, Vaccinia virus
guuaaacugugaauguc

SEQ ID NO: 4071635 - RNA, 20 nt, Vaccinia virus
guuaaagaaauuaauaaaga

SEQ ID NO: 4071636 - RNA, 18 nt, Vaccinia virus
guuaaagaucuuaagaaa

SEQ ID NO: 4071637 - RNA, 23 nt, Vaccinia virus
guuaaaugguucgauauaaagga

SEQ ID NO: 4071638 - RNA, 20 nt, Vaccinia virus
guuaaauguugguauaucaa

SEQ ID NO: 4071639 - RNA, 15 nt, Vaccinia virus
guuaagcauauccug

SEQ ID NO: 4071640 - RNA, 24 nt, Vaccinia virus
guuaauaucuauauauguauuuua

SEQ ID NO: 4071641 - RNA, 15 nt, Vaccinia virus
guuaaugaacaaauc

SEQ ID NO: 4071642 - RNA, 19 nt, Vaccinia virus
guuaauuuaucacauauca

SEQ ID NO: 4071643 - RNA, 13 nt, Vaccinia virus
guuaauuuuauca

SEQ ID NO: 4071644 - RNA, 10 nt, Vaccinia virus
guuacaaaag

SEQ ID NO: 4071645 - RNA, 18 nt, Vaccinia virus
guuacauuuauacuucuu

SEQ ID NO: 4071646 - RNA, 19 nt, Vaccinia virus
guuacauuuccaugucaau

SEQ ID NO: 4071647 - RNA, 13 nt, Vaccinia virus
guuacguauauau

SEQ ID NO: 4071648 - RNA, 13 nt, Vaccinia virus
guuacugauuuuu

SEQ ID NO: 4071649 - RNA, 19 nt, Vaccinia virus
guuagauaacucugcucca

SEQ ID NO: 4071650 - RNA, 21 nt, Vaccinia virus
guuagcaacgugauucaucaa

SEQ ID NO: 4071651 - RNA, 18 nt, Vaccinia virus
guuagcuguuuucaucaa

SEQ ID NO: 4071652 - RNA, 13 nt, Vaccinia virus
guuaguaaucaua

SEQ ID NO: 4071653 - RNA, 17 nt, Vaccinia virus
guuagugaugaauaucu

SEQ ID NO: 4071654 - RNA, 16 nt, Vaccinia virus
guuauaaacgggugua

SEQ ID NO: 4071655 - RNA, 14 nt, Vaccinia virus
guuauaauagagau

SEQ ID NO: 4071656 - RNA, 14 nt, Vaccinia virus
guuauaaucaaaga

SEQ ID NO: 4071657 - RNA, 15 nt, Vaccinia virus
guuauaguagauauc

SEQ ID NO: 4071658 - RNA, 18 nt, Vaccinia virus
guuauauuauuagauauc

SEQ ID NO: 4071659 - RNA, 21 nt, Vaccinia virus
guuauauuauuagauauccug

SEQ ID NO: 4071660 - RNA, 12 nt, Vaccinia virus
guuaucucagaa

SEQ ID NO: 4071661 - RNA, 16 nt, Vaccinia virus
guuauuaguacuauca

SEQ ID NO: 4071662 - RNA, 15 nt, Vaccinia virus
guuauuaucaucauu

SEQ ID NO: 4071663 - RNA, 16 nt, Vaccinia virus
guuauugguauuucuu

SEQ ID NO: 4071664 - RNA, 17 nt, Vaccinia virus
guucaaaacuuaaucuc

SEQ ID NO: 4071665 - RNA, 14 nt, Vaccinia virus
guucaaaauaaucc

SEQ ID NO: 4071666 - RNA, 21 nt, Vaccinia virus
guucacaaaaauacauaaaga

SEQ ID NO: 4071667 - RNA, 15 nt, Vaccinia virus
guucagaauauguua

SEQ ID NO: 4071668 - RNA, 16 nt, Vaccinia virus
guucagaggaugaaau

SEQ ID NO: 4071669 - RNA, 13 nt, Vaccinia virus
guucauaaucauc

SEQ ID NO: 4071670 - RNA, 16 nt, Vaccinia virus
guuccauaauaguuua

SEQ ID NO: 4071671 - RNA, 16 nt, Vaccinia virus
guuccggaucuauaga

SEQ ID NO: 4071672 - RNA, 23 nt, Vaccinia virus
guuccguuggaugguaauaaacu

SEQ ID NO: 4071673 - RNA, 16 nt, Vaccinia virus
guuccugaccauccau

SEQ ID NO: 4071674 - RNA, 23 nt, Vaccinia virus
guucuaacgccgaucucugaaug

SEQ ID NO: 4071675 - RNA, 21 nt, Vaccinia virus
guucuaucuucuaaaaaaucu

SEQ ID NO: 4071676 - RNA, 18 nt, Vaccinia virus
guucucaauauuacuuuu

SEQ ID NO: 4071677 - RNA, 15 nt, Vaccinia virus
guucucguucguaau

SEQ ID NO: 4071678 - RNA, 18 nt, Vaccinia virus
guucucuuugauaaaagu

SEQ ID NO: 4071679 - RNA, 17 nt, Vaccinia virus
guucugaaagagaugag

SEQ ID NO: 4071680 - RNA, 19 nt, Vaccinia virus
guucugauuuuaucuuuua

SEQ ID NO: 4071681 - RNA, 16 nt, Vaccinia virus
guucuuacacauauca

SEQ ID NO: 4071682 - RNA, 16 nt, Vaccinia virus
guucuugaucuuauua

SEQ ID NO: 4071683 - RNA, 15 nt, Vaccinia virus
guugaaauagaaaau

SEQ ID NO: 4071684 - RNA, 23 nt, Vaccinia virus
guugauguauugucguagaaaac

SEQ ID NO: 4071685 - RNA, 14 nt, Vaccinia virus
guuguauauuucuu

SEQ ID NO: 4071686 - RNA, 21 nt, Vaccinia virus
guuguuacuccauuauauauu

SEQ ID NO: 4071687 - RNA, 22 nt, Vaccinia virus
guuuaaaaacacacaguuugau

SEQ ID NO: 4071688 - RNA, 14 nt, Vaccinia virus
guuuaaaaauggug

SEQ ID NO: 4071689 - RNA, 18 nt, Vaccinia virus
guuuaaagauuucuuuuu

SEQ ID NO: 4071690 - RNA, 13 nt, Vaccinia virus
cauauuuugcaau

SEQ ID NO: 4071691 - RNA, 16 nt, Vaccinia virus
caucaaaauauguuuc

SEQ ID NO: 4071692 - RNA, 18 nt, Vaccinia virus
caucaacagucacauaau

SEQ ID NO: 4071693 - RNA, 20 nt, Vaccinia virus
caucauaugggaaucgaugu

SEQ ID NO: 4071694 - RNA, 16 nt, Vaccinia virus
caucauccauuaauau

SEQ ID NO: 4071695 - RNA, 21 nt, Vaccinia virus
caucaucguuacaauaaaaaa

SEQ ID NO: 4071696 - RNA, 16 nt, Vaccinia virus
cauccaugcagcauuu

SEQ ID NO: 4071697 - RNA, 20 nt, Vaccinia virus
caucccauauauuccaugaa

SEQ ID NO: 4071698 - RNA, 23 nt, Vaccinia virus
cauccuaagaugauaaaaaacuu

SEQ ID NO: 4071699 - RNA, 18 nt, Vaccinia virus
cauccucgacugaugugg

SEQ ID NO: 4071700 - RNA, 20 nt, Vaccinia virus
cauccuguggguuucucaua

SEQ ID NO: 4071701 - RNA, 15 nt, Vaccinia virus
caucgaagagcauuu

SEQ ID NO: 4071702 - RNA, 13 nt, Vaccinia virus
caucgaauacuuc

SEQ ID NO: 4071703 - RNA, 15 nt, Vaccinia virus
caucgauaguauaau

SEQ ID NO: 4071704 - RNA, 23 nt, Vaccinia virus
caucgauugugauuguauuuccu

SEQ ID NO: 4071705 - RNA, 20 nt, Vaccinia virus
caucggaaaaaaaucuuuuu

SEQ ID NO: 4071706 - RNA, 15 nt, Vaccinia virus
caucuaccaauucau

SEQ ID NO: 4071707 - RNA, 13 nt, Vaccinia virus
caucuaucgaugg

SEQ ID NO: 4071708 - RNA, 13 nt, Vaccinia virus
caucuauuccaaa

SEQ ID NO: 4071709 - RNA, 16 nt, Vaccinia virus
caucuauuuuaaauac

SEQ ID NO: 4071710 - RNA, 21 nt, Vaccinia virus
caucugauaauuuagauaauu

SEQ ID NO: 4071711 - RNA, 15 nt, Vaccinia virus
caucuggauuucaga

SEQ ID NO: 4071712 - RNA, 20 nt, Vaccinia virus
caucugggaauaaaauacua

SEQ ID NO: 4071713 - RNA, 21 nt, Vaccinia virus
caucuguuuccuauaaucguu

SEQ ID NO: 4071714 - RNA, 20 nt, Vaccinia virus
caucuucuuugauuaaugau

SEQ ID NO: 4071715 - RNA, 20 nt, Vaccinia virus
caugaagagauguuauauaa

SEQ ID NO: 4071716 - RNA, 16 nt, Vaccinia virus
caugaaggagauuuag

SEQ ID NO: 4071717 - RNA, 15 nt, Vaccinia virus
caugacguaaaugua

SEQ ID NO: 4071718 - RNA, 20 nt, Vaccinia virus
caugacuuaugaauacuaau

SEQ ID NO: 4071719 - RNA, 20 nt, Vaccinia virus
caugacuugguauuuggaaa

SEQ ID NO: 4071720 - RNA, 13 nt, Vaccinia virus
caugauaaacgaa

SEQ ID NO: 4071721 - RNA, 12 nt, Vaccinia virus
caugauagauuu

SEQ ID NO: 4071722 - RNA, 14 nt, Vaccinia virus
caugaugagauguu

SEQ ID NO: 4071723 - RNA, 17 nt, Vaccinia virus
caugcauucaaauggau

SEQ ID NO: 4071724 - RNA, 14 nt, Vaccinia virus
caugcucuauuuug

SEQ ID NO: 4071725 - RNA, 16 nt, Vaccinia virus
cauggaaaagaauuua

SEQ ID NO: 4071726 - RNA, 16 nt, Vaccinia virus
cauggaggaugcauua

SEQ ID NO: 4071727 - RNA, 21 nt, Vaccinia virus
cauggcaacggauuuaauuuu

SEQ ID NO: 4071728 - RNA, 15 nt, Vaccinia virus
caugguauauggaua

SEQ ID NO: 4071729 - RNA, 13 nt, Vaccinia virus
cauguacaugaau

SEQ ID NO: 4071730 - RNA, 18 nt, Vaccinia virus
cauguauacuugacaaaa

SEQ ID NO: 4071731 - RNA, 16 nt, Vaccinia virus
caugucgucuauuuuc

SEQ ID NO: 4071732 - RNA, 15 nt, Vaccinia virus
caugucuuagauguu

SEQ ID NO: 4071733 - RNA, 20 nt, Vaccinia virus
cauguggaucugaagaagag

SEQ ID NO: 4071734 - RNA, 22 nt, Vaccinia virus
cauguguagaugcuacuucauc

SEQ ID NO: 4071735 - RNA, 18 nt, Vaccinia virus
cauguguuucccaaacaa

SEQ ID NO: 4071736 - RNA, 21 nt, Vaccinia virus
cauguguuucccaaacaaaau

SEQ ID NO: 4071737 - RNA, 13 nt, Vaccinia virus
cauguuaaaaaug

SEQ ID NO: 4071738 - RNA, 21 nt, Vaccinia virus
cauguugaacauaaaacuaau

SEQ ID NO: 4071739 - RNA, 15 nt, Vaccinia virus
cauguugucuauuuc

SEQ ID NO: 4071740 - RNA, 15 nt, Vaccinia virus
cauguuuagaaagaa

SEQ ID NO: 4071741 - RNA, 17 nt, Vaccinia virus
cauguuuaucuauuuug

SEQ ID NO: 4071742 - RNA, 16 nt, Vaccinia virus
cauuaaaaugauuauu

SEQ ID NO: 4071743 - RNA, 19 nt, Vaccinia virus
cauuaaacgauuugaugag

SEQ ID NO: 4071744 - RNA, 18 nt, Vaccinia virus
cauuaaaucuauuauauu

SEQ ID NO: 4071745 - RNA, 14 nt, Vaccinia virus
cauuaagucauuaa

SEQ ID NO: 4071746 - RNA, 15 nt, Vaccinia virus
cauuaauaacauccu

SEQ ID NO: 4071747 - RNA, 20 nt, Vaccinia virus
cauuaauacagccuauuuuc

SEQ ID NO: 4071748 - RNA, 14 nt, Vaccinia virus
cauuaauacaguaa

SEQ ID NO: 4071749 - RNA, 23 nt, Vaccinia virus
cauuaauaggaaaagguggauuu

SEQ ID NO: 4071750 - RNA, 20 nt, Vaccinia virus
cauuaauauaugcucuagau

SEQ ID NO: 4071751 - RNA, 20 nt, Vaccinia virus
cauuaauaucuuuauaagag

SEQ ID NO: 4071752 - RNA, 18 nt, Vaccinia virus
cauuacagaaacuguaaa

SEQ ID NO: 4071753 - RNA, 15 nt, Vaccinia virus
cauuaccucaugaac

SEQ ID NO: 4071754 - RNA, 21 nt, Vaccinia virus
cauuacuaacuuuaucacaau

SEQ ID NO: 4071755 - RNA, 22 nt, Vaccinia virus
cauuacuaucuuuaacauaagu

SEQ ID NO: 4071756 - RNA, 18 nt, Vaccinia virus
cauuacuucuuccauguc

SEQ ID NO: 4071757 - RNA, 23 nt, Vaccinia virus
cauuacuucuuccauguccaaua

SEQ ID NO: 4071758 - RNA, 20 nt, Vaccinia virus
cauuagauauuauggcauug

SEQ ID NO: 4071759 - RNA, 15 nt, Vaccinia virus
cauuagguuaaauga

SEQ ID NO: 4071760 - RNA, 15 nt, Vaccinia virus
cauuaguaacagcuu

SEQ ID NO: 4071761 - RNA, 14 nt, Vaccinia virus
cauuauaaaaagug

SEQ ID NO: 4071762 - RNA, 21 nt, Vaccinia virus
cauuauacuuuuuuuuggaaa

SEQ ID NO: 4071763 - RNA, 11 nt, Vaccinia virus
cauuaugaauu

SEQ ID NO: 4071764 - RNA, 21 nt, Vaccinia virus
cauuauggauaaucuauuuac

SEQ ID NO: 4071765 - RNA, 19 nt, Vaccinia virus
cauuauuacauagauguau

SEQ ID NO: 4071766 - RNA, 20 nt, Vaccinia virus
augcuguuuuuuacuuugug

SEQ ID NO: 4071767 - RNA, 22 nt, Vaccinia virus
augcuugauaagauaaaaucua

SEQ ID NO: 4071768 - RNA, 13 nt, Vaccinia virus
auggaaaaaugac

SEQ ID NO: 4071769 - RNA, 21 nt, Vaccinia virus
auggaaacggaacagaaacua

SEQ ID NO: 4071770 - RNA, 13 nt, Vaccinia virus
auggaaaggaaac

SEQ ID NO: 4071771 - RNA, 20 nt, Vaccinia virus
auggaacaauaaaagagaau

SEQ ID NO: 4071772 - RNA, 20 nt, Vaccinia virus
auggaagaguuaaugaauau

SEQ ID NO: 4071773 - RNA, 18 nt, Vaccinia virus
auggaccaaauuaucauc

SEQ ID NO: 4071774 - RNA, 12 nt, Vaccinia virus
auggagcguaaa

SEQ ID NO: 4071775 - RNA, 16 nt, Vaccinia virus
auggaguauaaucuuu

SEQ ID NO: 4071776 - RNA, 20 nt, Vaccinia virus
auggauaauauuuguaaugg

SEQ ID NO: 4071777 - RNA, 23 nt, Vaccinia virus
auggauuaguuagacugaaugcu

SEQ ID NO: 4071778 - RNA, 14 nt, Vaccinia virus
auggcaacgacuau

SEQ ID NO: 4071779 - RNA, 21 nt, Vaccinia virus
auggcaucuauuuuaaauaca

SEQ ID NO: 4071780 - RNA, 16 nt, Vaccinia virus
auggcauugauaaugu

SEQ ID NO: 4071781 - RNA, 16 nt, Vaccinia virus
augggucauagaauuu

SEQ ID NO: 4071782 - RNA, 14 nt, Vaccinia virus
augguaaaagaaau

SEQ ID NO: 4071783 - RNA, 17 nt, Vaccinia virus
augguaaauaaauacuu

SEQ ID NO: 4071784 - RNA, 16 nt, Vaccinia virus
augguacaaaaaagaa

SEQ ID NO: 4071785 - RNA, 20 nt, Vaccinia virus
augguacuuaugacaaaguu

SEQ ID NO: 4071786 - RNA, 15 nt, Vaccinia virus
auggucauagagaac

SEQ ID NO: 4071787 - RNA, 21 nt, Vaccinia virus
auggucauguuuauuucuagu

SEQ ID NO: 4071788 - RNA, 19 nt, Vaccinia virus
augguucccauaaguuugg

SEQ ID NO: 4071789 - RNA, 20 nt, Vaccinia virus
augguucgcucaaaaauaua

SEQ ID NO: 4071790 - RNA, 18 nt, Vaccinia virus
augguuuacccuagaaua

SEQ ID NO: 4071791 - RNA, 17 nt, Vaccinia virus
auguaacuauagagaac

SEQ ID NO: 4071792 - RNA, 20 nt, Vaccinia virus
auguaauggagaguuaccuc

SEQ ID NO: 4071793 - RNA, 17 nt, Vaccinia virus
auguaauuaaauguuug

SEQ ID NO: 4071794 - RNA, 23 nt, Vaccinia virus
auguacgauccaaacaauguuuc

SEQ ID NO: 4071795 - RNA, 23 nt, Vaccinia virus
auguagagguguauuuccuauau

SEQ ID NO: 4071796 - RNA, 17 nt, Vaccinia virus
auguagugacgauguau

SEQ ID NO: 4071797 - RNA, 20 nt, Vaccinia virus
auguagugauagauaugaua

SEQ ID NO: 4071798 - RNA, 13 nt, Vaccinia virus
auguauaaaugaa

SEQ ID NO: 4071799 - RNA, 14 nt, Vaccinia virus
auguauacaaaugu

SEQ ID NO: 4071800 - RNA, 11 nt, Vaccinia virus
auguauauaca

SEQ ID NO: 4071801 - RNA, 14 nt, Vaccinia virus
auguaucaaagaua

SEQ ID NO: 4071802 - RNA, 21 nt, Vaccinia virus
auguaucauuagguaaaguag

SEQ ID NO: 4071803 - RNA, 13 nt, Vaccinia virus
auguauccguaaa

SEQ ID NO: 4071804 - RNA, 22 nt, Vaccinia virus
auguauccguaaaguaauuucc

SEQ ID NO: 4071805 - RNA, 17 nt, Vaccinia virus
auguauguuuaaacacu

SEQ ID NO: 4071806 - RNA, 21 nt, Vaccinia virus
auguauuucauuguucaucca

SEQ ID NO: 4071807 - RNA, 14 nt, Vaccinia virus
auguauuugauaua

SEQ ID NO: 4071808 - RNA, 19 nt, Vaccinia virus
auguauuuuaauaaaucau

SEQ ID NO: 4071809 - RNA, 22 nt, Vaccinia virus
auguauuuugaggaaauugaua

SEQ ID NO: 4071810 - RNA, 21 nt, Vaccinia virus
augucaaaggaugaaagaaag

SEQ ID NO: 4071811 - RNA, 22 nt, Vaccinia virus
augucacaauuuguauuaucca

SEQ ID NO: 4071812 - RNA, 15 nt, Vaccinia virus
augucaggaaauauu

SEQ ID NO: 4071813 - RNA, 16 nt, Vaccinia virus
augucaggaaauguau

SEQ ID NO: 4071814 - RNA, 13 nt, Vaccinia virus
augucauggaaac

SEQ ID NO: 4071815 - RNA, 20 nt, Vaccinia virus
augucauggaaacaaaugaa

SEQ ID NO: 4071816 - RNA, 18 nt, Vaccinia virus
augucauuuuuuuauccg

SEQ ID NO: 4071817 - RNA, 17 nt, Vaccinia virus
auguccauuaaaguuaa

SEQ ID NO: 4071818 - RNA, 21 nt, Vaccinia virus
augucgagauauauggacgau

SEQ ID NO: 4071819 - RNA, 18 nt, Vaccinia virus
augucguuauucugaaac

SEQ ID NO: 4071820 - RNA, 20 nt, Vaccinia virus
augucuaaugaugaacacaa

SEQ ID NO: 4071821 - RNA, 13 nt, Vaccinia virus
augucuacauaaa

SEQ ID NO: 4071822 - RNA, 13 nt, Vaccinia virus
augucuaugaaua

SEQ ID NO: 4071823 - RNA, 21 nt, Vaccinia virus
augucucuuuuucagaaauua

SEQ ID NO: 4071824 - RNA, 22 nt, Vaccinia virus
augucugauuuuucuucauuua

SEQ ID NO: 4071825 - RNA, 17 nt, Vaccinia virus
augugacguacaaaaaa

SEQ ID NO: 4071826 - RNA, 15 nt, Vaccinia virus
augugagaaguuugc

SEQ ID NO: 4071827 - RNA, 15 nt, Vaccinia virus
augugagcaaagauu

SEQ ID NO: 4071828 - RNA, 15 nt, Vaccinia virus
augugaguauuggau

SEQ ID NO: 4071829 - RNA, 20 nt, Vaccinia virus
augugauggaaaaaugacua

SEQ ID NO: 4071830 - RNA, 16 nt, Vaccinia virus
augugauucucugaaa

SEQ ID NO: 4071831 - RNA, 23 nt, Vaccinia virus
augugggacaucaauacgccaau

SEQ ID NO: 4071832 - RNA, 21 nt, Vaccinia virus
augugucuacauaaauaugca

SEQ ID NO: 4071833 - RNA, 16 nt, Vaccinia virus
auguguuuuagaauau

SEQ ID NO: 4071834 - RNA, 14 nt, Vaccinia virus
auguuaaaaaugac

SEQ ID NO: 4071835 - RNA, 20 nt, Vaccinia virus
auguuaaauauaaaaaauga

SEQ ID NO: 4071836 - RNA, 16 nt, Vaccinia virus
auguuaaauguagaca

SEQ ID NO: 4071837 - RNA, 13 nt, Vaccinia virus
auguuacagaaua

SEQ ID NO: 4071838 - RNA, 18 nt, Vaccinia virus
auguuagaaaaaaugaug

SEQ ID NO: 4071839 - RNA, 14 nt, Vaccinia virus
auguuauccaacau

SEQ ID NO: 4071840 - RNA, 22 nt, Vaccinia virus
auguucucguuuccaaaaaaug

SEQ ID NO: 4071841 - RNA, 17 nt, Vaccinia virus
auguugacauguauaua

SEQ ID NO: 4071842 - RNA, 18 nt, Vaccinia virus
auguugcaugaaauaaua

SEQ ID NO: 4071843 - RNA, 15 nt, Vaccinia virus
auguuggagauacua

SEQ ID NO: 4071844 - RNA, 21 nt, Vaccinia virus
auguugggauauugcaugaua

SEQ ID NO: 4071845 - RNA, 14 nt, Vaccinia virus
auguuguuaccaua

SEQ ID NO: 4071846 - RNA, 19 nt, Vaccinia virus
auguuuaaacaucaaacau

SEQ ID NO: 4071847 - RNA, 23 nt, Vaccinia virus
auguuuaauacuuauucauauuu

SEQ ID NO: 4071848 - RNA, 23 nt, Vaccinia virus
auguuuacugcugcguuaaacau

SEQ ID NO: 4071849 - RNA, 13 nt, Vaccinia virus
auguuucaaucau

SEQ ID NO: 4071850 - RNA, 17 nt, Vaccinia virus
auguuugacugaauaua

SEQ ID NO: 4071851 - RNA, 21 nt, Vaccinia virus
auguuugauaaaaauauguau

SEQ ID NO: 4071852 - RNA, 23 nt, Vaccinia virus
auguuugcggaagucaaauacga

SEQ ID NO: 4071853 - RNA, 18 nt, Vaccinia virus
auguuuucugucagaaaa

SEQ ID NO: 4071854 - RNA, 18 nt, Vaccinia virus
auguuuugauuucaauuu

SEQ ID NO: 4071855 - RNA, 14 nt, Vaccinia virus
auuaaaaaggaaaa

SEQ ID NO: 4071856 - RNA, 21 nt, Vaccinia virus
auuaaaacuaccaauaagaag

SEQ ID NO: 4071857 - RNA, 17 nt, Vaccinia virus
auuaaaauuaacaagga

SEQ ID NO: 4071858 - RNA, 15 nt, Vaccinia virus
auuaaacagaaaugg

SEQ ID NO: 4071859 - RNA, 19 nt, Vaccinia virus
auucguugaugaauuauua

SEQ ID NO: 4071860 - RNA, 22 nt, Vaccinia virus
auucuaaagagauuuagacaac

SEQ ID NO: 4071861 - RNA, 18 nt, Vaccinia virus
auucuaauauuaugaaug

SEQ ID NO: 4071862 - RNA, 12 nt, Vaccinia virus
auucuaaugaug

SEQ ID NO: 4071863 - RNA, 22 nt, Vaccinia virus
auucuaugaugaaacacaagau

SEQ ID NO: 4071864 - RNA, 22 nt, Vaccinia virus
auucucauugcuuauauuuuca

SEQ ID NO: 4071865 - RNA, 14 nt, Vaccinia virus
auucucuacagaug

SEQ ID NO: 4071866 - RNA, 17 nt, Vaccinia virus
auucucuauuaaauacc

SEQ ID NO: 4071867 - RNA, 23 nt, Vaccinia virus
auucugauuggucaaugugaaug

SEQ ID NO: 4071868 - RNA, 19 nt, Vaccinia virus
auucugcggcuauagaaaa

SEQ ID NO: 4071869 - RNA, 18 nt, Vaccinia virus
auucuguucuauucaaag

SEQ ID NO: 4071870 - RNA, 17 nt, Vaccinia virus
auucuuacaguacacag

SEQ ID NO: 4071871 - RNA, 17 nt, Vaccinia virus
auucuuaugagaauaga

SEQ ID NO: 4071872 - RNA, 17 nt, Vaccinia virus
auucuucauucugcaua

SEQ ID NO: 4071873 - RNA, 18 nt, Vaccinia virus
auucuucgcccucaauuu

SEQ ID NO: 4071874 - RNA, 16 nt, Vaccinia virus
auucuugguaauuaau

SEQ ID NO: 4071875 - RNA, 17 nt, Vaccinia virus
auucuuguucaauggau

SEQ ID NO: 4071876 - RNA, 15 nt, Vaccinia virus
auucuuuuauuaaug

SEQ ID NO: 4071877 - RNA, 19 nt, Vaccinia virus
auugaaaauacuaauuguu

SEQ ID NO: 4071878 - RNA, 21 nt, Vaccinia virus
auugaaacugaggcuguugaa

SEQ ID NO: 4071879 - RNA, 14 nt, Vaccinia virus
auugacagauagau

SEQ ID NO: 4071880 - RNA, 14 nt, Vaccinia virus
auugacgacuuugg

SEQ ID NO: 4071881 - RNA, 15 nt, Vaccinia virus
auugacgaugucaau

SEQ ID NO: 4071882 - RNA, 15 nt, Vaccinia virus
auugagaagaagcua

SEQ ID NO: 4071883 - RNA, 22 nt, Vaccinia virus
auugagacgaauggcucuuccu

SEQ ID NO: 4071884 - RNA, 20 nt, Vaccinia virus
auugauaguaccaaauucuu

SEQ ID NO: 4071885 - RNA, 23 nt, Vaccinia virus
auugaugugucuguuuauacaau

SEQ ID NO: 4071886 - RNA, 17 nt, Vaccinia virus
auugauuauuucaaaga

SEQ ID NO: 4071887 - RNA, 14 nt, Vaccinia virus
auugauuuuggaaa

SEQ ID NO: 4071888 - RNA, 22 nt, Vaccinia virus
auugcaugguaaggaaguagaa

SEQ ID NO: 4071889 - RNA, 21 nt, Vaccinia virus
auugcauuuugauaguuuauc

SEQ ID NO: 4071890 - RNA, 21 nt, Vaccinia virus
auugcguuuagcaucugauuu

SEQ ID NO: 4071891 - RNA, 22 nt, Vaccinia virus
auugcuagccucaucuucuaua

SEQ ID NO: 4071892 - RNA, 14 nt, Vaccinia virus
auugcuguaaacaa

SEQ ID NO: 4071893 - RNA, 22 nt, Vaccinia virus
auugcuguuaguauaauuauug

SEQ ID NO: 4071894 - RNA, 21 nt, Vaccinia virus
auuggaauaagcgucuucucg

SEQ ID NO: 4071895 - RNA, 20 nt, Vaccinia virus
auuggagauccgauccauga

SEQ ID NO: 4071896 - RNA, 16 nt, Vaccinia virus
auuggauggacacauu

SEQ ID NO: 4071897 - RNA, 19 nt, Vaccinia virus
auuggcaaaucuuaucauu

SEQ ID NO: 4071898 - RNA, 21 nt, Vaccinia virus
auuggcaaauuauuucuucug

SEQ ID NO: 4071899 - RNA, 18 nt, Vaccinia virus
auugggauaaaaauuaug

SEQ ID NO: 4071900 - RNA, 14 nt, Vaccinia virus
auugguaaauccuu

SEQ ID NO: 4071901 - RNA, 14 nt, Vaccinia virus
auuguaacaguauu

SEQ ID NO: 4071902 - RNA, 14 nt, Vaccinia virus
auuguacuuuguaa

SEQ ID NO: 4071903 - RNA, 17 nt, Vaccinia virus
auuguagaaucagcauc

SEQ ID NO: 4071904 - RNA, 19 nt, Vaccinia virus
auuguagcuauuuaaaugg

SEQ ID NO: 4071905 - RNA, 21 nt, Vaccinia virus
auugucgcacuauagaugcaa

SEQ ID NO: 4071906 - RNA, 20 nt, Vaccinia virus
auugucuagauaaaauacug

SEQ ID NO: 4071907 - RNA, 22 nt, Vaccinia virus
auugucuauaucuaaaaucaua

SEQ ID NO: 4071908 - RNA, 22 nt, Vaccinia virus
auugucugacauaagaugucua

SEQ ID NO: 4071909 - RNA, 22 nt, Vaccinia virus
auugugauuuaguguaguauau

SEQ ID NO: 4071910 - RNA, 16 nt, Vaccinia virus
auuguugucugaaaua

SEQ ID NO: 4071911 - RNA, 14 nt, Vaccinia virus
auuguuuuucacag

SEQ ID NO: 4071912 - RNA, 13 nt, Vaccinia virus
auuuaaaaugaua

SEQ ID NO: 4071913 - RNA, 10 nt, Vaccinia virus
auuuaaacau

SEQ ID NO: 4071914 - RNA, 12 nt, Vaccinia virus
auuuaaacgaag

SEQ ID NO: 4071915 - RNA, 18 nt, Vaccinia virus
auuuaacauuuuggcaaa

SEQ ID NO: 4071916 - RNA, 18 nt, Vaccinia virus
auuuaaggacuuaacaau

SEQ ID NO: 4071917 - RNA, 16 nt, Vaccinia virus
auuuaagguacuagau

SEQ ID NO: 4071918 - RNA, 14 nt, Vaccinia virus
auuuaauacuuuac

SEQ ID NO: 4071919 - RNA, 18 nt, Vaccinia virus
auuuaauuggacagauau

SEQ ID NO: 4071920 - RNA, 14 nt, Vaccinia virus
auuuacaauuauug

SEQ ID NO: 4071921 - RNA, 19 nt, Vaccinia virus
auuuacauucuuuuugcug

SEQ ID NO: 4071922 - RNA, 22 nt, Vaccinia virus
auuuaccaucccauauauucca

SEQ ID NO: 4071923 - RNA, 15 nt, Vaccinia virus
auuuacccauggaaa

SEQ ID NO: 4071924 - RNA, 20 nt, Vaccinia virus
auuuacuaaagucaucaaug

SEQ ID NO: 4071925 - RNA, 20 nt, Vaccinia virus
auuuacuaaucgauuuugca

SEQ ID NO: 4071926 - RNA, 16 nt, Vaccinia virus
auuuacuaucuguaau

SEQ ID NO: 4071927 - RNA, 16 nt, Vaccinia virus
auuuagacaacaggau

SEQ ID NO: 4071928 - RNA, 15 nt, Vaccinia virus
auuuaguuuaucuua

SEQ ID NO: 4071929 - RNA, 13 nt, Vaccinia virus
auuuauaaaaaaa

SEQ ID NO: 4071930 - RNA, 16 nt, Vaccinia virus
auuuauaauauacucu

SEQ ID NO: 4071931 - RNA, 15 nt, Vaccinia virus
auuuauauaugcauu

SEQ ID NO: 4071932 - RNA, 23 nt, Vaccinia virus
auuuauauccuauauacgaaaaa

SEQ ID NO: 4071933 - RNA, 18 nt, Vaccinia virus
auuuauaucuaaaaauua

SEQ ID NO: 4071934 - RNA, 19 nt, Vaccinia virus
auuuaucgguuuuggugaa

SEQ ID NO: 4071935 - RNA, 20 nt, Vaccinia virus
auuuaugauauauacacuuu

SEQ ID NO: 4071936 - RNA, 13 nt, Vaccinia virus
auuuauuaucaug

SEQ ID NO: 4071937 - RNA, 20 nt, Vaccinia virus
auuuauugcggauagcagua

SEQ ID NO: 4071938 - RNA, 19 nt, Vaccinia virus
auuuauuuaguauuaaaug

SEQ ID NO: 4071939 - RNA, 16 nt, Vaccinia virus
auuucaaaaaaugauc

SEQ ID NO: 4071940 - RNA, 17 nt, Vaccinia virus
auuucaaagacuaacuu

SEQ ID NO: 4071941 - RNA, 21 nt, Vaccinia virus
auuucaaauaggucuucgucu

SEQ ID NO: 4071942 - RNA, 19 nt, Vaccinia virus
auuucaacagacuguuuau

SEQ ID NO: 4071943 - RNA, 15 nt, Vaccinia virus
auuucacaaauggau

SEQ ID NO: 4071944 - RNA, 16 nt, Vaccinia virus
auuucacaacuuuacu

SEQ ID NO: 4071945 - RNA, 17 nt, Vaccinia virus
auuucaucguuuuguau

SEQ ID NO: 4071946 - RNA, 16 nt, Vaccinia virus
auuucaucugugguau

SEQ ID NO: 4071947 - RNA, 14 nt, Vaccinia virus
auuucauuaauagu

SEQ ID NO: 4071948 - RNA, 21 nt, Vaccinia virus
auuucauuauaauaguuuauc

SEQ ID NO: 4071949 - RNA, 17 nt, Vaccinia virus
auuucauucucugaaaa

SEQ ID NO: 4071950 - RNA, 21 nt, Vaccinia virus
auuuccaaagauacacacauu

SEQ ID NO: 4071951 - RNA, 23 nt, Vaccinia virus
auuuccaucucuaucuaauacag

SEQ ID NO: 4071952 - RNA, 17 nt, Vaccinia virus
auuucgaauacgauaau

SEQ ID NO: 4071953 - RNA, 13 nt, Vaccinia virus
auuucgacaaaaa

SEQ ID NO: 4071954 - RNA, 23 nt, Vaccinia virus
auuucguugaaccggaagaauug

SEQ ID NO: 4071955 - RNA, 22 nt, Vaccinia virus
auuucuaucccgaaagaacuga

SEQ ID NO: 4071956 - RNA, 14 nt, Vaccinia virus
auuucuuaauguaa

SEQ ID NO: 4071957 - RNA, 14 nt, Vaccinia virus
auuucuuacauaaa

SEQ ID NO: 4071958 - RNA, 21 nt, Vaccinia virus
auuucuuuuugggaaaaauug

SEQ ID NO: 4071959 - RNA, 22 nt, Vaccinia virus
auuugaaacuccuagagaauua

SEQ ID NO: 4071960 - RNA, 18 nt, Vaccinia virus
auuugagagaucauuucu

SEQ ID NO: 4071961 - RNA, 21 nt, Vaccinia virus
auuugcaccacuuucuaucaa

SEQ ID NO: 4071962 - RNA, 15 nt, Vaccinia virus
auuuggaaaagaaaa

SEQ ID NO: 4071963 - RNA, 17 nt, Vaccinia virus
auuuggaaaagaaaauu

SEQ ID NO: 4071964 - RNA, 16 nt, Vaccinia virus
auuugguaagacuauu

SEQ ID NO: 4071965 - RNA, 16 nt, Vaccinia virus
auuuggucauaauaga

SEQ ID NO: 4071966 - RNA, 22 nt, Vaccinia virus
auuuggucauaauagaauguau

SEQ ID NO: 4071967 - RNA, 16 nt, Vaccinia virus
auuuguacacaucuau

SEQ ID NO: 4071968 - RNA, 22 nt, Vaccinia virus
auuuguauuuuuuaaucuaucu

SEQ ID NO: 4071969 - RNA, 15 nt, Vaccinia virus
auuuguuaaaaauuu

SEQ ID NO: 4071970 - RNA, 15 nt, Vaccinia virus
auuuguuaacuauau

SEQ ID NO: 4071971 - RNA, 17 nt, Vaccinia virus
auuuguucaaacuuugu

SEQ ID NO: 4071972 - RNA, 17 nt, Vaccinia virus
auuuguucaagauagau

SEQ ID NO: 4071973 - RNA, 14 nt, Vaccinia virus
auuuguugaugaag

SEQ ID NO: 4071974 - RNA, 23 nt, Vaccinia virus
auuuguuuccaugacauauuaca

SEQ ID NO: 4071975 - RNA, 23 nt, Vaccinia virus
auuuguuuuguuaaacaauagau

SEQ ID NO: 4071976 - RNA, 14 nt, Vaccinia virus
auuuuaaaaaacug

SEQ ID NO: 4071977 - RNA, 18 nt, Vaccinia virus
auuuuaccucuucugaua

SEQ ID NO: 4071978 - RNA, 19 nt, Vaccinia virus
auuuuaggacggaucaaug

SEQ ID NO: 4071979 - RNA, 17 nt, Vaccinia virus
auuuuaguaauauggaa

SEQ ID NO: 4071980 - RNA, 15 nt, Vaccinia virus
auuuuauacuagagu

SEQ ID NO: 4071981 - RNA, 21 nt, Vaccinia virus
auuuuaucgauucuaaugaau

SEQ ID NO: 4071982 - RNA, 18 nt, Vaccinia virus
caaucuaagaaauuuaaa

SEQ ID NO: 4071983 - RNA, 16 nt, Vaccinia virus
caaucuagcauuucua

SEQ ID NO: 4071984 - RNA, 16 nt, Vaccinia virus
caaucucuauaucuau

SEQ ID NO: 4071985 - RNA, 17 nt, Vaccinia virus
caaugaaaugguacaau

SEQ ID NO: 4071986 - RNA, 16 nt, Vaccinia virus
caaugagaguuccuga

SEQ ID NO: 4071987 - RNA, 15 nt, Vaccinia virus
caaugagauaaauau

SEQ ID NO: 4071988 - RNA, 13 nt, Vaccinia virus
caaugauaacaau

SEQ ID NO: 4071989 - RNA, 20 nt, Vaccinia virus
caauggaaugcaaaacccca

SEQ ID NO: 4071990 - RNA, 13 nt, Vaccinia virus
caauggccaucug

SEQ ID NO: 4071991 - RNA, 18 nt, Vaccinia virus
caauggucucggauuggu

SEQ ID NO: 4071992 - RNA, 15 nt, Vaccinia virus
caauuaaaucaauau

SEQ ID NO: 4071993 - RNA, 16 nt, Vaccinia virus
caauuacugauaaugu

SEQ ID NO: 4071994 - RNA, 22 nt, Vaccinia virus
caauuauauguguguagacaau

SEQ ID NO: 4071995 - RNA, 15 nt, Vaccinia virus
caauuauguaucaau

SEQ ID NO: 4071996 - RNA, 19 nt, Vaccinia virus
caauuauucuaauggaugu

SEQ ID NO: 4071997 - RNA, 18 nt, Vaccinia virus
caauucagaaaucaaucu

SEQ ID NO: 4071998 - RNA, 15 nt, Vaccinia virus
caauucaugcucuau

SEQ ID NO: 4071999 - RNA, 16 nt, Vaccinia virus
caauuccuuuuugccu

SEQ ID NO: 4072000 - RNA, 19 nt, Vaccinia virus
caauuggcacgaacaaaag

SEQ ID NO: 4072001 - RNA, 24 nt, Vaccinia virus
caauugguagaguuuuauaacgaa

SEQ ID NO: 4072002 - RNA, 19 nt, Vaccinia virus
caauugucuguaaaccaca

SEQ ID NO: 4072003 - RNA, 22 nt, Vaccinia virus
caauugugauuuaguguaguau

SEQ ID NO: 4072004 - RNA, 20 nt, Vaccinia virus
caauuguuuuuguacauaau

SEQ ID NO: 4072005 - RNA, 16 nt, Vaccinia virus
caauuuagcugcauua

SEQ ID NO: 4072006 - RNA, 15 nt, Vaccinia virus
caauuuauuuuguau

SEQ ID NO: 4072007 - RNA, 23 nt, Vaccinia virus
caauuucauacgcuccucuuuug

SEQ ID NO: 4072008 - RNA, 22 nt, Vaccinia virus
cacaaauggauguuaauguauu

SEQ ID NO: 4072009 - RNA, 14 nt, Vaccinia virus
cacaacuuaaugaa

SEQ ID NO: 4072010 - RNA, 20 nt, Vaccinia virus
cacaauagcgcuuaaucuca

SEQ ID NO: 4072011 - RNA, 16 nt, Vaccinia virus
cacaauauauguugau

SEQ ID NO: 4072012 - RNA, 11 nt, Vaccinia virus
cacaaugaaug

SEQ ID NO: 4072013 - RNA, 17 nt, Vaccinia virus
cacaaugauaacaucca

SEQ ID NO: 4072014 - RNA, 17 nt, Vaccinia virus
cacacacgauuaauuuu

SEQ ID NO: 4072015 - RNA, 19 nt, Vaccinia virus
cacagaacaguaaauguuc

SEQ ID NO: 4072016 - RNA, 16 nt, Vaccinia virus
cacaguauugacaaau

SEQ ID NO: 4072017 - RNA, 14 nt, Vaccinia virus
cacauaagccauaa

SEQ ID NO: 4072018 - RNA, 18 nt, Vaccinia virus
cacauacauuuuuaacag

SEQ ID NO: 4072019 - RNA, 13 nt, Vaccinia virus
cacauagaauaaa

SEQ ID NO: 4072020 - RNA, 21 nt, Vaccinia virus
cacauauccacguucuacaaa

SEQ ID NO: 4072021 - RNA, 15 nt, Vaccinia virus
cacauauuaaugcag

SEQ ID NO: 4072022 - RNA, 21 nt, Vaccinia virus
cacauccuuuauuuuaucuau

SEQ ID NO: 4072023 - RNA, 15 nt, Vaccinia virus
cacaugauugacaaa

SEQ ID NO: 4072024 - RNA, 18 nt, Vaccinia virus
caccacacgacaaugaac

SEQ ID NO: 4072025 - RNA, 17 nt, Vaccinia virus
cacccguagaaauacua

SEQ ID NO: 4072026 - RNA, 23 nt, Vaccinia virus
caccgagggaaaaucuaaaguug

SEQ ID NO: 4072027 - RNA, 17 nt, Vaccinia virus
caccgauggugucacau

SEQ ID NO: 4072028 - RNA, 20 nt, Vaccinia virus
caccgcaugcaccauccgau

SEQ ID NO: 4072029 - RNA, 14 nt, Vaccinia virus
cacgaacaucuuuc

SEQ ID NO: 4072030 - RNA, 17 nt, Vaccinia virus
cacgaauauuacuaauu

SEQ ID NO: 4072031 - RNA, 16 nt, Vaccinia virus
cacgauuaauuuuuuu

SEQ ID NO: 4072032 - RNA, 14 nt, Vaccinia virus
cacggaagaacuac

SEQ ID NO: 4072033 - RNA, 18 nt, Vaccinia virus
cacguuuugauaaaucua

SEQ ID NO: 4072034 - RNA, 19 nt, Vaccinia virus
cacuaaucguaauauucua

SEQ ID NO: 4072035 - RNA, 13 nt, Vaccinia virus
cacuaauugacua

SEQ ID NO: 4072036 - RNA, 19 nt, Vaccinia virus
cacuaguuaagaacauguc

SEQ ID NO: 4072037 - RNA, 14 nt, Vaccinia virus
cacuauuauaacaa

SEQ ID NO: 4072038 - RNA, 16 nt, Vaccinia virus
cacucuucgaaaagaa

SEQ ID NO: 4072039 - RNA, 14 nt, Vaccinia virus
cacugauucagaaa

SEQ ID NO: 4072040 - RNA, 18 nt, Vaccinia virus
cacugcuggcaucgaugu

SEQ ID NO: 4072041 - RNA, 22 nt, Vaccinia virus
cacugucuggcaauaaaugaua

SEQ ID NO: 4072042 - RNA, 15 nt, Vaccinia virus
cacuguggaugugac

SEQ ID NO: 4072043 - RNA, 14 nt, Vaccinia virus
cacuguuaaaguua

SEQ ID NO: 4072044 - RNA, 22 nt, Vaccinia virus
cacuuagaacagauuuaacaau

SEQ ID NO: 4072045 - RNA, 19 nt, Vaccinia virus
cacuucgaagaguuaauau

SEQ ID NO: 4072046 - RNA, 15 nt, Vaccinia virus
cacuuggauauugua

SEQ ID NO: 4072047 - RNA, 13 nt, Vaccinia virus
cagaaaaaacaau

SEQ ID NO: 4072048 - RNA, 16 nt, Vaccinia virus
cagaaagacgaauaca

SEQ ID NO: 4072049 - RNA, 14 nt, Vaccinia virus
cagaaauacuauau

SEQ ID NO: 4072050 - RNA, 20 nt, Vaccinia virus
cagaaaugacuccaugaaaa

SEQ ID NO: 4072051 - RNA, 20 nt, Vaccinia virus
cagaaauugguauaaauguu

SEQ ID NO: 4072052 - RNA, 14 nt, Vaccinia virus
cagaacaauauauu

SEQ ID NO: 4072053 - RNA, 22 nt, Vaccinia virus
cagaagauagcaaagagaugau

SEQ ID NO: 4072054 - RNA, 22 nt, Vaccinia virus
cagaagauuauuauggaaauca

SEQ ID NO: 4072055 - RNA, 16 nt, Vaccinia virus
cagaaggaaacuucuu

SEQ ID NO: 4072056 - RNA, 21 nt, Vaccinia virus
cagacaaauggucaaugauau

SEQ ID NO: 4072057 - RNA, 22 nt, Vaccinia virus
cagacaauaagagcagcacaaa

SEQ ID NO: 4072058 - RNA, 17 nt, Vaccinia virus
cagacacagacgauauu

SEQ ID NO: 4072059 - RNA, 20 nt, Vaccinia virus
cagacucucaagauuuuaaa

SEQ ID NO: 4072060 - RNA, 19 nt, Vaccinia virus
cagaggaacgucauauauu

SEQ ID NO: 4072061 - RNA, 22 nt, Vaccinia virus
cagaguccucuaauugaucaag

SEQ ID NO: 4072062 - RNA, 17 nt, Vaccinia virus
cagaugcgccauauuua

SEQ ID NO: 4072063 - RNA, 22 nt, Vaccinia virus
cagauuaauaguuuuauuugaa

SEQ ID NO: 4072064 - RNA, 18 nt, Vaccinia virus
cagauugaacauacaguu

SEQ ID NO: 4072065 - RNA, 22 nt, Vaccinia virus
cagauugaauaggaguuugaau

SEQ ID NO: 4072066 - RNA, 22 nt, Vaccinia virus
cagauugcauggugauuugucu

SEQ ID NO: 4072067 - RNA, 23 nt, Vaccinia virus
cagauuguugccguaaauccugc

SEQ ID NO: 4072068 - RNA, 20 nt, Vaccinia virus
cagcaauuucuuuauucucu

SEQ ID NO: 4072069 - RNA, 19 nt, Vaccinia virus
cagcacggugguagauaua

SEQ ID NO: 4072070 - RNA, 21 nt, Vaccinia virus
cagcauagacuuugccacaac

SEQ ID NO: 4072071 - RNA, 14 nt, Vaccinia virus
cagccuuuaauagg

SEQ ID NO: 4072072 - RNA, 20 nt, Vaccinia virus
cagcuacugcugauaaugau

SEQ ID NO: 4072073 - RNA, 14 nt, Vaccinia virus
caggaauagaugua

SEQ ID NO: 4072074 - RNA, 15 nt, Vaccinia virus
caggauucuaaugau

SEQ ID NO: 4072075 - RNA, 14 nt, Vaccinia virus
caggcucuauuuuc

SEQ ID NO: 4072076 - RNA, 15 nt, Vaccinia virus
caggcucuauuuuca

SEQ ID NO: 4072077 - RNA, 13 nt, Vaccinia virus
cagggaaauuaaa

SEQ ID NO: 4072078 - RNA, 18 nt, Vaccinia virus
caggucuauucgacacua

SEQ ID NO: 4072079 - RNA, 19 nt, Vaccinia virus
cagguugcagcauagacuu

SEQ ID NO: 4072080 - RNA, 21 nt, Vaccinia virus
caguacuacuagguagaagaa

SEQ ID NO: 4072081 - RNA, 18 nt, Vaccinia virus
caguagcgagaaagcauc

SEQ ID NO: 4072082 - RNA, 17 nt, Vaccinia virus
caguaguauuggauggg

SEQ ID NO: 4072083 - RNA, 13 nt, Vaccinia virus
caguagucauugu

SEQ ID NO: 4072084 - RNA, 15 nt, Vaccinia virus
cagucugaacgcauu

SEQ ID NO: 4072085 - RNA, 14 nt, Vaccinia virus
cagucuuuaaugaa

SEQ ID NO: 4072086 - RNA, 22 nt, Vaccinia virus
caguuauguuuaacuuugaaau

SEQ ID NO: 4072087 - RNA, 17 nt, Vaccinia virus
caguuuauuauccacua

SEQ ID NO: 4072088 - RNA, 17 nt, Vaccinia virus
caguuucucaucuuuua

SEQ ID NO: 4072089 - RNA, 15 nt, Vaccinia virus
caguuucuguaauga

SEQ ID NO: 4072090 - RNA, 18 nt, Vaccinia virus
cauaaaacuaauauuuua

SEQ ID NO: 4072091 - RNA, 12 nt, Vaccinia virus
cauaaaaguugu

SEQ ID NO: 4072092 - RNA, 14 nt, Vaccinia virus
cauaaacacagaau

SEQ ID NO: 4072093 - RNA, 19 nt, Vaccinia virus
cauaaacuguaaaugauuu

SEQ ID NO: 4072094 - RNA, 22 nt, Vaccinia virus
cauaaauaacucuaauagcacg

SEQ ID NO: 4072095 - RNA, 18 nt, Vaccinia virus
cauaaauacacuuuuaua

SEQ ID NO: 4072096 - RNA, 19 nt, Vaccinia virus
cauaaaucaucuugauacu

SEQ ID NO: 4072097 - RNA, 20 nt, Vaccinia virus
cauaaauucaaccaugaauu

SEQ ID NO: 4072098 - RNA, 16 nt, Vaccinia virus
cauaacauaaaaacuc

SEQ ID NO: 4072099 - RNA, 21 nt, Vaccinia virus
cauaacaucuuucaucaucug

SEQ ID NO: 4072100 - RNA, 20 nt, Vaccinia virus
cauaacguccagaauguuua

SEQ ID NO: 4072101 - RNA, 15 nt, Vaccinia virus
cauaagauauccaua

SEQ ID NO: 4072102 - RNA, 14 nt, Vaccinia virus
cauaaguauauaau

SEQ ID NO: 4072103 - RNA, 16 nt, Vaccinia virus
cauaaguauguuugac

SEQ ID NO: 4072104 - RNA, 16 nt, Vaccinia virus
cauaauagaauguauu

SEQ ID NO: 4072105 - RNA, 18 nt, Vaccinia virus
cauaauaugagauguuua

SEQ ID NO: 4072106 - RNA, 19 nt, Vaccinia virus
uuauacagaagauuuaacu

SEQ ID NO: 4072107 - RNA, 12 nt, Vaccinia virus
uuauacaucuua

SEQ ID NO: 4072108 - RNA, 18 nt, Vaccinia virus
uuauaccaugucauuaac

SEQ ID NO: 4072109 - RNA, 22 nt, Vaccinia virus
uuauacgaaaaaaaucauuaaa

SEQ ID NO: 4072110 - RNA, 21 nt, Vaccinia virus
uuauacuucuccaacaucgau

SEQ ID NO: 4072111 - RNA, 15 nt, Vaccinia virus
uuauagaagauauca

SEQ ID NO: 4072112 - RNA, 14 nt, Vaccinia virus
uuauagaauuuaga

SEQ ID NO: 4072113 - RNA, 22 nt, Vaccinia virus
uuauaggcucuaaccauuuuca

SEQ ID NO: 4072114 - RNA, 20 nt, Vaccinia virus
uuauaguguuuaacaaagau

SEQ ID NO: 4072115 - RNA, 17 nt, Vaccinia virus
uuauauaaaaacauuuu

SEQ ID NO: 4072116 - RNA, 19 nt, Vaccinia virus
uuauaucguguucauuaac

SEQ ID NO: 4072117 - RNA, 18 nt, Vaccinia virus
uuauaucuauuuuauuca

SEQ ID NO: 4072118 - RNA, 23 nt, Vaccinia virus
uuauaugucucgcauaaacauua

SEQ ID NO: 4072119 - RNA, 17 nt, Vaccinia virus
uuauauuccucuauuaa

SEQ ID NO: 4072120 - RNA, 18 nt, Vaccinia virus
uuaucaaaacauauagau

SEQ ID NO: 4072121 - RNA, 17 nt, Vaccinia virus
uuaucaaaauuuggaaa

SEQ ID NO: 4072122 - RNA, 20 nt, Vaccinia virus
uuaucaagauguguauguuu

SEQ ID NO: 4072123 - RNA, 17 nt, Vaccinia virus
uuaucauuuugauuaau

SEQ ID NO: 4072124 - RNA, 13 nt, Vaccinia virus
uuauccaauacag

SEQ ID NO: 4072125 - RNA, 15 nt, Vaccinia virus
uuaucccuauauuca

SEQ ID NO: 4072126 - RNA, 22 nt, Vaccinia virus
uuauccguauuuccauaauaag

SEQ ID NO: 4072127 - RNA, 14 nt, Vaccinia virus
uuaucgacaucuug

SEQ ID NO: 4072128 - RNA, 17 nt, Vaccinia virus
uuaucgauucaucuaau

SEQ ID NO: 4072129 - RNA, 14 nt, Vaccinia virus
uuaucgcauacuag

SEQ ID NO: 4072130 - RNA, 16 nt, Vaccinia virus
uuaucgucuacgaaca

SEQ ID NO: 4072131 - RNA, 19 nt, Vaccinia virus
uuaucucagugcaaagauu

SEQ ID NO: 4072132 - RNA, 22 nt, Vaccinia virus
uuaucuuguuucgguggcugau

SEQ ID NO: 4072133 - RNA, 22 nt, Vaccinia virus
uuaugaaaaaguaaaugaugaa

SEQ ID NO: 4072134 - RNA, 23 nt, Vaccinia virus
uuaugaaacuuggaaacaucucu

SEQ ID NO: 4072135 - RNA, 22 nt, Vaccinia virus
uuaugauuagucacgacugaaa

SEQ ID NO: 4072136 - RNA, 16 nt, Vaccinia virus
uuaugccgaacuaaaa

SEQ ID NO: 4072137 - RNA, 17 nt, Vaccinia virus
uuauggagcaaacauua

SEQ ID NO: 4072138 - RNA, 19 nt, Vaccinia virus
uuauguaguaaagaugcua

SEQ ID NO: 4072139 - RNA, 19 nt, Vaccinia virus
uuauguauauguuuguaaa

SEQ ID NO: 4072140 - RNA, 19 nt, Vaccinia virus
uuauguguuauaagguacu

SEQ ID NO: 4072141 - RNA, 20 nt, Vaccinia virus
uuauguugccuaaacaagau

SEQ ID NO: 4072142 - RNA, 21 nt, Vaccinia virus
uuauuaaauccuuguuugaua

SEQ ID NO: 4072143 - RNA, 22 nt, Vaccinia virus
uuauuacauguuuucauauuca

SEQ ID NO: 4072144 - RNA, 17 nt, Vaccinia virus
uuauuacuaaacauuuu

SEQ ID NO: 4072145 - RNA, 17 nt, Vaccinia virus
uuauuagagauuucagc

SEQ ID NO: 4072146 - RNA, 23 nt, Vaccinia virus
uuauuagucgccgucucuauaaa

SEQ ID NO: 4072147 - RNA, 23 nt, Vaccinia virus
uuauuauagugguggaauucagu

SEQ ID NO: 4072148 - RNA, 18 nt, Vaccinia virus
uuauuaucccauuguaaa

SEQ ID NO: 4072149 - RNA, 14 nt, Vaccinia virus
uuauucauaauaag

SEQ ID NO: 4072150 - RNA, 22 nt, Vaccinia virus
uuauuccaauagaugucuuauu

SEQ ID NO: 4072151 - RNA, 11 nt, Vaccinia virus
uuauucuaaug

SEQ ID NO: 4072152 - RNA, 17 nt, Vaccinia virus
uuauugauaaagaucua

SEQ ID NO: 4072153 - RNA, 19 nt, Vaccinia virus
uuauugauugaaaaugaaa

SEQ ID NO: 4072154 - RNA, 14 nt, Vaccinia virus
uuauuguuugggua

SEQ ID NO: 4072155 - RNA, 18 nt, Vaccinia virus
uuauuucaaaauuauuua

SEQ ID NO: 4072156 - RNA, 22 nt, Vaccinia virus
uuauuucaaagacuaacuuaua

SEQ ID NO: 4072157 - RNA, 16 nt, Vaccinia virus
uuauuucucuauuaca

SEQ ID NO: 4072158 - RNA, 14 nt, Vaccinia virus
uuauuuuugaagau

SEQ ID NO: 4072159 - RNA, 19 nt, Vaccinia virus
uucaaaauuguaacaacaa

SEQ ID NO: 4072160 - RNA, 13 nt, Vaccinia virus
uucaacaaacuaa

SEQ ID NO: 4072161 - RNA, 10 nt, Vaccinia virus
uucaacaaug

SEQ ID NO: 4072162 - RNA, 23 nt, Vaccinia virus
uucaaccaugagugugaaacuaa

SEQ ID NO: 4072163 - RNA, 15 nt, Vaccinia virus
uucaaccauucauaa

SEQ ID NO: 4072164 - RNA, 23 nt, Vaccinia virus
uucaagagauaguuuucaucaga

SEQ ID NO: 4072165 - RNA, 14 nt, Vaccinia virus
uucaagauuaucuu

SEQ ID NO: 4072166 - RNA, 15 nt, Vaccinia virus
uucaauaucuauacu

SEQ ID NO: 4072167 - RNA, 22 nt, Vaccinia virus
uucaaugaacucaucgagauau

SEQ ID NO: 4072168 - RNA, 18 nt, Vaccinia virus
uucaaugugcucuuuaca

SEQ ID NO: 4072169 - RNA, 11 nt, Vaccinia virus
uucaauguuua

SEQ ID NO: 4072170 - RNA, 23 nt, Vaccinia virus
uucaauuacuacaaaaauuacuc

SEQ ID NO: 4072171 - RNA, 16 nt, Vaccinia virus
uucacguaaauacaaa

SEQ ID NO: 4072172 - RNA, 16 nt, Vaccinia virus
uucacuaaauaguuuu

SEQ ID NO: 4072173 - RNA, 19 nt, Vaccinia virus
uucacuauaucuaagaaac

SEQ ID NO: 4072174 - RNA, 22 nt, Vaccinia virus
uucacuuuuuauaauuuuacca

SEQ ID NO: 4072175 - RNA, 20 nt, Vaccinia virus
uucagaaagacgaauacaua

SEQ ID NO: 4072176 - RNA, 14 nt, Vaccinia virus
uucagaauuucuac

SEQ ID NO: 4072177 - RNA, 13 nt, Vaccinia virus
uucauaacaguga

SEQ ID NO: 4072178 - RNA, 19 nt, Vaccinia virus
uucauagcugagaauaucu

SEQ ID NO: 4072179 - RNA, 19 nt, Vaccinia virus
uucauaggauacucuauga

SEQ ID NO: 4072180 - RNA, 14 nt, Vaccinia virus
uucauagucauuaa

SEQ ID NO: 4072181 - RNA, 22 nt, Vaccinia virus
uucaucaauagacauaagaaau

SEQ ID NO: 4072182 - RNA, 17 nt, Vaccinia virus
uucaucagaaaugacuc

SEQ ID NO: 4072183 - RNA, 12 nt, Vaccinia virus
uucaucagauau

SEQ ID NO: 4072184 - RNA, 16 nt, Vaccinia virus
uucauccguuuccuua

SEQ ID NO: 4072185 - RNA, 18 nt, Vaccinia virus
uucaucggcauauuauua

SEQ ID NO: 4072186 - RNA, 23 nt, Vaccinia virus
uucaucguuuagaauaaaaugau

SEQ ID NO: 4072187 - RNA, 21 nt, Vaccinia virus
uucaugauuacggaauuauug

SEQ ID NO: 4072188 - RNA, 22 nt, Vaccinia virus
uucaugguaaggucuuagauau

SEQ ID NO: 4072189 - RNA, 12 nt, Vaccinia virus
uucauuaauuuc

SEQ ID NO: 4072190 - RNA, 12 nt, Vaccinia virus
uucauuacuaua

SEQ ID NO: 4072191 - RNA, 19 nt, Vaccinia virus
uucauuagauaacagugua

SEQ ID NO: 4072192 - RNA, 12 nt, Vaccinia virus
uucauuccuaua

SEQ ID NO: 4072193 - RNA, 12 nt, Vaccinia virus
uucauucguaaa

SEQ ID NO: 4072194 - RNA, 18 nt, Vaccinia virus
uuccaacauaauaaaagu

SEQ ID NO: 4072195 - RNA, 17 nt, Vaccinia virus
uuccaaccuacuacuag

SEQ ID NO: 4072196 - RNA, 18 nt, Vaccinia virus
uuccacagauaauauuag

SEQ ID NO: 4072197 - RNA, 16 nt, Vaccinia virus
uuccacauuaauacag

SEQ ID NO: 4072198 - RNA, 20 nt, Vaccinia virus
uuccacauuaauacagccua

SEQ ID NO: 4072199 - RNA, 21 nt, Vaccinia virus
uuccaccguauccauaaacaa

SEQ ID NO: 4072200 - RNA, 16 nt, Vaccinia virus
uuccaucaaacuguau

SEQ ID NO: 4072201 - RNA, 15 nt, Vaccinia virus
uuccaucuagacuau

SEQ ID NO: 4072202 - RNA, 21 nt, Vaccinia virus
uuccauuuauaucauccaaua

SEQ ID NO: 4072203 - RNA, 22 nt, Vaccinia virus
uucccauauccagacaacaauc

SEQ ID NO: 4072204 - RNA, 16 nt, Vaccinia virus
uucccauguacgacga

SEQ ID NO: 4072205 - RNA, 19 nt, Vaccinia virus
uucccuggaguaugagagu

SEQ ID NO: 4072206 - RNA, 18 nt, Vaccinia virus
uuccgguuugcaaaacaa

SEQ ID NO: 4072207 - RNA, 16 nt, Vaccinia virus
uuccguaucuguauuu

SEQ ID NO: 4072208 - RNA, 18 nt, Vaccinia virus
agagaacauauaaaugua

SEQ ID NO: 4072209 - RNA, 17 nt, Vaccinia virus
agagaagggaauuauug

SEQ ID NO: 4072210 - RNA, 14 nt, Vaccinia virus
agagacaaacuauu

SEQ ID NO: 4072211 - RNA, 19 nt, Vaccinia virus
agagacuuuauaacagaua

SEQ ID NO: 4072212 - RNA, 13 nt, Vaccinia virus
agagagaaauacu

SEQ ID NO: 4072213 - RNA, 14 nt, Vaccinia virus
agagagugcacuau

SEQ ID NO: 4072214 - RNA, 19 nt, Vaccinia virus
agagauaggucuaaugcau

SEQ ID NO: 4072215 - RNA, 15 nt, Vaccinia virus
agagaugucugaaac

SEQ ID NO: 4072216 - RNA, 15 nt, Vaccinia virus
agagauuuugaaaau

SEQ ID NO: 4072217 - RNA, 20 nt, Vaccinia virus
agagcauauuucauuuccaa

SEQ ID NO: 4072218 - RNA, 19 nt, Vaccinia virus
agagccuguaacaucucaa

SEQ ID NO: 4072219 - RNA, 18 nt, Vaccinia virus
agagcuauuuugacauac

SEQ ID NO: 4072220 - RNA, 17 nt, Vaccinia virus
agagcuucguauacucu

SEQ ID NO: 4072221 - RNA, 15 nt, Vaccinia virus
agaggcaaaagaugu

SEQ ID NO: 4072222 - RNA, 17 nt, Vaccinia virus
agaggcagucggauugg

SEQ ID NO: 4072223 - RNA, 14 nt, Vaccinia virus
agaggcauaaucaa

SEQ ID NO: 4072224 - RNA, 20 nt, Vaccinia virus
agagguucccaauuccaaag

SEQ ID NO: 4072225 - RNA, 20 nt, Vaccinia virus
agaguauccacuaaacuauu

SEQ ID NO: 4072226 - RNA, 13 nt, Vaccinia virus
agagucaauguuu

SEQ ID NO: 4072227 - RNA, 13 nt, Vaccinia virus
agaguccauguau

SEQ ID NO: 4072228 - RNA, 15 nt, Vaccinia virus
agagugauaauauau

SEQ ID NO: 4072229 - RNA, 19 nt, Vaccinia virus
agauaaacuaggauuuaaa

SEQ ID NO: 4072230 - RNA, 21 nt, Vaccinia virus
agauaaagaguccuauauauu

SEQ ID NO: 4072231 - RNA, 14 nt, Vaccinia virus
agauaaauuuauca

SEQ ID NO: 4072232 - RNA, 14 nt, Vaccinia virus
agauaacaguguaa

SEQ ID NO: 4072233 - RNA, 16 nt, Vaccinia virus
agauaauaacagagua

SEQ ID NO: 4072234 - RNA, 23 nt, Vaccinia virus
agauaauagggagaaaugacauu

SEQ ID NO: 4072235 - RNA, 21 nt, Vaccinia virus
agauacagauguuacaaaugu

SEQ ID NO: 4072236 - RNA, 14 nt, Vaccinia virus
agauacaucuauau

SEQ ID NO: 4072237 - RNA, 17 nt, Vaccinia virus
agauacauuguaugaug

SEQ ID NO: 4072238 - RNA, 13 nt, Vaccinia virus
agauacguauuag

SEQ ID NO: 4072239 - RNA, 16 nt, Vaccinia virus
agauacuaguaugaug

SEQ ID NO: 4072240 - RNA, 19 nt, Vaccinia virus
agauacuaucaaaauaucu

SEQ ID NO: 4072241 - RNA, 22 nt, Vaccinia virus
agauacuguguaaagaaauggu

SEQ ID NO: 4072242 - RNA, 14 nt, Vaccinia virus
agauagaaaugaau

SEQ ID NO: 4072243 - RNA, 17 nt, Vaccinia virus
agauagacgaggaaaca

SEQ ID NO: 4072244 - RNA, 17 nt, Vaccinia virus
agauagagacuccaaac

SEQ ID NO: 4072245 - RNA, 19 nt, Vaccinia virus
agauagagaugagaugucu

SEQ ID NO: 4072246 - RNA, 19 nt, Vaccinia virus
agauagcguauaucucuau

SEQ ID NO: 4072247 - RNA, 18 nt, Vaccinia virus
agauaguuuuaguuucca

SEQ ID NO: 4072248 - RNA, 17 nt, Vaccinia virus
agauaguuuuuuucauu

SEQ ID NO: 4072249 - RNA, 23 nt, Vaccinia virus
agauauaaaugacaaguauaaug

SEQ ID NO: 4072250 - RNA, 19 nt, Vaccinia virus
agauauacgcuaucuauau

SEQ ID NO: 4072251 - RNA, 22 nt, Vaccinia virus
agauauagcaccaucuauucca

SEQ ID NO: 4072252 - RNA, 19 nt, Vaccinia virus
agauauauauggucuuaug

SEQ ID NO: 4072253 - RNA, 23 nt, Vaccinia virus
agauaucucuggauauaucacaa

SEQ ID NO: 4072254 - RNA, 19 nt, Vaccinia virus
agauaucuucuuuuuucca

SEQ ID NO: 4072255 - RNA, 18 nt, Vaccinia virus
agauaugauaaaacuauu

SEQ ID NO: 4072256 - RNA, 17 nt, Vaccinia virus
agauauggucaaaucaa

SEQ ID NO: 4072257 - RNA, 13 nt, Vaccinia virus
agauauuaucuau

SEQ ID NO: 4072258 - RNA, 22 nt, Vaccinia virus
agauauuuccauuuaucuacug

SEQ ID NO: 4072259 - RNA, 21 nt, Vaccinia virus
agauauuuuaugggaaaaacg

SEQ ID NO: 4072260 - RNA, 15 nt, Vaccinia virus
agaucaagaaacauu

SEQ ID NO: 4072261 - RNA, 15 nt, Vaccinia virus
agaucauuaaauguu

SEQ ID NO: 4072262 - RNA, 20 nt, Vaccinia virus
agauccuuguucuauuccca

SEQ ID NO: 4072263 - RNA, 20 nt, Vaccinia virus
agaucuaaagauaaucuucu

SEQ ID NO: 4072264 - RNA, 15 nt, Vaccinia virus
agaucuaauuuuguu

SEQ ID NO: 4072265 - RNA, 19 nt, Vaccinia virus
agaucugaauuaaauaugu

SEQ ID NO: 4072266 - RNA, 18 nt, Vaccinia virus
agaucugagaauggauga

SEQ ID NO: 4072267 - RNA, 22 nt, Vaccinia virus
agaugaaaaauuuuccacaucu

SEQ ID NO: 4072268 - RNA, 22 nt, Vaccinia virus
agaugaaucaaauguaacuauu

SEQ ID NO: 4072269 - RNA, 16 nt, Vaccinia virus
agaugauaaaaacauu

SEQ ID NO: 4072270 - RNA, 22 nt, Vaccinia virus
agaugauuuggcuauuaaacag

SEQ ID NO: 4072271 - RNA, 15 nt, Vaccinia virus
agaugcaaacauuau

SEQ ID NO: 4072272 - RNA, 22 nt, Vaccinia virus
agaugcuaguguaccaauaugu

SEQ ID NO: 4072273 - RNA, 13 nt, Vaccinia virus
agaugcuauguau

SEQ ID NO: 4072274 - RNA, 16 nt, Vaccinia virus
agauguaaguaugaug

SEQ ID NO: 4072275 - RNA, 18 nt, Vaccinia virus
agauguaaguaugauguc

SEQ ID NO: 4072276 - RNA, 22 nt, Vaccinia virus
agauguauuagacaaaacuauu

SEQ ID NO: 4072277 - RNA, 17 nt, Vaccinia virus
agauguuaaaugaauua

SEQ ID NO: 4072278 - RNA, 21 nt, Vaccinia virus
agauguuagaaaaaaugaugc

SEQ ID NO: 4072279 - RNA, 19 nt, Vaccinia virus
agauguuuagaaaauggau

SEQ ID NO: 4072280 - RNA, 20 nt, Vaccinia virus
agauuagacauaucagauga

SEQ ID NO: 4072281 - RNA, 23 nt, Vaccinia virus
agauuagucagaccauucuuggu

SEQ ID NO: 4072282 - RNA, 19 nt, Vaccinia virus
agauuaucaaaaucuuguc

SEQ ID NO: 4072283 - RNA, 19 nt, Vaccinia virus
agauuauggagcaaacauu

SEQ ID NO: 4072284 - RNA, 15 nt, Vaccinia virus
agauuccuuuucuac

SEQ ID NO: 4072285 - RNA, 22 nt, Vaccinia virus
agauucucauuugauaaaaauu

SEQ ID NO: 4072286 - RNA, 17 nt, Vaccinia virus
agauugaucauguagaa

SEQ ID NO: 4072287 - RNA, 13 nt, Vaccinia virus
agauugcauggug

SEQ ID NO: 4072288 - RNA, 20 nt, Vaccinia virus
agauuggguuaauaaauaca

SEQ ID NO: 4072289 - RNA, 14 nt, Vaccinia virus
agauuguucucuua

SEQ ID NO: 4072290 - RNA, 21 nt, Vaccinia virus
agauuuaaggaaccagaauga

SEQ ID NO: 4072291 - RNA, 12 nt, Vaccinia virus
agauuuagaaau

SEQ ID NO: 4072292 - RNA, 14 nt, Vaccinia virus
agauuuagaaaugu

SEQ ID NO: 4072293 - RNA, 23 nt, Vaccinia virus
agauuuauugacggcuacucuaa

SEQ ID NO: 4072294 - RNA, 15 nt, Vaccinia virus
agauuuccaaagaua

SEQ ID NO: 4072295 - RNA, 18 nt, Vaccinia virus
agauuucugacaauuacu

SEQ ID NO: 4072296 - RNA, 13 nt, Vaccinia virus
agauuuucaauua

SEQ ID NO: 4072297 - RNA, 16 nt, Vaccinia virus
agauuuuguauuaccu

SEQ ID NO: 4072298 - RNA, 12 nt, Vaccinia virus
agcaaaaaauga

SEQ ID NO: 4072299 - RNA, 12 nt, Vaccinia virus
agcaaaaauaua

SEQ ID NO: 4072300 - RNA, 14 nt, Vaccinia virus
agcaaaauaauuaa

SEQ ID NO: 4072301 - RNA, 12 nt, Vaccinia virus
agcaaagaauga

SEQ ID NO: 4072302 - RNA, 21 nt, Vaccinia virus
agcaagacuaacacacaaugu

SEQ ID NO: 4072303 - RNA, 14 nt, Vaccinia virus
agcaagauacuuua

SEQ ID NO: 4072304 - RNA, 18 nt, Vaccinia virus
agcaagauuuuuaaacaa

SEQ ID NO: 4072305 - RNA, 14 nt, Vaccinia virus
agcaauucauguac

SEQ ID NO: 4072306 - RNA, 17 nt, Vaccinia virus
aaauuccccauauacca

SEQ ID NO: 4072307 - RNA, 17 nt, Vaccinia virus
aaauuccgcuacuaaua

SEQ ID NO: 4072308 - RNA, 14 nt, Vaccinia virus
aaauugauaaugag

SEQ ID NO: 4072309 - RNA, 22 nt, Vaccinia virus
aaauugauagagaguucauuua

SEQ ID NO: 4072310 - RNA, 22 nt, Vaccinia virus
aaauugcgacacuauucaugua

SEQ ID NO: 4072311 - RNA, 23 nt, Vaccinia virus
aaauugcgacacuauucauguaa

SEQ ID NO: 4072312 - RNA, 20 nt, Vaccinia virus
aaauugguauaaauguugua

SEQ ID NO: 4072313 - RNA, 21 nt, Vaccinia virus
aaauuggucuguguuacauau

SEQ ID NO: 4072314 - RNA, 22 nt, Vaccinia virus
aaauugucugaugaagaauuau

SEQ ID NO: 4072315 - RNA, 19 nt, Vaccinia virus
aaauuugauuguauacuuu

SEQ ID NO: 4072316 - RNA, 15 nt, Vaccinia virus
aaauuugucauuuau

SEQ ID NO: 4072317 - RNA, 22 nt, Vaccinia virus
aaauuuguucguccgucaugau

SEQ ID NO: 4072318 - RNA, 11 nt, Vaccinia virus
aaauuuucuaa

SEQ ID NO: 4072319 - RNA, 16 nt, Vaccinia virus
aaauuuuuaauccaaa

SEQ ID NO: 4072320 - RNA, 11 nt, Vaccinia virus
aacaaaacaau

SEQ ID NO: 4072321 - RNA, 12 nt, Vaccinia virus
aacaaaauacuc

SEQ ID NO: 4072322 - RNA, 23 nt, Vaccinia virus
aacaaaaucuaacagauacaaau

SEQ ID NO: 4072323 - RNA, 15 nt, Vaccinia virus
aacaaacaucucacc

SEQ ID NO: 4072324 - RNA, 16 nt, Vaccinia virus
aacaaacuauacaaga

SEQ ID NO: 4072325 - RNA, 19 nt, Vaccinia virus
aacaaauucugcaauaucu

SEQ ID NO: 4072326 - RNA, 21 nt, Vaccinia virus
aacaaauucuuuguugaacgu

SEQ ID NO: 4072327 - RNA, 16 nt, Vaccinia virus
aacaacucguuauuac

SEQ ID NO: 4072328 - RNA, 23 nt, Vaccinia virus
aacaagaucaugaacacgaugau

SEQ ID NO: 4072329 - RNA, 23 nt, Vaccinia virus
aacaaggcgauuauaaaguggaa

SEQ ID NO: 4072330 - RNA, 19 nt, Vaccinia virus
aacaaguuuggauuaucgu

SEQ ID NO: 4072331 - RNA, 22 nt, Vaccinia virus
aacaauaguuuguacugcaaaa

SEQ ID NO: 4072332 - RNA, 15 nt, Vaccinia virus
aacaauaugcaaaua

SEQ ID NO: 4072333 - RNA, 21 nt, Vaccinia virus
aacaauauuaaggagauucua

SEQ ID NO: 4072334 - RNA, 20 nt, Vaccinia virus
aacaaucguuaauaaaucug

SEQ ID NO: 4072335 - RNA, 16 nt, Vaccinia virus
aacaauguauacaaau

SEQ ID NO: 4072336 - RNA, 11 nt, Vaccinia virus
aacaauguuug

SEQ ID NO: 4072337 - RNA, 17 nt, Vaccinia virus
aacaauugucuguaaac

SEQ ID NO: 4072338 - RNA, 22 nt, Vaccinia virus
aacaauuuuguauuauucugaa

SEQ ID NO: 4072339 - RNA, 16 nt, Vaccinia virus
aacaauuuuuuguucu

SEQ ID NO: 4072340 - RNA, 16 nt, Vaccinia virus
aacacacacugagaaa

SEQ ID NO: 4072341 - RNA, 23 nt, Vaccinia virus
aacacacacugagaaacagcaua

SEQ ID NO: 4072342 - RNA, 15 nt, Vaccinia virus
aacacaucaauuucg

SEQ ID NO: 4072343 - RNA, 14 nt, Vaccinia virus
aacacauuaaacaa

SEQ ID NO: 4072344 - RNA, 21 nt, Vaccinia virus
aacacccauuuauuguacaaa

SEQ ID NO: 4072345 - RNA, 20 nt, Vaccinia virus
aacacuauacucauauuaau

SEQ ID NO: 4072346 - RNA, 17 nt, Vaccinia virus
aacacugguaacuauau

SEQ ID NO: 4072347 - RNA, 13 nt, Vaccinia virus
aacagaaaaaaca

SEQ ID NO: 4072348 - RNA, 17 nt, Vaccinia virus
aacagaaaaaacaaugu

SEQ ID NO: 4072349 - RNA, 18 nt, Vaccinia virus
aacagaaacuagaggaga

SEQ ID NO: 4072350 - RNA, 22 nt, Vaccinia virus
aacagaauaaacaaaauaaugu

SEQ ID NO: 4072351 - RNA, 19 nt, Vaccinia virus
aacagagccaucuguaaaa

SEQ ID NO: 4072352 - RNA, 18 nt, Vaccinia virus
aacagaguagauauuaau

SEQ ID NO: 4072353 - RNA, 23 nt, Vaccinia virus
aacaggaaacgcuguauauggaa

SEQ ID NO: 4072354 - RNA, 15 nt, Vaccinia virus
aacaggucauauucu

SEQ ID NO: 4072355 - RNA, 13 nt, Vaccinia virus
aacaguaaaagaa

SEQ ID NO: 4072356 - RNA, 14 nt, Vaccinia virus
aacaguaucauuua

SEQ ID NO: 4072357 - RNA, 16 nt, Vaccinia virus
aacaguucuaccacca

SEQ ID NO: 4072358 - RNA, 18 nt, Vaccinia virus
aacauacuauuguuuauu

SEQ ID NO: 4072359 - RNA, 13 nt, Vaccinia virus
aacauaugauauu

SEQ ID NO: 4072360 - RNA, 10 nt, Vaccinia virus
aacauauucu

SEQ ID NO: 4072361 - RNA, 12 nt, Vaccinia virus
aacauauucuca

SEQ ID NO: 4072362 - RNA, 17 nt, Vaccinia virus
aacaucaaaaaauuaua

SEQ ID NO: 4072363 - RNA, 13 nt, Vaccinia virus
aacaucaaacaug

SEQ ID NO: 4072364 - RNA, 17 nt, Vaccinia virus
aacaucaacacuuauau

SEQ ID NO: 4072365 - RNA, 21 nt, Vaccinia virus
aacaucauuauuuuugaagau

SEQ ID NO: 4072366 - RNA, 20 nt, Vaccinia virus
aacauccauuuauagaauuu

SEQ ID NO: 4072367 - RNA, 24 nt, Vaccinia virus
aacaucgauucccauaugauguuu

SEQ ID NO: 4072368 - RNA, 19 nt, Vaccinia virus
aacaucuagccucgguaau

SEQ ID NO: 4072369 - RNA, 14 nt, Vaccinia virus
aacauggaaguuau

SEQ ID NO: 4072370 - RNA, 20 nt, Vaccinia virus
aacauggggauugaaaauag

SEQ ID NO: 4072371 - RNA, 18 nt, Vaccinia virus
aacaugucucuaaaugug

SEQ ID NO: 4072372 - RNA, 20 nt, Vaccinia virus
aacauguuacuauagcauua

SEQ ID NO: 4072373 - RNA, 13 nt, Vaccinia virus
aacauuaggaaau

SEQ ID NO: 4072374 - RNA, 17 nt, Vaccinia virus
aacauucugauuuaaga

SEQ ID NO: 4072375 - RNA, 13 nt, Vaccinia virus
aacauuugcauua

SEQ ID NO: 4072376 - RNA, 21 nt, Vaccinia virus
aacauuuguguuuguaucuua

SEQ ID NO: 4072377 - RNA, 21 nt, Vaccinia virus
aacauuuuuauaaacaugaaa

SEQ ID NO: 4072378 - RNA, 11 nt, Vaccinia virus
aaccaaacauu

SEQ ID NO: 4072379 - RNA, 20 nt, Vaccinia virus
aaccaacgucauaaaaaugu

SEQ ID NO: 4072380 - RNA, 23 nt, Vaccinia virus
aaccaaggacuuuguagaaauau

SEQ ID NO: 4072381 - RNA, 23 nt, Vaccinia virus
aaccaauuacugauaauguagaa

SEQ ID NO: 4072382 - RNA, 16 nt, Vaccinia virus
aaccacggaucguaau

SEQ ID NO: 4072383 - RNA, 22 nt, Vaccinia virus
aaccaguauguuuaauaugaaa

SEQ ID NO: 4072384 - RNA, 12 nt, Vaccinia virus
aaccaguauuug

SEQ ID NO: 4072385 - RNA, 20 nt, Vaccinia virus
aaccaugcuacaaucauuau

SEQ ID NO: 4072386 - RNA, 14 nt, Vaccinia virus
aaccauucauuaau

SEQ ID NO: 4072387 - RNA, 20 nt, Vaccinia virus
aaccccauauaauguagaca

SEQ ID NO: 4072388 - RNA, 13 nt, Vaccinia virus
aaccgaaaguaaa

SEQ ID NO: 4072389 - RNA, 15 nt, Vaccinia virus
aaccgauaauaaugu

SEQ ID NO: 4072390 - RNA, 21 nt, Vaccinia virus
aaccguuauuuauagcagaua

SEQ ID NO: 4072391 - RNA, 17 nt, Vaccinia virus
aaccuaacucagucaau

SEQ ID NO: 4072392 - RNA, 15 nt, Vaccinia virus
aaccuauaaugucca

SEQ ID NO: 4072393 - RNA, 20 nt, Vaccinia virus
aaccucacuguuaaaaauau

SEQ ID NO: 4072394 - RNA, 12 nt, Vaccinia virus
aaccuucuuauu

SEQ ID NO: 4072395 - RNA, 17 nt, Vaccinia virus
aacgacuuauaauuaau

SEQ ID NO: 4072396 - RNA, 19 nt, Vaccinia virus
aacgagauaucuuguuaca

SEQ ID NO: 4072397 - RNA, 20 nt, Vaccinia virus
aacgaguucaaauaugaaau

SEQ ID NO: 4072398 - RNA, 19 nt, Vaccinia virus
aacgaugccuuuuguaaau

SEQ ID NO: 4072399 - RNA, 18 nt, Vaccinia virus
aacgauuagcuacagagu

SEQ ID NO: 4072400 - RNA, 23 nt, Vaccinia virus
aacgauugguauucguacaggua

SEQ ID NO: 4072401 - RNA, 19 nt, Vaccinia virus
aacgauuuaauuacagagu

SEQ ID NO: 4072402 - RNA, 21 nt, Vaccinia virus
aacgauuugaucgauuacauu

SEQ ID NO: 4072403 - RNA, 18 nt, Vaccinia virus
aacgcuacuauauauuau

SEQ ID NO: 4072404 - RNA, 18 nt, Vaccinia virus
aacguacaaauggauaaa

SEQ ID NO: 4072405 - RNA, 14 nt, Vaccinia virus
aacguauaaaugac

SEQ ID NO: 4072406 - RNA, 16 nt, Vaccinia virus
aacguauauuuuauuu

SEQ ID NO: 4072407 - RNA, 19 nt, Vaccinia virus
aacgucgguauuauauuau

SEQ ID NO: 4072408 - RNA, 21 nt, Vaccinia virus
aacgugauuauuauugucaua

SEQ ID NO: 4072409 - RNA, 16 nt, Vaccinia virus
aacguuccguaucugu

SEQ ID NO: 4072410 - RNA, 15 nt, Vaccinia virus
aacuaauauuaggaa

SEQ ID NO: 4072411 - RNA, 15 nt, Vaccinia virus
aacuacgucaagacu

SEQ ID NO: 4072412 - RNA, 19 nt, Vaccinia virus
aacuauacgaaauaaauau

SEQ ID NO: 4072413 - RNA, 15 nt, Vaccinia virus
aacuauagacaaaau

SEQ ID NO: 4072414 - RNA, 18 nt, Vaccinia virus
aacuauauucuuagaaau

SEQ ID NO: 4072415 - RNA, 16 nt, Vaccinia virus
aacuaucgauaguaau

SEQ ID NO: 4072416 - RNA, 15 nt, Vaccinia virus
aacuaucuaaaugua

SEQ ID NO: 4072417 - RNA, 15 nt, Vaccinia virus
aacuaugucaguagu

SEQ ID NO: 4072418 - RNA, 21 nt, Vaccinia virus
aacuauugaagccauugaaaa

SEQ ID NO: 4072419 - RNA, 15 nt, Vaccinia virus
aacuauuguuuuguu

SEQ ID NO: 4072420 - RNA, 14 nt, Vaccinia virus
aacuauuucuaaga

SEQ ID NO: 4072421 - RNA, 15 nt, Vaccinia virus
aacuauuuuuaacuu

SEQ ID NO: 4072422 - RNA, 18 nt, Vaccinia virus
aacucacauuucaaauau

SEQ ID NO: 4072423 - RNA, 19 nt, Vaccinia virus
aacucacauuucaaauaua

SEQ ID NO: 4072424 - RNA, 14 nt, Vaccinia virus
aacucaucgagaua

SEQ ID NO: 4072425 - RNA, 15 nt, Vaccinia virus
aacucauucuauaua

SEQ ID NO: 4072426 - RNA, 20 nt, Vaccinia virus
aacucuauaguuuguuuuca

SEQ ID NO: 4072427 - RNA, 20 nt, Vaccinia virus
aacucucuucuauaaaaaug

SEQ ID NO: 4072428 - RNA, 16 nt, Vaccinia virus
aacucuugaagaugau

SEQ ID NO: 4072429 - RNA, 22 nt, Vaccinia virus
aaucuaacauugauuuuaaaau

SEQ ID NO: 4072430 - RNA, 19 nt, Vaccinia virus
aaucuaagaaauuuaaaau

SEQ ID NO: 4072431 - RNA, 12 nt, Vaccinia virus
aaucuaccaguc

SEQ ID NO: 4072432 - RNA, 21 nt, Vaccinia virus
aaucuaguaaaucaacugaua

SEQ ID NO: 4072433 - RNA, 18 nt, Vaccinia virus
aaucuauaucauguagaa

SEQ ID NO: 4072434 - RNA, 17 nt, Vaccinia virus
aaucuaucuuauauaca

SEQ ID NO: 4072435 - RNA, 15 nt, Vaccinia virus
aaucuaugauauugu

SEQ ID NO: 4072436 - RNA, 16 nt, Vaccinia virus
aaucuauuagaauugg

SEQ ID NO: 4072437 - RNA, 16 nt, Vaccinia virus
aaucuauuuuggucau

SEQ ID NO: 4072438 - RNA, 13 nt, Vaccinia virus
aaucucacaauau

SEQ ID NO: 4072439 - RNA, 22 nt, Vaccinia virus
aaucuccgcaauacauuucuca

SEQ ID NO: 4072440 - RNA, 15 nt, Vaccinia virus
aaucucuauuugcca

SEQ ID NO: 4072441 - RNA, 17 nt, Vaccinia virus
aaucucuguuauuuccu

SEQ ID NO: 4072442 - RNA, 22 nt, Vaccinia virus
aaucuguacuauguguuaaaaa

SEQ ID NO: 4072443 - RNA, 22 nt, Vaccinia virus
aaucuuuagacgguugagaaaa

SEQ ID NO: 4072444 - RNA, 20 nt, Vaccinia virus
aaugaaacggugaauacaau

SEQ ID NO: 4072445 - RNA, 12 nt, Vaccinia virus
aaugaaaugaua

SEQ ID NO: 4072446 - RNA, 17 nt, Vaccinia virus
aaugaaauucuuguuua

SEQ ID NO: 4072447 - RNA, 19 nt, Vaccinia virus
aaugaacauaguaagaaau

SEQ ID NO: 4072448 - RNA, 14 nt, Vaccinia virus
aaugaaugaauaua

SEQ ID NO: 4072449 - RNA, 20 nt, Vaccinia virus
aaugacaaaaucaacuacau

SEQ ID NO: 4072450 - RNA, 13 nt, Vaccinia virus
aaugacaaacauu

SEQ ID NO: 4072451 - RNA, 14 nt, Vaccinia virus
aaugacauggaaau

SEQ ID NO: 4072452 - RNA, 18 nt, Vaccinia virus
aaugagauguuaaaugaa

SEQ ID NO: 4072453 - RNA, 22 nt, Vaccinia virus
aaugaguaagacaauaggaaau

SEQ ID NO: 4072454 - RNA, 14 nt, Vaccinia virus
aaugaguauuuaua

SEQ ID NO: 4072455 - RNA, 18 nt, Vaccinia virus
aaugauaaugauacagua

SEQ ID NO: 4072456 - RNA, 20 nt, Vaccinia virus
aaugaugaugaugaaaugga

SEQ ID NO: 4072457 - RNA, 23 nt, Vaccinia virus
aaugaugccucugccuuuuuaua

SEQ ID NO: 4072458 - RNA, 18 nt, Vaccinia virus
aaugcacacaguauuauc

SEQ ID NO: 4072459 - RNA, 14 nt, Vaccinia virus
aaugcagaaaugau

SEQ ID NO: 4072460 - RNA, 15 nt, Vaccinia virus
aaugcauuaaauaau

SEQ ID NO: 4072461 - RNA, 18 nt, Vaccinia virus
aaugcauuuuauaccgaa

SEQ ID NO: 4072462 - RNA, 15 nt, Vaccinia virus
aaugccacaaaugaa

SEQ ID NO: 4072463 - RNA, 16 nt, Vaccinia virus
aaugcccguaaagaua

SEQ ID NO: 4072464 - RNA, 15 nt, Vaccinia virus
aaugcgccaaaguua

SEQ ID NO: 4072465 - RNA, 22 nt, Vaccinia virus
aaugcgcgaaccaaaaugugau

SEQ ID NO: 4072466 - RNA, 17 nt, Vaccinia virus
aaugcggauuuagaaaa

SEQ ID NO: 4072467 - RNA, 18 nt, Vaccinia virus
aaugcucaguaaauguau

SEQ ID NO: 4072468 - RNA, 23 nt, Vaccinia virus
aaugcuucucuguuuaaugaauu

SEQ ID NO: 4072469 - RNA, 14 nt, Vaccinia virus
aaugcuugaaaaug

SEQ ID NO: 4072470 - RNA, 15 nt, Vaccinia virus
aauggagaaauacuu

SEQ ID NO: 4072471 - RNA, 16 nt, Vaccinia virus
aauggauaauuuccau

SEQ ID NO: 4072472 - RNA, 13 nt, Vaccinia virus
aauggauccacug

SEQ ID NO: 4072473 - RNA, 17 nt, Vaccinia virus
aauggaucuaguauuau

SEQ ID NO: 4072474 - RNA, 20 nt, Vaccinia virus
aauggaugaagcauauuacu

SEQ ID NO: 4072475 - RNA, 19 nt, Vaccinia virus
aauggaugaggaagugaua

SEQ ID NO: 4072476 - RNA, 16 nt, Vaccinia virus
aauggugguaaaacua

SEQ ID NO: 4072477 - RNA, 16 nt, Vaccinia virus
aauguaauuuuuguuu

SEQ ID NO: 4072478 - RNA, 16 nt, Vaccinia virus
aauguacauucgaaaa

SEQ ID NO: 4072479 - RNA, 15 nt, Vaccinia virus
aauguaguaaauaua

SEQ ID NO: 4072480 - RNA, 17 nt, Vaccinia virus
aauguauggcuucaaga

SEQ ID NO: 4072481 - RNA, 22 nt, Vaccinia virus
aauguauuaguuaaauauuaaa

SEQ ID NO: 4072482 - RNA, 16 nt, Vaccinia virus
aaugucaggaaaugua

SEQ ID NO: 4072483 - RNA, 23 nt, Vaccinia virus
aauguccaaaucuaguuguggaa

SEQ ID NO: 4072484 - RNA, 15 nt, Vaccinia virus
aaugucccuucaaga

SEQ ID NO: 4072485 - RNA, 15 nt, Vaccinia virus
aaugucucucauaau

SEQ ID NO: 4072486 - RNA, 22 nt, Vaccinia virus
aaugugauucucugaaaaugua

SEQ ID NO: 4072487 - RNA, 17 nt, Vaccinia virus
aauguguauaaaauaua

SEQ ID NO: 4072488 - RNA, 16 nt, Vaccinia virus
aauguguuaaaaagaa

SEQ ID NO: 4072489 - RNA, 21 nt, Vaccinia virus
aauguuaagcauauccugaau

SEQ ID NO: 4072490 - RNA, 15 nt, Vaccinia virus
aauguucucaagaac

SEQ ID NO: 4072491 - RNA, 20 nt, Vaccinia virus
aauguuguagguuaaaauua

SEQ ID NO: 4072492 - RNA, 23 nt, Vaccinia virus
aauguuuuugaaacuagaaucgu

SEQ ID NO: 4072493 - RNA, 13 nt, Vaccinia virus
aauguuuuuguuu

SEQ ID NO: 4072494 - RNA, 15 nt, Vaccinia virus
aauuaaaaccaagua

SEQ ID NO: 4072495 - RNA, 17 nt, Vaccinia virus
aauuaauaauauaaaau

SEQ ID NO: 4072496 - RNA, 18 nt, Vaccinia virus
aauuaaucuaguagaaaa

SEQ ID NO: 4072497 - RNA, 15 nt, Vaccinia virus
aauuaaugagauugu

SEQ ID NO: 4072498 - RNA, 16 nt, Vaccinia virus
aauuacauagaugaua

SEQ ID NO: 4072499 - RNA, 18 nt, Vaccinia virus
aauuacugauaauguaga

SEQ ID NO: 4072500 - RNA, 19 nt, Vaccinia virus
aauuacugauaauguagaa

SEQ ID NO: 4072501 - RNA, 15 nt, Vaccinia virus
aauuagaaagugaua

SEQ ID NO: 4072502 - RNA, 16 nt, Vaccinia virus
aauuagaaauucccaa

SEQ ID NO: 4072503 - RNA, 20 nt, Vaccinia virus
aauuagagacuuuauaacag

SEQ ID NO: 4072504 - RNA, 14 nt, Vaccinia virus
aauuagauuucgaa

SEQ ID NO: 4072505 - RNA, 15 nt, Vaccinia virus
aauuaggagaacuua

SEQ ID NO: 4072506 - RNA, 15 nt, Vaccinia virus
aauuaguaacuguua

SEQ ID NO: 4072507 - RNA, 21 nt, Vaccinia virus
aauuaguagaaucaaaggaua

SEQ ID NO: 4072508 - RNA, 16 nt, Vaccinia virus
aauuaguuuuucuuua

SEQ ID NO: 4072509 - RNA, 15 nt, Vaccinia virus
aauuauaaaauuaua

SEQ ID NO: 4072510 - RNA, 16 nt, Vaccinia virus
aauuauaagaaauaua

SEQ ID NO: 4072511 - RNA, 14 nt, Vaccinia virus
aauuauagacuuga

SEQ ID NO: 4072512 - RNA, 22 nt, Vaccinia virus
aauuauaguaagccaauuccaa

SEQ ID NO: 4072513 - RNA, 21 nt, Vaccinia virus
aauuaucaaauacuucaaaau

SEQ ID NO: 4072514 - RNA, 19 nt, Vaccinia virus
aauuaucacauauuaaaaa

SEQ ID NO: 4072515 - RNA, 12 nt, Vaccinia virus
aauuaugauaca

SEQ ID NO: 4072516 - RNA, 15 nt, Vaccinia virus
aauuaugauagaaau

SEQ ID NO: 4072517 - RNA, 12 nt, Vaccinia virus
aauuaugaugau

SEQ ID NO: 4072518 - RNA, 15 nt, Vaccinia virus
aauuauguaaaacau

SEQ ID NO: 4072519 - RNA, 13 nt, Vaccinia virus
aauuauuagaaua

SEQ ID NO: 4072520 - RNA, 19 nt, Vaccinia virus
aauuauuagaauaagagug

SEQ ID NO: 4072521 - RNA, 15 nt, Vaccinia virus
aauuauucuaucaau

SEQ ID NO: 4072522 - RNA, 20 nt, Vaccinia virus
aauuauuuaguuuuuucuuu

SEQ ID NO: 4072523 - RNA, 15 nt, Vaccinia virus
aauuauuuuguaaga

SEQ ID NO: 4072524 - RNA, 13 nt, Vaccinia virus
aauucaaauagau

SEQ ID NO: 4072525 - RNA, 18 nt, Vaccinia virus
aauucagcgguaaagaua

SEQ ID NO: 4072526 - RNA, 16 nt, Vaccinia virus
aauucaggaacuauaa

SEQ ID NO: 4072527 - RNA, 13 nt, Vaccinia virus
aauucaucaucug

SEQ ID NO: 4072528 - RNA, 13 nt, Vaccinia virus
aauucaucuucua

SEQ ID NO: 4072529 - RNA, 14 nt, Vaccinia virus
aauucauuccuaua

SEQ ID NO: 4072530 - RNA, 13 nt, Vaccinia virus
aauucauuuccau

SEQ ID NO: 4072531 - RNA, 18 nt, Vaccinia virus
aauucgguuauaaaugaa

SEQ ID NO: 4072532 - RNA, 20 nt, Vaccinia virus
aauucuacaacauuauuaua

SEQ ID NO: 4072533 - RNA, 17 nt, Vaccinia virus
aauucuaggcucaguau

SEQ ID NO: 4072534 - RNA, 23 nt, Vaccinia virus
aauucuauauauguuuucaucau

SEQ ID NO: 4072535 - RNA, 21 nt, Vaccinia virus
aauucuauccaagauacuuau

SEQ ID NO: 4072536 - RNA, 16 nt, Vaccinia virus
aauucuauuagaucau

SEQ ID NO: 4072537 - RNA, 17 nt, Vaccinia virus
aauucuuaucaauaaca

SEQ ID NO: 4072538 - RNA, 21 nt, Vaccinia virus
aauugaauugcgauuauaaga

SEQ ID NO: 4072539 - RNA, 17 nt, Vaccinia virus
aauugaccguguaauau

SEQ ID NO: 4072540 - RNA, 21 nt, Vaccinia virus
aauugaucaagaguaacuauu

SEQ ID NO: 4072541 - RNA, 14 nt, Vaccinia virus
aauugauucuuauu

SEQ ID NO: 4072542 - RNA, 14 nt, Vaccinia virus
aauuggaacacaag

SEQ ID NO: 4072543 - RNA, 21 nt, Vaccinia virus
aauugguuuaugauguauaau

SEQ ID NO: 4072544 - RNA, 17 nt, Vaccinia virus
aauuguaaaaacauaca

SEQ ID NO: 4072545 - RNA, 13 nt, Vaccinia virus
aauugucuaauga

SEQ ID NO: 4072546 - RNA, 14 nt, Vaccinia virus
aauuguuucuuuua

SEQ ID NO: 4072547 - RNA, 21 nt, Vaccinia virus
aauuuacucgcauuucuaaua

SEQ ID NO: 4072548 - RNA, 23 nt, Vaccinia virus
aauuuaguuacugcuauacagau

SEQ ID NO: 4072549 - RNA, 23 nt, Vaccinia virus
aauuuauagaugcuggaagacaa

SEQ ID NO: 4072550 - RNA, 15 nt, Vaccinia virus
aauuuauaucuaaga

SEQ ID NO: 4072551 - RNA, 14 nt, Vaccinia virus
aauuuauuucuaaa

SEQ ID NO: 4072552 - RNA, 14 nt, Vaccinia virus
aauuucauauuaau

SEQ ID NO: 4072553 - RNA, 17 nt, Vaccinia virus
aucagauaaguaugaag

SEQ ID NO: 4072554 - RNA, 20 nt, Vaccinia virus
aucagcauccacucauauag

SEQ ID NO: 4072555 - RNA, 20 nt, Vaccinia virus
aucagcaucuugaauagaaa

SEQ ID NO: 4072556 - RNA, 21 nt, Vaccinia virus
aucaggaauccaaagagcuau

SEQ ID NO: 4072557 - RNA, 17 nt, Vaccinia virus
aucaggauauaaagaaa

SEQ ID NO: 4072558 - RNA, 18 nt, Vaccinia virus
aucaggauauaaagaaaa

SEQ ID NO: 4072559 - RNA, 19 nt, Vaccinia virus
aucagucgagauacagaaa

SEQ ID NO: 4072560 - RNA, 13 nt, Vaccinia virus
aucauaaaaguug

SEQ ID NO: 4072561 - RNA, 14 nt, Vaccinia virus
aucauagaugaaug

SEQ ID NO: 4072562 - RNA, 12 nt, Vaccinia virus
aucauaguuuuu

SEQ ID NO: 4072563 - RNA, 19 nt, Vaccinia virus
aucauauuauaaagaugau

SEQ ID NO: 4072564 - RNA, 15 nt, Vaccinia virus
aucaucaucugaaau

SEQ ID NO: 4072565 - RNA, 15 nt, Vaccinia virus
aucaucauuguguaa

SEQ ID NO: 4072566 - RNA, 21 nt, Vaccinia virus
aucauccaccuguuuuaacau

SEQ ID NO: 4072567 - RNA, 14 nt, Vaccinia virus
aucauccauguacu

SEQ ID NO: 4072568 - RNA, 21 nt, Vaccinia virus
aucaucuacuccaugucuauu

SEQ ID NO: 4072569 - RNA, 17 nt, Vaccinia virus
aucaucuguuuuaaaaa

SEQ ID NO: 4072570 - RNA, 13 nt, Vaccinia virus
aucaugaaaugau

SEQ ID NO: 4072571 - RNA, 15 nt, Vaccinia virus
aucaugaauggauuu

SEQ ID NO: 4072572 - RNA, 17 nt, Vaccinia virus
aucaugacguaaaugua

SEQ ID NO: 4072573 - RNA, 13 nt, Vaccinia virus
aucaugaugauuu

SEQ ID NO: 4072574 - RNA, 20 nt, Vaccinia virus
aucauggauuuuauauagau

SEQ ID NO: 4072575 - RNA, 16 nt, Vaccinia virus
aucauguguaaaaagu

SEQ ID NO: 4072576 - RNA, 18 nt, Vaccinia virus
aucauucauuccuccaua

SEQ ID NO: 4072577 - RNA, 12 nt, Vaccinia virus
aucauuucacaa

SEQ ID NO: 4072578 - RNA, 19 nt, Vaccinia virus
aucauuuuugcaucauuua

SEQ ID NO: 4072579 - RNA, 15 nt, Vaccinia virus
auccaagaaaaaguc

SEQ ID NO: 4072580 - RNA, 22 nt, Vaccinia virus
auccaagaguuccgagauaauu

SEQ ID NO: 4072581 - RNA, 17 nt, Vaccinia virus
auccaaucuaagaaauu

SEQ ID NO: 4072582 - RNA, 15 nt, Vaccinia virus
auccaucaaaaaaca

SEQ ID NO: 4072583 - RNA, 20 nt, Vaccinia virus
auccaucuguauuaaagaua

SEQ ID NO: 4072584 - RNA, 23 nt, Vaccinia virus
auccaugguuuuaaguaaaugau

SEQ ID NO: 4072585 - RNA, 15 nt, Vaccinia virus
auccauucuaaugau

SEQ ID NO: 4072586 - RNA, 15 nt, Vaccinia virus
auccauuuacaacuc

SEQ ID NO: 4072587 - RNA, 13 nt, Vaccinia virus
aucccaaacauug

SEQ ID NO: 4072588 - RNA, 14 nt, Vaccinia virus
auccccuuucaaua

SEQ ID NO: 4072589 - RNA, 20 nt, Vaccinia virus
aucccuucucgcaaauucua

SEQ ID NO: 4072590 - RNA, 17 nt, Vaccinia virus
auccggauccuuuucuu

SEQ ID NO: 4072591 - RNA, 22 nt, Vaccinia virus
auccuaaugcauguuauagaug

SEQ ID NO: 4072592 - RNA, 15 nt, Vaccinia virus
auccuaauucacaau

SEQ ID NO: 4072593 - RNA, 15 nt, Vaccinia virus
auccuagaugaugau

SEQ ID NO: 4072594 - RNA, 13 nt, Vaccinia virus
auccuauaaacau

SEQ ID NO: 4072595 - RNA, 13 nt, Vaccinia virus
auccuauaacuuc

SEQ ID NO: 4072596 - RNA, 14 nt, Vaccinia virus
auccuauacucuga

SEQ ID NO: 4072597 - RNA, 13 nt, Vaccinia virus
auccucaaacauc

SEQ ID NO: 4072598 - RNA, 22 nt, Vaccinia virus
auccucagacucugauuugaac

SEQ ID NO: 4072599 - RNA, 21 nt, Vaccinia virus
auccucagucaucuugucuag

SEQ ID NO: 4072600 - RNA, 20 nt, Vaccinia virus
auccuuauaaagaaugaaug

SEQ ID NO: 4072601 - RNA, 15 nt, Vaccinia virus
auccuuauccuuuac

SEQ ID NO: 4072602 - RNA, 15 nt, Vaccinia virus
auccuucuagaauua

SEQ ID NO: 4072603 - RNA, 18 nt, Vaccinia virus
auccuuuaagaucaacau

SEQ ID NO: 4072604 - RNA, 17 nt, Vaccinia virus
auccuuuagauggugau

SEQ ID NO: 4072605 - RNA, 15 nt, Vaccinia virus
aucgaaaucauuuau

SEQ ID NO: 4072606 - RNA, 13 nt, Vaccinia virus
aucgaaaucuuaa

SEQ ID NO: 4072607 - RNA, 14 nt, Vaccinia virus
aucgaaugauauau

SEQ ID NO: 4072608 - RNA, 14 nt, Vaccinia virus
aucgacuauagaca

SEQ ID NO: 4072609 - RNA, 17 nt, Vaccinia virus
aucgacuauuuuaaaua

SEQ ID NO: 4072610 - RNA, 19 nt, Vaccinia virus
aucgacuugggucuucuca

SEQ ID NO: 4072611 - RNA, 14 nt, Vaccinia virus
aucgauaauuauuu

SEQ ID NO: 4072612 - RNA, 21 nt, Vaccinia virus
aucgauaauugucucauaugu

SEQ ID NO: 4072613 - RNA, 13 nt, Vaccinia virus
aucgaucauaucu

SEQ ID NO: 4072614 - RNA, 18 nt, Vaccinia virus
aucgauugauagugaaug

SEQ ID NO: 4072615 - RNA, 18 nt, Vaccinia virus
aucgauuuucaaauccau

SEQ ID NO: 4072616 - RNA, 18 nt, Vaccinia virus
aucgcauacuaguauuua

SEQ ID NO: 4072617 - RNA, 16 nt, Vaccinia virus
aucgcauagaaauaca

SEQ ID NO: 4072618 - RNA, 16 nt, Vaccinia virus
aucgccuuuauuucca

SEQ ID NO: 4072619 - RNA, 15 nt, Vaccinia virus
aucggcuuuaacaau

SEQ ID NO: 4072620 - RNA, 16 nt, Vaccinia virus
aucgucuguauuaaug

SEQ ID NO: 4072621 - RNA, 18 nt, Vaccinia virus
aucgugguuaacaauaug

SEQ ID NO: 4072622 - RNA, 14 nt, Vaccinia virus
aucgugugucuaua

SEQ ID NO: 4072623 - RNA, 22 nt, Vaccinia virus
aucguuuaaaauacuaaauuga

SEQ ID NO: 4072624 - RNA, 16 nt, Vaccinia virus
aucuaaacaauaccuc

SEQ ID NO: 4072625 - RNA, 22 nt, Vaccinia virus
aucuaaacauaagacuuauucu

SEQ ID NO: 4072626 - RNA, 20 nt, Vaccinia virus
aucuaaagauaaucuucucu

SEQ ID NO: 4072627 - RNA, 18 nt, Vaccinia virus
aucuaacagauacaaauu

SEQ ID NO: 4072628 - RNA, 22 nt, Vaccinia virus
aucuaauaaguugcgaugaaau

SEQ ID NO: 4072629 - RNA, 13 nt, Vaccinia virus
aucuaaucaucaa

SEQ ID NO: 4072630 - RNA, 15 nt, Vaccinia virus
aucuaaugaaugaag

SEQ ID NO: 4072631 - RNA, 14 nt, Vaccinia virus
aucuacacaaauag

SEQ ID NO: 4072632 - RNA, 21 nt, Vaccinia virus
aucuaccauaguuacagaauu

SEQ ID NO: 4072633 - RNA, 14 nt, Vaccinia virus
aucuacgaauguau

SEQ ID NO: 4072634 - RNA, 15 nt, Vaccinia virus
aucuacuagaaagau

SEQ ID NO: 4072635 - RNA, 18 nt, Vaccinia virus
aucuacucauagaaaggu

SEQ ID NO: 4072636 - RNA, 21 nt, Vaccinia virus
aucuacugauaaaacuggaag

SEQ ID NO: 4072637 - RNA, 15 nt, Vaccinia virus
aucuagacucuauau

SEQ ID NO: 4072638 - RNA, 13 nt, Vaccinia virus
aucuagagauugu

SEQ ID NO: 4072639 - RNA, 19 nt, Vaccinia virus
aucuagauuccaaucauug

SEQ ID NO: 4072640 - RNA, 15 nt, Vaccinia virus
aucuagguugccaaa

SEQ ID NO: 4072641 - RNA, 23 nt, Vaccinia virus
aucuaguuagaacuaucauagau

SEQ ID NO: 4072642 - RNA, 16 nt, Vaccinia virus
aucuaguuagcaauuu

SEQ ID NO: 4072643 - RNA, 15 nt, Vaccinia virus
aucuauauauaccuu

SEQ ID NO: 4072644 - RNA, 14 nt, Vaccinia virus
aucuauauauccuu

SEQ ID NO: 4072645 - RNA, 22 nt, Vaccinia virus
aucuauauauguauuuuaauaa

SEQ ID NO: 4072646 - RNA, 20 nt, Vaccinia virus
aucuauauuguuuaauauau

SEQ ID NO: 4072647 - RNA, 20 nt, Vaccinia virus
aucuauauuuaucacagucu

SEQ ID NO: 4072648 - RNA, 20 nt, Vaccinia virus
aucuaugguauuaagaauuc

SEQ ID NO: 4072649 - RNA, 17 nt, Vaccinia virus
aucuauuauugaugcaa

SEQ ID NO: 4072650 - RNA, 13 nt, Vaccinia virus
aucuauucccuug

SEQ ID NO: 4072651 - RNA, 22 nt, Vaccinia virus
aucuauuucaucguuuuguaua

SEQ ID NO: 4072652 - RNA, 13 nt, Vaccinia virus
aucuauuuuuguu

SEQ ID NO: 4072653 - RNA, 18 nt, Vaccinia virus
aucuauuuuuuugucaug

SEQ ID NO: 4072654 - RNA, 14 nt, Vaccinia virus
aucucaauaugaua

SEQ ID NO: 4072655 - RNA, 23 nt, Vaccinia virus
aucucagucuguggcguuugcuu

SEQ ID NO: 4072656 - RNA, 15 nt, Vaccinia virus
aucucauauuaaaaa

SEQ ID NO: 4072657 - RNA, 14 nt, Vaccinia virus
aucucaucagacau

SEQ ID NO: 4072658 - RNA, 19 nt, Vaccinia virus
aucuccacuuuugcuuuac

SEQ ID NO: 4072659 - RNA, 18 nt, Vaccinia virus
aucuccaucgaugauaca

SEQ ID NO: 4072660 - RNA, 15 nt, Vaccinia virus
aucucuaacuacuau

SEQ ID NO: 4072661 - RNA, 18 nt, Vaccinia virus
aucucuagauauguauuu

SEQ ID NO: 4072662 - RNA, 19 nt, Vaccinia virus
aucucuauaucuaugguug

SEQ ID NO: 4072663 - RNA, 16 nt, Vaccinia virus
aucucucauaagaaag

SEQ ID NO: 4072664 - RNA, 20 nt, Vaccinia virus
aucucuucuaguuucacuag

SEQ ID NO: 4072665 - RNA, 23 nt, Vaccinia virus
aucucuuuagaauguuaucgaug

SEQ ID NO: 4072666 - RNA, 15 nt, Vaccinia virus
aucucuuucuccuuu

SEQ ID NO: 4072667 - RNA, 17 nt, Vaccinia virus
aucucuuuuuuaacuaa

SEQ ID NO: 4072668 - RNA, 20 nt, Vaccinia virus
aucugaaauaacauauagau

SEQ ID NO: 4072669 - RNA, 16 nt, Vaccinia virus
aucugaagaaaguaau

SEQ ID NO: 4072670 - RNA, 18 nt, Vaccinia virus
aucugaaggugcaaccga

SEQ ID NO: 4072671 - RNA, 15 nt, Vaccinia virus
aucugaauaaaacau

SEQ ID NO: 4072672 - RNA, 15 nt, Vaccinia virus
aucugaauuaaauau

SEQ ID NO: 4072673 - RNA, 15 nt, Vaccinia virus
aucugacauaaacau

SEQ ID NO: 4072674 - RNA, 24 nt, Vaccinia virus
aucugacauaaacauaucaaaaga

SEQ ID NO: 4072675 - RNA, 14 nt, Vaccinia virus
aucugauagaaaga

SEQ ID NO: 4072676 - RNA, 13 nt, Vaccinia virus
aucugaucuuguu

SEQ ID NO: 4072677 - RNA, 18 nt, Vaccinia virus
aucugcacuaauuaacag

SEQ ID NO: 4072678 - RNA, 19 nt, Vaccinia virus
aucugggaauaaaauacua

SEQ ID NO: 4072679 - RNA, 17 nt, Vaccinia virus
aucuguacuucuguaca

SEQ ID NO: 4072680 - RNA, 15 nt, Vaccinia virus
aucugucaauagaca

SEQ ID NO: 4072681 - RNA, 22 nt, Vaccinia virus
aucugugauuucguuagucaua

SEQ ID NO: 4072682 - RNA, 13 nt, Vaccinia virus
aucuuaauaagca

SEQ ID NO: 4072683 - RNA, 17 nt, Vaccinia virus
aucuuauuuuuaacaaa

SEQ ID NO: 4072684 - RNA, 15 nt, Vaccinia virus
aucuuccuucuuauu

SEQ ID NO: 4072685 - RNA, 19 nt, Vaccinia virus
aucuucguuaaaaaguuuu

SEQ ID NO: 4072686 - RNA, 20 nt, Vaccinia virus
aucuucucuccuuucaaacu

SEQ ID NO: 4072687 - RNA, 20 nt, Vaccinia virus
aucuugaugcgguuuaauaa

SEQ ID NO: 4072688 - RNA, 15 nt, Vaccinia virus
aucuugauuuauaga

SEQ ID NO: 4072689 - RNA, 19 nt, Vaccinia virus
aucuugucugcuuaauaca

SEQ ID NO: 4072690 - RNA, 15 nt, Vaccinia virus
aucuuuaguaaacau

SEQ ID NO: 4072691 - RNA, 13 nt, Vaccinia virus
aucuuucauuucu

SEQ ID NO: 4072692 - RNA, 21 nt, Vaccinia virus
aucuuucccggagauaagacu

SEQ ID NO: 4072693 - RNA, 19 nt, Vaccinia virus
aucuuuggagaaucgucua

SEQ ID NO: 4072694 - RNA, 15 nt, Vaccinia virus
aucuuugucaaauau

SEQ ID NO: 4072695 - RNA, 19 nt, Vaccinia virus
aucuuuucacguuaaauga

SEQ ID NO: 4072696 - RNA, 16 nt, Vaccinia virus
aucuuuucucaaagau

SEQ ID NO: 4072697 - RNA, 14 nt, Vaccinia virus
augaaaaaaaacua

SEQ ID NO: 4072698 - RNA, 13 nt, Vaccinia virus
augaaacauuuaa

SEQ ID NO: 4072699 - RNA, 17 nt, Vaccinia virus
augaaacguuuggaaac

SEQ ID NO: 4072700 - RNA, 23 nt, Vaccinia virus
augaaagauacaacaaauuaaac

SEQ ID NO: 4072701 - RNA, 15 nt, Vaccinia virus
augaaauaaguauga

SEQ ID NO: 4072702 - RNA, 22 nt, Vaccinia virus
augaaauagcguucgucaacau

SEQ ID NO: 4072703 - RNA, 20 nt, Vaccinia virus
augaaauaucuuaaggagaa

SEQ ID NO: 4072704 - RNA, 20 nt, Vaccinia virus
augaaaucgcuuaauagaca

SEQ ID NO: 4072705 - RNA, 21 nt, Vaccinia virus
augaaaugauucucucaacau

SEQ ID NO: 4072706 - RNA, 14 nt, Vaccinia virus
augaaauuauucac

SEQ ID NO: 4072707 - RNA, 16 nt, Vaccinia virus
augaacaaagaaaugg

SEQ ID NO: 4072708 - RNA, 13 nt, Vaccinia virus
augaagaaugccu

SEQ ID NO: 4072709 - RNA, 22 nt, Vaccinia virus
augaagauagaucacaaaucac

SEQ ID NO: 4072710 - RNA, 17 nt, Vaccinia virus
augaaguugagaaugau

SEQ ID NO: 4072711 - RNA, 15 nt, Vaccinia virus
augaauacuaaugcc

SEQ ID NO: 4072712 - RNA, 16 nt, Vaccinia virus
augaauauaguaauua

SEQ ID NO: 4072713 - RNA, 21 nt, Vaccinia virus
augaauaucugcaauauauau

SEQ ID NO: 4072714 - RNA, 16 nt, Vaccinia virus
augaaugaugauauau

SEQ ID NO: 4072715 - RNA, 18 nt, Vaccinia virus
augaauggauacuuguau

SEQ ID NO: 4072716 - RNA, 19 nt, Vaccinia virus
augaauggaucaccguguu

SEQ ID NO: 4072717 - RNA, 17 nt, Vaccinia virus
augaauggaugcuagaa

SEQ ID NO: 4072718 - RNA, 14 nt, Vaccinia virus
augaauuaauuaag

SEQ ID NO: 4072719 - RNA, 13 nt, Vaccinia virus
augacaaacauug

SEQ ID NO: 4072720 - RNA, 22 nt, Vaccinia virus
augacacuaguuaagaacaugu

SEQ ID NO: 4072721 - RNA, 21 nt, Vaccinia virus
augaccaguuugcaauaugca

SEQ ID NO: 4072722 - RNA, 17 nt, Vaccinia virus
augacgaauacauuuau

SEQ ID NO: 4072723 - RNA, 15 nt, Vaccinia virus
augacucucaaauua

SEQ ID NO: 4072724 - RNA, 15 nt, Vaccinia virus
augagaucuguauag

SEQ ID NO: 4072725 - RNA, 18 nt, Vaccinia virus
augagaucuucuauuuua

SEQ ID NO: 4072726 - RNA, 19 nt, Vaccinia virus
augagauguuaaaugaauu

SEQ ID NO: 4072727 - RNA, 13 nt, Vaccinia virus
augagauguuauu

SEQ ID NO: 4072728 - RNA, 17 nt, Vaccinia virus
augaggcguuuaucaua

SEQ ID NO: 4072729 - RNA, 18 nt, Vaccinia virus
augaggucgcaaaaaaac

SEQ ID NO: 4072730 - RNA, 17 nt, Vaccinia virus
augaguacuuguacaca

SEQ ID NO: 4072731 - RNA, 15 nt, Vaccinia virus
augaguguagaugcu

SEQ ID NO: 4072732 - RNA, 12 nt, Vaccinia virus
augauaaaugau

SEQ ID NO: 4072733 - RNA, 15 nt, Vaccinia virus
augauaaugauacag

SEQ ID NO: 4072734 - RNA, 13 nt, Vaccinia virus
augauacacguau

SEQ ID NO: 4072735 - RNA, 21 nt, Vaccinia virus
augauacgauacuauauguau

SEQ ID NO: 4072736 - RNA, 17 nt, Vaccinia virus
augauacucucaaccau

SEQ ID NO: 4072737 - RNA, 21 nt, Vaccinia virus
augauacuucacucaucgauu

SEQ ID NO: 4072738 - RNA, 18 nt, Vaccinia virus
augauaguggaucucaau

SEQ ID NO: 4072739 - RNA, 14 nt, Vaccinia virus
augauauaauuaau

SEQ ID NO: 4072740 - RNA, 18 nt, Vaccinia virus
augauauaucuaguguuu

SEQ ID NO: 4072741 - RNA, 21 nt, Vaccinia virus
augauaugauuuuuaaucaag

SEQ ID NO: 4072742 - RNA, 15 nt, Vaccinia virus
augauauguugugau

SEQ ID NO: 4072743 - RNA, 14 nt, Vaccinia virus
augauauuguugau

SEQ ID NO: 4072744 - RNA, 17 nt, Vaccinia virus
augaucaagaaggaaau

SEQ ID NO: 4072745 - RNA, 21 nt, Vaccinia virus
augaucaagagugauuuaaga

SEQ ID NO: 4072746 - RNA, 18 nt, Vaccinia virus
augaucaggaaaguuuau

SEQ ID NO: 4072747 - RNA, 16 nt, Vaccinia virus
augaucuccacgcaau

SEQ ID NO: 4072748 - RNA, 14 nt, Vaccinia virus
augaugaaauguau

SEQ ID NO: 4072749 - RNA, 16 nt, Vaccinia virus
augauuucagauacua

SEQ ID NO: 4072750 - RNA, 14 nt, Vaccinia virus
augcaaaaaaaugu

SEQ ID NO: 4072751 - RNA, 12 nt, Vaccinia virus
augcaaacauua

SEQ ID NO: 4072752 - RNA, 23 nt, Vaccinia virus
augcaaacuuacagaaacaauga

SEQ ID NO: 4072753 - RNA, 18 nt, Vaccinia virus
augcaucgugaaaagaaa

SEQ ID NO: 4072754 - RNA, 17 nt, Vaccinia virus
augcaucuuauugaaug

SEQ ID NO: 4072755 - RNA, 19 nt, Vaccinia virus
augcauguuagauaacgga

SEQ ID NO: 4072756 - RNA, 14 nt, Vaccinia virus
augcauguuucaua

SEQ ID NO: 4072757 - RNA, 13 nt, Vaccinia virus
augcauuaucauu

SEQ ID NO: 4072758 - RNA, 14 nt, Vaccinia virus
augccuacauauca

SEQ ID NO: 4072759 - RNA, 22 nt, Vaccinia virus
augccuauuaggacagauacua

SEQ ID NO: 4072760 - RNA, 19 nt, Vaccinia virus
augccuuuccuggaauauc

SEQ ID NO: 4072761 - RNA, 18 nt, Vaccinia virus
augcuagugcucaaacaa

SEQ ID NO: 4072762 - RNA, 16 nt, Vaccinia virus
augcuauuagaaaugg

SEQ ID NO: 4072763 - RNA, 14 nt, Vaccinia virus
augcucuuaaauaa

SEQ ID NO: 4072764 - RNA, 22 nt, Vaccinia virus
augcuuaacuugacuaaauauu

SEQ ID NO: 4072765 - RNA, 12 nt, Vaccinia virus
augcuugaaaau

SEQ ID NO: 4072766 - RNA, 14 nt, Vaccinia virus
auggaaaguguaaa

SEQ ID NO: 4072767 - RNA, 17 nt, Vaccinia virus
auggaagaguuaaugaa

SEQ ID NO: 4072768 - RNA, 15 nt, Vaccinia virus
auggagcaaacauua

SEQ ID NO: 4072769 - RNA, 22 nt, Vaccinia virus
auggagucccagaccagaaaug

SEQ ID NO: 4072770 - RNA, 21 nt, Vaccinia virus
auggauaauccgucuauuuua

SEQ ID NO: 4072771 - RNA, 15 nt, Vaccinia virus
auggauauauuaaag

SEQ ID NO: 4072772 - RNA, 18 nt, Vaccinia virus
auggauuaaaucguguau

SEQ ID NO: 4072773 - RNA, 19 nt, Vaccinia virus
auggauuaucggaaauacu

SEQ ID NO: 4072774 - RNA, 20 nt, Vaccinia virus
auggauuuaucauaucaugg

SEQ ID NO: 4072775 - RNA, 18 nt, Vaccinia virus
auggcaaauguauagaac

SEQ ID NO: 4072776 - RNA, 15 nt, Vaccinia virus
auggcaagaaaugga

SEQ ID NO: 4072777 - RNA, 15 nt, Vaccinia virus
auggccgaugaaugg

SEQ ID NO: 4072778 - RNA, 14 nt, Vaccinia virus
augguaaaggauaa

SEQ ID NO: 4072779 - RNA, 15 nt, Vaccinia virus
augguacuuaugaca

SEQ ID NO: 4072780 - RNA, 12 nt, Vaccinia virus
augguauauaca

SEQ ID NO: 4072781 - RNA, 18 nt, Vaccinia virus
augguaucauuacaugcu

SEQ ID NO: 4072782 - RNA, 16 nt, Vaccinia virus
augguauuaagaauuc

SEQ ID NO: 4072783 - RNA, 16 nt, Vaccinia virus
auggucucacaaaaaa

SEQ ID NO: 4072784 - RNA, 22 nt, Vaccinia virus
auggucucggauugguggauau

SEQ ID NO: 4072785 - RNA, 16 nt, Vaccinia virus
augguuucugugacua

SEQ ID NO: 4072786 - RNA, 19 nt, Vaccinia virus
auguaacccuuuuuaucga

SEQ ID NO: 4072787 - RNA, 21 nt, Vaccinia virus
auguaaccuacuagaaugaua

SEQ ID NO: 4072788 - RNA, 13 nt, Vaccinia virus
auguaagucuuac

SEQ ID NO: 4072789 - RNA, 13 nt, Vaccinia virus
auguaauacuuug

SEQ ID NO: 4072790 - RNA, 17 nt, Vaccinia virus
auguaaucgaaauaaua

SEQ ID NO: 4072791 - RNA, 20 nt, Vaccinia virus
auguacgauccaaacaaugu

SEQ ID NO: 4072792 - RNA, 19 nt, Vaccinia virus
auguagaagguucauaugu

SEQ ID NO: 4072793 - RNA, 22 nt, Vaccinia virus
auguagaauuuuuuaaaaaguu

SEQ ID NO: 4072794 - RNA, 18 nt, Vaccinia virus
auguagagguaaaaagac

SEQ ID NO: 4072795 - RNA, 17 nt, Vaccinia virus
auguagcaaacaugaua

SEQ ID NO: 4072796 - RNA, 15 nt, Vaccinia virus
auguaguaguaacug

SEQ ID NO: 4072797 - RNA, 14 nt, Vaccinia virus
auguaguucguaaa

SEQ ID NO: 4072798 - RNA, 15 nt, Vaccinia virus
auguauaaaguguau

SEQ ID NO: 4072799 - RNA, 20 nt, Vaccinia virus
auguauaauaauaaacggaa

SEQ ID NO: 4072800 - RNA, 23 nt, Vaccinia virus
auguauaauauaaaaaaacauua

SEQ ID NO: 4072801 - RNA, 23 nt, Vaccinia virus
auguauaauuugguaaugguuuc

SEQ ID NO: 4072802 - RNA, 15 nt, Vaccinia virus
auuauagauuuucca

SEQ ID NO: 4072803 - RNA, 19 nt, Vaccinia virus
auuauagcaauauguguaa

SEQ ID NO: 4072804 - RNA, 21 nt, Vaccinia virus
auuauagcuucuggacauaau

SEQ ID NO: 4072805 - RNA, 22 nt, Vaccinia virus
auuauaucauugucuaauagau

SEQ ID NO: 4072806 - RNA, 22 nt, Vaccinia virus
auuauaucguauuugugcuaua

SEQ ID NO: 4072807 - RNA, 14 nt, Vaccinia virus
auuaucaaaagaca

SEQ ID NO: 4072808 - RNA, 19 nt, Vaccinia virus
auuaucaaaagacaugaua

SEQ ID NO: 4072809 - RNA, 13 nt, Vaccinia virus
auuaucaaaauuu

SEQ ID NO: 4072810 - RNA, 21 nt, Vaccinia virus
auuaucaaagucacaaagcaa

SEQ ID NO: 4072811 - RNA, 23 nt, Vaccinia virus
auuaucaggaacauuaucaauuu

SEQ ID NO: 4072812 - RNA, 17 nt, Vaccinia virus
auuauccaucuaacaaa

SEQ ID NO: 4072813 - RNA, 15 nt, Vaccinia virus
auuauccaugauaga

SEQ ID NO: 4072814 - RNA, 21 nt, Vaccinia virus
auuauccaugauagaaagaaa

SEQ ID NO: 4072815 - RNA, 17 nt, Vaccinia virus
auuaucccauuguaaag

SEQ ID NO: 4072816 - RNA, 17 nt, Vaccinia virus
auuaucgacauucaugg

SEQ ID NO: 4072817 - RNA, 18 nt, Vaccinia virus
auuaucgagauuuaauaa

SEQ ID NO: 4072818 - RNA, 18 nt, Vaccinia virus
auuaucgagcgugauguu

SEQ ID NO: 4072819 - RNA, 22 nt, Vaccinia virus
auuaucgagcgugauguuguaa

SEQ ID NO: 4072820 - RNA, 15 nt, Vaccinia virus
auuaucgcguucaga

SEQ ID NO: 4072821 - RNA, 23 nt, Vaccinia virus
auuaucguuccugguauauagau

SEQ ID NO: 4072822 - RNA, 18 nt, Vaccinia virus
auuaucucccauaaucuu

SEQ ID NO: 4072823 - RNA, 13 nt, Vaccinia virus
auuaucugaaaug

SEQ ID NO: 4072824 - RNA, 15 nt, Vaccinia virus
auuaucugaaauggu

SEQ ID NO: 4072825 - RNA, 21 nt, Vaccinia virus
auuaugaaaauuauaaugaau

SEQ ID NO: 4072826 - RNA, 22 nt, Vaccinia virus
auuaugacgucagccauagcau

SEQ ID NO: 4072827 - RNA, 19 nt, Vaccinia virus
auuaugauacucuuauaga

SEQ ID NO: 4072828 - RNA, 17 nt, Vaccinia virus
auuaugaugauacauuu

SEQ ID NO: 4072829 - RNA, 15 nt, Vaccinia virus
auuauguaaaacaaa

SEQ ID NO: 4072830 - RNA, 14 nt, Vaccinia virus
auuauguuuaaaga

SEQ ID NO: 4072831 - RNA, 20 nt, Vaccinia virus
auuauguuuuaugaauagau

SEQ ID NO: 4072832 - RNA, 18 nt, Vaccinia virus
auuauuagauuuaauagc

SEQ ID NO: 4072833 - RNA, 21 nt, Vaccinia virus
auuauugaagaugaugugaau

SEQ ID NO: 4072834 - RNA, 14 nt, Vaccinia virus
auuauuuaauggag

SEQ ID NO: 4072835 - RNA, 18 nt, Vaccinia virus
auuauuuaauuuaauaca

SEQ ID NO: 4072836 - RNA, 14 nt, Vaccinia virus
auuauuuauaccuc

SEQ ID NO: 4072837 - RNA, 14 nt, Vaccinia virus
auuauuuuaaaccu

SEQ ID NO: 4072838 - RNA, 16 nt, Vaccinia virus
auuauuuuuacagcga

SEQ ID NO: 4072839 - RNA, 24 nt, Vaccinia virus
auucaaaauggcaauuauacuaga

SEQ ID NO: 4072840 - RNA, 12 nt, Vaccinia virus
auucaagagaau

SEQ ID NO: 4072841 - RNA, 20 nt, Vaccinia virus
auucaagauuuuauuaucga

SEQ ID NO: 4072842 - RNA, 21 nt, Vaccinia virus
auucaagcaaaaacaaaaaac

SEQ ID NO: 4072843 - RNA, 15 nt, Vaccinia virus
auucaagucaaagaa

SEQ ID NO: 4072844 - RNA, 16 nt, Vaccinia virus
auucacaauaaaauuc

SEQ ID NO: 4072845 - RNA, 16 nt, Vaccinia virus
auucaccgaucaaaug

SEQ ID NO: 4072846 - RNA, 15 nt, Vaccinia virus
auucacguuauauaa

SEQ ID NO: 4072847 - RNA, 20 nt, Vaccinia virus
auucagaauuucuacauaau

SEQ ID NO: 4072848 - RNA, 12 nt, Vaccinia virus
auucagacacuu

SEQ ID NO: 4072849 - RNA, 23 nt, Vaccinia virus
auucaguuuauagagcaaaauaa

SEQ ID NO: 4072850 - RNA, 22 nt, Vaccinia virus
auucauaauaagauaaauccau

SEQ ID NO: 4072851 - RNA, 19 nt, Vaccinia virus
auucauaugacuaaaaugc

SEQ ID NO: 4072852 - RNA, 18 nt, Vaccinia virus
auucauauuuuaguuuuu

SEQ ID NO: 4072853 - RNA, 13 nt, Vaccinia virus
auucaucaacauu

SEQ ID NO: 4072854 - RNA, 13 nt, Vaccinia virus
auucaucaauaau

SEQ ID NO: 4072855 - RNA, 21 nt, Vaccinia virus
auucauccuguugucuaaauc

SEQ ID NO: 4072856 - RNA, 18 nt, Vaccinia virus
auucauggaguuagaaaa

SEQ ID NO: 4072857 - RNA, 14 nt, Vaccinia virus
auucauuaauucua

SEQ ID NO: 4072858 - RNA, 15 nt, Vaccinia virus
auucauuuagaaugg

SEQ ID NO: 4072859 - RNA, 12 nt, Vaccinia virus
auucauuuccau

SEQ ID NO: 4072860 - RNA, 16 nt, Vaccinia virus
auucauuuucaauuau

SEQ ID NO: 4072861 - RNA, 13 nt, Vaccinia virus
auucauuuucuau

SEQ ID NO: 4072862 - RNA, 12 nt, Vaccinia virus
auuccaaagauc

SEQ ID NO: 4072863 - RNA, 20 nt, Vaccinia virus
auuccacgaacuucuaauug

SEQ ID NO: 4072864 - RNA, 18 nt, Vaccinia virus
auuccguauauagcacaa

SEQ ID NO: 4072865 - RNA, 20 nt, Vaccinia virus
auuccuaccaaacaaaauuu

SEQ ID NO: 4072866 - RNA, 20 nt, Vaccinia virus
auuccucuaacgaacucaag

SEQ ID NO: 4072867 - RNA, 17 nt, Vaccinia virus
auucgaaauuagaaagu

SEQ ID NO: 4072868 - RNA, 15 nt, Vaccinia virus
auucgaauucaaaug

SEQ ID NO: 4072869 - RNA, 18 nt, Vaccinia virus
auucgacucaacauaaau

SEQ ID NO: 4072870 - RNA, 17 nt, Vaccinia virus
auucggagacuguauau

SEQ ID NO: 4072871 - RNA, 13 nt, Vaccinia virus
auucguaaaucuu

SEQ ID NO: 4072872 - RNA, 22 nt, Vaccinia virus
auucgucuuucugaaugucgaa

SEQ ID NO: 4072873 - RNA, 17 nt, Vaccinia virus
auucguuagcaaaauua

SEQ ID NO: 4072874 - RNA, 14 nt, Vaccinia virus
auucuaauggauga

SEQ ID NO: 4072875 - RNA, 21 nt, Vaccinia virus
auucuaccuuacccauaaaca

SEQ ID NO: 4072876 - RNA, 22 nt, Vaccinia virus
auucuaccuuuuuauuuucuaa

SEQ ID NO: 4072877 - RNA, 16 nt, Vaccinia virus
auucuagauacaagau

SEQ ID NO: 4072878 - RNA, 13 nt, Vaccinia virus
auucuauacuuaa

SEQ ID NO: 4072879 - RNA, 16 nt, Vaccinia virus
auucuaucguaucugu

SEQ ID NO: 4072880 - RNA, 13 nt, Vaccinia virus
auucuaugauggu

SEQ ID NO: 4072881 - RNA, 17 nt, Vaccinia virus
auucucaaacuccuaau

SEQ ID NO: 4072882 - RNA, 18 nt, Vaccinia virus
auucucauuaauuaacca

SEQ ID NO: 4072883 - RNA, 19 nt, Vaccinia virus
auucucgaauccgaaauua

SEQ ID NO: 4072884 - RNA, 23 nt, Vaccinia virus
auucucucaucuaucaaaaguua

SEQ ID NO: 4072885 - RNA, 19 nt, Vaccinia virus
auucugaauggauccacca

SEQ ID NO: 4072886 - RNA, 18 nt, Vaccinia virus
auucugauuggucaaugu

SEQ ID NO: 4072887 - RNA, 18 nt, Vaccinia virus
auucugcaauaucuucgu

SEQ ID NO: 4072888 - RNA, 15 nt, Vaccinia virus
auucuggacauagcu

SEQ ID NO: 4072889 - RNA, 15 nt, Vaccinia virus
auucugguuuaaaaa

SEQ ID NO: 4072890 - RNA, 14 nt, Vaccinia virus
auucuuaucaauaa

SEQ ID NO: 4072891 - RNA, 17 nt, Vaccinia virus
auucuugguuaaacuca

SEQ ID NO: 4072892 - RNA, 14 nt, Vaccinia virus
auugaacaauagau

SEQ ID NO: 4072893 - RNA, 13 nt, Vaccinia virus
auugaagaaggag

SEQ ID NO: 4072894 - RNA, 15 nt, Vaccinia virus
auugaguggaaaguu

SEQ ID NO: 4072895 - RNA, 15 nt, Vaccinia virus
auugauagugaauga

SEQ ID NO: 4072896 - RNA, 14 nt, Vaccinia virus
auugaucaaacauu

SEQ ID NO: 4072897 - RNA, 14 nt, Vaccinia virus
auugaucauuuaac

SEQ ID NO: 4072898 - RNA, 20 nt, Vaccinia virus
auugaucuauuauuuaauga

SEQ ID NO: 4072899 - RNA, 19 nt, Vaccinia virus
auugaugaaguucgaugau

SEQ ID NO: 4072900 - RNA, 17 nt, Vaccinia virus
auugaugcaaauagcag

SEQ ID NO: 4072901 - RNA, 15 nt, Vaccinia virus
auugaugucuacaca

SEQ ID NO: 4072902 - RNA, 17 nt, Vaccinia virus
auugauuacuauaaaug

SEQ ID NO: 4072903 - RNA, 22 nt, Vaccinia virus
auugauugaaaaugaaaauaua

SEQ ID NO: 4072904 - RNA, 21 nt, Vaccinia virus
auugauugccauaauaauuac

SEQ ID NO: 4072905 - RNA, 22 nt, Vaccinia virus
auugauugcuguuauuaaugga

SEQ ID NO: 4072906 - RNA, 20 nt, Vaccinia virus
auugcacuauacauuuugaa

SEQ ID NO: 4072907 - RNA, 17 nt, Vaccinia virus
auugcaugauagaaugg

SEQ ID NO: 4072908 - RNA, 17 nt, Vaccinia virus
auugcauggugauuugu

SEQ ID NO: 4072909 - RNA, 16 nt, Vaccinia virus
auugccaacucucaaa

SEQ ID NO: 4072910 - RNA, 20 nt, Vaccinia virus
auugcuuauauuuucaucua

SEQ ID NO: 4072911 - RNA, 23 nt, Vaccinia virus
auuggagaaguaggaaacaggaa

SEQ ID NO: 4072912 - RNA, 15 nt, Vaccinia virus
auuggcaaauuauuu

SEQ ID NO: 4072913 - RNA, 19 nt, Vaccinia virus
auuggcacgaacaaaagga

SEQ ID NO: 4072914 - RNA, 22 nt, Vaccinia virus
auugguaaauuccauagaauau

SEQ ID NO: 4072915 - RNA, 14 nt, Vaccinia virus
auugguacgaaaua

SEQ ID NO: 4072916 - RNA, 14 nt, Vaccinia virus
auugguauaaaugu

SEQ ID NO: 4072917 - RNA, 17 nt, Vaccinia virus
auuggucaaugugaaug

SEQ ID NO: 4072918 - RNA, 21 nt, Vaccinia virus
auugguguuccgauuuuagua

SEQ ID NO: 4072919 - RNA, 23 nt, Vaccinia virus
auugguugcgucaagaacuacua

SEQ ID NO: 4072920 - RNA, 13 nt, Vaccinia virus
auuguaaaugaua

SEQ ID NO: 4072921 - RNA, 20 nt, Vaccinia virus
auuguacgguagaauugaua

SEQ ID NO: 4072922 - RNA, 16 nt, Vaccinia virus
auuguagauuguugac

SEQ ID NO: 4072923 - RNA, 19 nt, Vaccinia virus
auuguauacugucuaaacg

SEQ ID NO: 4072924 - RNA, 17 nt, Vaccinia virus
auuguauaguuaauaag

SEQ ID NO: 4072925 - RNA, 16 nt, Vaccinia virus
auuguuaaacauacau

SEQ ID NO: 4072926 - RNA, 19 nt, Vaccinia virus
caaagaauuuuagacacua

SEQ ID NO: 4072927 - RNA, 14 nt, Vaccinia virus
caaagagaaaacaa

SEQ ID NO: 4072928 - RNA, 18 nt, Vaccinia virus
caaagaggguauauccau

SEQ ID NO: 4072929 - RNA, 20 nt, Vaccinia virus
caaagauauagaacacauaa

SEQ ID NO: 4072930 - RNA, 18 nt, Vaccinia virus
caaagauggcugaaauca

SEQ ID NO: 4072931 - RNA, 19 nt, Vaccinia virus
caaaggauccgacccuaau

SEQ ID NO: 4072932 - RNA, 18 nt, Vaccinia virus
caaaggaugaaagaaagc

SEQ ID NO: 4072933 - RNA, 17 nt, Vaccinia virus
caaaguguccuccuauu

SEQ ID NO: 4072934 - RNA, 14 nt, Vaccinia virus
caaauaaaaaguau

SEQ ID NO: 4072935 - RNA, 15 nt, Vaccinia virus
caaauaacaaaaucc

SEQ ID NO: 4072936 - RNA, 12 nt, Vaccinia virus
caaauacucuaa

SEQ ID NO: 4072937 - RNA, 16 nt, Vaccinia virus
caaauagauaagaaua

SEQ ID NO: 4072938 - RNA, 22 nt, Vaccinia virus
caaauaucauaacuuaguucuu

SEQ ID NO: 4072939 - RNA, 22 nt, Vaccinia virus
caaauaucggcauuuauguuuc

SEQ ID NO: 4072940 - RNA, 23 nt, Vaccinia virus
caaauaucuuuacgaauuacuuu

SEQ ID NO: 4072941 - RNA, 21 nt, Vaccinia virus
caaauauucacaagaugaauu

SEQ ID NO: 4072942 - RNA, 17 nt, Vaccinia virus
caaaucauuguguuuau

SEQ ID NO: 4072943 - RNA, 20 nt, Vaccinia virus
caaaugaguucuguguagau

SEQ ID NO: 4072944 - RNA, 15 nt, Vaccinia virus
caaaugauuaucaaa

SEQ ID NO: 4072945 - RNA, 15 nt, Vaccinia virus
caaauggucaaugau

SEQ ID NO: 4072946 - RNA, 15 nt, Vaccinia virus
caaauguuaaacauu

SEQ ID NO: 4072947 - RNA, 18 nt, Vaccinia virus
caaauuaaacucuggaau

SEQ ID NO: 4072948 - RNA, 20 nt, Vaccinia virus
caaauuauggcguuuguauu

SEQ ID NO: 4072949 - RNA, 12 nt, Vaccinia virus
caaauuauucua

SEQ ID NO: 4072950 - RNA, 21 nt, Vaccinia virus
caaauuccggaauagauguau

SEQ ID NO: 4072951 - RNA, 21 nt, Vaccinia virus
caacaaaagguauuacaagaa

SEQ ID NO: 4072952 - RNA, 18 nt, Vaccinia virus
caacaagagcagauaucu

SEQ ID NO: 4072953 - RNA, 15 nt, Vaccinia virus
caacaaguauacaau

SEQ ID NO: 4072954 - RNA, 22 nt, Vaccinia virus
caacaauguugccucauacauc

SEQ ID NO: 4072955 - RNA, 13 nt, Vaccinia virus
caacacuauguua

SEQ ID NO: 4072956 - RNA, 13 nt, Vaccinia virus
caacagaaaauau

SEQ ID NO: 4072957 - RNA, 20 nt, Vaccinia virus
caacagacgagacuccggaa

SEQ ID NO: 4072958 - RNA, 17 nt, Vaccinia virus
caacagugauaugugua

SEQ ID NO: 4072959 - RNA, 17 nt, Vaccinia virus
caacauccuuuaauggu

SEQ ID NO: 4072960 - RNA, 17 nt, Vaccinia virus
caacaucuauaaaagua

SEQ ID NO: 4072961 - RNA, 24 nt, Vaccinia virus
caacaugauuauucuacuaucaaa

SEQ ID NO: 4072962 - RNA, 15 nt, Vaccinia virus
caacauguuuaauau

SEQ ID NO: 4072963 - RNA, 13 nt, Vaccinia virus
caacauuccaaag

SEQ ID NO: 4072964 - RNA, 13 nt, Vaccinia virus
caaccaaauacuu

SEQ ID NO: 4072965 - RNA, 15 nt, Vaccinia virus
caaccgaaaucaugg

SEQ ID NO: 4072966 - RNA, 17 nt, Vaccinia virus
caacgaucuuguuguuu

SEQ ID NO: 4072967 - RNA, 18 nt, Vaccinia virus
caacucuauaguuuguuu

SEQ ID NO: 4072968 - RNA, 16 nt, Vaccinia virus
caacugucuauacaag

SEQ ID NO: 4072969 - RNA, 20 nt, Vaccinia virus
caagaaauauggauccucua

SEQ ID NO: 4072970 - RNA, 18 nt, Vaccinia virus
caagagugcauugacuuu

SEQ ID NO: 4072971 - RNA, 13 nt, Vaccinia virus
caagauauauaca

SEQ ID NO: 4072972 - RNA, 14 nt, Vaccinia virus
caagcgaauuauuu

SEQ ID NO: 4072973 - RNA, 20 nt, Vaccinia virus
caaggaacuaaauagauuua

SEQ ID NO: 4072974 - RNA, 13 nt, Vaccinia virus
caaggaucuucua

SEQ ID NO: 4072975 - RNA, 20 nt, Vaccinia virus
caaguaucaaaagauuaaag

SEQ ID NO: 4072976 - RNA, 21 nt, Vaccinia virus
caaguaugaagaaaaauguug

SEQ ID NO: 4072977 - RNA, 22 nt, Vaccinia virus
caaguauuguuuugauaacgau

SEQ ID NO: 4072978 - RNA, 21 nt, Vaccinia virus
caaguuguagacuuuuucaaa

SEQ ID NO: 4072979 - RNA, 23 nt, Vaccinia virus
caauaaaggagucuuauagaugu

SEQ ID NO: 4072980 - RNA, 23 nt, Vaccinia virus
caauaaaguuuuuaguaugacau

SEQ ID NO: 4072981 - RNA, 22 nt, Vaccinia virus
caauaaauagcuuuacuucuau

SEQ ID NO: 4072982 - RNA, 12 nt, Vaccinia virus
caauaaaugauu

SEQ ID NO: 4072983 - RNA, 20 nt, Vaccinia virus
caauaaauguuuaaacauca

SEQ ID NO: 4072984 - RNA, 19 nt, Vaccinia virus
caauaaauuagaauauauu

SEQ ID NO: 4072985 - RNA, 23 nt, Vaccinia virus
caauaacuucacuauugaucaag

SEQ ID NO: 4072986 - RNA, 22 nt, Vaccinia virus
caauaagcaguuuccuauucca

SEQ ID NO: 4072987 - RNA, 18 nt, Vaccinia virus
caauaagcuuuagauauu

SEQ ID NO: 4072988 - RNA, 20 nt, Vaccinia virus
caauacauuuuucuauguua

SEQ ID NO: 4072989 - RNA, 16 nt, Vaccinia virus
caauagcacaauuguu

SEQ ID NO: 4072990 - RNA, 22 nt, Vaccinia virus
caauaucuaugacucugauuuc

SEQ ID NO: 4072991 - RNA, 20 nt, Vaccinia virus
caauaucugauuauuaugau

SEQ ID NO: 4072992 - RNA, 16 nt, Vaccinia virus
caauauuaucaucuug

SEQ ID NO: 4072993 - RNA, 13 nt, Vaccinia virus
caauauuuaguuu

SEQ ID NO: 4072994 - RNA, 18 nt, Vaccinia virus
caaucauugauaucuuua

SEQ ID NO: 4072995 - RNA, 21 nt, Vaccinia virus
caauccguaacggaaauuaca

SEQ ID NO: 4072996 - RNA, 22 nt, Vaccinia virus
caaucuaucacugauuaauuau

SEQ ID NO: 4072997 - RNA, 13 nt, Vaccinia virus
caaucuuuaaugu

SEQ ID NO: 4072998 - RNA, 20 nt, Vaccinia virus
caaugaacaagauuaaucuc

SEQ ID NO: 4072999 - RNA, 17 nt, Vaccinia virus
caaugaacuaauauuua

SEQ ID NO: 4073000 - RNA, 20 nt, Vaccinia virus
caaugauaaugauacaguac

SEQ ID NO: 4073001 - RNA, 22 nt, Vaccinia virus
caauggauaccuugcuauuuuu

SEQ ID NO: 4073002 - RNA, 17 nt, Vaccinia virus
caauggauggauacaau

SEQ ID NO: 4073003 - RNA, 18 nt, Vaccinia virus
caauguacgccguguggu

SEQ ID NO: 4073004 - RNA, 17 nt, Vaccinia virus
caauguuuaauuuuuuu

SEQ ID NO: 4073005 - RNA, 20 nt, Vaccinia virus
caauuaccaacuagaagucu

SEQ ID NO: 4073006 - RNA, 18 nt, Vaccinia virus
caauuauacuagaacuau

SEQ ID NO: 4073007 - RNA, 13 nt, Vaccinia virus
caauuccaaagau

SEQ ID NO: 4073008 - RNA, 13 nt, Vaccinia virus
caauuuacuucua

SEQ ID NO: 4073009 - RNA, 23 nt, Vaccinia virus
caauuuauagucgcgcuuuacau

SEQ ID NO: 4073010 - RNA, 14 nt, Vaccinia virus
caauuuuaaaugau

SEQ ID NO: 4073011 - RNA, 16 nt, Vaccinia virus
cacaaagaaagcugua

SEQ ID NO: 4073012 - RNA, 21 nt, Vaccinia virus
cacaacaucguuuuugauauu

SEQ ID NO: 4073013 - RNA, 20 nt, Vaccinia virus
cacaagauuuccaaucuuug

SEQ ID NO: 4073014 - RNA, 15 nt, Vaccinia virus
cacaauguaugaaca

SEQ ID NO: 4073015 - RNA, 14 nt, Vaccinia virus
cacagaacaguaaa

SEQ ID NO: 4073016 - RNA, 13 nt, Vaccinia virus
cacauaaacaucg

SEQ ID NO: 4073017 - RNA, 13 nt, Vaccinia virus
cacauauugaugu

SEQ ID NO: 4073018 - RNA, 22 nt, Vaccinia virus
cacauuauacuuuuuuuuggaa

SEQ ID NO: 4073019 - RNA, 20 nt, Vaccinia virus
cacauuggugcuauccauuu

SEQ ID NO: 4073020 - RNA, 18 nt, Vaccinia virus
cacauuguauauaguuua

SEQ ID NO: 4073021 - RNA, 13 nt, Vaccinia virus
caccaaacauauu

SEQ ID NO: 4073022 - RNA, 17 nt, Vaccinia virus
caccaucggaugauauu

SEQ ID NO: 4073023 - RNA, 18 nt, Vaccinia virus
caccuaucuugugcauuu

SEQ ID NO: 4073024 - RNA, 13 nt, Vaccinia virus
caccuuugccuua

SEQ ID NO: 4073025 - RNA, 20 nt, Vaccinia virus
cacgaaauaaaaaacauaau

SEQ ID NO: 4073026 - RNA, 17 nt, Vaccinia virus
cacgauacuaugcauau

SEQ ID NO: 4073027 - RNA, 14 nt, Vaccinia virus
cacgaugaugauuu

SEQ ID NO: 4073028 - RNA, 16 nt, Vaccinia virus
cacguuaaaucaucua

SEQ ID NO: 4073029 - RNA, 21 nt, Vaccinia virus
cacuaaauaguuuuuuuguuu

SEQ ID NO: 4073030 - RNA, 18 nt, Vaccinia virus
cacuaacgcgcaugauuu

SEQ ID NO: 4073031 - RNA, 12 nt, Vaccinia virus
cacuaucuucug

SEQ ID NO: 4073032 - RNA, 23 nt, Vaccinia virus
cacugucucauacacuacaguaa

SEQ ID NO: 4073033 - RNA, 20 nt, Vaccinia virus
cacuuaaaucgauauaacag

SEQ ID NO: 4073034 - RNA, 15 nt, Vaccinia virus
cacuuaaugacaaaa

SEQ ID NO: 4073035 - RNA, 16 nt, Vaccinia virus
cacuuacagaaaagau

SEQ ID NO: 4073036 - RNA, 22 nt, Vaccinia virus
cagaaagaggaucguacaucca

SEQ ID NO: 4073037 - RNA, 17 nt, Vaccinia virus
cagaaauauguuaacaa

SEQ ID NO: 4073038 - RNA, 19 nt, Vaccinia virus
cagaaauggugauuuugag

SEQ ID NO: 4073039 - RNA, 21 nt, Vaccinia virus
cagaaauugguauaaauguug

SEQ ID NO: 4073040 - RNA, 17 nt, Vaccinia virus
cagaaccuauuaacgau

SEQ ID NO: 4073041 - RNA, 20 nt, Vaccinia virus
cagaaggaggaacaguuuua

SEQ ID NO: 4073042 - RNA, 17 nt, Vaccinia virus
cagaaucaguauauauu

SEQ ID NO: 4073043 - RNA, 22 nt, Vaccinia virus
cagaauccauauuucuuaaugu

SEQ ID NO: 4073044 - RNA, 23 nt, Vaccinia virus
cagaauccgcugauggaaacaca

SEQ ID NO: 4073045 - RNA, 21 nt, Vaccinia virus
cagaaucgcaacgcuaaaaga

SEQ ID NO: 4073046 - RNA, 20 nt, Vaccinia virus
cagaaucuagauuccaauca

SEQ ID NO: 4073047 - RNA, 18 nt, Vaccinia virus
cagacgugacguguauag

SEQ ID NO: 4073048 - RNA, 12 nt, Vaccinia virus
cagacuacuuau

SEQ ID NO: 4073049 - RNA, 12 nt, Vaccinia virus
guaucuauuuua

SEQ ID NO: 4073050 - RNA, 14 nt, Vaccinia virus
guaucucaauauga

SEQ ID NO: 4073051 - RNA, 19 nt, Vaccinia virus
guaucucgucuaaauuaga

SEQ ID NO: 4073052 - RNA, 19 nt, Vaccinia virus
guaucuuaguauugaaaug

SEQ ID NO: 4073053 - RNA, 15 nt, Vaccinia virus
guauguaguagauau

SEQ ID NO: 4073054 - RNA, 19 nt, Vaccinia virus
guaugucgauauacuuauc

SEQ ID NO: 4073055 - RNA, 18 nt, Vaccinia virus
guaugucgcggaugaaac

SEQ ID NO: 4073056 - RNA, 16 nt, Vaccinia virus
guauuauccaauacag

SEQ ID NO: 4073057 - RNA, 14 nt, Vaccinia virus
guauuccuacuuuu

SEQ ID NO: 4073058 - RNA, 21 nt, Vaccinia virus
guauucuauaccaauauuauu

SEQ ID NO: 4073059 - RNA, 22 nt, Vaccinia virus
guauucuucgauaguccuuauu

SEQ ID NO: 4073060 - RNA, 21 nt, Vaccinia virus
guauugacaauacuguauuau

SEQ ID NO: 4073061 - RNA, 17 nt, Vaccinia virus
guauuguucuaaagcca

SEQ ID NO: 4073062 - RNA, 16 nt, Vaccinia virus
guauuuauaaacuuua

SEQ ID NO: 4073063 - RNA, 15 nt, Vaccinia virus
guauuuauauaugca

SEQ ID NO: 4073064 - RNA, 16 nt, Vaccinia virus
guauuugaaaauggaa

SEQ ID NO: 4073065 - RNA, 15 nt, Vaccinia virus
guauuugaacagagc

SEQ ID NO: 4073066 - RNA, 17 nt, Vaccinia virus
gucaaacgaauaaacaa

SEQ ID NO: 4073067 - RNA, 18 nt, Vaccinia virus
gucaaacuuaauaaagga

SEQ ID NO: 4073068 - RNA, 14 nt, Vaccinia virus
gucaacaaaaaugu

SEQ ID NO: 4073069 - RNA, 19 nt, Vaccinia virus
gucaacggaccccaacauc

SEQ ID NO: 4073070 - RNA, 16 nt, Vaccinia virus
gucaaucuaauauuaa

SEQ ID NO: 4073071 - RNA, 14 nt, Vaccinia virus
gucaauuauacguu

SEQ ID NO: 4073072 - RNA, 16 nt, Vaccinia virus
gucaauugaguuuaua

SEQ ID NO: 4073073 - RNA, 15 nt, Vaccinia virus
gucacgaauauaaga

SEQ ID NO: 4073074 - RNA, 23 nt, Vaccinia virus
gucacgauguaggaauauagauc

SEQ ID NO: 4073075 - RNA, 23 nt, Vaccinia virus
gucacuaacugauaccaugaaau

SEQ ID NO: 4073076 - RNA, 22 nt, Vaccinia virus
gucaguaguauacaucaugaaa

SEQ ID NO: 4073077 - RNA, 22 nt, Vaccinia virus
gucauacuccaucaauuucaaa

SEQ ID NO: 4073078 - RNA, 14 nt, Vaccinia virus
gucauccuucacuc

SEQ ID NO: 4073079 - RNA, 18 nt, Vaccinia virus
gucaucuccagaggaaau

SEQ ID NO: 4073080 - RNA, 17 nt, Vaccinia virus
gucaucuuauguuuuua

SEQ ID NO: 4073081 - RNA, 22 nt, Vaccinia virus
gucaucuuauguuuuuaagaga

SEQ ID NO: 4073082 - RNA, 20 nt, Vaccinia virus
gucaucuuguucagaaauau

SEQ ID NO: 4073083 - RNA, 16 nt, Vaccinia virus
gucaugaacauuaaac

SEQ ID NO: 4073084 - RNA, 13 nt, Vaccinia virus
guccaaaaugaug

SEQ ID NO: 4073085 - RNA, 15 nt, Vaccinia virus
guccaauaugaucau

SEQ ID NO: 4073086 - RNA, 23 nt, Vaccinia virus
guccggagaucuaaagauaaucu

SEQ ID NO: 4073087 - RNA, 13 nt, Vaccinia virus
guccucaugauua

SEQ ID NO: 4073088 - RNA, 18 nt, Vaccinia virus
gucgacagaagaauauga

SEQ ID NO: 4073089 - RNA, 13 nt, Vaccinia virus
gucgauacaaaau

SEQ ID NO: 4073090 - RNA, 17 nt, Vaccinia virus
gucgcacuauagaugca

SEQ ID NO: 4073091 - RNA, 18 nt, Vaccinia virus
gucggaaaucuuaaccaa

SEQ ID NO: 4073092 - RNA, 21 nt, Vaccinia virus
gucuacaauuugggacaauga

SEQ ID NO: 4073093 - RNA, 17 nt, Vaccinia virus
gucuacuggaugaagau

SEQ ID NO: 4073094 - RNA, 22 nt, Vaccinia virus
gucuagagcaucaauguccugc

SEQ ID NO: 4073095 - RNA, 18 nt, Vaccinia virus
gucuaguaaguagaaauu

SEQ ID NO: 4073096 - RNA, 15 nt, Vaccinia virus
gucuaucaauaacug

SEQ ID NO: 4073097 - RNA, 19 nt, Vaccinia virus
gucuaucgccuuagauacu

SEQ ID NO: 4073098 - RNA, 23 nt, Vaccinia virus
gucuaugucucuuauuagagauu

SEQ ID NO: 4073099 - RNA, 23 nt, Vaccinia virus
gucucaugucguaauaaauauga

SEQ ID NO: 4073100 - RNA, 17 nt, Vaccinia virus
gucucucauaauaaauu

SEQ ID NO: 4073101 - RNA, 20 nt, Vaccinia virus
gucuguaacucugauaaucu

SEQ ID NO: 4073102 - RNA, 16 nt, Vaccinia virus
gucugucaaaucaucu

SEQ ID NO: 4073103 - RNA, 15 nt, Vaccinia virus
gucuuaaaguuuauu

SEQ ID NO: 4073104 - RNA, 15 nt, Vaccinia virus
gucuuaauagacaca

SEQ ID NO: 4073105 - RNA, 12 nt, Vaccinia virus
gucuuacacauu

SEQ ID NO: 4073106 - RNA, 12 nt, Vaccinia virus
gucuuagauaua

SEQ ID NO: 4073107 - RNA, 23 nt, Vaccinia virus
gucuuauucuuaaaaucuauucc

SEQ ID NO: 4073108 - RNA, 23 nt, Vaccinia virus
gucuugaacucgcugaaugaucu

SEQ ID NO: 4073109 - RNA, 17 nt, Vaccinia virus
gucuuuaaguauauacg

SEQ ID NO: 4073110 - RNA, 16 nt, Vaccinia virus
gugaauauauauguua

SEQ ID NO: 4073111 - RNA, 19 nt, Vaccinia virus
gugaauaugaucuucaucu

SEQ ID NO: 4073112 - RNA, 18 nt, Vaccinia virus
gugacauaauuacauaua

SEQ ID NO: 4073113 - RNA, 18 nt, Vaccinia virus
gugacggauauacaaaac

SEQ ID NO: 4073114 - RNA, 15 nt, Vaccinia virus
gugagaagucuuuuu

SEQ ID NO: 4073115 - RNA, 19 nt, Vaccinia virus
gugaguacggauuaaacau

SEQ ID NO: 4073116 - RNA, 15 nt, Vaccinia virus
gugaguuuuccuuaa

SEQ ID NO: 4073117 - RNA, 13 nt, Vaccinia virus
gugauauaaauaa

SEQ ID NO: 4073118 - RNA, 23 nt, Vaccinia virus
gugaugccaauaagcuuuagaua

SEQ ID NO: 4073119 - RNA, 17 nt, Vaccinia virus
gugauuauuuuuuggua

SEQ ID NO: 4073120 - RNA, 19 nt, Vaccinia virus
gugcacuuuuuuauaaaga

SEQ ID NO: 4073121 - RNA, 13 nt, Vaccinia virus
gugcuaccaaagg

SEQ ID NO: 4073122 - RNA, 18 nt, Vaccinia virus
gugcuucggauucaucca

SEQ ID NO: 4073123 - RNA, 20 nt, Vaccinia virus
gugcuuguaucgaaaaacuu

SEQ ID NO: 4073124 - RNA, 14 nt, Vaccinia virus
gugguguaaucuua

SEQ ID NO: 4073125 - RNA, 23 nt, Vaccinia virus
guguaaacgaaaacuauauacua

SEQ ID NO: 4073126 - RNA, 13 nt, Vaccinia virus
guguaaaguuaaa

SEQ ID NO: 4073127 - RNA, 23 nt, Vaccinia virus
guguacauccgaaauacaaaaug

SEQ ID NO: 4073128 - RNA, 21 nt, Vaccinia virus
guguacuagucauaauaucuu

SEQ ID NO: 4073129 - RNA, 16 nt, Vaccinia virus
guguagcuguuggaac

SEQ ID NO: 4073130 - RNA, 16 nt, Vaccinia virus
guguauacuauuuuua

SEQ ID NO: 4073131 - RNA, 14 nt, Vaccinia virus
guguauauaagacc

SEQ ID NO: 4073132 - RNA, 12 nt, Vaccinia virus
gugucacauaua

SEQ ID NO: 4073133 - RNA, 19 nt, Vaccinia virus
guguguugacuauaacaga

SEQ ID NO: 4073134 - RNA, 17 nt, Vaccinia virus
guguuaucuuagauaua

SEQ ID NO: 4073135 - RNA, 13 nt, Vaccinia virus
guguuuaauaacu

SEQ ID NO: 4073136 - RNA, 13 nt, Vaccinia virus
guguuuaaucuuc

SEQ ID NO: 4073137 - RNA, 15 nt, Vaccinia virus
guguuuuucaaaaca

SEQ ID NO: 4073138 - RNA, 19 nt, Vaccinia virus
guuaaaaaaaauuauccua

SEQ ID NO: 4073139 - RNA, 19 nt, Vaccinia virus
guuaaaaaauuaaguguua

SEQ ID NO: 4073140 - RNA, 15 nt, Vaccinia virus
guuaaaaauuuagau

SEQ ID NO: 4073141 - RNA, 23 nt, Vaccinia virus
guuaaaacauucaaauguuguua

SEQ ID NO: 4073142 - RNA, 16 nt, Vaccinia virus
guuaaaacuacaaaaa

SEQ ID NO: 4073143 - RNA, 18 nt, Vaccinia virus
guuaaaagaauaauccua

SEQ ID NO: 4073144 - RNA, 14 nt, Vaccinia virus
guuaaagaaauuaa

SEQ ID NO: 4073145 - RNA, 14 nt, Vaccinia virus
guuaaagaucuuaa

SEQ ID NO: 4073146 - RNA, 13 nt, Vaccinia virus
guuaaauuauuau

SEQ ID NO: 4073147 - RNA, 19 nt, Vaccinia virus
guuaaauuuuacaaaucua

SEQ ID NO: 4073148 - RNA, 16 nt, Vaccinia virus
guuaacauuuuauuau

SEQ ID NO: 4073149 - RNA, 19 nt, Vaccinia virus
guuaacuuugauuauccua

SEQ ID NO: 4073150 - RNA, 23 nt, Vaccinia virus
guuaagaaucgcgauucuaaaac

SEQ ID NO: 4073151 - RNA, 16 nt, Vaccinia virus
guuaagccugaauuua

SEQ ID NO: 4073152 - RNA, 12 nt, Vaccinia virus
guuaauaacauc

SEQ ID NO: 4073153 - RNA, 15 nt, Vaccinia virus
guuaauaauaaucuc

SEQ ID NO: 4073154 - RNA, 21 nt, Vaccinia virus
guuaauuucacaacuuuacug

SEQ ID NO: 4073155 - RNA, 15 nt, Vaccinia virus
guuaauuucuauuca

SEQ ID NO: 4073156 - RNA, 19 nt, Vaccinia virus
guuacaucaguuauaaaaa

SEQ ID NO: 4073157 - RNA, 17 nt, Vaccinia virus
guuacguuuacauguga

SEQ ID NO: 4073158 - RNA, 14 nt, Vaccinia virus
guuacuaaauuaau

SEQ ID NO: 4073159 - RNA, 18 nt, Vaccinia virus
guuagaaagcagauuaga

SEQ ID NO: 4073160 - RNA, 19 nt, Vaccinia virus
guuagaacgguuauagcau

SEQ ID NO: 4073161 - RNA, 17 nt, Vaccinia virus
guuagaaguuuuaaaaa

SEQ ID NO: 4073162 - RNA, 15 nt, Vaccinia virus
guuagauauagaaga

SEQ ID NO: 4073163 - RNA, 21 nt, Vaccinia virus
guuagauccaacauuaaucaa

SEQ ID NO: 4073164 - RNA, 20 nt, Vaccinia virus
guuaggauuugguaaaucau

SEQ ID NO: 4073165 - RNA, 15 nt, Vaccinia virus
guuaguacaguguua

SEQ ID NO: 4073166 - RNA, 14 nt, Vaccinia virus
guuagucauauuac

SEQ ID NO: 4073167 - RNA, 17 nt, Vaccinia virus
guuauaaaugaaauugu

SEQ ID NO: 4073168 - RNA, 17 nt, Vaccinia virus
guuauacagauguauua

SEQ ID NO: 4073169 - RNA, 18 nt, Vaccinia virus
guuauccccuuuauguaa

SEQ ID NO: 4073170 - RNA, 14 nt, Vaccinia virus
guuaugagggaaaa

SEQ ID NO: 4073171 - RNA, 20 nt, Vaccinia virus
guuauucuguucuauucaaa

SEQ ID NO: 4073172 - RNA, 15 nt, Vaccinia virus
guucaaaaauuuaga

SEQ ID NO: 4073173 - RNA, 16 nt, Vaccinia virus
uacugcuauacagaug

SEQ ID NO: 4073174 - RNA, 16 nt, Vaccinia virus
uacugcuggaaaauaa

SEQ ID NO: 4073175 - RNA, 17 nt, Vaccinia virus
uacuggaugaagaugug

SEQ ID NO: 4073176 - RNA, 18 nt, Vaccinia virus
uacugggauaagauuucc

SEQ ID NO: 4073177 - RNA, 21 nt, Vaccinia virus
uacuguauugauuacagugua

SEQ ID NO: 4073178 - RNA, 18 nt, Vaccinia virus
uacuuauuaguaaaacua

SEQ ID NO: 4073179 - RNA, 20 nt, Vaccinia virus
uacuucacucaucgauucaa

SEQ ID NO: 4073180 - RNA, 16 nt, Vaccinia virus
uacuuuaaagaaguag

SEQ ID NO: 4073181 - RNA, 19 nt, Vaccinia virus
uacuuugucggauuaucua

SEQ ID NO: 4073182 - RNA, 10 nt, Vaccinia virus
uacuuuucua

SEQ ID NO: 4073183 - RNA, 14 nt, Vaccinia virus
uacuuuuuacuaau

SEQ ID NO: 4073184 - RNA, 18 nt, Vaccinia virus
uacuuuuugcguauacau

SEQ ID NO: 4073185 - RNA, 13 nt, Vaccinia virus
uagaaaaaugcua

SEQ ID NO: 4073186 - RNA, 19 nt, Vaccinia virus
uagaaaauaauauagauuu

SEQ ID NO: 4073187 - RNA, 13 nt, Vaccinia virus
uagaaaauggauu

SEQ ID NO: 4073188 - RNA, 19 nt, Vaccinia virus
uagaaacuauacgaaauaa

SEQ ID NO: 4073189 - RNA, 22 nt, Vaccinia virus
uagaaagaaauuuguaaucauc

SEQ ID NO: 4073190 - RNA, 17 nt, Vaccinia virus
uagaaaguaauggauua

SEQ ID NO: 4073191 - RNA, 19 nt, Vaccinia virus
uagaaauaucuaggacaau

SEQ ID NO: 4073192 - RNA, 14 nt, Vaccinia virus
uagaaaucauauau

SEQ ID NO: 4073193 - RNA, 19 nt, Vaccinia virus
uagaaauuaucaaauguug

SEQ ID NO: 4073194 - RNA, 13 nt, Vaccinia virus
uagaacuuaacuu

SEQ ID NO: 4073195 - RNA, 16 nt, Vaccinia virus
uagaagaauucuugga

SEQ ID NO: 4073196 - RNA, 18 nt, Vaccinia virus
uagaagacaauaaagaua

SEQ ID NO: 4073197 - RNA, 16 nt, Vaccinia virus
uagaaguuguaaauga

SEQ ID NO: 4073198 - RNA, 12 nt, Vaccinia virus
uagaauaugucu

SEQ ID NO: 4073199 - RNA, 24 nt, Vaccinia virus
uagaaucagcgucguuuaacacaa

SEQ ID NO: 4073200 - RNA, 18 nt, Vaccinia virus
uagaauuuauaaacauca

SEQ ID NO: 4073201 - RNA, 12 nt, Vaccinia virus
uagaauuuccaa

SEQ ID NO: 4073202 - RNA, 16 nt, Vaccinia virus
uagaauuugaucuauu

SEQ ID NO: 4073203 - RNA, 19 nt, Vaccinia virus
uagacacgacuaaacauuu

SEQ ID NO: 4073204 - RNA, 16 nt, Vaccinia virus
uagacagaauaucgug

SEQ ID NO: 4073205 - RNA, 11 nt, Vaccinia virus
uagacauagau

SEQ ID NO: 4073206 - RNA, 21 nt, Vaccinia virus
uagacauaucgguaaaaugca

SEQ ID NO: 4073207 - RNA, 14 nt, Vaccinia virus
uagagacaaugaaa

SEQ ID NO: 4073208 - RNA, 17 nt, Vaccinia virus
uagagauacaauauuua

SEQ ID NO: 4073209 - RNA, 19 nt, Vaccinia virus
uagagauaccaaagacuuu

SEQ ID NO: 4073210 - RNA, 13 nt, Vaccinia virus
uagagauggauau

SEQ ID NO: 4073211 - RNA, 16 nt, Vaccinia virus
uagagauuauaucuuu

SEQ ID NO: 4073212 - RNA, 17 nt, Vaccinia virus
uagagauucgaugguuu

SEQ ID NO: 4073213 - RNA, 11 nt, Vaccinia virus
uagagauuuca

SEQ ID NO: 4073214 - RNA, 18 nt, Vaccinia virus
uagaggaauaucaucaaa

SEQ ID NO: 4073215 - RNA, 14 nt, Vaccinia virus
uagaggagaaguaa

SEQ ID NO: 4073216 - RNA, 19 nt, Vaccinia virus
uagaggaucuauuagaugu

SEQ ID NO: 4073217 - RNA, 17 nt, Vaccinia virus
uagaguccauuuaaagu

SEQ ID NO: 4073218 - RNA, 22 nt, Vaccinia virus
uagagugagucuagaauucauu

SEQ ID NO: 4073219 - RNA, 20 nt, Vaccinia virus
uagauaaaaaggaaucuauu

SEQ ID NO: 4073220 - RNA, 16 nt, Vaccinia virus
uagauaaaguagaugu

SEQ ID NO: 4073221 - RNA, 14 nt, Vaccinia virus
uagauaaauuuauc

SEQ ID NO: 4073222 - RNA, 12 nt, Vaccinia virus
uagauaacucuc

SEQ ID NO: 4073223 - RNA, 23 nt, Vaccinia virus
uagauaaugguagcaauaugcua

SEQ ID NO: 4073224 - RNA, 12 nt, Vaccinia virus
uagauacaaaau

SEQ ID NO: 4073225 - RNA, 17 nt, Vaccinia virus
uagauacaauggaugau

SEQ ID NO: 4073226 - RNA, 15 nt, Vaccinia virus
uagauauagaacaau

SEQ ID NO: 4073227 - RNA, 16 nt, Vaccinia virus
uagauaugugauuuac

SEQ ID NO: 4073228 - RNA, 17 nt, Vaccinia virus
uagauauuaguaaauua

SEQ ID NO: 4073229 - RNA, 18 nt, Vaccinia virus
uagauauuaguaaauuaa

SEQ ID NO: 4073230 - RNA, 15 nt, Vaccinia virus
uagaucaaauacuug

SEQ ID NO: 4073231 - RNA, 21 nt, Vaccinia virus
uagaucccggauacuggauau

SEQ ID NO: 4073232 - RNA, 20 nt, Vaccinia virus
uagaucugagaauggaugau

SEQ ID NO: 4073233 - RNA, 20 nt, Vaccinia virus
uagaugaaauacucuucaaa

SEQ ID NO: 4073234 - RNA, 20 nt, Vaccinia virus
uagaugauaauuuauacaaa

SEQ ID NO: 4073235 - RNA, 13 nt, Vaccinia virus
uagauguggaugu

SEQ ID NO: 4073236 - RNA, 13 nt, Vaccinia virus
uagauuaaaucca

SEQ ID NO: 4073237 - RNA, 15 nt, Vaccinia virus
uagauugacgacuuu

SEQ ID NO: 4073238 - RNA, 19 nt, Vaccinia virus
uagauugguacgaaauaua

SEQ ID NO: 4073239 - RNA, 16 nt, Vaccinia virus
uagauuucgaaaauac

SEQ ID NO: 4073240 - RNA, 21 nt, Vaccinia virus
uagauuucgaaaauacuaaau

SEQ ID NO: 4073241 - RNA, 17 nt, Vaccinia virus
uagauuuguaucuccuu

SEQ ID NO: 4073242 - RNA, 16 nt, Vaccinia virus
uagauuuuaucuaauu

SEQ ID NO: 4073243 - RNA, 13 nt, Vaccinia virus
uagauuuuggaua

SEQ ID NO: 4073244 - RNA, 18 nt, Vaccinia virus
uagauuuuggugaaauua

SEQ ID NO: 4073245 - RNA, 19 nt, Vaccinia virus
uagcaacaguaguucuugc

SEQ ID NO: 4073246 - RNA, 16 nt, Vaccinia virus
uagcaauuucaaaaua

SEQ ID NO: 4073247 - RNA, 16 nt, Vaccinia virus
uagcagcacaaaucaa

SEQ ID NO: 4073248 - RNA, 22 nt, Vaccinia virus
uagcagcugauacgucauuaac

SEQ ID NO: 4073249 - RNA, 16 nt, Vaccinia virus
uagcauaguuuuucau

SEQ ID NO: 4073250 - RNA, 22 nt, Vaccinia virus
uagcaucuuuccaaucaauaau

SEQ ID NO: 4073251 - RNA, 17 nt, Vaccinia virus
uagccaucguuaauuau

SEQ ID NO: 4073252 - RNA, 15 nt, Vaccinia virus
uagcgaagaaugcuu

SEQ ID NO: 4073253 - RNA, 13 nt, Vaccinia virus
uagcggaugaaaa

SEQ ID NO: 4073254 - RNA, 22 nt, Vaccinia virus
uagcgucgacaucuauauacua

SEQ ID NO: 4073255 - RNA, 15 nt, Vaccinia virus
uagcgugaaggauau

SEQ ID NO: 4073256 - RNA, 20 nt, Vaccinia virus
uagcguguuuuaaauccuua

SEQ ID NO: 4073257 - RNA, 23 nt, Vaccinia virus
uagcuaugaacuuguuuaaugac

SEQ ID NO: 4073258 - RNA, 14 nt, Vaccinia virus
uagcuauucuucuu

SEQ ID NO: 4073259 - RNA, 15 nt, Vaccinia virus
uagcuuucauaguua

SEQ ID NO: 4073260 - RNA, 13 nt, Vaccinia virus
uaggaaaaagaua

SEQ ID NO: 4073261 - RNA, 15 nt, Vaccinia virus
uaggagaacuuauag

SEQ ID NO: 4073262 - RNA, 14 nt, Vaccinia virus
uaggauaauaauua

SEQ ID NO: 4073263 - RNA, 15 nt, Vaccinia virus
uaggaucaguuauug

SEQ ID NO: 4073264 - RNA, 19 nt, Vaccinia virus
uaggauuuuggacuuauau

SEQ ID NO: 4073265 - RNA, 16 nt, Vaccinia virus
uaggauuuuuccaaag

SEQ ID NO: 4073266 - RNA, 15 nt, Vaccinia virus
uaggcguaaauuaug

SEQ ID NO: 4073267 - RNA, 13 nt, Vaccinia virus
uagguauguacca

SEQ ID NO: 4073268 - RNA, 21 nt, Vaccinia virus
uagguguuccggagaaucagu

SEQ ID NO: 4073269 - RNA, 14 nt, Vaccinia virus
uaguaaacauauca

SEQ ID NO: 4073270 - RNA, 19 nt, Vaccinia virus
uaguaaaccgauaguguau

SEQ ID NO: 4073271 - RNA, 17 nt, Vaccinia virus
uaguaacugacuuaaua

SEQ ID NO: 4073272 - RNA, 23 nt, Vaccinia virus
uaguaauuuauauuuuuacggua

SEQ ID NO: 4073273 - RNA, 19 nt, Vaccinia virus
uaguacgggcgcuguaauu

SEQ ID NO: 4073274 - RNA, 20 nt, Vaccinia virus
uaguacuacaauuuguauuu

SEQ ID NO: 4073275 - RNA, 23 nt, Vaccinia virus
uaguacuccucccauaauacuuu

SEQ ID NO: 4073276 - RNA, 19 nt, Vaccinia virus
uaguagcuucacaaagaug

SEQ ID NO: 4073277 - RNA, 18 nt, Vaccinia virus
uaguaguacacagcaugu

SEQ ID NO: 4073278 - RNA, 15 nt, Vaccinia virus
uaguauaacgugaau

SEQ ID NO: 4073279 - RNA, 22 nt, Vaccinia virus
uaguauaccaugaccuucuuca

SEQ ID NO: 4073280 - RNA, 18 nt, Vaccinia virus
uaguauccauuuuacauu

SEQ ID NO: 4073281 - RNA, 18 nt, Vaccinia virus
uaguaucguacaauucau

SEQ ID NO: 4073282 - RNA, 17 nt, Vaccinia virus
uaguauuugagaaauau

SEQ ID NO: 4073283 - RNA, 16 nt, Vaccinia virus
uagucaaucaaagaga

SEQ ID NO: 4073284 - RNA, 20 nt, Vaccinia virus
uagucuuuuuggucaucucu

SEQ ID NO: 4073285 - RNA, 15 nt, Vaccinia virus
uagugaaacaaaaua

SEQ ID NO: 4073286 - RNA, 23 nt, Vaccinia virus
uagugaaucgacuauagacauaa

SEQ ID NO: 4073287 - RNA, 17 nt, Vaccinia virus
uagugauuccauugaua

SEQ ID NO: 4073288 - RNA, 17 nt, Vaccinia virus
uagugcgccuaaaucaa

SEQ ID NO: 4073289 - RNA, 20 nt, Vaccinia virus
uagugguuauauucucugga

SEQ ID NO: 4073290 - RNA, 23 nt, Vaccinia virus
uaguguaauguuaacaaaaaugu

SEQ ID NO: 4073291 - RNA, 17 nt, Vaccinia virus
uaguguaucgacaucuu

SEQ ID NO: 4073292 - RNA, 23 nt, Vaccinia virus
uagugucaauuuuaaaugaugau

SEQ ID NO: 4073293 - RNA, 17 nt, Vaccinia virus
uaguguugcuaucucuu

SEQ ID NO: 4073294 - RNA, 17 nt, Vaccinia virus
uaguguuggauaucuuc

SEQ ID NO: 4073295 - RNA, 16 nt, Vaccinia virus
uaguuaauaaaaucua

SEQ ID NO: 4073296 - RNA, 20 nt, Vaccinia virus
uaguuaauggagaaauacuu

SEQ ID NO: 4073297 - RNA, 15 nt, Vaccinia virus
uauucuauuuuacua

SEQ ID NO: 4073298 - RNA, 20 nt, Vaccinia virus
uauucucguuaaacagcauu

SEQ ID NO: 4073299 - RNA, 21 nt, Vaccinia virus
uauucuggugcuaauuauucc

SEQ ID NO: 4073300 - RNA, 22 nt, Vaccinia virus
uauucuuaauucuuuaacaaaa

SEQ ID NO: 4073301 - RNA, 21 nt, Vaccinia virus
uauugaagaagaugacaaucu

SEQ ID NO: 4073302 - RNA, 16 nt, Vaccinia virus
uauugaagaugaugug

SEQ ID NO: 4073303 - RNA, 13 nt, Vaccinia virus
uauugaguggaaa

SEQ ID NO: 4073304 - RNA, 20 nt, Vaccinia virus
uauugcaaaucacucaauau

SEQ ID NO: 4073305 - RNA, 18 nt, Vaccinia virus
uauugcgacguucauaga

SEQ ID NO: 4073306 - RNA, 16 nt, Vaccinia virus
uauuggaauuauaaua

SEQ ID NO: 4073307 - RNA, 19 nt, Vaccinia virus
uauugguccauuaucagua

SEQ ID NO: 4073308 - RNA, 22 nt, Vaccinia virus
uauuguauuaauuaugaaaaac

SEQ ID NO: 4073309 - RNA, 14 nt, Vaccinia virus
uauuguuacagaug

SEQ ID NO: 4073310 - RNA, 14 nt, Vaccinia virus
uauuuaauaucaaa

SEQ ID NO: 4073311 - RNA, 19 nt, Vaccinia virus
uauuuacaucuaauuuacu

SEQ ID NO: 4073312 - RNA, 17 nt, Vaccinia virus
uauuuaguuuauucaua

SEQ ID NO: 4073313 - RNA, 14 nt, Vaccinia virus
uauuuauuuaaaau

SEQ ID NO: 4073314 - RNA, 21 nt, Vaccinia virus
uauuucuuucaugacugauuu

SEQ ID NO: 4073315 - RNA, 18 nt, Vaccinia virus
uauuuggcuagucaagau

SEQ ID NO: 4073316 - RNA, 20 nt, Vaccinia virus
uauuuguacacaucuaucaa

SEQ ID NO: 4073317 - RNA, 13 nt, Vaccinia virus
uauuuuacucauu

SEQ ID NO: 4073318 - RNA, 12 nt, Vaccinia virus
uauuuuaucauu

SEQ ID NO: 4073319 - RNA, 16 nt, Vaccinia virus
uauuuuauuucaaaau

SEQ ID NO: 4073320 - RNA, 20 nt, Vaccinia virus
uauuuucuauuuuuuaaauu

SEQ ID NO: 4073321 - RNA, 18 nt, Vaccinia virus
uauuuugcaauuucuuca

SEQ ID NO: 4073322 - RNA, 21 nt, Vaccinia virus
uauuuuuuucuauguuauaua

SEQ ID NO: 4073323 - RNA, 18 nt, Vaccinia virus
ucaaaacauauaaaucua

SEQ ID NO: 4073324 - RNA, 14 nt, Vaccinia virus
ucaaaagaaaucuu

SEQ ID NO: 4073325 - RNA, 16 nt, Vaccinia virus
ucaaaauagaaaauug

SEQ ID NO: 4073326 - RNA, 21 nt, Vaccinia virus
ucaaaauuguaacaacaaugu

SEQ ID NO: 4073327 - RNA, 12 nt, Vaccinia virus
ucaaagaaaaag

SEQ ID NO: 4073328 - RNA, 13 nt, Vaccinia virus
ucaaauagauguu

SEQ ID NO: 4073329 - RNA, 21 nt, Vaccinia virus
ucaaauccauaaauaaaguau

SEQ ID NO: 4073330 - RNA, 12 nt, Vaccinia virus
ucaaaucuauau

SEQ ID NO: 4073331 - RNA, 19 nt, Vaccinia virus
ucaaauggauuccauggaa

SEQ ID NO: 4073332 - RNA, 16 nt, Vaccinia virus
ucaaaugguacaaaaa

SEQ ID NO: 4073333 - RNA, 14 nt, Vaccinia virus
ucaaauguaguguu

SEQ ID NO: 4073334 - RNA, 13 nt, Vaccinia virus
ucaaauuaagcau

SEQ ID NO: 4073335 - RNA, 18 nt, Vaccinia virus
ucaaauuaagcauuuugg

SEQ ID NO: 4073336 - RNA, 22 nt, Vaccinia virus
ucaaauuugguaauucuauuaa

SEQ ID NO: 4073337 - RNA, 14 nt, Vaccinia virus
ucaaauuuuuucuu

SEQ ID NO: 4073338 - RNA, 15 nt, Vaccinia virus
ucaacaaaacucaaa

SEQ ID NO: 4073339 - RNA, 17 nt, Vaccinia virus
ucaacaaguguguagau

SEQ ID NO: 4073340 - RNA, 15 nt, Vaccinia virus
ucaacaaucguuaau

SEQ ID NO: 4073341 - RNA, 21 nt, Vaccinia virus
ucaacaauuuuguauuauucu

SEQ ID NO: 4073342 - RNA, 14 nt, Vaccinia virus
ucaacaucuuugau

SEQ ID NO: 4073343 - RNA, 23 nt, Vaccinia virus
ucaaccaaccgaauggaguaaaa

SEQ ID NO: 4073344 - RNA, 17 nt, Vaccinia virus
ucaaccacucgaaaaag

SEQ ID NO: 4073345 - RNA, 16 nt, Vaccinia virus
ucaacggaaaacauuu

SEQ ID NO: 4073346 - RNA, 18 nt, Vaccinia virus
ucaagacguggcaaacaa

SEQ ID NO: 4073347 - RNA, 20 nt, Vaccinia virus
ucaaggacaguuaaaacuau

SEQ ID NO: 4073348 - RNA, 21 nt, Vaccinia virus
ucaauagaauaugucucuuaa

SEQ ID NO: 4073349 - RNA, 15 nt, Vaccinia virus
ucaauagauuauaca

SEQ ID NO: 4073350 - RNA, 17 nt, Vaccinia virus
ucaauagauugguaaau

SEQ ID NO: 4073351 - RNA, 16 nt, Vaccinia virus
ucaauaguuucauaau

SEQ ID NO: 4073352 - RNA, 21 nt, Vaccinia virus
ucaauauacuauucuugugau

SEQ ID NO: 4073353 - RNA, 22 nt, Vaccinia virus
ucaaucguuuaaaguaaacuuc

SEQ ID NO: 4073354 - RNA, 14 nt, Vaccinia virus
ucaaugaagaguau

SEQ ID NO: 4073355 - RNA, 15 nt, Vaccinia virus
ucaaugugaauguau

SEQ ID NO: 4073356 - RNA, 23 nt, Vaccinia virus
ucaaugugaauguauucacuuaa

SEQ ID NO: 4073357 - RNA, 20 nt, Vaccinia virus
ucaauguguguaacuccaga

SEQ ID NO: 4073358 - RNA, 19 nt, Vaccinia virus
ucaauucguucgaugagua

SEQ ID NO: 4073359 - RNA, 15 nt, Vaccinia virus
ucaauucuucuacau

SEQ ID NO: 4073360 - RNA, 14 nt, Vaccinia virus
ucaauuuguacauc

SEQ ID NO: 4073361 - RNA, 20 nt, Vaccinia virus
ucacaaagauggcugaaauc

SEQ ID NO: 4073362 - RNA, 22 nt, Vaccinia virus
ucacaaguaugaagaaaaaugu

SEQ ID NO: 4073363 - RNA, 22 nt, Vaccinia virus
ucacagacacugucucauacac

SEQ ID NO: 4073364 - RNA, 14 nt, Vaccinia virus
ucacagauucuauu

SEQ ID NO: 4073365 - RNA, 11 nt, Vaccinia virus
ucacagucugu

SEQ ID NO: 4073366 - RNA, 15 nt, Vaccinia virus
ucacauccaccaaug

SEQ ID NO: 4073367 - RNA, 12 nt, Vaccinia virus
ucaccaauaaaa

SEQ ID NO: 4073368 - RNA, 21 nt, Vaccinia virus
ucaccaauaaaaauaaacuag

SEQ ID NO: 4073369 - RNA, 17 nt, Vaccinia virus
ucaccaguauguauucc

SEQ ID NO: 4073370 - RNA, 23 nt, Vaccinia virus
ucaccgauaaacgucauuucucu

SEQ ID NO: 4073371 - RNA, 20 nt, Vaccinia virus
ucacgaaaaaugaugaaggc

SEQ ID NO: 4073372 - RNA, 15 nt, Vaccinia virus
ucacguaaauacaaa

SEQ ID NO: 4073373 - RNA, 16 nt, Vaccinia virus
ucacuaacaauaacua

SEQ ID NO: 4073374 - RNA, 15 nt, Vaccinia virus
ucacuaauaaauugg

SEQ ID NO: 4073375 - RNA, 18 nt, Vaccinia virus
ucacuaugaaacaaaugu

SEQ ID NO: 4073376 - RNA, 21 nt, Vaccinia virus
ucacuguucuuuacaguuucu

SEQ ID NO: 4073377 - RNA, 14 nt, Vaccinia virus
ucacuguuguacau

SEQ ID NO: 4073378 - RNA, 13 nt, Vaccinia virus
ucacuucucuuca

SEQ ID NO: 4073379 - RNA, 21 nt, Vaccinia virus
ucacuucucuucauuacuacu

SEQ ID NO: 4073380 - RNA, 22 nt, Vaccinia virus
ucagaaagcugggggauguucu

SEQ ID NO: 4073381 - RNA, 13 nt, Vaccinia virus
ucagaaauuauuc

SEQ ID NO: 4073382 - RNA, 19 nt, Vaccinia virus
ucagaacgcucgucaauau

SEQ ID NO: 4073383 - RNA, 22 nt, Vaccinia virus
ucagaauaggaugaauauagua

SEQ ID NO: 4073384 - RNA, 13 nt, Vaccinia virus
ucagacaacaucu

SEQ ID NO: 4073385 - RNA, 19 nt, Vaccinia virus
ucagacgaguguaaacacu

SEQ ID NO: 4073386 - RNA, 15 nt, Vaccinia virus
ucagagaacuucugc

SEQ ID NO: 4073387 - RNA, 14 nt, Vaccinia virus
ucagcgcauaauaa

SEQ ID NO: 4073388 - RNA, 16 nt, Vaccinia virus
ucagcggcaucuaaau

SEQ ID NO: 4073389 - RNA, 14 nt, Vaccinia virus
ucagcgugauuuuc

SEQ ID NO: 4073390 - RNA, 12 nt, Vaccinia virus
ucaggaaaugua

SEQ ID NO: 4073391 - RNA, 20 nt, Vaccinia virus
ucaggaauccaaagagcuau

SEQ ID NO: 4073392 - RNA, 13 nt, Vaccinia virus
ucaguuacaaaac

SEQ ID NO: 4073393 - RNA, 14 nt, Vaccinia virus
ucauaaauuacaca

SEQ ID NO: 4073394 - RNA, 22 nt, Vaccinia virus
ucauaacuccggauagagaaau

SEQ ID NO: 4073395 - RNA, 17 nt, Vaccinia virus
ucauaauauuaaucauc

SEQ ID NO: 4073396 - RNA, 15 nt, Vaccinia virus
ucauaauuaauacaa

SEQ ID NO: 4073397 - RNA, 17 nt, Vaccinia virus
ucauaauuacauuuaga

SEQ ID NO: 4073398 - RNA, 21 nt, Vaccinia virus
ucauacauaugguacgauguu

SEQ ID NO: 4073399 - RNA, 16 nt, Vaccinia virus
ucauacaugauauuca

SEQ ID NO: 4073400 - RNA, 22 nt, Vaccinia virus
ucauauaaauguuuaacguuuu

SEQ ID NO: 4073401 - RNA, 20 nt, Vaccinia virus
ucauauaacuucuagaugua

SEQ ID NO: 4073402 - RNA, 16 nt, Vaccinia virus
ucauauaggaaacuau

SEQ ID NO: 4073403 - RNA, 19 nt, Vaccinia virus
ucauauauuuauagaagau

SEQ ID NO: 4073404 - RNA, 20 nt, Vaccinia virus
ucauauguauaaaugaagua

SEQ ID NO: 4073405 - RNA, 16 nt, Vaccinia virus
ucauauuaaacauacu

SEQ ID NO: 4073406 - RNA, 18 nt, Vaccinia virus
ucauauucaucaucaaua

SEQ ID NO: 4073407 - RNA, 24 nt, Vaccinia virus
ucauauugaacgguaucuucuuaa

SEQ ID NO: 4073408 - RNA, 21 nt, Vaccinia virus
ucaucaauguagaaaaugccc

SEQ ID NO: 4073409 - RNA, 13 nt, Vaccinia virus
ucaucacauaucg

SEQ ID NO: 4073410 - RNA, 22 nt, Vaccinia virus
ucaucacugucaucaguuaugu

SEQ ID NO: 4073411 - RNA, 19 nt, Vaccinia virus
ucaucacuuagaacagauu

SEQ ID NO: 4073412 - RNA, 18 nt, Vaccinia virus
ucaucagauaagauuuua

SEQ ID NO: 4073413 - RNA, 23 nt, Vaccinia virus
ucaucaucaacaauccaauaaua

SEQ ID NO: 4073414 - RNA, 19 nt, Vaccinia virus
ucaucaucguuacaauaaa

SEQ ID NO: 4073415 - RNA, 22 nt, Vaccinia virus
ucaucauuguguaaacuaaaua

SEQ ID NO: 4073416 - RNA, 16 nt, Vaccinia virus
ucaucauuuuuucacc

SEQ ID NO: 4073417 - RNA, 14 nt, Vaccinia virus
ucauccuugcuauc

SEQ ID NO: 4073418 - RNA, 23 nt, Vaccinia virus
ucaucgacuguacgauacauaau

SEQ ID NO: 4073419 - RNA, 13 nt, Vaccinia virus
ucaucuacaaaaa

SEQ ID NO: 4073420 - RNA, 13 nt, Vaccinia virus
ucaucuauaaaug

SEQ ID NO: 4073421 - RNA, 19 nt, Vaccinia virus
aauaauucauguauuucga

SEQ ID NO: 4073422 - RNA, 13 nt, Vaccinia virus
aauaauuuaucau

SEQ ID NO: 4073423 - RNA, 21 nt, Vaccinia virus
aauaauuuugaagcauuggaa

SEQ ID NO: 4073424 - RNA, 11 nt, Vaccinia virus
aauacaaaauc

SEQ ID NO: 4073425 - RNA, 15 nt, Vaccinia virus
aauacaaaaucaucu

SEQ ID NO: 4073426 - RNA, 14 nt, Vaccinia virus
aauacaaaugacua

SEQ ID NO: 4073427 - RNA, 21 nt, Vaccinia virus
aauacaagagaaugaaauaua

SEQ ID NO: 4073428 - RNA, 20 nt, Vaccinia virus
aauacaaggcacuaugucca

SEQ ID NO: 4073429 - RNA, 16 nt, Vaccinia virus
aauacacguuaauaca

SEQ ID NO: 4073430 - RNA, 21 nt, Vaccinia virus
aauacacuuacagaaaagaua

SEQ ID NO: 4073431 - RNA, 12 nt, Vaccinia virus
aauacaggauua

SEQ ID NO: 4073432 - RNA, 19 nt, Vaccinia virus
aauacauaauuuuguaaaa

SEQ ID NO: 4073433 - RNA, 22 nt, Vaccinia virus
aauacauuuaaauucaucaucu

SEQ ID NO: 4073434 - RNA, 22 nt, Vaccinia virus
aauaccgacgcgccugaauauc

SEQ ID NO: 4073435 - RNA, 17 nt, Vaccinia virus
aauacgaaaauccaugc

SEQ ID NO: 4073436 - RNA, 18 nt, Vaccinia virus
aauacgaugauauuaaaa

SEQ ID NO: 4073437 - RNA, 19 nt, Vaccinia virus
aauacgaugauauuaaaau

SEQ ID NO: 4073438 - RNA, 17 nt, Vaccinia virus
aauacguucauuaaaaa

SEQ ID NO: 4073439 - RNA, 15 nt, Vaccinia virus
aauacguuggucuau

SEQ ID NO: 4073440 - RNA, 23 nt, Vaccinia virus
aauacuaauuuguuuuacucuau

SEQ ID NO: 4073441 - RNA, 20 nt, Vaccinia virus
aauacuacgauuaacgauga

SEQ ID NO: 4073442 - RNA, 23 nt, Vaccinia virus
aauacucauuuucuuuuggaaaa

SEQ ID NO: 4073443 - RNA, 19 nt, Vaccinia virus
aauacugaugcauuuucca

SEQ ID NO: 4073444 - RNA, 12 nt, Vaccinia virus
aauacuguaaua

SEQ ID NO: 4073445 - RNA, 14 nt, Vaccinia virus
aauacuuaaaaaug

SEQ ID NO: 4073446 - RNA, 17 nt, Vaccinia virus
aauacuuaaaaauggau

SEQ ID NO: 4073447 - RNA, 18 nt, Vaccinia virus
aauacuuaccuaaugccu

SEQ ID NO: 4073448 - RNA, 16 nt, Vaccinia virus
aauacuucauuucuaa

SEQ ID NO: 4073449 - RNA, 21 nt, Vaccinia virus
aauacuuuuguuacuaauauc

SEQ ID NO: 4073450 - RNA, 17 nt, Vaccinia virus
aauagaaacguacuacu

SEQ ID NO: 4073451 - RNA, 23 nt, Vaccinia virus
aauagaaugcucuuaaauaaugu

SEQ ID NO: 4073452 - RNA, 13 nt, Vaccinia virus
aauagauaaaacg

SEQ ID NO: 4073453 - RNA, 14 nt, Vaccinia virus
aauagauggauaaa

SEQ ID NO: 4073454 - RNA, 18 nt, Vaccinia virus
aauagauguuaguacagu

SEQ ID NO: 4073455 - RNA, 19 nt, Vaccinia virus
aauagcuaacgcuaguaau

SEQ ID NO: 4073456 - RNA, 15 nt, Vaccinia virus
aauagcucaauauaa

SEQ ID NO: 4073457 - RNA, 19 nt, Vaccinia virus
aauaggaguaauagaacug

SEQ ID NO: 4073458 - RNA, 20 nt, Vaccinia virus
aauaggguaucuaauuuccu

SEQ ID NO: 4073459 - RNA, 23 nt, Vaccinia virus
aauagguguaaaucuaggaauua

SEQ ID NO: 4073460 - RNA, 19 nt, Vaccinia virus
aauaguaauuuuuuaucau

SEQ ID NO: 4073461 - RNA, 18 nt, Vaccinia virus
aauaguauacgcagaaaa

SEQ ID NO: 4073462 - RNA, 22 nt, Vaccinia virus
aauaguauuugagaaauaugua

SEQ ID NO: 4073463 - RNA, 16 nt, Vaccinia virus
aauagucaauagauua

SEQ ID NO: 4073464 - RNA, 18 nt, Vaccinia virus
aauaguccguguaaucca

SEQ ID NO: 4073465 - RNA, 17 nt, Vaccinia virus
aauagugccaucagaau

SEQ ID NO: 4073466 - RNA, 22 nt, Vaccinia virus
aauaguuuacagauauuuucca

SEQ ID NO: 4073467 - RNA, 22 nt, Vaccinia virus
aauaguuucauaauuguuagcu

SEQ ID NO: 4073468 - RNA, 23 nt, Vaccinia virus
aauaguuuguacugcaaaaauaa

SEQ ID NO: 4073469 - RNA, 14 nt, Vaccinia virus
aauauaaaaugaca

SEQ ID NO: 4073470 - RNA, 20 nt, Vaccinia virus
aauauauaagacacagaaau

SEQ ID NO: 4073471 - RNA, 21 nt, Vaccinia virus
aauauauaagacacagaaaua

SEQ ID NO: 4073472 - RNA, 14 nt, Vaccinia virus
aauauauacaguag

SEQ ID NO: 4073473 - RNA, 15 nt, Vaccinia virus
aauauauacguugau

SEQ ID NO: 4073474 - RNA, 20 nt, Vaccinia virus
aauauauacuucaauugaua

SEQ ID NO: 4073475 - RNA, 17 nt, Vaccinia virus
aauauaucaaacaugga

SEQ ID NO: 4073476 - RNA, 19 nt, Vaccinia virus
aauauaucaaacauggaga

SEQ ID NO: 4073477 - RNA, 22 nt, Vaccinia virus
aauauaucaaucaaaacagaau

SEQ ID NO: 4073478 - RNA, 17 nt, Vaccinia virus
aauauaucccuuaaaaa

SEQ ID NO: 4073479 - RNA, 23 nt, Vaccinia virus
aauauaucuauaauuugauccau

SEQ ID NO: 4073480 - RNA, 14 nt, Vaccinia virus
aauauaucuuauau

SEQ ID NO: 4073481 - RNA, 16 nt, Vaccinia virus
aauauauguugauaau

SEQ ID NO: 4073482 - RNA, 14 nt, Vaccinia virus
aauauauugaucau

SEQ ID NO: 4073483 - RNA, 17 nt, Vaccinia virus
aauauauugaucauaau

SEQ ID NO: 4073484 - RNA, 22 nt, Vaccinia virus
aauauauuuggauuuguggugu

SEQ ID NO: 4073485 - RNA, 19 nt, Vaccinia virus
aauauauuuuuuuaguaau

SEQ ID NO: 4073486 - RNA, 17 nt, Vaccinia virus
aauaucaaacaauccaa

SEQ ID NO: 4073487 - RNA, 15 nt, Vaccinia virus
aauaucagaaaggau

SEQ ID NO: 4073488 - RNA, 16 nt, Vaccinia virus
aauaucaguaucuucu

SEQ ID NO: 4073489 - RNA, 23 nt, Vaccinia virus
aauaucauaacuuaguucuuuua

SEQ ID NO: 4073490 - RNA, 21 nt, Vaccinia virus
aauaucauuaacgauauccaa

SEQ ID NO: 4073491 - RNA, 16 nt, Vaccinia virus
aauauccauuuuguuc

SEQ ID NO: 4073492 - RNA, 13 nt, Vaccinia virus
aauauccucaaua

SEQ ID NO: 4073493 - RNA, 20 nt, Vaccinia virus
aauaucuaauggauaaacug

SEQ ID NO: 4073494 - RNA, 15 nt, Vaccinia virus
aauaucuaggacaau

SEQ ID NO: 4073495 - RNA, 18 nt, Vaccinia virus
aauaucuccucaaggaau

SEQ ID NO: 4073496 - RNA, 15 nt, Vaccinia virus
aauaucuuuauaaga

SEQ ID NO: 4073497 - RNA, 10 nt, Vaccinia virus
aauaugaacc

SEQ ID NO: 4073498 - RNA, 18 nt, Vaccinia virus
aauaugaguaaugaaauc

SEQ ID NO: 4073499 - RNA, 19 nt, Vaccinia virus
aauaugaguuggaguugau

SEQ ID NO: 4073500 - RNA, 16 nt, Vaccinia virus
aauaugauuaacaagu

SEQ ID NO: 4073501 - RNA, 15 nt, Vaccinia virus
aauaugauuagaagu

SEQ ID NO: 4073502 - RNA, 21 nt, Vaccinia virus
aauaugauuuggccaaaugua

SEQ ID NO: 4073503 - RNA, 22 nt, Vaccinia virus
aauauggacacgcggcuguaaa

SEQ ID NO: 4073504 - RNA, 23 nt, Vaccinia virus
aauauggagagguguauuuccau

SEQ ID NO: 4073505 - RNA, 22 nt, Vaccinia virus
aauaugggauaacgaauccaau

SEQ ID NO: 4073506 - RNA, 21 nt, Vaccinia virus
aauaugucaucuauggaauua

SEQ ID NO: 4073507 - RNA, 13 nt, Vaccinia virus
aauauuaaaacua

SEQ ID NO: 4073508 - RNA, 16 nt, Vaccinia virus
aauauuaaauaucugu

SEQ ID NO: 4073509 - RNA, 17 nt, Vaccinia virus
aauauuacuaauugaua

SEQ ID NO: 4073510 - RNA, 12 nt, Vaccinia virus
aauauuagaaaa

SEQ ID NO: 4073511 - RNA, 19 nt, Vaccinia virus
aauauuagaguuaggcaau

SEQ ID NO: 4073512 - RNA, 12 nt, Vaccinia virus
aauauuaggaau

SEQ ID NO: 4073513 - RNA, 23 nt, Vaccinia virus
aauauuaugaaugagagauaccu

SEQ ID NO: 4073514 - RNA, 17 nt, Vaccinia virus
aauauucagaguccucu

SEQ ID NO: 4073515 - RNA, 19 nt, Vaccinia virus
aauauucauuaauucuaua

SEQ ID NO: 4073516 - RNA, 18 nt, Vaccinia virus
aauauuggaaaacuuuaa

SEQ ID NO: 4073517 - RNA, 19 nt, Vaccinia virus
aauauuuaacucaugauga

SEQ ID NO: 4073518 - RNA, 17 nt, Vaccinia virus
aauauuucauuagaugu

SEQ ID NO: 4073519 - RNA, 16 nt, Vaccinia virus
aauauuucuauuucua

SEQ ID NO: 4073520 - RNA, 17 nt, Vaccinia virus
aauauuuuaauagauua

SEQ ID NO: 4073521 - RNA, 20 nt, Vaccinia virus
aauauuuuucguuuacaaaa

SEQ ID NO: 4073522 - RNA, 20 nt, Vaccinia virus
aaucaaccaccgaugaugcg

SEQ ID NO: 4073523 - RNA, 16 nt, Vaccinia virus
aaucaagauucauuuu

SEQ ID NO: 4073524 - RNA, 14 nt, Vaccinia virus
aaucaaucauauua

SEQ ID NO: 4073525 - RNA, 19 nt, Vaccinia virus
aaucacagcaguaguuuaa

SEQ ID NO: 4073526 - RNA, 16 nt, Vaccinia virus
aaucagaaucuaauga

SEQ ID NO: 4073527 - RNA, 21 nt, Vaccinia virus
aaucagacucugguauuuaua

SEQ ID NO: 4073528 - RNA, 19 nt, Vaccinia virus
aaucauauaaaaaaugauu

SEQ ID NO: 4073529 - RNA, 17 nt, Vaccinia virus
aaucauauacaacucuu

SEQ ID NO: 4073530 - RNA, 14 nt, Vaccinia virus
aaucauauaugaua

SEQ ID NO: 4073531 - RNA, 15 nt, Vaccinia virus
aaucauauuuagaaa

SEQ ID NO: 4073532 - RNA, 18 nt, Vaccinia virus
aaucaucaauccuucaga

SEQ ID NO: 4073533 - RNA, 18 nt, Vaccinia virus
aaucauccuaagaugaua

SEQ ID NO: 4073534 - RNA, 18 nt, Vaccinia virus
aaucaugacguaaaugua

SEQ ID NO: 4073535 - RNA, 21 nt, Vaccinia virus
aaucaugugauuaugaauauu

SEQ ID NO: 4073536 - RNA, 23 nt, Vaccinia virus
aaucauuaucgauacuaauuaca

SEQ ID NO: 4073537 - RNA, 20 nt, Vaccinia virus
aaucauuccaucgauacauc

SEQ ID NO: 4073538 - RNA, 22 nt, Vaccinia virus
aaucauuccucauaagaugaua

SEQ ID NO: 4073539 - RNA, 14 nt, Vaccinia virus
aaucauuuaaucca

SEQ ID NO: 4073540 - RNA, 19 nt, Vaccinia virus
aaucauuuuuuuaaaacug

SEQ ID NO: 4073541 - RNA, 18 nt, Vaccinia virus
aauccaauuguuugauau

SEQ ID NO: 4073542 - RNA, 16 nt, Vaccinia virus
aauccauaaauaaagu

SEQ ID NO: 4073543 - RNA, 14 nt, Vaccinia virus
aauccauugauaau

SEQ ID NO: 4073544 - RNA, 22 nt, Vaccinia virus
aauccuauaccgaguacuguaa

SEQ ID NO: 4073545 - RNA, 18 nt, Vaccinia virus
aauccuuaaguucauaau

SEQ ID NO: 4073546 - RNA, 20 nt, Vaccinia virus
aauccuuggccuuugauucg

SEQ ID NO: 4073547 - RNA, 15 nt, Vaccinia virus
aauccuuugauuauc

SEQ ID NO: 4073548 - RNA, 15 nt, Vaccinia virus
aaucgauaacaagau

SEQ ID NO: 4073549 - RNA, 16 nt, Vaccinia virus
aaucgauuuuguaaua

SEQ ID NO: 4073550 - RNA, 22 nt, Vaccinia virus
aaucguacucauuauuggaaaa

SEQ ID NO: 4073551 - RNA, 14 nt, Vaccinia virus
aaucuaagaaauuu

SEQ ID NO: 4073552 - RNA, 16 nt, Vaccinia virus
aaucuaauauuaagaa

SEQ ID NO: 4073553 - RNA, 11 nt, Vaccinia virus
aaucuagcauu

SEQ ID NO: 4073554 - RNA, 21 nt, Vaccinia virus
aaucuaguacgcgaaauaaua

SEQ ID NO: 4073555 - RNA, 13 nt, Vaccinia virus
aaucuauaauauc

SEQ ID NO: 4073556 - RNA, 12 nt, Vaccinia virus
aaucuauaugac

SEQ ID NO: 4073557 - RNA, 15 nt, Vaccinia virus
aaucuauuagaauug

SEQ ID NO: 4073558 - RNA, 16 nt, Vaccinia virus
aaucuauucccuugau

SEQ ID NO: 4073559 - RNA, 17 nt, Vaccinia virus
aaucucaucaucgaaga

SEQ ID NO: 4073560 - RNA, 21 nt, Vaccinia virus
aaucucgucaguauugacaau

SEQ ID NO: 4073561 - RNA, 16 nt, Vaccinia virus
aaucucuaaagucacu

SEQ ID NO: 4073562 - RNA, 16 nt, Vaccinia virus
aaucucucucaaauau

SEQ ID NO: 4073563 - RNA, 17 nt, Vaccinia virus
aaucucugguucuaguu

SEQ ID NO: 4073564 - RNA, 15 nt, Vaccinia virus
aaucucuuaucaugu

SEQ ID NO: 4073565 - RNA, 13 nt, Vaccinia virus
aaucugaccaucc

SEQ ID NO: 4073566 - RNA, 21 nt, Vaccinia virus
aaucugauaaauauacaauag

SEQ ID NO: 4073567 - RNA, 20 nt, Vaccinia virus
aaucugauagaaagaauaag

SEQ ID NO: 4073568 - RNA, 13 nt, Vaccinia virus
aaucugaucuugu

SEQ ID NO: 4073569 - RNA, 13 nt, Vaccinia virus
aaucuguacuucu

SEQ ID NO: 4073570 - RNA, 15 nt, Vaccinia virus
aaucuguaucgaaug

SEQ ID NO: 4073571 - RNA, 13 nt, Vaccinia virus
aaucuguauuuca

SEQ ID NO: 4073572 - RNA, 18 nt, Vaccinia virus
aaucuuauuaacuguuuc

SEQ ID NO: 4073573 - RNA, 15 nt, Vaccinia virus
aaucuucuuauaaga

SEQ ID NO: 4073574 - RNA, 22 nt, Vaccinia virus
aaucuuggcauauugaucauuu

SEQ ID NO: 4073575 - RNA, 13 nt, Vaccinia virus
aaucuuugucaaa

SEQ ID NO: 4073576 - RNA, 20 nt, Vaccinia virus
aaucuuuguucuaaaaacug

SEQ ID NO: 4073577 - RNA, 18 nt, Vaccinia virus
aaucuuuugugaaaagau

SEQ ID NO: 4073578 - RNA, 13 nt, Vaccinia virus
aaugaaaauggau

SEQ ID NO: 4073579 - RNA, 14 nt, Vaccinia virus
aaugaaaauggaua

SEQ ID NO: 4073580 - RNA, 22 nt, Vaccinia virus
aaugaagaaugccuacauauca

SEQ ID NO: 4073581 - RNA, 13 nt, Vaccinia virus
aaugaauauuaaa

SEQ ID NO: 4073582 - RNA, 16 nt, Vaccinia virus
aaugaaucccaaacau

SEQ ID NO: 4073583 - RNA, 15 nt, Vaccinia virus
aaugacuccaugaaa

SEQ ID NO: 4073584 - RNA, 20 nt, Vaccinia virus
aaugaguauauguauuuucu

SEQ ID NO: 4073585 - RNA, 22 nt, Vaccinia virus
aaugaguuauuaagcaauauau

SEQ ID NO: 4073586 - RNA, 18 nt, Vaccinia virus
aaugauaaaaucaaacuu

SEQ ID NO: 4073587 - RNA, 13 nt, Vaccinia virus
aaugauaaagaua

SEQ ID NO: 4073588 - RNA, 22 nt, Vaccinia virus
aaugauagacuagaagaaagua

SEQ ID NO: 4073589 - RNA, 14 nt, Vaccinia virus
aaugauauauuaaa

SEQ ID NO: 4073590 - RNA, 17 nt, Vaccinia virus
aaugauggguuuucuau

SEQ ID NO: 4073591 - RNA, 12 nt, Vaccinia virus
aaugauucucuc

SEQ ID NO: 4073592 - RNA, 22 nt, Vaccinia virus
aaugauugcauagugaauauau

SEQ ID NO: 4073593 - RNA, 14 nt, Vaccinia virus
aaugauuuagaaau

SEQ ID NO: 4073594 - RNA, 15 nt, Vaccinia virus
aaugauuuuggaaaa

SEQ ID NO: 4073595 - RNA, 20 nt, Vaccinia virus
aaugcaauuaaaaaucgaua

SEQ ID NO: 4073596 - RNA, 15 nt, Vaccinia virus
aaugcagaaaugauu

SEQ ID NO: 4073597 - RNA, 22 nt, Vaccinia virus
aaugcagaucuaauaaauggag

SEQ ID NO: 4073598 - RNA, 19 nt, Vaccinia virus
aaugcaggaauuugaauau

SEQ ID NO: 4073599 - RNA, 16 nt, Vaccinia virus
aaugccucagaauauc

SEQ ID NO: 4073600 - RNA, 16 nt, Vaccinia virus
aaugccuuauucucug

SEQ ID NO: 4073601 - RNA, 19 nt, Vaccinia virus
aaugccuuccaaaguuuaa

SEQ ID NO: 4073602 - RNA, 17 nt, Vaccinia virus
aaugccuuuacagugga

SEQ ID NO: 4073603 - RNA, 22 nt, Vaccinia virus
aaugcgacgaguuaaaaagaua

SEQ ID NO: 4073604 - RNA, 17 nt, Vaccinia virus
aaugcgaggaaauguau

SEQ ID NO: 4073605 - RNA, 20 nt, Vaccinia virus
aaugcgaggaaauguauaau

SEQ ID NO: 4073606 - RNA, 17 nt, Vaccinia virus
aaugcgauacagacauu

SEQ ID NO: 4073607 - RNA, 20 nt, Vaccinia virus
aaugcuaauauauucuuaca

SEQ ID NO: 4073608 - RNA, 20 nt, Vaccinia virus
aaugcuucagaauuagaaca

SEQ ID NO: 4073609 - RNA, 16 nt, Vaccinia virus
aauggauaauuuaaga

SEQ ID NO: 4073610 - RNA, 18 nt, Vaccinia virus
aauggauuaucggaaaua

SEQ ID NO: 4073611 - RNA, 12 nt, Vaccinia virus
aaugguagaugu

SEQ ID NO: 4073612 - RNA, 21 nt, Vaccinia virus
aaugguauacacaucaaaaua

SEQ ID NO: 4073613 - RNA, 13 nt, Vaccinia virus
aaugguucuuucc

SEQ ID NO: 4073614 - RNA, 13 nt, Vaccinia virus
aauguaacuauag

SEQ ID NO: 4073615 - RNA, 14 nt, Vaccinia virus
aauguaauucuaaa

SEQ ID NO: 4073616 - RNA, 18 nt, Vaccinia virus
aauguagaaauuagaaag

SEQ ID NO: 4073617 - RNA, 15 nt, Vaccinia virus
aauguaggagaguua

SEQ ID NO: 4073618 - RNA, 21 nt, Vaccinia virus
aauguauccggccaauugaua

SEQ ID NO: 4073619 - RNA, 15 nt, Vaccinia virus
aauguauuaagauua

SEQ ID NO: 4073620 - RNA, 18 nt, Vaccinia virus
aauguauuaguaggaaau

SEQ ID NO: 4073621 - RNA, 14 nt, Vaccinia virus
aaugugucaagaau

SEQ ID NO: 4073622 - RNA, 14 nt, Vaccinia virus
aauguuaaacauua

SEQ ID NO: 4073623 - RNA, 14 nt, Vaccinia virus
aauguuaacaaaaa

SEQ ID NO: 4073624 - RNA, 18 nt, Vaccinia virus
aauguuucuuacauauuu

SEQ ID NO: 4073625 - RNA, 17 nt, Vaccinia virus
aauguuugacugaauau

SEQ ID NO: 4073626 - RNA, 19 nt, Vaccinia virus
aauguuugacugaauauau

SEQ ID NO: 4073627 - RNA, 22 nt, Vaccinia virus
aauguuugauaaaaauauguau

SEQ ID NO: 4073628 - RNA, 14 nt, Vaccinia virus
aauuaaaaaagaua

SEQ ID NO: 4073629 - RNA, 20 nt, Vaccinia virus
aauuaaaaaggaaaauacua

SEQ ID NO: 4073630 - RNA, 14 nt, Vaccinia virus
aauuaagauauugu

SEQ ID NO: 4073631 - RNA, 18 nt, Vaccinia virus
aauuaauaaaaauacaau

SEQ ID NO: 4073632 - RNA, 18 nt, Vaccinia virus
aauuaauaguuuugauau

SEQ ID NO: 4073633 - RNA, 19 nt, Vaccinia virus
aauuaauauguaugauuca

SEQ ID NO: 4073634 - RNA, 16 nt, Vaccinia virus
aauuaauuaauguuuu

SEQ ID NO: 4073635 - RNA, 15 nt, Vaccinia virus
aauuacacauuucca

SEQ ID NO: 4073636 - RNA, 16 nt, Vaccinia virus
aauuacacauuuccaa

SEQ ID NO: 4073637 - RNA, 15 nt, Vaccinia virus
aauuacacuauuugu

SEQ ID NO: 4073638 - RNA, 21 nt, Vaccinia virus
aauuacggcgaaauaaagaaa

SEQ ID NO: 4073639 - RNA, 21 nt, Vaccinia virus
aauuacgguugauucaaaaau

SEQ ID NO: 4073640 - RNA, 15 nt, Vaccinia virus
aauuacuuaaagaua

SEQ ID NO: 4073641 - RNA, 20 nt, Vaccinia virus
aauuacuuaaagauagaaau

SEQ ID NO: 4073642 - RNA, 15 nt, Vaccinia virus
aauuauacaagagau

SEQ ID NO: 4073643 - RNA, 14 nt, Vaccinia virus
aauuauauguagaa

SEQ ID NO: 4073644 - RNA, 12 nt, Vaccinia virus
aauuaucaaaau

SEQ ID NO: 4073645 - RNA, 17 nt, Vaccinia virus
aauuaugauagaaauua

SEQ ID NO: 4073646 - RNA, 16 nt, Vaccinia virus
aauuauguagaugaua

SEQ ID NO: 4073647 - RNA, 15 nt, Vaccinia virus
aauuauguuuuuaua

SEQ ID NO: 4073648 - RNA, 21 nt, Vaccinia virus
aauuauuccuaauuaagaaaa

SEQ ID NO: 4073649 - RNA, 19 nt, Vaccinia virus
aauuauucguuuacugaau

SEQ ID NO: 4073650 - RNA, 14 nt, Vaccinia virus
aauuauuucuaaua

SEQ ID NO: 4073651 - RNA, 19 nt, Vaccinia virus
aauucacaccuagagacaa

SEQ ID NO: 4073652 - RNA, 19 nt, Vaccinia virus
aauucaccuucacaaaaua

SEQ ID NO: 4073653 - RNA, 18 nt, Vaccinia virus
aauucauagcugagaaua

SEQ ID NO: 4073654 - RNA, 15 nt, Vaccinia virus
aauucaucuucuaua

SEQ ID NO: 4073655 - RNA, 17 nt, Vaccinia virus
aauucauuaauauguac

SEQ ID NO: 4073656 - RNA, 16 nt, Vaccinia virus
aauuccauauauuugu

SEQ ID NO: 4073657 - RNA, 14 nt, Vaccinia virus
aauucgauaucuuu

SEQ ID NO: 4073658 - RNA, 14 nt, Vaccinia virus
aauucguuagaaua

SEQ ID NO: 4073659 - RNA, 13 nt, Vaccinia virus
aauucuaaaugau

SEQ ID NO: 4073660 - RNA, 22 nt, Vaccinia virus
aauucuuaguuauauauacucu

SEQ ID NO: 4073661 - RNA, 20 nt, Vaccinia virus
aauucuucaauaaaaugaga

SEQ ID NO: 4073662 - RNA, 14 nt, Vaccinia virus
aauucuuuaauauc

SEQ ID NO: 4073663 - RNA, 15 nt, Vaccinia virus
aauugaaugucauga

SEQ ID NO: 4073664 - RNA, 13 nt, Vaccinia virus
aauugauucuuga

SEQ ID NO: 4073665 - RNA, 22 nt, Vaccinia virus
aauugcauacacuacaagacaa

SEQ ID NO: 4073666 - RNA, 17 nt, Vaccinia virus
aauugggguauuaauaa

SEQ ID NO: 4073667 - RNA, 18 nt, Vaccinia virus
aauugguagaguuuuaua

SEQ ID NO: 4073668 - RNA, 14 nt, Vaccinia virus
aauuguacuuugua

SEQ ID NO: 4073669 - RNA, 14 nt, Vaccinia virus
aauugucuaucugu

SEQ ID NO: 4073670 - RNA, 14 nt, Vaccinia virus
aauugucuguaaac

SEQ ID NO: 4073671 - RNA, 23 nt, Vaccinia virus
aauugugucagaaacuuagaaga

SEQ ID NO: 4073672 - RNA, 14 nt, Vaccinia virus
aauuuaaaaugaua

SEQ ID NO: 4073673 - RNA, 13 nt, Vaccinia virus
aauuuacagaaau

SEQ ID NO: 4073674 - RNA, 14 nt, Vaccinia virus
aauuuagaaauaua

SEQ ID NO: 4073675 - RNA, 17 nt, Vaccinia virus
aauuucaauauugaaaa

SEQ ID NO: 4073676 - RNA, 16 nt, Vaccinia virus
aauuucagaagaaaac

SEQ ID NO: 4073677 - RNA, 15 nt, Vaccinia virus
aauuucuauucauga

SEQ ID NO: 4073678 - RNA, 13 nt, Vaccinia virus
aauuugauaaaga

SEQ ID NO: 4073679 - RNA, 21 nt, Vaccinia virus
aauuugcugacugcauguacu

SEQ ID NO: 4073680 - RNA, 18 nt, Vaccinia virus
aauuugggucuaggagau

SEQ ID NO: 4073681 - RNA, 20 nt, Vaccinia virus
aauuuguagauuuuguuaua

SEQ ID NO: 4073682 - RNA, 13 nt, Vaccinia virus
aauuuuaacagau

SEQ ID NO: 4073683 - RNA, 16 nt, Vaccinia virus
aauuuuaagaaauggu

SEQ ID NO: 4073684 - RNA, 12 nt, Vaccinia virus
aauuuuagaaau

SEQ ID NO: 4073685 - RNA, 13 nt, Vaccinia virus
aauuuuagauaau

SEQ ID NO: 4073686 - RNA, 14 nt, Vaccinia virus
aauuuucaagagau

SEQ ID NO: 4073687 - RNA, 18 nt, Vaccinia virus
aauuuucuauacauagau

SEQ ID NO: 4073688 - RNA, 22 nt, Vaccinia virus
aauuuuguuuuuuuacuuucua

SEQ ID NO: 4073689 - RNA, 22 nt, Vaccinia virus
aauuuuuugagguaaucuucuu

SEQ ID NO: 4073690 - RNA, 23 nt, Vaccinia virus
aauuuuuugguagguuuuagaga

SEQ ID NO: 4073691 - RNA, 19 nt, Vaccinia virus
aauuuuuuguucuacacau

SEQ ID NO: 4073692 - RNA, 21 nt, Vaccinia virus
acaaaaagauuucagaaucua

SEQ ID NO: 4073693 - RNA, 14 nt, Vaccinia virus
acaaaaauacauaa

SEQ ID NO: 4073694 - RNA, 16 nt, Vaccinia virus
acaaaaauuaugaaau

SEQ ID NO: 4073695 - RNA, 16 nt, Vaccinia virus
acaaaagaguuaaguu

SEQ ID NO: 4073696 - RNA, 21 nt, Vaccinia virus
acaaaagguauuacaagaaua

SEQ ID NO: 4073697 - RNA, 18 nt, Vaccinia virus
acaaaagugaauauauau

SEQ ID NO: 4073698 - RNA, 16 nt, Vaccinia virus
acaaaaguuaauaauu

SEQ ID NO: 4073699 - RNA, 12 nt, Vaccinia virus
acaaaaucuuca

SEQ ID NO: 4073700 - RNA, 12 nt, Vaccinia virus
acaaaaugugau

SEQ ID NO: 4073701 - RNA, 20 nt, Vaccinia virus
acaaaauucguuagaauaua

SEQ ID NO: 4073702 - RNA, 17 nt, Vaccinia virus
acaaacaaacucuaaua

SEQ ID NO: 4073703 - RNA, 15 nt, Vaccinia virus
acaaacgaagaaaga

SEQ ID NO: 4073704 - RNA, 14 nt, Vaccinia virus
acaaacgugggaag

SEQ ID NO: 4073705 - RNA, 20 nt, Vaccinia virus
acaaagcacucaauaaauua

SEQ ID NO: 4073706 - RNA, 16 nt, Vaccinia virus
acaaaguccaaugauu

SEQ ID NO: 4073707 - RNA, 16 nt, Vaccinia virus
acaaauauaaaaugac

SEQ ID NO: 4073708 - RNA, 16 nt, Vaccinia virus
acaaaucacugaaaau

SEQ ID NO: 4073709 - RNA, 19 nt, Vaccinia virus
acaaaucaucuuaugguuu

SEQ ID NO: 4073710 - RNA, 18 nt, Vaccinia virus
acaaaugguucaaagacu

SEQ ID NO: 4073711 - RNA, 22 nt, Vaccinia virus
acaaauguuaaacauuaauuga

SEQ ID NO: 4073712 - RNA, 13 nt, Vaccinia virus
acaaauucuauau

SEQ ID NO: 4073713 - RNA, 18 nt, Vaccinia virus
acaaauuuauuuauuaac

SEQ ID NO: 4073714 - RNA, 22 nt, Vaccinia virus
acaacaauguugccucauacau

SEQ ID NO: 4073715 - RNA, 14 nt, Vaccinia virus
acaacacuaucuga

SEQ ID NO: 4073716 - RNA, 13 nt, Vaccinia virus
acaacauauaauu

SEQ ID NO: 4073717 - RNA, 17 nt, Vaccinia virus
acaacaucuaacuauau

SEQ ID NO: 4073718 - RNA, 19 nt, Vaccinia virus
acaacauggagcuaaucua

SEQ ID NO: 4073719 - RNA, 19 nt, Vaccinia virus
acaacgaaccaaaaugaau

SEQ ID NO: 4073720 - RNA, 19 nt, Vaccinia virus
acaacgagagauauuuuca

SEQ ID NO: 4073721 - RNA, 21 nt, Vaccinia virus
acaacgaggacaugauaacuu

SEQ ID NO: 4073722 - RNA, 16 nt, Vaccinia virus
acaagaaauauuucca

SEQ ID NO: 4073723 - RNA, 19 nt, Vaccinia virus
acaagacuacaaagaaugu

SEQ ID NO: 4073724 - RNA, 14 nt, Vaccinia virus
acaagaucaugaac

SEQ ID NO: 4073725 - RNA, 15 nt, Vaccinia virus
acaagaucuguaaau

SEQ ID NO: 4073726 - RNA, 18 nt, Vaccinia virus
acaagcccgucaauaauu

SEQ ID NO: 4073727 - RNA, 20 nt, Vaccinia virus
acaagcgagugcuucuucuu

SEQ ID NO: 4073728 - RNA, 14 nt, Vaccinia virus
acaaggaaacuaau

SEQ ID NO: 4073729 - RNA, 20 nt, Vaccinia virus
acaaguaucaaaagauuaaa

SEQ ID NO: 4073730 - RNA, 16 nt, Vaccinia virus
acaagucauuacuaau

SEQ ID NO: 4073731 - RNA, 17 nt, Vaccinia virus
acaaguuuucauauuau

SEQ ID NO: 4073732 - RNA, 14 nt, Vaccinia virus
acaauaacuucacu

SEQ ID NO: 4073733 - RNA, 12 nt, Vaccinia virus
acaauauuucau

SEQ ID NO: 4073734 - RNA, 19 nt, Vaccinia virus
acaaucaucuuggagcaac

SEQ ID NO: 4073735 - RNA, 17 nt, Vaccinia virus
acaaucguauaucuucu

SEQ ID NO: 4073736 - RNA, 13 nt, Vaccinia virus
acaaucucagaua

SEQ ID NO: 4073737 - RNA, 16 nt, Vaccinia virus
acaaucucuauaucua

SEQ ID NO: 4073738 - RNA, 16 nt, Vaccinia virus
acaaugaaaauggaua

SEQ ID NO: 4073739 - RNA, 22 nt, Vaccinia virus
acaaugaaccguaauauaucua

SEQ ID NO: 4073740 - RNA, 10 nt, Vaccinia virus
acaaugaacu

SEQ ID NO: 4073741 - RNA, 21 nt, Vaccinia virus
acaaugacuuauaaaaauacu

SEQ ID NO: 4073742 - RNA, 22 nt, Vaccinia virus
acaaugcuaauauauucuuaca

SEQ ID NO: 4073743 - RNA, 19 nt, Vaccinia virus
acaaugcucaguaaaugua

SEQ ID NO: 4073744 - RNA, 18 nt, Vaccinia virus
gauauccuaucuauuauu

SEQ ID NO: 4073745 - RNA, 17 nt, Vaccinia virus
gauaucgagaucuuuug

SEQ ID NO: 4073746 - RNA, 20 nt, Vaccinia virus
gauaucgccuuuauuuccac

SEQ ID NO: 4073747 - RNA, 16 nt, Vaccinia virus
gauaucuauacuuacu

SEQ ID NO: 4073748 - RNA, 18 nt, Vaccinia virus
gauaugaacagacauugu

SEQ ID NO: 4073749 - RNA, 15 nt, Vaccinia virus
gauauuaauaaugau

SEQ ID NO: 4073750 - RNA, 18 nt, Vaccinia virus
gauauuagaacugcuaau

SEQ ID NO: 4073751 - RNA, 15 nt, Vaccinia virus
gauauucuaugaauu

SEQ ID NO: 4073752 - RNA, 14 nt, Vaccinia virus
gauauugaagauga

SEQ ID NO: 4073753 - RNA, 12 nt, Vaccinia virus
gauauuguuaaa

SEQ ID NO: 4073754 - RNA, 20 nt, Vaccinia virus
gauauuuucguguuuuaguu

SEQ ID NO: 4073755 - RNA, 22 nt, Vaccinia virus
gaucaaggacuuuuauauccca

SEQ ID NO: 4073756 - RNA, 12 nt, Vaccinia virus
gaucaaguaaag

SEQ ID NO: 4073757 - RNA, 17 nt, Vaccinia virus
gaucaggaauccaaaga

SEQ ID NO: 4073758 - RNA, 16 nt, Vaccinia virus
gaucagguaaaacaau

SEQ ID NO: 4073759 - RNA, 21 nt, Vaccinia virus
gaucagguaaaacaauaaucg

SEQ ID NO: 4073760 - RNA, 18 nt, Vaccinia virus
gauccaucaaaaaacaac

SEQ ID NO: 4073761 - RNA, 18 nt, Vaccinia virus
gauccauuuauaguuaua

SEQ ID NO: 4073762 - RNA, 13 nt, Vaccinia virus
gaucguaaugaac

SEQ ID NO: 4073763 - RNA, 17 nt, Vaccinia virus
gaucuaaagauaaucuu

SEQ ID NO: 4073764 - RNA, 19 nt, Vaccinia virus
gaucuaauacaaaaucauc

SEQ ID NO: 4073765 - RNA, 15 nt, Vaccinia virus
gaucuaauuuuucau

SEQ ID NO: 4073766 - RNA, 20 nt, Vaccinia virus
gaucuagcaaaggaaauugu

SEQ ID NO: 4073767 - RNA, 17 nt, Vaccinia virus
gaucuaguuacaacuau

SEQ ID NO: 4073768 - RNA, 15 nt, Vaccinia virus
gaucucgagaaauaa

SEQ ID NO: 4073769 - RNA, 19 nt, Vaccinia virus
gaucugaugguaauccaau

SEQ ID NO: 4073770 - RNA, 14 nt, Vaccinia virus
gaucuggaaaauaa

SEQ ID NO: 4073771 - RNA, 21 nt, Vaccinia virus
gaugaaaaauuuuuagagguu

SEQ ID NO: 4073772 - RNA, 17 nt, Vaccinia virus
gaugaaggaauaaucuc

SEQ ID NO: 4073773 - RNA, 20 nt, Vaccinia virus
gaugaauuaauuaauguuuu

SEQ ID NO: 4073774 - RNA, 15 nt, Vaccinia virus
gaugagauguuuaua

SEQ ID NO: 4073775 - RNA, 21 nt, Vaccinia virus
gaugauagugacuauuucauu

SEQ ID NO: 4073776 - RNA, 16 nt, Vaccinia virus
gaugaugcaacucuau

SEQ ID NO: 4073777 - RNA, 13 nt, Vaccinia virus
gaugaugugaauu

SEQ ID NO: 4073778 - RNA, 22 nt, Vaccinia virus
gaugauguucuaccuauuucau

SEQ ID NO: 4073779 - RNA, 16 nt, Vaccinia virus
gaugauuaaaauuaac

SEQ ID NO: 4073780 - RNA, 22 nt, Vaccinia virus
gaugcgguuuaauaaauguuuu

SEQ ID NO: 4073781 - RNA, 14 nt, Vaccinia virus
gauggaauuaucau

SEQ ID NO: 4073782 - RNA, 15 nt, Vaccinia virus
gauggauauauuaaa

SEQ ID NO: 4073783 - RNA, 18 nt, Vaccinia virus
gauguaaauauauuuaca

SEQ ID NO: 4073784 - RNA, 11 nt, Vaccinia virus
gauguauauau

SEQ ID NO: 4073785 - RNA, 13 nt, Vaccinia virus
gauguauauauca

SEQ ID NO: 4073786 - RNA, 16 nt, Vaccinia virus
gauguauuguuuaguu

SEQ ID NO: 4073787 - RNA, 18 nt, Vaccinia virus
gaugucaaagauuguaca

SEQ ID NO: 4073788 - RNA, 15 nt, Vaccinia virus
gaugucaaugaagag

SEQ ID NO: 4073789 - RNA, 20 nt, Vaccinia virus
gaugucacaauuuguauuau

SEQ ID NO: 4073790 - RNA, 18 nt, Vaccinia virus
gaugucguuauucugaaa

SEQ ID NO: 4073791 - RNA, 14 nt, Vaccinia virus
gaugucuauguacg

SEQ ID NO: 4073792 - RNA, 14 nt, Vaccinia virus
gauguuuguucauu

SEQ ID NO: 4073793 - RNA, 20 nt, Vaccinia virus
gauuaaaucguguauucauc

SEQ ID NO: 4073794 - RNA, 12 nt, Vaccinia virus
gauuaacagagu

SEQ ID NO: 4073795 - RNA, 13 nt, Vaccinia virus
gauuaagauugcu

SEQ ID NO: 4073796 - RNA, 22 nt, Vaccinia virus
gauuaauuguuauuuuauucau

SEQ ID NO: 4073797 - RNA, 17 nt, Vaccinia virus
gauuaauuuuuuuucau

SEQ ID NO: 4073798 - RNA, 19 nt, Vaccinia virus
gauuauaauccuuauacau

SEQ ID NO: 4073799 - RNA, 17 nt, Vaccinia virus
gauuauuagaucuuuuc

SEQ ID NO: 4073800 - RNA, 16 nt, Vaccinia virus
gauuauuuacuauaau

SEQ ID NO: 4073801 - RNA, 20 nt, Vaccinia virus
gauucaaauccuucauucau

SEQ ID NO: 4073802 - RNA, 20 nt, Vaccinia virus
gauucaucaacauuugcugu

SEQ ID NO: 4073803 - RNA, 19 nt, Vaccinia virus
gauucaucaagguauauaa

SEQ ID NO: 4073804 - RNA, 20 nt, Vaccinia virus
gauucauccuuaaauguuuu

SEQ ID NO: 4073805 - RNA, 14 nt, Vaccinia virus
gauuccaacagcug

SEQ ID NO: 4073806 - RNA, 15 nt, Vaccinia virus
gauucuagaauauca

SEQ ID NO: 4073807 - RNA, 17 nt, Vaccinia virus
gauucuaguaucuuuug

SEQ ID NO: 4073808 - RNA, 16 nt, Vaccinia virus
gauugagauucucuau

SEQ ID NO: 4073809 - RNA, 14 nt, Vaccinia virus
gauugauaacugaa

SEQ ID NO: 4073810 - RNA, 11 nt, Vaccinia virus
gauugauuuuu

SEQ ID NO: 4073811 - RNA, 19 nt, Vaccinia virus
gauugcauagugaauauau

SEQ ID NO: 4073812 - RNA, 13 nt, Vaccinia virus
gauuguguuauau

SEQ ID NO: 4073813 - RNA, 18 nt, Vaccinia virus
gauuguuuaagaagagaa

SEQ ID NO: 4073814 - RNA, 23 nt, Vaccinia virus
gauuucuaucccgaaagaacuga

SEQ ID NO: 4073815 - RNA, 19 nt, Vaccinia virus
gauuugucacaauaugaau

SEQ ID NO: 4073816 - RNA, 12 nt, Vaccinia virus
gauuuucuggga

SEQ ID NO: 4073817 - RNA, 12 nt, Vaccinia virus
gauuuuugucca

SEQ ID NO: 4073818 - RNA, 19 nt, Vaccinia virus
gauuuuuuuccaugauauc

SEQ ID NO: 4073819 - RNA, 22 nt, Vaccinia virus
gcaaaaauaauaugauuagaag

SEQ ID NO: 4073820 - RNA, 18 nt, Vaccinia virus
gcaaaacuauuauuuuaa

SEQ ID NO: 4073821 - RNA, 22 nt, Vaccinia virus
gcaaaacugaaaauauauugau

SEQ ID NO: 4073822 - RNA, 23 nt, Vaccinia virus
gcaaacaacaacaaaauaauaau

SEQ ID NO: 4073823 - RNA, 20 nt, Vaccinia virus
gcaaacacuuuccugauuua

SEQ ID NO: 4073824 - RNA, 18 nt, Vaccinia virus
gcaaagaaauuaauagaa

SEQ ID NO: 4073825 - RNA, 13 nt, Vaccinia virus
gcaaauucuaguc

SEQ ID NO: 4073826 - RNA, 17 nt, Vaccinia virus
gcaaccguuagauguag

SEQ ID NO: 4073827 - RNA, 15 nt, Vaccinia virus
gcaagaaaauuuaua

SEQ ID NO: 4073828 - RNA, 12 nt, Vaccinia virus
gcaagaaaugga

SEQ ID NO: 4073829 - RNA, 19 nt, Vaccinia virus
gcaauaacuaaaaauguaa

SEQ ID NO: 4073830 - RNA, 17 nt, Vaccinia virus
gcaauagguaauaacua

SEQ ID NO: 4073831 - RNA, 23 nt, Vaccinia virus
gcaauagucagacuguaguucua

SEQ ID NO: 4073832 - RNA, 18 nt, Vaccinia virus
gcaauauaucaucuuuuc

SEQ ID NO: 4073833 - RNA, 14 nt, Vaccinia virus
gcaaugaauaucua

SEQ ID NO: 4073834 - RNA, 15 nt, Vaccinia virus
gcaaugcauaaucga

SEQ ID NO: 4073835 - RNA, 12 nt, Vaccinia virus
gcaauguaaugg

SEQ ID NO: 4073836 - RNA, 18 nt, Vaccinia virus
gcaauuagauccaaagaa

SEQ ID NO: 4073837 - RNA, 17 nt, Vaccinia virus
gcaauucgcuaaacaau

SEQ ID NO: 4073838 - RNA, 23 nt, Vaccinia virus
gcaauuuuauugcuaauaaugac

SEQ ID NO: 4073839 - RNA, 20 nt, Vaccinia virus
gcacacaaucuaauauugau

SEQ ID NO: 4073840 - RNA, 18 nt, Vaccinia virus
gcacauagcgaugauuau

SEQ ID NO: 4073841 - RNA, 12 nt, Vaccinia virus
gcacgaacaaaa

SEQ ID NO: 4073842 - RNA, 17 nt, Vaccinia virus
gcacuacuguuaagaau

SEQ ID NO: 4073843 - RNA, 19 nt, Vaccinia virus
gcagaaaugcaauuaaaaa

SEQ ID NO: 4073844 - RNA, 19 nt, Vaccinia virus
gcagcauuuccuacauaua

SEQ ID NO: 4073845 - RNA, 20 nt, Vaccinia virus
gcagguacuauaauauuaaa

SEQ ID NO: 4073846 - RNA, 17 nt, Vaccinia virus
gcagucuaacauuuuua

SEQ ID NO: 4073847 - RNA, 13 nt, Vaccinia virus
gcaguuucaauau

SEQ ID NO: 4073848 - RNA, 17 nt, Vaccinia virus
gcauaaacuaacacaag

SEQ ID NO: 4073849 - RNA, 16 nt, Vaccinia virus
gcauacuuuguaaucu

SEQ ID NO: 4073850 - RNA, 12 nt, Vaccinia virus
gcauagaaauac

SEQ ID NO: 4073851 - RNA, 17 nt, Vaccinia virus
gcauaggaacauuucug

SEQ ID NO: 4073852 - RNA, 14 nt, Vaccinia virus
gcauauauuagaaa

SEQ ID NO: 4073853 - RNA, 22 nt, Vaccinia virus
gcaucaacaauuacaaaugagu

SEQ ID NO: 4073854 - RNA, 22 nt, Vaccinia virus
gcauccccuuucaauaguucuc

SEQ ID NO: 4073855 - RNA, 15 nt, Vaccinia virus
gcauccguauaaaaa

SEQ ID NO: 4073856 - RNA, 22 nt, Vaccinia virus
gcauccuucuaagauuauuuua

SEQ ID NO: 4073857 - RNA, 20 nt, Vaccinia virus
gcaucuagucuuaaauggag

SEQ ID NO: 4073858 - RNA, 19 nt, Vaccinia virus
gcaucuauauaaucuuuuu

SEQ ID NO: 4073859 - RNA, 16 nt, Vaccinia virus
gcaucuuaauccuucu

SEQ ID NO: 4073860 - RNA, 22 nt, Vaccinia virus
gcaugcgacuaugauaucaugu

SEQ ID NO: 4073861 - RNA, 19 nt, Vaccinia virus
gcauguuugcucucugaau

SEQ ID NO: 4073862 - RNA, 14 nt, Vaccinia virus
gcauuaauaacauc

SEQ ID NO: 4073863 - RNA, 17 nt, Vaccinia virus
gcauuaguaucaugaac

SEQ ID NO: 4073864 - RNA, 16 nt, Vaccinia virus
gcauuccaaucuuaaa

SEQ ID NO: 4073865 - RNA, 22 nt, Vaccinia virus
gcauucuucauucuauuaaugu

SEQ ID NO: 4073866 - RNA, 12 nt, Vaccinia virus
gccaaaaugaua

SEQ ID NO: 4073867 - RNA, 18 nt, Vaccinia virus
gccaaacucauucacuuu

SEQ ID NO: 4073868 - RNA, 21 nt, Vaccinia virus
uagacugaaugcuuucuugga

SEQ ID NO: 4073869 - RNA, 19 nt, Vaccinia virus
uagacuguuuguagaaugc

SEQ ID NO: 4073870 - RNA, 20 nt, Vaccinia virus
uagacuguuuguagaaugcu

SEQ ID NO: 4073871 - RNA, 14 nt, Vaccinia virus
uagacuuacuaaag

SEQ ID NO: 4073872 - RNA, 16 nt, Vaccinia virus
uagacuugauuauucu

SEQ ID NO: 4073873 - RNA, 14 nt, Vaccinia virus
uagagaacauaaug

SEQ ID NO: 4073874 - RNA, 19 nt, Vaccinia virus
uagagacagauuaaguucu

SEQ ID NO: 4073875 - RNA, 16 nt, Vaccinia virus
uagagauaaaacaagu

SEQ ID NO: 4073876 - RNA, 22 nt, Vaccinia virus
uagagauuuugaaaauuaugua

SEQ ID NO: 4073877 - RNA, 20 nt, Vaccinia virus
uagagcccacguuuaaacau

SEQ ID NO: 4073878 - RNA, 23 nt, Vaccinia virus
uagaggaaguauaaaaauuaaac

SEQ ID NO: 4073879 - RNA, 16 nt, Vaccinia virus
uagaguuuuauucuca

SEQ ID NO: 4073880 - RNA, 14 nt, Vaccinia virus
uagauaaaauacug

SEQ ID NO: 4073881 - RNA, 21 nt, Vaccinia virus
uagauagacgaggaaacaaug

SEQ ID NO: 4073882 - RNA, 13 nt, Vaccinia virus
uagauauagagau

SEQ ID NO: 4073883 - RNA, 17 nt, Vaccinia virus
uagauauagauguuaua

SEQ ID NO: 4073884 - RNA, 14 nt, Vaccinia virus
uagauaucauuaau

SEQ ID NO: 4073885 - RNA, 16 nt, Vaccinia virus
uagaucaagaaacauu

SEQ ID NO: 4073886 - RNA, 15 nt, Vaccinia virus
uagaucacaaaucac

SEQ ID NO: 4073887 - RNA, 17 nt, Vaccinia virus
uagauccuaauucacaa

SEQ ID NO: 4073888 - RNA, 22 nt, Vaccinia virus
uagauccuucaauaacuuauag

SEQ ID NO: 4073889 - RNA, 13 nt, Vaccinia virus
uagaucggaugau

SEQ ID NO: 4073890 - RNA, 21 nt, Vaccinia virus
uagaucgucuaaaagaauugc

SEQ ID NO: 4073891 - RNA, 14 nt, Vaccinia virus
uagaucucuagaau

SEQ ID NO: 4073892 - RNA, 15 nt, Vaccinia virus
uagaugagaacagaa

SEQ ID NO: 4073893 - RNA, 19 nt, Vaccinia virus
uagaugcauauauuucauu

SEQ ID NO: 4073894 - RNA, 19 nt, Vaccinia virus
uagaugccauaucauacau

SEQ ID NO: 4073895 - RNA, 18 nt, Vaccinia virus
uagaugcuacuucaucua

SEQ ID NO: 4073896 - RNA, 14 nt, Vaccinia virus
uagauggucucauu

SEQ ID NO: 4073897 - RNA, 14 nt, Vaccinia virus
uagaugguucuuua

SEQ ID NO: 4073898 - RNA, 17 nt, Vaccinia virus
uagaugucgaagacuua

SEQ ID NO: 4073899 - RNA, 18 nt, Vaccinia virus
uagaugucgaagacuuac

SEQ ID NO: 4073900 - RNA, 21 nt, Vaccinia virus
uagauuaaugcuuaaacuauc

SEQ ID NO: 4073901 - RNA, 15 nt, Vaccinia virus
uagauuuauuugaua

SEQ ID NO: 4073902 - RNA, 18 nt, Vaccinia virus
uagauuucgaaaauacua

SEQ ID NO: 4073903 - RNA, 15 nt, Vaccinia virus
uagauuuuggauaau

SEQ ID NO: 4073904 - RNA, 15 nt, Vaccinia virus
uagauuuuguugaga

SEQ ID NO: 4073905 - RNA, 18 nt, Vaccinia virus
uagauuuuuaguuacaga

SEQ ID NO: 4073906 - RNA, 18 nt, Vaccinia virus
uagcaccauuaucuuugu

SEQ ID NO: 4073907 - RNA, 16 nt, Vaccinia virus
uagcagccaauacuuu

SEQ ID NO: 4073908 - RNA, 14 nt, Vaccinia virus
uagccaccauaaug

SEQ ID NO: 4073909 - RNA, 23 nt, Vaccinia virus
uagccagacaaauggucaaugau

SEQ ID NO: 4073910 - RNA, 18 nt, Vaccinia virus
uagccgcgguaacuuuua

SEQ ID NO: 4073911 - RNA, 17 nt, Vaccinia virus
uagccuuaagaaaacua

SEQ ID NO: 4073912 - RNA, 13 nt, Vaccinia virus
uagcgacauaaac

SEQ ID NO: 4073913 - RNA, 15 nt, Vaccinia virus
uagcgacauaaacau

SEQ ID NO: 4073914 - RNA, 12 nt, Vaccinia virus
uagcuaauauua

SEQ ID NO: 4073915 - RNA, 15 nt, Vaccinia virus
uagcuguucaagaau

SEQ ID NO: 4073916 - RNA, 23 nt, Vaccinia virus
uaggaaaacccgcacacauaaac

SEQ ID NO: 4073917 - RNA, 21 nt, Vaccinia virus
uaggaaauugguuuaugaugu

SEQ ID NO: 4073918 - RNA, 14 nt, Vaccinia virus
uaggaauaugugcu

SEQ ID NO: 4073919 - RNA, 12 nt, Vaccinia virus
uaggaaugccac

SEQ ID NO: 4073920 - RNA, 16 nt, Vaccinia virus
uaggagaguaaugggu

SEQ ID NO: 4073921 - RNA, 16 nt, Vaccinia virus
uaggaguuagaauaau

SEQ ID NO: 4073922 - RNA, 14 nt, Vaccinia virus
uaggauuuaaacaa

SEQ ID NO: 4073923 - RNA, 14 nt, Vaccinia virus
uagguaacauaaaa

SEQ ID NO: 4073924 - RNA, 21 nt, Vaccinia virus
uagguauugaccucucagaau

SEQ ID NO: 4073925 - RNA, 17 nt, Vaccinia virus
uagguuguaauaucaua

SEQ ID NO: 4073926 - RNA, 22 nt, Vaccinia virus
uagguuguuuauugauauacua

SEQ ID NO: 4073927 - RNA, 22 nt, Vaccinia virus
uaguaaacuugacuaaaucuua

SEQ ID NO: 4073928 - RNA, 17 nt, Vaccinia virus
uaguaaaguuagaugug

SEQ ID NO: 4073929 - RNA, 18 nt, Vaccinia virus
uaguaaccguuuuccauu

SEQ ID NO: 4073930 - RNA, 23 nt, Vaccinia virus
uaguaagccaauuccaauuguug

SEQ ID NO: 4073931 - RNA, 16 nt, Vaccinia virus
uaguaaggcuuuagaa

SEQ ID NO: 4073932 - RNA, 21 nt, Vaccinia virus
uaguaauaaugauucaacaau

SEQ ID NO: 4073933 - RNA, 14 nt, Vaccinia virus
uaguaauacaugua

SEQ ID NO: 4073934 - RNA, 15 nt, Vaccinia virus
uaguaauuaaugaaa

SEQ ID NO: 4073935 - RNA, 18 nt, Vaccinia virus
uaguaccaaauucuucua

SEQ ID NO: 4073936 - RNA, 20 nt, Vaccinia virus
uaguacgcgaaauaauauua

SEQ ID NO: 4073937 - RNA, 22 nt, Vaccinia virus
uaguacguauaacuuucuucug

SEQ ID NO: 4073938 - RNA, 17 nt, Vaccinia virus
uaguacucauuaucauu

SEQ ID NO: 4073939 - RNA, 15 nt, Vaccinia virus
uaguauaaauaguua

SEQ ID NO: 4073940 - RNA, 17 nt, Vaccinia virus
uaguauacccaaagaga

SEQ ID NO: 4073941 - RNA, 19 nt, Vaccinia virus
uaguauauugagaguguau

SEQ ID NO: 4073942 - RNA, 21 nt, Vaccinia virus
uaguaucaauaacgcaaucau

SEQ ID NO: 4073943 - RNA, 16 nt, Vaccinia virus
uaguaucuaaaacuac

SEQ ID NO: 4073944 - RNA, 14 nt, Vaccinia virus
uaguauguuauaua

SEQ ID NO: 4073945 - RNA, 19 nt, Vaccinia virus
uaguauuauucauuuucua

SEQ ID NO: 4073946 - RNA, 23 nt, Vaccinia virus
uaguauucaagucaaagaaauac

SEQ ID NO: 4073947 - RNA, 13 nt, Vaccinia virus
uagucaaggaugu

SEQ ID NO: 4073948 - RNA, 12 nt, Vaccinia virus
uagucacaauca

SEQ ID NO: 4073949 - RNA, 15 nt, Vaccinia virus
uagucagacuguagu

SEQ ID NO: 4073950 - RNA, 18 nt, Vaccinia virus
uagucguuuauuaucuug

SEQ ID NO: 4073951 - RNA, 17 nt, Vaccinia virus
uagucuuaaauggagau

SEQ ID NO: 4073952 - RNA, 19 nt, Vaccinia virus
uagugacggacuuaacaug

SEQ ID NO: 4073953 - RNA, 22 nt, Vaccinia virus
uaguggaguaauuuacaaauug

SEQ ID NO: 4073954 - RNA, 17 nt, Vaccinia virus
uaguggaucucaaugac

SEQ ID NO: 4073955 - RNA, 21 nt, Vaccinia virus
uagugugacuuaacuuguaau

SEQ ID NO: 4073956 - RNA, 13 nt, Vaccinia virus
uaguuaaauauua

SEQ ID NO: 4073957 - RNA, 21 nt, Vaccinia virus
uaguuaagaacaugucuucua

SEQ ID NO: 4073958 - RNA, 17 nt, Vaccinia virus
uaguuaugauaaaugau

SEQ ID NO: 4073959 - RNA, 18 nt, Vaccinia virus
uaguucuaucaugcuucc

SEQ ID NO: 4073960 - RNA, 19 nt, Vaccinia virus
uaguugauagaacaaaaua

SEQ ID NO: 4073961 - RNA, 23 nt, Vaccinia virus
uaguugauagaacaaaauacaua

SEQ ID NO: 4073962 - RNA, 15 nt, Vaccinia virus
uaguuuaucaaaaau

SEQ ID NO: 4073963 - RNA, 18 nt, Vaccinia virus
uaguuucaucauccauga

SEQ ID NO: 4073964 - RNA, 20 nt, Vaccinia virus
uaguuuccuuuuuauaaaau

SEQ ID NO: 4073965 - RNA, 17 nt, Vaccinia virus
uaguuucugguuuucua

SEQ ID NO: 4073966 - RNA, 22 nt, Vaccinia virus
uaguuucugguuuucuauaaau

SEQ ID NO: 4073967 - RNA, 14 nt, Vaccinia virus
uaguuuguuuucau

SEQ ID NO: 4073968 - RNA, 14 nt, Vaccinia virus
uaguuuuaagaaag

SEQ ID NO: 4073969 - RNA, 16 nt, Vaccinia virus
uaguuuuacuaucaua

SEQ ID NO: 4073970 - RNA, 14 nt, Vaccinia virus
uaguuuucuaaaau

SEQ ID NO: 4073971 - RNA, 21 nt, Vaccinia virus
uaguuuucucuauucugaaau

SEQ ID NO: 4073972 - RNA, 20 nt, Vaccinia virus
uaguuuuuuuguuuccuugu

SEQ ID NO: 4073973 - RNA, 22 nt, Vaccinia virus
uauaaaaacauuuuauuucuag

SEQ ID NO: 4073974 - RNA, 23 nt, Vaccinia virus
uauaaaaacauuuuauuucuaga

SEQ ID NO: 4073975 - RNA, 19 nt, Vaccinia virus
uauaaaaguaauaaaacaa

SEQ ID NO: 4073976 - RNA, 21 nt, Vaccinia virus
uauaaaauacuaaugcaucua

SEQ ID NO: 4073977 - RNA, 14 nt, Vaccinia virus
uauaaaauauucua

SEQ ID NO: 4073978 - RNA, 17 nt, Vaccinia virus
uauaaacguauacugua

SEQ ID NO: 4073979 - RNA, 14 nt, Vaccinia virus
uauaaagacaaaca

SEQ ID NO: 4073980 - RNA, 20 nt, Vaccinia virus
uauaaaggaauaaaauauga

SEQ ID NO: 4073981 - RNA, 22 nt, Vaccinia virus
uauaaauaaaagacaaaucuug

SEQ ID NO: 4073982 - RNA, 21 nt, Vaccinia virus
uauaaauaguuuuuauguaua

SEQ ID NO: 4073983 - RNA, 17 nt, Vaccinia virus
uauaaaucauauuuaga

SEQ ID NO: 4073984 - RNA, 15 nt, Vaccinia virus
uauaaauguagacuc

SEQ ID NO: 4073985 - RNA, 18 nt, Vaccinia virus
uauaacacuuauguauua

SEQ ID NO: 4073986 - RNA, 15 nt, Vaccinia virus
uauaacauuaauauu

SEQ ID NO: 4073987 - RNA, 19 nt, Vaccinia virus
uauaacguuaugaaacgaa

SEQ ID NO: 4073988 - RNA, 21 nt, Vaccinia virus
uauaacucguuuuuauaugug

SEQ ID NO: 4073989 - RNA, 16 nt, Vaccinia virus
uauaacuucuaaucuu

SEQ ID NO: 4073990 - RNA, 15 nt, Vaccinia virus
uauaauacaggauua

SEQ ID NO: 4073991 - RNA, 22 nt, Vaccinia virus
uauaauacuuaaaaauggaugu

SEQ ID NO: 4073992 - RNA, 15 nt, Vaccinia virus
ucaagucaaagaaau

SEQ ID NO: 4073993 - RNA, 21 nt, Vaccinia virus
ucaauaagaugcaucgugaaa

SEQ ID NO: 4073994 - RNA, 14 nt, Vaccinia virus
ucaauaaggaauua

SEQ ID NO: 4073995 - RNA, 21 nt, Vaccinia virus
ucaauaauuguggcuauauau

SEQ ID NO: 4073996 - RNA, 23 nt, Vaccinia virus
ucaauacaaaacauaaaaaacaa

SEQ ID NO: 4073997 - RNA, 17 nt, Vaccinia virus
ucaauacggccauccag

SEQ ID NO: 4073998 - RNA, 18 nt, Vaccinia virus
ucaauauauuaagaaguu

SEQ ID NO: 4073999 - RNA, 14 nt, Vaccinia virus
ucaauaucaacaag

SEQ ID NO: 4074000 - RNA, 15 nt, Vaccinia virus
ucaauaugagcaaug

SEQ ID NO: 4074001 - RNA, 18 nt, Vaccinia virus
ucaauccuuugauuauca

SEQ ID NO: 4074002 - RNA, 20 nt, Vaccinia virus
ucaauggauaccuugcuauu

SEQ ID NO: 4074003 - RNA, 22 nt, Vaccinia virus
ucaaugucuuaauaagaagugu

SEQ ID NO: 4074004 - RNA, 15 nt, Vaccinia virus
ucaauugauaagaca

SEQ ID NO: 4074005 - RNA, 11 nt, Vaccinia virus
ucacaauaaaa

SEQ ID NO: 4074006 - RNA, 18 nt, Vaccinia virus
ucacaauuaaaucauuga

SEQ ID NO: 4074007 - RNA, 19 nt, Vaccinia virus
ucacaccagaugucauuau

SEQ ID NO: 4074008 - RNA, 14 nt, Vaccinia virus
ucacagucuguuuu

SEQ ID NO: 4074009 - RNA, 15 nt, Vaccinia virus
ucacaugauguagug

SEQ ID NO: 4074010 - RNA, 19 nt, Vaccinia virus
ucaccaaauuuuacaaaaa

SEQ ID NO: 4074011 - RNA, 14 nt, Vaccinia virus
ucaccgauagagaa

SEQ ID NO: 4074012 - RNA, 18 nt, Vaccinia virus
ucaccugccauaaauaaa

SEQ ID NO: 4074013 - RNA, 16 nt, Vaccinia virus
ucaccuuaucaaaguc

SEQ ID NO: 4074014 - RNA, 19 nt, Vaccinia virus
ucacgauguaggaauauag

SEQ ID NO: 4074015 - RNA, 20 nt, Vaccinia virus
ucacguuauauaacuaucaa

SEQ ID NO: 4074016 - RNA, 17 nt, Vaccinia virus
ucacuaacaauaacuag

SEQ ID NO: 4074017 - RNA, 14 nt, Vaccinia virus
ucacuagaaacuag

SEQ ID NO: 4074018 - RNA, 22 nt, Vaccinia virus
ucacucgguggauacaauaaau

SEQ ID NO: 4074019 - RNA, 16 nt, Vaccinia virus
ucacucgugaagaagc

SEQ ID NO: 4074020 - RNA, 16 nt, Vaccinia virus
ucacucuucgaaaaga

SEQ ID NO: 4074021 - RNA, 16 nt, Vaccinia virus
ucacugcgauuguauu

SEQ ID NO: 4074022 - RNA, 18 nt, Vaccinia virus
ucacugggguaaaguaag

SEQ ID NO: 4074023 - RNA, 19 nt, Vaccinia virus
ucacuguguguaagaagau

SEQ ID NO: 4074024 - RNA, 18 nt, Vaccinia virus
ucagaacacacuuuucuc

SEQ ID NO: 4074025 - RNA, 14 nt, Vaccinia virus
ucagaaucaaauau

SEQ ID NO: 4074026 - RNA, 16 nt, Vaccinia virus
ucagaguuacaucaaa

SEQ ID NO: 4074027 - RNA, 15 nt, Vaccinia virus
ucagauauaucuauu

SEQ ID NO: 4074028 - RNA, 12 nt, Vaccinia virus
ucagaucaaagu

SEQ ID NO: 4074029 - RNA, 22 nt, Vaccinia virus
ucagaucguauagccuauccaa

SEQ ID NO: 4074030 - RNA, 15 nt, Vaccinia virus
ucagaugauguauua

SEQ ID NO: 4074031 - RNA, 21 nt, Vaccinia virus
ucagauuaaauccaucucaga

SEQ ID NO: 4074032 - RNA, 19 nt, Vaccinia virus
ucagauuauuaaguauaau

SEQ ID NO: 4074033 - RNA, 15 nt, Vaccinia virus
ucagauuauucuuaa

SEQ ID NO: 4074034 - RNA, 21 nt, Vaccinia virus
ucagauuauucuuaaaugccu

SEQ ID NO: 4074035 - RNA, 17 nt, Vaccinia virus
ucagccauagcaucagc

SEQ ID NO: 4074036 - RNA, 16 nt, Vaccinia virus
ucagcugaaaaacuau

SEQ ID NO: 4074037 - RNA, 18 nt, Vaccinia virus
ucaguaacuauguucauu

SEQ ID NO: 4074038 - RNA, 18 nt, Vaccinia virus
ucaguguagauaguaaau

SEQ ID NO: 4074039 - RNA, 19 nt, Vaccinia virus
ucaguguggguacaaauau

SEQ ID NO: 4074040 - RNA, 22 nt, Vaccinia virus
ucauaaaaaaauauauuauuuu

SEQ ID NO: 4074041 - RNA, 17 nt, Vaccinia virus
ucauaaauaaaaaugaa

SEQ ID NO: 4074042 - RNA, 18 nt, Vaccinia virus
ucauaaauuuuuauuucu

SEQ ID NO: 4074043 - RNA, 15 nt, Vaccinia virus
ucauaacguccagaa

SEQ ID NO: 4074044 - RNA, 23 nt, Vaccinia virus
ucauaaguggacauauagaugca

SEQ ID NO: 4074045 - RNA, 14 nt, Vaccinia virus
ucauaauugcuauu

SEQ ID NO: 4074046 - RNA, 20 nt, Vaccinia virus
ucauacgauaugccuccaga

SEQ ID NO: 4074047 - RNA, 18 nt, Vaccinia virus
ucauacuuguuaguaguu

SEQ ID NO: 4074048 - RNA, 13 nt, Vaccinia virus
ucauauagauauu

SEQ ID NO: 4074049 - RNA, 14 nt, Vaccinia virus
ucauauauuuuugg

SEQ ID NO: 4074050 - RNA, 20 nt, Vaccinia virus
ucauaucacauaguguuuua

SEQ ID NO: 4074051 - RNA, 15 nt, Vaccinia virus
ucauauccuacugua

SEQ ID NO: 4074052 - RNA, 19 nt, Vaccinia virus
ucauaugacuaaaaugcug

SEQ ID NO: 4074053 - RNA, 18 nt, Vaccinia virus
ucauauuaauaaaguguu

SEQ ID NO: 4074054 - RNA, 13 nt, Vaccinia virus
ucauauucucaua

SEQ ID NO: 4074055 - RNA, 15 nt, Vaccinia virus
ucauauuuagaauau

SEQ ID NO: 4074056 - RNA, 16 nt, Vaccinia virus
ucaucaaacaacugaa

SEQ ID NO: 4074057 - RNA, 15 nt, Vaccinia virus
ucaucaauagacaua

SEQ ID NO: 4074058 - RNA, 21 nt, Vaccinia virus
ucaucacauaucgccacaaaa

SEQ ID NO: 4074059 - RNA, 14 nt, Vaccinia virus
ucaucaucaaaaga

SEQ ID NO: 4074060 - RNA, 14 nt, Vaccinia virus
ucaucauuaaacau

SEQ ID NO: 4074061 - RNA, 17 nt, Vaccinia virus
ucauccagaucauuaag

SEQ ID NO: 4074062 - RNA, 18 nt, Vaccinia virus
ucauccguggauauuuga

SEQ ID NO: 4074063 - RNA, 18 nt, Vaccinia virus
ucauccuuaaauguuuuc

SEQ ID NO: 4074064 - RNA, 16 nt, Vaccinia virus
ucaucggaucuguaaa

SEQ ID NO: 4074065 - RNA, 20 nt, Vaccinia virus
ucaucguauagcaauguaau

SEQ ID NO: 4074066 - RNA, 13 nt, Vaccinia virus
ucaucuacauaau

SEQ ID NO: 4074067 - RNA, 23 nt, Vaccinia virus
ucaucuggaauugucacuacuaa

SEQ ID NO: 4074068 - RNA, 16 nt, Vaccinia virus
ucaucuucuauauaag

SEQ ID NO: 4074069 - RNA, 17 nt, Vaccinia virus
ucaucuugucuagaaug

SEQ ID NO: 4074070 - RNA, 19 nt, Vaccinia virus
ucaucuuguucagaaauau

SEQ ID NO: 4074071 - RNA, 13 nt, Vaccinia virus
ucaugaacauaau

SEQ ID NO: 4074072 - RNA, 20 nt, Vaccinia virus
ucaugaauacguuuaauguu

SEQ ID NO: 4074073 - RNA, 20 nt, Vaccinia virus
ucaugacugauuuuuuaacu

SEQ ID NO: 4074074 - RNA, 21 nt, Vaccinia virus
ucaugcauuuguuaguuauuc

SEQ ID NO: 4074075 - RNA, 20 nt, Vaccinia virus
ucauggaaacaaaugaaaca

SEQ ID NO: 4074076 - RNA, 20 nt, Vaccinia virus
ucauggauaauauuuguaau

SEQ ID NO: 4074077 - RNA, 12 nt, Vaccinia virus
ucauguaaccaa

SEQ ID NO: 4074078 - RNA, 14 nt, Vaccinia virus
ucauguagauaguu

SEQ ID NO: 4074079 - RNA, 19 nt, Vaccinia virus
ucauguucgaaaaagugaa

SEQ ID NO: 4074080 - RNA, 17 nt, Vaccinia virus
ucauuaaaaaaauuaac

SEQ ID NO: 4074081 - RNA, 17 nt, Vaccinia virus
ucauuaauaguauacac

SEQ ID NO: 4074082 - RNA, 17 nt, Vaccinia virus
ucauuacagaaacugua

SEQ ID NO: 4074083 - RNA, 18 nt, Vaccinia virus
ucauuauaacucuagaau

SEQ ID NO: 4074084 - RNA, 15 nt, Vaccinia virus
ucauuauauaguguu

SEQ ID NO: 4074085 - RNA, 21 nt, Vaccinia virus
ucauuaucgguguauuuucca

SEQ ID NO: 4074086 - RNA, 13 nt, Vaccinia virus
ucauuaucugaaa

SEQ ID NO: 4074087 - RNA, 15 nt, Vaccinia virus
ucauucaagauaagc

SEQ ID NO: 4074088 - RNA, 13 nt, Vaccinia virus
ucauucauauucu

SEQ ID NO: 4074089 - RNA, 23 nt, Vaccinia virus
ucauucgcggaacuacauaguaa

SEQ ID NO: 4074090 - RNA, 19 nt, Vaccinia virus
ucauugauugagaagaagc

SEQ ID NO: 4074091 - RNA, 20 nt, Vaccinia virus
ucauuguccagauugaacau

SEQ ID NO: 4074092 - RNA, 15 nt, Vaccinia virus
ucauuguuacauaaa

SEQ ID NO: 4074093 - RNA, 15 nt, Vaccinia virus
ucauuguuaugaauc

SEQ ID NO: 4074094 - RNA, 20 nt, Vaccinia virus
ucauuuauaaucuauuagaa

SEQ ID NO: 4074095 - RNA, 21 nt, Vaccinia virus
ucauuuucggguuuaaauucu

SEQ ID NO: 4074096 - RNA, 18 nt, Vaccinia virus
ucauuuuuuuaaaacugu

SEQ ID NO: 4074097 - RNA, 17 nt, Vaccinia virus
uccaaaaagaaugagua

SEQ ID NO: 4074098 - RNA, 22 nt, Vaccinia virus
uccaaggauguaauuaaauguu

SEQ ID NO: 4074099 - RNA, 14 nt, Vaccinia virus
uccaaguuucuauu

SEQ ID NO: 4074100 - RNA, 15 nt, Vaccinia virus
uccaauagugaaacu

SEQ ID NO: 4074101 - RNA, 14 nt, Vaccinia virus
uccaaucaugugua

SEQ ID NO: 4074102 - RNA, 15 nt, Vaccinia virus
uccaaucuuaaacau

SEQ ID NO: 4074103 - RNA, 15 nt, Vaccinia virus
uccaauguauuuaug

SEQ ID NO: 4074104 - RNA, 20 nt, Vaccinia virus
uccacaccgccucuagauau

SEQ ID NO: 4074105 - RNA, 13 nt, Vaccinia virus
uccacauccauga

SEQ ID NO: 4074106 - RNA, 22 nt, Vaccinia virus
uccaccgacucauuauuuccca

SEQ ID NO: 4074107 - RNA, 18 nt, Vaccinia virus
uccacugucacuggaaag

SEQ ID NO: 4074108 - RNA, 12 nt, Vaccinia virus
uccagaauguac

SEQ ID NO: 4074109 - RNA, 20 nt, Vaccinia virus
uccagauacagugauuuugg

SEQ ID NO: 4074110 - RNA, 17 nt, Vaccinia virus
uccaguaaaccguuuuu

SEQ ID NO: 4074111 - RNA, 14 nt, Vaccinia virus
uccauaaacugaua

SEQ ID NO: 4074112 - RNA, 14 nt, Vaccinia virus
uccauaauccucua

SEQ ID NO: 4074113 - RNA, 16 nt, Vaccinia virus
uccauaggauacuuug

SEQ ID NO: 4074114 - RNA, 22 nt, Vaccinia virus
uccauaggcaguccagaaauau

SEQ ID NO: 4074115 - RNA, 19 nt, Vaccinia virus
uccauauuucuuaauguaa

SEQ ID NO: 4074116 - RNA, 19 nt, Vaccinia virus
aucaauucuggauuauccc

SEQ ID NO: 4074117 - RNA, 21 nt, Vaccinia virus
aucaauucuggauuaucccuc

SEQ ID NO: 4074118 - RNA, 15 nt, Vaccinia virus
aucacaaaaaaaacu

SEQ ID NO: 4074119 - RNA, 22 nt, Vaccinia virus
aucacaaaaaaaacuucucuaa

SEQ ID NO: 4074120 - RNA, 13 nt, Vaccinia virus
aucacaaaucaca

SEQ ID NO: 4074121 - RNA, 20 nt, Vaccinia virus
aucacaagaaguuagaaagu

SEQ ID NO: 4074122 - RNA, 20 nt, Vaccinia virus
aucacagaauucuucaauaa

SEQ ID NO: 4074123 - RNA, 19 nt, Vaccinia virus
aucacagucuguuuuggua

SEQ ID NO: 4074124 - RNA, 15 nt, Vaccinia virus
aucacauauuaaaaa

SEQ ID NO: 4074125 - RNA, 22 nt, Vaccinia virus
aucaccauggacauaaagauag

SEQ ID NO: 4074126 - RNA, 22 nt, Vaccinia virus
aucacgauuuugucuuucagga

SEQ ID NO: 4074127 - RNA, 19 nt, Vaccinia virus
aucacuauauguuccagua

SEQ ID NO: 4074128 - RNA, 18 nt, Vaccinia virus
aucacuaucgcccaggag

SEQ ID NO: 4074129 - RNA, 17 nt, Vaccinia virus
aucacuguagugcuaug

SEQ ID NO: 4074130 - RNA, 18 nt, Vaccinia virus
aucagaaucauacaauga

SEQ ID NO: 4074131 - RNA, 18 nt, Vaccinia virus
aucagaccguacauacau

SEQ ID NO: 4074132 - RNA, 19 nt, Vaccinia virus
aucagaccguacauacaua

SEQ ID NO: 4074133 - RNA, 22 nt, Vaccinia virus
aucagaccguacauacauagac

SEQ ID NO: 4074134 - RNA, 14 nt, Vaccinia virus
aucagauaugaauu

SEQ ID NO: 4074135 - RNA, 16 nt, Vaccinia virus
aucagaugaucgauga

SEQ ID NO: 4074136 - RNA, 15 nt, Vaccinia virus
aucagauucuuauau

SEQ ID NO: 4074137 - RNA, 21 nt, Vaccinia virus
aucagcauguagacaaaauga

SEQ ID NO: 4074138 - RNA, 16 nt, Vaccinia virus
aucagcugaaaaacua

SEQ ID NO: 4074139 - RNA, 17 nt, Vaccinia virus
aucagcuuuaguuuaua

SEQ ID NO: 4074140 - RNA, 15 nt, Vaccinia virus
aucaggaaaaaagau

SEQ ID NO: 4074141 - RNA, 23 nt, Vaccinia virus
aucaguuuuguauuccaaauuaa

SEQ ID NO: 4074142 - RNA, 12 nt, Vaccinia virus
aucauaaaaaug

SEQ ID NO: 4074143 - RNA, 14 nt, Vaccinia virus
aucauaaaaaugag

SEQ ID NO: 4074144 - RNA, 20 nt, Vaccinia virus
aucauaaaaguuguaaagua

SEQ ID NO: 4074145 - RNA, 22 nt, Vaccinia virus
aucauaaaaguuguaaaguaaa

SEQ ID NO: 4074146 - RNA, 14 nt, Vaccinia virus
aucauaaagaacag

SEQ ID NO: 4074147 - RNA, 18 nt, Vaccinia virus
aucauaaauuauuucauu

SEQ ID NO: 4074148 - RNA, 15 nt, Vaccinia virus
aucauaaggaacuaa

SEQ ID NO: 4074149 - RNA, 19 nt, Vaccinia virus
aucauaauuacauuuagac

SEQ ID NO: 4074150 - RNA, 21 nt, Vaccinia virus
aucauacaaugaauuaauuaa

SEQ ID NO: 4074151 - RNA, 15 nt, Vaccinia virus
aucauacuuagaauu

SEQ ID NO: 4074152 - RNA, 15 nt, Vaccinia virus
aucauaucacauagu

SEQ ID NO: 4074153 - RNA, 21 nt, Vaccinia virus
aucauaucuauaggaaaggau

SEQ ID NO: 4074154 - RNA, 20 nt, Vaccinia virus
aucaucauuuaccagaauac

SEQ ID NO: 4074155 - RNA, 17 nt, Vaccinia virus
aucauccaauaguacau

SEQ ID NO: 4074156 - RNA, 16 nt, Vaccinia virus
aucauccaguuuucca

SEQ ID NO: 4074157 - RNA, 17 nt, Vaccinia virus
aucauccauuaauauaa

SEQ ID NO: 4074158 - RNA, 21 nt, Vaccinia virus
aucaucgaucauguuaaguaa

SEQ ID NO: 4074159 - RNA, 23 nt, Vaccinia virus
aucaucuguaggaaauggaagau

SEQ ID NO: 4074160 - RNA, 20 nt, Vaccinia virus
aucaugaaaugaugauauau

SEQ ID NO: 4074161 - RNA, 21 nt, Vaccinia virus
aucaugaauggauuuaucauc

SEQ ID NO: 4074162 - RNA, 14 nt, Vaccinia virus
aucaugacaaaauu

SEQ ID NO: 4074163 - RNA, 19 nt, Vaccinia virus
aucaugacaaaauuaaaaa

SEQ ID NO: 4074164 - RNA, 11 nt, Vaccinia virus
aucaugucuaa

SEQ ID NO: 4074165 - RNA, 18 nt, Vaccinia virus
aucaugucuaaugaugaa

SEQ ID NO: 4074166 - RNA, 16 nt, Vaccinia virus
aucauuaaaaaaauua

SEQ ID NO: 4074167 - RNA, 13 nt, Vaccinia virus
aucauuaaaugau

SEQ ID NO: 4074168 - RNA, 18 nt, Vaccinia virus
aucauuaucauuuuguaa

SEQ ID NO: 4074169 - RNA, 17 nt, Vaccinia virus
aucauugggaaacauua

SEQ ID NO: 4074170 - RNA, 15 nt, Vaccinia virus
aucauuuaaacauuu

SEQ ID NO: 4074171 - RNA, 15 nt, Vaccinia virus
aucauuuccaaaucu

SEQ ID NO: 4074172 - RNA, 13 nt, Vaccinia virus
aucauuucuauaa

SEQ ID NO: 4074173 - RNA, 14 nt, Vaccinia virus
auccaagucaauau

SEQ ID NO: 4074174 - RNA, 23 nt, Vaccinia virus
auccaauuguuugauauauaauu

SEQ ID NO: 4074175 - RNA, 19 nt, Vaccinia virus
auccacaacccauuaaaaa

SEQ ID NO: 4074176 - RNA, 16 nt, Vaccinia virus
auccaccacagacuga

SEQ ID NO: 4074177 - RNA, 22 nt, Vaccinia virus
auccacuaugaucaauucugga

SEQ ID NO: 4074178 - RNA, 23 nt, Vaccinia virus
auccacuaugaucaauucuggau

SEQ ID NO: 4074179 - RNA, 17 nt, Vaccinia virus
auccagacaacaaucgu

SEQ ID NO: 4074180 - RNA, 14 nt, Vaccinia virus
auccagaguguuuc

SEQ ID NO: 4074181 - RNA, 21 nt, Vaccinia virus
auccagcuagugaauauauau

SEQ ID NO: 4074182 - RNA, 16 nt, Vaccinia virus
auccauauuuucuggu

SEQ ID NO: 4074183 - RNA, 14 nt, Vaccinia virus
auccaucaaaaaug

SEQ ID NO: 4074184 - RNA, 19 nt, Vaccinia virus
aucccauucuaauacuuua

SEQ ID NO: 4074185 - RNA, 20 nt, Vaccinia virus
auccguguuaaaaaaaauua

SEQ ID NO: 4074186 - RNA, 20 nt, Vaccinia virus
auccuaaagaguauggugaa

SEQ ID NO: 4074187 - RNA, 13 nt, Vaccinia virus
auccuaacaauga

SEQ ID NO: 4074188 - RNA, 14 nt, Vaccinia virus
auccuaacaaugaa

SEQ ID NO: 4074189 - RNA, 16 nt, Vaccinia virus
auccuaggauccuuua

SEQ ID NO: 4074190 - RNA, 17 nt, Vaccinia virus
auccuauaacuucuaau

SEQ ID NO: 4074191 - RNA, 15 nt, Vaccinia virus
auccuaucuaagaug

SEQ ID NO: 4074192 - RNA, 15 nt, Vaccinia virus
auccuauucuaaaug

SEQ ID NO: 4074193 - RNA, 15 nt, Vaccinia virus
auccuccuauuacau

SEQ ID NO: 4074194 - RNA, 15 nt, Vaccinia virus
auccucuaaaggcug

SEQ ID NO: 4074195 - RNA, 17 nt, Vaccinia virus
auccuguuucuacuaac

SEQ ID NO: 4074196 - RNA, 20 nt, Vaccinia virus
auccuucagauaaucugaaa

SEQ ID NO: 4074197 - RNA, 16 nt, Vaccinia virus
auccuucuagaauuag

SEQ ID NO: 4074198 - RNA, 22 nt, Vaccinia virus
auccuuuauuaaaucaugaaug

SEQ ID NO: 4074199 - RNA, 21 nt, Vaccinia virus
auccuuuuguuggaaaaauga

SEQ ID NO: 4074200 - RNA, 20 nt, Vaccinia virus
aucgaagugacacucuauau

SEQ ID NO: 4074201 - RNA, 15 nt, Vaccinia virus
aucgacaucgagaac

SEQ ID NO: 4074202 - RNA, 13 nt, Vaccinia virus
aucgacuauuuua

SEQ ID NO: 4074203 - RNA, 22 nt, Vaccinia virus
aucgauaguguaguuauugaac

SEQ ID NO: 4074204 - RNA, 20 nt, Vaccinia virus
aucgauccucacuucgaaga

SEQ ID NO: 4074205 - RNA, 19 nt, Vaccinia virus
aucgaugaauaauacauuu

SEQ ID NO: 4074206 - RNA, 22 nt, Vaccinia virus
aucgaugaauaauacauuuaaa

SEQ ID NO: 4074207 - RNA, 18 nt, Vaccinia virus
aucgauuauauucuaaga

SEQ ID NO: 4074208 - RNA, 23 nt, Vaccinia virus
aucgcccaucuauuacaaacaug

SEQ ID NO: 4074209 - RNA, 17 nt, Vaccinia virus
aucgcuuaauagacaaa

SEQ ID NO: 4074210 - RNA, 17 nt, Vaccinia virus
aucggauacagacacuc

SEQ ID NO: 4074211 - RNA, 16 nt, Vaccinia virus
aucggaugauauuaau

SEQ ID NO: 4074212 - RNA, 22 nt, Vaccinia virus
aucggcauuuauguuucuuuaa

SEQ ID NO: 4074213 - RNA, 19 nt, Vaccinia virus
aucggccuucuuuuuuaca

SEQ ID NO: 4074214 - RNA, 13 nt, Vaccinia virus
aucguauauuaag

SEQ ID NO: 4074215 - RNA, 22 nt, Vaccinia virus
aucguauuugugugauggauuu

SEQ ID NO: 4074216 - RNA, 17 nt, Vaccinia virus
aucgucgauacaaaaug

SEQ ID NO: 4074217 - RNA, 20 nt, Vaccinia virus
aucgugcacccaacguauuu

SEQ ID NO: 4074218 - RNA, 17 nt, Vaccinia virus
aucgugcagguuaaaua

SEQ ID NO: 4074219 - RNA, 18 nt, Vaccinia virus
aucgugcagguuaaauag

SEQ ID NO: 4074220 - RNA, 16 nt, Vaccinia virus
aucguuaaauuuuaca

SEQ ID NO: 4074221 - RNA, 13 nt, Vaccinia virus
aucguuugucaua

SEQ ID NO: 4074222 - RNA, 13 nt, Vaccinia virus
aucuaaauauuua

SEQ ID NO: 4074223 - RNA, 23 nt, Vaccinia virus
aucuaacaaaaauuaugaaauaa

SEQ ID NO: 4074224 - RNA, 15 nt, Vaccinia virus
acaaugcuuuaauaa

SEQ ID NO: 4074225 - RNA, 16 nt, Vaccinia virus
acaauggaauacuuca

SEQ ID NO: 4074226 - RNA, 16 nt, Vaccinia virus
acaauguccaaaucua

SEQ ID NO: 4074227 - RNA, 12 nt, Vaccinia virus
acaauuacaaau

SEQ ID NO: 4074228 - RNA, 18 nt, Vaccinia virus
acaauuacguaaugaaga

SEQ ID NO: 4074229 - RNA, 17 nt, Vaccinia virus
acaauuauuauauaauu

SEQ ID NO: 4074230 - RNA, 20 nt, Vaccinia virus
acaauuugggacaaugaauu

SEQ ID NO: 4074231 - RNA, 23 nt, Vaccinia virus
acacaaguugauaaaauguugau

SEQ ID NO: 4074232 - RNA, 15 nt, Vaccinia virus
acacaauuaacaaua

SEQ ID NO: 4074233 - RNA, 20 nt, Vaccinia virus
acacacaacgcgucuagacu

SEQ ID NO: 4074234 - RNA, 17 nt, Vaccinia virus
acacacgaugaaaaugu

SEQ ID NO: 4074235 - RNA, 20 nt, Vaccinia virus
acacaguaaccaaaaugaaa

SEQ ID NO: 4074236 - RNA, 18 nt, Vaccinia virus
acacauauugaugugucu

SEQ ID NO: 4074237 - RNA, 19 nt, Vaccinia virus
acacauuaaacaaaaaucu

SEQ ID NO: 4074238 - RNA, 13 nt, Vaccinia virus
acacauuaacauc

SEQ ID NO: 4074239 - RNA, 13 nt, Vaccinia virus
acaccauagcacu

SEQ ID NO: 4074240 - RNA, 16 nt, Vaccinia virus
acaccuaauacucugg

SEQ ID NO: 4074241 - RNA, 16 nt, Vaccinia virus
acaccuagagaacuua

SEQ ID NO: 4074242 - RNA, 15 nt, Vaccinia virus
acaccucuacauaac

SEQ ID NO: 4074243 - RNA, 15 nt, Vaccinia virus
acacgacaaugaaca

SEQ ID NO: 4074244 - RNA, 15 nt, Vaccinia virus
acacgcauuaacaug

SEQ ID NO: 4074245 - RNA, 20 nt, Vaccinia virus
acacguagcaugugaauaua

SEQ ID NO: 4074246 - RNA, 13 nt, Vaccinia virus
acacguguagaau

SEQ ID NO: 4074247 - RNA, 19 nt, Vaccinia virus
acacguuuauuucauauaa

SEQ ID NO: 4074248 - RNA, 19 nt, Vaccinia virus
acacuaauauuaugaugaa

SEQ ID NO: 4074249 - RNA, 14 nt, Vaccinia virus
acacuaucuuuauu

SEQ ID NO: 4074250 - RNA, 16 nt, Vaccinia virus
acacuauucuuaaauu

SEQ ID NO: 4074251 - RNA, 20 nt, Vaccinia virus
acacuauucuuaaauuucau

SEQ ID NO: 4074252 - RNA, 13 nt, Vaccinia virus
acacucucaauau

SEQ ID NO: 4074253 - RNA, 14 nt, Vaccinia virus
acacugauucagaa

SEQ ID NO: 4074254 - RNA, 20 nt, Vaccinia virus
acacuguuaucuaaugaaug

SEQ ID NO: 4074255 - RNA, 17 nt, Vaccinia virus
acagaaacaucauauac

SEQ ID NO: 4074256 - RNA, 15 nt, Vaccinia virus
acagaacaauauauu

SEQ ID NO: 4074257 - RNA, 21 nt, Vaccinia virus
acagaacaucaaaaaauuaua

SEQ ID NO: 4074258 - RNA, 22 nt, Vaccinia virus
acagacaugguaucaacagaua

SEQ ID NO: 4074259 - RNA, 14 nt, Vaccinia virus
acagauaaauggaa

SEQ ID NO: 4074260 - RNA, 13 nt, Vaccinia virus
acagauacagaug

SEQ ID NO: 4074261 - RNA, 16 nt, Vaccinia virus
acagaugauauaucca

SEQ ID NO: 4074262 - RNA, 13 nt, Vaccinia virus
acagauggauaaa

SEQ ID NO: 4074263 - RNA, 23 nt, Vaccinia virus
acagcuaucaaaauauguagaaa

SEQ ID NO: 4074264 - RNA, 16 nt, Vaccinia virus
acagcuggagauuauc

SEQ ID NO: 4074265 - RNA, 16 nt, Vaccinia virus
acaggauuauaaucuc

SEQ ID NO: 4074266 - RNA, 13 nt, Vaccinia virus
acaggcauauuag

SEQ ID NO: 4074267 - RNA, 15 nt, Vaccinia virus
acaggcuauuuacaa

SEQ ID NO: 4074268 - RNA, 18 nt, Vaccinia virus
acaguaucugauaaucua

SEQ ID NO: 4074269 - RNA, 20 nt, Vaccinia virus
acuuagucuguacaaaaguu

SEQ ID NO: 4074270 - RNA, 15 nt, Vaccinia virus
acuuauguaugugca

SEQ ID NO: 4074271 - RNA, 20 nt, Vaccinia virus
acuuaugucacgaugaugga

SEQ ID NO: 4074272 - RNA, 14 nt, Vaccinia virus
acuuauuuaacucu

SEQ ID NO: 4074273 - RNA, 15 nt, Vaccinia virus
acuucaggaaauauc

SEQ ID NO: 4074274 - RNA, 15 nt, Vaccinia virus
acuucauuaaucuuu

SEQ ID NO: 4074275 - RNA, 19 nt, Vaccinia virus
acuuccaauaaaauuacuu

SEQ ID NO: 4074276 - RNA, 18 nt, Vaccinia virus
acuucuaacaaacaucuc

SEQ ID NO: 4074277 - RNA, 18 nt, Vaccinia virus
acuucuaucgauaauugu

SEQ ID NO: 4074278 - RNA, 21 nt, Vaccinia virus
acuucuccuuauugauugaaa

SEQ ID NO: 4074279 - RNA, 22 nt, Vaccinia virus
acuucuccuuauugauugaaaa

SEQ ID NO: 4074280 - RNA, 15 nt, Vaccinia virus
acuucucuaaaugag

SEQ ID NO: 4074281 - RNA, 19 nt, Vaccinia virus
acuugaaagagauaauaga

SEQ ID NO: 4074282 - RNA, 15 nt, Vaccinia virus
acuugacaaaaauug

SEQ ID NO: 4074283 - RNA, 17 nt, Vaccinia virus
acuugagacuugauaga

SEQ ID NO: 4074284 - RNA, 15 nt, Vaccinia virus
acuugcaaaaaagac

SEQ ID NO: 4074285 - RNA, 13 nt, Vaccinia virus
acuuguuuaauga

SEQ ID NO: 4074286 - RNA, 19 nt, Vaccinia virus
acuuuaaagcaaaaugguu

SEQ ID NO: 4074287 - RNA, 19 nt, Vaccinia virus
acuuuaaauacuuaacaga

SEQ ID NO: 4074288 - RNA, 17 nt, Vaccinia virus
acuuuaacguauaaaug

SEQ ID NO: 4074289 - RNA, 11 nt, Vaccinia virus
acuuuaaugau

SEQ ID NO: 4074290 - RNA, 22 nt, Vaccinia virus
acuuuaggaucucuauugccaa

SEQ ID NO: 4074291 - RNA, 20 nt, Vaccinia virus
acuuuauugccuguaauaau

SEQ ID NO: 4074292 - RNA, 21 nt, Vaccinia virus
acuuucaaugagauaaauaug

SEQ ID NO: 4074293 - RNA, 16 nt, Vaccinia virus
acuuucaucuaauaag

SEQ ID NO: 4074294 - RNA, 18 nt, Vaccinia virus
acuuuccaacuuaucauu

SEQ ID NO: 4074295 - RNA, 20 nt, Vaccinia virus
acuuucgguucuuuaaaaga

SEQ ID NO: 4074296 - RNA, 15 nt, Vaccinia virus
acuuucgguuucaua

SEQ ID NO: 4074297 - RNA, 16 nt, Vaccinia virus
acuuugauagcaagga

SEQ ID NO: 4074298 - RNA, 22 nt, Vaccinia virus
acuuugauagcaaggaugaaaa

SEQ ID NO: 4074299 - RNA, 12 nt, Vaccinia virus
acuuuuaaauac

SEQ ID NO: 4074300 - RNA, 23 nt, Vaccinia virus
acuuuuaacuaucgcaucaaaag

SEQ ID NO: 4074301 - RNA, 21 nt, Vaccinia virus
acuuuugaacuaaaauacaau

SEQ ID NO: 4074302 - RNA, 17 nt, Vaccinia virus
agaaaaaaaauugaauu

SEQ ID NO: 4074303 - RNA, 12 nt, Vaccinia virus
agaaaaaaaugg

SEQ ID NO: 4074304 - RNA, 14 nt, Vaccinia virus
agaaaaaaauggaa

SEQ ID NO: 4074305 - RNA, 12 nt, Vaccinia virus
agaaaaacagaa

SEQ ID NO: 4074306 - RNA, 19 nt, Vaccinia virus
agaaaaaugauuaucuucu

SEQ ID NO: 4074307 - RNA, 23 nt, Vaccinia virus
agaaaagguucuaucaacaauau

SEQ ID NO: 4074308 - RNA, 22 nt, Vaccinia virus
agaaaauaauccugaauauauu

SEQ ID NO: 4074309 - RNA, 16 nt, Vaccinia virus
agaaaauccuguaaua

SEQ ID NO: 4074310 - RNA, 17 nt, Vaccinia virus
agaaaauucuauauauu

SEQ ID NO: 4074311 - RNA, 15 nt, Vaccinia virus
agaaaauuuaauaaa

SEQ ID NO: 4074312 - RNA, 13 nt, Vaccinia virus
agaaacagaacua

SEQ ID NO: 4074313 - RNA, 17 nt, Vaccinia virus
agaaacaucauauacaa

SEQ ID NO: 4074314 - RNA, 22 nt, Vaccinia virus
agaaacuauagauaaugauaua

SEQ ID NO: 4074315 - RNA, 19 nt, Vaccinia virus
agaaacugacuugauaaaa

SEQ ID NO: 4074316 - RNA, 14 nt, Vaccinia virus
agaaagaaauuugu

SEQ ID NO: 4074317 - RNA, 15 nt, Vaccinia virus
agaaagaagaaauac

SEQ ID NO: 4074318 - RNA, 18 nt, Vaccinia virus
agaaagcgcguaauacua

SEQ ID NO: 4074319 - RNA, 23 nt, Vaccinia virus
agaaaguaugauacaauacuuac

SEQ ID NO: 4074320 - RNA, 20 nt, Vaccinia virus
agaaaguggauaaaacaaua

SEQ ID NO: 4074321 - RNA, 13 nt, Vaccinia virus
agaaauaaaaauu

SEQ ID NO: 4074322 - RNA, 12 nt, Vaccinia virus
agaaauaaagua

SEQ ID NO: 4074323 - RNA, 21 nt, Vaccinia virus
agaaauaacaggcuaaaaugu

SEQ ID NO: 4074324 - RNA, 21 nt, Vaccinia virus
agaaauaagagacuuaaacaa

SEQ ID NO: 4074325 - RNA, 13 nt, Vaccinia virus
agaaauacuauau

SEQ ID NO: 4074326 - RNA, 13 nt, Vaccinia virus
agaaauauauacu

SEQ ID NO: 4074327 - RNA, 16 nt, Vaccinia virus
agaaauaucuauaauu

SEQ ID NO: 4074328 - RNA, 14 nt, Vaccinia virus
agaaaucaacuuau

SEQ ID NO: 4074329 - RNA, 21 nt, Vaccinia virus
agaaauggagagagacuguuu

SEQ ID NO: 4074330 - RNA, 19 nt, Vaccinia virus
agaaauugguucuuuacca

SEQ ID NO: 4074331 - RNA, 18 nt, Vaccinia virus
agaaauuuagcaacgaua

SEQ ID NO: 4074332 - RNA, 14 nt, Vaccinia virus
agaaauuuuucuac

SEQ ID NO: 4074333 - RNA, 16 nt, Vaccinia virus
agaacgaauguuguag

SEQ ID NO: 4074334 - RNA, 18 nt, Vaccinia virus
agaacgaugucaaaauau

SEQ ID NO: 4074335 - RNA, 15 nt, Vaccinia virus
agaacggagaauugu

SEQ ID NO: 4074336 - RNA, 19 nt, Vaccinia virus
agaacuauaaaaacagaua

SEQ ID NO: 4074337 - RNA, 20 nt, Vaccinia virus
agaacuaucauagaugagaa

SEQ ID NO: 4074338 - RNA, 22 nt, Vaccinia virus
agaacuggaccguauaucucau

SEQ ID NO: 4074339 - RNA, 12 nt, Vaccinia virus
agaagaacauau

SEQ ID NO: 4074340 - RNA, 16 nt, Vaccinia virus
agaagauaucauaaau

SEQ ID NO: 4074341 - RNA, 19 nt, Vaccinia virus
agaagauggagagucacua

SEQ ID NO: 4074342 - RNA, 20 nt, Vaccinia virus
agaagauguuagaaaaaaug

SEQ ID NO: 4074343 - RNA, 23 nt, Vaccinia virus
agaagauguuagaaaaaaugaug

SEQ ID NO: 4074344 - RNA, 12 nt, Vaccinia virus
agaagauuaaac

SEQ ID NO: 4074345 - RNA, 13 nt, Vaccinia virus
agaagauuuaacu

SEQ ID NO: 4074346 - RNA, 17 nt, Vaccinia virus
agaagauuuaacuagau

SEQ ID NO: 4074347 - RNA, 21 nt, Vaccinia virus
agaagcauacgccaaauaucu

SEQ ID NO: 4074348 - RNA, 24 nt, Vaccinia virus
agaagcugguaauaguuuacagau

SEQ ID NO: 4074349 - RNA, 14 nt, Vaccinia virus
agaaggaaacuucu

SEQ ID NO: 4074350 - RNA, 22 nt, Vaccinia virus
agaaggguucgauuaucuguau

SEQ ID NO: 4074351 - RNA, 18 nt, Vaccinia virus
agaagucauacuagaaua

SEQ ID NO: 4074352 - RNA, 16 nt, Vaccinia virus
agaagucugaucuuaa

SEQ ID NO: 4074353 - RNA, 18 nt, Vaccinia virus
agaagugaguauacuugu

SEQ ID NO: 4074354 - RNA, 14 nt, Vaccinia virus
agaauaaauuauau

SEQ ID NO: 4074355 - RNA, 16 nt, Vaccinia virus
agaauaagaacuauaa

SEQ ID NO: 4074356 - RNA, 15 nt, Vaccinia virus
agaauaaguuucaua

SEQ ID NO: 4074357 - RNA, 12 nt, Vaccinia virus
agaauaauacag

SEQ ID NO: 4074358 - RNA, 23 nt, Vaccinia virus
agaauacgaugauauuaaaauua

SEQ ID NO: 4074359 - RNA, 22 nt, Vaccinia virus
agaauauaacgugguaucuucu

SEQ ID NO: 4074360 - RNA, 14 nt, Vaccinia virus
agaauauacuacaa

SEQ ID NO: 4074361 - RNA, 14 nt, Vaccinia virus
agaauaucuauaca

SEQ ID NO: 4074362 - RNA, 23 nt, Vaccinia virus
agaauaucuaucgacucuagaug

SEQ ID NO: 4074363 - RNA, 13 nt, Vaccinia virus
agaauaugucucu

SEQ ID NO: 4074364 - RNA, 19 nt, Vaccinia virus
agaauauuccucuaacaga

SEQ ID NO: 4074365 - RNA, 13 nt, Vaccinia virus
agaaucaaaggau

SEQ ID NO: 4074366 - RNA, 19 nt, Vaccinia virus
agaaucaaauauagauuuu

SEQ ID NO: 4074367 - RNA, 14 nt, Vaccinia virus
agaaucaauacaaa

SEQ ID NO: 4074368 - RNA, 18 nt, Vaccinia virus
agaaucaguuacauguuu

SEQ ID NO: 4074369 - RNA, 16 nt, Vaccinia virus
agaaucauugcuguaa

SEQ ID NO: 4074370 - RNA, 18 nt, Vaccinia virus
agaaucauugcuguaaac

SEQ ID NO: 4074371 - RNA, 18 nt, Vaccinia virus
agaauccaucaaaaaugu

SEQ ID NO: 4074372 - RNA, 22 nt, Vaccinia virus
agaauccgcugauggaaacaca

SEQ ID NO: 4074373 - RNA, 18 nt, Vaccinia virus
agaaucuauuuuaaugag

SEQ ID NO: 4074374 - RNA, 14 nt, Vaccinia virus
agaaucucaugaau

SEQ ID NO: 4074375 - RNA, 21 nt, Vaccinia virus
agaaucuuaguugguccaaau

SEQ ID NO: 4074376 - RNA, 16 nt, Vaccinia virus
agaaugaagauaucau

SEQ ID NO: 4074377 - RNA, 14 nt, Vaccinia virus
agaaugaauguuua

SEQ ID NO: 4074378 - RNA, 14 nt, Vaccinia virus
agaaugauauagaa

SEQ ID NO: 4074379 - RNA, 17 nt, Vaccinia virus
agaaugcauaaauuugu

SEQ ID NO: 4074380 - RNA, 17 nt, Vaccinia virus
agaaugcauccaaugag

SEQ ID NO: 4074381 - RNA, 13 nt, Vaccinia virus
agaauuaaaagag

SEQ ID NO: 4074382 - RNA, 19 nt, Vaccinia virus
agaauuaaaucuaacgaga

SEQ ID NO: 4074383 - RNA, 19 nt, Vaccinia virus
agaauuaauaauaucucua

SEQ ID NO: 4074384 - RNA, 22 nt, Vaccinia virus
agaauuagucaaucuuauucaa

SEQ ID NO: 4074385 - RNA, 15 nt, Vaccinia virus
agaauucuaaaugau

SEQ ID NO: 4074386 - RNA, 18 nt, Vaccinia virus
agaauugcugcaauauau

SEQ ID NO: 4074387 - RNA, 15 nt, Vaccinia virus
agaauuguaaaauua

SEQ ID NO: 4074388 - RNA, 11 nt, Vaccinia virus
agaauuucauu

SEQ ID NO: 4074389 - RNA, 14 nt, Vaccinia virus
agaauuucuguuca

SEQ ID NO: 4074390 - RNA, 18 nt, Vaccinia virus
agaauuuuuauacauuau

SEQ ID NO: 4074391 - RNA, 21 nt, Vaccinia virus
agacaaacuguaaguauguuu

SEQ ID NO: 4074392 - RNA, 16 nt, Vaccinia virus
agacaaauauacuuua

SEQ ID NO: 4074393 - RNA, 17 nt, Vaccinia virus
auauaccgccucaaacu

SEQ ID NO: 4074394 - RNA, 20 nt, Vaccinia virus
auauaccgccuuucaaaauu

SEQ ID NO: 4074395 - RNA, 18 nt, Vaccinia virus
auauaccuauuaauacau

SEQ ID NO: 4074396 - RNA, 21 nt, Vaccinia virus
aucuauuuuauucaagagaau

SEQ ID NO: 4074397 - RNA, 15 nt, Vaccinia virus
aucucaucauuccau

SEQ ID NO: 4074398 - RNA, 17 nt, Vaccinia virus
aucucuauguuucaguu

SEQ ID NO: 4074399 - RNA, 14 nt, Vaccinia virus
aucucuauuaaaug

SEQ ID NO: 4074400 - RNA, 19 nt, Vaccinia virus
aucucuuucagaacugaug

SEQ ID NO: 4074401 - RNA, 21 nt, Vaccinia virus
aucucuuuuucucaaauccau

SEQ ID NO: 4074402 - RNA, 22 nt, Vaccinia virus
aucugauaaauauacaauagau

SEQ ID NO: 4074403 - RNA, 23 nt, Vaccinia virus
aucugauaacuuuaaacauggau

SEQ ID NO: 4074404 - RNA, 15 nt, Vaccinia virus
aucuguaaacauuug

SEQ ID NO: 4074405 - RNA, 21 nt, Vaccinia virus
aucuguacuauguguuaaaaa

SEQ ID NO: 4074406 - RNA, 16 nt, Vaccinia virus
aucuguacuucuguac

SEQ ID NO: 4074407 - RNA, 15 nt, Vaccinia virus
aucugucaaguuacu

SEQ ID NO: 4074408 - RNA, 15 nt, Vaccinia virus
aucugucuuaauuaa

SEQ ID NO: 4074409 - RNA, 23 nt, Vaccinia virus
aucugucuuaauuaacugucuuu

SEQ ID NO: 4074410 - RNA, 19 nt, Vaccinia virus
aucuguuaccauaauuccu

SEQ ID NO: 4074411 - RNA, 21 nt, Vaccinia virus
aucuguuccucaucugucaua

SEQ ID NO: 4074412 - RNA, 13 nt, Vaccinia virus
aucuuaaauacca

SEQ ID NO: 4074413 - RNA, 19 nt, Vaccinia virus
aucuuaacacucucugcca

SEQ ID NO: 4074414 - RNA, 21 nt, Vaccinia virus
aucuuaacuccucuauuaaug

SEQ ID NO: 4074415 - RNA, 16 nt, Vaccinia virus
aucuuaccaucuucuu

SEQ ID NO: 4074416 - RNA, 22 nt, Vaccinia virus
aucuuaccauguccucaaauaa

SEQ ID NO: 4074417 - RNA, 15 nt, Vaccinia virus
aucuuacucaaaaua

SEQ ID NO: 4074418 - RNA, 20 nt, Vaccinia virus
aucuuauccuuggacaagau

SEQ ID NO: 4074419 - RNA, 17 nt, Vaccinia virus
aucuucauaauaaauaa

SEQ ID NO: 4074420 - RNA, 20 nt, Vaccinia virus
aucuucaucuaccaaagaaa

SEQ ID NO: 4074421 - RNA, 21 nt, Vaccinia virus
aucuucuuauuuagaucuugu

SEQ ID NO: 4074422 - RNA, 17 nt, Vaccinia virus
aucuugauuuauagaug

SEQ ID NO: 4074423 - RNA, 14 nt, Vaccinia virus
aucuugugcauuuu

SEQ ID NO: 4074424 - RNA, 15 nt, Vaccinia virus
aucuuguucagaaau

SEQ ID NO: 4074425 - RNA, 23 nt, Vaccinia virus
aucuuuaacgauaccuauaccua

SEQ ID NO: 4074426 - RNA, 17 nt, Vaccinia virus
aucuuuaauagaacucu

SEQ ID NO: 4074427 - RNA, 16 nt, Vaccinia virus
aucuuuaaucuuacua

SEQ ID NO: 4074428 - RNA, 21 nt, Vaccinia virus
aucuuuacccauccaauacua

SEQ ID NO: 4074429 - RNA, 20 nt, Vaccinia virus
aucuuuacgaauuacuuuac

SEQ ID NO: 4074430 - RNA, 17 nt, Vaccinia virus
aucuuucuccaauacua

SEQ ID NO: 4074431 - RNA, 15 nt, Vaccinia virus
aucuuugauauacua

SEQ ID NO: 4074432 - RNA, 22 nt, Vaccinia virus
aucuuuguucuaaaaacuguau

SEQ ID NO: 4074433 - RNA, 15 nt, Vaccinia virus
aucuuuuuaggaaug

SEQ ID NO: 4074434 - RNA, 16 nt, Vaccinia virus
aucuuuuuaggaaugu

SEQ ID NO: 4074435 - RNA, 20 nt, Vaccinia virus
aucuuuuucuacgucaaaau

SEQ ID NO: 4074436 - RNA, 17 nt, Vaccinia virus
augaaaaaaaacacuga

SEQ ID NO: 4074437 - RNA, 13 nt, Vaccinia virus
augaaaaaaagau

SEQ ID NO: 4074438 - RNA, 14 nt, Vaccinia virus
augaaaaaacauua

SEQ ID NO: 4074439 - RNA, 20 nt, Vaccinia virus
augaaaaacucugauaacua

SEQ ID NO: 4074440 - RNA, 13 nt, Vaccinia virus
augaaaaaguaaa

SEQ ID NO: 4074441 - RNA, 12 nt, Vaccinia virus
augaaaauacuu

SEQ ID NO: 4074442 - RNA, 21 nt, Vaccinia virus
augaaaauacuuuaguaauua

SEQ ID NO: 4074443 - RNA, 18 nt, Vaccinia virus
augaaaaugguaucacac

SEQ ID NO: 4074444 - RNA, 15 nt, Vaccinia virus
augaaacaugcauaa

SEQ ID NO: 4074445 - RNA, 14 nt, Vaccinia virus
augaaauauauuaa

SEQ ID NO: 4074446 - RNA, 12 nt, Vaccinia virus
augaaauguuug

SEQ ID NO: 4074447 - RNA, 17 nt, Vaccinia virus
augaaauuuaaguaaca

SEQ ID NO: 4074448 - RNA, 13 nt, Vaccinia virus
augaacaaagaaa

SEQ ID NO: 4074449 - RNA, 21 nt, Vaccinia virus
augaacacacgaugaaaaugu

SEQ ID NO: 4074450 - RNA, 19 nt, Vaccinia virus
augaacauaguaagaaauu

SEQ ID NO: 4074451 - RNA, 19 nt, Vaccinia virus
augaacuagacgauaaugu

SEQ ID NO: 4074452 - RNA, 19 nt, Vaccinia virus
augaacuuucaaggacuug

SEQ ID NO: 4074453 - RNA, 15 nt, Vaccinia virus
augaaucuaaaagaa

SEQ ID NO: 4074454 - RNA, 23 nt, Vaccinia virus
augaauuaacgagauauaugcga

SEQ ID NO: 4074455 - RNA, 17 nt, Vaccinia virus
augaauuccucugaaaa

SEQ ID NO: 4074456 - RNA, 13 nt, Vaccinia virus
augaauugauucu

SEQ ID NO: 4074457 - RNA, 21 nt, Vaccinia virus
augaauuugauaagacuuuga

SEQ ID NO: 4074458 - RNA, 14 nt, Vaccinia virus
augacaaaauuaaa

SEQ ID NO: 4074459 - RNA, 15 nt, Vaccinia virus
augacacuagaugau

SEQ ID NO: 4074460 - RNA, 19 nt, Vaccinia virus
augacgcauauucuacucu

SEQ ID NO: 4074461 - RNA, 13 nt, Vaccinia virus
augacucugauuu

SEQ ID NO: 4074462 - RNA, 19 nt, Vaccinia virus
augacuuauaaaaauacua

SEQ ID NO: 4074463 - RNA, 14 nt, Vaccinia virus
augacuuaugaaua

SEQ ID NO: 4074464 - RNA, 17 nt, Vaccinia virus
augacuuaugaauacua

SEQ ID NO: 4074465 - RNA, 21 nt, Vaccinia virus
augacuucguaaaaaauaaua

SEQ ID NO: 4074466 - RNA, 17 nt, Vaccinia virus
augagaaacuuaaagua

SEQ ID NO: 4074467 - RNA, 21 nt, Vaccinia virus
augagaauaaaacucuacuau

SEQ ID NO: 4074468 - RNA, 14 nt, Vaccinia virus
augagacgauguau

SEQ ID NO: 4074469 - RNA, 16 nt, Vaccinia virus
augagaucaauagaca

SEQ ID NO: 4074470 - RNA, 20 nt, Vaccinia virus
augagauuauuaaguauuua

SEQ ID NO: 4074471 - RNA, 15 nt, Vaccinia virus
augagguuuugcaac

SEQ ID NO: 4074472 - RNA, 17 nt, Vaccinia virus
augagugauaaguaaua

SEQ ID NO: 4074473 - RNA, 19 nt, Vaccinia virus
augauaaaggagaauagcg

SEQ ID NO: 4074474 - RNA, 16 nt, Vaccinia virus
augauaaguccaucau

SEQ ID NO: 4074475 - RNA, 21 nt, Vaccinia virus
augauaauaggaauggauaau

SEQ ID NO: 4074476 - RNA, 13 nt, Vaccinia virus
augauacauguau

SEQ ID NO: 4074477 - RNA, 16 nt, Vaccinia virus
augauacguacaauga

SEQ ID NO: 4074478 - RNA, 18 nt, Vaccinia virus
augauagaaaugaugaag

SEQ ID NO: 4074479 - RNA, 19 nt, Vaccinia virus
augauauacagucuuaaau

SEQ ID NO: 4074480 - RNA, 13 nt, Vaccinia virus
augauaucgagaa

SEQ ID NO: 4074481 - RNA, 15 nt, Vaccinia virus
augaucacaaagaaa

SEQ ID NO: 4074482 - RNA, 22 nt, Vaccinia virus
augaucauuuugauauugugaa

SEQ ID NO: 4074483 - RNA, 16 nt, Vaccinia virus
augauccauuuauagu

SEQ ID NO: 4074484 - RNA, 13 nt, Vaccinia virus
augaucuguuuau

SEQ ID NO: 4074485 - RNA, 21 nt, Vaccinia virus
augaugauacucucaaccauu

SEQ ID NO: 4074486 - RNA, 14 nt, Vaccinia virus
augaugauguagaa

SEQ ID NO: 4074487 - RNA, 22 nt, Vaccinia virus
augauguguuauuuuuuaacug

SEQ ID NO: 4074488 - RNA, 18 nt, Vaccinia virus
augauuaaaauuaacaag

SEQ ID NO: 4074489 - RNA, 14 nt, Vaccinia virus
augauucaaauccu

SEQ ID NO: 4074490 - RNA, 18 nt, Vaccinia virus
augauucgucuacauguu

SEQ ID NO: 4074491 - RNA, 22 nt, Vaccinia virus
augauucuccggccacuauuau

SEQ ID NO: 4074492 - RNA, 23 nt, Vaccinia virus
augauucucucaacaucuucaau

SEQ ID NO: 4074493 - RNA, 21 nt, Vaccinia virus
augauugacgcauuuaauaga

SEQ ID NO: 4074494 - RNA, 17 nt, Vaccinia virus
augauugauuagaaaau

SEQ ID NO: 4074495 - RNA, 16 nt, Vaccinia virus
augauugauuucgaau

SEQ ID NO: 4074496 - RNA, 14 nt, Vaccinia virus
augauuuaugaauu

SEQ ID NO: 4074497 - RNA, 19 nt, Vaccinia virus
cuauuaagaguaacagcug

SEQ ID NO: 4074498 - RNA, 16 nt, Vaccinia virus
cuauuaucuguuuaua

SEQ ID NO: 4074499 - RNA, 19 nt, Vaccinia virus
cuauuauuugcgaggauga

SEQ ID NO: 4074500 - RNA, 17 nt, Vaccinia virus
cuauucuaucuccagua

SEQ ID NO: 4074501 - RNA, 19 nt, Vaccinia virus
cuauucucguccauuuuag

SEQ ID NO: 4074502 - RNA, 14 nt, Vaccinia virus
cuauuguuuggaau

SEQ ID NO: 4074503 - RNA, 21 nt, Vaccinia virus
cuauuuauugacauuaaucua

SEQ ID NO: 4074504 - RNA, 17 nt, Vaccinia virus
cuauuucaacaaacugg

SEQ ID NO: 4074505 - RNA, 20 nt, Vaccinia virus
cuauuucauacuauuuugug

SEQ ID NO: 4074506 - RNA, 14 nt, Vaccinia virus
cuauuucuuaauga

SEQ ID NO: 4074507 - RNA, 13 nt, Vaccinia virus
cuauuuguuuaua

SEQ ID NO: 4074508 - RNA, 17 nt, Vaccinia virus
cuauuuuaccagcauua

SEQ ID NO: 4074509 - RNA, 17 nt, Vaccinia virus
cuauuuuacuaaauaau

SEQ ID NO: 4074510 - RNA, 14 nt, Vaccinia virus
cuauuuuuaauaua

SEQ ID NO: 4074511 - RNA, 19 nt, Vaccinia virus
cuauuuuuuuauacuucua

SEQ ID NO: 4074512 - RNA, 21 nt, Vaccinia virus
cuauuuuuuuauacuucuaau

SEQ ID NO: 4074513 - RNA, 19 nt, Vaccinia virus
cucaaaagaucaaggaaau

SEQ ID NO: 4074514 - RNA, 13 nt, Vaccinia virus
cucaaacauccuc

SEQ ID NO: 4074515 - RNA, 13 nt, Vaccinia virus
cucaaauagcacc

SEQ ID NO: 4074516 - RNA, 20 nt, Vaccinia virus
cucaagauuuuaaaaaacug

SEQ ID NO: 4074517 - RNA, 13 nt, Vaccinia virus
cucaauaccccaa

SEQ ID NO: 4074518 - RNA, 19 nt, Vaccinia virus
cucagcgauagcucuucua

SEQ ID NO: 4074519 - RNA, 19 nt, Vaccinia virus
cucauaauguaaagauauu

SEQ ID NO: 4074520 - RNA, 20 nt, Vaccinia virus
cucauagucuauuaaguggu

SEQ ID NO: 4074521 - RNA, 16 nt, Vaccinia virus
cucauaugauuucagu

SEQ ID NO: 4074522 - RNA, 18 nt, Vaccinia virus
cucaucguauaaaacucu

SEQ ID NO: 4074523 - RNA, 14 nt, Vaccinia virus
cucaucuuucccaa

SEQ ID NO: 4074524 - RNA, 19 nt, Vaccinia virus
cucauguaaccuacuagaa

SEQ ID NO: 4074525 - RNA, 20 nt, Vaccinia virus
cucauguucuuaaucaaugu

SEQ ID NO: 4074526 - RNA, 21 nt, Vaccinia virus
cucauuaauuaaccauuccaa

SEQ ID NO: 4074527 - RNA, 18 nt, Vaccinia virus
cuccauaguggacaacau

SEQ ID NO: 4074528 - RNA, 20 nt, Vaccinia virus
cuccaugauuaaauauuuua

SEQ ID NO: 4074529 - RNA, 16 nt, Vaccinia virus
cucccaccaaauuaau

SEQ ID NO: 4074530 - RNA, 16 nt, Vaccinia virus
cucccauaauacuuua

SEQ ID NO: 4074531 - RNA, 14 nt, Vaccinia virus
cuccccaaacauug

SEQ ID NO: 4074532 - RNA, 22 nt, Vaccinia virus
cuccgcuaggagcauacaguaa

SEQ ID NO: 4074533 - RNA, 21 nt, Vaccinia virus
cuccucauuacguuucauuuu

SEQ ID NO: 4074534 - RNA, 22 nt, Vaccinia virus
cucgauaacacauuuucaucua

SEQ ID NO: 4074535 - RNA, 17 nt, Vaccinia virus
cucgcuuuguguaucau

SEQ ID NO: 4074536 - RNA, 16 nt, Vaccinia virus
cucguuaaacagcauu

SEQ ID NO: 4074537 - RNA, 20 nt, Vaccinia virus
cucguuaaacgccuuuagaa

SEQ ID NO: 4074538 - RNA, 22 nt, Vaccinia virus
cucuaacaacaacgaaccaaaa

SEQ ID NO: 4074539 - RNA, 17 nt, Vaccinia virus
cucuaaggauccagaag

SEQ ID NO: 4074540 - RNA, 14 nt, Vaccinia virus
cucuacaaauaucu

SEQ ID NO: 4074541 - RNA, 13 nt, Vaccinia virus
cucuacucuagau

SEQ ID NO: 4074542 - RNA, 19 nt, Vaccinia virus
cucuagaauauuuaauuug

SEQ ID NO: 4074543 - RNA, 11 nt, Vaccinia virus
cucuagauaug

SEQ ID NO: 4074544 - RNA, 17 nt, Vaccinia virus
cucuagauauguauuua

SEQ ID NO: 4074545 - RNA, 21 nt, Vaccinia virus
cucuaguaaagucaggacuga

SEQ ID NO: 4074546 - RNA, 22 nt, Vaccinia virus
cucuauaguuuguuuucauuau

SEQ ID NO: 4074547 - RNA, 20 nt, Vaccinia virus
cucuauuauagcuucuggac

SEQ ID NO: 4074548 - RNA, 13 nt, Vaccinia virus
cucuauuguuuga

SEQ ID NO: 4074549 - RNA, 20 nt, Vaccinia virus
cucuauuucuuaaugaauuu

SEQ ID NO: 4074550 - RNA, 21 nt, Vaccinia virus
cucucagguacagauuuugaa

SEQ ID NO: 4074551 - RNA, 19 nt, Vaccinia virus
cucuccuagguuucucuau

SEQ ID NO: 4074552 - RNA, 14 nt, Vaccinia virus
cucucuaauggaug

SEQ ID NO: 4074553 - RNA, 19 nt, Vaccinia virus
cucucuauuucuuaaugaa

SEQ ID NO: 4074554 - RNA, 19 nt, Vaccinia virus
cucucugaaucucugugga

SEQ ID NO: 4074555 - RNA, 16 nt, Vaccinia virus
cucucuuaauuucaga

SEQ ID NO: 4074556 - RNA, 21 nt, Vaccinia virus
cucugaauauagaacaucauu

SEQ ID NO: 4074557 - RNA, 17 nt, Vaccinia virus
cucugauccguauccau

SEQ ID NO: 4074558 - RNA, 15 nt, Vaccinia virus
cucuggagaaaagau

SEQ ID NO: 4074559 - RNA, 17 nt, Vaccinia virus
cucuggauauaucacaa

SEQ ID NO: 4074560 - RNA, 16 nt, Vaccinia virus
cucuucaacaucuuug

SEQ ID NO: 4074561 - RNA, 19 nt, Vaccinia virus
gaaucuaccuauagaaaag

SEQ ID NO: 4074562 - RNA, 13 nt, Vaccinia virus
gaaucugugaaug

SEQ ID NO: 4074563 - RNA, 17 nt, Vaccinia virus
gaaugaaauauauacau

SEQ ID NO: 4074564 - RNA, 19 nt, Vaccinia virus
gaaugacaucgcauuuaua

SEQ ID NO: 4074565 - RNA, 23 nt, Vaccinia virus
gaaugagaugcauaaaacuuuau

SEQ ID NO: 4074566 - RNA, 13 nt, Vaccinia virus
gaaugaugauaua

SEQ ID NO: 4074567 - RNA, 16 nt, Vaccinia virus
gaaugcccgcauauau

SEQ ID NO: 4074568 - RNA, 23 nt, Vaccinia virus
gaauggaaaccuuuaaucuauau

SEQ ID NO: 4074569 - RNA, 12 nt, Vaccinia virus
gaauguauauac

SEQ ID NO: 4074570 - RNA, 12 nt, Vaccinia virus
gaaugucaugau

SEQ ID NO: 4074571 - RNA, 14 nt, Vaccinia virus
gaauguguauucuc

SEQ ID NO: 4074572 - RNA, 18 nt, Vaccinia virus
gaauuaauaauaucucua

SEQ ID NO: 4074573 - RNA, 15 nt, Vaccinia virus
gaauuaauguccuga

SEQ ID NO: 4074574 - RNA, 15 nt, Vaccinia virus
gaauuacucaugcau

SEQ ID NO: 4074575 - RNA, 14 nt, Vaccinia virus
gaauuauagacacu

SEQ ID NO: 4074576 - RNA, 20 nt, Vaccinia virus
gaauucauccguccuucaga

SEQ ID NO: 4074577 - RNA, 21 nt, Vaccinia virus
gaauugacgaaacaauguuuc

SEQ ID NO: 4074578 - RNA, 16 nt, Vaccinia virus
gaauugcaauuuugau

SEQ ID NO: 4074579 - RNA, 14 nt, Vaccinia virus
gaauuuagaaauau

SEQ ID NO: 4074580 - RNA, 11 nt, Vaccinia virus
gacaaauguaa

SEQ ID NO: 4074581 - RNA, 12 nt, Vaccinia virus
gacaauaaucuc

SEQ ID NO: 4074582 - RNA, 16 nt, Vaccinia virus
gacaauaggaaaucua

SEQ ID NO: 4074583 - RNA, 21 nt, Vaccinia virus
gacaauauuuaguuuauucau

SEQ ID NO: 4074584 - RNA, 20 nt, Vaccinia virus
gacacauaugcgaucagaua

SEQ ID NO: 4074585 - RNA, 15 nt, Vaccinia virus
gacaccauagagaua

SEQ ID NO: 4074586 - RNA, 20 nt, Vaccinia virus
gacacgauuaccaauacuuu

SEQ ID NO: 4074587 - RNA, 17 nt, Vaccinia virus
gacacugaaucaauuga

SEQ ID NO: 4074588 - RNA, 15 nt, Vaccinia virus
gacauaauacuaucu

SEQ ID NO: 4074589 - RNA, 18 nt, Vaccinia virus
gacauacguauauuucua

SEQ ID NO: 4074590 - RNA, 15 nt, Vaccinia virus
gacauaguaauacau

SEQ ID NO: 4074591 - RNA, 15 nt, Vaccinia virus
gacauaucagaugau

SEQ ID NO: 4074592 - RNA, 13 nt, Vaccinia virus
gacauauuucauu

SEQ ID NO: 4074593 - RNA, 19 nt, Vaccinia virus
gacaucuggauuucagaua

SEQ ID NO: 4074594 - RNA, 17 nt, Vaccinia virus
gacauuuucacaaauac

SEQ ID NO: 4074595 - RNA, 17 nt, Vaccinia virus
gaccaagacacauaugg

SEQ ID NO: 4074596 - RNA, 14 nt, Vaccinia virus
gaccaguauugaug

SEQ ID NO: 4074597 - RNA, 23 nt, Vaccinia virus
gaccgacgauaauauaaacaucu

SEQ ID NO: 4074598 - RNA, 18 nt, Vaccinia virus
gacgaaauauuagaaaaa

SEQ ID NO: 4074599 - RNA, 12 nt, Vaccinia virus
gacgauauuaac

SEQ ID NO: 4074600 - RNA, 13 nt, Vaccinia virus
gacgauauuucug

SEQ ID NO: 4074601 - RNA, 23 nt, Vaccinia virus
gacgauuucugaauuauuucaua

SEQ ID NO: 4074602 - RNA, 21 nt, Vaccinia virus
gacgcuuguuaauaaguaaau

SEQ ID NO: 4074603 - RNA, 15 nt, Vaccinia virus
gacggauaaaacaaa

SEQ ID NO: 4074604 - RNA, 18 nt, Vaccinia virus
gacggcguuaauaguaau

SEQ ID NO: 4074605 - RNA, 22 nt, Vaccinia virus
gacgucuagaguuuauaucaau

SEQ ID NO: 4074606 - RNA, 23 nt, Vaccinia virus
gacguugccagaaaauccuguaa

SEQ ID NO: 4074607 - RNA, 15 nt, Vaccinia virus
gacuacgaaacugau

SEQ ID NO: 4074608 - RNA, 14 nt, Vaccinia virus
gacuagacauuuac

SEQ ID NO: 4074609 - RNA, 19 nt, Vaccinia virus
gacuauagacauaauacua

SEQ ID NO: 4074610 - RNA, 16 nt, Vaccinia virus
gacuaugggaauauau

SEQ ID NO: 4074611 - RNA, 14 nt, Vaccinia virus
gacucauuaaaacu

SEQ ID NO: 4074612 - RNA, 18 nt, Vaccinia virus
gacucauuauuucccaaa

SEQ ID NO: 4074613 - RNA, 18 nt, Vaccinia virus
gacuccggaaccaauuac

SEQ ID NO: 4074614 - RNA, 14 nt, Vaccinia virus
gacucgucuacuau

SEQ ID NO: 4074615 - RNA, 17 nt, Vaccinia virus
gacucuaccugaugaau

SEQ ID NO: 4074616 - RNA, 17 nt, Vaccinia virus
gacugaccaguauugau

SEQ ID NO: 4074617 - RNA, 21 nt, Vaccinia virus
gacugccacguuagaggauga

SEQ ID NO: 4074618 - RNA, 19 nt, Vaccinia virus
gacuguagaacucaugaau

SEQ ID NO: 4074619 - RNA, 18 nt, Vaccinia virus
gacuuaagacuuaaaacu

SEQ ID NO: 4074620 - RNA, 15 nt, Vaccinia virus
gacuuaaucaugcau

SEQ ID NO: 4074621 - RNA, 21 nt, Vaccinia virus
gacuuacgucugcuaaaauac

SEQ ID NO: 4074622 - RNA, 16 nt, Vaccinia virus
gacuugauuuaaaacc

SEQ ID NO: 4074623 - RNA, 19 nt, Vaccinia virus
gacuuugaacauuauugau

SEQ ID NO: 4074624 - RNA, 19 nt, Vaccinia virus
gagaaaguggauaaaacaa

SEQ ID NO: 4074625 - RNA, 17 nt, Vaccinia virus
gagaagaugguuaaaaa

SEQ ID NO: 4074626 - RNA, 13 nt, Vaccinia virus
gagaauaauagau

SEQ ID NO: 4074627 - RNA, 16 nt, Vaccinia virus
gagaaugacauaacua

SEQ ID NO: 4074628 - RNA, 17 nt, Vaccinia virus
gagacgaucuacuauca

SEQ ID NO: 4074629 - RNA, 22 nt, Vaccinia virus
gagagaucauuucuauaauuua

SEQ ID NO: 4074630 - RNA, 19 nt, Vaccinia virus
agacggauaagaaauauau

SEQ ID NO: 4074631 - RNA, 14 nt, Vaccinia virus
agacuacaauauau

SEQ ID NO: 4074632 - RNA, 18 nt, Vaccinia virus
agacuaugugguuaaaug

SEQ ID NO: 4074633 - RNA, 21 nt, Vaccinia virus
agacugacuucuaacaaacau

SEQ ID NO: 4074634 - RNA, 20 nt, Vaccinia virus
agacuuuaagcuaaaauauu

SEQ ID NO: 4074635 - RNA, 16 nt, Vaccinia virus
agacuuuaucuagauc

SEQ ID NO: 4074636 - RNA, 17 nt, Vaccinia virus
agagaagucgucaagca

SEQ ID NO: 4074637 - RNA, 20 nt, Vaccinia virus
agagaaugaaauauauacau

SEQ ID NO: 4074638 - RNA, 22 nt, Vaccinia virus
agagacccugcgcuuucucuau

SEQ ID NO: 4074639 - RNA, 16 nt, Vaccinia virus
agagaccgauaccuau

SEQ ID NO: 4074640 - RNA, 17 nt, Vaccinia virus
agagacgggaaaauagu

SEQ ID NO: 4074641 - RNA, 14 nt, Vaccinia virus
agagauaacuauaa

SEQ ID NO: 4074642 - RNA, 12 nt, Vaccinia virus
agagauuuuacu

SEQ ID NO: 4074643 - RNA, 12 nt, Vaccinia virus
agagcaugaagg

SEQ ID NO: 4074644 - RNA, 16 nt, Vaccinia virus
agagccaucuguaaaa

SEQ ID NO: 4074645 - RNA, 15 nt, Vaccinia virus
agagcuauucuugga

SEQ ID NO: 4074646 - RNA, 13 nt, Vaccinia virus
agaggaaacuaau

SEQ ID NO: 4074647 - RNA, 22 nt, Vaccinia virus
agaggaccguugggaauuuuau

SEQ ID NO: 4074648 - RNA, 14 nt, Vaccinia virus
agaggauaacuauu

SEQ ID NO: 4074649 - RNA, 20 nt, Vaccinia virus
agagucacgaauaacgauau

SEQ ID NO: 4074650 - RNA, 14 nt, Vaccinia virus
agaguguuuaucca

SEQ ID NO: 4074651 - RNA, 16 nt, Vaccinia virus
agauaaaaaauuauau

SEQ ID NO: 4074652 - RNA, 12 nt, Vaccinia virus
agauaaauggaa

SEQ ID NO: 4074653 - RNA, 21 nt, Vaccinia virus
agauaacaacgacuuauaauu

SEQ ID NO: 4074654 - RNA, 15 nt, Vaccinia virus
agauaaccaaaaagu

SEQ ID NO: 4074655 - RNA, 12 nt, Vaccinia virus
agauaaggaagu

SEQ ID NO: 4074656 - RNA, 13 nt, Vaccinia virus
agauaaguuuaag

SEQ ID NO: 4074657 - RNA, 13 nt, Vaccinia virus
agauaauauaccg

SEQ ID NO: 4074658 - RNA, 17 nt, Vaccinia virus
agauaauauuagacaua

SEQ ID NO: 4074659 - RNA, 16 nt, Vaccinia virus
agauaaucaaaauugu

SEQ ID NO: 4074660 - RNA, 13 nt, Vaccinia virus
agauaaucuauau

SEQ ID NO: 4074661 - RNA, 13 nt, Vaccinia virus
agauaaugauaua

SEQ ID NO: 4074662 - RNA, 18 nt, Vaccinia virus
agauaaugcgguuuauca

SEQ ID NO: 4074663 - RNA, 18 nt, Vaccinia virus
agauaaugguagcaauau

SEQ ID NO: 4074664 - RNA, 20 nt, Vaccinia virus
agauaauugugguaauacac

SEQ ID NO: 4074665 - RNA, 13 nt, Vaccinia virus
agauaauuuuacc

SEQ ID NO: 4074666 - RNA, 20 nt, Vaccinia virus
agauaauuuuaccagaauac

SEQ ID NO: 4074667 - RNA, 22 nt, Vaccinia virus
agauacaguuaauaucuauaua

SEQ ID NO: 4074668 - RNA, 15 nt, Vaccinia virus
agauaccaaacagaa

SEQ ID NO: 4074669 - RNA, 20 nt, Vaccinia virus
agauaccacgaguaucaauu

SEQ ID NO: 4074670 - RNA, 16 nt, Vaccinia virus
agauacuguuuagaga

SEQ ID NO: 4074671 - RNA, 23 nt, Vaccinia virus
agauagaucacacauuaugaacu

SEQ ID NO: 4074672 - RNA, 21 nt, Vaccinia virus
agauagguauuuuaucucuau

SEQ ID NO: 4074673 - RNA, 20 nt, Vaccinia virus
agauauaaaauagaaaauaa

SEQ ID NO: 4074674 - RNA, 21 nt, Vaccinia virus
agauauaaaaugcguauucca

SEQ ID NO: 4074675 - RNA, 23 nt, Vaccinia virus
agauauacccgaagauauacaca

SEQ ID NO: 4074676 - RNA, 22 nt, Vaccinia virus
agauauacgcuaucuauauccu

SEQ ID NO: 4074677 - RNA, 18 nt, Vaccinia virus
agauauagauuugcauuu

SEQ ID NO: 4074678 - RNA, 17 nt, Vaccinia virus
agauauaguauauucca

SEQ ID NO: 4074679 - RNA, 15 nt, Vaccinia virus
agauauauagaauua

SEQ ID NO: 4074680 - RNA, 18 nt, Vaccinia virus
agauaucagagaacuucu

SEQ ID NO: 4074681 - RNA, 23 nt, Vaccinia virus
agauaucauaaaugaaauagaua

SEQ ID NO: 4074682 - RNA, 17 nt, Vaccinia virus
agauaucuauacuuacu

SEQ ID NO: 4074683 - RNA, 14 nt, Vaccinia virus
agauaugauagaca

SEQ ID NO: 4074684 - RNA, 23 nt, Vaccinia virus
agauaugguaaaauuaaauagua

SEQ ID NO: 4074685 - RNA, 10 nt, Vaccinia virus
agauauuaau

SEQ ID NO: 4074686 - RNA, 17 nt, Vaccinia virus
agauauuaguaaaagau

SEQ ID NO: 4074687 - RNA, 20 nt, Vaccinia virus
agauauuauuaaaucaugac

SEQ ID NO: 4074688 - RNA, 19 nt, Vaccinia virus
agauauuuagcaauugcau

SEQ ID NO: 4074689 - RNA, 19 nt, Vaccinia virus
agauauuuccauuuaucua

SEQ ID NO: 4074690 - RNA, 21 nt, Vaccinia virus
agauauuuggcuaaacuauau

SEQ ID NO: 4074691 - RNA, 17 nt, Vaccinia virus
agaucaacagaaauauu

SEQ ID NO: 4074692 - RNA, 13 nt, Vaccinia virus
agaucaaggaaau

SEQ ID NO: 4074693 - RNA, 22 nt, Vaccinia virus
agaucaauggugugauguugau

SEQ ID NO: 4074694 - RNA, 19 nt, Vaccinia virus
agaucaucaaaauauguuu

SEQ ID NO: 4074695 - RNA, 20 nt, Vaccinia virus
agauccugcauagaaauauc

SEQ ID NO: 4074696 - RNA, 15 nt, Vaccinia virus
agaucgaaaaaagag

SEQ ID NO: 4074697 - RNA, 24 nt, Vaccinia virus
agaucgcuuucugguaacaugaua

SEQ ID NO: 4074698 - RNA, 18 nt, Vaccinia virus
agaucuaaauacaaaauc

SEQ ID NO: 4074699 - RNA, 20 nt, Vaccinia virus
agaucuacuggcgaaauggu

SEQ ID NO: 4074700 - RNA, 19 nt, Vaccinia virus
agaucugcguguaaaaagu

SEQ ID NO: 4074701 - RNA, 23 nt, Vaccinia virus
agaucuucucuccuuucaaacuu

SEQ ID NO: 4074702 - RNA, 21 nt, Vaccinia virus
agaucuuuucucaaagauguu

SEQ ID NO: 4074703 - RNA, 16 nt, Vaccinia virus
agaugacgaugauaug

SEQ ID NO: 4074704 - RNA, 15 nt, Vaccinia virus
agaugagaacucuau

SEQ ID NO: 4074705 - RNA, 21 nt, Vaccinia virus
agaugagcauaaacauaauaa

SEQ ID NO: 4074706 - RNA, 17 nt, Vaccinia virus
agaugauaauuuauaca

SEQ ID NO: 4074707 - RNA, 23 nt, Vaccinia virus
agaugaugauacguauauacacu

SEQ ID NO: 4074708 - RNA, 20 nt, Vaccinia virus
agaugccaagauaucuauau

SEQ ID NO: 4074709 - RNA, 18 nt, Vaccinia virus
agaugcuauaucaaaaua

SEQ ID NO: 4074710 - RNA, 23 nt, Vaccinia virus
agaugcuauguauauauauuucu

SEQ ID NO: 4074711 - RNA, 15 nt, Vaccinia virus
agauggauaaaacuu

SEQ ID NO: 4074712 - RNA, 20 nt, Vaccinia virus
agaugguaaaauacaaaaua

SEQ ID NO: 4074713 - RNA, 18 nt, Vaccinia virus
agaugguagaacaaugug

SEQ ID NO: 4074714 - RNA, 16 nt, Vaccinia virus
agaugucuuauuaaaa

SEQ ID NO: 4074715 - RNA, 19 nt, Vaccinia virus
agaugugauggaaaaauga

SEQ ID NO: 4074716 - RNA, 19 nt, Vaccinia virus
agauguuacaaauguagaa

SEQ ID NO: 4074717 - RNA, 16 nt, Vaccinia virus
agauguuauuccuguu

SEQ ID NO: 4074718 - RNA, 13 nt, Vaccinia virus
agauuaaaaaugg

SEQ ID NO: 4074719 - RNA, 14 nt, Vaccinia virus
agauuaaaaauggu

SEQ ID NO: 4074720 - RNA, 22 nt, Vaccinia virus
agauuaaagacuuauagcuaga

SEQ ID NO: 4074721 - RNA, 18 nt, Vaccinia virus
agauuaccuauucacuua

SEQ ID NO: 4074722 - RNA, 15 nt, Vaccinia virus
agauuacucauguaa

SEQ ID NO: 4074723 - RNA, 17 nt, Vaccinia virus
agauuaguaaauucaag

SEQ ID NO: 4074724 - RNA, 14 nt, Vaccinia virus
agauuaguaacagu

SEQ ID NO: 4074725 - RNA, 13 nt, Vaccinia virus
agauuaucaaaau

SEQ ID NO: 4074726 - RNA, 14 nt, Vaccinia virus
agauucaacauuua

SEQ ID NO: 4074727 - RNA, 17 nt, Vaccinia virus
agauucgcauaaaggau

SEQ ID NO: 4074728 - RNA, 16 nt, Vaccinia virus
agauucucuaugagac

SEQ ID NO: 4074729 - RNA, 22 nt, Vaccinia virus
agauucuuccuccaaacaguua

SEQ ID NO: 4074730 - RNA, 14 nt, Vaccinia virus
agauugaaugccau

SEQ ID NO: 4074731 - RNA, 15 nt, Vaccinia virus
agauugguacgaaau

SEQ ID NO: 4074732 - RNA, 16 nt, Vaccinia virus
agauuguaucaguuuc

SEQ ID NO: 4074733 - RNA, 20 nt, Vaccinia virus
agauuguuguauagaaauuu

SEQ ID NO: 4074734 - RNA, 15 nt, Vaccinia virus
agauuguuuucagug

SEQ ID NO: 4074735 - RNA, 17 nt, Vaccinia virus
agauuuaucauauuucu

SEQ ID NO: 4074736 - RNA, 22 nt, Vaccinia virus
agauuuauuugauaaucauguu

SEQ ID NO: 4074737 - RNA, 16 nt, Vaccinia virus
agauuucaaagauguu

SEQ ID NO: 4074738 - RNA, 18 nt, Vaccinia virus
agauuuccuagauuuacu

SEQ ID NO: 4074739 - RNA, 15 nt, Vaccinia virus
agauuucgucuaaua

SEQ ID NO: 4074740 - RNA, 17 nt, Vaccinia virus
agauuucugacaauuac

SEQ ID NO: 4074741 - RNA, 15 nt, Vaccinia virus
agauuuuaaaaaacu

SEQ ID NO: 4074742 - RNA, 15 nt, Vaccinia virus
agauuuuaaauguau

SEQ ID NO: 4074743 - RNA, 14 nt, Vaccinia virus
agauuuuacuaacu

SEQ ID NO: 4074744 - RNA, 19 nt, Vaccinia virus
agauuuuuagcguauuauc

SEQ ID NO: 4074745 - RNA, 16 nt, Vaccinia virus
agauuuuuuaaaggau

SEQ ID NO: 4074746 - RNA, 11 nt, Vaccinia virus
agcaaaaaacc

SEQ ID NO: 4074747 - RNA, 15 nt, Vaccinia virus
agcaaaggaaauugu

SEQ ID NO: 4074748 - RNA, 23 nt, Vaccinia virus
agcaaagggugguaucauggcag

SEQ ID NO: 4074749 - RNA, 14 nt, Vaccinia virus
agcaacaugucucu

SEQ ID NO: 4074750 - RNA, 19 nt, Vaccinia virus
agcaauagugauagauuuu

SEQ ID NO: 4074751 - RNA, 15 nt, Vaccinia virus
agcaaucagaaauga

SEQ ID NO: 4074752 - RNA, 17 nt, Vaccinia virus
agcaaucagaaaugaug

SEQ ID NO: 4074753 - RNA, 17 nt, Vaccinia virus
agcaaugcuauaccuaa

SEQ ID NO: 4074754 - RNA, 16 nt, Vaccinia virus
auacauccuguucuau

SEQ ID NO: 4074755 - RNA, 14 nt, Vaccinia virus
auacauguuuguaa

SEQ ID NO: 4074756 - RNA, 13 nt, Vaccinia virus
auacauguuuuau

SEQ ID NO: 4074757 - RNA, 19 nt, Vaccinia virus
auacauuaaguaaaguaaa

SEQ ID NO: 4074758 - RNA, 19 nt, Vaccinia virus
auacauuauuacuaaacau

SEQ ID NO: 4074759 - RNA, 20 nt, Vaccinia virus
auacauuauuacuaaacauu

SEQ ID NO: 4074760 - RNA, 14 nt, Vaccinia virus
auacauugaauauu

SEQ ID NO: 4074761 - RNA, 20 nt, Vaccinia virus
auacauuuccgaaugaaugu

SEQ ID NO: 4074762 - RNA, 15 nt, Vaccinia virus
auacauuucucaaau

SEQ ID NO: 4074763 - RNA, 22 nt, Vaccinia virus
auacauuuugcauuagauuuac

SEQ ID NO: 4074764 - RNA, 15 nt, Vaccinia virus
auacauuuuucuaug

SEQ ID NO: 4074765 - RNA, 12 nt, Vaccinia virus
auaccaaaauuc

SEQ ID NO: 4074766 - RNA, 14 nt, Vaccinia virus
auaccaacaugucu

SEQ ID NO: 4074767 - RNA, 18 nt, Vaccinia virus
auaccaacauuaaaaugu

SEQ ID NO: 4074768 - RNA, 22 nt, Vaccinia virus
auaccaguauaccucaaaaauu

SEQ ID NO: 4074769 - RNA, 15 nt, Vaccinia virus
auaccaguuuggaaa

SEQ ID NO: 4074770 - RNA, 22 nt, Vaccinia virus
auaccauauccuccuguagaua

SEQ ID NO: 4074771 - RNA, 19 nt, Vaccinia virus
auaccuuuaacuucuggaa

SEQ ID NO: 4074772 - RNA, 18 nt, Vaccinia virus
auacgaagaaaaaguaaa

SEQ ID NO: 4074773 - RNA, 14 nt, Vaccinia virus
auacgauaaacauu

SEQ ID NO: 4074774 - RNA, 23 nt, Vaccinia virus
auacgauaguuuguuucuggaau

SEQ ID NO: 4074775 - RNA, 13 nt, Vaccinia virus
auacgauaucuuc

SEQ ID NO: 4074776 - RNA, 17 nt, Vaccinia virus
auacgcugauaaauaua

SEQ ID NO: 4074777 - RNA, 18 nt, Vaccinia virus
auacguaagaauauacua

SEQ ID NO: 4074778 - RNA, 23 nt, Vaccinia virus
auacuaaaaaauguagaaauuga

SEQ ID NO: 4074779 - RNA, 12 nt, Vaccinia virus
auacuaaagaaa

SEQ ID NO: 4074780 - RNA, 16 nt, Vaccinia virus
auacuaaagaaacugu

SEQ ID NO: 4074781 - RNA, 19 nt, Vaccinia virus
auacuaaaucuccuucaug

SEQ ID NO: 4074782 - RNA, 14 nt, Vaccinia virus
auacuaauaugaca

SEQ ID NO: 4074783 - RNA, 15 nt, Vaccinia virus
auacuagaacuauag

SEQ ID NO: 4074784 - RNA, 13 nt, Vaccinia virus
auacuauauguau

SEQ ID NO: 4074785 - RNA, 16 nt, Vaccinia virus
auacuaugaugucuag

SEQ ID NO: 4074786 - RNA, 14 nt, Vaccinia virus
auacucagaauuau

SEQ ID NO: 4074787 - RNA, 18 nt, Vaccinia virus
auacucaugccuaguaau

SEQ ID NO: 4074788 - RNA, 18 nt, Vaccinia virus
auacuccuucaugaacau

SEQ ID NO: 4074789 - RNA, 14 nt, Vaccinia virus
auacuccuuuguau

SEQ ID NO: 4074790 - RNA, 14 nt, Vaccinia virus
auacucuaaucuuu

SEQ ID NO: 4074791 - RNA, 23 nt, Vaccinia virus
auacucuaugaauggauacuugu

SEQ ID NO: 4074792 - RNA, 16 nt, Vaccinia virus
auacucuauucgaaaa

SEQ ID NO: 4074793 - RNA, 14 nt, Vaccinia virus
auacugaaccaucg

SEQ ID NO: 4074794 - RNA, 22 nt, Vaccinia virus
auacuguauauacuauuauaga

SEQ ID NO: 4074795 - RNA, 16 nt, Vaccinia virus
auacuguguaaagaaa

SEQ ID NO: 4074796 - RNA, 17 nt, Vaccinia virus
auacuguguaaagaaau

SEQ ID NO: 4074797 - RNA, 16 nt, Vaccinia virus
auacuuccaucaacau

SEQ ID NO: 4074798 - RNA, 18 nt, Vaccinia virus
auacuuuaaagcaaaaug

SEQ ID NO: 4074799 - RNA, 15 nt, Vaccinia virus
auacuuuuucuagaa

SEQ ID NO: 4074800 - RNA, 22 nt, Vaccinia virus
auagaaacauauucuaugaauu

SEQ ID NO: 4074801 - RNA, 23 nt, Vaccinia virus
auagaagcguauaaccuguauac

SEQ ID NO: 4074802 - RNA, 20 nt, Vaccinia virus
auagaauaaauauccuugga

SEQ ID NO: 4074803 - RNA, 12 nt, Vaccinia virus
auagaaucugug

SEQ ID NO: 4074804 - RNA, 17 nt, Vaccinia virus
auagaaugaagaaugcc

SEQ ID NO: 4074805 - RNA, 18 nt, Vaccinia virus
auagaauuuagaaauaua

SEQ ID NO: 4074806 - RNA, 15 nt, Vaccinia virus
auagacaaauuauuc

SEQ ID NO: 4074807 - RNA, 20 nt, Vaccinia virus
auagacggcuucuagaaguu

SEQ ID NO: 4074808 - RNA, 19 nt, Vaccinia virus
auagagaacauauaaaugu

SEQ ID NO: 4074809 - RNA, 17 nt, Vaccinia virus
auagagaguucauuuau

SEQ ID NO: 4074810 - RNA, 16 nt, Vaccinia virus
auagagaugagaugcu

SEQ ID NO: 4074811 - RNA, 23 nt, Vaccinia virus
auagagccaagacgaacaaaauc

SEQ ID NO: 4074812 - RNA, 22 nt, Vaccinia virus
auagagcccacguuuaaacauu

SEQ ID NO: 4074813 - RNA, 17 nt, Vaccinia virus
auagaggaagacacauu

SEQ ID NO: 4074814 - RNA, 22 nt, Vaccinia virus
auagauaguagcuauaauauau

SEQ ID NO: 4074815 - RNA, 18 nt, Vaccinia virus
auagauaugccagaacua

SEQ ID NO: 4074816 - RNA, 17 nt, Vaccinia virus
auagauauuuucuuucu

SEQ ID NO: 4074817 - RNA, 13 nt, Vaccinia virus
auagaucauaucu

SEQ ID NO: 4074818 - RNA, 21 nt, Vaccinia virus
auagaucggcaaagcuauugu

SEQ ID NO: 4074819 - RNA, 12 nt, Vaccinia virus
auagaugaaugu

SEQ ID NO: 4074820 - RNA, 16 nt, Vaccinia virus
auagauucagaauuuc

SEQ ID NO: 4074821 - RNA, 19 nt, Vaccinia virus
auagauuucgaaaauacua

SEQ ID NO: 4074822 - RNA, 13 nt, Vaccinia virus
auagcuaaaaaug

SEQ ID NO: 4074823 - RNA, 16 nt, Vaccinia virus
auagcuagaggaaaug

SEQ ID NO: 4074824 - RNA, 15 nt, Vaccinia virus
auagcugagaauauc

SEQ ID NO: 4074825 - RNA, 21 nt, Vaccinia virus
auagguaauacauauaaaugu

SEQ ID NO: 4074826 - RNA, 20 nt, Vaccinia virus
auaggucuucgucuacagua

SEQ ID NO: 4074827 - RNA, 18 nt, Vaccinia virus
auaggugcguuguauaca

SEQ ID NO: 4074828 - RNA, 22 nt, Vaccinia virus
auaggugcguuguauacacaua

SEQ ID NO: 4074829 - RNA, 14 nt, Vaccinia virus
auaguaaaauauua

SEQ ID NO: 4074830 - RNA, 19 nt, Vaccinia virus
auaguacuacaauuuguau

SEQ ID NO: 4074831 - RNA, 16 nt, Vaccinia virus
auaguagaguaaacau

SEQ ID NO: 4074832 - RNA, 17 nt, Vaccinia virus
auaguagaguaaacauu

SEQ ID NO: 4074833 - RNA, 23 nt, Vaccinia virus
auaguaggucuggaucuggaaaa

SEQ ID NO: 4074834 - RNA, 17 nt, Vaccinia virus
auaguauaauuauaugu

SEQ ID NO: 4074835 - RNA, 18 nt, Vaccinia virus
auagugaaacaaaauaua

SEQ ID NO: 4074836 - RNA, 23 nt, Vaccinia virus
auaguguuuaacaaagauauuac

SEQ ID NO: 4074837 - RNA, 19 nt, Vaccinia virus
auaguuacagaauuuguau

SEQ ID NO: 4074838 - RNA, 15 nt, Vaccinia virus
auaguuauaucacac

SEQ ID NO: 4074839 - RNA, 23 nt, Vaccinia virus
auaguuaucuaucuuaaaaacua

SEQ ID NO: 4074840 - RNA, 17 nt, Vaccinia virus
auaguucuuaacaucua

SEQ ID NO: 4074841 - RNA, 19 nt, Vaccinia virus
auaguuugggaaaagaaau

SEQ ID NO: 4074842 - RNA, 14 nt, Vaccinia virus
auauaaaaaaauga

SEQ ID NO: 4074843 - RNA, 15 nt, Vaccinia virus
auauaaauaugagca

SEQ ID NO: 4074844 - RNA, 18 nt, Vaccinia virus
auauaaaucuaaaauuga

SEQ ID NO: 4074845 - RNA, 17 nt, Vaccinia virus
auauaacuucugguaaa

SEQ ID NO: 4074846 - RNA, 13 nt, Vaccinia virus
auauaaugauaua

SEQ ID NO: 4074847 - RNA, 23 nt, Vaccinia virus
auauaauggauuugcaccacuuu

SEQ ID NO: 4074848 - RNA, 22 nt, Vaccinia virus
auauaaugggucccuagucaua

SEQ ID NO: 4074849 - RNA, 17 nt, Vaccinia virus
auauaauuauacuaucg

SEQ ID NO: 4074850 - RNA, 15 nt, Vaccinia virus
auauacacauaauua

SEQ ID NO: 4074851 - RNA, 14 nt, Vaccinia virus
auauaccauuaaaa

SEQ ID NO: 4074852 - RNA, 17 nt, Vaccinia virus
auauacgccaugauugu

SEQ ID NO: 4074853 - RNA, 22 nt, Vaccinia virus
auauacguugauagauuagcug

SEQ ID NO: 4074854 - RNA, 14 nt, Vaccinia virus
auauacuuuucuaa

SEQ ID NO: 4074855 - RNA, 21 nt, Vaccinia virus
auauagaaccugaucuggaaa

SEQ ID NO: 4074856 - RNA, 17 nt, Vaccinia virus
auauagaagauaaacau

SEQ ID NO: 4074857 - RNA, 19 nt, Vaccinia virus
auauagagauuagaggagg

SEQ ID NO: 4074858 - RNA, 20 nt, Vaccinia virus
auauagauuuuuuaaaggau

SEQ ID NO: 4074859 - RNA, 23 nt, Vaccinia virus
auauagcaucgauccaugagaaa

SEQ ID NO: 4074860 - RNA, 20 nt, Vaccinia virus
auauagcggaugaaaaauuu

SEQ ID NO: 4074861 - RNA, 15 nt, Vaccinia virus
auauagcuuauucca

SEQ ID NO: 4074862 - RNA, 19 nt, Vaccinia virus
auauaggaccacuagcaaa

SEQ ID NO: 4074863 - RNA, 12 nt, Vaccinia virus
auauaguaauga

SEQ ID NO: 4074864 - RNA, 14 nt, Vaccinia virus
auauaguaccuaga

SEQ ID NO: 4074865 - RNA, 15 nt, Vaccinia virus
auauaguauauagau

SEQ ID NO: 4074866 - RNA, 19 nt, Vaccinia virus
auauagugaaacaaaauau

SEQ ID NO: 4074867 - RNA, 21 nt, Vaccinia virus
auauaguucgucauuuaauaa

SEQ ID NO: 4074868 - RNA, 13 nt, Vaccinia virus
auauauacaguag

SEQ ID NO: 4074869 - RNA, 19 nt, Vaccinia virus
auauaucacccauccauuu

SEQ ID NO: 4074870 - RNA, 17 nt, Vaccinia virus
auauaucacuauaagaa

SEQ ID NO: 4074871 - RNA, 15 nt, Vaccinia virus
auauaucaugaugau

SEQ ID NO: 4074872 - RNA, 13 nt, Vaccinia virus
auauaucuauugu

SEQ ID NO: 4074873 - RNA, 12 nt, Vaccinia virus
auauauguugau

SEQ ID NO: 4074874 - RNA, 12 nt, Vaccinia virus
auauauguuuau

SEQ ID NO: 4074875 - RNA, 19 nt, Vaccinia virus
auauauguuuucaucauuu

SEQ ID NO: 4074876 - RNA, 15 nt, Vaccinia virus
auauauuagaaauac

SEQ ID NO: 4074877 - RNA, 18 nt, Vaccinia virus
auauauuaucauagaccu

SEQ ID NO: 4074878 - RNA, 22 nt, Vaccinia virus
cuaaaauuccuaacgaugauau

SEQ ID NO: 4074879 - RNA, 23 nt, Vaccinia virus
cuaaaauuccuaacgaugauaug

SEQ ID NO: 4074880 - RNA, 15 nt, Vaccinia virus
cuaaacaauguuaug

SEQ ID NO: 4074881 - RNA, 18 nt, Vaccinia virus
cuaaaccuucuuauucua

SEQ ID NO: 4074882 - RNA, 13 nt, Vaccinia virus
cuaaaguauuucu

SEQ ID NO: 4074883 - RNA, 14 nt, Vaccinia virus
cuaaauaaguagua

SEQ ID NO: 4074884 - RNA, 20 nt, Vaccinia virus
cuaaauaauggcuguuugua

SEQ ID NO: 4074885 - RNA, 16 nt, Vaccinia virus
cuaaaucucuuuagaa

SEQ ID NO: 4074886 - RNA, 18 nt, Vaccinia virus
cuaaauucaugucuaaug

SEQ ID NO: 4074887 - RNA, 21 nt, Vaccinia virus
cuaacaaaaauuaugaaauaa

SEQ ID NO: 4074888 - RNA, 13 nt, Vaccinia virus
cuaacacauuuca

SEQ ID NO: 4074889 - RNA, 23 nt, Vaccinia virus
cuaacauugauuuuaaaauuaaa

SEQ ID NO: 4074890 - RNA, 14 nt, Vaccinia virus
cuaagagaugaaaa

SEQ ID NO: 4074891 - RNA, 16 nt, Vaccinia virus
cuaaguccuauucucg

SEQ ID NO: 4074892 - RNA, 20 nt, Vaccinia virus
cuaauaaacauuccacauuc

SEQ ID NO: 4074893 - RNA, 15 nt, Vaccinia virus
cuaauacuaaauaca

SEQ ID NO: 4074894 - RNA, 22 nt, Vaccinia virus
cuaauagauguauuugauauac

SEQ ID NO: 4074895 - RNA, 15 nt, Vaccinia virus
cuaaucuuuaauaga

SEQ ID NO: 4074896 - RNA, 20 nt, Vaccinia virus
cuaaugccuuaggauaugua

SEQ ID NO: 4074897 - RNA, 18 nt, Vaccinia virus
cuaaugcggaaugucaac

SEQ ID NO: 4074898 - RNA, 17 nt, Vaccinia virus
cuaaugugauucucuga

SEQ ID NO: 4074899 - RNA, 13 nt, Vaccinia virus
cuaauguuguaaa

SEQ ID NO: 4074900 - RNA, 18 nt, Vaccinia virus
cuaauuauuccuauuuca

SEQ ID NO: 4074901 - RNA, 12 nt, Vaccinia virus
cuaauucuuucu

SEQ ID NO: 4074902 - RNA, 22 nt, Vaccinia virus
cuaauugaucaagaguaacuau

SEQ ID NO: 4074903 - RNA, 18 nt, Vaccinia virus
cuaauuugauauaaugaa

SEQ ID NO: 4074904 - RNA, 13 nt, Vaccinia virus
cuacaaaauguug

SEQ ID NO: 4074905 - RNA, 16 nt, Vaccinia virus
cuacaauauauucuca

SEQ ID NO: 4074906 - RNA, 21 nt, Vaccinia virus
cuacaauugucuaaugauauc

SEQ ID NO: 4074907 - RNA, 14 nt, Vaccinia virus
cuacaauuuguauu

SEQ ID NO: 4074908 - RNA, 15 nt, Vaccinia virus
cuacaguaaugucca

SEQ ID NO: 4074909 - RNA, 17 nt, Vaccinia virus
cuacaucaguuuuguau

SEQ ID NO: 4074910 - RNA, 16 nt, Vaccinia virus
cuaccaguuauucucg

SEQ ID NO: 4074911 - RNA, 23 nt, Vaccinia virus
cuaccauggcuccguuuaauuug

SEQ ID NO: 4074912 - RNA, 16 nt, Vaccinia virus
cuaccgaauaaaguug

SEQ ID NO: 4074913 - RNA, 18 nt, Vaccinia virus
cuaccgcaucaucaucgu

SEQ ID NO: 4074914 - RNA, 17 nt, Vaccinia virus
cuaccguuguuaaauac

SEQ ID NO: 4074915 - RNA, 13 nt, Vaccinia virus
cuaccugcuguug

SEQ ID NO: 4074916 - RNA, 15 nt, Vaccinia virus
cuaccuuuucaauuu

SEQ ID NO: 4074917 - RNA, 19 nt, Vaccinia virus
cuacgaaacugauacaauc

SEQ ID NO: 4074918 - RNA, 15 nt, Vaccinia virus
cuacgaaacuuugau

SEQ ID NO: 4074919 - RNA, 16 nt, Vaccinia virus
cuacuaauguauacau

SEQ ID NO: 4074920 - RNA, 19 nt, Vaccinia virus
cuacuacguucucuuugau

SEQ ID NO: 4074921 - RNA, 23 nt, Vaccinia virus
cuacuaguauagaucaaauacuu

SEQ ID NO: 4074922 - RNA, 13 nt, Vaccinia virus
cuacuauagaauu

SEQ ID NO: 4074923 - RNA, 20 nt, Vaccinia virus
cuacucuauagcgcuuuagu

SEQ ID NO: 4074924 - RNA, 16 nt, Vaccinia virus
cuacugcaucacugac

SEQ ID NO: 4074925 - RNA, 19 nt, Vaccinia virus
cuagaaaacgaaaacaucc

SEQ ID NO: 4074926 - RNA, 18 nt, Vaccinia virus
cuagaauacucauuuucu

SEQ ID NO: 4074927 - RNA, 19 nt, Vaccinia virus
cuagaauuagaauuacaaa

SEQ ID NO: 4074928 - RNA, 21 nt, Vaccinia virus
cuagaccgaugaccauuuaaa

SEQ ID NO: 4074929 - RNA, 24 nt, Vaccinia virus
cuagacgauuaguaauauaucuca

SEQ ID NO: 4074930 - RNA, 20 nt, Vaccinia virus
cuagauagaguauuaaauau

SEQ ID NO: 4074931 - RNA, 16 nt, Vaccinia virus
cuagauggaaauauug

SEQ ID NO: 4074932 - RNA, 17 nt, Vaccinia virus
cuagauuccaaucauug

SEQ ID NO: 4074933 - RNA, 16 nt, Vaccinia virus
cuagcgauuaugaaaa

SEQ ID NO: 4074934 - RNA, 18 nt, Vaccinia virus
cuagcguuauaacaaaau

SEQ ID NO: 4074935 - RNA, 16 nt, Vaccinia virus
cuaggugcuauggaug

SEQ ID NO: 4074936 - RNA, 14 nt, Vaccinia virus
cuaguagaaaagau

SEQ ID NO: 4074937 - RNA, 17 nt, Vaccinia virus
cuaguagcgaaaacuau

SEQ ID NO: 4074938 - RNA, 16 nt, Vaccinia virus
cuaguaucuuuuguuc

SEQ ID NO: 4074939 - RNA, 20 nt, Vaccinia virus
cuagucauaauaucuuuaau

SEQ ID NO: 4074940 - RNA, 14 nt, Vaccinia virus
cuagucuuaaaugg

SEQ ID NO: 4074941 - RNA, 14 nt, Vaccinia virus
cuaguucugagaaa

SEQ ID NO: 4074942 - RNA, 13 nt, Vaccinia virus
cuaguuguagaau

SEQ ID NO: 4074943 - RNA, 13 nt, Vaccinia virus
cuaguuguuuaug

SEQ ID NO: 4074944 - RNA, 20 nt, Vaccinia virus
cuauaaaacgauuaaacaau

SEQ ID NO: 4074945 - RNA, 21 nt, Vaccinia virus
cuauaaaauuguauauucaga

SEQ ID NO: 4074946 - RNA, 22 nt, Vaccinia virus
cuauaaacgaugguuuaauuug

SEQ ID NO: 4074947 - RNA, 12 nt, Vaccinia virus
cuauaacuucua

SEQ ID NO: 4074948 - RNA, 17 nt, Vaccinia virus
cuauaauaauaaaugua

SEQ ID NO: 4074949 - RNA, 23 nt, Vaccinia virus
cuauaccauauccuccuguagau

SEQ ID NO: 4074950 - RNA, 16 nt, Vaccinia virus
cuauaccauuaucuau

SEQ ID NO: 4074951 - RNA, 16 nt, Vaccinia virus
cuauacgaugaauaca

SEQ ID NO: 4074952 - RNA, 14 nt, Vaccinia virus
cuauagaaacaccu

SEQ ID NO: 4074953 - RNA, 18 nt, Vaccinia virus
cuauagaaauuauuuuua

SEQ ID NO: 4074954 - RNA, 14 nt, Vaccinia virus
cuauagacauaaua

SEQ ID NO: 4074955 - RNA, 19 nt, Vaccinia virus
cuauagaccaaacugcaaa

SEQ ID NO: 4074956 - RNA, 22 nt, Vaccinia virus
cuauagaguagacauuaauaga

SEQ ID NO: 4074957 - RNA, 19 nt, Vaccinia virus
cuauauaauucuauuagau

SEQ ID NO: 4074958 - RNA, 21 nt, Vaccinia virus
cuauauacaacgaaacaucua

SEQ ID NO: 4074959 - RNA, 13 nt, Vaccinia virus
cuauauagauauu

SEQ ID NO: 4074960 - RNA, 21 nt, Vaccinia virus
cuauauaucgucucauagaga

SEQ ID NO: 4074961 - RNA, 13 nt, Vaccinia virus
cuauauauguuuu

SEQ ID NO: 4074962 - RNA, 18 nt, Vaccinia virus
cuauaucgcuaaaauuuu

SEQ ID NO: 4074963 - RNA, 16 nt, Vaccinia virus
cuauaucuaacaucuu

SEQ ID NO: 4074964 - RNA, 20 nt, Vaccinia virus
cuauaucuauguuuuuagau

SEQ ID NO: 4074965 - RNA, 14 nt, Vaccinia virus
cuauauuauguuuu

SEQ ID NO: 4074966 - RNA, 22 nt, Vaccinia virus
cuaucaaauucggaucguaaau

SEQ ID NO: 4074967 - RNA, 21 nt, Vaccinia virus
cuaucaaccgcauaauacaau

SEQ ID NO: 4074968 - RNA, 18 nt, Vaccinia virus
cuaucauuaccucaugaa

SEQ ID NO: 4074969 - RNA, 15 nt, Vaccinia virus
cuaucuauauguuuu

SEQ ID NO: 4074970 - RNA, 16 nt, Vaccinia virus
cuaucuucaucauauu

SEQ ID NO: 4074971 - RNA, 13 nt, Vaccinia virus
cuaugauauuguu

SEQ ID NO: 4074972 - RNA, 20 nt, Vaccinia virus
cuaugcaaagaauuuggaau

SEQ ID NO: 4074973 - RNA, 21 nt, Vaccinia virus
cuaugcauauuauuaaucauu

SEQ ID NO: 4074974 - RNA, 23 nt, Vaccinia virus
cuaugguauugauaaaauuaaug

SEQ ID NO: 4074975 - RNA, 22 nt, Vaccinia virus
cuauguauucagaauuaauaga

SEQ ID NO: 4074976 - RNA, 15 nt, Vaccinia virus
cuauguuuuuaauga

SEQ ID NO: 4074977 - RNA, 15 nt, Vaccinia virus
cuauuaaagauggag

SEQ ID NO: 4074978 - RNA, 19 nt, Vaccinia virus
cuauuaaugacacuaguua

SEQ ID NO: 4074979 - RNA, 17 nt, Vaccinia virus
cuauuacugacuuuaau

SEQ ID NO: 4074980 - RNA, 23 nt, Vaccinia virus
cuauuagaguauugcauuuugau

SEQ ID NO: 4074981 - RNA, 21 nt, Vaccinia virus
cuauuccaucaaacuguauag

SEQ ID NO: 4074982 - RNA, 22 nt, Vaccinia virus
cuauuccuggugcuauuuugau

SEQ ID NO: 4074983 - RNA, 22 nt, Vaccinia virus
cuauuuguaauauuuagacaua

SEQ ID NO: 4074984 - RNA, 22 nt, Vaccinia virus
cucaaagagaauuauauauuua

SEQ ID NO: 4074985 - RNA, 19 nt, Vaccinia virus
cucaaaugggaaacaaucu

SEQ ID NO: 4074986 - RNA, 23 nt, Vaccinia virus
cucaaauguaguguuggauaucu

SEQ ID NO: 4074987 - RNA, 16 nt, Vaccinia virus
cucaacauaaauaauu

SEQ ID NO: 4074988 - RNA, 15 nt, Vaccinia virus
cucaacgcgauaucu

SEQ ID NO: 4074989 - RNA, 18 nt, Vaccinia virus
cucaauaaaaaaauuaau

SEQ ID NO: 4074990 - RNA, 14 nt, Vaccinia virus
cucaauaagaugac

SEQ ID NO: 4074991 - RNA, 15 nt, Vaccinia virus
cucaauucaggaaca

SEQ ID NO: 4074992 - RNA, 18 nt, Vaccinia virus
cucaccauuucgacaucu

SEQ ID NO: 4074993 - RNA, 12 nt, Vaccinia virus
cucacuucucuu

SEQ ID NO: 4074994 - RNA, 19 nt, Vaccinia virus
cucagaauucuaaaugaug

SEQ ID NO: 4074995 - RNA, 19 nt, Vaccinia virus
cucagauuaaauccaucuc

SEQ ID NO: 4074996 - RNA, 19 nt, Vaccinia virus
cucaguaaauguaucgugu

SEQ ID NO: 4074997 - RNA, 19 nt, Vaccinia virus
cucauaaguguauauaucu

SEQ ID NO: 4074998 - RNA, 15 nt, Vaccinia virus
cucauaguaucgauu

SEQ ID NO: 4074999 - RNA, 23 nt, Vaccinia virus
cucauauggaucuccaucgauga

SEQ ID NO: 4075000 - RNA, 18 nt, Vaccinia virus
cucaucggaucuguaaaa

SEQ ID NO: 4075001 - RNA, 15 nt, Vaccinia virus
gagacggauacuguc

SEQ ID NO: 4075002 - RNA, 21 nt, Vaccinia virus
gagacguaacaauguagcgca

SEQ ID NO: 4075003 - RNA, 23 nt, Vaccinia virus
gagacuuguuaguuaaaaugaua

SEQ ID NO: 4075004 - RNA, 13 nt, Vaccinia virus
gagagagaaauac

SEQ ID NO: 4075005 - RNA, 13 nt, Vaccinia virus
gagaguagauauc

SEQ ID NO: 4075006 - RNA, 17 nt, Vaccinia virus
gagauacuaacacauuu

SEQ ID NO: 4075007 - RNA, 20 nt, Vaccinia virus
gagaucauuaaauguuucau

SEQ ID NO: 4075008 - RNA, 22 nt, Vaccinia virus
gagaucuacuggcgaaauggua

SEQ ID NO: 4075009 - RNA, 15 nt, Vaccinia virus
gagauguuucauaau

SEQ ID NO: 4075010 - RNA, 20 nt, Vaccinia virus
gagauuggguuaauaaauac

SEQ ID NO: 4075011 - RNA, 15 nt, Vaccinia virus
gagcaaguagaaaac

SEQ ID NO: 4075012 - RNA, 22 nt, Vaccinia virus
gagcaauucccaagauuucauc

SEQ ID NO: 4075013 - RNA, 17 nt, Vaccinia virus
gagcacuauuucuaaau

SEQ ID NO: 4075014 - RNA, 19 nt, Vaccinia virus
gaggaaaucguauaaauac

SEQ ID NO: 4075015 - RNA, 15 nt, Vaccinia virus
gaggauguuaaacaa

SEQ ID NO: 4075016 - RNA, 17 nt, Vaccinia virus
gaggcuaaaacacauuu

SEQ ID NO: 4075017 - RNA, 15 nt, Vaccinia virus
gagguagcaaaaaga

SEQ ID NO: 4075018 - RNA, 18 nt, Vaccinia virus
gaguaacagucgaacaau

SEQ ID NO: 4075019 - RNA, 18 nt, Vaccinia virus
gaguaguacaagaaauau

SEQ ID NO: 4075020 - RNA, 14 nt, Vaccinia virus
gaguauauauuaag

SEQ ID NO: 4075021 - RNA, 19 nt, Vaccinia virus
gaguauuaaccaugaaaga

SEQ ID NO: 4075022 - RNA, 14 nt, Vaccinia virus
gagugguaaacaac

SEQ ID NO: 4075023 - RNA, 19 nt, Vaccinia virus
gaguuagauauuaauaaca

SEQ ID NO: 4075024 - RNA, 15 nt, Vaccinia virus
gaguucauuaaaaua

SEQ ID NO: 4075025 - RNA, 18 nt, Vaccinia virus
gaguuccauuacaaauau

SEQ ID NO: 4075026 - RNA, 16 nt, Vaccinia virus
gaguugauuguaaaua

SEQ ID NO: 4075027 - RNA, 12 nt, Vaccinia virus
gaguuuauacac

SEQ ID NO: 4075028 - RNA, 19 nt, Vaccinia virus
gaguuuuccguuagaaaag

SEQ ID NO: 4075029 - RNA, 17 nt, Vaccinia virus
gauaaaacgauaaaaga

SEQ ID NO: 4075030 - RNA, 22 nt, Vaccinia virus
gauaaaacguggaaagaaucua

SEQ ID NO: 4075031 - RNA, 18 nt, Vaccinia virus
gauaaacacucauauuau

SEQ ID NO: 4075032 - RNA, 16 nt, Vaccinia virus
gauaaagauauaugau

SEQ ID NO: 4075033 - RNA, 18 nt, Vaccinia virus
gauaaauaggaucaucua

SEQ ID NO: 4075034 - RNA, 22 nt, Vaccinia virus
gauaacuacaauauuucaucau

SEQ ID NO: 4075035 - RNA, 17 nt, Vaccinia virus
gauaacuagaaucagaa

SEQ ID NO: 4075036 - RNA, 18 nt, Vaccinia virus
gauaacuagauagaaaga

SEQ ID NO: 4075037 - RNA, 17 nt, Vaccinia virus
gauaacuauaaauggag

SEQ ID NO: 4075038 - RNA, 20 nt, Vaccinia virus
gauaagauauguuuauucau

SEQ ID NO: 4075039 - RNA, 23 nt, Vaccinia virus
gauaaggaguagcagauuuccua

SEQ ID NO: 4075040 - RNA, 16 nt, Vaccinia virus
gauaagguaaagugua

SEQ ID NO: 4075041 - RNA, 22 nt, Vaccinia virus
gauaauaaaaucacuaguauca

SEQ ID NO: 4075042 - RNA, 13 nt, Vaccinia virus
gauaauaaaucaa

SEQ ID NO: 4075043 - RNA, 21 nt, Vaccinia virus
gauaauaacagaguaccauca

SEQ ID NO: 4075044 - RNA, 20 nt, Vaccinia virus
gauaauacauuuucuuacaa

SEQ ID NO: 4075045 - RNA, 19 nt, Vaccinia virus
gauaauauuagacauauga

SEQ ID NO: 4075046 - RNA, 21 nt, Vaccinia virus
gauaauucgcgcaccaacaau

SEQ ID NO: 4075047 - RNA, 12 nt, Vaccinia virus
gauaauuuccau

SEQ ID NO: 4075048 - RNA, 22 nt, Vaccinia virus
gauaauuucuccagaacauuga

SEQ ID NO: 4075049 - RNA, 19 nt, Vaccinia virus
gauacaaaaucuaaacaaa

SEQ ID NO: 4075050 - RNA, 16 nt, Vaccinia virus
gauacagauacagaua

SEQ ID NO: 4075051 - RNA, 20 nt, Vaccinia virus
gauacagauuaauuuccaca

SEQ ID NO: 4075052 - RNA, 17 nt, Vaccinia virus
gauaccguuacauuuga

SEQ ID NO: 4075053 - RNA, 19 nt, Vaccinia virus
gauaccuuuguuauuuauu

SEQ ID NO: 4075054 - RNA, 19 nt, Vaccinia virus
gauacuaauuguagcuauu

SEQ ID NO: 4075055 - RNA, 19 nt, Vaccinia virus
gauacuagaguaguauauu

SEQ ID NO: 4075056 - RNA, 17 nt, Vaccinia virus
gauacuauccaguaaac

SEQ ID NO: 4075057 - RNA, 17 nt, Vaccinia virus
gauagacgcaaauuaga

SEQ ID NO: 4075058 - RNA, 18 nt, Vaccinia virus
gauaguaauuucacgaau

SEQ ID NO: 4075059 - RNA, 22 nt, Vaccinia virus
gauagucguucucguucagaau

SEQ ID NO: 4075060 - RNA, 23 nt, Vaccinia virus
gauauaauucguggauaaucauu

SEQ ID NO: 4075061 - RNA, 22 nt, Vaccinia virus
gauauacgcuaucuauauccug

SEQ ID NO: 4075062 - RNA, 20 nt, Vaccinia virus
gauauaguauauuccaguuc

SEQ ID NO: 4075063 - RNA, 21 nt, Vaccinia virus
gauauauaguaaugaagagag

SEQ ID NO: 4075064 - RNA, 22 nt, Vaccinia virus
gauauauuguuucauaauugcu

SEQ ID NO: 4075065 - RNA, 18 nt, Vaccinia virus
gauauauuuuucauaaau

SEQ ID NO: 4075066 - RNA, 22 nt, Vaccinia virus
gauauuaacgcguuuuaugaau

SEQ ID NO: 4075067 - RNA, 12 nt, Vaccinia virus
gauauuuucuau

SEQ ID NO: 4075068 - RNA, 23 nt, Vaccinia virus
gauauuuucuuucuaucauggau

SEQ ID NO: 4075069 - RNA, 13 nt, Vaccinia virus
gaucaaauacuug

SEQ ID NO: 4075070 - RNA, 17 nt, Vaccinia virus
gaucaacggauaaucug

SEQ ID NO: 4075071 - RNA, 19 nt, Vaccinia virus
gaucaacggauaaucugaa

SEQ ID NO: 4075072 - RNA, 15 nt, Vaccinia virus
gaucacacauuauga

SEQ ID NO: 4075073 - RNA, 19 nt, Vaccinia virus
gaucacauuuagauaaaaa

SEQ ID NO: 4075074 - RNA, 21 nt, Vaccinia virus
gaucauagaacagaccaaaua

SEQ ID NO: 4075075 - RNA, 14 nt, Vaccinia virus
gaucauucuuuuag

SEQ ID NO: 4075076 - RNA, 17 nt, Vaccinia virus
gaucauuuugauauugu

SEQ ID NO: 4075077 - RNA, 20 nt, Vaccinia virus
gauccacaaaacguauauag

SEQ ID NO: 4075078 - RNA, 18 nt, Vaccinia virus
gauccugcauagaaauau

SEQ ID NO: 4075079 - RNA, 13 nt, Vaccinia virus
gaucguuaaugaa

SEQ ID NO: 4075080 - RNA, 15 nt, Vaccinia virus
gaucuaaaaauuaaa

SEQ ID NO: 4075081 - RNA, 18 nt, Vaccinia virus
gaucuaauggaauccaau

SEQ ID NO: 4075082 - RNA, 21 nt, Vaccinia virus
gaucuagcaaaggaaauugug

SEQ ID NO: 4075083 - RNA, 20 nt, Vaccinia virus
gaucuauguaguuuuaaaac

SEQ ID NO: 4075084 - RNA, 21 nt, Vaccinia virus
gaucuauuagaaaauucucuu

SEQ ID NO: 4075085 - RNA, 15 nt, Vaccinia virus
gaucuccaacaaauu

SEQ ID NO: 4075086 - RNA, 23 nt, Vaccinia virus
gaucuccucuauuuguacuaucu

SEQ ID NO: 4075087 - RNA, 20 nt, Vaccinia virus
gaucucgagaaauaauaaga

SEQ ID NO: 4075088 - RNA, 21 nt, Vaccinia virus
gaugacaauauuauuaugaag

SEQ ID NO: 4075089 - RNA, 17 nt, Vaccinia virus
gaugacuccaucuuuua

SEQ ID NO: 4075090 - RNA, 19 nt, Vaccinia virus
gaugacuuuaguaaaucau

SEQ ID NO: 4075091 - RNA, 17 nt, Vaccinia virus
gaugagaacagaagcgu

SEQ ID NO: 4075092 - RNA, 18 nt, Vaccinia virus
gaugagcauaaacauaau

SEQ ID NO: 4075093 - RNA, 13 nt, Vaccinia virus
gaugaguauauau

SEQ ID NO: 4075094 - RNA, 14 nt, Vaccinia virus
gaugauaauuuaua

SEQ ID NO: 4075095 - RNA, 16 nt, Vaccinia virus
gaugauacauuucauc

SEQ ID NO: 4075096 - RNA, 15 nt, Vaccinia virus
gaugauauagauaug

SEQ ID NO: 4075097 - RNA, 21 nt, Vaccinia virus
gaugauccuuugagaagacaa

SEQ ID NO: 4075098 - RNA, 17 nt, Vaccinia virus
gaugaucugaauuauau

SEQ ID NO: 4075099 - RNA, 16 nt, Vaccinia virus
gaugaugucauucaca

SEQ ID NO: 4075100 - RNA, 18 nt, Vaccinia virus
gaugccaucauagauaua

SEQ ID NO: 4075101 - RNA, 23 nt, Vaccinia virus
gaugccgccaucguugauuacaa

SEQ ID NO: 4075102 - RNA, 18 nt, Vaccinia virus
gaugccgguaaauguuuu

SEQ ID NO: 4075103 - RNA, 23 nt, Vaccinia virus
gaugcuauccaucagaauguuuc

SEQ ID NO: 4075104 - RNA, 15 nt, Vaccinia virus
gaugcuauguuuaua

SEQ ID NO: 4075105 - RNA, 16 nt, Vaccinia virus
gaugcugcaugaugaa

SEQ ID NO: 4075106 - RNA, 20 nt, Vaccinia virus
gauggaaaguguaaagacaa

SEQ ID NO: 4075107 - RNA, 23 nt, Vaccinia virus
gauggugccaccguaguguauau

SEQ ID NO: 4075108 - RNA, 18 nt, Vaccinia virus
gauguaauuaaauguuug

SEQ ID NO: 4075109 - RNA, 20 nt, Vaccinia virus
gauguauaauuuuuuuaguu

SEQ ID NO: 4075110 - RNA, 22 nt, Vaccinia virus
gaugucauauaggaaacuauaa

SEQ ID NO: 4075111 - RNA, 12 nt, Vaccinia virus
gaugucaugaac

SEQ ID NO: 4075112 - RNA, 17 nt, Vaccinia virus
gaugugucuacauaaau

SEQ ID NO: 4075113 - RNA, 13 nt, Vaccinia virus
gauguuguaauau

SEQ ID NO: 4075114 - RNA, 19 nt, Vaccinia virus
gauuaaaaauaaaguuauc

SEQ ID NO: 4075115 - RNA, 22 nt, Vaccinia virus
gauuaaacuuuaaugauugcau

SEQ ID NO: 4075116 - RNA, 14 nt, Vaccinia virus
gauuaauaauucau

SEQ ID NO: 4075117 - RNA, 15 nt, Vaccinia virus
gauuaauuagauaua

SEQ ID NO: 4075118 - RNA, 21 nt, Vaccinia virus
gauuacaucucugaacuauau

SEQ ID NO: 4075119 - RNA, 21 nt, Vaccinia virus
gauuagaaaauauaaauuaau

SEQ ID NO: 4075120 - RNA, 22 nt, Vaccinia virus
gauuagcacgccggaaaaauaa

SEQ ID NO: 4075121 - RNA, 22 nt, Vaccinia virus
gauuaucguuuucaucuuuuau

SEQ ID NO: 4075122 - RNA, 17 nt, Vaccinia virus
gauuauguuuuaugaau

SEQ ID NO: 4075123 - RNA, 13 nt, Vaccinia virus
ucguuuacaaaau

SEQ ID NO: 4075124 - RNA, 19 nt, Vaccinia virus
ucguuuccucuguacacau

SEQ ID NO: 4075125 - RNA, 13 nt, Vaccinia virus
ucuaaaauguaua

SEQ ID NO: 4075126 - RNA, 10 nt, Vaccinia virus
ucuaaacaaa

SEQ ID NO: 4075127 - RNA, 18 nt, Vaccinia virus
ucuaaaccuucuuauucu

SEQ ID NO: 4075128 - RNA, 22 nt, Vaccinia virus
ucuaaagaaaaaugauuaucuu

SEQ ID NO: 4075129 - RNA, 16 nt, Vaccinia virus
ucuaaagagauuuaga

SEQ ID NO: 4075130 - RNA, 14 nt, Vaccinia virus
ucuaaauacaaaau

SEQ ID NO: 4075131 - RNA, 23 nt, Vaccinia virus
ucuaaauguggcuacaaacuuuu

SEQ ID NO: 4075132 - RNA, 14 nt, Vaccinia virus
ucuaacaucaucau

SEQ ID NO: 4075133 - RNA, 22 nt, Vaccinia virus
ucuaaccuuucccauugaucau

SEQ ID NO: 4075134 - RNA, 16 nt, Vaccinia virus
ucuaagauuauuuuaa

SEQ ID NO: 4075135 - RNA, 13 nt, Vaccinia virus
ucuaauauacuuu

SEQ ID NO: 4075136 - RNA, 17 nt, Vaccinia virus
ucuaaucacuuuaacuu

SEQ ID NO: 4075137 - RNA, 22 nt, Vaccinia virus
ucuaauccuccuauuacauaua

SEQ ID NO: 4075138 - RNA, 19 nt, Vaccinia virus
ucuaaugugauucucugaa

SEQ ID NO: 4075139 - RNA, 17 nt, Vaccinia virus
ucuaauuaguuuuucuu

SEQ ID NO: 4075140 - RNA, 20 nt, Vaccinia virus
ucuaauugggacauuauguu

SEQ ID NO: 4075141 - RNA, 16 nt, Vaccinia virus
ucuacaagaauuuugg

SEQ ID NO: 4075142 - RNA, 19 nt, Vaccinia virus
ucuacauaaucuacgauau

SEQ ID NO: 4075143 - RNA, 14 nt, Vaccinia virus
ucuacaugaaauag

SEQ ID NO: 4075144 - RNA, 23 nt, Vaccinia virus
ucuaccacagcagaaucccauga

SEQ ID NO: 4075145 - RNA, 20 nt, Vaccinia virus
ucuacuaggcugacacuaug

SEQ ID NO: 4075146 - RNA, 12 nt, Vaccinia virus
ucuacuuuuguc

SEQ ID NO: 4075147 - RNA, 15 nt, Vaccinia virus
ucuagagauuguacu

SEQ ID NO: 4075148 - RNA, 14 nt, Vaccinia virus
ucuagauagaguau

SEQ ID NO: 4075149 - RNA, 23 nt, Vaccinia virus
ucuagcuuauugaguggaaaguu

SEQ ID NO: 4075150 - RNA, 19 nt, Vaccinia virus
ucuaguauccauuuuacau

SEQ ID NO: 4075151 - RNA, 18 nt, Vaccinia virus
ucuaguuaucauguagua

SEQ ID NO: 4075152 - RNA, 23 nt, Vaccinia virus
ucuaguuuuauuuuuuuguacgu

SEQ ID NO: 4075153 - RNA, 17 nt, Vaccinia virus
ucuauaaacauaaguau

SEQ ID NO: 4075154 - RNA, 18 nt, Vaccinia virus
ucuauaauauaauaauca

SEQ ID NO: 4075155 - RNA, 16 nt, Vaccinia virus
ucuauacguuucuauu

SEQ ID NO: 4075156 - RNA, 19 nt, Vaccinia virus
ucuauacugucuguaacuc

SEQ ID NO: 4075157 - RNA, 22 nt, Vaccinia virus
ucuauagcgcuuuaguuccuua

SEQ ID NO: 4075158 - RNA, 22 nt, Vaccinia virus
ucuauaggugaugcugguucug

SEQ ID NO: 4075159 - RNA, 19 nt, Vaccinia virus
ucuauaguuuguuuucauu

SEQ ID NO: 4075160 - RNA, 17 nt, Vaccinia virus
ucuauauagauggagua

SEQ ID NO: 4075161 - RNA, 15 nt, Vaccinia virus
ucuauaucuucuuuu

SEQ ID NO: 4075162 - RNA, 23 nt, Vaccinia virus
ucuauauucccgauuuuguagua

SEQ ID NO: 4075163 - RNA, 14 nt, Vaccinia virus
ucuaucauagauuu

SEQ ID NO: 4075164 - RNA, 15 nt, Vaccinia virus
ucuaucauggauaau

SEQ ID NO: 4075165 - RNA, 18 nt, Vaccinia virus
ucuaucauggcaauaaca

SEQ ID NO: 4075166 - RNA, 20 nt, Vaccinia virus
ucuauccauuguuucacauu

SEQ ID NO: 4075167 - RNA, 23 nt, Vaccinia virus
ucuauccuuuuccggaagcaaug

SEQ ID NO: 4075168 - RNA, 15 nt, Vaccinia virus
ucuaucgacaucaga

SEQ ID NO: 4075169 - RNA, 13 nt, Vaccinia virus
ucuaucucaaaau

SEQ ID NO: 4075170 - RNA, 22 nt, Vaccinia virus
ucuaucuccaguauuuacauua

SEQ ID NO: 4075171 - RNA, 16 nt, Vaccinia virus
ucuaucuuuagaguau

SEQ ID NO: 4075172 - RNA, 18 nt, Vaccinia virus
ucuaucuuuaguaguguu

SEQ ID NO: 4075173 - RNA, 18 nt, Vaccinia virus
ucuaucuuuguagaguau

SEQ ID NO: 4075174 - RNA, 18 nt, Vaccinia virus
ucuauguugacauguaua

SEQ ID NO: 4075175 - RNA, 19 nt, Vaccinia virus
ucuauguugacauguauau

SEQ ID NO: 4075176 - RNA, 18 nt, Vaccinia virus
ucuauuaagaguaacagc

SEQ ID NO: 4075177 - RNA, 21 nt, Vaccinia virus
ucuauuacaccaccuccuaua

SEQ ID NO: 4075178 - RNA, 20 nt, Vaccinia virus
ucuauuaguaugguuucaua

SEQ ID NO: 4075179 - RNA, 21 nt, Vaccinia virus
ucuauucgaaaacucuaagaa

SEQ ID NO: 4075180 - RNA, 17 nt, Vaccinia virus
ucuauugccauuaguuu

SEQ ID NO: 4075181 - RNA, 12 nt, Vaccinia virus
ucuauuuggauu

SEQ ID NO: 4075182 - RNA, 18 nt, Vaccinia virus
ucuauuuuaucauuuucc

SEQ ID NO: 4075183 - RNA, 17 nt, Vaccinia virus
ucuauuuugucauuaac

SEQ ID NO: 4075184 - RNA, 22 nt, Vaccinia virus
ucucaaagauguuaugguugaa

SEQ ID NO: 4075185 - RNA, 18 nt, Vaccinia virus
ucucaacaaguucucaau

SEQ ID NO: 4075186 - RNA, 15 nt, Vaccinia virus
ucucaauacaaccaa

SEQ ID NO: 4075187 - RNA, 16 nt, Vaccinia virus
ucucaauaguuucaua

SEQ ID NO: 4075188 - RNA, 18 nt, Vaccinia virus
ucucacaaaaaaaguuuu

SEQ ID NO: 4075189 - RNA, 16 nt, Vaccinia virus
ucucacugaauacgag

SEQ ID NO: 4075190 - RNA, 21 nt, Vaccinia virus
ucucauaauaaacuagaguau

SEQ ID NO: 4075191 - RNA, 16 nt, Vaccinia virus
ucucauaauaaauuuu

SEQ ID NO: 4075192 - RNA, 23 nt, Vaccinia virus
ucucaucaucagaauaaaucaau

SEQ ID NO: 4075193 - RNA, 23 nt, Vaccinia virus
ucucaugagaauggaaaggaaac

SEQ ID NO: 4075194 - RNA, 13 nt, Vaccinia virus
ucucauguucuua

SEQ ID NO: 4075195 - RNA, 15 nt, Vaccinia virus
ucucauuuucuuuaa

SEQ ID NO: 4075196 - RNA, 15 nt, Vaccinia virus
ucuccaccaaacaua

SEQ ID NO: 4075197 - RNA, 18 nt, Vaccinia virus
ucuccauagagaaauuag

SEQ ID NO: 4075198 - RNA, 20 nt, Vaccinia virus
ucuccgcaauacauuucuca

SEQ ID NO: 4075199 - RNA, 13 nt, Vaccinia virus
ucuccuuucucuu

SEQ ID NO: 4075200 - RNA, 15 nt, Vaccinia virus
ucucgaugaaaauaa

SEQ ID NO: 4075201 - RNA, 16 nt, Vaccinia virus
ucucggacauuucagc

SEQ ID NO: 4075202 - RNA, 17 nt, Vaccinia virus
ucucguauacucugccc

SEQ ID NO: 4075203 - RNA, 19 nt, Vaccinia virus
ucucguauccacaaauagu

SEQ ID NO: 4075204 - RNA, 19 nt, Vaccinia virus
ucucuaaauaccucauaaa

SEQ ID NO: 4075205 - RNA, 20 nt, Vaccinia virus
ucucuauccaaggauguaau

SEQ ID NO: 4075206 - RNA, 17 nt, Vaccinia virus
ucucucagguacagauu

SEQ ID NO: 4075207 - RNA, 17 nt, Vaccinia virus
ucucucaucuaucaaaa

SEQ ID NO: 4075208 - RNA, 19 nt, Vaccinia virus
ucucuccaguuuuaguauu

SEQ ID NO: 4075209 - RNA, 15 nt, Vaccinia virus
ucucugacauucaga

SEQ ID NO: 4075210 - RNA, 18 nt, Vaccinia virus
ucucuuaguaaguuuauu

SEQ ID NO: 4075211 - RNA, 12 nt, Vaccinia virus
ucucuuaguguu

SEQ ID NO: 4075212 - RNA, 15 nt, Vaccinia virus
ucucuucaacaucuu

SEQ ID NO: 4075213 - RNA, 23 nt, Vaccinia virus
ucugaaauaacguauuuaaacaa

SEQ ID NO: 4075214 - RNA, 22 nt, Vaccinia virus
ucugaaauccguagaaacaucu

SEQ ID NO: 4075215 - RNA, 19 nt, Vaccinia virus
ucugaaguaguuucuaaua

SEQ ID NO: 4075216 - RNA, 20 nt, Vaccinia virus
ucugaauuauauuuauuauu

SEQ ID NO: 4075217 - RNA, 22 nt, Vaccinia virus
ucugacacccaaaaacaaccga

SEQ ID NO: 4075218 - RNA, 13 nt, Vaccinia virus
ucugacauucaga

SEQ ID NO: 4075219 - RNA, 20 nt, Vaccinia virus
ucugacuggguuguaauguu

SEQ ID NO: 4075220 - RNA, 22 nt, Vaccinia virus
ucugagaaaaugucucucauaa

SEQ ID NO: 4075221 - RNA, 15 nt, Vaccinia virus
ucugauaaucucuaa

SEQ ID NO: 4075222 - RNA, 14 nt, Vaccinia virus
ucugauaauuuaga

SEQ ID NO: 4075223 - RNA, 18 nt, Vaccinia virus
ucugauuugaacaaugca

SEQ ID NO: 4075224 - RNA, 15 nt, Vaccinia virus
ucugcggauuuauaa

SEQ ID NO: 4075225 - RNA, 13 nt, Vaccinia virus
ucuggaauuaaaa

SEQ ID NO: 4075226 - RNA, 19 nt, Vaccinia virus
ucuggacauaauucaucua

SEQ ID NO: 4075227 - RNA, 18 nt, Vaccinia virus
ucugggaauaaaauacua

SEQ ID NO: 4075228 - RNA, 15 nt, Vaccinia virus
ucuguaaauagaauc

SEQ ID NO: 4075229 - RNA, 19 nt, Vaccinia virus
ucugugguaaguaccgaua

SEQ ID NO: 4075230 - RNA, 15 nt, Vaccinia virus
ucuguuaguuuccuu

SEQ ID NO: 4075231 - RNA, 16 nt, Vaccinia virus
ucuguuuuauuaaccg

SEQ ID NO: 4075232 - RNA, 14 nt, Vaccinia virus
ucuuaaaaaguuuc

SEQ ID NO: 4075233 - RNA, 13 nt, Vaccinia virus
ucuuaaaagguuu

SEQ ID NO: 4075234 - RNA, 12 nt, Vaccinia virus
ucuuaaccaaaa

SEQ ID NO: 4075235 - RNA, 18 nt, Vaccinia virus
ucuuaacuuacaaaaugu

SEQ ID NO: 4075236 - RNA, 16 nt, Vaccinia virus
ucuuaaucauauucuu

SEQ ID NO: 4075237 - RNA, 16 nt, Vaccinia virus
ucuuacauucuauaga

SEQ ID NO: 4075238 - RNA, 19 nt, Vaccinia virus
ucuuaccaucuucuuugau

SEQ ID NO: 4075239 - RNA, 19 nt, Vaccinia virus
ucuuaccauguccucaaau

SEQ ID NO: 4075240 - RNA, 23 nt, Vaccinia virus
ucuuaguaacucuaguaaaauaa

SEQ ID NO: 4075241 - RNA, 13 nt, Vaccinia virus
ucuuauagaugua

SEQ ID NO: 4075242 - RNA, 18 nt, Vaccinia virus
ucuuauauagauuucgaa

SEQ ID NO: 4075243 - RNA, 13 nt, Vaccinia virus
ucuuauucuuaaa

SEQ ID NO: 4075244 - RNA, 21 nt, Vaccinia virus
ucuucaaaguuucugaaauaa

SEQ ID NO: 4075245 - RNA, 21 nt, Vaccinia virus
ucuucaucuauaaaucaagau

SEQ ID NO: 4075246 - RNA, 15 nt, Vaccinia virus
uguccauauuuucca

SEQ ID NO: 4075247 - RNA, 18 nt, Vaccinia virus
ugucccuucaagaagaua

SEQ ID NO: 4075248 - RNA, 21 nt, Vaccinia virus
uguccuugcguuucucugaua

SEQ ID NO: 4075249 - RNA, 15 nt, Vaccinia virus
uguccuuuacaucau

SEQ ID NO: 4075250 - RNA, 12 nt, Vaccinia virus
ugucgguaaacg

SEQ ID NO: 4075251 - RNA, 21 nt, Vaccinia virus
ugucuacaaccgcuacauaau

SEQ ID NO: 4075252 - RNA, 19 nt, Vaccinia virus
ugucuagaauggcaaaucu

SEQ ID NO: 4075253 - RNA, 20 nt, Vaccinia virus
ugucuagcauucuagagcau

SEQ ID NO: 4075254 - RNA, 14 nt, Vaccinia virus
ugucuaguuucgua

SEQ ID NO: 4075255 - RNA, 13 nt, Vaccinia virus
ugucuauaucuuc

SEQ ID NO: 4075256 - RNA, 16 nt, Vaccinia virus
ugucuaucucuguaaa

SEQ ID NO: 4075257 - RNA, 18 nt, Vaccinia virus
ugucucagaaucaaauau

SEQ ID NO: 4075258 - RNA, 15 nt, Vaccinia virus
ugucugacugaauac

SEQ ID NO: 4075259 - RNA, 23 nt, Vaccinia virus
ugucuuggaaucaauuacagauu

SEQ ID NO: 4075260 - RNA, 17 nt, Vaccinia virus
ugugaagguuuagaugu

SEQ ID NO: 4075261 - RNA, 23 nt, Vaccinia virus
ugugauacgauuaugacacuauu

SEQ ID NO: 4075262 - RNA, 13 nt, Vaccinia virus
ugugauaugaaca

SEQ ID NO: 4075263 - RNA, 15 nt, Vaccinia virus
ugugcuuaauuauuu

SEQ ID NO: 4075264 - RNA, 15 nt, Vaccinia virus
uguguaaaauaucag

SEQ ID NO: 4075265 - RNA, 16 nt, Vaccinia virus
uguguaugaaaugcuu

SEQ ID NO: 4075266 - RNA, 23 nt, Vaccinia virus
ugugucuacaaccgcuacauaau

SEQ ID NO: 4075267 - RNA, 14 nt, Vaccinia virus
ugugucuacauaaa

SEQ ID NO: 4075268 - RNA, 13 nt, Vaccinia virus
uguguuuacagua

SEQ ID NO: 4075269 - RNA, 23 nt, Vaccinia virus
uguuaaaugaucggaucuaaaau

SEQ ID NO: 4075270 - RNA, 13 nt, Vaccinia virus
uguuaauguauua

SEQ ID NO: 4075271 - RNA, 18 nt, Vaccinia virus
uguuacaaaaguuaauaa

SEQ ID NO: 4075272 - RNA, 23 nt, Vaccinia virus
uguuacucaguugaacagaugau

SEQ ID NO: 4075273 - RNA, 23 nt, Vaccinia virus
uguuagauauagaagauaaacau

SEQ ID NO: 4075274 - RNA, 17 nt, Vaccinia virus
uguuauaagauuacuua

SEQ ID NO: 4075275 - RNA, 15 nt, Vaccinia virus
uguuauaaguuuuua

SEQ ID NO: 4075276 - RNA, 22 nt, Vaccinia virus
uguuauacacggucuagagcau

SEQ ID NO: 4075277 - RNA, 21 nt, Vaccinia virus
uguuaugaaaccauacuaaua

SEQ ID NO: 4075278 - RNA, 16 nt, Vaccinia virus
uguuauuacuacugaa

SEQ ID NO: 4075279 - RNA, 14 nt, Vaccinia virus
uguuauuaucuguu

SEQ ID NO: 4075280 - RNA, 19 nt, Vaccinia virus
uguuauucuguucuauuca

SEQ ID NO: 4075281 - RNA, 23 nt, Vaccinia virus
uguuauuuuuucuguaauaguua

SEQ ID NO: 4075282 - RNA, 20 nt, Vaccinia virus
uguucacauccaccaaugau

SEQ ID NO: 4075283 - RNA, 13 nt, Vaccinia virus
uguucacauccuu

SEQ ID NO: 4075284 - RNA, 21 nt, Vaccinia virus
uguucauaauugcuuuucuaa

SEQ ID NO: 4075285 - RNA, 20 nt, Vaccinia virus
uguucccgucaauagagcaa

SEQ ID NO: 4075286 - RNA, 13 nt, Vaccinia virus
uguucuacauauu

SEQ ID NO: 4075287 - RNA, 18 nt, Vaccinia virus
uguugugcuguuguacau

SEQ ID NO: 4075288 - RNA, 16 nt, Vaccinia virus
uguuguguacauguag

SEQ ID NO: 4075289 - RNA, 19 nt, Vaccinia virus
uguuuaacaaaguuauuca

SEQ ID NO: 4075290 - RNA, 13 nt, Vaccinia virus
uguuuaauacuua

SEQ ID NO: 4075291 - RNA, 15 nt, Vaccinia virus
uguuuaauuuucaca

SEQ ID NO: 4075292 - RNA, 18 nt, Vaccinia virus
uguuuacaguaguaauga

SEQ ID NO: 4075293 - RNA, 21 nt, Vaccinia virus
uguuuauacaauccaugauau

SEQ ID NO: 4075294 - RNA, 21 nt, Vaccinia virus
uguuucaucuaucauagauuu

SEQ ID NO: 4075295 - RNA, 13 nt, Vaccinia virus
uguuuccauccau

SEQ ID NO: 4075296 - RNA, 23 nt, Vaccinia virus
uguuuccuauaaucguuaaauuu

SEQ ID NO: 4075297 - RNA, 20 nt, Vaccinia virus
uguuucuaccggcauagugg

SEQ ID NO: 4075298 - RNA, 21 nt, Vaccinia virus
uguuucuacuccauaauacuc

SEQ ID NO: 4075299 - RNA, 14 nt, Vaccinia virus
uguuucuuuuagaa

SEQ ID NO: 4075300 - RNA, 23 nt, Vaccinia virus
uguuugaaaacagaaacaucaua

SEQ ID NO: 4075301 - RNA, 14 nt, Vaccinia virus
uguuugagaauuaa

SEQ ID NO: 4075302 - RNA, 19 nt, Vaccinia virus
uguuugcugcguguauaac

SEQ ID NO: 4075303 - RNA, 16 nt, Vaccinia virus
uguuugguauacuguu

SEQ ID NO: 4075304 - RNA, 18 nt, Vaccinia virus
uguuuuacaacuaucaua

SEQ ID NO: 4075305 - RNA, 17 nt, Vaccinia virus
uguuuuagugauaucaa

SEQ ID NO: 4075306 - RNA, 17 nt, Vaccinia virus
uguuuucaucaagauuu

SEQ ID NO: 4075307 - RNA, 22 nt, Vaccinia virus
uguuuugaauuucuuagucaua

SEQ ID NO: 4075308 - RNA, 21 nt, Vaccinia virus
uguuuuuaagcuguucaaaau

SEQ ID NO: 4075309 - RNA, 13 nt, Vaccinia virus
uguuuuucacuuu

SEQ ID NO: 4075310 - RNA, 13 nt, Vaccinia virus
uguuuuuguacau

SEQ ID NO: 4075311 - RNA, 14 nt, Vaccinia virus
uguuuuuuaucaua

SEQ ID NO: 4075312 - RNA, 16 nt, Vaccinia virus
uguuuuuucauuauuu

SEQ ID NO: 4075313 - RNA, 17 nt, Vaccinia virus
uuaaaaaaaaauacuuu

SEQ ID NO: 4075314 - RNA, 13 nt, Vaccinia virus
uuaaaaaaauuaa

SEQ ID NO: 4075315 - RNA, 11 nt, Vaccinia virus
uuaaaaaauuu

SEQ ID NO: 4075316 - RNA, 23 nt, Vaccinia virus
uuaaaaaguugacagaaccuugu

SEQ ID NO: 4075317 - RNA, 21 nt, Vaccinia virus
uuaaaaauaagaaugaaauaa

SEQ ID NO: 4075318 - RNA, 13 nt, Vaccinia virus
uuaaaaauuuaga

SEQ ID NO: 4075319 - RNA, 11 nt, Vaccinia virus
uuaaaacauuc

SEQ ID NO: 4075320 - RNA, 15 nt, Vaccinia virus
uuaaaagauauuaau

SEQ ID NO: 4075321 - RNA, 20 nt, Vaccinia virus
uuaaaauaaaaaauauucuu

SEQ ID NO: 4075322 - RNA, 22 nt, Vaccinia virus
uuaaaauaaaaaauauucuuca

SEQ ID NO: 4075323 - RNA, 12 nt, Vaccinia virus
uuaaaauacuuu

SEQ ID NO: 4075324 - RNA, 16 nt, Vaccinia virus
uuaaaauauauuauca

SEQ ID NO: 4075325 - RNA, 23 nt, Vaccinia virus
uuaaaauauauuaucacuucagu

SEQ ID NO: 4075326 - RNA, 16 nt, Vaccinia virus
uuaaaaugauuauucc

SEQ ID NO: 4075327 - RNA, 23 nt, Vaccinia virus
uuaaacagaaauauaugagaugu

SEQ ID NO: 4075328 - RNA, 14 nt, Vaccinia virus
uuaaacauuguuca

SEQ ID NO: 4075329 - RNA, 16 nt, Vaccinia virus
uuaaacgaauaaaaga

SEQ ID NO: 4075330 - RNA, 22 nt, Vaccinia virus
uuaaacgaauuaaaauuauuua

SEQ ID NO: 4075331 - RNA, 19 nt, Vaccinia virus
uuaaacgauggauuuucca

SEQ ID NO: 4075332 - RNA, 17 nt, Vaccinia virus
uuaaacuguuuauuaau

SEQ ID NO: 4075333 - RNA, 19 nt, Vaccinia virus
uuaaacuucgcaauauuca

SEQ ID NO: 4075334 - RNA, 14 nt, Vaccinia virus
uuaaagaauguaua

SEQ ID NO: 4075335 - RNA, 21 nt, Vaccinia virus
uuaaagaugacaauauuauua

SEQ ID NO: 4075336 - RNA, 14 nt, Vaccinia virus
uuaaagauggagua

SEQ ID NO: 4075337 - RNA, 22 nt, Vaccinia virus
uuaaagcccauugaugcaaaua

SEQ ID NO: 4075338 - RNA, 15 nt, Vaccinia virus
uuaaaguauaucuua

SEQ ID NO: 4075339 - RNA, 14 nt, Vaccinia virus
uuaaaguuaaucau

SEQ ID NO: 4075340 - RNA, 15 nt, Vaccinia virus
uuaaaguuacaaaca

SEQ ID NO: 4075341 - RNA, 15 nt, Vaccinia virus
uuaaauaucugugaa

SEQ ID NO: 4075342 - RNA, 12 nt, Vaccinia virus
uuaaauauuaau

SEQ ID NO: 4075343 - RNA, 13 nt, Vaccinia virus
uuaaaucauuaaa

SEQ ID NO: 4075344 - RNA, 19 nt, Vaccinia virus
uuaaaucauuacuaauacu

SEQ ID NO: 4075345 - RNA, 18 nt, Vaccinia virus
uuaaauccaaacaucacu

SEQ ID NO: 4075346 - RNA, 17 nt, Vaccinia virus
uuaaauccuuguuugau

SEQ ID NO: 4075347 - RNA, 16 nt, Vaccinia virus
uuaaaugccuuauucu

SEQ ID NO: 4075348 - RNA, 21 nt, Vaccinia virus
uuaaaugccuuccaaaguuua

SEQ ID NO: 4075349 - RNA, 18 nt, Vaccinia virus
uuaaaugggucuaguuuu

SEQ ID NO: 4075350 - RNA, 13 nt, Vaccinia virus
uuaaauguuuucu

SEQ ID NO: 4075351 - RNA, 20 nt, Vaccinia virus
uuaaauuauccgcacaugca

SEQ ID NO: 4075352 - RNA, 16 nt, Vaccinia virus
uuaaauuauuauuaau

SEQ ID NO: 4075353 - RNA, 17 nt, Vaccinia virus
uuaaauuauuuaguuuu

SEQ ID NO: 4075354 - RNA, 23 nt, Vaccinia virus
uuaaauuuagagauaauauccug

SEQ ID NO: 4075355 - RNA, 19 nt, Vaccinia virus
uuaaauuucaguuuauguu

SEQ ID NO: 4075356 - RNA, 18 nt, Vaccinia virus
uuaaauuuuucaucuguu

SEQ ID NO: 4075357 - RNA, 16 nt, Vaccinia virus
uuaacaaaguuauuca

SEQ ID NO: 4075358 - RNA, 23 nt, Vaccinia virus
uuaacaaauucugcaauaucuuc

SEQ ID NO: 4075359 - RNA, 21 nt, Vaccinia virus
uuaacaauugucuguaaacca

SEQ ID NO: 4075360 - RNA, 15 nt, Vaccinia virus
uuaacacucauaaau

SEQ ID NO: 4075361 - RNA, 14 nt, Vaccinia virus
uuaacagauaaaaa

SEQ ID NO: 4075362 - RNA, 16 nt, Vaccinia virus
uuaacagauucacaaa

SEQ ID NO: 4075363 - RNA, 14 nt, Vaccinia virus
uuaacaucacuaau

SEQ ID NO: 4075364 - RNA, 17 nt, Vaccinia virus
uuaacaucuauuaauca

SEQ ID NO: 4075365 - RNA, 18 nt, Vaccinia virus
uuaacaucuauuaaucau

SEQ ID NO: 4075366 - RNA, 18 nt, Vaccinia virus
uuaacauuauuauauucu

SEQ ID NO: 4075367 - RNA, 17 nt, Vaccinia virus
uuaaccaacugauuaau

SEQ ID NO: 4075368 - RNA, 15 nt, Vaccinia virus
uuaaccuaacuaaaa

SEQ ID NO: 4075369 - RNA, 17 nt, Vaccinia virus
uuaacgaggacuuauuc

SEQ ID NO: 4075370 - RNA, 15 nt, Vaccinia virus
uugaucagaaugaau

SEQ ID NO: 4075371 - RNA, 18 nt, Vaccinia virus
uugaucaugcuguaauca

SEQ ID NO: 4075372 - RNA, 15 nt, Vaccinia virus
uugaucauguagaaa

SEQ ID NO: 4075373 - RNA, 15 nt, Vaccinia virus
uugaucuauguaguu

SEQ ID NO: 4075374 - RNA, 21 nt, Vaccinia virus
uugaugacgucaaacaauguu

SEQ ID NO: 4075375 - RNA, 21 nt, Vaccinia virus
uugauguaguacuuugaugau

SEQ ID NO: 4075376 - RNA, 12 nt, Vaccinia virus
uugauuuuggaa

SEQ ID NO: 4075377 - RNA, 20 nt, Vaccinia virus
uugcacaauccaaacuuuuu

SEQ ID NO: 4075378 - RNA, 15 nt, Vaccinia virus
uugcauccggaugau

SEQ ID NO: 4075379 - RNA, 14 nt, Vaccinia virus
uugcauuauagaau

SEQ ID NO: 4075380 - RNA, 22 nt, Vaccinia virus
uugccuccggagucauaaaagg

SEQ ID NO: 4075381 - RNA, 16 nt, Vaccinia virus
uugcgaaaugcucuaa

SEQ ID NO: 4075382 - RNA, 15 nt, Vaccinia virus
uugcgauauacauaa

SEQ ID NO: 4075383 - RNA, 15 nt, Vaccinia virus
uugcggcauauauaa

SEQ ID NO: 4075384 - RNA, 17 nt, Vaccinia virus
uugcguuucacaaacac

SEQ ID NO: 4075385 - RNA, 23 nt, Vaccinia virus
uuggaggcgaugaucuuaauuuu

SEQ ID NO: 4075386 - RNA, 14 nt, Vaccinia virus
uuggauauguggaa

SEQ ID NO: 4075387 - RNA, 14 nt, Vaccinia virus
uuggcaaauuauuu

SEQ ID NO: 4075388 - RNA, 14 nt, Vaccinia virus
uuggcuacauuuaa

SEQ ID NO: 4075389 - RNA, 17 nt, Vaccinia virus
uugguacagucuaguau

SEQ ID NO: 4075390 - RNA, 21 nt, Vaccinia virus
uuggucagaaauauuguauug

SEQ ID NO: 4075391 - RNA, 16 nt, Vaccinia virus
uugguggaauagauga

SEQ ID NO: 4075392 - RNA, 23 nt, Vaccinia virus
uugguguaauaaaaaaauuauuu

SEQ ID NO: 4075393 - RNA, 12 nt, Vaccinia virus
uugguuguauug

SEQ ID NO: 4075394 - RNA, 18 nt, Vaccinia virus
uuguaaagaaauuauuuu

SEQ ID NO: 4075395 - RNA, 12 nt, Vaccinia virus
uuguaaaugaca

SEQ ID NO: 4075396 - RNA, 15 nt, Vaccinia virus
uuguaagguuguaaa

SEQ ID NO: 4075397 - RNA, 12 nt, Vaccinia virus
uuguacaaaugg

SEQ ID NO: 4075398 - RNA, 22 nt, Vaccinia virus
uuguacacuucuauaguaucua

SEQ ID NO: 4075399 - RNA, 15 nt, Vaccinia virus
uuguacauguaauga

SEQ ID NO: 4075400 - RNA, 13 nt, Vaccinia virus
uuguacauuauua

SEQ ID NO: 4075401 - RNA, 17 nt, Vaccinia virus
uuguacuaucuagagau

SEQ ID NO: 4075402 - RNA, 17 nt, Vaccinia virus
uuguauagaaacuguau

SEQ ID NO: 4075403 - RNA, 16 nt, Vaccinia virus
uuguauauuuuauuuu

SEQ ID NO: 4075404 - RNA, 18 nt, Vaccinia virus
uuguaucaguuucagaau

SEQ ID NO: 4075405 - RNA, 17 nt, Vaccinia virus
uuguauccauacuguau

SEQ ID NO: 4075406 - RNA, 16 nt, Vaccinia virus
uuguauccuuaucuau

SEQ ID NO: 4075407 - RNA, 13 nt, Vaccinia virus
uuguauuauucug

SEQ ID NO: 4075408 - RNA, 16 nt, Vaccinia virus
uuguauuauucugaau

SEQ ID NO: 4075409 - RNA, 15 nt, Vaccinia virus
uuguccggcauauca

SEQ ID NO: 4075410 - RNA, 20 nt, Vaccinia virus
uugucgcuuauauugaugau

SEQ ID NO: 4075411 - RNA, 15 nt, Vaccinia virus
uugucuagaauauca

SEQ ID NO: 4075412 - RNA, 19 nt, Vaccinia virus
uugucucauggccguguau

SEQ ID NO: 4075413 - RNA, 16 nt, Vaccinia virus
uugugcuuaauuauuu

SEQ ID NO: 4075414 - RNA, 17 nt, Vaccinia virus
uugugggcaacugucua

SEQ ID NO: 4075415 - RNA, 19 nt, Vaccinia virus
uuguuaacgggcucguaaa

SEQ ID NO: 4075416 - RNA, 20 nt, Vaccinia virus
uuguucuauguaucuaaaau

SEQ ID NO: 4075417 - RNA, 23 nt, Vaccinia virus
uuguuuagcuauucguaacaaaa

SEQ ID NO: 4075418 - RNA, 14 nt, Vaccinia virus
uuguuuauauuaaa

SEQ ID NO: 4075419 - RNA, 16 nt, Vaccinia virus
uuuaaaaaguuaucuu

SEQ ID NO: 4075420 - RNA, 22 nt, Vaccinia virus
uuuaaacaagacggauauacag

SEQ ID NO: 4075421 - RNA, 22 nt, Vaccinia virus
uuuaaacuguccuauaaccucu

SEQ ID NO: 4075422 - RNA, 21 nt, Vaccinia virus
uuuaacgaggacuuauucaga

SEQ ID NO: 4075423 - RNA, 16 nt, Vaccinia virus
uuuaacgccuuccauu

SEQ ID NO: 4075424 - RNA, 21 nt, Vaccinia virus
uuuaacuucauccguuuccuu

SEQ ID NO: 4075425 - RNA, 22 nt, Vaccinia virus
uuuaagagaucaaagcaucaaa

SEQ ID NO: 4075426 - RNA, 14 nt, Vaccinia virus
uuuaagcuaguuau

SEQ ID NO: 4075427 - RNA, 16 nt, Vaccinia virus
uuuaauacuuauucau

SEQ ID NO: 4075428 - RNA, 20 nt, Vaccinia virus
uuuaauccgaauuucaaaau

SEQ ID NO: 4075429 - RNA, 16 nt, Vaccinia virus
uuuaaugugaaaucgu

SEQ ID NO: 4075430 - RNA, 17 nt, Vaccinia virus
uuuaauuggacagauau

SEQ ID NO: 4075431 - RNA, 19 nt, Vaccinia virus
uuuacaacacuuuucuauu

SEQ ID NO: 4075432 - RNA, 23 nt, Vaccinia virus
uuuacaucgacgagauuauuauu

SEQ ID NO: 4075433 - RNA, 13 nt, Vaccinia virus
uuuacauuauuua

SEQ ID NO: 4075434 - RNA, 18 nt, Vaccinia virus
uuuaccgaacaggcauuu

SEQ ID NO: 4075435 - RNA, 23 nt, Vaccinia virus
uuuacgguauagccucuagauaa

SEQ ID NO: 4075436 - RNA, 16 nt, Vaccinia virus
uuuacguuauuaauca

SEQ ID NO: 4075437 - RNA, 22 nt, Vaccinia virus
uuuacuguauauacuuagauau

SEQ ID NO: 4075438 - RNA, 18 nt, Vaccinia virus
uuuacuuuuucaucuuua

SEQ ID NO: 4075439 - RNA, 14 nt, Vaccinia virus
uuuagaaaaacuuu

SEQ ID NO: 4075440 - RNA, 19 nt, Vaccinia virus
uuuagaaaaaugcuaauau

SEQ ID NO: 4075441 - RNA, 19 nt, Vaccinia virus
uuuagacagugguuucaug

SEQ ID NO: 4075442 - RNA, 17 nt, Vaccinia virus
uuuagacgcuuauuauu

SEQ ID NO: 4075443 - RNA, 23 nt, Vaccinia virus
uuuagaucauuaacucuagaaau

SEQ ID NO: 4075444 - RNA, 14 nt, Vaccinia virus
uuuagauuuauuuu

SEQ ID NO: 4075445 - RNA, 22 nt, Vaccinia virus
uuuagcagucuaacauuuuuaa

SEQ ID NO: 4075446 - RNA, 17 nt, Vaccinia virus
uuuaguaggacuaguau

SEQ ID NO: 4075447 - RNA, 14 nt, Vaccinia virus
uuuaguauaaacag

SEQ ID NO: 4075448 - RNA, 15 nt, Vaccinia virus
uuuauaaaaacuuuu

SEQ ID NO: 4075449 - RNA, 15 nt, Vaccinia virus
uuuauaacgaaguag

SEQ ID NO: 4075450 - RNA, 16 nt, Vaccinia virus
uuuauaccuuguaauu

SEQ ID NO: 4075451 - RNA, 11 nt, Vaccinia virus
uuuauacuguu

SEQ ID NO: 4075452 - RNA, 11 nt, Vaccinia virus
uuuauauacau

SEQ ID NO: 4075453 - RNA, 14 nt, Vaccinia virus
uuuauccaaaaaga

SEQ ID NO: 4075454 - RNA, 13 nt, Vaccinia virus
uuuauccaaugau

SEQ ID NO: 4075455 - RNA, 17 nt, Vaccinia virus
uuuauccuauuauguaa

SEQ ID NO: 4075456 - RNA, 20 nt, Vaccinia virus
uuuaucgaccaagacacaua

SEQ ID NO: 4075457 - RNA, 15 nt, Vaccinia virus
uuuaucuauucauaa

SEQ ID NO: 4075458 - RNA, 20 nt, Vaccinia virus
uuuaugaugccgguaaaugu

SEQ ID NO: 4075459 - RNA, 22 nt, Vaccinia virus
uuuauuaaugucaggaaaugua

SEQ ID NO: 4075460 - RNA, 20 nt, Vaccinia virus
uuuauuaucuauagccaauu

SEQ ID NO: 4075461 - RNA, 15 nt, Vaccinia virus
uuuauuccaaucauu

SEQ ID NO: 4075462 - RNA, 22 nt, Vaccinia virus
uuuauucgguaagacaaucauu

SEQ ID NO: 4075463 - RNA, 19 nt, Vaccinia virus
uuucacuacuaucuaugau

SEQ ID NO: 4075464 - RNA, 20 nt, Vaccinia virus
uuucagcguggauuucucau

SEQ ID NO: 4075465 - RNA, 18 nt, Vaccinia virus
uuucauccgaucauugau

SEQ ID NO: 4075466 - RNA, 17 nt, Vaccinia virus
uuucauggaacaauaaa

SEQ ID NO: 4075467 - RNA, 14 nt, Vaccinia virus
uuucauggauguag

SEQ ID NO: 4075468 - RNA, 17 nt, Vaccinia virus
uuucauucgucaaggau

SEQ ID NO: 4075469 - RNA, 22 nt, Vaccinia virus
uuuccaagugucaaauuccaaa

SEQ ID NO: 4075470 - RNA, 12 nt, Vaccinia virus
uuuccauaauaa

SEQ ID NO: 4075471 - RNA, 11 nt, Vaccinia virus
uuuccauccac

SEQ ID NO: 4075472 - RNA, 21 nt, Vaccinia virus
uuuccggagauagauuuccaa

SEQ ID NO: 4075473 - RNA, 14 nt, Vaccinia virus
uuuccuauauuauu

SEQ ID NO: 4075474 - RNA, 15 nt, Vaccinia virus
uuuccuuccaaugau

SEQ ID NO: 4075475 - RNA, 18 nt, Vaccinia virus
uuucgcaucguauuuuaa

SEQ ID NO: 4075476 - RNA, 14 nt, Vaccinia virus
uuucgcuauuucua

SEQ ID NO: 4075477 - RNA, 14 nt, Vaccinia virus
uuucguacaucucu

SEQ ID NO: 4075478 - RNA, 21 nt, Vaccinia virus
uuucuacaauaacuacauauu

SEQ ID NO: 4075479 - RNA, 12 nt, Vaccinia virus
uuucuacauaau

SEQ ID NO: 4075480 - RNA, 17 nt, Vaccinia virus
uuucuagccccugcgga

SEQ ID NO: 4075481 - RNA, 16 nt, Vaccinia virus
uuucuauauagcuauu

SEQ ID NO: 4075482 - RNA, 23 nt, Vaccinia virus
uuucugaugaaacauuuaaugau

SEQ ID NO: 4075483 - RNA, 18 nt, Vaccinia virus
uuucuuguuaucagauau

SEQ ID NO: 4075484 - RNA, 22 nt, Vaccinia virus
uuugaacaaugcacgaccuaua

SEQ ID NO: 4075485 - RNA, 14 nt, Vaccinia virus
uuugacuuacauaa

SEQ ID NO: 4075486 - RNA, 17 nt, Vaccinia virus
uuugagaauauauacag

SEQ ID NO: 4075487 - RNA, 14 nt, Vaccinia virus
uuugagagggaaaa

SEQ ID NO: 4075488 - RNA, 18 nt, Vaccinia virus
uuugauagggacaaagua

SEQ ID NO: 4075489 - RNA, 21 nt, Vaccinia virus
uuugauuaguauaacuagauu

SEQ ID NO: 4075490 - RNA, 12 nt, Vaccinia virus
uuugauucuauu

SEQ ID NO: 4075491 - RNA, 13 nt, Vaccinia virus
uuugauuucaauu

SEQ ID NO: 4075492 - RNA, 23 nt, Vaccinia virus
uuuggagaaaugagaaacuguuu

SEQ ID NO: 4075493 - RNA, 15 nt, Vaccinia virus
uuuggauuuggaaaa

SEQ ID NO: 4075494 - RNA, 16 nt, Vaccinia virus
aacaaguuaaugagau

SEQ ID NO: 4075495 - RNA, 13 nt, Vaccinia virus
aacaaguuuuuau

SEQ ID NO: 4075496 - RNA, 20 nt, Vaccinia virus
aacaauaucuuuaauacaga

SEQ ID NO: 4075497 - RNA, 22 nt, Vaccinia virus
aacaauaugguaauuuagagaa

SEQ ID NO: 4075498 - RNA, 12 nt, Vaccinia virus
aacaauauuaag

SEQ ID NO: 4075499 - RNA, 19 nt, Vaccinia virus
aacaaucacaagaacagag

SEQ ID NO: 4075500 - RNA, 13 nt, Vaccinia virus
aacaaucuagaca

SEQ ID NO: 4075501 - RNA, 12 nt, Vaccinia virus
aacaauguuucu

SEQ ID NO: 4075502 - RNA, 17 nt, Vaccinia virus
aacaauuucuauuuccu

SEQ ID NO: 4075503 - RNA, 19 nt, Vaccinia virus
aacacaagucuaauaaugu

SEQ ID NO: 4075504 - RNA, 14 nt, Vaccinia virus
aacacagaacagua

SEQ ID NO: 4075505 - RNA, 22 nt, Vaccinia virus
aacaccuugugcauuauguaaa

SEQ ID NO: 4075506 - RNA, 22 nt, Vaccinia virus
aacacgauuauuauaaaauaac

SEQ ID NO: 4075507 - RNA, 19 nt, Vaccinia virus
aacacgauuuaaaaucaaa

SEQ ID NO: 4075508 - RNA, 20 nt, Vaccinia virus
aacacugaagcuaacgauga

SEQ ID NO: 4075509 - RNA, 17 nt, Vaccinia virus
aacacuuuccugauuua

SEQ ID NO: 4075510 - RNA, 13 nt, Vaccinia virus
aacagaacagaua

SEQ ID NO: 4075511 - RNA, 23 nt, Vaccinia virus
aacagacuauuuaucagaacacu

SEQ ID NO: 4075512 - RNA, 23 nt, Vaccinia virus
aacagcuaucaaaauauguagaa

SEQ ID NO: 4075513 - RNA, 16 nt, Vaccinia virus
aacaggaugaauccau

SEQ ID NO: 4075514 - RNA, 19 nt, Vaccinia virus
aacaggguuuguugauucg

SEQ ID NO: 4075515 - RNA, 12 nt, Vaccinia virus
aacaguauuauu

SEQ ID NO: 4075516 - RNA, 14 nt, Vaccinia virus
aacauaaaaacugu

SEQ ID NO: 4075517 - RNA, 15 nt, Vaccinia virus
aacauaaguauauaa

SEQ ID NO: 4075518 - RNA, 22 nt, Vaccinia virus
aacauaauagucgaauacagua

SEQ ID NO: 4075519 - RNA, 22 nt, Vaccinia virus
aguauucguuuucuaauucuuu

SEQ ID NO: 4075520 - RNA, 18 nt, Vaccinia virus
aguauucuauuuuggaaa

SEQ ID NO: 4075521 - RNA, 15 nt, Vaccinia virus
aguauucuuauguau

SEQ ID NO: 4075522 - RNA, 18 nt, Vaccinia virus
aguauuguuuaguauuuu

SEQ ID NO: 4075523 - RNA, 20 nt, Vaccinia virus
aguauuuacaauguagaaau

SEQ ID NO: 4075524 - RNA, 20 nt, Vaccinia virus
aguauuugagaaauauguau

SEQ ID NO: 4075525 - RNA, 16 nt, Vaccinia virus
aguauuuuuaccuaau

SEQ ID NO: 4075526 - RNA, 22 nt, Vaccinia virus
aguauuuuuguguuaaaacaau

SEQ ID NO: 4075527 - RNA, 13 nt, Vaccinia virus
agucaaaaagaua

SEQ ID NO: 4075528 - RNA, 15 nt, Vaccinia virus
agucaaacauucaac

SEQ ID NO: 4075529 - RNA, 13 nt, Vaccinia virus
agucaacacuaug

SEQ ID NO: 4075530 - RNA, 15 nt, Vaccinia virus
agucaagucaaugau

SEQ ID NO: 4075531 - RNA, 21 nt, Vaccinia virus
agucaauugguagaguuuuau

SEQ ID NO: 4075532 - RNA, 13 nt, Vaccinia virus
agucacuauuuuu

SEQ ID NO: 4075533 - RNA, 22 nt, Vaccinia virus
agucauaaacuugggauguaaa

SEQ ID NO: 4075534 - RNA, 19 nt, Vaccinia virus
agucauaucuagaaugaag

SEQ ID NO: 4075535 - RNA, 21 nt, Vaccinia virus
agucaucuuauguuuuuaaga

SEQ ID NO: 4075536 - RNA, 21 nt, Vaccinia virus
agucaugcuuauugauaaaga

SEQ ID NO: 4075537 - RNA, 15 nt, Vaccinia virus
agucauguuaaaaau

SEQ ID NO: 4075538 - RNA, 18 nt, Vaccinia virus
agucauguuaaaaaugac

SEQ ID NO: 4075539 - RNA, 14 nt, Vaccinia virus
agucauuauauacu

SEQ ID NO: 4075540 - RNA, 17 nt, Vaccinia virus
agucauuucugaugaaa

SEQ ID NO: 4075541 - RNA, 12 nt, Vaccinia virus
aguccagaaaua

SEQ ID NO: 4075542 - RNA, 13 nt, Vaccinia virus
aguccgcauuaug

SEQ ID NO: 4075543 - RNA, 19 nt, Vaccinia virus
aguccuaguuguauacuga

SEQ ID NO: 4075544 - RNA, 21 nt, Vaccinia virus
aguccuauauauuugaaaauc

SEQ ID NO: 4075545 - RNA, 13 nt, Vaccinia virus
agucgucaagcau

SEQ ID NO: 4075546 - RNA, 14 nt, Vaccinia virus
agucucucuccaua

SEQ ID NO: 4075547 - RNA, 15 nt, Vaccinia virus
agucugagaaaaugu

SEQ ID NO: 4075548 - RNA, 13 nt, Vaccinia virus
agucuuacacauu

SEQ ID NO: 4075549 - RNA, 20 nt, Vaccinia virus
agucuuuaaugaauuaacga

SEQ ID NO: 4075550 - RNA, 15 nt, Vaccinia virus
agugaaauaagcuuu

SEQ ID NO: 4075551 - RNA, 18 nt, Vaccinia virus
agugauagagguaaacuu

SEQ ID NO: 4075552 - RNA, 20 nt, Vaccinia virus
agugcaggcuuaaagcaauu

SEQ ID NO: 4075553 - RNA, 15 nt, Vaccinia virus
agugccaucagaaua

SEQ ID NO: 4075554 - RNA, 20 nt, Vaccinia virus
agugcggagucaacaaugaa

SEQ ID NO: 4075555 - RNA, 17 nt, Vaccinia virus
aguggaagucauuugac

SEQ ID NO: 4075556 - RNA, 22 nt, Vaccinia virus
agugggaugaaauccuauuuua

SEQ ID NO: 4075557 - RNA, 18 nt, Vaccinia virus
aguguaccaauaugugaa

SEQ ID NO: 4075558 - RNA, 23 nt, Vaccinia virus
aguguagugagagagcaugaagg

SEQ ID NO: 4075559 - RNA, 17 nt, Vaccinia virus
aguuaaaaguuaaugag

SEQ ID NO: 4075560 - RNA, 20 nt, Vaccinia virus
aguuaaacugugaaugucaa

SEQ ID NO: 4075561 - RNA, 17 nt, Vaccinia virus
aguuaacacaugucaca

SEQ ID NO: 4075562 - RNA, 13 nt, Vaccinia virus
aguuaauagcuuc

SEQ ID NO: 4075563 - RNA, 15 nt, Vaccinia virus
aucuguauaauaaga

SEQ ID NO: 4075564 - RNA, 14 nt, Vaccinia virus
aucuguauuaccga

SEQ ID NO: 4075565 - RNA, 21 nt, Vaccinia virus
aucugugguauucuugucauu

SEQ ID NO: 4075566 - RNA, 16 nt, Vaccinia virus
aucuguuuccuauaau

SEQ ID NO: 4075567 - RNA, 13 nt, Vaccinia virus
aucuuaaucgagu

SEQ ID NO: 4075568 - RNA, 20 nt, Vaccinia virus
aucuuagacauuuuuagaga

SEQ ID NO: 4075569 - RNA, 16 nt, Vaccinia virus
aucuuagcgaacugaa

SEQ ID NO: 4075570 - RNA, 17 nt, Vaccinia virus
aucuuagcgaacugaag

SEQ ID NO: 4075571 - RNA, 21 nt, Vaccinia virus
aucuuaggcauggacauacua

SEQ ID NO: 4075572 - RNA, 20 nt, Vaccinia virus
aucuuauucugguuuaaaaa

SEQ ID NO: 4075573 - RNA, 21 nt, Vaccinia virus
aucuucaagagugcauugacu

SEQ ID NO: 4075574 - RNA, 23 nt, Vaccinia virus
aucuucacaaauuauaucauugu

SEQ ID NO: 4075575 - RNA, 22 nt, Vaccinia virus
aucuucauccaguagacgacau

SEQ ID NO: 4075576 - RNA, 16 nt, Vaccinia virus
aucuucauuaucugau

SEQ ID NO: 4075577 - RNA, 16 nt, Vaccinia virus
aucuucgucuauuaca

SEQ ID NO: 4075578 - RNA, 14 nt, Vaccinia virus
aucuugauuaauaa

SEQ ID NO: 4075579 - RNA, 20 nt, Vaccinia virus
aucuugguuauauuauuaga

SEQ ID NO: 4075580 - RNA, 19 nt, Vaccinia virus
aucuugugaacuagacaua

SEQ ID NO: 4075581 - RNA, 20 nt, Vaccinia virus
aucuuguuauaauuauaaua

SEQ ID NO: 4075582 - RNA, 18 nt, Vaccinia virus
aucuuguucagaaauaua

SEQ ID NO: 4075583 - RNA, 21 nt, Vaccinia virus
aucuuuauaagagcuacuaac

SEQ ID NO: 4075584 - RNA, 17 nt, Vaccinia virus
aucuuuucacuaaauaa

SEQ ID NO: 4075585 - RNA, 16 nt, Vaccinia virus
aucuuuucuguacuca

SEQ ID NO: 4075586 - RNA, 16 nt, Vaccinia virus
aucuuuugaaaauaua

SEQ ID NO: 4075587 - RNA, 14 nt, Vaccinia virus
augaaaaaaaacac

SEQ ID NO: 4075588 - RNA, 15 nt, Vaccinia virus
augaaaaaaauacuu

SEQ ID NO: 4075589 - RNA, 12 nt, Vaccinia virus
augaaaaugaug

SEQ ID NO: 4075590 - RNA, 16 nt, Vaccinia virus
augaaaccauacuaau

SEQ ID NO: 4075591 - RNA, 17 nt, Vaccinia virus
augaaacgaacacuauu

SEQ ID NO: 4075592 - RNA, 19 nt, Vaccinia virus
augaacaaacgugggaaga

SEQ ID NO: 4075593 - RNA, 13 nt, Vaccinia virus
augaacaaauccu

SEQ ID NO: 4075594 - RNA, 21 nt, Vaccinia virus
augaacgcgauguuucuguaa

SEQ ID NO: 4075595 - RNA, 13 nt, Vaccinia virus
augaagaaagaaa

SEQ ID NO: 4075596 - RNA, 14 nt, Vaccinia virus
augaagaaagaaaa

SEQ ID NO: 4075597 - RNA, 16 nt, Vaccinia virus
augaagaauggaugau

SEQ ID NO: 4075598 - RNA, 21 nt, Vaccinia virus
augaagggaucguuaaugaac

SEQ ID NO: 4075599 - RNA, 23 nt, Vaccinia virus
augaauggaugguuuauguagac

SEQ ID NO: 4075600 - RNA, 21 nt, Vaccinia virus
augaauuacuaaaauauacaa

SEQ ID NO: 4075601 - RNA, 13 nt, Vaccinia virus
augaauuagagaa

SEQ ID NO: 4075602 - RNA, 17 nt, Vaccinia virus
augaauuagagaauuac

SEQ ID NO: 4075603 - RNA, 22 nt, Vaccinia virus
augacaucgccuacaaaugaca

SEQ ID NO: 4075604 - RNA, 16 nt, Vaccinia virus
augacauggaaauauc

SEQ ID NO: 4075605 - RNA, 15 nt, Vaccinia virus
augacauuuauucau

SEQ ID NO: 4075606 - RNA, 13 nt, Vaccinia virus
augacauuuuccu

SEQ ID NO: 4075607 - RNA, 17 nt, Vaccinia virus
augaccauuaaaauaaa

SEQ ID NO: 4075608 - RNA, 14 nt, Vaccinia virus
augagggaaaagau

SEQ ID NO: 4075609 - RNA, 15 nt, Vaccinia virus
augaguaaaacggaa

SEQ ID NO: 4075610 - RNA, 14 nt, Vaccinia virus
augaguauauguau

SEQ ID NO: 4075611 - RNA, 14 nt, Vaccinia virus
augaguuaauguau

SEQ ID NO: 4075612 - RNA, 14 nt, Vaccinia virus
augaguuagauuac

SEQ ID NO: 4075613 - RNA, 15 nt, Vaccinia virus
augauaaaaacauuu

SEQ ID NO: 4075614 - RNA, 18 nt, Vaccinia virus
augauaacuucaggaaau

SEQ ID NO: 4075615 - RNA, 13 nt, Vaccinia virus
augauaauaggaa

SEQ ID NO: 4075616 - RNA, 16 nt, Vaccinia virus
augauacauuaaguaa

SEQ ID NO: 4075617 - RNA, 19 nt, Vaccinia virus
augauauauuaaacaagga

SEQ ID NO: 4075618 - RNA, 19 nt, Vaccinia virus
augauaucuucacguagau

SEQ ID NO: 4075619 - RNA, 13 nt, Vaccinia virus
augauauggaugu

SEQ ID NO: 4075620 - RNA, 21 nt, Vaccinia virus
augauauugcgcauaauuucc

SEQ ID NO: 4075621 - RNA, 14 nt, Vaccinia virus
augaucaaaaagag

SEQ ID NO: 4075622 - RNA, 18 nt, Vaccinia virus
augauccuauucuaaaug

SEQ ID NO: 4075623 - RNA, 19 nt, Vaccinia virus
augaucgucuuuuguggaa

SEQ ID NO: 4075624 - RNA, 22 nt, Vaccinia virus
augaucucgauauuucaaucau

SEQ ID NO: 4075625 - RNA, 14 nt, Vaccinia virus
augaucuggaucau

SEQ ID NO: 4075626 - RNA, 20 nt, Vaccinia virus
augaucugucuuauaugaag

SEQ ID NO: 4075627 - RNA, 13 nt, Vaccinia virus
augaucuuaauuu

SEQ ID NO: 4075628 - RNA, 20 nt, Vaccinia virus
augaugaaacacaagaucaa

SEQ ID NO: 4075629 - RNA, 17 nt, Vaccinia virus
augaugaaauggauaau

SEQ ID NO: 4075630 - RNA, 20 nt, Vaccinia virus
augaugccgguaaauguuuu

SEQ ID NO: 4075631 - RNA, 15 nt, Vaccinia virus
augauuaucaaacac

SEQ ID NO: 4075632 - RNA, 21 nt, Vaccinia virus
augauucacaauuuacauguu

SEQ ID NO: 4075633 - RNA, 16 nt, Vaccinia virus
augauucuaacgacau

SEQ ID NO: 4075634 - RNA, 16 nt, Vaccinia virus
augauugggaaccagu

SEQ ID NO: 4075635 - RNA, 13 nt, Vaccinia virus
augauuuauaaug

SEQ ID NO: 4075636 - RNA, 22 nt, Vaccinia virus
augauuuggcuagauucaacau

SEQ ID NO: 4075637 - RNA, 22 nt, Vaccinia virus
augauuuuacugcaauauguau

SEQ ID NO: 4075638 - RNA, 22 nt, Vaccinia virus
augauuuuccuucuaaaguaag

SEQ ID NO: 4075639 - RNA, 22 nt, Vaccinia virus
augauuuugaaccguauuacuc

SEQ ID NO: 4075640 - RNA, 14 nt, Vaccinia virus
augcaaaaaugcua

SEQ ID NO: 4075641 - RNA, 13 nt, Vaccinia virus
augcaccauccga

SEQ ID NO: 4075642 - RNA, 16 nt, Vaccinia virus
augcaccgaacaucca

SEQ ID NO: 4075643 - RNA, 16 nt, Vaccinia virus
augcacuaacgagaaa

SEQ ID NO: 4075644 - RNA, 19 nt, Vaccinia virus
augcaucuauauaaucuuu

SEQ ID NO: 4075645 - RNA, 14 nt, Vaccinia virus
auguaaaaauguua

SEQ ID NO: 4075646 - RNA, 13 nt, Vaccinia virus
auguaaaacauuu

SEQ ID NO: 4075647 - RNA, 13 nt, Vaccinia virus
auguaaaauaaua

SEQ ID NO: 4075648 - RNA, 13 nt, Vaccinia virus
auguaaaauacuu

SEQ ID NO: 4075649 - RNA, 14 nt, Vaccinia virus
auguaaagaaggag

SEQ ID NO: 4075650 - RNA, 12 nt, Vaccinia virus
auguaaaugaua

SEQ ID NO: 4075651 - RNA, 21 nt, Vaccinia virus
auguaaguaguuuaucaacau

SEQ ID NO: 4075652 - RNA, 13 nt, Vaccinia virus
auguauacaaaug

SEQ ID NO: 4075653 - RNA, 16 nt, Vaccinia virus
auguauagaacaacga

SEQ ID NO: 4075654 - RNA, 14 nt, Vaccinia virus
auguauauaucacu

SEQ ID NO: 4075655 - RNA, 13 nt, Vaccinia virus
auguauauguuug

SEQ ID NO: 4075656 - RNA, 19 nt, Vaccinia virus
auguaucaaagauauagau

SEQ ID NO: 4075657 - RNA, 17 nt, Vaccinia virus
auguauggcuucaagau

SEQ ID NO: 4075658 - RNA, 13 nt, Vaccinia virus
auguauguuuaaa

SEQ ID NO: 4075659 - RNA, 19 nt, Vaccinia virus
auguauuguuuaguuacuc

SEQ ID NO: 4075660 - RNA, 19 nt, Vaccinia virus
auguauuuccuagcacauc

SEQ ID NO: 4075661 - RNA, 15 nt, Vaccinia virus
augucaaaaaaagau

SEQ ID NO: 4075662 - RNA, 22 nt, Vaccinia virus
augucauaaacuguaaaugauu

SEQ ID NO: 4075663 - RNA, 17 nt, Vaccinia virus
augucaucgaaauggua

SEQ ID NO: 4075664 - RNA, 22 nt, Vaccinia virus
auguccaaaucuaguuguggaa

SEQ ID NO: 4075665 - RNA, 20 nt, Vaccinia virus
auguccggaaugaagagaag

SEQ ID NO: 4075666 - RNA, 19 nt, Vaccinia virus
augucuaaaaacagaaaua

SEQ ID NO: 4075667 - RNA, 21 nt, Vaccinia virus
augucuaauggcgaacauguu

SEQ ID NO: 4075668 - RNA, 21 nt, Vaccinia virus
augucucgcauaaacauuacu

SEQ ID NO: 4075669 - RNA, 21 nt, Vaccinia virus
augucugacaccuaaaaagaa

SEQ ID NO: 4075670 - RNA, 19 nt, Vaccinia virus
augugagagagaaauacuu

SEQ ID NO: 4075671 - RNA, 22 nt, Vaccinia virus
augugagcaaagauuguucucu

SEQ ID NO: 4075672 - RNA, 16 nt, Vaccinia virus
augugaguauuggauu

SEQ ID NO: 4075673 - RNA, 16 nt, Vaccinia virus
augugcuaaaaucacu

SEQ ID NO: 4075674 - RNA, 22 nt, Vaccinia virus
augugcuaaaaucacugaacau

SEQ ID NO: 4075675 - RNA, 22 nt, Vaccinia virus
auguguauuaucagauauccaa

SEQ ID NO: 4075676 - RNA, 22 nt, Vaccinia virus
auguguguccggaguuagaaag

SEQ ID NO: 4075677 - RNA, 18 nt, Vaccinia virus
auguguuuuagaauauau

SEQ ID NO: 4075678 - RNA, 16 nt, Vaccinia virus
auguuaaauguuuuac

SEQ ID NO: 4075679 - RNA, 22 nt, Vaccinia virus
auguuacagaauauaaauuaua

SEQ ID NO: 4075680 - RNA, 22 nt, Vaccinia virus
auguucgugguguuaugaaaca

SEQ ID NO: 4075681 - RNA, 19 nt, Vaccinia virus
auguucugauuuuaucuuu

SEQ ID NO: 4075682 - RNA, 22 nt, Vaccinia virus
auguucuuaaucaauguacaua

SEQ ID NO: 4075683 - RNA, 21 nt, Vaccinia virus
auguucuucgcagaugaugau

SEQ ID NO: 4075684 - RNA, 18 nt, Vaccinia virus
auguucuuuuugugugaa

SEQ ID NO: 4075685 - RNA, 14 nt, Vaccinia virus
auguugacauguau

SEQ ID NO: 4075686 - RNA, 23 nt, Vaccinia virus
auguuggauuaaucuuuaccaua

SEQ ID NO: 4075687 - RNA, 15 nt, Vaccinia virus
auguuguuuuauaua

SEQ ID NO: 4075688 - RNA, 15 nt, Vaccinia virus
auguuuaaugauacg

SEQ ID NO: 4075689 - RNA, 14 nt, Vaccinia virus
auguuuauagaugu

SEQ ID NO: 4075690 - RNA, 13 nt, Vaccinia virus
auguuuaucacac

SEQ ID NO: 4075691 - RNA, 19 nt, Vaccinia virus
auguuucuuuaaaagucaa

SEQ ID NO: 4075692 - RNA, 16 nt, Vaccinia virus
auguuuggagaaauga

SEQ ID NO: 4075693 - RNA, 17 nt, Vaccinia virus
auguuugucauauguau

SEQ ID NO: 4075694 - RNA, 16 nt, Vaccinia virus
auguuuuaaauaucaa

SEQ ID NO: 4075695 - RNA, 21 nt, Vaccinia virus
auguuuuuagauuuuagcaua

SEQ ID NO: 4075696 - RNA, 20 nt, Vaccinia virus
auuaaaaaauucgacaauga

SEQ ID NO: 4075697 - RNA, 15 nt, Vaccinia virus
auuaaaaauuuccau

SEQ ID NO: 4075698 - RNA, 20 nt, Vaccinia virus
auuaaacaagugauacguaa

SEQ ID NO: 4075699 - RNA, 15 nt, Vaccinia virus
auuaaacguauucau

SEQ ID NO: 4075700 - RNA, 19 nt, Vaccinia virus
auuaaacguggauaaaaug

SEQ ID NO: 4075701 - RNA, 15 nt, Vaccinia virus
auuaaacuaauucau

SEQ ID NO: 4075702 - RNA, 21 nt, Vaccinia virus
auuaaacuaauucauuuucaa

SEQ ID NO: 4075703 - RNA, 23 nt, Vaccinia virus
auuaaagagauaguuuuuuucau

SEQ ID NO: 4075704 - RNA, 19 nt, Vaccinia virus
auuaaauagaauauuuaac

SEQ ID NO: 4075705 - RNA, 13 nt, Vaccinia virus
auuaaaucaauau

SEQ ID NO: 4075706 - RNA, 23 nt, Vaccinia virus
auuaaaucauugacugcuagaga

SEQ ID NO: 4075707 - RNA, 18 nt, Vaccinia virus
auuaaaugaugaaacuaa

SEQ ID NO: 4075708 - RNA, 18 nt, Vaccinia virus
auuaaaugcgucaaucau

SEQ ID NO: 4075709 - RNA, 19 nt, Vaccinia virus
auuaacaaaagugaauaua

SEQ ID NO: 4075710 - RNA, 22 nt, Vaccinia virus
auuaacgauaucuugcaaaaua

SEQ ID NO: 4075711 - RNA, 16 nt, Vaccinia virus
auuaacgguaauacau

SEQ ID NO: 4075712 - RNA, 22 nt, Vaccinia virus
auuaacuacuugaaauucucca

SEQ ID NO: 4075713 - RNA, 15 nt, Vaccinia virus
auuaacugaggauga

SEQ ID NO: 4075714 - RNA, 16 nt, Vaccinia virus
auuaacuuuguucauu

SEQ ID NO: 4075715 - RNA, 21 nt, Vaccinia virus
auuaaguucuggcaauguuuc

SEQ ID NO: 4075716 - RNA, 13 nt, Vaccinia virus
auuaauaauaauu

SEQ ID NO: 4075717 - RNA, 13 nt, Vaccinia virus
auuaauaauuaau

SEQ ID NO: 4075718 - RNA, 19 nt, Vaccinia virus
auuaauacacauaaugaag

SEQ ID NO: 4075719 - RNA, 21 nt, Vaccinia virus
auuaauacaggaucuagcaaa

SEQ ID NO: 4075720 - RNA, 13 nt, Vaccinia virus
auuaauacauauu

SEQ ID NO: 4075721 - RNA, 13 nt, Vaccinia virus
auuaauacauuua

SEQ ID NO: 4075722 - RNA, 22 nt, Vaccinia virus
auuaauauaguuauuaaugaug

SEQ ID NO: 4075723 - RNA, 19 nt, Vaccinia virus
auuaauguggaauauagau

SEQ ID NO: 4075724 - RNA, 10 nt, Vaccinia virus
auuaauuaaa

SEQ ID NO: 4075725 - RNA, 14 nt, Vaccinia virus
auuaauuaaccauu

SEQ ID NO: 4075726 - RNA, 13 nt, Vaccinia virus
auuacaacauaau

SEQ ID NO: 4075727 - RNA, 22 nt, Vaccinia virus
auuacaagacuacaaagaaugu

SEQ ID NO: 4075728 - RNA, 21 nt, Vaccinia virus
auuacacuacauuuuuaucau

SEQ ID NO: 4075729 - RNA, 16 nt, Vaccinia virus
auuacauacuuaaaaa

SEQ ID NO: 4075730 - RNA, 16 nt, Vaccinia virus
auuacauuuuaucaga

SEQ ID NO: 4075731 - RNA, 22 nt, Vaccinia virus
auuacauuuuuuauaaauagau

SEQ ID NO: 4075732 - RNA, 23 nt, Vaccinia virus
auuaccauagaagauguuagaaa

SEQ ID NO: 4075733 - RNA, 20 nt, Vaccinia virus
auuaccggucauauuaauaa

SEQ ID NO: 4075734 - RNA, 14 nt, Vaccinia virus
aagacauaaaacuc

SEQ ID NO: 4075735 - RNA, 16 nt, Vaccinia virus
aagacauaaaacucau

SEQ ID NO: 4075736 - RNA, 19 nt, Vaccinia virus
aagacaugauaauauuaaa

SEQ ID NO: 4075737 - RNA, 22 nt, Vaccinia virus
aagacauuccuaugaugaugca

SEQ ID NO: 4075738 - RNA, 19 nt, Vaccinia virus
aagacgguaacuaaauguu

SEQ ID NO: 4075739 - RNA, 20 nt, Vaccinia virus
aagacgguaacuaaauguuc

SEQ ID NO: 4075740 - RNA, 18 nt, Vaccinia virus
aagacuaucggacucuuc

SEQ ID NO: 4075741 - RNA, 18 nt, Vaccinia virus
aagagacuacaauauauu

SEQ ID NO: 4075742 - RNA, 20 nt, Vaccinia virus
aagagauuucaacagacugu

SEQ ID NO: 4075743 - RNA, 13 nt, Vaccinia virus
aagaguauuguac

SEQ ID NO: 4075744 - RNA, 20 nt, Vaccinia virus
aagaguggaaacucacauau

SEQ ID NO: 4075745 - RNA, 20 nt, Vaccinia virus
aagaguuaaugaauaucauu

SEQ ID NO: 4075746 - RNA, 22 nt, Vaccinia virus
aagaguuucaaaaauauucauu

SEQ ID NO: 4075747 - RNA, 15 nt, Vaccinia virus
aagauaaaagaauuc

SEQ ID NO: 4075748 - RNA, 20 nt, Vaccinia virus
aagauacuccuucaugaaca

SEQ ID NO: 4075749 - RNA, 19 nt, Vaccinia virus
aagauaguugucaguucau

SEQ ID NO: 4075750 - RNA, 17 nt, Vaccinia virus
caaaauccuauauugua

SEQ ID NO: 4075751 - RNA, 18 nt, Vaccinia virus
caaaaucguuaagaaguu

SEQ ID NO: 4075752 - RNA, 21 nt, Vaccinia virus
caaaaucguuccgccaaauuu

SEQ ID NO: 4075753 - RNA, 16 nt, Vaccinia virus
caaaaugauagauauu

SEQ ID NO: 4075754 - RNA, 16 nt, Vaccinia virus
caaaaugauauacagu

SEQ ID NO: 4075755 - RNA, 16 nt, Vaccinia virus
caaaaugcaagcaucu

SEQ ID NO: 4075756 - RNA, 12 nt, Vaccinia virus
caaaauguuuga

SEQ ID NO: 4075757 - RNA, 23 nt, Vaccinia virus
caaaauuaacagauaaaaagacu

SEQ ID NO: 4075758 - RNA, 12 nt, Vaccinia virus
caaaauuacaau

SEQ ID NO: 4075759 - RNA, 22 nt, Vaccinia virus
caaaauuggaaggauauacaaa

SEQ ID NO: 4075760 - RNA, 21 nt, Vaccinia virus
caaacaauccaaaaaaugaaa

SEQ ID NO: 4075761 - RNA, 23 nt, Vaccinia virus
caaacaucacucuucgaaaagaa

SEQ ID NO: 4075762 - RNA, 14 nt, Vaccinia virus
caaacauccucuau

SEQ ID NO: 4075763 - RNA, 16 nt, Vaccinia virus
caaacauucuuucaaa

SEQ ID NO: 4075764 - RNA, 11 nt, Vaccinia virus
caaacauuuaa

SEQ ID NO: 4075765 - RNA, 22 nt, Vaccinia virus
caaacgugaguauuuuacucau

SEQ ID NO: 4075766 - RNA, 14 nt, Vaccinia virus
caaacgugggaaga

SEQ ID NO: 4075767 - RNA, 14 nt, Vaccinia virus
caaacugcugaagu

SEQ ID NO: 4075768 - RNA, 15 nt, Vaccinia virus
caaacuuaacagcuc

SEQ ID NO: 4075769 - RNA, 14 nt, Vaccinia virus
caaagaaaugagua

SEQ ID NO: 4075770 - RNA, 22 nt, Vaccinia virus
caaagaauccgacaucaaaugg

SEQ ID NO: 4075771 - RNA, 16 nt, Vaccinia virus
caaagauaaaaaccac

SEQ ID NO: 4075772 - RNA, 16 nt, Vaccinia virus
caaagauggcugaaau

SEQ ID NO: 4075773 - RNA, 14 nt, Vaccinia virus
caaagcaucgauuu

SEQ ID NO: 4075774 - RNA, 15 nt, Vaccinia virus
caaauaaaauggaua

SEQ ID NO: 4075775 - RNA, 16 nt, Vaccinia virus
caaauaaaauucugau

SEQ ID NO: 4075776 - RNA, 22 nt, Vaccinia virus
caaauaaaucacuaaauaauau

SEQ ID NO: 4075777 - RNA, 14 nt, Vaccinia virus
caaauauacuuuau

SEQ ID NO: 4075778 - RNA, 12 nt, Vaccinia virus
caaauauauuua

SEQ ID NO: 4075779 - RNA, 23 nt, Vaccinia virus
caaauaucggaauaaguagacau

SEQ ID NO: 4075780 - RNA, 22 nt, Vaccinia virus
caaaucagacguuguaaauuau

SEQ ID NO: 4075781 - RNA, 23 nt, Vaccinia virus
caaauccuucauucauuagauaa

SEQ ID NO: 4075782 - RNA, 16 nt, Vaccinia virus
caaaucuauauuguuu

SEQ ID NO: 4075783 - RNA, 23 nt, Vaccinia virus
caaaucucugauccguauccaug

SEQ ID NO: 4075784 - RNA, 21 nt, Vaccinia virus
caaauggauguuaauguauua

SEQ ID NO: 4075785 - RNA, 21 nt, Vaccinia virus
caaauguagugaauaucucua

SEQ ID NO: 4075786 - RNA, 20 nt, Vaccinia virus
caaauuaagcauuuuggaaa

SEQ ID NO: 4075787 - RNA, 19 nt, Vaccinia virus
caaauucauuauuaaacag

SEQ ID NO: 4075788 - RNA, 18 nt, Vaccinia virus
caaauucugcaauaucuu

SEQ ID NO: 4075789 - RNA, 20 nt, Vaccinia virus
caaauucuuggauauaugau

SEQ ID NO: 4075790 - RNA, 24 nt, Vaccinia virus
caaauuguuaaauuaauaauggau

SEQ ID NO: 4075791 - RNA, 23 nt, Vaccinia virus
caaauuuuacuacauaguuaucu

SEQ ID NO: 4075792 - RNA, 22 nt, Vaccinia virus
caacaaacgaguuuauuaguuu

SEQ ID NO: 4075793 - RNA, 18 nt, Vaccinia virus
caacaaguuggaugauau

SEQ ID NO: 4075794 - RNA, 13 nt, Vaccinia virus
caacaaugauaua

SEQ ID NO: 4075795 - RNA, 15 nt, Vaccinia virus
caacaauuuuuuguu

SEQ ID NO: 4075796 - RNA, 19 nt, Vaccinia virus
caacagaacagauaguuua

SEQ ID NO: 4075797 - RNA, 16 nt, Vaccinia virus
caacauacuauuguuu

SEQ ID NO: 4075798 - RNA, 23 nt, Vaccinia virus
caacauacuguuuagaugauauu

SEQ ID NO: 4075799 - RNA, 15 nt, Vaccinia virus
caacauauacacauu

SEQ ID NO: 4075800 - RNA, 14 nt, Vaccinia virus
caacauaucuaucc

SEQ ID NO: 4075801 - RNA, 16 nt, Vaccinia virus
caacauuggaauaaua

SEQ ID NO: 4075802 - RNA, 19 nt, Vaccinia virus
caaccaucucauaaaauag

SEQ ID NO: 4075803 - RNA, 14 nt, Vaccinia virus
caaccggauuuaaa

SEQ ID NO: 4075804 - RNA, 23 nt, Vaccinia virus
caacgaauacaaacgccauaauu

SEQ ID NO: 4075805 - RNA, 13 nt, Vaccinia virus
caacgagauaucu

SEQ ID NO: 4075806 - RNA, 15 nt, Vaccinia virus
caacggagauacauu

SEQ ID NO: 4075807 - RNA, 20 nt, Vaccinia virus
caacguaguaucaucuucua

SEQ ID NO: 4075808 - RNA, 23 nt, Vaccinia virus
caacugauuaaugagaucuucua

SEQ ID NO: 4075809 - RNA, 22 nt, Vaccinia virus
caacuucaucaugaguuaaaua

SEQ ID NO: 4075810 - RNA, 23 nt, Vaccinia virus
caacuucaucaugaguuaaauau

SEQ ID NO: 4075811 - RNA, 22 nt, Vaccinia virus
caagaaagugaaaaguucacau

SEQ ID NO: 4075812 - RNA, 13 nt, Vaccinia virus
caagaauaaacga

SEQ ID NO: 4075813 - RNA, 16 nt, Vaccinia virus
caagaauauauguuua

SEQ ID NO: 4075814 - RNA, 23 nt, Vaccinia virus
caagaauccgaucccacuucugu

SEQ ID NO: 4075815 - RNA, 16 nt, Vaccinia virus
caagacuaacacacaa

SEQ ID NO: 4075816 - RNA, 20 nt, Vaccinia virus
caagagacguaaauauucua

SEQ ID NO: 4075817 - RNA, 15 nt, Vaccinia virus
caagaggauggaauu

SEQ ID NO: 4075818 - RNA, 17 nt, Vaccinia virus
caagaguaacuauugac

SEQ ID NO: 4075819 - RNA, 22 nt, Vaccinia virus
caagagugauuuaagaacaucc

SEQ ID NO: 4075820 - RNA, 15 nt, Vaccinia virus
caagauaagcaaacg

SEQ ID NO: 4075821 - RNA, 14 nt, Vaccinia virus
caagauuauuacgu

SEQ ID NO: 4075822 - RNA, 16 nt, Vaccinia virus
caagauuccuuuucua

SEQ ID NO: 4075823 - RNA, 17 nt, Vaccinia virus
caaguaaagauuucaaa

SEQ ID NO: 4075824 - RNA, 14 nt, Vaccinia virus
caaguauacaauuu

SEQ ID NO: 4075825 - RNA, 16 nt, Vaccinia virus
caagucuggaaaacug

SEQ ID NO: 4075826 - RNA, 22 nt, Vaccinia virus
caaguuuccuguaaauuuucua

SEQ ID NO: 4075827 - RNA, 19 nt, Vaccinia virus
caauaaaaauaaacuagag

SEQ ID NO: 4075828 - RNA, 13 nt, Vaccinia virus
caauaaacaaaau

SEQ ID NO: 4075829 - RNA, 21 nt, Vaccinia virus
caauaaacuccguagagaaau

SEQ ID NO: 4075830 - RNA, 18 nt, Vaccinia virus
caauaacgcaaucaugau

SEQ ID NO: 4075831 - RNA, 12 nt, Vaccinia virus
caauaagaaagu

SEQ ID NO: 4075832 - RNA, 16 nt, Vaccinia virus
caauaagcauuaugau

SEQ ID NO: 4075833 - RNA, 14 nt, Vaccinia virus
caauaauauacaau

SEQ ID NO: 4075834 - RNA, 18 nt, Vaccinia virus
caauacacacaauagaca

SEQ ID NO: 4075835 - RNA, 18 nt, Vaccinia virus
caauaccaaagaaggaag

SEQ ID NO: 4075836 - RNA, 19 nt, Vaccinia virus
caauaguuucauaauuguu

SEQ ID NO: 4075837 - RNA, 15 nt, Vaccinia virus
caauauaaauccagu

SEQ ID NO: 4075838 - RNA, 20 nt, Vaccinia virus
caauaucaauaaauuuuuuu

SEQ ID NO: 4075839 - RNA, 18 nt, Vaccinia virus
caauaucaguaucuucuu

SEQ ID NO: 4075840 - RNA, 15 nt, Vaccinia virus
caauaucguagaauu

SEQ ID NO: 4075841 - RNA, 16 nt, Vaccinia virus
caauaucguuaaagau

SEQ ID NO: 4075842 - RNA, 20 nt, Vaccinia virus
caauaugucuguacaaaugu

SEQ ID NO: 4075843 - RNA, 15 nt, Vaccinia virus
caauauuaaugcauu

SEQ ID NO: 4075844 - RNA, 12 nt, Vaccinia virus
caauauuacuuu

SEQ ID NO: 4075845 - RNA, 23 nt, Vaccinia virus
caauauucuauuacugcagaggg

SEQ ID NO: 4075846 - RNA, 16 nt, Vaccinia virus
caaucacuacaauaau

SEQ ID NO: 4075847 - RNA, 21 nt, Vaccinia virus
caaucauaaaaaaaauacaug

SEQ ID NO: 4075848 - RNA, 19 nt, Vaccinia virus
caaucggauacagacacuc

SEQ ID NO: 4075849 - RNA, 12 nt, Vaccinia virus
caaucuaucuau

SEQ ID NO: 4075850 - RNA, 19 nt, Vaccinia virus
caaucuccauuauuuuuuu

SEQ ID NO: 4075851 - RNA, 16 nt, Vaccinia virus
caaucucguuuaauau

SEQ ID NO: 4075852 - RNA, 20 nt, Vaccinia virus
caaucugggcguauaaugaa

SEQ ID NO: 4075853 - RNA, 12 nt, Vaccinia virus
caaugaaaucac

SEQ ID NO: 4075854 - RNA, 16 nt, Vaccinia virus
caaugauagacuagaa

SEQ ID NO: 4075855 - RNA, 18 nt, Vaccinia virus
caaugcucaguaaaugua

SEQ ID NO: 4075856 - RNA, 13 nt, Vaccinia virus
caauguccaaauc

SEQ ID NO: 4075857 - RNA, 22 nt, Vaccinia virus
caauuaacgaucuuuauaauau

SEQ ID NO: 4075858 - RNA, 12 nt, Vaccinia virus
caauuacugaua

SEQ ID NO: 4075859 - RNA, 20 nt, Vaccinia virus
caauuagauccaaagaagau

SEQ ID NO: 4075860 - RNA, 15 nt, Vaccinia virus
caauuaguuaauaau

SEQ ID NO: 4075861 - RNA, 17 nt, Vaccinia virus
caauuaguuuauuggua

SEQ ID NO: 4075862 - RNA, 23 nt, Vaccinia virus
caauuauaugguagauuguuaac

SEQ ID NO: 4075863 - RNA, 17 nt, Vaccinia virus
caauuauguaucaauau

SEQ ID NO: 4075864 - RNA, 17 nt, Vaccinia virus
caauuauugggccagua

SEQ ID NO: 4075865 - RNA, 16 nt, Vaccinia virus
caauucgguuauaaau

SEQ ID NO: 4075866 - RNA, 14 nt, Vaccinia virus
caauucguauaaau

SEQ ID NO: 4075867 - RNA, 19 nt, Vaccinia virus
caauugucuuucucuuuua

SEQ ID NO: 4075868 - RNA, 20 nt, Vaccinia virus
cauauuaaacuaauucauuu

SEQ ID NO: 4075869 - RNA, 17 nt, Vaccinia virus
cguauauagaugucaau

SEQ ID NO: 4075870 - RNA, 20 nt, Vaccinia virus
cguauaucucuauuaaaugc

SEQ ID NO: 4075871 - RNA, 14 nt, Vaccinia virus
cguauauguuucua

SEQ ID NO: 4075872 - RNA, 13 nt, Vaccinia virus
cguauauuucuau

SEQ ID NO: 4075873 - RNA, 15 nt, Vaccinia virus
cguaucauuaaacau

SEQ ID NO: 4075874 - RNA, 16 nt, Vaccinia virus
cguaugccuguuuaua

SEQ ID NO: 4075875 - RNA, 17 nt, Vaccinia virus
cgucaugauaaaaauuu

SEQ ID NO: 4075876 - RNA, 16 nt, Vaccinia virus
cgucuacaaaaaacuu

SEQ ID NO: 4075877 - RNA, 13 nt, Vaccinia virus
cgucuaucaucua

SEQ ID NO: 4075878 - RNA, 22 nt, Vaccinia virus
cgucucugacgguaccauaaac

SEQ ID NO: 4075879 - RNA, 15 nt, Vaccinia virus
cgugauguuguaaca

SEQ ID NO: 4075880 - RNA, 21 nt, Vaccinia virus
cgugcacuuuuuuauaaagau

SEQ ID NO: 4075881 - RNA, 20 nt, Vaccinia virus
cguggcaaacaauguauaca

SEQ ID NO: 4075882 - RNA, 17 nt, Vaccinia virus
cguguaacaaaguauua

SEQ ID NO: 4075883 - RNA, 18 nt, Vaccinia virus
cguguaaggcguaucuag

SEQ ID NO: 4075884 - RNA, 17 nt, Vaccinia virus
cgugucaaccaguuaaa

SEQ ID NO: 4075885 - RNA, 16 nt, Vaccinia virus
cguguucuuguguaau

SEQ ID NO: 4075886 - RNA, 19 nt, Vaccinia virus
cguuaacgauaguaucaau

SEQ ID NO: 4075887 - RNA, 11 nt, Vaccinia virus
cguuagaugua

SEQ ID NO: 4075888 - RNA, 18 nt, Vaccinia virus
cguuaguaacgccauuau

SEQ ID NO: 4075889 - RNA, 12 nt, Vaccinia virus
cguuagucauau

SEQ ID NO: 4075890 - RNA, 22 nt, Vaccinia virus
cguuauacaucuuaguuguaaa

SEQ ID NO: 4075891 - RNA, 19 nt, Vaccinia virus
cguuaucguuuucuacaau

SEQ ID NO: 4075892 - RNA, 20 nt, Vaccinia virus
cguuauuugagagaucauuu

SEQ ID NO: 4075893 - RNA, 19 nt, Vaccinia virus
cguucaacauuuuauggaa

SEQ ID NO: 4075894 - RNA, 22 nt, Vaccinia virus
cguugcgaagaaaaaaauggaa

SEQ ID NO: 4075895 - RNA, 18 nt, Vaccinia virus
cguuggaccauuaauagg

SEQ ID NO: 4075896 - RNA, 19 nt, Vaccinia virus
cguuguugaaucuauuuug

SEQ ID NO: 4075897 - RNA, 15 nt, Vaccinia virus
cuaaaaaaaaugacu

SEQ ID NO: 4075898 - RNA, 12 nt, Vaccinia virus
cuaaaaaacuaa

SEQ ID NO: 4075899 - RNA, 19 nt, Vaccinia virus
cuaaaaacuguaucgauuu

SEQ ID NO: 4075900 - RNA, 15 nt, Vaccinia virus
cuaaaaauguuaauu

SEQ ID NO: 4075901 - RNA, 17 nt, Vaccinia virus
cuaaaauuuugaucauc

SEQ ID NO: 4075902 - RNA, 15 nt, Vaccinia virus
cuaaacaagcuaucu

SEQ ID NO: 4075903 - RNA, 20 nt, Vaccinia virus
cuaaacacacauuauucaga

SEQ ID NO: 4075904 - RNA, 21 nt, Vaccinia virus
cuaaacccgacuuaguuauau

SEQ ID NO: 4075905 - RNA, 22 nt, Vaccinia virus
cuaaagcacaacgagagauauu

SEQ ID NO: 4075906 - RNA, 23 nt, Vaccinia virus
cuaaaggaugaguacauuucaca

SEQ ID NO: 4075907 - RNA, 17 nt, Vaccinia virus
cuaaauaaauaugugua

SEQ ID NO: 4075908 - RNA, 18 nt, Vaccinia virus
cuaaaucgcuuguuuaga

SEQ ID NO: 4075909 - RNA, 12 nt, Vaccinia virus
cuaaauuagaac

SEQ ID NO: 4075910 - RNA, 20 nt, Vaccinia virus
cuaacaauaacuagaucauc

SEQ ID NO: 4075911 - RNA, 19 nt, Vaccinia virus
cuaacagcaauaguauaau

SEQ ID NO: 4075912 - RNA, 23 nt, Vaccinia virus
cuaacauacgagacauguuagua

SEQ ID NO: 4075913 - RNA, 17 nt, Vaccinia virus
cuaacaugcauuugaaa

SEQ ID NO: 4075914 - RNA, 18 nt, Vaccinia virus
cuaacgccgaucucugaa

SEQ ID NO: 4075915 - RNA, 13 nt, Vaccinia virus
cuaacuauauacc

SEQ ID NO: 4075916 - RNA, 16 nt, Vaccinia virus
cuaaggaguaaaauag

SEQ ID NO: 4075917 - RNA, 13 nt, Vaccinia virus
cuaauaaacauuc

SEQ ID NO: 4075918 - RNA, 17 nt, Vaccinia virus
cuaauacaaaaucaucu

SEQ ID NO: 4075919 - RNA, 19 nt, Vaccinia virus
cuaauacaucucuggaaau

SEQ ID NO: 4075920 - RNA, 22 nt, Vaccinia virus
cuaauacaucucuggaaauaga

SEQ ID NO: 4075921 - RNA, 15 nt, Vaccinia virus
cuaaucaauagcuua

SEQ ID NO: 4075922 - RNA, 22 nt, Vaccinia virus
cuaaucuaaacgcguuagauaa

SEQ ID NO: 4075923 - RNA, 16 nt, Vaccinia virus
cuaaugaccacaucuu

SEQ ID NO: 4075924 - RNA, 21 nt, Vaccinia virus
cuaauguauagauuguuuuca

SEQ ID NO: 4075925 - RNA, 18 nt, Vaccinia virus
cuaauuaaucuaaaaucu

SEQ ID NO: 4075926 - RNA, 19 nt, Vaccinia virus
cuaauuuguaaaccaucuu

SEQ ID NO: 4075927 - RNA, 17 nt, Vaccinia virus
cuacaacagauauucca

SEQ ID NO: 4075928 - RNA, 15 nt, Vaccinia virus
cuacacuaaaaugau

SEQ ID NO: 4075929 - RNA, 17 nt, Vaccinia virus
cuacaguaauguccaaa

SEQ ID NO: 4075930 - RNA, 21 nt, Vaccinia virus
cuacauaguuaucuaucuuaa

SEQ ID NO: 4075931 - RNA, 21 nt, Vaccinia virus
cuacaucaguuuuguauucca

SEQ ID NO: 4075932 - RNA, 20 nt, Vaccinia virus
cuacauccauguuuaucuau

SEQ ID NO: 4075933 - RNA, 16 nt, Vaccinia virus
cuacaucuaugucuuu

SEQ ID NO: 4075934 - RNA, 23 nt, Vaccinia virus
cuacaucuuccuucuuauucuua

SEQ ID NO: 4075935 - RNA, 15 nt, Vaccinia virus
cuacaucuuuaagau

SEQ ID NO: 4075936 - RNA, 20 nt, Vaccinia virus
cuacauggacucauuaaaac

SEQ ID NO: 4075937 - RNA, 20 nt, Vaccinia virus
cuaccaacgauaagauauca

SEQ ID NO: 4075938 - RNA, 20 nt, Vaccinia virus
cuaccacacuucuagauauc

SEQ ID NO: 4075939 - RNA, 19 nt, Vaccinia virus
cuaccagccuacauuuugc

SEQ ID NO: 4075940 - RNA, 23 nt, Vaccinia virus
cuacgaaacugauacaaucucuu

SEQ ID NO: 4075941 - RNA, 18 nt, Vaccinia virus
cuacuaccgaugauguaa

SEQ ID NO: 4075942 - RNA, 17 nt, Vaccinia virus
cuacucuagguaacaaa

SEQ ID NO: 4075943 - RNA, 17 nt, Vaccinia virus
cuagaauuagaauuaca

SEQ ID NO: 4075944 - RNA, 15 nt, Vaccinia virus
cuagacaauauucca

SEQ ID NO: 4075945 - RNA, 15 nt, Vaccinia virus
cuagacuugauuuaa

SEQ ID NO: 4075946 - RNA, 18 nt, Vaccinia virus
cuagagcaucaauguccu

SEQ ID NO: 4075947 - RNA, 23 nt, Vaccinia virus
cuagauaaaaaggaaucuauuaa

SEQ ID NO: 4075948 - RNA, 22 nt, Vaccinia virus
cuagauacccaaucucucucaa

SEQ ID NO: 4075949 - RNA, 23 nt, Vaccinia virus
cuagauauguauuuaauaucaaa

SEQ ID NO: 4075950 - RNA, 17 nt, Vaccinia virus
cuagaucaagaaacauu

SEQ ID NO: 4075951 - RNA, 13 nt, Vaccinia virus
cuagccucaucuu

SEQ ID NO: 4075952 - RNA, 14 nt, Vaccinia virus
cuagcgacucuguu

SEQ ID NO: 4075953 - RNA, 17 nt, Vaccinia virus
cuaggaguguuggauuu

SEQ ID NO: 4075954 - RNA, 14 nt, Vaccinia virus
cuagucuucucuga

SEQ ID NO: 4075955 - RNA, 24 nt, Vaccinia virus
cuagucuuugugggcaacugucua

SEQ ID NO: 4075956 - RNA, 21 nt, Vaccinia virus
cuaguuaagaacaugucuucu

SEQ ID NO: 4075957 - RNA, 20 nt, Vaccinia virus
cuaguucaccuucuauagau

SEQ ID NO: 4075958 - RNA, 14 nt, Vaccinia virus
cuaguuuguuuaua

SEQ ID NO: 4075959 - RNA, 23 nt, Vaccinia virus
cuaguuuuauacacaucucuuca

SEQ ID NO: 4075960 - RNA, 18 nt, Vaccinia virus
cuauaaaauaaaaugagu

SEQ ID NO: 4075961 - RNA, 14 nt, Vaccinia virus
cuauaaacugaaua

SEQ ID NO: 4075962 - RNA, 17 nt, Vaccinia virus
cuauaaaugaauucuca

SEQ ID NO: 4075963 - RNA, 14 nt, Vaccinia virus
cuauaacuccuaua

SEQ ID NO: 4075964 - RNA, 20 nt, Vaccinia virus
cuauaagauuaucaaaaucu

SEQ ID NO: 4075965 - RNA, 16 nt, Vaccinia virus
cuauaauaucuuugaa

SEQ ID NO: 4075966 - RNA, 17 nt, Vaccinia virus
cuauaaugacaauaaaa

SEQ ID NO: 4075967 - RNA, 23 nt, Vaccinia virus
cuauaauguaguaaauauaaaau

SEQ ID NO: 4075968 - RNA, 15 nt, Vaccinia virus
cuauacaagucgucu

SEQ ID NO: 4075969 - RNA, 16 nt, Vaccinia virus
cuauacccaucaugua

SEQ ID NO: 4075970 - RNA, 13 nt, Vaccinia virus
cuauacuauguua

SEQ ID NO: 4075971 - RNA, 11 nt, Vaccinia virus
cuauagaaaau

SEQ ID NO: 4075972 - RNA, 21 nt, Vaccinia virus
cuauagacauaauacuaucug

SEQ ID NO: 4075973 - RNA, 20 nt, Vaccinia virus
cuauagcaucaauaauuguu

SEQ ID NO: 4075974 - RNA, 22 nt, Vaccinia virus
cuauaguccugucuuucgaugu

SEQ ID NO: 4075975 - RNA, 14 nt, Vaccinia virus
cuuccaagaagaag

SEQ ID NO: 4075976 - RNA, 19 nt, Vaccinia virus
cuuccaccacauccaucaa

SEQ ID NO: 4075977 - RNA, 17 nt, Vaccinia virus
cuucgauauuagauuuu

SEQ ID NO: 4075978 - RNA, 23 nt, Vaccinia virus
cuucgauauuagauuuuguauua

SEQ ID NO: 4075979 - RNA, 13 nt, Vaccinia virus
cuucguacauaag

SEQ ID NO: 4075980 - RNA, 12 nt, Vaccinia virus
cuucuaucuugu

SEQ ID NO: 4075981 - RNA, 14 nt, Vaccinia virus
cuucuaucuuuagu

SEQ ID NO: 4075982 - RNA, 13 nt, Vaccinia virus
cuucuauuucuaa

SEQ ID NO: 4075983 - RNA, 16 nt, Vaccinia virus
cuucucaucuauguaa

SEQ ID NO: 4075984 - RNA, 16 nt, Vaccinia virus
cuucucuauuguuuag

SEQ ID NO: 4075985 - RNA, 15 nt, Vaccinia virus
cuucuggacauaauu

SEQ ID NO: 4075986 - RNA, 14 nt, Vaccinia virus
cuucuguuaauuuu

SEQ ID NO: 4075987 - RNA, 14 nt, Vaccinia virus
cuucuuauuuagau

SEQ ID NO: 4075988 - RNA, 16 nt, Vaccinia virus
cuucuuccuuuuguuc

SEQ ID NO: 4075989 - RNA, 14 nt, Vaccinia virus
cuucuuuuuuccaa

SEQ ID NO: 4075990 - RNA, 18 nt, Vaccinia virus
cuugaucucaucauucca

SEQ ID NO: 4075991 - RNA, 18 nt, Vaccinia virus
cuuggauuuuuuguacau

SEQ ID NO: 4075992 - RNA, 19 nt, Vaccinia virus
cuuguauucaacaugcuuu

SEQ ID NO: 4075993 - RNA, 15 nt, Vaccinia virus
cuuuaaaagaaacug

SEQ ID NO: 4075994 - RNA, 23 nt, Vaccinia virus
cuuuaaacuuuggcauauacaag

SEQ ID NO: 4075995 - RNA, 20 nt, Vaccinia virus
cuuuaauugucuugaugaag

SEQ ID NO: 4075996 - RNA, 15 nt, Vaccinia virus
cuuuacuaagaaagu

SEQ ID NO: 4075997 - RNA, 20 nt, Vaccinia virus
cuuuagaauguuaucgauga

SEQ ID NO: 4075998 - RNA, 15 nt, Vaccinia virus
cuuuauaacugaacu

SEQ ID NO: 4075999 - RNA, 20 nt, Vaccinia virus
cuuuauaucguguucauuaa

SEQ ID NO: 4076000 - RNA, 21 nt, Vaccinia virus
cuuuaucucuuaguaaguuua

SEQ ID NO: 4076001 - RNA, 19 nt, Vaccinia virus
cuuuauuuccacauuagau

SEQ ID NO: 4076002 - RNA, 17 nt, Vaccinia virus
cuuucaaacuuaaucuu

SEQ ID NO: 4076003 - RNA, 19 nt, Vaccinia virus
cuuuccaaucaauaauuuu

SEQ ID NO: 4076004 - RNA, 15 nt, Vaccinia virus
cuuucgauuuggaaa

SEQ ID NO: 4076005 - RNA, 18 nt, Vaccinia virus
cuuucuagaauaaguuuc

SEQ ID NO: 4076006 - RNA, 16 nt, Vaccinia virus
cuuucuccuguaaaga

SEQ ID NO: 4076007 - RNA, 19 nt, Vaccinia virus
cuuugaaaauguuacugaa

SEQ ID NO: 4076008 - RNA, 14 nt, Vaccinia virus
cuuugauaaaaguu

SEQ ID NO: 4076009 - RNA, 13 nt, Vaccinia virus
cuuugauggauuc

SEQ ID NO: 4076010 - RNA, 18 nt, Vaccinia virus
cuuugauguggauacauc

SEQ ID NO: 4076011 - RNA, 17 nt, Vaccinia virus
cuuugguuuaauuauuu

SEQ ID NO: 4076012 - RNA, 18 nt, Vaccinia virus
cuuuguagaaaaaaauuc

SEQ ID NO: 4076013 - RNA, 22 nt, Vaccinia virus
cuuuuagaagugauucuuugau

SEQ ID NO: 4076014 - RNA, 22 nt, Vaccinia virus
cuuuuagagguucccaauucca

SEQ ID NO: 4076015 - RNA, 19 nt, Vaccinia virus
cuuuucaauguuuaauuuu

SEQ ID NO: 4076016 - RNA, 22 nt, Vaccinia virus
cuuuucauccaguugaauggau

SEQ ID NO: 4076017 - RNA, 16 nt, Vaccinia virus
cuuuuguauucauaga

SEQ ID NO: 4076018 - RNA, 18 nt, Vaccinia virus
cuuuuguggaauuuccca

SEQ ID NO: 4076019 - RNA, 19 nt, Vaccinia virus
gaaaaaaaagcuauuauca

SEQ ID NO: 4076020 - RNA, 17 nt, Vaccinia virus
gaaaaaaaauuaucuau

SEQ ID NO: 4076021 - RNA, 15 nt, Vaccinia virus
gaaaaaaauucaguu

SEQ ID NO: 4076022 - RNA, 13 nt, Vaccinia virus
gaaaaacacauuu

SEQ ID NO: 4076023 - RNA, 18 nt, Vaccinia virus
gaaaaaguaaaugaugaa

SEQ ID NO: 4076024 - RNA, 13 nt, Vaccinia virus
gaaaaaugauuau

SEQ ID NO: 4076025 - RNA, 17 nt, Vaccinia virus
gaaaacauuauauccuc

SEQ ID NO: 4076026 - RNA, 21 nt, Vaccinia virus
gaaaacgucauucaauaagau

SEQ ID NO: 4076027 - RNA, 17 nt, Vaccinia virus
gaaaacugguuaaaaca

SEQ ID NO: 4076028 - RNA, 15 nt, Vaccinia virus
gaaaaguaugauggu

SEQ ID NO: 4076029 - RNA, 21 nt, Vaccinia virus
gaaaaguucaacaugauuauu

SEQ ID NO: 4076030 - RNA, 16 nt, Vaccinia virus
gaaaauaacaaaucua

SEQ ID NO: 4076031 - RNA, 14 nt, Vaccinia virus
gaaaauauauucua

SEQ ID NO: 4076032 - RNA, 15 nt, Vaccinia virus
gaaaaucaucaucua

SEQ ID NO: 4076033 - RNA, 22 nt, Vaccinia virus
gaaaaugaaaagguacuagaua

SEQ ID NO: 4076034 - RNA, 17 nt, Vaccinia virus
gaaaaugcagaaaugau

SEQ ID NO: 4076035 - RNA, 17 nt, Vaccinia virus
gaaaaugcgauguugau

SEQ ID NO: 4076036 - RNA, 21 nt, Vaccinia virus
gaaaauguacuucgaugagau

SEQ ID NO: 4076037 - RNA, 15 nt, Vaccinia virus
gaaaauuagaaggau

SEQ ID NO: 4076038 - RNA, 18 nt, Vaccinia virus
gaaaauucauauacugau

SEQ ID NO: 4076039 - RNA, 22 nt, Vaccinia virus
gaaacaauguuucuuacauauu

SEQ ID NO: 4076040 - RNA, 13 nt, Vaccinia virus
gaaacauacgaua

SEQ ID NO: 4076041 - RNA, 23 nt, Vaccinia virus
gaaacauauucuaugaauuuaua

SEQ ID NO: 4076042 - RNA, 20 nt, Vaccinia virus
gaaacuaugucaaaaauugu

SEQ ID NO: 4076043 - RNA, 20 nt, Vaccinia virus
gaaacucuguuguauaucua

SEQ ID NO: 4076044 - RNA, 14 nt, Vaccinia virus
gaaagagaagaugg

SEQ ID NO: 4076045 - RNA, 13 nt, Vaccinia virus
gaaagauguuauu

SEQ ID NO: 4076046 - RNA, 15 nt, Vaccinia virus
gaaagauuaaaucau

SEQ ID NO: 4076047 - RNA, 15 nt, Vaccinia virus
gaaagcgugauuuua

SEQ ID NO: 4076048 - RNA, 20 nt, Vaccinia virus
gaaagcuguaaugguuuaua

SEQ ID NO: 4076049 - RNA, 15 nt, Vaccinia virus
gaaagucagaaucua

SEQ ID NO: 4076050 - RNA, 16 nt, Vaccinia virus
gaaagugcaaaugagg

SEQ ID NO: 4076051 - RNA, 20 nt, Vaccinia virus
gaaauaaaggcagaaaugca

SEQ ID NO: 4076052 - RNA, 15 nt, Vaccinia virus
gaaauaaauaaugaa

SEQ ID NO: 4076053 - RNA, 12 nt, Vaccinia virus
gaaauaauacaa

SEQ ID NO: 4076054 - RNA, 16 nt, Vaccinia virus
gaaauaggaauaauua

SEQ ID NO: 4076055 - RNA, 21 nt, Vaccinia virus
gaaauauuauacaugcugaca

SEQ ID NO: 4076056 - RNA, 16 nt, Vaccinia virus
gaaaucaacauaauau

SEQ ID NO: 4076057 - RNA, 14 nt, Vaccinia virus
gaaaucuaguucug

SEQ ID NO: 4076058 - RNA, 19 nt, Vaccinia virus
gaaaucuaucuuauauaca

SEQ ID NO: 4076059 - RNA, 15 nt, Vaccinia virus
gaaauggugauuuug

SEQ ID NO: 4076060 - RNA, 15 nt, Vaccinia virus
gaaauguauaaacua

SEQ ID NO: 4076061 - RNA, 20 nt, Vaccinia virus
gaaauguugggauauugcau

SEQ ID NO: 4076062 - RNA, 15 nt, Vaccinia virus
gaaauugcaaaauau

SEQ ID NO: 4076063 - RNA, 23 nt, Vaccinia virus
gaacaagagauauauuggagcac

SEQ ID NO: 4076064 - RNA, 16 nt, Vaccinia virus
gaacacauuuacgaua

SEQ ID NO: 4076065 - RNA, 13 nt, Vaccinia virus
gaacacgauguuu

SEQ ID NO: 4076066 - RNA, 22 nt, Vaccinia virus
gaacacgauuauuauaaaauaa

SEQ ID NO: 4076067 - RNA, 16 nt, Vaccinia virus
gaacagauaguuuauc

SEQ ID NO: 4076068 - RNA, 12 nt, Vaccinia virus
gaacaguuuauu

SEQ ID NO: 4076069 - RNA, 20 nt, Vaccinia virus
gaacaucauuuccaaaucua

SEQ ID NO: 4076070 - RNA, 17 nt, Variola virus
aguacuccguuuacaga

SEQ ID NO: 4076071 - RNA, 22 nt, Variola virus
aguacucucuuauaaaguggau

SEQ ID NO: 4076072 - RNA, 19 nt, Variola virus
aguacuguucauacaugau

SEQ ID NO: 4076073 - RNA, 13 nt, Variola virus
aguacuuaaugaa

SEQ ID NO: 4076074 - RNA, 18 nt, Variola virus
aguagaaauuccauugga

SEQ ID NO: 4076075 - RNA, 22 nt, Variola virus
aguagagauucggguacuguau

SEQ ID NO: 4076076 - RNA, 18 nt, Variola virus
aguagcuagacaaauggu

SEQ ID NO: 4076077 - RNA, 22 nt, Variola virus
aguauaaacuauaaacuaaaaa

SEQ ID NO: 4076078 - RNA, 21 nt, Variola virus
aguauaaugauaucuaugauu

SEQ ID NO: 4076079 - RNA, 14 nt, Variola virus
aguauacaauauau

SEQ ID NO: 4076080 - RNA, 24 nt, Variola virus
aguauacgaagaaaaaguaaauac

SEQ ID NO: 4076081 - RNA, 14 nt, Variola virus
aguauacuaccuau

SEQ ID NO: 4076082 - RNA, 23 nt, Variola virus
aguauacuaccuauuauauuucu

SEQ ID NO: 4076083 - RNA, 19 nt, Variola virus
aguauagcuaaugaugcag

SEQ ID NO: 4076084 - RNA, 16 nt, Variola virus
aguauauacacagaau

SEQ ID NO: 4076085 - RNA, 17 nt, Variola virus
aguauauagauaugccu

SEQ ID NO: 4076086 - RNA, 23 nt, Variola virus
aguauauuuuaauucauuucauu

SEQ ID NO: 4076087 - RNA, 13 nt, Variola virus
aguaucaaacucu

SEQ ID NO: 4076088 - RNA, 21 nt, Variola virus
aguaucaugaacucuaaucaa

SEQ ID NO: 4076089 - RNA, 21 nt, Variola virus
aguaucugagcacuacaguca

SEQ ID NO: 4076090 - RNA, 17 nt, Variola virus
aguaucuucuuuaucua

SEQ ID NO: 4076091 - RNA, 18 nt, Variola virus
aguaugacuuacuuguau

SEQ ID NO: 4076092 - RNA, 18 nt, Variola virus
aguauuagucauaaacuu

SEQ ID NO: 4076093 - RNA, 15 nt, Variola virus
aguauucaagucaaa

SEQ ID NO: 4076094 - RNA, 16 nt, Variola virus
aguauugaaacuauau

SEQ ID NO: 4076095 - RNA, 13 nt, Variola virus
aguauuuuucuaa

SEQ ID NO: 4076096 - RNA, 20 nt, Variola virus
agucaauaaaggcaaagaua

SEQ ID NO: 4076097 - RNA, 13 nt, Variola virus
agucaauaucuuu

SEQ ID NO: 4076098 - RNA, 14 nt, Variola virus
agucauaaaucauu

SEQ ID NO: 4076099 - RNA, 16 nt, Variola virus
agucauguuaaaaaug

SEQ ID NO: 4076100 - RNA, 15 nt, Variola virus
aguccagaaauggaa

SEQ ID NO: 4076101 - RNA, 21 nt, Variola virus
aguccuauauauuugaaaauc

SEQ ID NO: 4076102 - RNA, 23 nt, Variola virus
agucuaaaaguucuuuauugcac

SEQ ID NO: 4076103 - RNA, 15 nt, Variola virus
agucuccacacuauu

SEQ ID NO: 4076104 - RNA, 15 nt, Variola virus
agucucuccuuccaa

SEQ ID NO: 4076105 - RNA, 17 nt, Variola virus
agucuuaaaaauacuua

SEQ ID NO: 4076106 - RNA, 12 nt, Variola virus
agugaaacauuc

SEQ ID NO: 4076107 - RNA, 19 nt, Variola virus
agugaaauguugucauuau

SEQ ID NO: 4076108 - RNA, 12 nt, Variola virus
agugacaaguag

SEQ ID NO: 4076109 - RNA, 15 nt, Variola virus
agugaccaacucauc

SEQ ID NO: 4076110 - RNA, 21 nt, Variola virus
agugauaaguaauaacuaugu

SEQ ID NO: 4076111 - RNA, 16 nt, Variola virus
agugaucaaauuauug

SEQ ID NO: 4076112 - RNA, 17 nt, Variola virus
agugcuauuuugacaua

SEQ ID NO: 4076113 - RNA, 18 nt, Variola virus
agugcuauuuugacauac

SEQ ID NO: 4076114 - RNA, 17 nt, Variola virus
agugggacaaagaaaau

SEQ ID NO: 4076115 - RNA, 14 nt, Variola virus
agugguuaaucuua

SEQ ID NO: 4076116 - RNA, 19 nt, Variola virus
aguguaauaauuuauguau

SEQ ID NO: 4076117 - RNA, 19 nt, Variola virus
aguguagcguuuuaaauau

SEQ ID NO: 4076118 - RNA, 19 nt, Variola virus
aguguauguggaaauguua

SEQ ID NO: 4076119 - RNA, 21 nt, Variola virus
aguguauuuaugaaaaauaua

SEQ ID NO: 4076120 - RNA, 18 nt, Variola virus
agugugaauaugaucuuc

SEQ ID NO: 4076121 - RNA, 24 nt, Variola virus
aguguuuagcguggcuagaauagu

SEQ ID NO: 4076122 - RNA, 18 nt, Variola virus
aguuaaagaaaaauacuc

SEQ ID NO: 4076123 - RNA, 20 nt, Variola virus
aguuaaauucauauaaagua

SEQ ID NO: 4076124 - RNA, 17 nt, Variola virus
aguuaacacaugucaca

SEQ ID NO: 4076125 - RNA, 22 nt, Variola virus
aguuaaggauaagaacuggacu

SEQ ID NO: 4076126 - RNA, 13 nt, Variola virus
aguuaauaggaca

SEQ ID NO: 4076127 - RNA, 18 nt, Variola virus
aguuaaugcaucuaaaac

SEQ ID NO: 4076128 - RNA, 22 nt, Variola virus
aguuacucuuggucuaauacug

SEQ ID NO: 4076129 - RNA, 16 nt, Variola virus
aguuagaaaaaaugau

SEQ ID NO: 4076130 - RNA, 17 nt, Variola virus
aguuagauacaaagaua

SEQ ID NO: 4076131 - RNA, 16 nt, Variola virus
aguuauaauauuucca

SEQ ID NO: 4076132 - RNA, 21 nt, Variola virus
aguuauacgucauuucaucug

SEQ ID NO: 4076133 - RNA, 13 nt, Variola virus
aguuauauauacu

SEQ ID NO: 4076134 - RNA, 13 nt, Variola virus
aguuauaugaaua

SEQ ID NO: 4076135 - RNA, 21 nt, Variola virus
aguuauauuuucgucuaucca

SEQ ID NO: 4076136 - RNA, 16 nt, Variola virus
aguuaucaucuauaug

SEQ ID NO: 4076137 - RNA, 17 nt, Variola virus
aguuauccgaucuaaaa

SEQ ID NO: 4076138 - RNA, 23 nt, Variola virus
aguuauggacauaguaauacaua

SEQ ID NO: 4076139 - RNA, 20 nt, Variola virus
aguucaaauaugaaaugcua

SEQ ID NO: 4076140 - RNA, 18 nt, Variola virus
aguuccaaauuuaaauac

SEQ ID NO: 4076141 - RNA, 17 nt, Variola virus
aguuccgagauaauuuc

SEQ ID NO: 4076142 - RNA, 16 nt, Variola virus
aguuccucaacgugau

SEQ ID NO: 4076143 - RNA, 19 nt, Variola virus
aguucuggcaauguuucau

SEQ ID NO: 4076144 - RNA, 12 nt, Variola virus
aguucugugcag

SEQ ID NO: 4076145 - RNA, 16 nt, Variola virus
aguucuuaauacuucg

SEQ ID NO: 4076146 - RNA, 13 nt, Variola virus
aguucuucuagaa

SEQ ID NO: 4076147 - RNA, 24 nt, Variola virus
aguugaauauauuaaaguuauuua

SEQ ID NO: 4076148 - RNA, 16 nt, Variola virus
aguugcauagauguau

SEQ ID NO: 4076149 - RNA, 20 nt, Variola virus
aguuguauacuaucggaauc

SEQ ID NO: 4076150 - RNA, 16 nt, Variola virus
aguugucggucuaaag

SEQ ID NO: 4076151 - RNA, 23 nt, Variola virus
aguuguuauaaaggacagaaaua

SEQ ID NO: 4076152 - RNA, 12 nt, Variola virus
aguuucuagaua

SEQ ID NO: 4076153 - RNA, 17 nt, Variola virus
aguuucugguuuucuau

SEQ ID NO: 4076154 - RNA, 15 nt, Variola virus
aguuucuuaacuaca

SEQ ID NO: 4076155 - RNA, 22 nt, Variola virus
aguuucuugcguuuaauaaaca

SEQ ID NO: 4076156 - RNA, 16 nt, Variola virus
aguuugaauaguuugu

SEQ ID NO: 4076157 - RNA, 15 nt, Variola virus
aguuuggauuaauaa

SEQ ID NO: 4076158 - RNA, 20 nt, Variola virus
aguuuggcaauuaaaaauua

SEQ ID NO: 4076159 - RNA, 16 nt, Variola virus
aguuuuaaacaaaaua

SEQ ID NO: 4076160 - RNA, 17 nt, Variola virus
aguuuuaccuucuaaug

SEQ ID NO: 4076161 - RNA, 15 nt, Variola virus
aguuuuauaacgaag

SEQ ID NO: 4076162 - RNA, 22 nt, Variola virus
aguuuucucuuggcuucuucca

SEQ ID NO: 4076163 - RNA, 16 nt, Variola virus
aguuuuggaucaaaug

SEQ ID NO: 4076164 - RNA, 19 nt, Variola virus
aguuuuggccauuauuaga

SEQ ID NO: 4076165 - RNA, 13 nt, Variola virus
auaaaaaaaauua

SEQ ID NO: 4076166 - RNA, 17 nt, Variola virus
auaaaaaauaaguauau

SEQ ID NO: 4076167 - RNA, 18 nt, Variola virus
auaaaaaauuuuauucaa

SEQ ID NO: 4076168 - RNA, 16 nt, Variola virus
auaaaaacauuauucu

SEQ ID NO: 4076169 - RNA, 17 nt, Variola virus
auaaaaagguaucugau

SEQ ID NO: 4076170 - RNA, 20 nt, Variola virus
auaaaaauguuuuuguuuaa

SEQ ID NO: 4076171 - RNA, 15 nt, Variola virus
auaaaacucauauag

SEQ ID NO: 4076172 - RNA, 12 nt, Variola virus
auaaaauagaca

SEQ ID NO: 4076173 - RNA, 18 nt, Variola virus
auaaaauuaauaauagaa

SEQ ID NO: 4076174 - RNA, 17 nt, Variola virus
auaaacaacauaauaca

SEQ ID NO: 4076175 - RNA, 14 nt, Variola virus
auaaacaugucuau

SEQ ID NO: 4076176 - RNA, 20 nt, Variola virus
auaaacaugucuauuguuaa

SEQ ID NO: 4076177 - RNA, 15 nt, Variola virus
auaaacgacauaaua

SEQ ID NO: 4076178 - RNA, 18 nt, Variola virus
auaaacguucacguaaau

SEQ ID NO: 4076179 - RNA, 14 nt, Variola virus
auaaacuaacacaa

SEQ ID NO: 4076180 - RNA, 14 nt, Variola virus
auaaacucagauaa

SEQ ID NO: 4076181 - RNA, 19 nt, Variola virus
auaaacugcgccaaauugu

SEQ ID NO: 4076182 - RNA, 15 nt, Variola virus
auaaagaaaaaucua

SEQ ID NO: 4076183 - RNA, 15 nt, Variola virus
auaaagaaaauaugg

SEQ ID NO: 4076184 - RNA, 17 nt, Variola virus
auaaaggacagaaauau

SEQ ID NO: 4076185 - RNA, 17 nt, Variola virus
auaaaggagaaggaaaa

SEQ ID NO: 4076186 - RNA, 14 nt, Variola virus
auaaagucugucaa

SEQ ID NO: 4076187 - RNA, 15 nt, Variola virus
auaaauaaucaaaau

SEQ ID NO: 4076188 - RNA, 20 nt, Variola virus
auaaauauccuuggaauuga

SEQ ID NO: 4076189 - RNA, 18 nt, Variola virus
auaaauguucaaugaauu

SEQ ID NO: 4076190 - RNA, 20 nt, Variola virus
auaaauuaggagauaaucua

SEQ ID NO: 4076191 - RNA, 14 nt, Variola virus
auaaauuauaucua

SEQ ID NO: 4076192 - RNA, 18 nt, Variola virus
auaaauugguaaauccua

SEQ ID NO: 4076193 - RNA, 21 nt, Variola virus
auaaauuuuuccaagaaacua

SEQ ID NO: 4076194 - RNA, 10 nt, Variola virus
auaacaaagg

SEQ ID NO: 4076195 - RNA, 18 nt, Variola virus
auaacaaaugcagaaauu

SEQ ID NO: 4076196 - RNA, 21 nt, Variola virus
aucugauaagauaucuucuca

SEQ ID NO: 4076197 - RNA, 15 nt, Variola virus
aucugauuccauaua

SEQ ID NO: 4076198 - RNA, 16 nt, Variola virus
aucugauuuauuuccu

SEQ ID NO: 4076199 - RNA, 17 nt, Variola virus
aucugccgaauacagug

SEQ ID NO: 4076200 - RNA, 15 nt, Variola virus
aucuguaaacauuug

SEQ ID NO: 4076201 - RNA, 15 nt, Variola virus
aucuguauaauaaga

SEQ ID NO: 4076202 - RNA, 20 nt, Variola virus
aucuguauaauaagaugcaa

SEQ ID NO: 4076203 - RNA, 12 nt, Variola virus
aucuguauucuc

SEQ ID NO: 4076204 - RNA, 21 nt, Variola virus
aucuguauucucgauacagua

SEQ ID NO: 4076205 - RNA, 16 nt, Variola virus
aucugugauguaugca

SEQ ID NO: 4076206 - RNA, 16 nt, Variola virus
aucuuacauauacaga

SEQ ID NO: 4076207 - RNA, 22 nt, Variola virus
aucuuaccauguccucaaauaa

SEQ ID NO: 4076208 - RNA, 20 nt, Variola virus
aucuuagacauuuuuagaga

SEQ ID NO: 4076209 - RNA, 14 nt, Variola virus
aucuucguuaaaaa

SEQ ID NO: 4076210 - RNA, 19 nt, Variola virus
aucuucguuaaaaaguuuu

SEQ ID NO: 4076211 - RNA, 19 nt, Variola virus
aucuugacugucuaucucu

SEQ ID NO: 4076212 - RNA, 17 nt, Variola virus
aucuuuaugaauuacuu

SEQ ID NO: 4076213 - RNA, 19 nt, Variola virus
aucuuuggagaaucaucua

SEQ ID NO: 4076214 - RNA, 14 nt, Variola virus
aucuuuguuaaaua

SEQ ID NO: 4076215 - RNA, 24 nt, Variola virus
aucuuuguuggaucagucucuaag

SEQ ID NO: 4076216 - RNA, 15 nt, Variola virus
aucuuuuuaggaaug

SEQ ID NO: 4076217 - RNA, 17 nt, Variola virus
augaaacgaacacuauu

SEQ ID NO: 4076218 - RNA, 16 nt, Variola virus
augaaagaaagaagac

SEQ ID NO: 4076219 - RNA, 20 nt, Variola virus
augaaauaucuuaaggagaa

SEQ ID NO: 4076220 - RNA, 19 nt, Variola virus
augaaauauguagucguga

SEQ ID NO: 4076221 - RNA, 16 nt, Variola virus
augaacaaagaaaugg

SEQ ID NO: 4076222 - RNA, 21 nt, Variola virus
augaacacacgaugaaaaugu

SEQ ID NO: 4076223 - RNA, 23 nt, Variola virus
augaagaugacgaugaaaaugau

SEQ ID NO: 4076224 - RNA, 18 nt, Variola virus
augaaggaaagacauuau

SEQ ID NO: 4076225 - RNA, 21 nt, Variola virus
augaagggaucguuaaugaac

SEQ ID NO: 4076226 - RNA, 19 nt, Variola virus
augaauaaagagaaugcag

SEQ ID NO: 4076227 - RNA, 23 nt, Variola virus
augaaucacguguuuaacaaugg

SEQ ID NO: 4076228 - RNA, 14 nt, Variola virus
augaauuaauuaaa

SEQ ID NO: 4076229 - RNA, 13 nt, Variola virus
augaauuagagaa

SEQ ID NO: 4076230 - RNA, 17 nt, Variola virus
augaauuccucugaaaa

SEQ ID NO: 4076231 - RNA, 18 nt, Variola virus
augaauuuagaaaugauu

SEQ ID NO: 4076232 - RNA, 22 nt, Variola virus
augacacuaguuaagaacaugu

SEQ ID NO: 4076233 - RNA, 15 nt, Variola virus
augacauuuauucau

SEQ ID NO: 4076234 - RNA, 15 nt, Variola virus
augaccaaugaaugg

SEQ ID NO: 4076235 - RNA, 21 nt, Variola virus
augaccauuuaaaaaaacacu

SEQ ID NO: 4076236 - RNA, 14 nt, Variola virus
augacgcaguaaca

SEQ ID NO: 4076237 - RNA, 17 nt, Variola virus
augacgucaugucuauu

SEQ ID NO: 4076238 - RNA, 19 nt, Variola virus
augacuuauaaaaauacua

SEQ ID NO: 4076239 - RNA, 23 nt, Variola virus
augacuuauaaaaauacuaaaac

SEQ ID NO: 4076240 - RNA, 20 nt, Variola virus
augagacagauuaucauaua

SEQ ID NO: 4076241 - RNA, 13 nt, Variola virus
augagauguuauu

SEQ ID NO: 4076242 - RNA, 15 nt, Variola virus
augagcaaguagaaa

SEQ ID NO: 4076243 - RNA, 17 nt, Variola virus
augaggcguuuaucaua

SEQ ID NO: 4076244 - RNA, 18 nt, Variola virus
augaguaaaaucaaacac

SEQ ID NO: 4076245 - RNA, 11 nt, Variola virus
augaguauuuu

SEQ ID NO: 4076246 - RNA, 15 nt, Variola virus
augaguucugugcag

SEQ ID NO: 4076247 - RNA, 13 nt, Variola virus
augauaaaaugaa

SEQ ID NO: 4076248 - RNA, 21 nt, Variola virus
augauacacuaaguauauaca

SEQ ID NO: 4076249 - RNA, 13 nt, Variola virus
augauauaagacu

SEQ ID NO: 4076250 - RNA, 21 nt, Variola virus
augauaugauuuuuaaucaag

SEQ ID NO: 4076251 - RNA, 14 nt, Variola virus
augaucaaaaagag

SEQ ID NO: 4076252 - RNA, 15 nt, Variola virus
augaucauacauuau

SEQ ID NO: 4076253 - RNA, 20 nt, Variola virus
augaucugucuuauaugaag

SEQ ID NO: 4076254 - RNA, 21 nt, Variola virus
augaugauacucucaaccauu

SEQ ID NO: 4076255 - RNA, 20 nt, Variola virus
augaugcuauuagaauuuac

SEQ ID NO: 4076256 - RNA, 18 nt, Variola virus
augauuauaguuucuauu

SEQ ID NO: 4076257 - RNA, 19 nt, Variola virus
augauuauaguuucuauuu

SEQ ID NO: 4076258 - RNA, 14 nt, Variola virus
augauuauguuguu

SEQ ID NO: 4076259 - RNA, 16 nt, Variola virus
augauuucagauacua

SEQ ID NO: 4076260 - RNA, 22 nt, Variola virus
augauuuuaccgcaauauguau

SEQ ID NO: 4076261 - RNA, 22 nt, Variola virus
augauuuugaaccguauuacuc

SEQ ID NO: 4076262 - RNA, 13 nt, Variola virus
augcaaggcauuu

SEQ ID NO: 4076263 - RNA, 13 nt, Variola virus
augcauaaacgaa

SEQ ID NO: 4076264 - RNA, 13 nt, Variola virus
augcaucaaacag

SEQ ID NO: 4076265 - RNA, 19 nt, Variola virus
augcaucuauauaaucuuu

SEQ ID NO: 4076266 - RNA, 17 nt, Variola virus
augcauuauccaaaaua

SEQ ID NO: 4076267 - RNA, 20 nt, Variola virus
augcauuggcaucaaaagaa

SEQ ID NO: 4076268 - RNA, 17 nt, Variola virus
augcgagagacaaaaug

SEQ ID NO: 4076269 - RNA, 15 nt, Variola virus
augcggaugcucagu

SEQ ID NO: 4076270 - RNA, 24 nt, Variola virus
augcucuagauacugcaaaacuua

SEQ ID NO: 4076271 - RNA, 22 nt, Variola virus
augcugguuauuacacaugugu

SEQ ID NO: 4076272 - RNA, 12 nt, Variola virus
auggaaaggaaa

SEQ ID NO: 4076273 - RNA, 15 nt, Variola virus
auggaaauauuaaag

SEQ ID NO: 4076274 - RNA, 15 nt, Variola virus
auggaauaguuuuua

SEQ ID NO: 4076275 - RNA, 23 nt, Variola virus
auggaauauaauaaucuauuuua

SEQ ID NO: 4076276 - RNA, 18 nt, Variola virus
auggaccaaauuaucauc

SEQ ID NO: 4076277 - RNA, 17 nt, Variola virus
auggaccgucggacagu

SEQ ID NO: 4076278 - RNA, 16 nt, Variola virus
auggacgcaaaugauc

SEQ ID NO: 4076279 - RNA, 22 nt, Variola virus
auggagaagguuucgauuaucu

SEQ ID NO: 4076280 - RNA, 16 nt, Variola virus
auggagagauuuaacu

SEQ ID NO: 4076281 - RNA, 17 nt, Variola virus
auggaguaaguaguuua

SEQ ID NO: 4076282 - RNA, 14 nt, Variola virus
auggaguuguaaau

SEQ ID NO: 4076283 - RNA, 14 nt, Variola virus
auggaugcagaaua

SEQ ID NO: 4076284 - RNA, 16 nt, Variola virus
auggauggaugaugca

SEQ ID NO: 4076285 - RNA, 23 nt, Variola virus
auggauuaguuagacugaaugcu

SEQ ID NO: 4076286 - RNA, 23 nt, Variola virus
augggcgccgaccagucugaaca

SEQ ID NO: 4076287 - RNA, 14 nt, Variola virus
auggucauguuuau

SEQ ID NO: 4076288 - RNA, 15 nt, Variola virus
augguuuucacauuu

SEQ ID NO: 4076289 - RNA, 14 nt, Variola virus
auguaaaaauguua

SEQ ID NO: 4076290 - RNA, 14 nt, Variola virus
auguaacaauauua

SEQ ID NO: 4076291 - RNA, 16 nt, Variola virus
auguaacauuaaguaa

SEQ ID NO: 4076292 - RNA, 13 nt, Variola virus
auguaaguauuua

SEQ ID NO: 4076293 - RNA, 16 nt, Variola virus
auguaaucauuaucca

SEQ ID NO: 4076294 - RNA, 18 nt, Variola virus
auguaauggauaauuucc

SEQ ID NO: 4076295 - RNA, 23 nt, Variola virus
auguacucacggcuacggcauua

SEQ ID NO: 4076296 - RNA, 22 nt, Variola virus
auguagaauaucuaccaaauua

SEQ ID NO: 4076297 - RNA, 21 nt, Variola virus
auguagaaugugauaauuucc

SEQ ID NO: 4076298 - RNA, 22 nt, Variola virus
auguagaauuuuuuaaaaaguu

SEQ ID NO: 4076299 - RNA, 21 nt, Variola virus
auguauaauauaaaaacauua

SEQ ID NO: 4076300 - RNA, 14 nt, Variola virus
auguauacauaaua

SEQ ID NO: 4076301 - RNA, 14 nt, Variola virus
auguauauaucacu

SEQ ID NO: 4076302 - RNA, 21 nt, Variola virus
auguaucuuccacaucaaacg

SEQ ID NO: 4076303 - RNA, 14 nt, Variola virus
auguauuagacaaa

SEQ ID NO: 4076304 - RNA, 21 nt, Variola virus
auguauuucauuguucaucca

SEQ ID NO: 4076305 - RNA, 19 nt, Variola virus
auguauuuuaauaaaucau

SEQ ID NO: 4076306 - RNA, 21 nt, Variola virus
augucaaaggaugaaagaaag

SEQ ID NO: 4076307 - RNA, 19 nt, Variola virus
augucaagaucuuuuguau

SEQ ID NO: 4076308 - RNA, 13 nt, Variola virus
augucacuauuaa

SEQ ID NO: 4076309 - RNA, 16 nt, Variola virus
augucaucgaaauggu

SEQ ID NO: 4076310 - RNA, 21 nt, Variola virus
augucuaacggcgaacauguu

SEQ ID NO: 4076311 - RNA, 13 nt, Variola virus
augucuacauaaa

SEQ ID NO: 4076312 - RNA, 13 nt, Variola virus
augucuccaauuu

SEQ ID NO: 4076313 - RNA, 23 nt, Variola virus
augucuuaaaguuauuaauuaau

SEQ ID NO: 4076314 - RNA, 13 nt, Variola virus
augucuucaauuc

SEQ ID NO: 4076315 - RNA, 18 nt, Variola virus
augugacucuaguaacuc

SEQ ID NO: 4076316 - RNA, 20 nt, Variola virus
augugauuuuaucaaacaug

SEQ ID NO: 4076317 - RNA, 13 nt, Variola virus
auguggaauuaug

SEQ ID NO: 4076318 - RNA, 14 nt, Variola virus
augugguaaaagaa

SEQ ID NO: 4076319 - RNA, 18 nt, Variola virus
auguguaaaaaguuuuaa

SEQ ID NO: 4076320 - RNA, 14 nt, Variola virus
auguguagaauuaa

SEQ ID NO: 4076321 - RNA, 22 nt, Variola virus
augugucuacauaaauaugcaa

SEQ ID NO: 4076322 - RNA, 13 nt, Variola virus
gauguaguaauau

SEQ ID NO: 4076323 - RNA, 15 nt, Variola virus
gauguauaaguuuua

SEQ ID NO: 4076324 - RNA, 17 nt, Variola virus
gauguaucacacgcucu

SEQ ID NO: 4076325 - RNA, 18 nt, Variola virus
gaugucaaaggaugaaag

SEQ ID NO: 4076326 - RNA, 17 nt, Variola virus
gaugucaagaucuuuug

SEQ ID NO: 4076327 - RNA, 20 nt, Variola virus
gauguugauuaggucuuuua

SEQ ID NO: 4076328 - RNA, 16 nt, Variola virus
gauguuuuuagaaaau

SEQ ID NO: 4076329 - RNA, 21 nt, Variola virus
gauuaaaaauaaaguuaucau

SEQ ID NO: 4076330 - RNA, 22 nt, Variola virus
gauuaaacuuuaaugauugcau

SEQ ID NO: 4076331 - RNA, 22 nt, Variola virus
gauuaaggacuuuuauauccca

SEQ ID NO: 4076332 - RNA, 22 nt, Variola virus
gauuaauaauucauggaaauuu

SEQ ID NO: 4076333 - RNA, 12 nt, Variola virus
gauuaauguuuu

SEQ ID NO: 4076334 - RNA, 15 nt, Variola virus
gauuacaagaaauau

SEQ ID NO: 4076335 - RNA, 20 nt, Variola virus
gauuacuuugacaaauguag

SEQ ID NO: 4076336 - RNA, 22 nt, Variola virus
gauuaucguuuucaucuuuuau

SEQ ID NO: 4076337 - RNA, 16 nt, Variola virus
gauuauucacuauaau

SEQ ID NO: 4076338 - RNA, 12 nt, Variola virus
gauuauuuucau

SEQ ID NO: 4076339 - RNA, 15 nt, Variola virus
gauucaacauuuaua

SEQ ID NO: 4076340 - RNA, 13 nt, Variola virus
gauucacaaauau

SEQ ID NO: 4076341 - RNA, 15 nt, Variola virus
gauucacaauuuaua

SEQ ID NO: 4076342 - RNA, 14 nt, Variola virus
gauuccauauacca

SEQ ID NO: 4076343 - RNA, 19 nt, Variola virus
gauuccauggaagaacuac

SEQ ID NO: 4076344 - RNA, 14 nt, Variola virus
gauucuaaugauuu

SEQ ID NO: 4076345 - RNA, 18 nt, Variola virus
gauucucuacucuagaua

SEQ ID NO: 4076346 - RNA, 22 nt, Variola virus
gauucugauaacauaaaaauau

SEQ ID NO: 4076347 - RNA, 21 nt, Variola virus
gauugcauauuauauuuuaua

SEQ ID NO: 4076348 - RNA, 23 nt, Variola virus
gauuggucuuaaaagauauuaau

SEQ ID NO: 4076349 - RNA, 19 nt, Variola virus
gauuguuuauuguauauac

SEQ ID NO: 4076350 - RNA, 18 nt, Variola virus
gauuuacgcaaacuauau

SEQ ID NO: 4076351 - RNA, 16 nt, Variola virus
gauuuccaaucuuuug

SEQ ID NO: 4076352 - RNA, 22 nt, Variola virus
gauuuuauuuaguguagauaug

SEQ ID NO: 4076353 - RNA, 12 nt, Variola virus
gauuuucuggga

SEQ ID NO: 4076354 - RNA, 23 nt, Variola virus
gauuuuuuuaaaaaauagaaaaa

SEQ ID NO: 4076355 - RNA, 16 nt, Variola virus
gcaaaaauaauaugau

SEQ ID NO: 4076356 - RNA, 22 nt, Variola virus
gcaacggggaugaugauaauga

SEQ ID NO: 4076357 - RNA, 17 nt, Variola virus
gcaacuauuuauuucua

SEQ ID NO: 4076358 - RNA, 16 nt, Variola virus
gcaagaacauaaugau

SEQ ID NO: 4076359 - RNA, 22 nt, Variola virus
gcaaguaggauuuuuccaaagu

SEQ ID NO: 4076360 - RNA, 15 nt, Variola virus
gcaauaaauaugauu

SEQ ID NO: 4076361 - RNA, 12 nt, Variola virus
gcaauaauacaa

SEQ ID NO: 4076362 - RNA, 17 nt, Variola virus
gcaaucuaacauuuuua

SEQ ID NO: 4076363 - RNA, 15 nt, Variola virus
gcaauuauauaaugu

SEQ ID NO: 4076364 - RNA, 16 nt, Variola virus
gcaauuauauaaugua

SEQ ID NO: 4076365 - RNA, 21 nt, Variola virus
gcaccauucauaauuacagaa

SEQ ID NO: 4076366 - RNA, 12 nt, Variola virus
gcacgaacaaaa

SEQ ID NO: 4076367 - RNA, 21 nt, Variola virus
gcacgccguauacucuauagu

SEQ ID NO: 4076368 - RNA, 17 nt, Variola virus
gcacuacuguuaagaau

SEQ ID NO: 4076369 - RNA, 14 nt, Variola virus
gcagaauagauauu

SEQ ID NO: 4076370 - RNA, 14 nt, Variola virus
gcagaauauuucua

SEQ ID NO: 4076371 - RNA, 17 nt, Variola virus
gcagacaaaaugaagau

SEQ ID NO: 4076372 - RNA, 21 nt, Variola virus
gcagguaugauagcuccacca

SEQ ID NO: 4076373 - RNA, 17 nt, Variola virus
gcaguaauauuguuaau

SEQ ID NO: 4076374 - RNA, 19 nt, Variola virus
gcagucauuccaucauuua

SEQ ID NO: 4076375 - RNA, 23 nt, Variola virus
gcaguuagaacgguuauagcauc

SEQ ID NO: 4076376 - RNA, 15 nt, Variola virus
gcauaccauacuuag

SEQ ID NO: 4076377 - RNA, 16 nt, Variola virus
gcauagauguauauag

SEQ ID NO: 4076378 - RNA, 17 nt, Variola virus
gcauaggaacauuucug

SEQ ID NO: 4076379 - RNA, 23 nt, Variola virus
gcaucauacgaaaauagauucua

SEQ ID NO: 4076380 - RNA, 12 nt, Variola virus
gcauccauccaa

SEQ ID NO: 4076381 - RNA, 19 nt, Variola virus
gcaucuauauaaucuuuuu

SEQ ID NO: 4076382 - RNA, 19 nt, Variola virus
gcaugauaauauagaagau

SEQ ID NO: 4076383 - RNA, 17 nt, Variola virus
gcauggucuuguaauau

SEQ ID NO: 4076384 - RNA, 19 nt, Variola virus
gcauuaacaaaaucuuuaa

SEQ ID NO: 4076385 - RNA, 23 nt, Variola virus
gccaaaaaauccuguaauacuuu

SEQ ID NO: 4076386 - RNA, 19 nt, Variola virus
gccaaauguucaauaucua

SEQ ID NO: 4076387 - RNA, 18 nt, Variola virus
gccaacagguuaaagaaa

SEQ ID NO: 4076388 - RNA, 17 nt, Variola virus
gccaaucuauaauagau

SEQ ID NO: 4076389 - RNA, 14 nt, Variola virus
gccauuauuagaaa

SEQ ID NO: 4076390 - RNA, 20 nt, Variola virus
gccauugaaaacuauuucuu

SEQ ID NO: 4076391 - RNA, 19 nt, Variola virus
gccauugcuggauuacauc

SEQ ID NO: 4076392 - RNA, 14 nt, Variola virus
gccauuuguuuugu

SEQ ID NO: 4076393 - RNA, 15 nt, Variola virus
gccggcagucacauc

SEQ ID NO: 4076394 - RNA, 19 nt, Variola virus
gccgguugccgcaaauaga

SEQ ID NO: 4076395 - RNA, 13 nt, Variola virus
gccucuagauaua

SEQ ID NO: 4076396 - RNA, 20 nt, Variola virus
gccucuagauauagcuuuua

SEQ ID NO: 4076397 - RNA, 22 nt, Variola virus
gccuuauucucuggagaaaaga

SEQ ID NO: 4076398 - RNA, 15 nt, Variola virus
gcgauaauagauagu

SEQ ID NO: 4076399 - RNA, 17 nt, Variola virus
gcgaucugaauaaacaa

SEQ ID NO: 4076400 - RNA, 18 nt, Variola virus
gcgauuguagauaaugaa

SEQ ID NO: 4076401 - RNA, 11 nt, Variola virus
gcgcaugauuu

SEQ ID NO: 4076402 - RNA, 13 nt, Variola virus
gcgccaaauugug

SEQ ID NO: 4076403 - RNA, 13 nt, Variola virus
gcgcuaucuuuua

SEQ ID NO: 4076404 - RNA, 16 nt, Variola virus
gcggagauuuaaucug

SEQ ID NO: 4076405 - RNA, 17 nt, Variola virus
gcggcuuaauaaauguu

SEQ ID NO: 4076406 - RNA, 17 nt, Variola virus
gcgguaaacauucaugu

SEQ ID NO: 4076407 - RNA, 11 nt, Variola virus
gcguacaaaag

SEQ ID NO: 4076408 - RNA, 22 nt, Variola virus
gcgucuaguagauaugcuuuua

SEQ ID NO: 4076409 - RNA, 20 nt, Variola virus
gcgugaacaacuuacagaug

SEQ ID NO: 4076410 - RNA, 11 nt, Variola virus
gcguuaaacau

SEQ ID NO: 4076411 - RNA, 22 nt, Variola virus
gcuaauauuuuauuacaaucau

SEQ ID NO: 4076412 - RNA, 24 nt, Variola virus
gcuacacaaauaccaaucaaaaga

SEQ ID NO: 4076413 - RNA, 15 nt, Variola virus
gcuacagaaagguag

SEQ ID NO: 4076414 - RNA, 15 nt, Variola virus
gcuaccaaaguuauu

SEQ ID NO: 4076415 - RNA, 11 nt, Variola virus
gcuauaaugau

SEQ ID NO: 4076416 - RNA, 20 nt, Variola virus
gcuauagaggacaauaauau

SEQ ID NO: 4076417 - RNA, 14 nt, Variola virus
gcuauauaaaucau

SEQ ID NO: 4076418 - RNA, 18 nt, Variola virus
gcuauauaauaaauguau

SEQ ID NO: 4076419 - RNA, 23 nt, Variola virus
gcuauauagaugacgauccuuua

SEQ ID NO: 4076420 - RNA, 17 nt, Variola virus
gcuauauggauauucau

SEQ ID NO: 4076421 - RNA, 17 nt, Variola virus
gcuaugaaggaaagaca

SEQ ID NO: 4076422 - RNA, 14 nt, Variola virus
gcuauuaaucuuua

SEQ ID NO: 4076423 - RNA, 16 nt, Variola virus
gcucaaacaaaaugug

SEQ ID NO: 4076424 - RNA, 15 nt, Variola virus
gcucaguaaauguau

SEQ ID NO: 4076425 - RNA, 14 nt, Variola virus
gcuccauauuacaa

SEQ ID NO: 4076426 - RNA, 12 nt, Variola virus
gcucuacaaaau

SEQ ID NO: 4076427 - RNA, 18 nt, Variola virus
gcugaacacguuaaacaa

SEQ ID NO: 4076428 - RNA, 21 nt, Variola virus
gcugaaguaaucaauuuuucu

SEQ ID NO: 4076429 - RNA, 16 nt, Variola virus
gcugcaucuaaauuaa

SEQ ID NO: 4076430 - RNA, 23 nt, Variola virus
gcugcuaugauaauuagaucauu

SEQ ID NO: 4076431 - RNA, 19 nt, Variola virus
gcugcuggaucuaaauauu

SEQ ID NO: 4076432 - RNA, 14 nt, Variola virus
gcugguaaaguaaa

SEQ ID NO: 4076433 - RNA, 23 nt, Variola virus
gcugguaauaguuuacagauauu

SEQ ID NO: 4076434 - RNA, 16 nt, Variola virus
gcuguacuaaauucaa

SEQ ID NO: 4076435 - RNA, 19 nt, Variola virus
gcuguuccucuguaaauaa

SEQ ID NO: 4076436 - RNA, 22 nt, Variola virus
gcuuauaucagguauaauagau

SEQ ID NO: 4076437 - RNA, 22 nt, Variola virus
gcuuccagauacagugauuuug

SEQ ID NO: 4076438 - RNA, 14 nt, Variola virus
gcuugaaaauggac

SEQ ID NO: 4076439 - RNA, 14 nt, Variola virus
gcuuguauguguua

SEQ ID NO: 4076440 - RNA, 19 nt, Variola virus
gcuuuaauaucuaaauaug

SEQ ID NO: 4076441 - RNA, 18 nt, Variola virus
gcuuuuuugacauauuaa

SEQ ID NO: 4076442 - RNA, 23 nt, Variola virus
ggaaaaaaaucuuuuuuuauucu

SEQ ID NO: 4076443 - RNA, 11 nt, Variola virus
ggaaaaagcuc

SEQ ID NO: 4076444 - RNA, 22 nt, Variola virus
ggaaaacuuuaauaacaaagaa

SEQ ID NO: 4076445 - RNA, 23 nt, Variola virus
ggaaaagaauuuaccagauaucu

SEQ ID NO: 4076446 - RNA, 11 nt, Variola virus
ggaaaaugaug

SEQ ID NO: 4076447 - RNA, 22 nt, Variola virus
ggaaaucacaaugacuuuauca

SEQ ID NO: 4076448 - RNA, 18 nt, Variola virus
uaaggguccuacaaccau

SEQ ID NO: 4076449 - RNA, 15 nt, Variola virus
uaaguuacaggaacu

SEQ ID NO: 4076450 - RNA, 19 nt, Variola virus
uaaguuccauuacaaauau

SEQ ID NO: 4076451 - RNA, 21 nt, Variola virus
uaauaaaaguggaagucauuu

SEQ ID NO: 4076452 - RNA, 15 nt, Variola virus
uaauaaaauuauuca

SEQ ID NO: 4076453 - RNA, 14 nt, Variola virus
uaauaaauguuucg

SEQ ID NO: 4076454 - RNA, 13 nt, Variola virus
uaauaaauuuauu

SEQ ID NO: 4076455 - RNA, 13 nt, Variola virus
uaauaacaaguau

SEQ ID NO: 4076456 - RNA, 21 nt, Variola virus
uaauaacaugcgguucaaaau

SEQ ID NO: 4076457 - RNA, 19 nt, Variola virus
uaauaauuuguauauacau

SEQ ID NO: 4076458 - RNA, 16 nt, Variola virus
uaauacauauuauuca

SEQ ID NO: 4076459 - RNA, 16 nt, Variola virus
uaauacccauguuuaa

SEQ ID NO: 4076460 - RNA, 20 nt, Variola virus
uaauacccugguagaagaau

SEQ ID NO: 4076461 - RNA, 15 nt, Variola virus
uaauagaauuuauau

SEQ ID NO: 4076462 - RNA, 13 nt, Variola virus
uaauagacuauau

SEQ ID NO: 4076463 - RNA, 16 nt, Variola virus
uaauagauauaucucu

SEQ ID NO: 4076464 - RNA, 20 nt, Variola virus
uaauagaucaacagaaauau

SEQ ID NO: 4076465 - RNA, 15 nt, Variola virus
uaauaguuuaucaua

SEQ ID NO: 4076466 - RNA, 19 nt, Variola virus
uaauaguuuaucauacuua

SEQ ID NO: 4076467 - RNA, 21 nt, Variola virus
uaauauaaaaacuuauuacau

SEQ ID NO: 4076468 - RNA, 20 nt, Variola virus
uaauauaaaucaaauacuug

SEQ ID NO: 4076469 - RNA, 14 nt, Variola virus
uaauauaauacuaa

SEQ ID NO: 4076470 - RNA, 13 nt, Variola virus
uaauauaauauua

SEQ ID NO: 4076471 - RNA, 21 nt, Variola virus
uaauauaucuuauaucucguu

SEQ ID NO: 4076472 - RNA, 19 nt, Variola virus
uaauaucccacauugucau

SEQ ID NO: 4076473 - RNA, 17 nt, Variola virus
uaauauccgcuauuaca

SEQ ID NO: 4076474 - RNA, 22 nt, Variola virus
uaauauccuuauccgacuuuau

SEQ ID NO: 4076475 - RNA, 19 nt, Variola virus
uaauauuaaaaauaagaau

SEQ ID NO: 4076476 - RNA, 14 nt, Variola virus
uaauauuagaauau

SEQ ID NO: 4076477 - RNA, 20 nt, Variola virus
uaauauuaucuauaugaugg

SEQ ID NO: 4076478 - RNA, 14 nt, Variola virus
uaauauucauuaag

SEQ ID NO: 4076479 - RNA, 19 nt, Variola virus
uaauauucguauuuugcau

SEQ ID NO: 4076480 - RNA, 14 nt, Variola virus
uaauauucuaaaac

SEQ ID NO: 4076481 - RNA, 12 nt, Variola virus
uaauauugugaa

SEQ ID NO: 4076482 - RNA, 23 nt, Variola virus
uaauauugugaaugguaaagaau

SEQ ID NO: 4076483 - RNA, 12 nt, Variola virus
uaauauuguuaa

SEQ ID NO: 4076484 - RNA, 14 nt, Variola virus
uaauauuguuaauu

SEQ ID NO: 4076485 - RNA, 20 nt, Variola virus
uaaucaaaauugucuaugau

SEQ ID NO: 4076486 - RNA, 22 nt, Variola virus
uaaucaaauuugguguuguuaa

SEQ ID NO: 4076487 - RNA, 17 nt, Variola virus
uaaucagauucuuauau

SEQ ID NO: 4076488 - RNA, 23 nt, Variola virus
uaaucaguacguucuucauuuau

SEQ ID NO: 4076489 - RNA, 20 nt, Variola virus
uaaucagucauaacaaaugu

SEQ ID NO: 4076490 - RNA, 21 nt, Variola virus
uaauccaaauaugauauguga

SEQ ID NO: 4076491 - RNA, 16 nt, Variola virus
uaauccagucuuuaau

SEQ ID NO: 4076492 - RNA, 15 nt, Variola virus
uaauccuguguuuau

SEQ ID NO: 4076493 - RNA, 23 nt, Variola virus
uaauccuuuuuauuuauccucuc

SEQ ID NO: 4076494 - RNA, 14 nt, Variola virus
uaaucgauuuugca

SEQ ID NO: 4076495 - RNA, 20 nt, Variola virus
uaaucgucgaacguucuagu

SEQ ID NO: 4076496 - RNA, 20 nt, Variola virus
uaaucguguauaacaucuuu

SEQ ID NO: 4076497 - RNA, 14 nt, Variola virus
uaaucguuaucauu

SEQ ID NO: 4076498 - RNA, 17 nt, Variola virus
uaaucguuauuaucauc

SEQ ID NO: 4076499 - RNA, 20 nt, Variola virus
uaaucguuauuaucaucauu

SEQ ID NO: 4076500 - RNA, 21 nt, Variola virus
uaaucuaaaauaguucuguaa

SEQ ID NO: 4076501 - RNA, 19 nt, Variola virus
uaaucuauaaaacaaucau

SEQ ID NO: 4076502 - RNA, 21 nt, Variola virus
uaaucuguacuucuauacaaa

SEQ ID NO: 4076503 - RNA, 17 nt, Variola virus
uaaucuuacugaguuua

SEQ ID NO: 4076504 - RNA, 15 nt, Variola virus
uaaugaauuaguguu

SEQ ID NO: 4076505 - RNA, 23 nt, Variola virus
uaaugagcaaguagaaaaccucu

SEQ ID NO: 4076506 - RNA, 13 nt, Variola virus
uaaugauaaauuu

SEQ ID NO: 4076507 - RNA, 17 nt, Variola virus
uaaugaucuauggauua

SEQ ID NO: 4076508 - RNA, 20 nt, Variola virus
uaaugaugaccuauaugccc

SEQ ID NO: 4076509 - RNA, 15 nt, Variola virus
uaaugauugcauauu

SEQ ID NO: 4076510 - RNA, 14 nt, Variola virus
uaaugugaauuuag

SEQ ID NO: 4076511 - RNA, 18 nt, Variola virus
uaaugugaauuuagcaua

SEQ ID NO: 4076512 - RNA, 12 nt, Variola virus
uaauguuguauu

SEQ ID NO: 4076513 - RNA, 16 nt, Variola virus
uaauguuuaauuuauc

SEQ ID NO: 4076514 - RNA, 14 nt, Variola virus
uaauuacauacuuu

SEQ ID NO: 4076515 - RNA, 15 nt, Variola virus
uaauuacuaaaucug

SEQ ID NO: 4076516 - RNA, 16 nt, Variola virus
uaauuauaagaaauau

SEQ ID NO: 4076517 - RNA, 15 nt, Variola virus
uaauuauagauguau

SEQ ID NO: 4076518 - RNA, 17 nt, Variola virus
uaauucagauacuacag

SEQ ID NO: 4076519 - RNA, 18 nt, Variola virus
uaauucauuuucaauaau

SEQ ID NO: 4076520 - RNA, 14 nt, Variola virus
uaauugcuuuucua

SEQ ID NO: 4076521 - RNA, 20 nt, Variola virus
uaauuguuuaccgguguaau

SEQ ID NO: 4076522 - RNA, 16 nt, Variola virus
uaauuuuagaagcuau

SEQ ID NO: 4076523 - RNA, 15 nt, Variola virus
uaauuuuucauuaac

SEQ ID NO: 4076524 - RNA, 13 nt, Variola virus
uacaaaacgacuu

SEQ ID NO: 4076525 - RNA, 18 nt, Variola virus
uacaaaauaauagauaua

SEQ ID NO: 4076526 - RNA, 19 nt, Variola virus
uacaaacuuuuccuuuucc

SEQ ID NO: 4076527 - RNA, 13 nt, Variola virus
uacaaauagagau

SEQ ID NO: 4076528 - RNA, 20 nt, Variola virus
uacaaauuacaauaaugcag

SEQ ID NO: 4076529 - RNA, 17 nt, Variola virus
uacaaauuuuaagaaau

SEQ ID NO: 4076530 - RNA, 16 nt, Variola virus
uacaacauuccaaaga

SEQ ID NO: 4076531 - RNA, 16 nt, Variola virus
uacaaccaaauucuug

SEQ ID NO: 4076532 - RNA, 12 nt, Variola virus
uacaacuaguga

SEQ ID NO: 4076533 - RNA, 16 nt, Variola virus
uacaauacacacaaua

SEQ ID NO: 4076534 - RNA, 17 nt, Variola virus
uacaauacgauaaacau

SEQ ID NO: 4076535 - RNA, 17 nt, Variola virus
uacaaucaauaauauag

SEQ ID NO: 4076536 - RNA, 14 nt, Variola virus
uacaauuuuaucau

SEQ ID NO: 4076537 - RNA, 17 nt, Variola virus
uacacaaggcauugucu

SEQ ID NO: 4076538 - RNA, 14 nt, Variola virus
uacacaccaaugga

SEQ ID NO: 4076539 - RNA, 12 nt, Variola virus
uacacauaauga

SEQ ID NO: 4076540 - RNA, 20 nt, Variola virus
uacacauauggaauauaucu

SEQ ID NO: 4076541 - RNA, 16 nt, Variola virus
uacacguaccagcauu

SEQ ID NO: 4076542 - RNA, 13 nt, Variola virus
uacacuauuauau

SEQ ID NO: 4076543 - RNA, 16 nt, Variola virus
uacagaaacaaugauu

SEQ ID NO: 4076544 - RNA, 20 nt, Variola virus
uacagagauguacagcuucc

SEQ ID NO: 4076545 - RNA, 19 nt, Variola virus
uacagauguaaauauaucu

SEQ ID NO: 4076546 - RNA, 22 nt, Variola virus
uacaggaucuagcaaaggaaau

SEQ ID NO: 4076547 - RNA, 13 nt, Variola virus
uacaguucuucua

SEQ ID NO: 4076548 - RNA, 16 nt, Variola virus
uacauaaaaaaaaugu

SEQ ID NO: 4076549 - RNA, 13 nt, Variola virus
uacauaaaugucu

SEQ ID NO: 4076550 - RNA, 18 nt, Variola virus
uacauaggcaacaucaga

SEQ ID NO: 4076551 - RNA, 15 nt, Variola virus
uacaucgcauacaaa

SEQ ID NO: 4076552 - RNA, 19 nt, Variola virus
uacaucgguaucuagaucu

SEQ ID NO: 4076553 - RNA, 14 nt, Variola virus
uacaucuguuuccu

SEQ ID NO: 4076554 - RNA, 23 nt, Variola virus
uacaugaaauagaagauagauau

SEQ ID NO: 4076555 - RNA, 17 nt, Variola virus
uacauguauuaaagaau

SEQ ID NO: 4076556 - RNA, 21 nt, Variola virus
uacauuuuuaaacuguuugua

SEQ ID NO: 4076557 - RNA, 22 nt, Variola virus
uaccaaagacuuugaaauauag

SEQ ID NO: 4076558 - RNA, 17 nt, Variola virus
uaccaaccuacacuauu

SEQ ID NO: 4076559 - RNA, 14 nt, Variola virus
uaccaaucauuuau

SEQ ID NO: 4076560 - RNA, 18 nt, Variola virus
uaccaaucauuuauugau

SEQ ID NO: 4076561 - RNA, 22 nt, Variola virus
uaccacgcaauuauauaaugua

SEQ ID NO: 4076562 - RNA, 14 nt, Variola virus
uaccacuagcaaaa

SEQ ID NO: 4076563 - RNA, 18 nt, Variola virus
uaccagugauuauccauu

SEQ ID NO: 4076564 - RNA, 23 nt, Variola virus
uaccaucuucuuugauuaaugau

SEQ ID NO: 4076565 - RNA, 23 nt, Variola virus
uaccaugacuccucuucauacag

SEQ ID NO: 4076566 - RNA, 18 nt, Variola virus
uacccaacaauacauuua

SEQ ID NO: 4076567 - RNA, 13 nt, Variola virus
uacccuuccaaau

SEQ ID NO: 4076568 - RNA, 12 nt, Variola virus
uaccgaaaauaa

SEQ ID NO: 4076569 - RNA, 15 nt, Variola virus
uaccgauuuaucauc

SEQ ID NO: 4076570 - RNA, 13 nt, Variola virus
uaccgguguauau

SEQ ID NO: 4076571 - RNA, 17 nt, Variola virus
uaccguugugucuacaa

SEQ ID NO: 4076572 - RNA, 17 nt, Variola virus
uaccguuguuacuccau

SEQ ID NO: 4076573 - RNA, 21 nt, Variola virus
uaccuaauacuaaauacauua

SEQ ID NO: 4076574 - RNA, 15 nt, Variola virus
auguuuuauuaauuu

SEQ ID NO: 4076575 - RNA, 15 nt, Variola virus
auuaaaaauaaaguu

SEQ ID NO: 4076576 - RNA, 15 nt, Variola virus
auuaaaaauuuccau

SEQ ID NO: 4076577 - RNA, 22 nt, Variola virus
auuaaaauaaauauucuucaua

SEQ ID NO: 4076578 - RNA, 15 nt, Variola virus
auuaaacuaauucau

SEQ ID NO: 4076579 - RNA, 20 nt, Variola virus
auuaaacuaauucauuuuca

SEQ ID NO: 4076580 - RNA, 17 nt, Variola virus
auuaaacucuacauaau

SEQ ID NO: 4076581 - RNA, 22 nt, Variola virus
auuaaagauacaaaacguaauu

SEQ ID NO: 4076582 - RNA, 16 nt, Variola virus
auuaaaggauguacuc

SEQ ID NO: 4076583 - RNA, 19 nt, Variola virus
auuaaauagaauauuuaac

SEQ ID NO: 4076584 - RNA, 20 nt, Variola virus
auuaaauaucauuuuuugaa

SEQ ID NO: 4076585 - RNA, 13 nt, Variola virus
auuaaaucaauau

SEQ ID NO: 4076586 - RNA, 19 nt, Variola virus
auuaacaaaaucuuuaauu

SEQ ID NO: 4076587 - RNA, 14 nt, Variola virus
auuaacaagaauac

SEQ ID NO: 4076588 - RNA, 23 nt, Variola virus
auuaacaagaauacgucaaggaa

SEQ ID NO: 4076589 - RNA, 16 nt, Variola virus
auuaacaagucauuua

SEQ ID NO: 4076590 - RNA, 22 nt, Variola virus
auuaacgaguucaaauaugaaa

SEQ ID NO: 4076591 - RNA, 16 nt, Variola virus
auuaacgguaauacau

SEQ ID NO: 4076592 - RNA, 16 nt, Variola virus
auuaacguuccuaauu

SEQ ID NO: 4076593 - RNA, 22 nt, Variola virus
auuaacuccgaggcacauacau

SEQ ID NO: 4076594 - RNA, 20 nt, Variola virus
auuaacuuuaacaugucuac

SEQ ID NO: 4076595 - RNA, 16 nt, Variola virus
auuaacuuuguucauu

SEQ ID NO: 4076596 - RNA, 22 nt, Variola virus
auuaagcaacaugucuuuaaau

SEQ ID NO: 4076597 - RNA, 23 nt, Variola virus
auuaaggacuuuuauaucccaca

SEQ ID NO: 4076598 - RNA, 21 nt, Variola virus
auuaaguucuggcaauguuuc

SEQ ID NO: 4076599 - RNA, 19 nt, Variola virus
auuaauaacauuacauauu

SEQ ID NO: 4076600 - RNA, 15 nt, Variola virus
auuaauaauauaauu

SEQ ID NO: 4076601 - RNA, 21 nt, Variola virus
auuaauacaggaucuagcaaa

SEQ ID NO: 4076602 - RNA, 13 nt, Variola virus
auuaauacauauu

SEQ ID NO: 4076603 - RNA, 19 nt, Variola virus
auuaauacggaauauagau

SEQ ID NO: 4076604 - RNA, 12 nt, Variola virus
auuaauccaugg

SEQ ID NO: 4076605 - RNA, 19 nt, Variola virus
auuaaucuaguagaaaaga

SEQ ID NO: 4076606 - RNA, 19 nt, Variola virus
auuaaugcccaauuuggau

SEQ ID NO: 4076607 - RNA, 17 nt, Variola virus
auuaaugcuacagauau

SEQ ID NO: 4076608 - RNA, 10 nt, Variola virus
auuaauuaaa

SEQ ID NO: 4076609 - RNA, 13 nt, Variola virus
auuacaaaaacua

SEQ ID NO: 4076610 - RNA, 14 nt, Variola virus
auuacaaaagaaac

SEQ ID NO: 4076611 - RNA, 15 nt, Variola virus
auuacaaauacuuua

SEQ ID NO: 4076612 - RNA, 14 nt, Variola virus
auuacaauuaauaa

SEQ ID NO: 4076613 - RNA, 19 nt, Variola virus
auuacauccgaaaaaguug

SEQ ID NO: 4076614 - RNA, 20 nt, Variola virus
auuacauuuuuauaaauaga

SEQ ID NO: 4076615 - RNA, 22 nt, Variola virus
auuaccaggguucuuguuauau

SEQ ID NO: 4076616 - RNA, 15 nt, Variola virus
auuaccaucauauau

SEQ ID NO: 4076617 - RNA, 19 nt, Variola virus
auuaccaucguuguugaau

SEQ ID NO: 4076618 - RNA, 15 nt, Variola virus
auuaccaucucuaag

SEQ ID NO: 4076619 - RNA, 22 nt, Variola virus
auuaccaucucuaaguuucuuu

SEQ ID NO: 4076620 - RNA, 18 nt, Variola virus
auuacgaguugacacauu

SEQ ID NO: 4076621 - RNA, 20 nt, Variola virus
auuacguauuauauauguaa

SEQ ID NO: 4076622 - RNA, 16 nt, Variola virus
auuacuaauaaagaag

SEQ ID NO: 4076623 - RNA, 21 nt, Variola virus
auuacucuccuagguuucucu

SEQ ID NO: 4076624 - RNA, 18 nt, Variola virus
auuacuugauauaguaau

SEQ ID NO: 4076625 - RNA, 14 nt, Variola virus
auuacuuuaauagu

SEQ ID NO: 4076626 - RNA, 22 nt, Variola virus
auuagaaauacacuuacagaaa

SEQ ID NO: 4076627 - RNA, 17 nt, Variola virus
auuagaauagucucuuu

SEQ ID NO: 4076628 - RNA, 15 nt, Variola virus
auuagauaugccaaa

SEQ ID NO: 4076629 - RNA, 15 nt, Variola virus
auuagcagaauagau

SEQ ID NO: 4076630 - RNA, 20 nt, Variola virus
auuagccgaacauauagcug

SEQ ID NO: 4076631 - RNA, 21 nt, Variola virus
auuagcgagguauuuauucau

SEQ ID NO: 4076632 - RNA, 17 nt, Variola virus
auuagcgauagaacguu

SEQ ID NO: 4076633 - RNA, 16 nt, Variola virus
auuaguaauuaaauau

SEQ ID NO: 4076634 - RNA, 17 nt, Variola virus
auuaguggaagaaagau

SEQ ID NO: 4076635 - RNA, 21 nt, Variola virus
auuaguuuuuuguuacugacu

SEQ ID NO: 4076636 - RNA, 16 nt, Variola virus
auuauacuguuaaaug

SEQ ID NO: 4076637 - RNA, 15 nt, Variola virus
auuauacuuugguaa

SEQ ID NO: 4076638 - RNA, 22 nt, Variola virus
auuauacuuuuuuuuggaaaug

SEQ ID NO: 4076639 - RNA, 15 nt, Variola virus
auuauagauuuucca

SEQ ID NO: 4076640 - RNA, 22 nt, Variola virus
auuauaucauugucuaauagau

SEQ ID NO: 4076641 - RNA, 14 nt, Variola virus
auuaucaaaaagaa

SEQ ID NO: 4076642 - RNA, 18 nt, Variola virus
auuaucaaaagacaugau

SEQ ID NO: 4076643 - RNA, 19 nt, Variola virus
auuaucaaaagacaugaua

SEQ ID NO: 4076644 - RNA, 20 nt, Variola virus
auuaucaaaauuuggaaacu

SEQ ID NO: 4076645 - RNA, 21 nt, Variola virus
auuaucauuagucauguuaaa

SEQ ID NO: 4076646 - RNA, 15 nt, Variola virus
auuaucauuuuguaa

SEQ ID NO: 4076647 - RNA, 15 nt, Variola virus
auuaucuauaugaug

SEQ ID NO: 4076648 - RNA, 18 nt, Variola virus
auuaucucagugcaaaga

SEQ ID NO: 4076649 - RNA, 20 nt, Variola virus
auuaucuuuguuuugauauc

SEQ ID NO: 4076650 - RNA, 15 nt, Variola virus
auuaugaaacuauau

SEQ ID NO: 4076651 - RNA, 23 nt, Variola virus
auuaugacaaaauuaaaaaagau

SEQ ID NO: 4076652 - RNA, 20 nt, Variola virus
auuaugcauucguuuaaaga

SEQ ID NO: 4076653 - RNA, 23 nt, Variola virus
auuauguaaauaucuuuaauaca

SEQ ID NO: 4076654 - RNA, 18 nt, Variola virus
auuauguuguuaugagug

SEQ ID NO: 4076655 - RNA, 18 nt, Variola virus
auuauuaaguauaauaga

SEQ ID NO: 4076656 - RNA, 21 nt, Variola virus
auuauuaauaauuuguauaua

SEQ ID NO: 4076657 - RNA, 18 nt, Variola virus
auuauuaaucauuaacuu

SEQ ID NO: 4076658 - RNA, 17 nt, Variola virus
auuauuacacauagcau

SEQ ID NO: 4076659 - RNA, 14 nt, Variola virus
auuauuacauagau

SEQ ID NO: 4076660 - RNA, 18 nt, Variola virus
auuauuacauagauguau

SEQ ID NO: 4076661 - RNA, 17 nt, Variola virus
auuauuaguugauguga

SEQ ID NO: 4076662 - RNA, 14 nt, Variola virus
auuauuaugaugau

SEQ ID NO: 4076663 - RNA, 16 nt, Variola virus
auuauuccuaauuaag

SEQ ID NO: 4076664 - RNA, 17 nt, Variola virus
auuauugauauucaugg

SEQ ID NO: 4076665 - RNA, 18 nt, Variola virus
auuauuguguuuguguag

SEQ ID NO: 4076666 - RNA, 21 nt, Variola virus
auuauuguguuuguguaguuc

SEQ ID NO: 4076667 - RNA, 18 nt, Variola virus
auuauuuaauuuaauaca

SEQ ID NO: 4076668 - RNA, 18 nt, Variola virus
auuauuuuauauucauuu

SEQ ID NO: 4076669 - RNA, 14 nt, Variola virus
auuauuuuucacca

SEQ ID NO: 4076670 - RNA, 16 nt, Variola virus
auucaaaauauuaaac

SEQ ID NO: 4076671 - RNA, 17 nt, Variola virus
auucaagauuuuauuau

SEQ ID NO: 4076672 - RNA, 20 nt, Variola virus
auucaagcgaauuacucugu

SEQ ID NO: 4076673 - RNA, 15 nt, Variola virus
auucaagucaaagaa

SEQ ID NO: 4076674 - RNA, 14 nt, Variola virus
auucaauauuguau

SEQ ID NO: 4076675 - RNA, 19 nt, Variola virus
auucaauuaguuuauuaau

SEQ ID NO: 4076676 - RNA, 15 nt, Variola virus
auucacaaauaugac

SEQ ID NO: 4076677 - RNA, 22 nt, Variola virus
auucacaccuagagacaaugaa

SEQ ID NO: 4076678 - RNA, 14 nt, Variola virus
auucacauaaaaga

SEQ ID NO: 4076679 - RNA, 18 nt, Variola virus
auucagaacacacuuuuc

SEQ ID NO: 4076680 - RNA, 22 nt, Variola virus
auucagaauuucuacauaauua

SEQ ID NO: 4076681 - RNA, 14 nt, Variola virus
auucagcugaaaug

SEQ ID NO: 4076682 - RNA, 14 nt, Variola virus
auucaguagcuaga

SEQ ID NO: 4076683 - RNA, 15 nt, Variola virus
auucaguaguguuua

SEQ ID NO: 4076684 - RNA, 13 nt, Variola virus
auucauauagaac

SEQ ID NO: 4076685 - RNA, 14 nt, Variola virus
auucaucuagaaug

SEQ ID NO: 4076686 - RNA, 23 nt, Variola virus
auucaugguaaggucuuagaaau

SEQ ID NO: 4076687 - RNA, 15 nt, Variola virus
auucauguugaacau

SEQ ID NO: 4076688 - RNA, 15 nt, Variola virus
auucauuaaggagau

SEQ ID NO: 4076689 - RNA, 14 nt, Variola virus
auucauuaauucua

SEQ ID NO: 4076690 - RNA, 13 nt, Variola virus
auucauugacaua

SEQ ID NO: 4076691 - RNA, 12 nt, Variola virus
auucauuucauu

SEQ ID NO: 4076692 - RNA, 16 nt, Variola virus
auucauuuucaauaau

SEQ ID NO: 4076693 - RNA, 16 nt, Variola virus
auuccaacgauauuaa

SEQ ID NO: 4076694 - RNA, 21 nt, Variola virus
auuccaagucacuauguguaa

SEQ ID NO: 4076695 - RNA, 16 nt, Variola virus
auuccacuuuaacauc

SEQ ID NO: 4076696 - RNA, 21 nt, Variola virus
auuccagauguuguaaaauua

SEQ ID NO: 4076697 - RNA, 15 nt, Variola virus
auuccaucuacuaag

SEQ ID NO: 4076698 - RNA, 18 nt, Variola virus
auuccauuaucugaaaug

SEQ ID NO: 4076699 - RNA, 21 nt, Variola virus
auucccuggcgcguuuaagau

SEQ ID NO: 4076700 - RNA, 18 nt, Variola virus
caaucauugauaucuuua

SEQ ID NO: 4076701 - RNA, 19 nt, Variola virus
caaucggauacagacacuc

SEQ ID NO: 4076702 - RNA, 21 nt, Variola virus
caaucggauuaauaucucuau

SEQ ID NO: 4076703 - RNA, 12 nt, Variola virus
caaucuaucuau

SEQ ID NO: 4076704 - RNA, 17 nt, Variola virus
caaucuuauaucuucuu

SEQ ID NO: 4076705 - RNA, 19 nt, Variola virus
caaugauaaugaaccaucu

SEQ ID NO: 4076706 - RNA, 19 nt, Variola virus
caaugccaucuuacaugau

SEQ ID NO: 4076707 - RNA, 13 nt, Variola virus
caaugcucaguaa

SEQ ID NO: 4076708 - RNA, 16 nt, Variola virus
caauggagaaauacuu

SEQ ID NO: 4076709 - RNA, 18 nt, Variola virus
caaugucugucauaugua

SEQ ID NO: 4076710 - RNA, 14 nt, Variola virus
caauuaaugauauu

SEQ ID NO: 4076711 - RNA, 15 nt, Variola virus
caauuaguuaauaau

SEQ ID NO: 4076712 - RNA, 17 nt, Variola virus
caauuaguuuauuggua

SEQ ID NO: 4076713 - RNA, 22 nt, Variola virus
caauuauaacaauuauaacaau

SEQ ID NO: 4076714 - RNA, 14 nt, Variola virus
caauucuauccauu

SEQ ID NO: 4076715 - RNA, 17 nt, Variola virus
caauuggaguaucaucu

SEQ ID NO: 4076716 - RNA, 20 nt, Variola virus
caauuguuuuuguacauaau

SEQ ID NO: 4076717 - RNA, 14 nt, Variola virus
caauuuccaacaaa

SEQ ID NO: 4076718 - RNA, 18 nt, Variola virus
caauuuuaacagauguau

SEQ ID NO: 4076719 - RNA, 19 nt, Variola virus
caauuuugauguauaacaa

SEQ ID NO: 4076720 - RNA, 13 nt, Variola virus
cacacucuacaau

SEQ ID NO: 4076721 - RNA, 13 nt, Variola virus
cacagaaauacug

SEQ ID NO: 4076722 - RNA, 14 nt, Variola virus
cacagucaaacauu

SEQ ID NO: 4076723 - RNA, 13 nt, Variola virus
cacagucaucaag

SEQ ID NO: 4076724 - RNA, 15 nt, Variola virus
cacauacaaaacuag

SEQ ID NO: 4076725 - RNA, 18 nt, Variola virus
cacaucgacggacaaucu

SEQ ID NO: 4076726 - RNA, 18 nt, Variola virus
uaaauuaguagaaaauac

SEQ ID NO: 4076727 - RNA, 14 nt, Variola virus
uaaauuauuucauu

SEQ ID NO: 4076728 - RNA, 16 nt, Variola virus
uaaauuguauaaguau

SEQ ID NO: 4076729 - RNA, 14 nt, Variola virus
uaaauuuuaauauu

SEQ ID NO: 4076730 - RNA, 16 nt, Variola virus
uaaauuuucuauacau

SEQ ID NO: 4076731 - RNA, 20 nt, Variola virus
uaacaaaaucaggaaaaaag

SEQ ID NO: 4076732 - RNA, 14 nt, Variola virus
uaacaaaauuaaag

SEQ ID NO: 4076733 - RNA, 13 nt, Variola virus
uaacaaauuaaag

SEQ ID NO: 4076734 - RNA, 21 nt, Variola virus
uaacaacgacuuauaauuaau

SEQ ID NO: 4076735 - RNA, 14 nt, Variola virus
uaacaaucuuauau

SEQ ID NO: 4076736 - RNA, 18 nt, Variola virus
uaacacacucuaccaguu

SEQ ID NO: 4076737 - RNA, 17 nt, Variola virus
uaacacauaccuuuuuc

SEQ ID NO: 4076738 - RNA, 23 nt, Variola virus
uaacaccuauaagauuaucaaaa

SEQ ID NO: 4076739 - RNA, 22 nt, Variola virus
uaacaguaucauuuaaacauuu

SEQ ID NO: 4076740 - RNA, 21 nt, Variola virus
uaacaucacuaauaucaauau

SEQ ID NO: 4076741 - RNA, 22 nt, Variola virus
uaacaugacauuuauucaucau

SEQ ID NO: 4076742 - RNA, 23 nt, Variola virus
uaacaugauaacugguguagaga

SEQ ID NO: 4076743 - RNA, 20 nt, Variola virus
uaacaugcgguucaaaauag

SEQ ID NO: 4076744 - RNA, 13 nt, Variola virus
uaacauguuaauu

SEQ ID NO: 4076745 - RNA, 19 nt, Variola virus
uaaccaccgauaaaucuag

SEQ ID NO: 4076746 - RNA, 22 nt, Variola virus
uaaccgauaaaaagacuuuuau

SEQ ID NO: 4076747 - RNA, 22 nt, Variola virus
uaaccggcgcugucauguaucc

SEQ ID NO: 4076748 - RNA, 13 nt, Variola virus
uaaccuuuuuagu

SEQ ID NO: 4076749 - RNA, 23 nt, Variola virus
uaacgaacgcggugugaauguac

SEQ ID NO: 4076750 - RNA, 17 nt, Variola virus
uaacgaggacaaacuau

SEQ ID NO: 4076751 - RNA, 15 nt, Variola virus
uaacgaggauacauc

SEQ ID NO: 4076752 - RNA, 13 nt, Variola virus
uaacggaugaaaa

SEQ ID NO: 4076753 - RNA, 18 nt, Variola virus
uaacuacggauaacaaaa

SEQ ID NO: 4076754 - RNA, 15 nt, Variola virus
uaacuacuaauguau

SEQ ID NO: 4076755 - RNA, 15 nt, Variola virus
uaacuauuaauauua

SEQ ID NO: 4076756 - RNA, 22 nt, Variola virus
uaacuccaggccguuuguuucc

SEQ ID NO: 4076757 - RNA, 19 nt, Variola virus
uaacucgguaucuacuuua

SEQ ID NO: 4076758 - RNA, 19 nt, Variola virus
uaacucuuucgaauacuua

SEQ ID NO: 4076759 - RNA, 16 nt, Variola virus
uaacugcuacacaaau

SEQ ID NO: 4076760 - RNA, 21 nt, Variola virus
uaacuuucuucggcaaacuua

SEQ ID NO: 4076761 - RNA, 15 nt, Variola virus
uaacuuuugauuuua

SEQ ID NO: 4076762 - RNA, 21 nt, Variola virus
uaacuuuuucuuucucagcau

SEQ ID NO: 4076763 - RNA, 21 nt, Variola virus
uaagaaacuaguuuauuguga

SEQ ID NO: 4076764 - RNA, 19 nt, Variola virus
uaagaacuggacuguauau

SEQ ID NO: 4076765 - RNA, 17 nt, Variola virus
uaagaauaauccagaau

SEQ ID NO: 4076766 - RNA, 21 nt, Variola virus
uaagaauucguuuuucaacau

SEQ ID NO: 4076767 - RNA, 20 nt, Variola virus
uaagacacagaaauacugua

SEQ ID NO: 4076768 - RNA, 17 nt, Variola virus
uaagacaugacacaaag

SEQ ID NO: 4076769 - RNA, 17 nt, Variola virus
uaagaccgaaauuauca

SEQ ID NO: 4076770 - RNA, 14 nt, Variola virus
uaagacgucucauu

SEQ ID NO: 4076771 - RNA, 18 nt, Variola virus
uaagacguuguaucucuu

SEQ ID NO: 4076772 - RNA, 17 nt, Variola virus
uaagacugcuaaaugua

SEQ ID NO: 4076773 - RNA, 19 nt, Variola virus
uaagagauaucuaucuauu

SEQ ID NO: 4076774 - RNA, 20 nt, Variola virus
uaagaucguagaucucccau

SEQ ID NO: 4076775 - RNA, 16 nt, Variola virus
uaagaugcaaacauua

SEQ ID NO: 4076776 - RNA, 15 nt, Variola virus
uaagauuaucaaaau

SEQ ID NO: 4076777 - RNA, 17 nt, Variola virus
uaaguauaaacuauaaa

SEQ ID NO: 4076778 - RNA, 21 nt, Variola virus
uaaguaugucgaaucuaaacu

SEQ ID NO: 4076779 - RNA, 19 nt, Variola virus
uaaguauucacaaacggga

SEQ ID NO: 4076780 - RNA, 17 nt, Variola virus
uaaguauuuauacaaac

SEQ ID NO: 4076781 - RNA, 22 nt, Variola virus
uaaguauuuggcuagucaagau

SEQ ID NO: 4076782 - RNA, 20 nt, Variola virus
uaagugcgaugauuguacac

SEQ ID NO: 4076783 - RNA, 21 nt, Variola virus
uaaguuacagcgacacgguau

SEQ ID NO: 4076784 - RNA, 23 nt, Variola virus
uaaguuacugcugcaucauauaa

SEQ ID NO: 4076785 - RNA, 15 nt, Variola virus
uaaguucauaaucau

SEQ ID NO: 4076786 - RNA, 13 nt, Variola virus
uaaguucuuuaua

SEQ ID NO: 4076787 - RNA, 18 nt, Variola virus
uaaguucuuugaucucuu

SEQ ID NO: 4076788 - RNA, 20 nt, Variola virus
uaaguuuauaaauuccacaa

SEQ ID NO: 4076789 - RNA, 13 nt, Variola virus
uaauaaaauguca

SEQ ID NO: 4076790 - RNA, 15 nt, Variola virus
uaauaaaguguauau

SEQ ID NO: 4076791 - RNA, 19 nt, Variola virus
uaauaaauaaaucugaacc

SEQ ID NO: 4076792 - RNA, 19 nt, Variola virus
uaauaaauugguaaauccu

SEQ ID NO: 4076793 - RNA, 13 nt, Variola virus
uaauaagaaauau

SEQ ID NO: 4076794 - RNA, 13 nt, Variola virus
uaauaagauaaau

SEQ ID NO: 4076795 - RNA, 19 nt, Variola virus
uaauaaugauucaacaaug

SEQ ID NO: 4076796 - RNA, 16 nt, Variola virus
uaauacaaaauuuuca

SEQ ID NO: 4076797 - RNA, 15 nt, Variola virus
uaauacacacaaagu

SEQ ID NO: 4076798 - RNA, 20 nt, Variola virus
uaauacagcauccaacuuga

SEQ ID NO: 4076799 - RNA, 17 nt, Variola virus
uaauacgaaaugucuga

SEQ ID NO: 4076800 - RNA, 15 nt, Variola virus
uaauacgaguuauau

SEQ ID NO: 4076801 - RNA, 17 nt, Variola virus
uaauacuaauuauauca

SEQ ID NO: 4076802 - RNA, 15 nt, Variola virus
uaauagaaaaugaau

SEQ ID NO: 4076803 - RNA, 15 nt, Variola virus
uaauagacuaucaga

SEQ ID NO: 4076804 - RNA, 14 nt, Variola virus
uaauagauuucuag

SEQ ID NO: 4076805 - RNA, 17 nt, Variola virus
uaauagcauaaaugcua

SEQ ID NO: 4076806 - RNA, 13 nt, Variola virus
uaauaguaaauga

SEQ ID NO: 4076807 - RNA, 14 nt, Variola virus
uaauaguguuugaa

SEQ ID NO: 4076808 - RNA, 21 nt, Variola virus
uaauauaaaagaauauguaua

SEQ ID NO: 4076809 - RNA, 13 nt, Variola virus
uaauauagaagau

SEQ ID NO: 4076810 - RNA, 22 nt, Variola virus
uaauaucaaacgguaacacauc

SEQ ID NO: 4076811 - RNA, 17 nt, Variola virus
uaauaucagaauugucu

SEQ ID NO: 4076812 - RNA, 21 nt, Variola virus
uaauauguuggucuaucuauu

SEQ ID NO: 4076813 - RNA, 17 nt, Variola virus
uaauauuacuguuaaua

SEQ ID NO: 4076814 - RNA, 17 nt, Variola virus
uaauauuaguacuauau

SEQ ID NO: 4076815 - RNA, 22 nt, Variola virus
uaauauucauucaauauuuaca

SEQ ID NO: 4076816 - RNA, 15 nt, Variola virus
uaauauugaaaauac

SEQ ID NO: 4076817 - RNA, 18 nt, Variola virus
uaauauuucuauuucuau

SEQ ID NO: 4076818 - RNA, 15 nt, Variola virus
uaauauuuuauuaca

SEQ ID NO: 4076819 - RNA, 19 nt, Variola virus
uaauauuuuauuucaaaau

SEQ ID NO: 4076820 - RNA, 16 nt, Variola virus
uaaucaaaaucuuaau

SEQ ID NO: 4076821 - RNA, 21 nt, Variola virus
uaaucagucauaacaaaugua

SEQ ID NO: 4076822 - RNA, 22 nt, Variola virus
uaaucauguacucauaaaacga

SEQ ID NO: 4076823 - RNA, 13 nt, Variola virus
uaaucauuaucca

SEQ ID NO: 4076824 - RNA, 12 nt, Variola virus
uaaucuauuuua

SEQ ID NO: 4076825 - RNA, 19 nt, Variola virus
uaaucucuucuuuaacagu

SEQ ID NO: 4076826 - RNA, 15 nt, Variola virus
uaaucuuuguuggau

SEQ ID NO: 4076827 - RNA, 15 nt, Variola virus
uaaugaacaaauccu

SEQ ID NO: 4076828 - RNA, 17 nt, Variola virus
uaaugagcaaauuuauu

SEQ ID NO: 4076829 - RNA, 15 nt, Variola virus
uaaugauagaauuau

SEQ ID NO: 4076830 - RNA, 15 nt, Variola virus
uaaugauauaucuug

SEQ ID NO: 4076831 - RNA, 21 nt, Variola virus
uaaugauugcccauagaguau

SEQ ID NO: 4076832 - RNA, 19 nt, Variola virus
uaauggucgaaacacguca

SEQ ID NO: 4076833 - RNA, 17 nt, Variola virus
uaauguuguuaccauau

SEQ ID NO: 4076834 - RNA, 18 nt, Variola virus
uaauuaauuucucguaaa

SEQ ID NO: 4076835 - RNA, 15 nt, Variola virus
uaauuacagaauuau

SEQ ID NO: 4076836 - RNA, 23 nt, Variola virus
uaauuacgcucuacaaaauguca

SEQ ID NO: 4076837 - RNA, 17 nt, Variola virus
uaauucauuaauuuuca

SEQ ID NO: 4076838 - RNA, 16 nt, Variola virus
uaauuccguuaauauu

SEQ ID NO: 4076839 - RNA, 21 nt, Variola virus
uaauuccguuaauauuaaaaa

SEQ ID NO: 4076840 - RNA, 15 nt, Variola virus
uaauucuccugaaaa

SEQ ID NO: 4076841 - RNA, 15 nt, Variola virus
uaauucuuucuccac

SEQ ID NO: 4076842 - RNA, 18 nt, Variola virus
uaauugcucguugguauu

SEQ ID NO: 4076843 - RNA, 18 nt, Variola virus
uaauuucuuuauuaucua

SEQ ID NO: 4076844 - RNA, 16 nt, Variola virus
uaauuuguauauacau

SEQ ID NO: 4076845 - RNA, 20 nt, Variola virus
uaauuuuagauaauauacca

SEQ ID NO: 4076846 - RNA, 18 nt, Variola virus
uaauuuuauauuccucua

SEQ ID NO: 4076847 - RNA, 17 nt, Variola virus
uaauuuuaucaagacau

SEQ ID NO: 4076848 - RNA, 16 nt, Variola virus
uacaaaaaauaaaaga

SEQ ID NO: 4076849 - RNA, 13 nt, Variola virus
uacaaaaacauac

SEQ ID NO: 4076850 - RNA, 22 nt, Variola virus
uacaaacgauuauuagaucuuu

SEQ ID NO: 4076851 - RNA, 16 nt, Variola virus
uacaaauauuauacau

SEQ ID NO: 4076852 - RNA, 13 nt, Variola virus
uagagaucuaauu

SEQ ID NO: 4076853 - RNA, 16 nt, Variola virus
uagagauuauaucuuu

SEQ ID NO: 4076854 - RNA, 22 nt, Variola virus
uagagcccacguuuaaacauuc

SEQ ID NO: 4076855 - RNA, 17 nt, Variola virus
uagaggacuuggauguu

SEQ ID NO: 4076856 - RNA, 13 nt, Variola virus
uagaggaucuauu

SEQ ID NO: 4076857 - RNA, 19 nt, Variola virus
uagaggaucuauuagaugu

SEQ ID NO: 4076858 - RNA, 12 nt, Variola virus
uagauaaaucaa

SEQ ID NO: 4076859 - RNA, 16 nt, Variola virus
uagauacaacgucauc

SEQ ID NO: 4076860 - RNA, 15 nt, Variola virus
uagauauaaauucaa

SEQ ID NO: 4076861 - RNA, 14 nt, Variola virus
uagauauagauguu

SEQ ID NO: 4076862 - RNA, 21 nt, Variola virus
uagauauagcuuuuauuucca

SEQ ID NO: 4076863 - RNA, 20 nt, Variola virus
uagauaucaaauccaaugga

SEQ ID NO: 4076864 - RNA, 15 nt, Variola virus
uagaucaucugaaaa

SEQ ID NO: 4076865 - RNA, 17 nt, Variola virus
uagaucauuugaaauua

SEQ ID NO: 4076866 - RNA, 12 nt, Variola virus
uagauccaagga

SEQ ID NO: 4076867 - RNA, 22 nt, Variola virus
uagaucuuccaaucuaucuauu

SEQ ID NO: 4076868 - RNA, 22 nt, Variola virus
uagaucuuuuacacuguuaaag

SEQ ID NO: 4076869 - RNA, 19 nt, Variola virus
uagaugaacuuuaauucaa

SEQ ID NO: 4076870 - RNA, 16 nt, Variola virus
uagaugcaucuaaaag

SEQ ID NO: 4076871 - RNA, 19 nt, Variola virus
uagaugccauaucauacau

SEQ ID NO: 4076872 - RNA, 19 nt, Variola virus
uagaugguauuucugaaag

SEQ ID NO: 4076873 - RNA, 14 nt, Variola virus
uagaugguucuuua

SEQ ID NO: 4076874 - RNA, 21 nt, Variola virus
uagauguaguaauaucugauu

SEQ ID NO: 4076875 - RNA, 19 nt, Variola virus
uagauguauauauuucauu

SEQ ID NO: 4076876 - RNA, 23 nt, Variola virus
uagaugucaaugaagaguacaca

SEQ ID NO: 4076877 - RNA, 17 nt, Variola virus
uagaugucgaagacuua

SEQ ID NO: 4076878 - RNA, 16 nt, Variola virus
uagauuauaauccuua

SEQ ID NO: 4076879 - RNA, 21 nt, Variola virus
uagauuauaauccuuauacau

SEQ ID NO: 4076880 - RNA, 21 nt, Variola virus
uagauuaugaagaauacucua

SEQ ID NO: 4076881 - RNA, 15 nt, Variola virus
uagauucacauaaag

SEQ ID NO: 4076882 - RNA, 18 nt, Variola virus
uagcaaaacuauuucaga

SEQ ID NO: 4076883 - RNA, 19 nt, Variola virus
uagcaacaguaguucuugc

SEQ ID NO: 4076884 - RNA, 23 nt, Variola virus
uagcaagauuuuuaaacaacaau

SEQ ID NO: 4076885 - RNA, 16 nt, Variola virus
uagcagauagauaaag

SEQ ID NO: 4076886 - RNA, 16 nt, Variola virus
uagcagcacaaaucaa

SEQ ID NO: 4076887 - RNA, 16 nt, Variola virus
uagcagccaauacuuu

SEQ ID NO: 4076888 - RNA, 14 nt, Variola virus
uagccaccauaaug

SEQ ID NO: 4076889 - RNA, 15 nt, Variola virus
uagccuauguuagga

SEQ ID NO: 4076890 - RNA, 17 nt, Variola virus
uagccuuaagaaaacua

SEQ ID NO: 4076891 - RNA, 13 nt, Variola virus
uagcggaugaaaa

SEQ ID NO: 4076892 - RNA, 20 nt, Variola virus
uagcguugcuucuacauaaa

SEQ ID NO: 4076893 - RNA, 17 nt, Variola virus
uagcuaaaaaaauagua

SEQ ID NO: 4076894 - RNA, 12 nt, Variola virus
uagcuaauauua

SEQ ID NO: 4076895 - RNA, 23 nt, Variola virus
uagcuaucucgucucucaacaaa

SEQ ID NO: 4076896 - RNA, 23 nt, Variola virus
uagcuaugaacuuguuuaaugau

SEQ ID NO: 4076897 - RNA, 17 nt, Variola virus
uagcucuguuaguuucc

SEQ ID NO: 4076898 - RNA, 15 nt, Variola virus
uagcuuuaacagugg

SEQ ID NO: 4076899 - RNA, 21 nt, Variola virus
uaggaaaggagugcauagaua

SEQ ID NO: 4076900 - RNA, 21 nt, Variola virus
uaggaaauuuugugcaacgaa

SEQ ID NO: 4076901 - RNA, 21 nt, Variola virus
uaggaccacuagcaaaagaua

SEQ ID NO: 4076902 - RNA, 13 nt, Variola virus
uaggauucucauc

SEQ ID NO: 4076903 - RNA, 14 nt, Variola virus
uaggauuuaaacaa

SEQ ID NO: 4076904 - RNA, 21 nt, Variola virus
uaggguaaucuuguaucuauu

SEQ ID NO: 4076905 - RNA, 12 nt, Variola virus
uagguaauaacu

SEQ ID NO: 4076906 - RNA, 21 nt, Variola virus
uagguauuguuuucacgguau

SEQ ID NO: 4076907 - RNA, 17 nt, Variola virus
uaggugaacaagagaua

SEQ ID NO: 4076908 - RNA, 15 nt, Variola virus
uaggugcaauagcau

SEQ ID NO: 4076909 - RNA, 22 nt, Variola virus
uagguuguuuauugauauacua

SEQ ID NO: 4076910 - RNA, 15 nt, Variola virus
uagguuuacuaaaau

SEQ ID NO: 4076911 - RNA, 17 nt, Variola virus
uaguaaucguuaucauu

SEQ ID NO: 4076912 - RNA, 18 nt, Variola virus
uaguaccaaauucuucua

SEQ ID NO: 4076913 - RNA, 18 nt, Variola virus
uaguauauggacaaacgu

SEQ ID NO: 4076914 - RNA, 20 nt, Variola virus
uaguaucaauccaacaaaug

SEQ ID NO: 4076915 - RNA, 17 nt, Variola virus
uaguauuccaauaucug

SEQ ID NO: 4076916 - RNA, 16 nt, Variola virus
uagucauaauaucuuu

SEQ ID NO: 4076917 - RNA, 17 nt, Variola virus
uagucauagaugaaaua

SEQ ID NO: 4076918 - RNA, 18 nt, Variola virus
uagucuguguuacauaau

SEQ ID NO: 4076919 - RNA, 16 nt, Variola virus
uagugaccaacucauc

SEQ ID NO: 4076920 - RNA, 12 nt, Variola virus
uagugaccauau

SEQ ID NO: 4076921 - RNA, 20 nt, Variola virus
uagugcuauggaacaaaaua

SEQ ID NO: 4076922 - RNA, 22 nt, Variola virus
uaguggaguaauuuacaaauug

SEQ ID NO: 4076923 - RNA, 23 nt, Variola virus
uaguguaccaauaugcgaaucau

SEQ ID NO: 4076924 - RNA, 18 nt, Variola virus
uaguuaaucuuauucaag

SEQ ID NO: 4076925 - RNA, 21 nt, Variola virus
uaguuagcgucaacuuucaua

SEQ ID NO: 4076926 - RNA, 21 nt, Variola virus
uaguucugaccagcaacucau

SEQ ID NO: 4076927 - RNA, 16 nt, Variola virus
uaguugcauagaugua

SEQ ID NO: 4076928 - RNA, 17 nt, Variola virus
uaguuuauuccaaucau

SEQ ID NO: 4076929 - RNA, 20 nt, Variola virus
uaguuuccuuaacaaaucua

SEQ ID NO: 4076930 - RNA, 20 nt, Variola virus
uaguuuccuuuuuauaaaau

SEQ ID NO: 4076931 - RNA, 22 nt, Variola virus
uaguuucugguuuucuauaaau

SEQ ID NO: 4076932 - RNA, 13 nt, Variola virus
uaguuucuguaac

SEQ ID NO: 4076933 - RNA, 14 nt, Variola virus
uaguuuuaagaaag

SEQ ID NO: 4076934 - RNA, 14 nt, Variola virus
uaguuuucuaaaau

SEQ ID NO: 4076935 - RNA, 24 nt, Variola virus
uaguuuuguaauaucuauagcauc

SEQ ID NO: 4076936 - RNA, 16 nt, Variola virus
uaguuuuucuaccuca

SEQ ID NO: 4076937 - RNA, 21 nt, Variola virus
uaguuuuuuuagaaaauucua

SEQ ID NO: 4076938 - RNA, 18 nt, Variola virus
uauaaaaacauuauucua

SEQ ID NO: 4076939 - RNA, 18 nt, Variola virus
uauaaaacuacuacaaug

SEQ ID NO: 4076940 - RNA, 17 nt, Variola virus
uauaaaauagaaaauaa

SEQ ID NO: 4076941 - RNA, 19 nt, Variola virus
uauaaaauucccaaucuug

SEQ ID NO: 4076942 - RNA, 20 nt, Variola virus
uauaaacauuuguguuugua

SEQ ID NO: 4076943 - RNA, 18 nt, Variola virus
uauaaacgaguauagcau

SEQ ID NO: 4076944 - RNA, 17 nt, Variola virus
uauaaacucucaacauu

SEQ ID NO: 4076945 - RNA, 14 nt, Variola virus
uauaaaguguaugu

SEQ ID NO: 4076946 - RNA, 17 nt, Variola virus
uauaaauagacaaacaa

SEQ ID NO: 4076947 - RNA, 15 nt, Variola virus
uauaacauuaauauu

SEQ ID NO: 4076948 - RNA, 16 nt, Variola virus
uauaacuucuaaucuu

SEQ ID NO: 4076949 - RNA, 17 nt, Variola virus
uauaagacgauacuguu

SEQ ID NO: 4076950 - RNA, 13 nt, Variola virus
uauaauaaaugua

SEQ ID NO: 4076951 - RNA, 18 nt, Variola virus
uauaauaaauguauacau

SEQ ID NO: 4076952 - RNA, 15 nt, Variola virus
uauaauaucuuugaa

SEQ ID NO: 4076953 - RNA, 13 nt, Variola virus
uauaauauuuccu

SEQ ID NO: 4076954 - RNA, 14 nt, Variola virus
uauaaucaaagauu

SEQ ID NO: 4076955 - RNA, 17 nt, Variola virus
uauaauccgauauauga

SEQ ID NO: 4076956 - RNA, 16 nt, Variola virus
uauaaucgcuuuccag

SEQ ID NO: 4076957 - RNA, 13 nt, Variola virus
uauaaucuauaaa

SEQ ID NO: 4076958 - RNA, 20 nt, Variola virus
uauaaucuucgucuauuaca

SEQ ID NO: 4076959 - RNA, 22 nt, Variola virus
uauaauguucaccauuuauaua

SEQ ID NO: 4076960 - RNA, 17 nt, Variola virus
uauaauuuaccgcuaua

SEQ ID NO: 4076961 - RNA, 15 nt, Variola virus
uauaauuuuuggaca

SEQ ID NO: 4076962 - RNA, 15 nt, Variola virus
uauacaagauugaaa

SEQ ID NO: 4076963 - RNA, 18 nt, Variola virus
uauacaaguguagaugau

SEQ ID NO: 4076964 - RNA, 16 nt, Variola virus
uauacagcauuacauu

SEQ ID NO: 4076965 - RNA, 16 nt, Variola virus
uauacaguauaaugau

SEQ ID NO: 4076966 - RNA, 21 nt, Variola virus
uauaccaaggauaaaauauca

SEQ ID NO: 4076967 - RNA, 17 nt, Variola virus
uauaccaauauuauucu

SEQ ID NO: 4076968 - RNA, 13 nt, Variola virus
uauacuccauuaa

SEQ ID NO: 4076969 - RNA, 16 nt, Variola virus
uauacuguuaaaugua

SEQ ID NO: 4076970 - RNA, 11 nt, Variola virus
uauacuuguca

SEQ ID NO: 4076971 - RNA, 16 nt, Variola virus
uauacuugucaucauu

SEQ ID NO: 4076972 - RNA, 15 nt, Variola virus
uauagaaauuuugau

SEQ ID NO: 4076973 - RNA, 22 nt, Variola virus
uauagaauguuuccaaugagua

SEQ ID NO: 4076974 - RNA, 22 nt, Variola virus
uauagauggagguaauuggcau

SEQ ID NO: 4076975 - RNA, 19 nt, Variola virus
uauagcuauucuucuuuaa

SEQ ID NO: 4076976 - RNA, 13 nt, Variola virus
uauaguaucuauu

SEQ ID NO: 4076977 - RNA, 15 nt, Variola virus
uauaguggauccauu

SEQ ID NO: 4076978 - RNA, 11 nt, Variola virus
uauauguuucu

SEQ ID NO: 4076979 - RNA, 17 nt, Variola virus
uauauuaucauagaccu

SEQ ID NO: 4076980 - RNA, 12 nt, Variola virus
uauauucaauau

SEQ ID NO: 4076981 - RNA, 18 nt, Variola virus
uauauucagggacacuca

SEQ ID NO: 4076982 - RNA, 14 nt, Variola virus
uauauucuaucaua

SEQ ID NO: 4076983 - RNA, 13 nt, Variola virus
uauauucuaugau

SEQ ID NO: 4076984 - RNA, 23 nt, Variola virus
uauauucuuuaaauggaacagac

SEQ ID NO: 4076985 - RNA, 20 nt, Variola virus
uauauugccuccauagcauu

SEQ ID NO: 4076986 - RNA, 18 nt, Variola virus
uauauuuguuaacuacau

SEQ ID NO: 4076987 - RNA, 14 nt, Variola virus
uauauuuuauacau

SEQ ID NO: 4076988 - RNA, 14 nt, Variola virus
uauauuuuuggauu

SEQ ID NO: 4076989 - RNA, 11 nt, Variola virus
uaucaaagaua

SEQ ID NO: 4076990 - RNA, 12 nt, Variola virus
uaucaaaucuag

SEQ ID NO: 4076991 - RNA, 15 nt, Variola virus
uaucaagacauaugc

SEQ ID NO: 4076992 - RNA, 17 nt, Variola virus
uaucaauccaacaaaug

SEQ ID NO: 4076993 - RNA, 18 nt, Variola virus
uaucacuaucuucaucau

SEQ ID NO: 4076994 - RNA, 17 nt, Variola virus
uaucaucgacacaaaug

SEQ ID NO: 4076995 - RNA, 15 nt, Variola virus
uaucaucuguaagau

SEQ ID NO: 4076996 - RNA, 12 nt, Variola virus
uaucaucuuuuc

SEQ ID NO: 4076997 - RNA, 17 nt, Variola virus
uaucaugaauuagauau

SEQ ID NO: 4076998 - RNA, 14 nt, Variola virus
uaucauuaauacag

SEQ ID NO: 4076999 - RNA, 15 nt, Variola virus
uauccagaugagucc

SEQ ID NO: 4077000 - RNA, 17 nt, Variola virus
uauccagcuaacuuauu

SEQ ID NO: 4077001 - RNA, 14 nt, Variola virus
uauccucaaacauc

SEQ ID NO: 4077002 - RNA, 18 nt, Variola virus
uauccucuauuauacauu

SEQ ID NO: 4077003 - RNA, 15 nt, Variola virus
uaucgauaauuauuu

SEQ ID NO: 4077004 - RNA, 14 nt, Variola virus
uaucgauguacaca

SEQ ID NO: 4077005 - RNA, 17 nt, Variola virus
uaucgcgauugcauaga

SEQ ID NO: 4077006 - RNA, 22 nt, Variola virus
uaucgcuaaaaucuucaucaaa

SEQ ID NO: 4077007 - RNA, 22 nt, Variola virus
uaucguauauuaaguugggaga

SEQ ID NO: 4077008 - RNA, 17 nt, Variola virus
uaucuaaccauucaauu

SEQ ID NO: 4077009 - RNA, 15 nt, Variola virus
uaucuaauaauauua

SEQ ID NO: 4077010 - RNA, 12 nt, Variola virus
uaucuacaauua

SEQ ID NO: 4077011 - RNA, 19 nt, Variola virus
uaucuacauauuuaccaaa

SEQ ID NO: 4077012 - RNA, 23 nt, Variola virus
uaucuaguguuccuaauaucaua

SEQ ID NO: 4077013 - RNA, 13 nt, Variola virus
uaucuauacauac

SEQ ID NO: 4077014 - RNA, 14 nt, Variola virus
uaucuauauaugua

SEQ ID NO: 4077015 - RNA, 15 nt, Variola virus
uaucuauguuaucau

SEQ ID NO: 4077016 - RNA, 23 nt, Variola virus
uaucucgcauccauauguuugga

SEQ ID NO: 4077017 - RNA, 14 nt, Variola virus
uaucuguuaccaua

SEQ ID NO: 4077018 - RNA, 21 nt, Variola virus
uaucuuaaagccauacauuua

SEQ ID NO: 4077019 - RNA, 18 nt, Variola virus
uaucuuaaauaacucauu

SEQ ID NO: 4077020 - RNA, 18 nt, Variola virus
uaucuucauaaaauacua

SEQ ID NO: 4077021 - RNA, 17 nt, Variola virus
uaucuuccgucaaggau

SEQ ID NO: 4077022 - RNA, 20 nt, Variola virus
uaucuuuagcuucugaaaua

SEQ ID NO: 4077023 - RNA, 13 nt, Variola virus
uaucuuuccaacu

SEQ ID NO: 4077024 - RNA, 21 nt, Variola virus
uaucuuuuagagguucccaau

SEQ ID NO: 4077025 - RNA, 16 nt, Variola virus
uaugaagauaaacacu

SEQ ID NO: 4077026 - RNA, 22 nt, Variola virus
uaugaauaucaggaaauguaua

SEQ ID NO: 4077027 - RNA, 21 nt, Variola virus
uaugaauccgaugaucucacu

SEQ ID NO: 4077028 - RNA, 13 nt, Variola virus
uaugaaucuggau

SEQ ID NO: 4077029 - RNA, 21 nt, Variola virus
uaugaauggauaccuguauua

SEQ ID NO: 4077030 - RNA, 12 nt, Variola virus
uaugacaaacuu

SEQ ID NO: 4077031 - RNA, 23 nt, Variola virus
uaugacaucaacuacaaaugaua

SEQ ID NO: 4077032 - RNA, 20 nt, Variola virus
uaugacgcgcguucaacauu

SEQ ID NO: 4077033 - RNA, 14 nt, Variola virus
uaugacuaaaucua

SEQ ID NO: 4077034 - RNA, 16 nt, Variola virus
uaugaggaaaaugauu

SEQ ID NO: 4077035 - RNA, 23 nt, Variola virus
uaugauacugucuauaauagcaa

SEQ ID NO: 4077036 - RNA, 16 nt, Variola virus
uaugauggguggauau

SEQ ID NO: 4077037 - RNA, 13 nt, Variola virus
uaugauucuaaua

SEQ ID NO: 4077038 - RNA, 18 nt, Variola virus
uaugcaaccguaucaaaa

SEQ ID NO: 4077039 - RNA, 21 nt, Variola virus
uaugcaccuagagguucuauu

SEQ ID NO: 4077040 - RNA, 19 nt, Variola virus
uauggaagaagaaauaaag

SEQ ID NO: 4077041 - RNA, 19 nt, Variola virus
uauggacgcagauagcuau

SEQ ID NO: 4077042 - RNA, 23 nt, Variola virus
uauggucucaucguuguuuagaa

SEQ ID NO: 4077043 - RNA, 23 nt, Variola virus
uauguaacagacgagauaguuuu

SEQ ID NO: 4077044 - RNA, 16 nt, Variola virus
uauguaagacuugugg

SEQ ID NO: 4077045 - RNA, 23 nt, Variola virus
uauguauacauaauauuaucaug

SEQ ID NO: 4077046 - RNA, 17 nt, Variola virus
uaugucaaaaauuguag

SEQ ID NO: 4077047 - RNA, 21 nt, Variola virus
uauguccauuaaaguuaaauu

SEQ ID NO: 4077048 - RNA, 19 nt, Variola virus
uaugucuguacaaauguua

SEQ ID NO: 4077049 - RNA, 19 nt, Variola virus
uauguuaacggaaaguauu

SEQ ID NO: 4077050 - RNA, 20 nt, Variola virus
uauguuaauacuuauucaua

SEQ ID NO: 4077051 - RNA, 15 nt, Variola virus
uauguucaacuuuga

SEQ ID NO: 4077052 - RNA, 13 nt, Variola virus
uauguugauuuau

SEQ ID NO: 4077053 - RNA, 16 nt, Variola virus
uauguuucuaaauuuu

SEQ ID NO: 4077054 - RNA, 19 nt, Variola virus
uauuaaaaaaaaauacuuu

SEQ ID NO: 4077055 - RNA, 16 nt, Variola virus
uauuaaaacuaucaau

SEQ ID NO: 4077056 - RNA, 18 nt, Variola virus
uauuaaaauuauuucuaa

SEQ ID NO: 4077057 - RNA, 22 nt, Variola virus
uauuaaacucuacauaaucaua

SEQ ID NO: 4077058 - RNA, 23 nt, Variola virus
uauuaacuacggauaacaaaaua

SEQ ID NO: 4077059 - RNA, 15 nt, Variola virus
uauuaagauuaucua

SEQ ID NO: 4077060 - RNA, 23 nt, Variola virus
uauuaauaagaaugacuccuaua

SEQ ID NO: 4077061 - RNA, 14 nt, Variola virus
uauuaauaagacuu

SEQ ID NO: 4077062 - RNA, 20 nt, Variola virus
uauuaauacaugucuuagau

SEQ ID NO: 4077063 - RNA, 13 nt, Variola virus
uauuaaucuuuuu

SEQ ID NO: 4077064 - RNA, 14 nt, Variola virus
uauuacaauuaaau

SEQ ID NO: 4077065 - RNA, 16 nt, Variola virus
uauuacacauaaacau

SEQ ID NO: 4077066 - RNA, 19 nt, Variola virus
uauuacauaauauauacag

SEQ ID NO: 4077067 - RNA, 15 nt, Variola virus
uauuacgguaucaaa

SEQ ID NO: 4077068 - RNA, 16 nt, Variola virus
uauuacgguaucaaaa

SEQ ID NO: 4077069 - RNA, 16 nt, Variola virus
uauuacguauuauaua

SEQ ID NO: 4077070 - RNA, 17 nt, Variola virus
uauuagauaauaaacag

SEQ ID NO: 4077071 - RNA, 16 nt, Variola virus
uauuagcacuaucaua

SEQ ID NO: 4077072 - RNA, 17 nt, Variola virus
uauuauaaaaaaguuuu

SEQ ID NO: 4077073 - RNA, 19 nt, Variola virus
uauuauaaacucucaacau

SEQ ID NO: 4077074 - RNA, 11 nt, Variola virus
uauuauacaug

SEQ ID NO: 4077075 - RNA, 20 nt, Variola virus
uauuaucaaaauuuggaaac

SEQ ID NO: 4077076 - RNA, 12 nt, Variola virus
uauuaucaagau

SEQ ID NO: 4077077 - RNA, 15 nt, Variola virus
uauuaucauuaguca

SEQ ID NO: 4077078 - RNA, 17 nt, Variola virus
uauuauccguauuucca

SEQ ID NO: 4077079 - RNA, 14 nt, Variola virus
uauuaucucagugc

SEQ ID NO: 4077080 - RNA, 19 nt, Variola virus
uauuauugauccaaucaaa

SEQ ID NO: 4077081 - RNA, 21 nt, Variola virus
uauuauuuaaugagaaacuua

SEQ ID NO: 4077082 - RNA, 21 nt, Variola virus
uauucaauuuuuguauaucua

SEQ ID NO: 4077083 - RNA, 21 nt, Variola virus
uauucacagucgccauuuagu

SEQ ID NO: 4077084 - RNA, 14 nt, Variola virus
uauucaucaucaaa

SEQ ID NO: 4077085 - RNA, 20 nt, Variola virus
uauucaucgucgacuaucaa

SEQ ID NO: 4077086 - RNA, 22 nt, Variola virus
ucauaacuugagagcauccagu

SEQ ID NO: 4077087 - RNA, 13 nt, Variola virus
ucauaagaacuau

SEQ ID NO: 4077088 - RNA, 15 nt, Variola virus
ucauaauaucuuuaa

SEQ ID NO: 4077089 - RNA, 16 nt, Variola virus
ucauacaugauauuca

SEQ ID NO: 4077090 - RNA, 22 nt, Variola virus
ucauagaugaaauacucuuuaa

SEQ ID NO: 4077091 - RNA, 19 nt, Variola virus
ucauauaucugcucuuaaa

SEQ ID NO: 4077092 - RNA, 15 nt, Variola virus
ucaucaauagacaua

SEQ ID NO: 4077093 - RNA, 15 nt, Variola virus
ucaucaucuucuggu

SEQ ID NO: 4077094 - RNA, 15 nt, Variola virus
ucauccaguugaaug

SEQ ID NO: 4077095 - RNA, 23 nt, Variola virus
ucaucgacuguacgauacauaau

SEQ ID NO: 4077096 - RNA, 20 nt, Variola virus
ucaucggacuuugugcauau

SEQ ID NO: 4077097 - RNA, 16 nt, Variola virus
ucaucguuauuuuuaa

SEQ ID NO: 4077098 - RNA, 17 nt, Variola virus
ucaucuagauaauggga

SEQ ID NO: 4077099 - RNA, 13 nt, Variola virus
ucaucuaugaaug

SEQ ID NO: 4077100 - RNA, 16 nt, Variola virus
ucaucugaaauuguca

SEQ ID NO: 4077101 - RNA, 13 nt, Variola virus
ucaucuucauagg

SEQ ID NO: 4077102 - RNA, 16 nt, Variola virus
ucaucuuugauauuua

SEQ ID NO: 4077103 - RNA, 22 nt, Variola virus
ucaugaacaaucacaagaauag

SEQ ID NO: 4077104 - RNA, 20 nt, Variola virus
ucaugaaccaauacaaugua

SEQ ID NO: 4077105 - RNA, 13 nt, Variola virus
ucaugaauacagu

SEQ ID NO: 4077106 - RNA, 21 nt, Variola virus
ucaugaugauuugguuguauu

SEQ ID NO: 4077107 - RNA, 21 nt, Variola virus
ucaugcauuuguuaguuauuc

SEQ ID NO: 4077108 - RNA, 22 nt, Variola virus
ucauggaauacauaaagaacga

SEQ ID NO: 4077109 - RNA, 15 nt, Variola virus
ucauggggcaaacau

SEQ ID NO: 4077110 - RNA, 22 nt, Variola virus
ucaugucugguaauucauauag

SEQ ID NO: 4077111 - RNA, 18 nt, Variola virus
ucauguguggaugcuacu

SEQ ID NO: 4077112 - RNA, 19 nt, Variola virus
ucauguuaacacucuacgu

SEQ ID NO: 4077113 - RNA, 16 nt, Variola virus
ucauguuauagaugug

SEQ ID NO: 4077114 - RNA, 17 nt, Variola virus
ucauuaauaauuucuag

SEQ ID NO: 4077115 - RNA, 16 nt, Variola virus
ucauuacuacuguaaa

SEQ ID NO: 4077116 - RNA, 15 nt, Variola virus
ucauuacucuaaaau

SEQ ID NO: 4077117 - RNA, 12 nt, Variola virus
ucauuagauguu

SEQ ID NO: 4077118 - RNA, 14 nt, Variola virus
ucauuauaaauucu

SEQ ID NO: 4077119 - RNA, 21 nt, Variola virus
ucauuaucgguguauuuucca

SEQ ID NO: 4077120 - RNA, 17 nt, Variola virus
ucauucaauauuuacaa

SEQ ID NO: 4077121 - RNA, 14 nt, Variola virus
ucauucauuccucc

SEQ ID NO: 4077122 - RNA, 19 nt, Variola virus
ucauucgcuuaacaucuuc

SEQ ID NO: 4077123 - RNA, 14 nt, Variola virus
ucauugucuaaaaa

SEQ ID NO: 4077124 - RNA, 20 nt, Variola virus
ucauuucaaccagagaaguu

SEQ ID NO: 4077125 - RNA, 12 nt, Variola virus
ucauuuccaaau

SEQ ID NO: 4077126 - RNA, 13 nt, Variola virus
ucauuuccaaauc

SEQ ID NO: 4077127 - RNA, 16 nt, Variola virus
ucauuuguguacccaa

SEQ ID NO: 4077128 - RNA, 23 nt, Variola virus
ucauuuuccagaugauauguaug

SEQ ID NO: 4077129 - RNA, 16 nt, Variola virus
uccaaauuuaauucuu

SEQ ID NO: 4077130 - RNA, 22 nt, Variola virus
uccaaguacgguaauagauuuu

SEQ ID NO: 4077131 - RNA, 23 nt, Variola virus
uccaaucuaagaaauuuaaaauu

SEQ ID NO: 4077132 - RNA, 14 nt, Variola virus
uccaauguguuuaa

SEQ ID NO: 4077133 - RNA, 15 nt, Variola virus
uccaauuuuauucua

SEQ ID NO: 4077134 - RNA, 14 nt, Variola virus
uccaauuuuucaga

SEQ ID NO: 4077135 - RNA, 16 nt, Variola virus
uccacauuaauacagc

SEQ ID NO: 4077136 - RNA, 19 nt, Variola virus
uccaccaucuaccauaauc

SEQ ID NO: 4077137 - RNA, 14 nt, Variola virus
uccagauaauaacc

SEQ ID NO: 4077138 - RNA, 13 nt, Variola virus
uccagauauauau

SEQ ID NO: 4077139 - RNA, 17 nt, Variola virus
uccagaugcgagagaau

SEQ ID NO: 4077140 - RNA, 17 nt, Variola virus
uccagaugucaugauau

SEQ ID NO: 4077141 - RNA, 11 nt, Variola virus
uccagauuuca

SEQ ID NO: 4077142 - RNA, 14 nt, Variola virus
uccauaaauuuaua

SEQ ID NO: 4077143 - RNA, 19 nt, Variola virus
uccauaaauuuauaauguu

SEQ ID NO: 4077144 - RNA, 22 nt, Variola virus
uccauauguuuggagcaaauau

SEQ ID NO: 4077145 - RNA, 19 nt, Variola virus
uccauauuuugcaauuucu

SEQ ID NO: 4077146 - RNA, 18 nt, Variola virus
uccaucuguggaaaauaa

SEQ ID NO: 4077147 - RNA, 19 nt, Variola virus
uccaugaucuguuuaucau

SEQ ID NO: 4077148 - RNA, 21 nt, Variola virus
uccaugcaacauuuccuacau

SEQ ID NO: 4077149 - RNA, 22 nt, Variola virus
uccauggaaaagauaaaguuuu

SEQ ID NO: 4077150 - RNA, 18 nt, Variola virus
uccaugucaaauagaguu

SEQ ID NO: 4077151 - RNA, 23 nt, Variola virus
uccauguucgagcauacuagcau

SEQ ID NO: 4077152 - RNA, 19 nt, Variola virus
uccauuauuuauuuacaga

SEQ ID NO: 4077153 - RNA, 14 nt, Variola virus
ucccaaauaucuuu

SEQ ID NO: 4077154 - RNA, 17 nt, Variola virus
ucccauucuaauacuuu

SEQ ID NO: 4077155 - RNA, 19 nt, Variola virus
ucccgccgauccuguauua

SEQ ID NO: 4077156 - RNA, 19 nt, Variola virus
uccgacaugcaaaaaugcu

SEQ ID NO: 4077157 - RNA, 15 nt, Variola virus
uccgccguucuaaug

SEQ ID NO: 4077158 - RNA, 15 nt, Variola virus
uccggucgaugauga

SEQ ID NO: 4077159 - RNA, 13 nt, Variola virus
uccgguuaauuuu

SEQ ID NO: 4077160 - RNA, 22 nt, Variola virus
uccguguaauccauaauccagu

SEQ ID NO: 4077161 - RNA, 14 nt, Variola virus
uccguuucuaaaaa

SEQ ID NO: 4077162 - RNA, 18 nt, Variola virus
uccuacaggaauaucuuu

SEQ ID NO: 4077163 - RNA, 15 nt, Variola virus
uccuauacucugaaa

SEQ ID NO: 4077164 - RNA, 11 nt, Variola virus
uccucaucugu

SEQ ID NO: 4077165 - RNA, 18 nt, Variola virus
uccucuucaacacaaagu

SEQ ID NO: 4077166 - RNA, 21 nt, Variola virus
uccuguaguauugauucuaga

SEQ ID NO: 4077167 - RNA, 13 nt, Variola virus
uccuuaaaguaac

SEQ ID NO: 4077168 - RNA, 15 nt, Variola virus
uccuugcaaauuccg

SEQ ID NO: 4077169 - RNA, 13 nt, Variola virus
ucgaaauaucuuu

SEQ ID NO: 4077170 - RNA, 15 nt, Variola virus
ucgaaauauguaaua

SEQ ID NO: 4077171 - RNA, 15 nt, Variola virus
ucgaauacaaauuuu

SEQ ID NO: 4077172 - RNA, 19 nt, Variola virus
ucgacaucuggauuucaga

SEQ ID NO: 4077173 - RNA, 18 nt, Variola virus
ucgacauucagaaagacg

SEQ ID NO: 4077174 - RNA, 23 nt, Variola virus
ucgacguaacuauauuccaaauu

SEQ ID NO: 4077175 - RNA, 17 nt, Variola virus
ucgauaacagcauuugu

SEQ ID NO: 4077176 - RNA, 17 nt, Variola virus
ucgauaacuguagucuu

SEQ ID NO: 4077177 - RNA, 11 nt, Variola virus
ucgauacuuuu

SEQ ID NO: 4077178 - RNA, 23 nt, Variola virus
ucgaucuuuggauauucuaacga

SEQ ID NO: 4077179 - RNA, 22 nt, Variola virus
ucgauucuggcuauuucaaaau

SEQ ID NO: 4077180 - RNA, 17 nt, Variola virus
ucgcaaauucuagucuu

SEQ ID NO: 4077181 - RNA, 14 nt, Variola virus
ucgcaacugucuuu

SEQ ID NO: 4077182 - RNA, 13 nt, Variola virus
ucgcagaugauga

SEQ ID NO: 4077183 - RNA, 16 nt, Variola virus
ucgcgcuaauuucuaa

SEQ ID NO: 4077184 - RNA, 15 nt, Variola virus
ucgcuaauuaugaaa

SEQ ID NO: 4077185 - RNA, 17 nt, Variola virus
ucggcaaucuuucucaa

SEQ ID NO: 4077186 - RNA, 22 nt, Variola virus
ucgggaccaauuacuaauaaag

SEQ ID NO: 4077187 - RNA, 14 nt, Variola virus
ucggucaacuuauu

SEQ ID NO: 4077188 - RNA, 14 nt, Variola virus
ucgguuaugaauga

SEQ ID NO: 4077189 - RNA, 20 nt, Variola virus
ucguacaguagagauauuug

SEQ ID NO: 4077190 - RNA, 14 nt, Variola virus
ucguauaaauacug

SEQ ID NO: 4077191 - RNA, 15 nt, Variola virus
ucguauaaauauccu

SEQ ID NO: 4077192 - RNA, 14 nt, Variola virus
ucguauacuagaaa

SEQ ID NO: 4077193 - RNA, 20 nt, Variola virus
ucgucaacaaguuggaugau

SEQ ID NO: 4077194 - RNA, 13 nt, Variola virus
ucgucucucuuag

SEQ ID NO: 4077195 - RNA, 21 nt, Variola virus
ucguguuuguguaguuuucac

SEQ ID NO: 4077196 - RNA, 20 nt, Variola virus
ucguuauaacucgagaauau

SEQ ID NO: 4077197 - RNA, 20 nt, Variola virus
ucguucaacugucuuucaag

SEQ ID NO: 4077198 - RNA, 22 nt, Variola virus
ucguuccaagucauaucuagaa

SEQ ID NO: 4077199 - RNA, 21 nt, Variola virus
ucguugguaggauaauacauc

SEQ ID NO: 4077200 - RNA, 19 nt, Variola virus
ucguuuaacgaucauauua

SEQ ID NO: 4077201 - RNA, 19 nt, Variola virus
ucguuuauaucacauugua

SEQ ID NO: 4077202 - RNA, 16 nt, Variola virus
ucguuuuucuuaagaa

SEQ ID NO: 4077203 - RNA, 16 nt, Variola virus
ucuaaaaaauccuuaa

SEQ ID NO: 4077204 - RNA, 21 nt, Variola virus
ucuaaaaauguuaauuuugaa

SEQ ID NO: 4077205 - RNA, 13 nt, Variola virus
ucuaaaauguaua

SEQ ID NO: 4077206 - RNA, 17 nt, Variola virus
ucuaaaauuacaaacaa

SEQ ID NO: 4077207 - RNA, 18 nt, Variola virus
ucuaaaccuucuuauuuu

SEQ ID NO: 4077208 - RNA, 16 nt, Variola virus
ucuaaguuaacacaug

SEQ ID NO: 4077209 - RNA, 16 nt, Variola virus
ucuaauaauuuggaua

SEQ ID NO: 4077210 - RNA, 14 nt, Variola virus
ucuaauacauaauu

SEQ ID NO: 4077211 - RNA, 23 nt, Variola virus
ucuaauauccauuuuacauuauu

SEQ ID NO: 4077212 - RNA, 13 nt, Variola virus
aaauaagagacuu

SEQ ID NO: 4077213 - RNA, 16 nt, Variola virus
aaauaaguaaaaagug

SEQ ID NO: 4077214 - RNA, 14 nt, Variola virus
aaauaauacuauau

SEQ ID NO: 4077215 - RNA, 13 nt, Variola virus
aaauaauccugaa

SEQ ID NO: 4077216 - RNA, 18 nt, Variola virus
aaauaauccugaauauau

SEQ ID NO: 4077217 - RNA, 16 nt, Variola virus
aaauaauuauucuuua

SEQ ID NO: 4077218 - RNA, 11 nt, Variola virus
aaauacuagua

SEQ ID NO: 4077219 - RNA, 13 nt, Variola virus
aaauacuuuauca

SEQ ID NO: 4077220 - RNA, 23 nt, Variola virus
aaauagaucucugguucuauguu

SEQ ID NO: 4077221 - RNA, 12 nt, Variola virus
aaauagauguua

SEQ ID NO: 4077222 - RNA, 18 nt, Variola virus
aaauagguuuuguucuau

SEQ ID NO: 4077223 - RNA, 18 nt, Variola virus
aaauaguaucaucuauca

SEQ ID NO: 4077224 - RNA, 14 nt, Variola virus
aaauaguucauuuu

SEQ ID NO: 4077225 - RNA, 13 nt, Variola virus
aaauauaacuauu

SEQ ID NO: 4077226 - RNA, 14 nt, Variola virus
aaauauauacauau

SEQ ID NO: 4077227 - RNA, 14 nt, Variola virus
aaauauauacuuca

SEQ ID NO: 4077228 - RNA, 20 nt, Variola virus
aaauauauaguauuaaugau

SEQ ID NO: 4077229 - RNA, 23 nt, Variola virus
aaauauauuagacaauacuacaa

SEQ ID NO: 4077230 - RNA, 11 nt, Variola virus
aaauaucucau

SEQ ID NO: 4077231 - RNA, 22 nt, Variola virus
aaauaucuuuaauacagaguuu

SEQ ID NO: 4077232 - RNA, 13 nt, Variola virus
aaauauguagaaa

SEQ ID NO: 4077233 - RNA, 14 nt, Variola virus
aaauauuuacuaau

SEQ ID NO: 4077234 - RNA, 20 nt, Variola virus
aaauauuucauuagauguua

SEQ ID NO: 4077235 - RNA, 20 nt, Variola virus
aaauauuuucguugugaaga

SEQ ID NO: 4077236 - RNA, 21 nt, Variola virus
aaaucaaacacaagaucuucu

SEQ ID NO: 4077237 - RNA, 21 nt, Variola virus
aaaucaaucaaggaacuaaau

SEQ ID NO: 4077238 - RNA, 18 nt, Variola virus
aaaucacacgaugugucu

SEQ ID NO: 4077239 - RNA, 16 nt, Variola virus
aaaucaguaacuaugu

SEQ ID NO: 4077240 - RNA, 21 nt, Variola virus
aaaucauaauaugagauguuu

SEQ ID NO: 4077241 - RNA, 13 nt, Variola virus
aaaucauccacag

SEQ ID NO: 4077242 - RNA, 19 nt, Variola virus
aaaucauccguuguuauau

SEQ ID NO: 4077243 - RNA, 15 nt, Variola virus
aaaucaucuuauuua

SEQ ID NO: 4077244 - RNA, 19 nt, Variola virus
aaaucauggggcaaacauu

SEQ ID NO: 4077245 - RNA, 12 nt, Variola virus
aaauccaaauuu

SEQ ID NO: 4077246 - RNA, 19 nt, Variola virus
aaauccauguucuaccaac

SEQ ID NO: 4077247 - RNA, 17 nt, Variola virus
aaauccuucaucacuuc

SEQ ID NO: 4077248 - RNA, 21 nt, Variola virus
aaauccuuguuugauaaaugu

SEQ ID NO: 4077249 - RNA, 20 nt, Variola virus
aaaucguauaaauacugucu

SEQ ID NO: 4077250 - RNA, 18 nt, Variola virus
aaaucucaguuaacgauu

SEQ ID NO: 4077251 - RNA, 17 nt, Variola virus
aaaugacuaauuuugua

SEQ ID NO: 4077252 - RNA, 23 nt, Variola virus
aaaugacuaauuuuguagcauua

SEQ ID NO: 4077253 - RNA, 20 nt, Variola virus
aaaugagguagcaaaaaaac

SEQ ID NO: 4077254 - RNA, 14 nt, Variola virus
aaaugauugaagaa

SEQ ID NO: 4077255 - RNA, 15 nt, Variola virus
aaaugcguacauaac

SEQ ID NO: 4077256 - RNA, 21 nt, Variola virus
aaaugcucugcaauaacuaau

SEQ ID NO: 4077257 - RNA, 18 nt, Variola virus
aaauggaagguauuucca

SEQ ID NO: 4077258 - RNA, 11 nt, Variola virus
aaauggauaag

SEQ ID NO: 4077259 - RNA, 18 nt, Variola virus
aaauguauaaaaacuaau

SEQ ID NO: 4077260 - RNA, 16 nt, Variola virus
aaaugucccucauaau

SEQ ID NO: 4077261 - RNA, 17 nt, Variola virus
aaauguugauagcugaa

SEQ ID NO: 4077262 - RNA, 15 nt, Variola virus
aaauuauauacugaa

SEQ ID NO: 4077263 - RNA, 16 nt, Variola virus
aaauuauucacuauau

SEQ ID NO: 4077264 - RNA, 22 nt, Variola virus
aaauucuggauuggaugucacu

SEQ ID NO: 4077265 - RNA, 22 nt, Variola virus
aaauugauagagaguucauuua

SEQ ID NO: 4077266 - RNA, 13 nt, Variola virus
aaauugcaaaaua

SEQ ID NO: 4077267 - RNA, 16 nt, Variola virus
aaauugcauuugauua

SEQ ID NO: 4077268 - RNA, 22 nt, Variola virus
aaauugguagcugaauguuaua

SEQ ID NO: 4077269 - RNA, 20 nt, Variola virus
aaauugguauaaauguugua

SEQ ID NO: 4077270 - RNA, 17 nt, Variola virus
aaauuguccuauauaau

SEQ ID NO: 4077271 - RNA, 13 nt, Variola virus
aaauuguuuaguu

SEQ ID NO: 4077272 - RNA, 19 nt, Variola virus
aaauuuacggugacuacua

SEQ ID NO: 4077273 - RNA, 17 nt, Variola virus
aaauuuauuaaaaaugu

SEQ ID NO: 4077274 - RNA, 12 nt, Variola virus
aaauuuuucuac

SEQ ID NO: 4077275 - RNA, 18 nt, Variola virus
aaauuuuuuauacauuau

SEQ ID NO: 4077276 - RNA, 15 nt, Variola virus
aacaaacaucucacc

SEQ ID NO: 4077277 - RNA, 15 nt, Variola virus
aacaaaguuauucau

SEQ ID NO: 4077278 - RNA, 14 nt, Variola virus
aacaaauauuggca

SEQ ID NO: 4077279 - RNA, 16 nt, Variola virus
aacaaaucuauuugga

SEQ ID NO: 4077280 - RNA, 17 nt, Variola virus
aacaacucccggacuua

SEQ ID NO: 4077281 - RNA, 23 nt, Variola virus
aacaaguuccucaacgugauuau

SEQ ID NO: 4077282 - RNA, 14 nt, Variola virus
aacaauaaugagaa

SEQ ID NO: 4077283 - RNA, 18 nt, Variola virus
aacaauagucuuguaaag

SEQ ID NO: 4077284 - RNA, 13 nt, Variola virus
aacaaucaagaag

SEQ ID NO: 4077285 - RNA, 20 nt, Variola virus
aacaaucguuaauaaaucug

SEQ ID NO: 4077286 - RNA, 22 nt, Variola virus
aacacgauuauuauaaaauaac

SEQ ID NO: 4077287 - RNA, 20 nt, Variola virus
aacacuauacuuauauuaau

SEQ ID NO: 4077288 - RNA, 22 nt, Variola virus
aacacuauuccaucuguggaaa

SEQ ID NO: 4077289 - RNA, 24 nt, Variola virus
aacacuccggaaaaauaauuucca

SEQ ID NO: 4077290 - RNA, 16 nt, Variola virus
aacacuggcuagaaaa

SEQ ID NO: 4077291 - RNA, 13 nt, Variola virus
aacacuuuucuau

SEQ ID NO: 4077292 - RNA, 18 nt, Variola virus
aacagaaacguuuagaga

SEQ ID NO: 4077293 - RNA, 22 nt, Variola virus
aacagggaauuacuuuaauagu

SEQ ID NO: 4077294 - RNA, 16 nt, Variola virus
aacaguaucagauaau

SEQ ID NO: 4077295 - RNA, 20 nt, Variola virus
aacaguuaucaaaauaugua

SEQ ID NO: 4077296 - RNA, 16 nt, Variola virus
aacaguucuaccacca

SEQ ID NO: 4077297 - RNA, 18 nt, Variola virus
aacauaaauaauucuaga

SEQ ID NO: 4077298 - RNA, 12 nt, Variola virus
aacauaaugccg

SEQ ID NO: 4077299 - RNA, 17 nt, Variola virus
aacauauaauuauaaga

SEQ ID NO: 4077300 - RNA, 12 nt, Variola virus
aacaucaagaau

SEQ ID NO: 4077301 - RNA, 22 nt, Variola virus
aacaucuaauugugauaaaugu

SEQ ID NO: 4077302 - RNA, 20 nt, Variola virus
aacaucuuuguaaacagaua

SEQ ID NO: 4077303 - RNA, 23 nt, Variola virus
aacaugguaucuauuuuaaauac

SEQ ID NO: 4077304 - RNA, 17 nt, Variola virus
aacaugugugaaaauau

SEQ ID NO: 4077305 - RNA, 13 nt, Variola virus
aacauguuaaaau

SEQ ID NO: 4077306 - RNA, 13 nt, Variola virus
aacauuaguucca

SEQ ID NO: 4077307 - RNA, 15 nt, Variola virus
aacauugauaacuac

SEQ ID NO: 4077308 - RNA, 15 nt, Variola virus
aacauuuugaaaauu

SEQ ID NO: 4077309 - RNA, 20 nt, Variola virus
aacauuuugcagaaaaaagu

SEQ ID NO: 4077310 - RNA, 20 nt, Variola virus
aaccaacgucauaaaaaugu

SEQ ID NO: 4077311 - RNA, 15 nt, Variola virus
aaccaagaaacaguc

SEQ ID NO: 4077312 - RNA, 16 nt, Variola virus
aaccaauuuguauaug

SEQ ID NO: 4077313 - RNA, 22 nt, Variola virus
aaccaguacucucuuauaaagu

SEQ ID NO: 4077314 - RNA, 13 nt, Variola virus
aaccauaaauaca

SEQ ID NO: 4077315 - RNA, 19 nt, Variola virus
aaccauucaaaaaaguaau

SEQ ID NO: 4077316 - RNA, 16 nt, Variola virus
aaccgacauuaccauc

SEQ ID NO: 4077317 - RNA, 15 nt, Variola virus
aaccuaacacaaauu

SEQ ID NO: 4077318 - RNA, 15 nt, Variola virus
aaccuaagacaaauu

SEQ ID NO: 4077319 - RNA, 16 nt, Variola virus
aaccuuugcaaauaca

SEQ ID NO: 4077320 - RNA, 13 nt, Variola virus
aacgaaacaaugu

SEQ ID NO: 4077321 - RNA, 15 nt, Variola virus
aacgaaguaaaaagu

SEQ ID NO: 4077322 - RNA, 17 nt, Variola virus
aacgaaguauuuauacu

SEQ ID NO: 4077323 - RNA, 18 nt, Variola virus
aacgauaauuuauacgua

SEQ ID NO: 4077324 - RNA, 16 nt, Variola virus
aacguguauuaaauag

SEQ ID NO: 4077325 - RNA, 16 nt, Variola virus
aacguucauagaauuu

SEQ ID NO: 4077326 - RNA, 18 nt, Variola virus
aacuaaaaauuaaacaau

SEQ ID NO: 4077327 - RNA, 19 nt, Variola virus
aacuaaaugguauacacau

SEQ ID NO: 4077328 - RNA, 15 nt, Variola virus
aacuaaauuaacaau

SEQ ID NO: 4077329 - RNA, 21 nt, Variola virus
aacuaauucauuuucaauaau

SEQ ID NO: 4077330 - RNA, 22 nt, Variola virus
aacuacuuguaauauugaaauc

SEQ ID NO: 4077331 - RNA, 18 nt, Variola virus
aacuacuuuaucaguaaa

SEQ ID NO: 4077332 - RNA, 16 nt, Variola virus
aacuagacaauaaugu

SEQ ID NO: 4077333 - RNA, 17 nt, Variola virus
aacuagucuauuucaua

SEQ ID NO: 4077334 - RNA, 15 nt, Variola virus
aacuaguguagaaaa

SEQ ID NO: 4077335 - RNA, 15 nt, Variola virus
aacuaucacuuauac

SEQ ID NO: 4077336 - RNA, 13 nt, Variola virus
aacuauuuagaaa

SEQ ID NO: 4077337 - RNA, 16 nt, Variola virus
aacuauuuucaguaau

SEQ ID NO: 4077338 - RNA, 16 nt, Variola virus
aacucaucuaccauuu

SEQ ID NO: 4077339 - RNA, 23 nt, Variola virus
aauaauaccuucuacuaugcaau

SEQ ID NO: 4077340 - RNA, 20 nt, Variola virus
aauaauaucacuauuacaau

SEQ ID NO: 4077341 - RNA, 14 nt, Variola virus
aauaaucuucauua

SEQ ID NO: 4077342 - RNA, 13 nt, Variola virus
aauaaugaauauu

SEQ ID NO: 4077343 - RNA, 22 nt, Variola virus
aauaauguaguaaauauaaaau

SEQ ID NO: 4077344 - RNA, 23 nt, Variola virus
aauaauucauggaaauuuaacag

SEQ ID NO: 4077345 - RNA, 21 nt, Variola virus
aauaauuguaaaacauacaau

SEQ ID NO: 4077346 - RNA, 14 nt, Variola virus
aauaauuuaacaau

SEQ ID NO: 4077347 - RNA, 21 nt, Variola virus
aauaauuuaccucguacuaua

SEQ ID NO: 4077348 - RNA, 13 nt, Variola virus
aauacaagcaucu

SEQ ID NO: 4077349 - RNA, 15 nt, Variola virus
aauacacauaaugaa

SEQ ID NO: 4077350 - RNA, 11 nt, Variola virus
aauacagaaug

SEQ ID NO: 4077351 - RNA, 14 nt, Variola virus
aauacagaucaaaa

SEQ ID NO: 4077352 - RNA, 13 nt, Variola virus
aauacaggaucua

SEQ ID NO: 4077353 - RNA, 20 nt, Variola virus
aauacauauuuuuuguaaaa

SEQ ID NO: 4077354 - RNA, 22 nt, Variola virus
aauacaucaucaauuuugaaaa

SEQ ID NO: 4077355 - RNA, 23 nt, Variola virus
aauaccaguuauguucaacuuug

SEQ ID NO: 4077356 - RNA, 19 nt, Variola virus
aauacgaugauauuaaaau

SEQ ID NO: 4077357 - RNA, 16 nt, Variola virus
aauacguguugauaau

SEQ ID NO: 4077358 - RNA, 13 nt, Variola virus
aauacguugaaaa

SEQ ID NO: 4077359 - RNA, 18 nt, Variola virus
aauacucaauacuuucca

SEQ ID NO: 4077360 - RNA, 14 nt, Variola virus
aauacucuacagag

SEQ ID NO: 4077361 - RNA, 12 nt, Variola virus
aauacugaauuc

SEQ ID NO: 4077362 - RNA, 18 nt, Variola virus
aauacugcaauaauuuuc

SEQ ID NO: 4077363 - RNA, 22 nt, Variola virus
aauacuucucuguccuuaauaa

SEQ ID NO: 4077364 - RNA, 23 nt, Variola virus
aauacuugacugacuuaaaacuu

SEQ ID NO: 4077365 - RNA, 20 nt, Variola virus
aauacuuuaacaucacuaau

SEQ ID NO: 4077366 - RNA, 22 nt, Variola virus
aauagaauauacucuauucuuc

SEQ ID NO: 4077367 - RNA, 23 nt, Variola virus
aauagaaugcucuuaaauaaugu

SEQ ID NO: 4077368 - RNA, 23 nt, Variola virus
aauagauagugcuaaacgacuua

SEQ ID NO: 4077369 - RNA, 17 nt, Variola virus
aauagauccugaauauu

SEQ ID NO: 4077370 - RNA, 21 nt, Variola virus
aauagcaaaauuuuuacuauu

SEQ ID NO: 4077371 - RNA, 14 nt, Variola virus
aauagcaucaucuu

SEQ ID NO: 4077372 - RNA, 14 nt, Variola virus
aauaguaaaaucua

SEQ ID NO: 4077373 - RNA, 14 nt, Variola virus
aauaguaaugauuc

SEQ ID NO: 4077374 - RNA, 22 nt, Variola virus
aauaguaguagaauaagaacua

SEQ ID NO: 4077375 - RNA, 16 nt, Variola virus
aauagucaauagauua

SEQ ID NO: 4077376 - RNA, 18 nt, Variola virus
aauagucuuguaaagaua

SEQ ID NO: 4077377 - RNA, 20 nt, Variola virus
aauaguuagauacaaagaua

SEQ ID NO: 4077378 - RNA, 18 nt, Variola virus
aauaguuauuacuuuucu

SEQ ID NO: 4077379 - RNA, 15 nt, Variola virus
aauaguuuuuaacua

SEQ ID NO: 4077380 - RNA, 20 nt, Variola virus
aauauaaaaaaauaaauaua

SEQ ID NO: 4077381 - RNA, 17 nt, Variola virus
aauauaaaaaaaugauu

SEQ ID NO: 4077382 - RNA, 15 nt, Variola virus
aauauaauaaauaua

SEQ ID NO: 4077383 - RNA, 12 nt, Variola virus
aauauacucuau

SEQ ID NO: 4077384 - RNA, 20 nt, Variola virus
aauauacuuuguguuucaug

SEQ ID NO: 4077385 - RNA, 18 nt, Variola virus
aauauagaaauaaugaua

SEQ ID NO: 4077386 - RNA, 18 nt, Variola virus
aauauaguaguuagauua

SEQ ID NO: 4077387 - RNA, 15 nt, Variola virus
aauauaguuaauagu

SEQ ID NO: 4077388 - RNA, 17 nt, Variola virus
aauauaguuaguauaac

SEQ ID NO: 4077389 - RNA, 14 nt, Variola virus
aauauauucuauga

SEQ ID NO: 4077390 - RNA, 22 nt, Variola virus
aauaucaucaauauagagauua

SEQ ID NO: 4077391 - RNA, 17 nt, Variola virus
aauauccagaauguuuc

SEQ ID NO: 4077392 - RNA, 20 nt, Variola virus
aauaucgauuagauuuccua

SEQ ID NO: 4077393 - RNA, 13 nt, Variola virus
aauaucuuguaua

SEQ ID NO: 4077394 - RNA, 22 nt, Variola virus
aauaucuuguucugguuuaaaa

SEQ ID NO: 4077395 - RNA, 19 nt, Variola virus
aauaucuuuaauacagagu

SEQ ID NO: 4077396 - RNA, 18 nt, Variola virus
aauaugauagaaaugaug

SEQ ID NO: 4077397 - RNA, 15 nt, Variola virus
aauaugauuagaagu

SEQ ID NO: 4077398 - RNA, 20 nt, Variola virus
aauaugauuagaaguuauau

SEQ ID NO: 4077399 - RNA, 18 nt, Variola virus
aauaugcuaguuaauagu

SEQ ID NO: 4077400 - RNA, 19 nt, Variola virus
aauaugcucaugaagauua

SEQ ID NO: 4077401 - RNA, 23 nt, Variola virus
aauaugucucuuaacuauuuccg

SEQ ID NO: 4077402 - RNA, 18 nt, Variola virus
aauauuaaagauaaagcg

SEQ ID NO: 4077403 - RNA, 12 nt, Variola virus
aauauuaaauau

SEQ ID NO: 4077404 - RNA, 18 nt, Variola virus
aauauuaauaacauuaca

SEQ ID NO: 4077405 - RNA, 12 nt, Variola virus
aauauuagaaaa

SEQ ID NO: 4077406 - RNA, 19 nt, Variola virus
aauauuagaguuagguaau

SEQ ID NO: 4077407 - RNA, 15 nt, Variola virus
aauauuauaaagccu

SEQ ID NO: 4077408 - RNA, 15 nt, Variola virus
aauauuauaauacca

SEQ ID NO: 4077409 - RNA, 16 nt, Variola virus
aauauuauacaugaua

SEQ ID NO: 4077410 - RNA, 17 nt, Variola virus
aauauucauauccuugu

SEQ ID NO: 4077411 - RNA, 19 nt, Variola virus
aauauucauuaauucuaua

SEQ ID NO: 4077412 - RNA, 23 nt, Variola virus
aauauuguaacaauuuauuuugu

SEQ ID NO: 4077413 - RNA, 12 nt, Variola virus
aauauuuaacuc

SEQ ID NO: 4077414 - RNA, 21 nt, Variola virus
aauauuuguuaucaugaugac

SEQ ID NO: 4077415 - RNA, 11 nt, Variola virus
aauauuuuacg

SEQ ID NO: 4077416 - RNA, 14 nt, Variola virus
aauauuuuauuuca

SEQ ID NO: 4077417 - RNA, 20 nt, Variola virus
aaucaaccgccaaugaugcg

SEQ ID NO: 4077418 - RNA, 22 nt, Variola virus
aaucaagauucauuuuuaaaau

SEQ ID NO: 4077419 - RNA, 19 nt, Variola virus
aaucaagggaaaaucugaa

SEQ ID NO: 4077420 - RNA, 18 nt, Variola virus
aaucacucaauaucuaga

SEQ ID NO: 4077421 - RNA, 21 nt, Variola virus
aaucaguacguucuucauuua

SEQ ID NO: 4077422 - RNA, 13 nt, Variola virus
aaucauaaccauu

SEQ ID NO: 4077423 - RNA, 16 nt, Variola virus
aaucauauuuagaaaa

SEQ ID NO: 4077424 - RNA, 14 nt, Variola virus
aaucaucauaucca

SEQ ID NO: 4077425 - RNA, 13 nt, Variola virus
aaucauccuaaga

SEQ ID NO: 4077426 - RNA, 14 nt, Variola virus
aaucauuaaaugau

SEQ ID NO: 4077427 - RNA, 21 nt, Variola virus
aaucauuacugucgcuaucau

SEQ ID NO: 4077428 - RNA, 22 nt, Variola virus
aaucauucaaaaaucuaucacu

SEQ ID NO: 4077429 - RNA, 12 nt, Variola virus
aaucauugacau

SEQ ID NO: 4077430 - RNA, 15 nt, Variola virus
aauccaaauaugaua

SEQ ID NO: 4077431 - RNA, 18 nt, Variola virus
aauccaauuguuugauau

SEQ ID NO: 4077432 - RNA, 14 nt, Variola virus
aauccauccauuau

SEQ ID NO: 4077433 - RNA, 20 nt, Variola virus
aauccauucucucaaucacu

SEQ ID NO: 4077434 - RNA, 21 nt, Variola virus
aauccauugauaauuucuugu

SEQ ID NO: 4077435 - RNA, 13 nt, Variola virus
aaucccaauucag

SEQ ID NO: 4077436 - RNA, 22 nt, Variola virus
aaucccuacauauuuuagaaca

SEQ ID NO: 4077437 - RNA, 19 nt, Variola virus
aauccuauacucugaaaga

SEQ ID NO: 4077438 - RNA, 21 nt, Variola virus
aauccucuauuuauugacauu

SEQ ID NO: 4077439 - RNA, 15 nt, Variola virus
aauccuuugauuauc

SEQ ID NO: 4077440 - RNA, 17 nt, Variola virus
aauccuuuuuuauaaaa

SEQ ID NO: 4077441 - RNA, 17 nt, Variola virus
aaucgcgcguuagaaau

SEQ ID NO: 4077442 - RNA, 14 nt, Variola virus
aaucgcuuaauaga

SEQ ID NO: 4077443 - RNA, 16 nt, Variola virus
aaucggagaauguuuc

SEQ ID NO: 4077444 - RNA, 14 nt, Variola virus
aaucguuuaauagu

SEQ ID NO: 4077445 - RNA, 21 nt, Variola virus
aaucuaguacucgaaauaaua

SEQ ID NO: 4077446 - RNA, 16 nt, Variola virus
aaucuauucccuugau

SEQ ID NO: 4077447 - RNA, 21 nt, Variola virus
aaucucgucaguauugacaau

SEQ ID NO: 4077448 - RNA, 12 nt, Variola virus
aaucugaaaaug

SEQ ID NO: 4077449 - RNA, 13 nt, Variola virus
aaucugaaaaugu

SEQ ID NO: 4077450 - RNA, 20 nt, Variola virus
aaucugauagaaagaauaag

SEQ ID NO: 4077451 - RNA, 17 nt, Variola virus
aaucuuaauaucuucgu

SEQ ID NO: 4077452 - RNA, 13 nt, Variola virus
aaucuuuaccaua

SEQ ID NO: 4077453 - RNA, 13 nt, Variola virus
aaugaaaauggau

SEQ ID NO: 4077454 - RNA, 12 nt, Variola virus
aaugaaaugaua

SEQ ID NO: 4077455 - RNA, 15 nt, Variola virus
aaugaagauccaaga

SEQ ID NO: 4077456 - RNA, 14 nt, Variola virus
aaugaauaucuaca

SEQ ID NO: 4077457 - RNA, 16 nt, Variola virus
aaugaaucccaaacau

SEQ ID NO: 4077458 - RNA, 20 nt, Variola virus
aaugaauggcguaccaguuu

SEQ ID NO: 4077459 - RNA, 14 nt, Variola virus
aaugacuuauaaaa

SEQ ID NO: 4077460 - RNA, 19 nt, Variola virus
aaugagauacauaaaacuu

SEQ ID NO: 4077461 - RNA, 24 nt, Variola virus
aaugaggaaaucguauaaauacug

SEQ ID NO: 4077462 - RNA, 17 nt, Variola virus
aaugaguaaguucuaua

SEQ ID NO: 4077463 - RNA, 15 nt, Variola virus
aaugauaauaggaau

SEQ ID NO: 4077464 - RNA, 19 nt, Variola virus
aaugaugcgcacaaugaua

SEQ ID NO: 4077465 - RNA, 16 nt, Variola virus
acaaccgcuacauaau

SEQ ID NO: 4077466 - RNA, 22 nt, Variola virus
acaacgacgaaccaaaaugaau

SEQ ID NO: 4077467 - RNA, 23 nt, Variola virus
acaacuggauauucgauaacagc

SEQ ID NO: 4077468 - RNA, 20 nt, Variola virus
acaacuuucucgugguggug

SEQ ID NO: 4077469 - RNA, 21 nt, Variola virus
acaacuuuuaaauacaaauau

SEQ ID NO: 4077470 - RNA, 19 nt, Variola virus
acaagaaaauuagaaggau

SEQ ID NO: 4077471 - RNA, 21 nt, Variola virus
acaagauuuuuagcguauuau

SEQ ID NO: 4077472 - RNA, 22 nt, Variola virus
acaagccgaagaguauaaauuc

SEQ ID NO: 4077473 - RNA, 22 nt, Variola virus
acaagucuaauaauguuauuac

SEQ ID NO: 4077474 - RNA, 23 nt, Variola virus
acaaguugaccaauuuauuucua

SEQ ID NO: 4077475 - RNA, 12 nt, Variola virus
acaaguuuucau

SEQ ID NO: 4077476 - RNA, 17 nt, Variola virus
acaaguuuucauaucau

SEQ ID NO: 4077477 - RNA, 13 nt, Variola virus
acaauacagcagu

SEQ ID NO: 4077478 - RNA, 17 nt, Variola virus
acaauacauguacaaau

SEQ ID NO: 4077479 - RNA, 15 nt, Variola virus
acaauacguguugau

SEQ ID NO: 4077480 - RNA, 21 nt, Variola virus
acaauagauggauaauggaag

SEQ ID NO: 4077481 - RNA, 18 nt, Variola virus
acaauaguguucugaauu

SEQ ID NO: 4077482 - RNA, 16 nt, Variola virus
acaauaguuagauaca

SEQ ID NO: 4077483 - RNA, 20 nt, Variola virus
acaauauauguaaucauuau

SEQ ID NO: 4077484 - RNA, 15 nt, Variola virus
acaaucaauaauaua

SEQ ID NO: 4077485 - RNA, 19 nt, Variola virus
acaaucauccggauauucu

SEQ ID NO: 4077486 - RNA, 16 nt, Variola virus
acaauccaaaaaauga

SEQ ID NO: 4077487 - RNA, 18 nt, Variola virus
acaaucuaguacucgaaa

SEQ ID NO: 4077488 - RNA, 17 nt, Variola virus
acaaucuuauaucuucu

SEQ ID NO: 4077489 - RNA, 19 nt, Variola virus
acaaugaaccguaauauau

SEQ ID NO: 4077490 - RNA, 22 nt, Variola virus
acaaugaaccguaauauaucua

SEQ ID NO: 4077491 - RNA, 22 nt, Variola virus
acaaugacucuaucaacuauag

SEQ ID NO: 4077492 - RNA, 20 nt, Variola virus
acaaugaugccaucauagau

SEQ ID NO: 4077493 - RNA, 20 nt, Variola virus
acaaugccaucuuacaugau

SEQ ID NO: 4077494 - RNA, 15 nt, Variola virus
acaaugcuuuaauaa

SEQ ID NO: 4077495 - RNA, 15 nt, Variola virus
acaauuacacuacau

SEQ ID NO: 4077496 - RNA, 22 nt, Variola virus
acaauuauuagcaaaaauauau

SEQ ID NO: 4077497 - RNA, 20 nt, Variola virus
acaauuuauuucuaaaucua

SEQ ID NO: 4077498 - RNA, 15 nt, Variola virus
acaauuucacaaaug

SEQ ID NO: 4077499 - RNA, 18 nt, Variola virus
acaauuucacaaauggau

SEQ ID NO: 4077500 - RNA, 20 nt, Variola virus
acaauuugggacaaugaauu

SEQ ID NO: 4077501 - RNA, 14 nt, Variola virus
acaauuuuaacaga

SEQ ID NO: 4077502 - RNA, 13 nt, Variola virus
acacaaucaugau

SEQ ID NO: 4077503 - RNA, 22 nt, Variola virus
acacaccaaaaaagaaaaggau

SEQ ID NO: 4077504 - RNA, 15 nt, Variola virus
acacaccuaaaugug

SEQ ID NO: 4077505 - RNA, 20 nt, Variola virus
acacacugagaaacagcaua

SEQ ID NO: 4077506 - RNA, 21 nt, Variola virus
acacacuuaccuucaacagua

SEQ ID NO: 4077507 - RNA, 21 nt, Variola virus
acacauccgucaaagaaauaa

SEQ ID NO: 4077508 - RNA, 12 nt, Variola virus
acacauguguuu

SEQ ID NO: 4077509 - RNA, 15 nt, Variola virus
acacgagccuuuauu

SEQ ID NO: 4077510 - RNA, 15 nt, Variola virus
acacugagaaacagc

SEQ ID NO: 4077511 - RNA, 23 nt, Variola virus
acacuguucacauccuuccaaga

SEQ ID NO: 4077512 - RNA, 17 nt, Variola virus
acagaaauauaugagau

SEQ ID NO: 4077513 - RNA, 12 nt, Variola virus
acagaauuauug

SEQ ID NO: 4077514 - RNA, 19 nt, Variola virus
acagacguuaauauagaca

SEQ ID NO: 4077515 - RNA, 18 nt, Variola virus
acagagccaucuguaaaa

SEQ ID NO: 4077516 - RNA, 14 nt, Variola virus
acagauauuaucau

SEQ ID NO: 4077517 - RNA, 17 nt, Variola virus
acagaucaaaaaauaua

SEQ ID NO: 4077518 - RNA, 23 nt, Variola virus
acagaucaaaaaauauaguucca

SEQ ID NO: 4077519 - RNA, 19 nt, Variola virus
acagaugagagauaauaua

SEQ ID NO: 4077520 - RNA, 15 nt, Variola virus
acagauguaaauaua

SEQ ID NO: 4077521 - RNA, 13 nt, Variola virus
acagauuaauagu

SEQ ID NO: 4077522 - RNA, 13 nt, Variola virus
acagauuucggaa

SEQ ID NO: 4077523 - RNA, 14 nt, Variola virus
acagccucauauau

SEQ ID NO: 4077524 - RNA, 14 nt, Variola virus
acagcguaaaacac

SEQ ID NO: 4077525 - RNA, 16 nt, Variola virus
acagcuucuagaaguu

SEQ ID NO: 4077526 - RNA, 21 nt, Variola virus
acagucguucaacugucuuuc

SEQ ID NO: 4077527 - RNA, 23 nt, Variola virus
acagucuaucaucgacacaaaug

SEQ ID NO: 4077528 - RNA, 16 nt, Variola virus
acaguuacaaaugagu

SEQ ID NO: 4077529 - RNA, 13 nt, Variola virus
acaguuuaauaga

SEQ ID NO: 4077530 - RNA, 14 nt, Variola virus
acaguuuaucacau

SEQ ID NO: 4077531 - RNA, 15 nt, Variola virus
acaguuuuuuucuag

SEQ ID NO: 4077532 - RNA, 20 nt, Variola virus
acauaaaccgaucacuaauu

SEQ ID NO: 4077533 - RNA, 15 nt, Variola virus
acauaacuuguacag

SEQ ID NO: 4077534 - RNA, 19 nt, Variola virus
acauaagaugucuaugaau

SEQ ID NO: 4077535 - RNA, 12 nt, Variola virus
acauaauacaau

SEQ ID NO: 4077536 - RNA, 13 nt, Variola virus
acauaauaguuua

SEQ ID NO: 4077537 - RNA, 17 nt, Variola virus
acauaauuauucuauca

SEQ ID NO: 4077538 - RNA, 21 nt, Variola virus
acauaauuuucuauaacugaa

SEQ ID NO: 4077539 - RNA, 18 nt, Variola virus
acauacaaaaaaguggau

SEQ ID NO: 4077540 - RNA, 19 nt, Variola virus
acauacagcgaauggaaua

SEQ ID NO: 4077541 - RNA, 16 nt, Variola virus
acauacaucuaugaau

SEQ ID NO: 4077542 - RNA, 16 nt, Variola virus
acauacguauaaucug

SEQ ID NO: 4077543 - RNA, 12 nt, Variola virus
acauagaaauaa

SEQ ID NO: 4077544 - RNA, 23 nt, Variola virus
acauagagagcuucaucaauaga

SEQ ID NO: 4077545 - RNA, 20 nt, Variola virus
acauaguguuuuauauucca

SEQ ID NO: 4077546 - RNA, 18 nt, Variola virus
acauauagacaauaacua

SEQ ID NO: 4077547 - RNA, 17 nt, Variola virus
acauaucuaaaugaaua

SEQ ID NO: 4077548 - RNA, 18 nt, Variola virus
acauauggaucuuuaugu

SEQ ID NO: 4077549 - RNA, 15 nt, Variola virus
acauauuaaugaauu

SEQ ID NO: 4077550 - RNA, 14 nt, Variola virus
acauauuaaugcag

SEQ ID NO: 4077551 - RNA, 13 nt, Variola virus
acaucaucugaaa

SEQ ID NO: 4077552 - RNA, 14 nt, Variola virus
acaucaucugaaau

SEQ ID NO: 4077553 - RNA, 20 nt, Variola virus
acauccaaaauacaaaaugu

SEQ ID NO: 4077554 - RNA, 22 nt, Variola virus
acauccuacacggacucauuaa

SEQ ID NO: 4077555 - RNA, 23 nt, Variola virus
acaucgguacggguauucauuua

SEQ ID NO: 4077556 - RNA, 18 nt, Variola virus
acaucguaaucaaaagaa

SEQ ID NO: 4077557 - RNA, 17 nt, Variola virus
acaucuauauacuauau

SEQ ID NO: 4077558 - RNA, 21 nt, Variola virus
acaucuauauugcuacauaau

SEQ ID NO: 4077559 - RNA, 15 nt, Variola virus
acaucuuuccuacau

SEQ ID NO: 4077560 - RNA, 17 nt, Variola virus
acaugcaucuuauuaga

SEQ ID NO: 4077561 - RNA, 14 nt, Variola virus
acauggaggcacua

SEQ ID NO: 4077562 - RNA, 22 nt, Variola virus
acauggauuuaucauaucaugg

SEQ ID NO: 4077563 - RNA, 23 nt, Variola virus
acauguaucgacgguaaauggaa

SEQ ID NO: 4077564 - RNA, 14 nt, Variola virus
acauguauuaaaga

SEQ ID NO: 4077565 - RNA, 17 nt, Variola virus
acaugucucucucaaau

SEQ ID NO: 4077566 - RNA, 13 nt, Variola virus
acaugucuucaau

SEQ ID NO: 4077567 - RNA, 12 nt, Variola virus
acauuaaaugua

SEQ ID NO: 4077568 - RNA, 13 nt, Variola virus
acauuaaauguau

SEQ ID NO: 4077569 - RNA, 21 nt, Variola virus
acauuaacaucauacaucaau

SEQ ID NO: 4077570 - RNA, 21 nt, Variola virus
acauuaauuccuuuuuaaauu

SEQ ID NO: 4077571 - RNA, 15 nt, Variola virus
acauuaauugccaua

SEQ ID NO: 4077572 - RNA, 20 nt, Variola virus
acauuagaccguuuaauaga

SEQ ID NO: 4077573 - RNA, 20 nt, Variola virus
acauuagcgcauguacauau

SEQ ID NO: 4077574 - RNA, 22 nt, Variola virus
acauuauaucguuaucauuaau

SEQ ID NO: 4077575 - RNA, 23 nt, Variola virus
acauuauuuacaucuaauuuacu

SEQ ID NO: 4077576 - RNA, 20 nt, Variola virus
acauucaaccacucucgaua

SEQ ID NO: 4077577 - RNA, 18 nt, Variola virus
acauuguauuaugaugaa

SEQ ID NO: 4077578 - RNA, 19 nt, Variola virus
acauuguccaauccaggac

SEQ ID NO: 4077579 - RNA, 14 nt, Variola virus
acauuguuaauuga

SEQ ID NO: 4077580 - RNA, 16 nt, Variola virus
acauuucucaaaugaa

SEQ ID NO: 4077581 - RNA, 22 nt, Variola virus
acauuucuuauguuauuaauga

SEQ ID NO: 4077582 - RNA, 22 nt, Variola virus
acauuugggccauuauaccucu

SEQ ID NO: 4077583 - RNA, 18 nt, Variola virus
acauuuuggcaaauugau

SEQ ID NO: 4077584 - RNA, 21 nt, Variola virus
acauuuuuugacgaugaugau

SEQ ID NO: 4077585 - RNA, 14 nt, Variola virus
acauuuuuuguaaa

SEQ ID NO: 4077586 - RNA, 17 nt, Variola virus
accaaaaaggauaaaga

SEQ ID NO: 4077587 - RNA, 17 nt, Variola virus
accaaagacuuugaaau

SEQ ID NO: 4077588 - RNA, 16 nt, Variola virus
accaaagcaaccagaa

SEQ ID NO: 4077589 - RNA, 12 nt, Variola virus
accaaaucagau

SEQ ID NO: 4077590 - RNA, 17 nt, Variola virus
aucuucauuaucugaua

SEQ ID NO: 4077591 - RNA, 18 nt, Variola virus
aucuucguaccucaaacu

SEQ ID NO: 4077592 - RNA, 16 nt, Variola virus
aucuucgucuauuaca

SEQ ID NO: 4077593 - RNA, 16 nt, Variola virus
aucuugacugucuauc

SEQ ID NO: 4077594 - RNA, 18 nt, Variola virus
aucuugcaaguuaaauag

SEQ ID NO: 4077595 - RNA, 22 nt, Variola virus
aucuugcaaguuaaauagaaug

SEQ ID NO: 4077596 - RNA, 19 nt, Variola virus
aucuugucugcuuaauaca

SEQ ID NO: 4077597 - RNA, 15 nt, Variola virus
aucuuuaguaaacau

SEQ ID NO: 4077598 - RNA, 21 nt, Variola virus
aucuuuauacgagcuacgaau

SEQ ID NO: 4077599 - RNA, 15 nt, Variola virus
aucuuuguucuuaag

SEQ ID NO: 4077600 - RNA, 17 nt, Variola virus
augaaaaaaaacacuga

SEQ ID NO: 4077601 - RNA, 14 nt, Variola virus
augaaauauauuaa

SEQ ID NO: 4077602 - RNA, 15 nt, Variola virus
augaaauauauuaac

SEQ ID NO: 4077603 - RNA, 17 nt, Variola virus
augaacgagaugcagaa

SEQ ID NO: 4077604 - RNA, 14 nt, Variola virus
augaacuuuaucca

SEQ ID NO: 4077605 - RNA, 14 nt, Variola virus
augaagaaagaaaa

SEQ ID NO: 4077606 - RNA, 17 nt, Variola virus
augaagaguacacagaa

SEQ ID NO: 4077607 - RNA, 23 nt, Variola virus
augaagauccaagauuuguagaa

SEQ ID NO: 4077608 - RNA, 15 nt, Variola virus
augaauaucacauau

SEQ ID NO: 4077609 - RNA, 20 nt, Variola virus
augaauaucaggaaauguau

SEQ ID NO: 4077610 - RNA, 18 nt, Variola virus
augaauggauaccuguau

SEQ ID NO: 4077611 - RNA, 15 nt, Variola virus
augaauguuuucaau

SEQ ID NO: 4077612 - RNA, 19 nt, Variola virus
augaauuacuuuacauaua

SEQ ID NO: 4077613 - RNA, 17 nt, Variola virus
augaauuagagaauuac

SEQ ID NO: 4077614 - RNA, 13 nt, Variola virus
augaauugauucu

SEQ ID NO: 4077615 - RNA, 14 nt, Variola virus
augaauugcauaca

SEQ ID NO: 4077616 - RNA, 17 nt, Variola virus
augaccaguuugcaaua

SEQ ID NO: 4077617 - RNA, 19 nt, Variola virus
augacgcauauucuacucu

SEQ ID NO: 4077618 - RNA, 14 nt, Variola virus
augagauugaucau

SEQ ID NO: 4077619 - RNA, 14 nt, Variola virus
augagggaaaagau

SEQ ID NO: 4077620 - RNA, 15 nt, Variola virus
augagugaaggagac

SEQ ID NO: 4077621 - RNA, 15 nt, Variola virus
augauaaaaacaaua

SEQ ID NO: 4077622 - RNA, 13 nt, Variola virus
augauaacuagau

SEQ ID NO: 4077623 - RNA, 13 nt, Variola virus
augauaauaggaa

SEQ ID NO: 4077624 - RNA, 18 nt, Variola virus
augauaaugauaaugacg

SEQ ID NO: 4077625 - RNA, 22 nt, Variola virus
augauaauuuauacaaaguaua

SEQ ID NO: 4077626 - RNA, 13 nt, Variola virus
augauacgugcau

SEQ ID NO: 4077627 - RNA, 14 nt, Variola virus
augauauuguugau

SEQ ID NO: 4077628 - RNA, 17 nt, Variola virus
augaucaagaaggaaau

SEQ ID NO: 4077629 - RNA, 23 nt, Variola virus
augaucaagaaggaaaucaaauc

SEQ ID NO: 4077630 - RNA, 18 nt, Variola virus
augauccuauucuaaaug

SEQ ID NO: 4077631 - RNA, 19 nt, Variola virus
augaucgucuuuuguggaa

SEQ ID NO: 4077632 - RNA, 18 nt, Variola virus
augaucuauauguuuuau

SEQ ID NO: 4077633 - RNA, 14 nt, Variola virus
augaugaaauguau

SEQ ID NO: 4077634 - RNA, 16 nt, Variola virus
augaugucuauguaug

SEQ ID NO: 4077635 - RNA, 23 nt, Variola virus
augauucauuuuuuaaguauuug

SEQ ID NO: 4077636 - RNA, 23 nt, Variola virus
augauucuaucuacaucuucaau

SEQ ID NO: 4077637 - RNA, 22 nt, Variola virus
augauucuccggccacuauuau

SEQ ID NO: 4077638 - RNA, 17 nt, Variola virus
augcacguaaacauuau

SEQ ID NO: 4077639 - RNA, 20 nt, Variola virus
augcauuauccaaaauauua

SEQ ID NO: 4077640 - RNA, 22 nt, Variola virus
augccacgaauaaaaaauacuu

SEQ ID NO: 4077641 - RNA, 15 nt, Variola virus
augccugagaguaaa

SEQ ID NO: 4077642 - RNA, 21 nt, Variola virus
augcgacgaguuagaaagaua

SEQ ID NO: 4077643 - RNA, 15 nt, Variola virus
augcgauuggauaag

SEQ ID NO: 4077644 - RNA, 23 nt, Variola virus
augcggugccauucaugaaaaug

SEQ ID NO: 4077645 - RNA, 13 nt, Variola virus
auggaaaaacaaa

SEQ ID NO: 4077646 - RNA, 12 nt, Variola virus
auggaaauacuu

SEQ ID NO: 4077647 - RNA, 23 nt, Variola virus
auggaagguauuuccaucuaucu

SEQ ID NO: 4077648 - RNA, 21 nt, Variola virus
auggaauuaucaucaaaaaac

SEQ ID NO: 4077649 - RNA, 21 nt, Variola virus
auggacauuauuuuuuuaaac

SEQ ID NO: 4077650 - RNA, 15 nt, Variola virus
auggacuuaucuaca

SEQ ID NO: 4077651 - RNA, 16 nt, Variola virus
auggaguauaaucuuu

SEQ ID NO: 4077652 - RNA, 13 nt, Variola virus
auggaguauauau

SEQ ID NO: 4077653 - RNA, 21 nt, Variola virus
auggauaauccgucuauuuua

SEQ ID NO: 4077654 - RNA, 14 nt, Variola virus
auggauaauucucc

SEQ ID NO: 4077655 - RNA, 15 nt, Variola virus
auggaucuaguauua

SEQ ID NO: 4077656 - RNA, 13 nt, Variola virus
auggaucuggaaa

SEQ ID NO: 4077657 - RNA, 17 nt, Variola virus
auggaucugugauguau

SEQ ID NO: 4077658 - RNA, 18 nt, Variola virus
auggauugguaacauuau

SEQ ID NO: 4077659 - RNA, 24 nt, Variola virus
auggauuuggucauaauagaaugu

SEQ ID NO: 4077660 - RNA, 21 nt, Variola virus
augggaacggaacagaaacua

SEQ ID NO: 4077661 - RNA, 22 nt, Variola virus
augggugacauaauuacauaua

SEQ ID NO: 4077662 - RNA, 14 nt, Variola virus
augguaaaagaaau

SEQ ID NO: 4077663 - RNA, 18 nt, Variola virus
augguaaaauacaaaaua

SEQ ID NO: 4077664 - RNA, 15 nt, Variola virus
auggucagugcauaa

SEQ ID NO: 4077665 - RNA, 21 nt, Variola virus
auggucauguuuauuucuagc

SEQ ID NO: 4077666 - RNA, 11 nt, Variola virus
auggucucaca

SEQ ID NO: 4077667 - RNA, 16 nt, Variola virus
auggucucacaaaaaa

SEQ ID NO: 4077668 - RNA, 15 nt, Variola virus
augguucaaagacua

SEQ ID NO: 4077669 - RNA, 21 nt, Variola virus
augguuuucuaaauagaauuc

SEQ ID NO: 4077670 - RNA, 19 nt, Variola virus
augguuuuuauauguguuu

SEQ ID NO: 4077671 - RNA, 13 nt, Variola virus
auguaaaauaaua

SEQ ID NO: 4077672 - RNA, 12 nt, Variola virus
auguaaaaucau

SEQ ID NO: 4077673 - RNA, 16 nt, Variola virus
aaucacuauagaaaau

SEQ ID NO: 4077674 - RNA, 14 nt, Variola virus
aaucagaguuuuua

SEQ ID NO: 4077675 - RNA, 17 nt, Variola virus
aaucagaucugauaaua

SEQ ID NO: 4077676 - RNA, 20 nt, Variola virus
aaucaggacgaauaauucua

SEQ ID NO: 4077677 - RNA, 22 nt, Variola virus
aaucaggguuaucaaaguguuu

SEQ ID NO: 4077678 - RNA, 20 nt, Variola virus
aaucagucauaacaaaugua

SEQ ID NO: 4077679 - RNA, 22 nt, Variola virus
aaucaguuacaaaacguuuaua

SEQ ID NO: 4077680 - RNA, 20 nt, Variola virus
aaucaguugcuguugaagag

SEQ ID NO: 4077681 - RNA, 19 nt, Variola virus
aaucauaacaguaguuuaa

SEQ ID NO: 4077682 - RNA, 19 nt, Variola virus
aaucauauaaaaaaugauu

SEQ ID NO: 4077683 - RNA, 14 nt, Variola virus
aaucauauaugaua

SEQ ID NO: 4077684 - RNA, 15 nt, Variola virus
aaucauauuuagaaa

SEQ ID NO: 4077685 - RNA, 18 nt, Variola virus
aaucauccuaagaugaua

SEQ ID NO: 4077686 - RNA, 21 nt, Variola virus
aaucaugugauuaugaauauu

SEQ ID NO: 4077687 - RNA, 22 nt, Variola virus
aaucauuaaaaaaauuaacuga

SEQ ID NO: 4077688 - RNA, 20 nt, Variola virus
aaucauucucuucuaucuuu

SEQ ID NO: 4077689 - RNA, 12 nt, Variola virus
aaucauugauau

SEQ ID NO: 4077690 - RNA, 19 nt, Variola virus
aauccaaauaaaauggaua

SEQ ID NO: 4077691 - RNA, 20 nt, Variola virus
aauccagucuuuaaugaauu

SEQ ID NO: 4077692 - RNA, 15 nt, Variola virus
aauccauccuauccu

SEQ ID NO: 4077693 - RNA, 14 nt, Variola virus
aauccauugauaau

SEQ ID NO: 4077694 - RNA, 13 nt, Variola virus
aaucgauguguca

SEQ ID NO: 4077695 - RNA, 18 nt, Variola virus
aaucggguaauuauaaga

SEQ ID NO: 4077696 - RNA, 15 nt, Variola virus
aaucguauaaauacu

SEQ ID NO: 4077697 - RNA, 16 nt, Variola virus
aaucguauaaauacug

SEQ ID NO: 4077698 - RNA, 14 nt, Variola virus
aaucguuuaucuuu

SEQ ID NO: 4077699 - RNA, 17 nt, Variola virus
aaucguuuuugaaggau

SEQ ID NO: 4077700 - RNA, 13 nt, Variola virus
aaucuaacagaua

SEQ ID NO: 4077701 - RNA, 22 nt, Variola virus
aaucuaacauugauuuuaaaau

SEQ ID NO: 4077702 - RNA, 16 nt, Variola virus
aaucuaauacaaaauc

SEQ ID NO: 4077703 - RNA, 16 nt, Variola virus
aaucucaauuagaaua

SEQ ID NO: 4077704 - RNA, 15 nt, Variola virus
aaucucagaaagaua

SEQ ID NO: 4077705 - RNA, 17 nt, Variola virus
aaucucaucaucgaaga

SEQ ID NO: 4077706 - RNA, 19 nt, Variola virus
aaucucuaucgucacauau

SEQ ID NO: 4077707 - RNA, 13 nt, Variola virus
aaucucuauuugu

SEQ ID NO: 4077708 - RNA, 17 nt, Variola virus
aaucucuguuauuuccu

SEQ ID NO: 4077709 - RNA, 17 nt, Variola virus
aaucucuucuauuuuca

SEQ ID NO: 4077710 - RNA, 12 nt, Variola virus
aaucugaaaaua

SEQ ID NO: 4077711 - RNA, 18 nt, Variola virus
aaucugaaccaucaucug

SEQ ID NO: 4077712 - RNA, 19 nt, Variola virus
aaucugguggauacucuag

SEQ ID NO: 4077713 - RNA, 15 nt, Variola virus
aaucuguauaucuuu

SEQ ID NO: 4077714 - RNA, 14 nt, Variola virus
aaucuuaauaucuu

SEQ ID NO: 4077715 - RNA, 15 nt, Variola virus
aaucuuauaucuucu

SEQ ID NO: 4077716 - RNA, 18 nt, Variola virus
aaucuuuguuaaauauug

SEQ ID NO: 4077717 - RNA, 17 nt, Variola virus
aaucuuuuucaucuugu

SEQ ID NO: 4077718 - RNA, 20 nt, Variola virus
aaugaaguaguugcauagau

SEQ ID NO: 4077719 - RNA, 12 nt, Variola virus
aaugaauguuua

SEQ ID NO: 4077720 - RNA, 23 nt, Variola virus
aaugaauuaauuaaaauauuguu

SEQ ID NO: 4077721 - RNA, 22 nt, Variola virus
aaugacaucgaagauuguccaa

SEQ ID NO: 4077722 - RNA, 14 nt, Variola virus
aaugacauggaaau

SEQ ID NO: 4077723 - RNA, 16 nt, Variola virus
aaugacgaauugaaaa

SEQ ID NO: 4077724 - RNA, 18 nt, Variola virus
aaugacgaauugaaaauu

SEQ ID NO: 4077725 - RNA, 17 nt, Variola virus
aaugacggguuuucuau

SEQ ID NO: 4077726 - RNA, 20 nt, Variola virus
aaugacguuaauaacaaaaa

SEQ ID NO: 4077727 - RNA, 17 nt, Variola virus
aaugacuuagugauauc

SEQ ID NO: 4077728 - RNA, 16 nt, Variola virus
aaugagagcaaaauau

SEQ ID NO: 4077729 - RNA, 17 nt, Variola virus
aaugagagcaaaauaua

SEQ ID NO: 4077730 - RNA, 21 nt, Variola virus
aaugagagcauauuucauuuc

SEQ ID NO: 4077731 - RNA, 16 nt, Variola virus
aaugagcguuuaaagu

SEQ ID NO: 4077732 - RNA, 21 nt, Variola virus
aaugagguagcaaaaaaacug

SEQ ID NO: 4077733 - RNA, 20 nt, Variola virus
aaugaguauauguauuuucu

SEQ ID NO: 4077734 - RNA, 19 nt, Variola virus
aaugaguuauuaagaaaua

SEQ ID NO: 4077735 - RNA, 18 nt, Variola virus
aaugauaaaaucaaacuu

SEQ ID NO: 4077736 - RNA, 17 nt, Variola virus
aaugauacugauaaagu

SEQ ID NO: 4077737 - RNA, 19 nt, Variola virus
aaugauauacaaugcucag

SEQ ID NO: 4077738 - RNA, 16 nt, Variola virus
aaugaucuaaauuaua

SEQ ID NO: 4077739 - RNA, 18 nt, Variola virus
aaugaugauaaaauggau

SEQ ID NO: 4077740 - RNA, 12 nt, Variola virus
aaugaugauguu

SEQ ID NO: 4077741 - RNA, 13 nt, Variola virus
aaugaugcagaua

SEQ ID NO: 4077742 - RNA, 19 nt, Variola virus
aaugcauucguauucuaua

SEQ ID NO: 4077743 - RNA, 19 nt, Variola virus
aaugccuuccaaaguuuaa

SEQ ID NO: 4077744 - RNA, 16 nt, Variola virus
aaugcgaggaaaugua

SEQ ID NO: 4077745 - RNA, 18 nt, Variola virus
aaugcuaguuuuagaaua

SEQ ID NO: 4077746 - RNA, 15 nt, Variola virus
aaugcucugcaauaa

SEQ ID NO: 4077747 - RNA, 17 nt, Variola virus
aaugcuugaaaauggac

SEQ ID NO: 4077748 - RNA, 18 nt, Variola virus
aauggaagguauuuccau

SEQ ID NO: 4077749 - RNA, 13 nt, Variola virus
aauggaauccaau

SEQ ID NO: 4077750 - RNA, 13 nt, Variola virus
aauggcaaaugua

SEQ ID NO: 4077751 - RNA, 14 nt, Variola virus
aaugguacagaaaa

SEQ ID NO: 4077752 - RNA, 24 nt, Variola virus
aauguaaagagugaucaaaucauu

SEQ ID NO: 4077753 - RNA, 15 nt, Variola virus
aaugucccuuuaaga

SEQ ID NO: 4077754 - RNA, 20 nt, Variola virus
aaugucgcaauuuguauuau

SEQ ID NO: 4077755 - RNA, 19 nt, Variola virus
aaugucuauuauaaagaua

SEQ ID NO: 4077756 - RNA, 17 nt, Variola virus
aaugugaguauuuuacu

SEQ ID NO: 4077757 - RNA, 16 nt, Variola virus
aaugugauguaucuau

SEQ ID NO: 4077758 - RNA, 16 nt, Variola virus
aauguguuaaaaagaa

SEQ ID NO: 4077759 - RNA, 16 nt, Variola virus
aauguuagugaugaau

SEQ ID NO: 4077760 - RNA, 19 nt, Variola virus
aauguuauauguaacauua

SEQ ID NO: 4077761 - RNA, 17 nt, Variola virus
aauguugucaaaugauc

SEQ ID NO: 4077762 - RNA, 19 nt, Variola virus
aauguuugacugaauauau

SEQ ID NO: 4077763 - RNA, 21 nt, Variola virus
aauuaaaaccaaguacuacaa

SEQ ID NO: 4077764 - RNA, 17 nt, Variola virus
aauuaacgaugagugca

SEQ ID NO: 4077765 - RNA, 18 nt, Variola virus
aauuaauucguuggaaaa

SEQ ID NO: 4077766 - RNA, 16 nt, Variola virus
aauuacagacaguaau

SEQ ID NO: 4077767 - RNA, 16 nt, Variola virus
aauuacauagaugaua

SEQ ID NO: 4077768 - RNA, 16 nt, Variola virus
aauuacuaguaucaau

SEQ ID NO: 4077769 - RNA, 18 nt, Variola virus
aauuacugauaauguaga

SEQ ID NO: 4077770 - RNA, 21 nt, Variola virus
aauuacugauaauguagaaaa

SEQ ID NO: 4077771 - RNA, 13 nt, Variola virus
aauuagagaauua

SEQ ID NO: 4077772 - RNA, 19 nt, Variola virus
aauuagucauacguaauga

SEQ ID NO: 4077773 - RNA, 17 nt, Variola virus
aauuagucgguuaaugu

SEQ ID NO: 4077774 - RNA, 23 nt, Variola virus
aauuaguguauaauuuugucaua

SEQ ID NO: 4077775 - RNA, 21 nt, Variola virus
aauuauacuuugguaaauguu

SEQ ID NO: 4077776 - RNA, 17 nt, Variola virus
aauuauauaauucuauu

SEQ ID NO: 4077777 - RNA, 12 nt, Variola virus
aauuaugauacu

SEQ ID NO: 4077778 - RNA, 17 nt, Variola virus
aauuauucguuuacuga

SEQ ID NO: 4077779 - RNA, 15 nt, Variola virus
aauuauucuaucaau

SEQ ID NO: 4077780 - RNA, 22 nt, Variola virus
aauuauugauaccuuuaaaagu

SEQ ID NO: 4077781 - RNA, 15 nt, Variola virus
aauuauuucuaacau

SEQ ID NO: 4077782 - RNA, 18 nt, Variola virus
aauucauagccaauggau

SEQ ID NO: 4077783 - RNA, 19 nt, Variola virus
aauucccaaucuuguuaua

SEQ ID NO: 4077784 - RNA, 18 nt, Variola virus
aauuccguuaauauuaaa

SEQ ID NO: 4077785 - RNA, 19 nt, Variola virus
aauuccuuugcuauuucua

SEQ ID NO: 4077786 - RNA, 21 nt, Variola virus
aauucgaggaagauguaaaga

SEQ ID NO: 4077787 - RNA, 20 nt, Variola virus
aauucguuuuuauaugugac

SEQ ID NO: 4077788 - RNA, 13 nt, Variola virus
aauucuaaaugau

SEQ ID NO: 4077789 - RNA, 13 nt, Variola virus
aauucuaauggau

SEQ ID NO: 4077790 - RNA, 20 nt, Variola virus
aauucuacaacauuauuaua

SEQ ID NO: 4077791 - RNA, 21 nt, Variola virus
aauucuaccagucuaggaaua

SEQ ID NO: 4077792 - RNA, 17 nt, Variola virus
aauucuaggcucaguau

SEQ ID NO: 4077793 - RNA, 21 nt, Variola virus
aauucuauccaagauacuuau

SEQ ID NO: 4077794 - RNA, 23 nt, Variola virus
aauucucggauagucuucuuauc

SEQ ID NO: 4077795 - RNA, 15 nt, Variola virus
aauucuucaaaugaa

SEQ ID NO: 4077796 - RNA, 14 nt, Variola virus
aauucuuuaauauc

SEQ ID NO: 4077797 - RNA, 17 nt, Variola virus
aauucuuuauaacugaa

SEQ ID NO: 4077798 - RNA, 16 nt, Variola virus
aauugaaucuuaguaa

SEQ ID NO: 4077799 - RNA, 21 nt, Variola virus
acuaauucauuuucaauaaua

SEQ ID NO: 4077800 - RNA, 24 nt, Variola virus
acuaauucuuuuucauuaacuaga

SEQ ID NO: 4077801 - RNA, 17 nt, Variola virus
acuaauuguuuaaauaa

SEQ ID NO: 4077802 - RNA, 16 nt, Variola virus
acuacaguaaguacau

SEQ ID NO: 4077803 - RNA, 20 nt, Variola virus
acuacauuaaaacuuaaaaa

SEQ ID NO: 4077804 - RNA, 19 nt, Variola virus
acuaccaaccuacacuauu

SEQ ID NO: 4077805 - RNA, 22 nt, Variola virus
acuacuaggagggaaaaugaag

SEQ ID NO: 4077806 - RNA, 15 nt, Variola virus
acuacuauuauugaa

SEQ ID NO: 4077807 - RNA, 21 nt, Variola virus
acuacucuuccacuauugcca

SEQ ID NO: 4077808 - RNA, 18 nt, Variola virus
acuacuuacauggacaca

SEQ ID NO: 4077809 - RNA, 14 nt, Variola virus
acuacuucauuaau

SEQ ID NO: 4077810 - RNA, 19 nt, Variola virus
acuagaaagggaaaaauua

SEQ ID NO: 4077811 - RNA, 17 nt, Variola virus
acuagacauuuaccaug

SEQ ID NO: 4077812 - RNA, 15 nt, Variola virus
acuagcauauuugua

SEQ ID NO: 4077813 - RNA, 19 nt, Variola virus
acuagcucgagaaugaaua

SEQ ID NO: 4077814 - RNA, 16 nt, Variola virus
acuaggagaauuauuu

SEQ ID NO: 4077815 - RNA, 22 nt, Variola virus
acuauaaaaaaaauaauaauua

SEQ ID NO: 4077816 - RNA, 16 nt, Variola virus
acuauaccauauccuc

SEQ ID NO: 4077817 - RNA, 16 nt, Variola virus
acuauagaugcuauca

SEQ ID NO: 4077818 - RNA, 22 nt, Variola virus
acuauagucagcacucuuccau

SEQ ID NO: 4077819 - RNA, 13 nt, Variola virus
acuauaucaguau

SEQ ID NO: 4077820 - RNA, 17 nt, Variola virus
acuaucaaccacauaau

SEQ ID NO: 4077821 - RNA, 21 nt, Variola virus
acuaucaguaaguuuuauaga

SEQ ID NO: 4077822 - RNA, 15 nt, Variola virus
acuaucauaauuaaa

SEQ ID NO: 4077823 - RNA, 12 nt, Variola virus
acuauccaauaa

SEQ ID NO: 4077824 - RNA, 15 nt, Variola virus
acuauccaucagaau

SEQ ID NO: 4077825 - RNA, 15 nt, Variola virus
acuaucuuuaauaga

SEQ ID NO: 4077826 - RNA, 16 nt, Variola virus
acuauguuaauacuua

SEQ ID NO: 4077827 - RNA, 17 nt, Variola virus
acuauuacaauuaauaa

SEQ ID NO: 4077828 - RNA, 23 nt, Variola virus
acuauuacagaaguuuuaaaaga

SEQ ID NO: 4077829 - RNA, 14 nt, Variola virus
acuauucauguaau

SEQ ID NO: 4077830 - RNA, 18 nt, Variola virus
acuauuccaaaugaugau

SEQ ID NO: 4077831 - RNA, 15 nt, Variola virus
acuauuguacauuau

SEQ ID NO: 4077832 - RNA, 12 nt, Variola virus
acuauuugucua

SEQ ID NO: 4077833 - RNA, 19 nt, Variola virus
acuauuuugguaucuucca

SEQ ID NO: 4077834 - RNA, 12 nt, Variola virus
acucaaacagaa

SEQ ID NO: 4077835 - RNA, 16 nt, Variola virus
acucaaacuaaauguc

SEQ ID NO: 4077836 - RNA, 21 nt, Variola virus
acucaacauaaauaauucuag

SEQ ID NO: 4077837 - RNA, 15 nt, Variola virus
acucacaaucacugu

SEQ ID NO: 4077838 - RNA, 22 nt, Variola virus
acucagauaauagcaauauuag

SEQ ID NO: 4077839 - RNA, 16 nt, Variola virus
acucaugauuaaaccu

SEQ ID NO: 4077840 - RNA, 15 nt, Variola virus
acuccauauauguuu

SEQ ID NO: 4077841 - RNA, 14 nt, Variola virus
acucccacaaauac

SEQ ID NO: 4077842 - RNA, 16 nt, Variola virus
acuccggauagagaaa

SEQ ID NO: 4077843 - RNA, 18 nt, Variola virus
acuccggucgaugaugau

SEQ ID NO: 4077844 - RNA, 23 nt, Variola virus
acuccuuauuuuuagacauuaga

SEQ ID NO: 4077845 - RNA, 18 nt, Variola virus
acucgaacagauaguuua

SEQ ID NO: 4077846 - RNA, 15 nt, Variola virus
acucgcguuuagagg

SEQ ID NO: 4077847 - RNA, 13 nt, Variola virus
acucuaaguuugu

SEQ ID NO: 4077848 - RNA, 14 nt, Variola virus
acucucaaaaugcu

SEQ ID NO: 4077849 - RNA, 23 nt, Variola virus
acucucaagauuuuaaaaaacug

SEQ ID NO: 4077850 - RNA, 18 nt, Variola virus
acucucccuauaucuucu

SEQ ID NO: 4077851 - RNA, 15 nt, Variola virus
acucucgaaaucaca

SEQ ID NO: 4077852 - RNA, 13 nt, Variola virus
acucucgauaaau

SEQ ID NO: 4077853 - RNA, 15 nt, Variola virus
acucugaaaagaaag

SEQ ID NO: 4077854 - RNA, 20 nt, Variola virus
acucuguugguuuucuuaua

SEQ ID NO: 4077855 - RNA, 17 nt, Variola virus
acucuguuucuguaucu

SEQ ID NO: 4077856 - RNA, 19 nt, Variola virus
acucuguuuuauuaaccga

SEQ ID NO: 4077857 - RNA, 14 nt, Variola virus
acucuuauuauaga

SEQ ID NO: 4077858 - RNA, 12 nt, Variola virus
acucuucuuauu

SEQ ID NO: 4077859 - RNA, 16 nt, Variola virus
acucuuuuauuuucca

SEQ ID NO: 4077860 - RNA, 23 nt, Variola virus
acugaaaauuaaaauaacacuau

SEQ ID NO: 4077861 - RNA, 21 nt, Variola virus
acugaacgaugguuuucacau

SEQ ID NO: 4077862 - RNA, 14 nt, Variola virus
acugaagagacuga

SEQ ID NO: 4077863 - RNA, 23 nt, Variola virus
acugaauacauuaucaaaaagaa

SEQ ID NO: 4077864 - RNA, 18 nt, Variola virus
acugaaugcuuucuugga

SEQ ID NO: 4077865 - RNA, 20 nt, Variola virus
acugacuucuaacaaacauc

SEQ ID NO: 4077866 - RNA, 16 nt, Variola virus
acugagaaacagcaua

SEQ ID NO: 4077867 - RNA, 22 nt, Variola virus
acugauaaaguagauuaugaag

SEQ ID NO: 4077868 - RNA, 18 nt, Variola virus
acugauaauguagaaaau

SEQ ID NO: 4077869 - RNA, 15 nt, Variola virus
acugauaccaugaaa

SEQ ID NO: 4077870 - RNA, 13 nt, Variola virus
acugauucagaaa

SEQ ID NO: 4077871 - RNA, 17 nt, Variola virus
acugcaauaaaacauuu

SEQ ID NO: 4077872 - RNA, 21 nt, Variola virus
acugcuaccgaagagcagcua

SEQ ID NO: 4077873 - RNA, 20 nt, Variola virus
acuggucauagaaaaugauu

SEQ ID NO: 4077874 - RNA, 22 nt, Variola virus
acuggugaguuaauauucaugu

SEQ ID NO: 4077875 - RNA, 23 nt, Variola virus
acuguagaugguucuuuaauagu

SEQ ID NO: 4077876 - RNA, 12 nt, Variola virus
acuguauuugga

SEQ ID NO: 4077877 - RNA, 16 nt, Variola virus
acugucaaaaaaauag

SEQ ID NO: 4077878 - RNA, 18 nt, Variola virus
acuguguucaagucauaa

SEQ ID NO: 4077879 - RNA, 13 nt, Variola virus
acuguuuaauagc

SEQ ID NO: 4077880 - RNA, 20 nt, Variola virus
acuguuuucuagauggaaau

SEQ ID NO: 4077881 - RNA, 20 nt, Variola virus
acuuaaaacuugauaauuaa

SEQ ID NO: 4077882 - RNA, 18 nt, Variola virus
acuuaaacaaaauacaau

SEQ ID NO: 4077883 - RNA, 18 nt, Variola virus
acuuaacaugagacauaa

SEQ ID NO: 4077884 - RNA, 16 nt, Variola virus
acuuaacuaucuuuca

SEQ ID NO: 4077885 - RNA, 19 nt, Variola virus
acuuaauauaauauugaag

SEQ ID NO: 4077886 - RNA, 22 nt, Variola virus
acuuaaugaagauuuauuucca

SEQ ID NO: 4077887 - RNA, 22 nt, Variola virus
acuuacagauggauaaaacuuc

SEQ ID NO: 4077888 - RNA, 20 nt, Variola virus
acuuacauggacacauucuu

SEQ ID NO: 4077889 - RNA, 20 nt, Variola virus
acuuauggacaacagaggau

SEQ ID NO: 4077890 - RNA, 17 nt, Variola virus
acuuauuguuuuaauaa

SEQ ID NO: 4077891 - RNA, 15 nt, Variola virus
acuucauuaaucuuu

SEQ ID NO: 4077892 - RNA, 17 nt, Variola virus
acuucauugauaucuuu

SEQ ID NO: 4077893 - RNA, 17 nt, Variola virus
acuuccaauaaaauuac

SEQ ID NO: 4077894 - RNA, 19 nt, Variola virus
acuuccaauaaaauuacuu

SEQ ID NO: 4077895 - RNA, 19 nt, Variola virus
acuuccguuuaaaaauggu

SEQ ID NO: 4077896 - RNA, 16 nt, Variola virus
acuucgauaaaauuac

SEQ ID NO: 4077897 - RNA, 19 nt, Variola virus
acuugaaagagauaauaga

SEQ ID NO: 4077898 - RNA, 23 nt, Variola virus
acuugaaauaaucggagaauguu

SEQ ID NO: 4077899 - RNA, 15 nt, Variola virus
acuuggaaacaucuc

SEQ ID NO: 4077900 - RNA, 14 nt, Variola virus
acuuguauaauaag

SEQ ID NO: 4077901 - RNA, 19 nt, Variola virus
acuuuaaccuauacaugau

SEQ ID NO: 4077902 - RNA, 16 nt, Variola virus
acuuuaauaacaaaga

SEQ ID NO: 4077903 - RNA, 18 nt, Variola virus
acuuuauaauuaaugaaa

SEQ ID NO: 4077904 - RNA, 20 nt, Variola virus
acuuuauugccuguaauaau

SEQ ID NO: 4077905 - RNA, 16 nt, Variola virus
acuuucaucuaauaag

SEQ ID NO: 4077906 - RNA, 22 nt, Variola virus
acuuugcauucuaucucaaaau

SEQ ID NO: 4077907 - RNA, 16 nt, Variola virus
acuuuuguccuaaaau

SEQ ID NO: 4077908 - RNA, 15 nt, Variola virus
acuuuuguuacuaau

SEQ ID NO: 4077909 - RNA, 13 nt, Variola virus
acuuuuuacuaau

SEQ ID NO: 4077910 - RNA, 22 nt, Variola virus
acuuuuucuagaaaaaaaauug

SEQ ID NO: 4077911 - RNA, 14 nt, Variola virus
agaaaaaaauggaa

SEQ ID NO: 4077912 - RNA, 23 nt, Variola virus
agaaaaaugaugcugguuauuac

SEQ ID NO: 4077913 - RNA, 19 nt, Variola virus
agaaaaaugcuaauauuaa

SEQ ID NO: 4077914 - RNA, 19 nt, Variola virus
agaaaacaaagucuagauu

SEQ ID NO: 4077915 - RNA, 22 nt, Variola virus
agaaaagauuaagauuaaacau

SEQ ID NO: 4077916 - RNA, 23 nt, Variola virus
agaaaagguucuaucaacaauau

SEQ ID NO: 4077917 - RNA, 17 nt, Variola virus
agaaaaguccuagaauu

SEQ ID NO: 4077918 - RNA, 23 nt, Variola virus
agaaaauaucuucuccuguaaua

SEQ ID NO: 4077919 - RNA, 15 nt, Variola virus
agaaacagaacuauu

SEQ ID NO: 4077920 - RNA, 22 nt, Variola virus
agaaagauauauuaagaauaau

SEQ ID NO: 4077921 - RNA, 18 nt, Variola virus
agaaaguaucaaaucgau

SEQ ID NO: 4077922 - RNA, 12 nt, Variola virus
agaaauacuucc

SEQ ID NO: 4077923 - RNA, 18 nt, Variola virus
agaaauagcgcugaaaau

SEQ ID NO: 4077924 - RNA, 18 nt, Variola virus
caauaccaaagaaggaag

SEQ ID NO: 4077925 - RNA, 16 nt, Variola virus
caauagcacaauuguu

SEQ ID NO: 4077926 - RNA, 22 nt, Variola virus
caauagcaucgcaacuauucua

SEQ ID NO: 4077927 - RNA, 17 nt, Variola virus
caauagucuuguaaaga

SEQ ID NO: 4077928 - RNA, 18 nt, Variola virus
caauaugccaauaaugau

SEQ ID NO: 4077929 - RNA, 20 nt, Variola virus
caauaugucuguacaaaugu

SEQ ID NO: 4077930 - RNA, 21 nt, Variola virus
caauaugucuguacaaauguu

SEQ ID NO: 4077931 - RNA, 20 nt, Variola virus
caaucaacgaauuaaugaua

SEQ ID NO: 4077932 - RNA, 21 nt, Variola virus
caauccguaacggaaauuaca

SEQ ID NO: 4077933 - RNA, 18 nt, Variola virus
caaucuaagaaauuuaaa

SEQ ID NO: 4077934 - RNA, 14 nt, Variola virus
caaugaauggauua

SEQ ID NO: 4077935 - RNA, 17 nt, Variola virus
caaugcucaguaaaugu

SEQ ID NO: 4077936 - RNA, 18 nt, Variola virus
caaugcucaguaaaugua

SEQ ID NO: 4077937 - RNA, 21 nt, Variola virus
caauggaugaggaagugauau

SEQ ID NO: 4077938 - RNA, 20 nt, Variola virus
caaugggagauuaaacuacu

SEQ ID NO: 4077939 - RNA, 20 nt, Variola virus
caaugggaugcaaaacccca

SEQ ID NO: 4077940 - RNA, 15 nt, Variola virus
caaugggucguugga

SEQ ID NO: 4077941 - RNA, 21 nt, Variola virus
caauguagaaauuagaaagau

SEQ ID NO: 4077942 - RNA, 17 nt, Variola virus
caauguauacaaaugua

SEQ ID NO: 4077943 - RNA, 20 nt, Variola virus
caauuaacauucuuauaaca

SEQ ID NO: 4077944 - RNA, 21 nt, Variola virus
caauuaacauucuuauaacau

SEQ ID NO: 4077945 - RNA, 19 nt, Variola virus
caauuaauuaauacaguaa

SEQ ID NO: 4077946 - RNA, 14 nt, Variola virus
caauuacugucucc

SEQ ID NO: 4077947 - RNA, 15 nt, Variola virus
caauuagaacacgua

SEQ ID NO: 4077948 - RNA, 22 nt, Variola virus
caauuauacguuuuuauauaau

SEQ ID NO: 4077949 - RNA, 17 nt, Variola virus
caauucgguuaugaaug

SEQ ID NO: 4077950 - RNA, 18 nt, Variola virus
caauugauaguaaauaau

SEQ ID NO: 4077951 - RNA, 18 nt, Variola virus
caauuggaguaucaucua

SEQ ID NO: 4077952 - RNA, 13 nt, Variola virus
caauugucauuag

SEQ ID NO: 4077953 - RNA, 15 nt, Variola virus
caauugucuauacaa

SEQ ID NO: 4077954 - RNA, 21 nt, Variola virus
caauuuuucagauuuuugaau

SEQ ID NO: 4077955 - RNA, 22 nt, Variola virus
cacaaauggauguuaauguauu

SEQ ID NO: 4077956 - RNA, 17 nt, Variola virus
cacacugauauuaugau

SEQ ID NO: 4077957 - RNA, 18 nt, Variola virus
cacauccaucaauuguaa

SEQ ID NO: 4077958 - RNA, 14 nt, Variola virus
cacauuguaacuau

SEQ ID NO: 4077959 - RNA, 18 nt, Variola virus
cacauuuuaaauaaaugu

SEQ ID NO: 4077960 - RNA, 13 nt, Variola virus
caccaagaaagcu

SEQ ID NO: 4077961 - RNA, 17 nt, Variola virus
cacccguagaaauacua

SEQ ID NO: 4077962 - RNA, 12 nt, Variola virus
caccuaaaugug

SEQ ID NO: 4077963 - RNA, 18 nt, Variola virus
cacgaaaucuauagguaa

SEQ ID NO: 4077964 - RNA, 23 nt, Variola virus
cacgaagagaccgauacaugauu

SEQ ID NO: 4077965 - RNA, 18 nt, Variola virus
cacgguaauaaaauguca

SEQ ID NO: 4077966 - RNA, 12 nt, Variola virus
cacguuaaacaa

SEQ ID NO: 4077967 - RNA, 18 nt, Variola virus
cacuaaguauauacacag

SEQ ID NO: 4077968 - RNA, 20 nt, Variola virus
cacuagaagagaauacacau

SEQ ID NO: 4077969 - RNA, 20 nt, Variola virus
cacuauaucaguaucuucuu

SEQ ID NO: 4077970 - RNA, 16 nt, Variola virus
cacuauguuagcauuu

SEQ ID NO: 4077971 - RNA, 14 nt, Variola virus
cacuauuauaacaa

SEQ ID NO: 4077972 - RNA, 23 nt, Variola virus
cacucgacugaauauuagcacau

SEQ ID NO: 4077973 - RNA, 14 nt, Variola virus
cacugcugaacagu

SEQ ID NO: 4077974 - RNA, 19 nt, Variola virus
cacuuaacuaucuuucaag

SEQ ID NO: 4077975 - RNA, 14 nt, Variola virus
cacuucucuaucaa

SEQ ID NO: 4077976 - RNA, 14 nt, Variola virus
cagaaauaugugaa

SEQ ID NO: 4077977 - RNA, 21 nt, Variola virus
cagaaauugguauaaauguug

SEQ ID NO: 4077978 - RNA, 17 nt, Variola virus
cagaacaucuuccauag

SEQ ID NO: 4077979 - RNA, 18 nt, Variola virus
cagaaguuuuguauugua

SEQ ID NO: 4077980 - RNA, 18 nt, Variola virus
cagaauagauauuaaugu

SEQ ID NO: 4077981 - RNA, 21 nt, Variola virus
cagaauauacuuuguguuuca

SEQ ID NO: 4077982 - RNA, 14 nt, Variola virus
cagaauaucccaaa

SEQ ID NO: 4077983 - RNA, 12 nt, Variola virus
cagaauaucuau

SEQ ID NO: 4077984 - RNA, 14 nt, Variola virus
cagaaucuagauuc

SEQ ID NO: 4077985 - RNA, 15 nt, Variola virus
cagaauguacacuau

SEQ ID NO: 4077986 - RNA, 15 nt, Variola virus
cagacuacuuuccua

SEQ ID NO: 4077987 - RNA, 17 nt, Variola virus
cagagccaucuguaaaa

SEQ ID NO: 4077988 - RNA, 14 nt, Variola virus
cagaggaaauauca

SEQ ID NO: 4077989 - RNA, 16 nt, Variola virus
cagaggaugaaauaga

SEQ ID NO: 4077990 - RNA, 16 nt, Variola virus
cagauacaaauuuuaa

SEQ ID NO: 4077991 - RNA, 15 nt, Variola virus
cagaucaauggauua

SEQ ID NO: 4077992 - RNA, 20 nt, Variola virus
cagauccucccguuaaaacc

SEQ ID NO: 4077993 - RNA, 16 nt, Variola virus
cagaugucagcaucug

SEQ ID NO: 4077994 - RNA, 22 nt, Variola virus
cagauugaauaggaguuugaau

SEQ ID NO: 4077995 - RNA, 18 nt, Variola virus
cagauuuaacaauuucua

SEQ ID NO: 4077996 - RNA, 22 nt, Variola virus
cagauuuuugaaugaaugaaua

SEQ ID NO: 4077997 - RNA, 17 nt, Variola virus
cagcaucuugaauagaa

SEQ ID NO: 4077998 - RNA, 12 nt, Variola virus
cagcauuacuug

SEQ ID NO: 4077999 - RNA, 16 nt, Variola virus
caggagauagauaucc

SEQ ID NO: 4078000 - RNA, 17 nt, Variola virus
caggauaaggaauugua

SEQ ID NO: 4078001 - RNA, 16 nt, Variola virus
caggcugucggagcca

SEQ ID NO: 4078002 - RNA, 19 nt, Variola virus
caguaaccaaauacauauu

SEQ ID NO: 4078003 - RNA, 18 nt, Variola virus
caguagcgagaaagcauc

SEQ ID NO: 4078004 - RNA, 17 nt, Variola virus
caguccagaaauauuua

SEQ ID NO: 4078005 - RNA, 18 nt, Variola virus
cagucccaugguuccaua

SEQ ID NO: 4078006 - RNA, 15 nt, Variola virus
cagucggucaacuua

SEQ ID NO: 4078007 - RNA, 17 nt, Variola virus
cagucuaauauccauuu

SEQ ID NO: 4078008 - RNA, 16 nt, Variola virus
cagucuaguauacaua

SEQ ID NO: 4078009 - RNA, 11 nt, Variola virus
cagucuggaaa

SEQ ID NO: 4078010 - RNA, 20 nt, Variola virus
cagucuuuaaguucuggaau

SEQ ID NO: 4078011 - RNA, 19 nt, Variola virus
cagugauagacuagaagaa

SEQ ID NO: 4078012 - RNA, 15 nt, Variola virus
cagugcaucaacuuc

SEQ ID NO: 4078013 - RNA, 18 nt, Variola virus
caguggaguaguaaaugc

SEQ ID NO: 4078014 - RNA, 17 nt, Variola virus
caguguauguaaaaaug

SEQ ID NO: 4078015 - RNA, 16 nt, Variola virus
caguuagcuacucuag

SEQ ID NO: 4078016 - RNA, 19 nt, Variola virus
caguuuggggcuauucauc

SEQ ID NO: 4078017 - RNA, 18 nt, Variola virus
caguuuucucaucacuua

SEQ ID NO: 4078018 - RNA, 12 nt, Variola virus
cauaaaacauca

SEQ ID NO: 4078019 - RNA, 18 nt, Variola virus
cauaaaacuaauauuuua

SEQ ID NO: 4078020 - RNA, 12 nt, Variola virus
cauaaaaguugu

SEQ ID NO: 4078021 - RNA, 23 nt, Variola virus
cauaaacaauauuaaggagauuc

SEQ ID NO: 4078022 - RNA, 18 nt, Variola virus
cauaaaccgaucacuaau

SEQ ID NO: 4078023 - RNA, 20 nt, Variola virus
cauaaaggcgcccauuucaa

SEQ ID NO: 4078024 - RNA, 16 nt, Variola virus
cauaaauuauuucauu

SEQ ID NO: 4078025 - RNA, 20 nt, Variola virus
cauaaauuucuccaacgauu

SEQ ID NO: 4078026 - RNA, 16 nt, Variola virus
cauaacauguaucaau

SEQ ID NO: 4078027 - RNA, 16 nt, Variola virus
cauaacuguauaaaau

SEQ ID NO: 4078028 - RNA, 18 nt, Variola virus
cauaagcgcuauauaaau

SEQ ID NO: 4078029 - RNA, 16 nt, Variola virus
cauaauauaaaaacuu

SEQ ID NO: 4078030 - RNA, 16 nt, Variola virus
cauaauaugaucacau

SEQ ID NO: 4078031 - RNA, 15 nt, Variola virus
cauaauauuaaacac

SEQ ID NO: 4078032 - RNA, 23 nt, Variola virus
cauacaaaaauauauuauuuuua

SEQ ID NO: 4078033 - RNA, 14 nt, Variola virus
cauacaugauauuc

SEQ ID NO: 4078034 - RNA, 22 nt, Variola virus
cauaccgucccaaaacauggau

SEQ ID NO: 4078035 - RNA, 17 nt, Variola virus
cauacgacgaaaauggu

SEQ ID NO: 4078036 - RNA, 16 nt, Variola virus
cauacgcguucucaag

SEQ ID NO: 4078037 - RNA, 14 nt, Variola virus
cauacuacuauuau

SEQ ID NO: 4078038 - RNA, 21 nt, Variola virus
cauagaugagguacuauuuua

SEQ ID NO: 4078039 - RNA, 13 nt, Variola virus
cauaguuaaauaa

SEQ ID NO: 4078040 - RNA, 15 nt, Variola virus
cauaguuuuaagaaa

SEQ ID NO: 4078041 - RNA, 23 nt, Variola virus
cauauaacuaucaacugugaugu

SEQ ID NO: 4078042 - RNA, 17 nt, Variola virus
cauauacuauuacuuau

SEQ ID NO: 4078043 - RNA, 20 nt, Variola virus
cauauacugauaauaaugaa

SEQ ID NO: 4078044 - RNA, 23 nt, Variola virus
cauauccagacaacaaucguuug

SEQ ID NO: 4078045 - RNA, 21 nt, Variola virus
cauaucugcgacggagcauuu

SEQ ID NO: 4078046 - RNA, 18 nt, Variola virus
cauauguaguguuaauuu

SEQ ID NO: 4078047 - RNA, 14 nt, Variola virus
cauauucuacucuu

SEQ ID NO: 4078048 - RNA, 19 nt, Variola virus
cauauuuagaaaaaagauu

SEQ ID NO: 4078049 - RNA, 20 nt, Variola virus
cauauuugaacuuaacuuca

SEQ ID NO: 4078050 - RNA, 17 nt, Variola virus
cugacauucagaaagag

SEQ ID NO: 4078051 - RNA, 20 nt, Variola virus
cugagcaaacucucaaaaga

SEQ ID NO: 4078052 - RNA, 16 nt, Variola virus
cugaguuuuuaggaaa

SEQ ID NO: 4078053 - RNA, 17 nt, Variola virus
cugauaauauuaucuau

SEQ ID NO: 4078054 - RNA, 19 nt, Variola virus
cugauacccaaaaacaucc

SEQ ID NO: 4078055 - RNA, 14 nt, Variola virus
cugauauucagaaa

SEQ ID NO: 4078056 - RNA, 23 nt, Variola virus
cugauguaacccacguaacauua

SEQ ID NO: 4078057 - RNA, 14 nt, Variola virus
cugauuaacaaaug

SEQ ID NO: 4078058 - RNA, 19 nt, Variola virus
cugauuaacccaucaucua

SEQ ID NO: 4078059 - RNA, 14 nt, Variola virus
cugcacuaugucca

SEQ ID NO: 4078060 - RNA, 16 nt, Variola virus
cugcauagaaauaucu

SEQ ID NO: 4078061 - RNA, 13 nt, Variola virus
cugcauucaauuc

SEQ ID NO: 4078062 - RNA, 15 nt, Variola virus
cugccgaauuuagag

SEQ ID NO: 4078063 - RNA, 22 nt, Variola virus
cugccuuuuuauacauauucca

SEQ ID NO: 4078064 - RNA, 15 nt, Variola virus
cugcguuaaacauuc

SEQ ID NO: 4078065 - RNA, 17 nt, Variola virus
cugcuauaauuaagaua

SEQ ID NO: 4078066 - RNA, 23 nt, Variola virus
cugcuggaaaauaaaucacugac

SEQ ID NO: 4078067 - RNA, 16 nt, Variola virus
cuggaaaaauacuuuu

SEQ ID NO: 4078068 - RNA, 20 nt, Variola virus
cuggaacauuaaauguauuu

SEQ ID NO: 4078069 - RNA, 20 nt, Variola virus
cuggaauagaaucuauuuua

SEQ ID NO: 4078070 - RNA, 15 nt, Variola virus
cuggaggaguaagaa

SEQ ID NO: 4078071 - RNA, 23 nt, Variola virus
cuggauuauuuuuauuauauuca

SEQ ID NO: 4078072 - RNA, 17 nt, Variola virus
cuggucuaaaauuucca

SEQ ID NO: 4078073 - RNA, 18 nt, Variola virus
cuguaaauguaguauuua

SEQ ID NO: 4078074 - RNA, 20 nt, Variola virus
cuguaagcguugucuguauu

SEQ ID NO: 4078075 - RNA, 21 nt, Variola virus
cuguacacaugguguuacaaa

SEQ ID NO: 4078076 - RNA, 14 nt, Variola virus
cuguagauaguuuu

SEQ ID NO: 4078077 - RNA, 21 nt, Variola virus
cuguauugaugguaucuguua

SEQ ID NO: 4078078 - RNA, 18 nt, Variola virus
cuguauuggauguaugca

SEQ ID NO: 4078079 - RNA, 14 nt, Variola virus
cuguauuguuaaua

SEQ ID NO: 4078080 - RNA, 19 nt, Variola virus
cugucugcagccauuuuua

SEQ ID NO: 4078081 - RNA, 22 nt, Variola virus
cugugagaacuuguuaaagaag

SEQ ID NO: 4078082 - RNA, 11 nt, Variola virus
cuguggaauaa

SEQ ID NO: 4078083 - RNA, 13 nt, Variola virus
cuguguuacauaa

SEQ ID NO: 4078084 - RNA, 22 nt, Variola virus
cuguucaaaaauuuagaaugau

SEQ ID NO: 4078085 - RNA, 14 nt, Variola virus
cuguucaucguuua

SEQ ID NO: 4078086 - RNA, 12 nt, Variola virus
cuguuccaucaa

SEQ ID NO: 4078087 - RNA, 23 nt, Variola virus
cuguugccaaugauguuaggaaa

SEQ ID NO: 4078088 - RNA, 13 nt, Variola virus
cuguuuauacaag

SEQ ID NO: 4078089 - RNA, 20 nt, Variola virus
cuguuuaucuauacuauuaa

SEQ ID NO: 4078090 - RNA, 15 nt, Variola virus
cuguuucuacuaacu

SEQ ID NO: 4078091 - RNA, 16 nt, Variola virus
cuuaaacuuauucuua

SEQ ID NO: 4078092 - RNA, 14 nt, Variola virus
cuuaaauguuuucu

SEQ ID NO: 4078093 - RNA, 19 nt, Variola virus
cuuaacaauuccacaaauu

SEQ ID NO: 4078094 - RNA, 23 nt, Variola virus
cuuaacgaaagaaguuguaucau

SEQ ID NO: 4078095 - RNA, 14 nt, Variola virus
cuuaacuauuuccg

SEQ ID NO: 4078096 - RNA, 13 nt, Variola virus
cuuaacuuuuucu

SEQ ID NO: 4078097 - RNA, 20 nt, Variola virus
cuuaagacaaguuuaacaau

SEQ ID NO: 4078098 - RNA, 20 nt, Variola virus
cuuaaucauauucuuaugaa

SEQ ID NO: 4078099 - RNA, 23 nt, Variola virus
cuuaauccuucuagaauuagaau

SEQ ID NO: 4078100 - RNA, 17 nt, Variola virus
cuuaauucuagcaucuu

SEQ ID NO: 4078101 - RNA, 12 nt, Variola virus
cuuacaauaaac

SEQ ID NO: 4078102 - RNA, 14 nt, Variola virus
cuuacauaaaugaa

SEQ ID NO: 4078103 - RNA, 17 nt, Variola virus
cuuacguguuuaauuuu

SEQ ID NO: 4078104 - RNA, 16 nt, Variola virus
cuuagauaaaaaauua

SEQ ID NO: 4078105 - RNA, 15 nt, Variola virus
cuuaguaaacagucc

SEQ ID NO: 4078106 - RNA, 16 nt, Variola virus
cuuaguguaaaacuau

SEQ ID NO: 4078107 - RNA, 19 nt, Variola virus
cuuauaauuaauguccaag

SEQ ID NO: 4078108 - RNA, 13 nt, Variola virus
cuuauuaacauuu

SEQ ID NO: 4078109 - RNA, 16 nt, Variola virus
cuuauuacuccauuau

SEQ ID NO: 4078110 - RNA, 18 nt, Variola virus
cuuauuccauuaucugaa

SEQ ID NO: 4078111 - RNA, 23 nt, Variola virus
cuucagaauauucuuuucuaaga

SEQ ID NO: 4078112 - RNA, 22 nt, Variola virus
cuucauaggauuaacaacaaug

SEQ ID NO: 4078113 - RNA, 16 nt, Variola virus
cuucaucacuucacua

SEQ ID NO: 4078114 - RNA, 20 nt, Variola virus
cuuccaaauaauauucucuu

SEQ ID NO: 4078115 - RNA, 22 nt, Variola virus
cuuccaaauaauauucucuuug

SEQ ID NO: 4078116 - RNA, 11 nt, Variola virus
cuuccacauua

SEQ ID NO: 4078117 - RNA, 20 nt, Variola virus
cuuccuaggauagcuuuagu

SEQ ID NO: 4078118 - RNA, 21 nt, Variola virus
cuucgauagauauucuucaga

SEQ ID NO: 4078119 - RNA, 20 nt, Variola virus
cuucuaaugauauauuuucc

SEQ ID NO: 4078120 - RNA, 14 nt, Variola virus
cuucuacauuuuca

SEQ ID NO: 4078121 - RNA, 13 nt, Variola virus
cuucuagauaucc

SEQ ID NO: 4078122 - RNA, 12 nt, Variola virus
cuucuaucuuua

SEQ ID NO: 4078123 - RNA, 11 nt, Variola virus
cuucuauuuua

SEQ ID NO: 4078124 - RNA, 20 nt, Variola virus
cuucuauuuuaucauuuucc

SEQ ID NO: 4078125 - RNA, 14 nt, Variola virus
cuucuuauuuagau

SEQ ID NO: 4078126 - RNA, 15 nt, Variola virus
cuucuuguauuuccu

SEQ ID NO: 4078127 - RNA, 13 nt, Variola virus
cuugaaauucucc

SEQ ID NO: 4078128 - RNA, 15 nt, Variola virus
cuugaauucuuuuau

SEQ ID NO: 4078129 - RNA, 14 nt, Variola virus
cuugacaaaaauua

SEQ ID NO: 4078130 - RNA, 20 nt, Variola virus
cuugagacuugauagauauu

SEQ ID NO: 4078131 - RNA, 22 nt, Variola virus
cuugaggagaucuaaacgaucu

SEQ ID NO: 4078132 - RNA, 14 nt, Variola virus
cuugauaaauugua

SEQ ID NO: 4078133 - RNA, 21 nt, Variola virus
cuugauucuaguaucuuuugu

SEQ ID NO: 4078134 - RNA, 12 nt, Variola virus
cuugcuauuuuu

SEQ ID NO: 4078135 - RNA, 18 nt, Variola virus
cuuguaagaaguaaaugc

SEQ ID NO: 4078136 - RNA, 18 nt, Variola virus
cuuguagacgaacauaau

SEQ ID NO: 4078137 - RNA, 19 nt, Variola virus
cuugucauguugauacauc

SEQ ID NO: 4078138 - RNA, 16 nt, Variola virus
cuuuaacagaugaucu

SEQ ID NO: 4078139 - RNA, 22 nt, Variola virus
cuuuaacgcccuuguauguuuu

SEQ ID NO: 4078140 - RNA, 17 nt, Variola virus
cuuuaaguauauacgau

SEQ ID NO: 4078141 - RNA, 19 nt, Variola virus
cuuuaauaacaaagaaaga

SEQ ID NO: 4078142 - RNA, 14 nt, Variola virus
cuuuaauagauaua

SEQ ID NO: 4078143 - RNA, 17 nt, Variola virus
cuuuagaaauuguauuc

SEQ ID NO: 4078144 - RNA, 20 nt, Variola virus
cuuuaguaaaguugucuaua

SEQ ID NO: 4078145 - RNA, 20 nt, Variola virus
cuuuauaucguguucauuaa

SEQ ID NO: 4078146 - RNA, 13 nt, Variola virus
cuuuaucaagcac

SEQ ID NO: 4078147 - RNA, 19 nt, Variola virus
cuuuaucuaguuguuuaug

SEQ ID NO: 4078148 - RNA, 21 nt, Variola virus
cuuuaucucuuaguaaguuua

SEQ ID NO: 4078149 - RNA, 22 nt, Variola virus
cuuucaaugcacgggcacugau

SEQ ID NO: 4078150 - RNA, 16 nt, Variola virus
cuuucucaacauuuca

SEQ ID NO: 4078151 - RNA, 16 nt, Variola virus
cuuugaauccauuuuc

SEQ ID NO: 4078152 - RNA, 14 nt, Variola virus
cuuugauaaaaguu

SEQ ID NO: 4078153 - RNA, 23 nt, Variola virus
cuuuuaaauacaaauauaucaau

SEQ ID NO: 4078154 - RNA, 23 nt, Variola virus
cuuuuagagguucccaauuccaa

SEQ ID NO: 4078155 - RNA, 20 nt, Variola virus
cuuuuaguaacguaugugaa

SEQ ID NO: 4078156 - RNA, 15 nt, Variola virus
cuuuuauaauucaua

SEQ ID NO: 4078157 - RNA, 19 nt, Variola virus
cuuuuaucgcguagauaua

SEQ ID NO: 4078158 - RNA, 12 nt, Variola virus
cuuuuauuucca

SEQ ID NO: 4078159 - RNA, 21 nt, Variola virus
cuuuucuauaaucauuuuuag

SEQ ID NO: 4078160 - RNA, 16 nt, Variola virus
cuuuuguauucauaga

SEQ ID NO: 4078161 - RNA, 19 nt, Variola virus
cuuuuguccuaaaauacua

SEQ ID NO: 4078162 - RNA, 17 nt, Variola virus
cuuuuuauccuuuagau

SEQ ID NO: 4078163 - RNA, 14 nt, Variola virus
cuuuuuccaauucu

SEQ ID NO: 4078164 - RNA, 22 nt, Variola virus
gaaaaaaaauugaauugaugau

SEQ ID NO: 4078165 - RNA, 22 nt, Variola virus
gaaaaaaauugguguaaaagau

SEQ ID NO: 4078166 - RNA, 16 nt, Variola virus
gaaaaaacauguggua

SEQ ID NO: 4078167 - RNA, 13 nt, Variola virus
gaaaaaauaucua

SEQ ID NO: 4078168 - RNA, 22 nt, Variola virus
gaaaaacacauaacugaagaaa

SEQ ID NO: 4078169 - RNA, 15 nt, Variola virus
gaaaaaguaaaugau

SEQ ID NO: 4078170 - RNA, 16 nt, Variola virus
gaaaaauuuguagauu

SEQ ID NO: 4078171 - RNA, 13 nt, Variola virus
gaaaacauaucua

SEQ ID NO: 4078172 - RNA, 16 nt, Variola virus
gaaaaccgauaacgau

SEQ ID NO: 4078173 - RNA, 18 nt, Variola virus
gaaaacuagauacaaaau

SEQ ID NO: 4078174 - RNA, 16 nt, Variola virus
gaaaagauauccagag

SEQ ID NO: 4078175 - RNA, 16 nt, Variola virus
gaaaagaugaaaugau

SEQ ID NO: 4078176 - RNA, 16 nt, Variola virus
uccaacuccuuuucga

SEQ ID NO: 4078177 - RNA, 15 nt, Variola virus
uccaaucuuaaacau

SEQ ID NO: 4078178 - RNA, 13 nt, Variola virus
uccacauccauga

SEQ ID NO: 4078179 - RNA, 13 nt, Variola virus
uccacuuaaauau

SEQ ID NO: 4078180 - RNA, 16 nt, Variola virus
uccaggauucuccuaa

SEQ ID NO: 4078181 - RNA, 20 nt, Variola virus
uccauaauacucccacaaau

SEQ ID NO: 4078182 - RNA, 17 nt, Variola virus
uccauaauuuucucucg

SEQ ID NO: 4078183 - RNA, 13 nt, Variola virus
uccauagauuucc

SEQ ID NO: 4078184 - RNA, 21 nt, Variola virus
uccauagugguacaauacuac

SEQ ID NO: 4078185 - RNA, 16 nt, Variola virus
uccaucaaaaaugucg

SEQ ID NO: 4078186 - RNA, 18 nt, Variola virus
uccaucagaauguuuccc

SEQ ID NO: 4078187 - RNA, 21 nt, Variola virus
uccaucauuguccuauuucaa

SEQ ID NO: 4078188 - RNA, 18 nt, Variola virus
uccaugauacaacucugc

SEQ ID NO: 4078189 - RNA, 23 nt, Variola virus
uccauuagccuuuccacuucugc

SEQ ID NO: 4078190 - RNA, 22 nt, Variola virus
uccauucucucaaucacuacau

SEQ ID NO: 4078191 - RNA, 19 nt, Variola virus
uccauuggaaaaacacagu

SEQ ID NO: 4078192 - RNA, 14 nt, Variola virus
uccauuuuacauua

SEQ ID NO: 4078193 - RNA, 14 nt, Variola virus
uccauuuucuguaa

SEQ ID NO: 4078194 - RNA, 14 nt, Variola virus
ucccaaugaaucaa

SEQ ID NO: 4078195 - RNA, 13 nt, Variola virus
ucccaauguuucg

SEQ ID NO: 4078196 - RNA, 14 nt, Variola virus
ucccaauuccaaag

SEQ ID NO: 4078197 - RNA, 17 nt, Variola virus
ucccccuuaucaguaga

SEQ ID NO: 4078198 - RNA, 20 nt, Variola virus
ucccuauuaaaauucuuaaa

SEQ ID NO: 4078199 - RNA, 12 nt, Variola virus
ucccuuuccaaa

SEQ ID NO: 4078200 - RNA, 20 nt, Variola virus
uccgagauaauuucuccaga

SEQ ID NO: 4078201 - RNA, 18 nt, Variola virus
uccgaggauaguaaaaua

SEQ ID NO: 4078202 - RNA, 16 nt, Variola virus
uccgauauucaauuuu

SEQ ID NO: 4078203 - RNA, 22 nt, Variola virus
uccgcauacgcauuacaguuuu

SEQ ID NO: 4078204 - RNA, 23 nt, Variola virus
uccggcauuauagauguguauac

SEQ ID NO: 4078205 - RNA, 20 nt, Variola virus
uccggugcgcagucuaaaag

SEQ ID NO: 4078206 - RNA, 17 nt, Variola virus
uccguauuauacuugua

SEQ ID NO: 4078207 - RNA, 14 nt, Variola virus
uccguauuccaaac

SEQ ID NO: 4078208 - RNA, 13 nt, Variola virus
uccguuuguacau

SEQ ID NO: 4078209 - RNA, 22 nt, Variola virus
uccuaaaauacuauuauaucuu

SEQ ID NO: 4078210 - RNA, 18 nt, Variola virus
uccuaaacuuuguaucug

SEQ ID NO: 4078211 - RNA, 21 nt, Variola virus
uccuauauauuugaaaaucgu

SEQ ID NO: 4078212 - RNA, 21 nt, Variola virus
uccuaucuauuauugaugcaa

SEQ ID NO: 4078213 - RNA, 18 nt, Variola virus
uccuauucccaacaaugu

SEQ ID NO: 4078214 - RNA, 24 nt, Variola virus
uccucagauuuauacauauucuaa

SEQ ID NO: 4078215 - RNA, 13 nt, Variola virus
uccuguaauaucu

SEQ ID NO: 4078216 - RNA, 19 nt, Variola virus
uccuuaaauguuuucucug

SEQ ID NO: 4078217 - RNA, 21 nt, Variola virus
uccuuccaagaagaagacuua

SEQ ID NO: 4078218 - RNA, 17 nt, Variola virus
uccuugguuuacaugga

SEQ ID NO: 4078219 - RNA, 16 nt, Variola virus
uccuuuaccaccaaau

SEQ ID NO: 4078220 - RNA, 16 nt, Variola virus
uccuuugauuaucauc

SEQ ID NO: 4078221 - RNA, 20 nt, Variola virus
ucgaaaaacuuuaauguaga

SEQ ID NO: 4078222 - RNA, 20 nt, Variola virus
ucgaaaauugcuauuucaga

SEQ ID NO: 4078223 - RNA, 14 nt, Variola virus
ucgaauaauguaua

SEQ ID NO: 4078224 - RNA, 15 nt, Variola virus
ucgaaugucauauac

SEQ ID NO: 4078225 - RNA, 17 nt, Variola virus
ucgaauuucuacaaaag

SEQ ID NO: 4078226 - RNA, 16 nt, Variola virus
ucgacauauguaugua

SEQ ID NO: 4078227 - RNA, 18 nt, Variola virus
ucgacguugcucaaaguc

SEQ ID NO: 4078228 - RNA, 21 nt, Variola virus
ucgacuaucaacaauuuugua

SEQ ID NO: 4078229 - RNA, 18 nt, Variola virus
ucgagaacagauuugaua

SEQ ID NO: 4078230 - RNA, 23 nt, Variola virus
ucgagaugggcccguucucugaa

SEQ ID NO: 4078231 - RNA, 15 nt, Variola virus
ucgaguacgccauau

SEQ ID NO: 4078232 - RNA, 13 nt, Variola virus
ucgauaauuauua

SEQ ID NO: 4078233 - RNA, 17 nt, Variola virus
ucgauacaucaacucuc

SEQ ID NO: 4078234 - RNA, 16 nt, Variola virus
ucgauaccuagaagau

SEQ ID NO: 4078235 - RNA, 14 nt, Variola virus
ucgauccaauaaau

SEQ ID NO: 4078236 - RNA, 14 nt, Variola virus
ucgauggucucaca

SEQ ID NO: 4078237 - RNA, 19 nt, Variola virus
ucgauuacuauggauaucu

SEQ ID NO: 4078238 - RNA, 19 nt, Variola virus
ucgcauuaauacuguuuuc

SEQ ID NO: 4078239 - RNA, 16 nt, Variola virus
ucgcuauauccaccaa

SEQ ID NO: 4078240 - RNA, 18 nt, Variola virus
ucgcuccaaauauacauu

SEQ ID NO: 4078241 - RNA, 20 nt, Variola virus
ucgcugaucgucuagaugau

SEQ ID NO: 4078242 - RNA, 17 nt, Variola virus
ucggauaauauguaaaa

SEQ ID NO: 4078243 - RNA, 13 nt, Variola virus
ucggaucuaaaau

SEQ ID NO: 4078244 - RNA, 13 nt, Variola virus
ucggguacaaaag

SEQ ID NO: 4078245 - RNA, 13 nt, Variola virus
ucggguuccaaac

SEQ ID NO: 4078246 - RNA, 17 nt, Variola virus
ucguaaaaagauucuug

SEQ ID NO: 4078247 - RNA, 19 nt, Variola virus
ucguacauaacuuguacag

SEQ ID NO: 4078248 - RNA, 12 nt, Variola virus
ucguagaaagua

SEQ ID NO: 4078249 - RNA, 15 nt, Variola virus
ucguaugauuucagu

SEQ ID NO: 4078250 - RNA, 21 nt, Variola virus
ucguaugucauaaauucuuua

SEQ ID NO: 4078251 - RNA, 22 nt, Variola virus
ucguauuccugacgucuagagu

SEQ ID NO: 4078252 - RNA, 14 nt, Variola virus
ucguccuuaaccaa

SEQ ID NO: 4078253 - RNA, 13 nt, Variola virus
ucgucuacaucau

SEQ ID NO: 4078254 - RNA, 20 nt, Variola virus
ucguggauaaucauucuuaa

SEQ ID NO: 4078255 - RNA, 18 nt, Variola virus
ucguguauaacaucuuug

SEQ ID NO: 4078256 - RNA, 12 nt, Variola virus
ucguuaaauuuu

SEQ ID NO: 4078257 - RNA, 14 nt, Variola virus
ucguuauuaucauc

SEQ ID NO: 4078258 - RNA, 15 nt, Variola virus
ucguucaacugucuu

SEQ ID NO: 4078259 - RNA, 23 nt, Variola virus
ucguuccaagucauaucuagaau

SEQ ID NO: 4078260 - RNA, 15 nt, Variola virus
ucguugguagauauu

SEQ ID NO: 4078261 - RNA, 16 nt, Variola virus
ucguuuaauauuacau

SEQ ID NO: 4078262 - RNA, 23 nt, Variola virus
ucuaaaacagcugugaauacagc

SEQ ID NO: 4078263 - RNA, 23 nt, Variola virus
ucuaaauaauaucuauuguuugg

SEQ ID NO: 4078264 - RNA, 13 nt, Variola virus
ucuaaauguauua

SEQ ID NO: 4078265 - RNA, 12 nt, Variola virus
ucuaaauuauuc

SEQ ID NO: 4078266 - RNA, 15 nt, Variola virus
ucuaacgguaguguu

SEQ ID NO: 4078267 - RNA, 21 nt, Variola virus
ucuaagacgucucauuucuau

SEQ ID NO: 4078268 - RNA, 16 nt, Variola virus
ucuaauacuuuaacau

SEQ ID NO: 4078269 - RNA, 17 nt, Variola virus
ucuaaucacuuuaacuu

SEQ ID NO: 4078270 - RNA, 19 nt, Variola virus
ucuaaugugauucucugaa

SEQ ID NO: 4078271 - RNA, 19 nt, Variola virus
ucuaauugaccgucucuaa

SEQ ID NO: 4078272 - RNA, 13 nt, Variola virus
ucuacaauuauug

SEQ ID NO: 4078273 - RNA, 19 nt, Variola virus
ucuacagauauuuuaguuu

SEQ ID NO: 4078274 - RNA, 14 nt, Variola virus
ucuaccauuucauu

SEQ ID NO: 4078275 - RNA, 17 nt, Variola virus
ucuaccuauuucaucag

SEQ ID NO: 4078276 - RNA, 22 nt, Variola virus
ucuacuaagcccaaaaccaaac

SEQ ID NO: 4078277 - RNA, 20 nt, Variola virus
ucuacuacacuucuagauau

SEQ ID NO: 4078278 - RNA, 19 nt, Variola virus
ucuacuuacuggaaaauag

SEQ ID NO: 4078279 - RNA, 15 nt, Variola virus
ucuagauaaaaucac

SEQ ID NO: 4078280 - RNA, 14 nt, Variola virus
ucuagauauccaga

SEQ ID NO: 4078281 - RNA, 18 nt, Variola virus
ucuagccauaucuaaagc

SEQ ID NO: 4078282 - RNA, 20 nt, Variola virus
ucuaggagcaccagaaguau

SEQ ID NO: 4078283 - RNA, 21 nt, Variola virus
ucuagugcuuguauguguuau

SEQ ID NO: 4078284 - RNA, 18 nt, Variola virus
ucuaguuaucauguagua

SEQ ID NO: 4078285 - RNA, 14 nt, Variola virus
ucuaguucugaacg

SEQ ID NO: 4078286 - RNA, 14 nt, Variola virus
ucuauaaaauacua

SEQ ID NO: 4078287 - RNA, 21 nt, Variola virus
ucuauaaacgaugguuuaauu

SEQ ID NO: 4078288 - RNA, 17 nt, Variola virus
ucuauaaauaaaagaca

SEQ ID NO: 4078289 - RNA, 13 nt, Variola virus
ucuauaacaaaug

SEQ ID NO: 4078290 - RNA, 15 nt, Variola virus
ucuauaagguuucuu

SEQ ID NO: 4078291 - RNA, 17 nt, Variola virus
ucuauaauaauguagua

SEQ ID NO: 4078292 - RNA, 17 nt, Variola virus
ucuauaauaucagaauu

SEQ ID NO: 4078293 - RNA, 18 nt, Variola virus
ucuauacagcgaauaaau

SEQ ID NO: 4078294 - RNA, 22 nt, Variola virus
ucuauacgucuuuauuuucuau

SEQ ID NO: 4078295 - RNA, 16 nt, Variola virus
ucuauauaauuauuuu

SEQ ID NO: 4078296 - RNA, 15 nt, Variola virus
ucuauaucauguaga

SEQ ID NO: 4078297 - RNA, 18 nt, Variola virus
ucuauaucuauaucuaca

SEQ ID NO: 4078298 - RNA, 15 nt, Variola virus
ucuauaucuucuuuu

SEQ ID NO: 4078299 - RNA, 18 nt, Variola virus
ucuaucauggcaauaaua

SEQ ID NO: 4078300 - RNA, 14 nt, Variola virus
ucuaucauguagua

SEQ ID NO: 4078301 - RNA, 23 nt, Variola virus
ucuauccuuuuccggaagcaaug

SEQ ID NO: 4078302 - RNA, 20 nt, Variola virus
agaugaggauaguaaaauaa

SEQ ID NO: 4078303 - RNA, 16 nt, Variola virus
agaugaucaaaaagac

SEQ ID NO: 4078304 - RNA, 14 nt, Variola virus
agaugcaauacaaa

SEQ ID NO: 4078305 - RNA, 13 nt, Variola virus
agaugcaccauau

SEQ ID NO: 4078306 - RNA, 18 nt, Variola virus
agaugccaagauaucuau

SEQ ID NO: 4078307 - RNA, 15 nt, Variola virus
agaugguaaacuguu

SEQ ID NO: 4078308 - RNA, 14 nt, Variola virus
agauguaaauauau

SEQ ID NO: 4078309 - RNA, 23 nt, Variola virus
agauguauuacagccucauauau

SEQ ID NO: 4078310 - RNA, 18 nt, Variola virus
agaugucagcaucugaua

SEQ ID NO: 4078311 - RNA, 18 nt, Variola virus
agaugucugugaacuauu

SEQ ID NO: 4078312 - RNA, 22 nt, Variola virus
agaugugauuuuaucaaacaug

SEQ ID NO: 4078313 - RNA, 18 nt, Variola virus
agauguuugagaauauau

SEQ ID NO: 4078314 - RNA, 15 nt, Variola virus
agauuaaaaaugguu

SEQ ID NO: 4078315 - RNA, 16 nt, Variola virus
agauuaauuuugaauu

SEQ ID NO: 4078316 - RNA, 15 nt, Variola virus
agauuacucauguaa

SEQ ID NO: 4078317 - RNA, 23 nt, Variola virus
agauuagucagaccauucuuggu

SEQ ID NO: 4078318 - RNA, 14 nt, Variola virus
agauuauaacuuau

SEQ ID NO: 4078319 - RNA, 14 nt, Variola virus
agauucaacauuua

SEQ ID NO: 4078320 - RNA, 17 nt, Variola virus
agauucacauaaaggau

SEQ ID NO: 4078321 - RNA, 20 nt, Variola virus
agauucuggaggagauggau

SEQ ID NO: 4078322 - RNA, 18 nt, Variola virus
agauugguacgaaauaua

SEQ ID NO: 4078323 - RNA, 16 nt, Variola virus
agauuguuuaauauau

SEQ ID NO: 4078324 - RNA, 11 nt, Variola virus
agauuuaagaa

SEQ ID NO: 4078325 - RNA, 21 nt, Variola virus
agauuuaagaaaccagaauga

SEQ ID NO: 4078326 - RNA, 16 nt, Variola virus
agauuuacucugaaaa

SEQ ID NO: 4078327 - RNA, 12 nt, Variola virus
agauuuagaaau

SEQ ID NO: 4078328 - RNA, 23 nt, Variola virus
augugaucuaugacaucaugcau

SEQ ID NO: 4078329 - RNA, 20 nt, Variola virus
augugauggaaaaaugacua

SEQ ID NO: 4078330 - RNA, 14 nt, Variola virus
augugauuguucaa

SEQ ID NO: 4078331 - RNA, 18 nt, Variola virus
augugcuaaaaaguuuuc

SEQ ID NO: 4078332 - RNA, 22 nt, Variola virus
augugcuaaaaucacugaacau

SEQ ID NO: 4078333 - RNA, 14 nt, Variola virus
auguggguauuuau

SEQ ID NO: 4078334 - RNA, 13 nt, Variola virus
auguuacacuaua

SEQ ID NO: 4078335 - RNA, 20 nt, Variola virus
auguuaucaugaaauguuug

SEQ ID NO: 4078336 - RNA, 22 nt, Variola virus
auguucucguuuccaaaaaaug

SEQ ID NO: 4078337 - RNA, 18 nt, Variola virus
auguugaacauaaaacua

SEQ ID NO: 4078338 - RNA, 21 nt, Variola virus
auguuggaauagcgaauguau

SEQ ID NO: 4078339 - RNA, 23 nt, Variola virus
auguuggauuaaucuuuaccaua

SEQ ID NO: 4078340 - RNA, 22 nt, Variola virus
auguugggauuauugcaugaua

SEQ ID NO: 4078341 - RNA, 14 nt, Variola virus
auguuguuaccaua

SEQ ID NO: 4078342 - RNA, 20 nt, Variola virus
auguuuaacuugacauuuau

SEQ ID NO: 4078343 - RNA, 19 nt, Variola virus
auguuuauauguuggcaua

SEQ ID NO: 4078344 - RNA, 16 nt, Variola virus
auguuuccgagaaaua

SEQ ID NO: 4078345 - RNA, 17 nt, Variola virus
auguuucgauuucaauu

SEQ ID NO: 4078346 - RNA, 16 nt, Variola virus
auguuugggagaauua

SEQ ID NO: 4078347 - RNA, 15 nt, Variola virus
auguuuuacacguau

SEQ ID NO: 4078348 - RNA, 14 nt, Variola virus
auguuuuacucugg

SEQ ID NO: 4078349 - RNA, 16 nt, Variola virus
auuaaaaaacauauau

SEQ ID NO: 4078350 - RNA, 19 nt, Variola virus
auuaaaaaacauauauaau

SEQ ID NO: 4078351 - RNA, 14 nt, Variola virus
auuaaaaccuaauu

SEQ ID NO: 4078352 - RNA, 14 nt, Variola virus
auuaaacaauagau

SEQ ID NO: 4078353 - RNA, 13 nt, Variola virus
auuaaacauaaau

SEQ ID NO: 4078354 - RNA, 17 nt, Variola virus
auuaaaccuaaauaauu

SEQ ID NO: 4078355 - RNA, 18 nt, Variola virus
auuaaacguauaaaaacg

SEQ ID NO: 4078356 - RNA, 23 nt, Variola virus
auuaaagagauaguuuuuuucau

SEQ ID NO: 4078357 - RNA, 20 nt, Variola virus
auuaaaucauuaaaugauug

SEQ ID NO: 4078358 - RNA, 18 nt, Variola virus
auuaaaugaugaaacuaa

SEQ ID NO: 4078359 - RNA, 15 nt, Variola virus
auuaaauucuggaau

SEQ ID NO: 4078360 - RNA, 19 nt, Variola virus
auuaaauuuuuuuauuaau

SEQ ID NO: 4078361 - RNA, 21 nt, Variola virus
auuaacaccggaacaaaaagc

SEQ ID NO: 4078362 - RNA, 14 nt, Variola virus
auuaacagcuuuaa

SEQ ID NO: 4078363 - RNA, 15 nt, Variola virus
auuaacaucauacau

SEQ ID NO: 4078364 - RNA, 21 nt, Variola virus
auuaacgaguucaaauaugaa

SEQ ID NO: 4078365 - RNA, 22 nt, Variola virus
auuaacuuccacauuaauacag

SEQ ID NO: 4078366 - RNA, 17 nt, Variola virus
auuaacuuuaucacaau

SEQ ID NO: 4078367 - RNA, 22 nt, Variola virus
auuaagacgaauggcucuuccu

SEQ ID NO: 4078368 - RNA, 16 nt, Variola virus
auuaauaaaaauaauu

SEQ ID NO: 4078369 - RNA, 20 nt, Variola virus
auuaauaagauuuuuauuau

SEQ ID NO: 4078370 - RNA, 13 nt, Variola virus
auuaauaaugacg

SEQ ID NO: 4078371 - RNA, 19 nt, Variola virus
auuaauacacauaaugaag

SEQ ID NO: 4078372 - RNA, 17 nt, Variola virus
auuaauagauauaucuc

SEQ ID NO: 4078373 - RNA, 20 nt, Variola virus
auuaauaucuauuaaacgaa

SEQ ID NO: 4078374 - RNA, 20 nt, Variola virus
gaaaacucucuaucucuuaa

SEQ ID NO: 4078375 - RNA, 21 nt, Variola virus
gaaaaguucaacaugauuauu

SEQ ID NO: 4078376 - RNA, 17 nt, Variola virus
gaaaauaaaaauguuuu

SEQ ID NO: 4078377 - RNA, 22 nt, Variola virus
gaaaauaaauccaaaauaacua

SEQ ID NO: 4078378 - RNA, 21 nt, Variola virus
gaaaauaccauccaagucaau

SEQ ID NO: 4078379 - RNA, 19 nt, Variola virus
gaaaauagaaauuuguaaa

SEQ ID NO: 4078380 - RNA, 14 nt, Variola virus
gaaaauauauucua

SEQ ID NO: 4078381 - RNA, 16 nt, Variola virus
gaaaauuauaaugaau

SEQ ID NO: 4078382 - RNA, 16 nt, Variola virus
gaaaauuuaggacuua

SEQ ID NO: 4078383 - RNA, 16 nt, Variola virus
gaaaauuuauaaacua

SEQ ID NO: 4078384 - RNA, 20 nt, Variola virus
gaaacccccucauuuuuuaa

SEQ ID NO: 4078385 - RNA, 15 nt, Variola virus
gaaacgauaccaucu

SEQ ID NO: 4078386 - RNA, 13 nt, Variola virus
gaaacugauacaa

SEQ ID NO: 4078387 - RNA, 17 nt, Variola virus
gaaagaaaguaugauau

SEQ ID NO: 4078388 - RNA, 23 nt, Variola virus
gaaagacgaauauuauaauacca

SEQ ID NO: 4078389 - RNA, 16 nt, Variola virus
gaaagagauaauagaa

SEQ ID NO: 4078390 - RNA, 15 nt, Variola virus
gaaagcgugauuuua

SEQ ID NO: 4078391 - RNA, 23 nt, Variola virus
gaaagcuaucgaacguaaacgua

SEQ ID NO: 4078392 - RNA, 24 nt, Variola virus
gaaaguaauuauuacaagucaaag

SEQ ID NO: 4078393 - RNA, 15 nt, Variola virus
gaaagucagaaucua

SEQ ID NO: 4078394 - RNA, 21 nt, Variola virus
gaaagucuuagggaugaggaa

SEQ ID NO: 4078395 - RNA, 16 nt, Variola virus
gaaagugcaaaugagg

SEQ ID NO: 4078396 - RNA, 17 nt, Variola virus
gaaauaauauaaaugau

SEQ ID NO: 4078397 - RNA, 21 nt, Variola virus
gaaauagcgcugaaaauaaag

SEQ ID NO: 4078398 - RNA, 23 nt, Variola virus
gaaauagcgcugaaaauaaagau

SEQ ID NO: 4078399 - RNA, 22 nt, Variola virus
gaaauauaaaaccaacuaauau

SEQ ID NO: 4078400 - RNA, 20 nt, Variola virus
gaaauauagaauauacuuca

SEQ ID NO: 4078401 - RNA, 14 nt, Variola virus
gaaauauauacaua

SEQ ID NO: 4078402 - RNA, 15 nt, Variola virus
gaaauauauacuuca

SEQ ID NO: 4078403 - RNA, 13 nt, Variola virus
gaaauauucuguu

SEQ ID NO: 4078404 - RNA, 17 nt, Variola virus
gaaaucguauauaacua

SEQ ID NO: 4078405 - RNA, 14 nt, Variola virus
gaaaucuauaauau

SEQ ID NO: 4078406 - RNA, 15 nt, Variola virus
gaaaucuguaaucua

SEQ ID NO: 4078407 - RNA, 17 nt, Variola virus
gaaaugaugaaggaaag

SEQ ID NO: 4078408 - RNA, 18 nt, Variola virus
gaaaugccugauaaagau

SEQ ID NO: 4078409 - RNA, 22 nt, Variola virus
gaaauguccguuauauaaucua

SEQ ID NO: 4078410 - RNA, 17 nt, Variola virus
gaaauguguaauaauau

SEQ ID NO: 4078411 - RNA, 14 nt, Variola virus
gaaauguuaaaacu

SEQ ID NO: 4078412 - RNA, 15 nt, Variola virus
gaaauugauaaugag

SEQ ID NO: 4078413 - RNA, 17 nt, Variola virus
gaacaaugucaaaauau

SEQ ID NO: 4078414 - RNA, 15 nt, Variola virus
gaacaauuacagaca

SEQ ID NO: 4078415 - RNA, 22 nt, Variola virus
gaacacgauuauuauaaaauaa

SEQ ID NO: 4078416 - RNA, 15 nt, Variola virus
gaacacguuaaacaa

SEQ ID NO: 4078417 - RNA, 14 nt, Variola virus
gaacagaugauaua

SEQ ID NO: 4078418 - RNA, 16 nt, Variola virus
gaacauaagauaucua

SEQ ID NO: 4078419 - RNA, 18 nt, Variola virus
gaacauaguaagaaauuc

SEQ ID NO: 4078420 - RNA, 20 nt, Variola virus
gaacaucauuuccaaaucua

SEQ ID NO: 4078421 - RNA, 14 nt, Variola virus
gaacauuuaagaga

SEQ ID NO: 4078422 - RNA, 17 nt, Variola virus
gaaccagauaguuuaua

SEQ ID NO: 4078423 - RNA, 14 nt, Variola virus
gaacgauaaacaaa

SEQ ID NO: 4078424 - RNA, 13 nt, Variola virus
gaacgaugauaug

SEQ ID NO: 4078425 - RNA, 19 nt, Variola virus
gaacuauaaaacuacuaca

SEQ ID NO: 4078426 - RNA, 21 nt, Variola virus
gaacuauuuuuuuauacuucu

SEQ ID NO: 4078427 - RNA, 21 nt, Variola virus
gaacucuugaagaugauuuug

SEQ ID NO: 4078428 - RNA, 16 nt, Variola virus
gaacuguucaaaauau

SEQ ID NO: 4078429 - RNA, 15 nt, Variola virus
gaacuguuuaagaga

SEQ ID NO: 4078430 - RNA, 23 nt, Variola virus
gaagaacguguauuaaauagaau

SEQ ID NO: 4078431 - RNA, 14 nt, Variola virus
gaagaagaaaacaa

SEQ ID NO: 4078432 - RNA, 15 nt, Variola virus
gaagaagaaaacaaa

SEQ ID NO: 4078433 - RNA, 13 nt, Variola virus
gaagaagaaauaa

SEQ ID NO: 4078434 - RNA, 23 nt, Variola virus
gaagaauggaaaccuuuaaucua

SEQ ID NO: 4078435 - RNA, 16 nt, Variola virus
gaagaauggaugauau

SEQ ID NO: 4078436 - RNA, 15 nt, Variola virus
gaagacaauaaugac

SEQ ID NO: 4078437 - RNA, 14 nt, Variola virus
gaagacauauuaau

SEQ ID NO: 4078438 - RNA, 22 nt, Variola virus
gaagagaugccucguuccaagu

SEQ ID NO: 4078439 - RNA, 13 nt, Variola virus
gaagauaaugaau

SEQ ID NO: 4078440 - RNA, 13 nt, Variola virus
gaagauagauaua

SEQ ID NO: 4078441 - RNA, 17 nt, Variola virus
gaagauuaccucuaguu

SEQ ID NO: 4078442 - RNA, 19 nt, Variola virus
gaagauucccaaauaauca

SEQ ID NO: 4078443 - RNA, 14 nt, Variola virus
gaagcuauauguaa

SEQ ID NO: 4078444 - RNA, 18 nt, Variola virus
gaagcugguaaaguaaau

SEQ ID NO: 4078445 - RNA, 17 nt, Variola virus
gaagguuggguagaugg

SEQ ID NO: 4078446 - RNA, 17 nt, Variola virus
gaaguaaacgaacgucu

SEQ ID NO: 4078447 - RNA, 16 nt, Variola virus
gaaguuaaacugugaa

SEQ ID NO: 4078448 - RNA, 17 nt, Variola virus
gaaguuguauacuaucg

SEQ ID NO: 4078449 - RNA, 20 nt, Variola virus
gaaguuuaauaauacaauau

SEQ ID NO: 4078450 - RNA, 19 nt, Variola virus
gaauaaagagaaugcagaa

SEQ ID NO: 4078451 - RNA, 13 nt, Variola virus
gaauaaaguauau

SEQ ID NO: 4078452 - RNA, 21 nt, Variola virus
gaauaaaguuaaacaacuauu

SEQ ID NO: 4078453 - RNA, 16 nt, Variola virus
gaauaaauuauaucua

SEQ ID NO: 4078454 - RNA, 19 nt, Variola virus
gaauaaauuaucaacgaau

SEQ ID NO: 4078455 - RNA, 13 nt, Variola virus
gaauaaguuuauu

SEQ ID NO: 4078456 - RNA, 18 nt, Variola virus
gaauaauguuucuauguu

SEQ ID NO: 4078457 - RNA, 17 nt, Variola virus
gaauacacauguuuuaa

SEQ ID NO: 4078458 - RNA, 16 nt, Variola virus
gaauacauuuauugca

SEQ ID NO: 4078459 - RNA, 18 nt, Variola virus
gaauacgaugauauuaaa

SEQ ID NO: 4078460 - RNA, 16 nt, Variola virus
gaauaguaaaauuaga

SEQ ID NO: 4078461 - RNA, 16 nt, Variola virus
gaauagugguauauaa

SEQ ID NO: 4078462 - RNA, 19 nt, Variola virus
gaauauacuucauaaaaga

SEQ ID NO: 4078463 - RNA, 21 nt, Variola virus
gaauaucuccucaaggaauac

SEQ ID NO: 4078464 - RNA, 17 nt, Variola virus
auucucuauuaaauacc

SEQ ID NO: 4078465 - RNA, 20 nt, Variola virus
auucucugaaaauguaaauc

SEQ ID NO: 4078466 - RNA, 15 nt, Variola virus
auucugaaacaguau

SEQ ID NO: 4078467 - RNA, 19 nt, Variola virus
auucugaauagauccacca

SEQ ID NO: 4078468 - RNA, 21 nt, Variola virus
auucugaauagugaaaaccuu

SEQ ID NO: 4078469 - RNA, 18 nt, Variola virus
auucugcaauaucuucgu

SEQ ID NO: 4078470 - RNA, 14 nt, Variola virus
auucugcaauauug

SEQ ID NO: 4078471 - RNA, 21 nt, Variola virus
auucuggcuauuucaaaauaa

SEQ ID NO: 4078472 - RNA, 14 nt, Variola virus
auucuuaaaaucua

SEQ ID NO: 4078473 - RNA, 16 nt, Variola virus
auucuuaagacacauu

SEQ ID NO: 4078474 - RNA, 17 nt, Variola virus
auucuucauucugcaua

SEQ ID NO: 4078475 - RNA, 17 nt, Variola virus
auucuugguuaaacuca

SEQ ID NO: 4078476 - RNA, 16 nt, Variola virus
auugaacgguaucuuc

SEQ ID NO: 4078477 - RNA, 19 nt, Variola virus
auugaauuggaaaaauaac

SEQ ID NO: 4078478 - RNA, 19 nt, Variola virus
auugacauggcuucuucca

SEQ ID NO: 4078479 - RNA, 16 nt, Variola virus
auugaugacacuagau

SEQ ID NO: 4078480 - RNA, 23 nt, Variola virus
auugaugcgaauagcagauagau

SEQ ID NO: 4078481 - RNA, 20 nt, Variola virus
auugauuacuuugacaaaug

SEQ ID NO: 4078482 - RNA, 17 nt, Variola virus
auugauuagaaaauaua

SEQ ID NO: 4078483 - RNA, 17 nt, Variola virus
auugauuucgucaaugu

SEQ ID NO: 4078484 - RNA, 18 nt, Variola virus
auugcacaauccaaacuu

SEQ ID NO: 4078485 - RNA, 17 nt, Variola virus
auugcauugugaauaua

SEQ ID NO: 4078486 - RNA, 21 nt, Variola virus
auugcauuuugauaguuuauc

SEQ ID NO: 4078487 - RNA, 22 nt, Variola virus
auugcuagccuuaucuucuaua

SEQ ID NO: 4078488 - RNA, 17 nt, Variola virus
auuggaacuaguauuua

SEQ ID NO: 4078489 - RNA, 21 nt, Variola virus
auuggaauguguuaaaaagaa

SEQ ID NO: 4078490 - RNA, 18 nt, Variola virus
auuggggaagguaacaau

SEQ ID NO: 4078491 - RNA, 16 nt, Variola virus
auugguauaaauguug

SEQ ID NO: 4078492 - RNA, 20 nt, Variola virus
auuguaccaucuuguuguaa

SEQ ID NO: 4078493 - RNA, 17 nt, Variola virus
auuguauauacuuagau

SEQ ID NO: 4078494 - RNA, 19 nt, Variola virus
auuguauccauacauacau

SEQ ID NO: 4078495 - RNA, 15 nt, Variola virus
auugucacuacuaaa

SEQ ID NO: 4078496 - RNA, 22 nt, Variola virus
auugucuauaucuaaaaucaua

SEQ ID NO: 4078497 - RNA, 16 nt, Variola virus
auugugauaaauguuc

SEQ ID NO: 4078498 - RNA, 18 nt, Variola virus
auuguuaauuauuucuaa

SEQ ID NO: 4078499 - RNA, 13 nt, Variola virus
auuguuacaaaag

SEQ ID NO: 4078500 - RNA, 12 nt, Variola virus
auuguuguguac

SEQ ID NO: 4078501 - RNA, 12 nt, Variola virus
auuguuuaagau

SEQ ID NO: 4078502 - RNA, 14 nt, Variola virus
auuguuuucaguaa

SEQ ID NO: 4078503 - RNA, 17 nt, Variola virus
auuguuuuuguacauaa

SEQ ID NO: 4078504 - RNA, 15 nt, Variola virus
auuuaaacauuuaac

SEQ ID NO: 4078505 - RNA, 19 nt, Variola virus
auuuaagagaucaaagcau

SEQ ID NO: 4078506 - RNA, 17 nt, Variola virus
auuuaaggcuuuaaaau

SEQ ID NO: 4078507 - RNA, 18 nt, Variola virus
auuuaaguagagaauguu

SEQ ID NO: 4078508 - RNA, 13 nt, Variola virus
auuuaauaagacu

SEQ ID NO: 4078509 - RNA, 17 nt, Variola virus
auuuaauaagacuuuga

SEQ ID NO: 4078510 - RNA, 14 nt, Variola virus
auuuaaugauucau

SEQ ID NO: 4078511 - RNA, 22 nt, Variola virus
auuuacagauuuaguuguuuaa

SEQ ID NO: 4078512 - RNA, 19 nt, Variola virus
auuuacauucuuuuugcug

SEQ ID NO: 4078513 - RNA, 19 nt, Variola virus
auuuaccguuacuaauaag

SEQ ID NO: 4078514 - RNA, 15 nt, Variola virus
auuuacuacugaugu

SEQ ID NO: 4078515 - RNA, 22 nt, Variola virus
auuuaggagugaucaucaaaug

SEQ ID NO: 4078516 - RNA, 16 nt, Variola virus
auuuaguauuaaauga

SEQ ID NO: 4078517 - RNA, 14 nt, Variola virus
auuuauaaaaaugc

SEQ ID NO: 4078518 - RNA, 17 nt, Variola virus
auuuauaccaugucaaa

SEQ ID NO: 4078519 - RNA, 11 nt, Variola virus
auuuauccauc

SEQ ID NO: 4078520 - RNA, 21 nt, Variola virus
auuuauuauuuucacggagau

SEQ ID NO: 4078521 - RNA, 14 nt, Variola virus
auuuauuucuucuu

SEQ ID NO: 4078522 - RNA, 21 nt, Variola virus
auuucaaagguguguacuuua

SEQ ID NO: 4078523 - RNA, 14 nt, Variola virus
auuucaacaggcau

SEQ ID NO: 4078524 - RNA, 18 nt, Variola virus
auuucaaggacaaaauga

SEQ ID NO: 4078525 - RNA, 15 nt, Variola virus
auuucaaucaaacaa

SEQ ID NO: 4078526 - RNA, 15 nt, Variola virus
auuucacuaauuaau

SEQ ID NO: 4078527 - RNA, 16 nt, Variola virus
auuucauauaguugaa

SEQ ID NO: 4078528 - RNA, 16 nt, Variola virus
auuucaucuguaguau

SEQ ID NO: 4078529 - RNA, 20 nt, Variola virus
auuuccagauauauaucuuu

SEQ ID NO: 4078530 - RNA, 17 nt, Variola virus
auuuccgcauucuuccu

SEQ ID NO: 4078531 - RNA, 21 nt, Variola virus
auuucgaauacgauacuuaua

SEQ ID NO: 4078532 - RNA, 13 nt, Variola virus
auuucgacaaaaa

SEQ ID NO: 4078533 - RNA, 21 nt, Variola virus
auuucuauacuuguuggugaa

SEQ ID NO: 4078534 - RNA, 12 nt, Variola virus
auuucuaucugu

SEQ ID NO: 4078535 - RNA, 19 nt, Variola virus
auuucuuauguuauuaaug

SEQ ID NO: 4078536 - RNA, 19 nt, Variola virus
auuugaaguauuuguugua

SEQ ID NO: 4078537 - RNA, 16 nt, Variola virus
auuugagagucuuaua

SEQ ID NO: 4078538 - RNA, 16 nt, Variola virus
auuugauauaaugaau

SEQ ID NO: 4078539 - RNA, 17 nt, Variola virus
auuuggaaaagaaaauu

SEQ ID NO: 4078540 - RNA, 22 nt, Variola virus
auuuggcaguacucauuaauaa

SEQ ID NO: 4078541 - RNA, 20 nt, Variola virus
auuugguaaauuauuaucua

SEQ ID NO: 4078542 - RNA, 17 nt, Variola virus
auuugguauaaaaauua

SEQ ID NO: 4078543 - RNA, 20 nt, Variola virus
auuuguagcaaaacuauuuc

SEQ ID NO: 4078544 - RNA, 18 nt, Variola virus
auuuguauauacauagau

SEQ ID NO: 4078545 - RNA, 15 nt, Variola virus
auuugucacaauaug

SEQ ID NO: 4078546 - RNA, 19 nt, Variola virus
auuugucugcuuucuuuua

SEQ ID NO: 4078547 - RNA, 17 nt, Variola virus
auuuguucaagauagau

SEQ ID NO: 4078548 - RNA, 19 nt, Variola virus
auuuguucguaugucauaa

SEQ ID NO: 4078549 - RNA, 12 nt, Variola virus
auuuuaaauaca

SEQ ID NO: 4078550 - RNA, 18 nt, Variola virus
auuuuaaauuuuaaacau

SEQ ID NO: 4078551 - RNA, 19 nt, Variola virus
auuuuaacgacgacauauu

SEQ ID NO: 4078552 - RNA, 19 nt, Variola virus
auuuuaacgucuaaaugua

SEQ ID NO: 4078553 - RNA, 18 nt, Variola virus
auuuuaauaguauccauu

SEQ ID NO: 4078554 - RNA, 19 nt, Variola virus
auuuuaauucuagacuauu

SEQ ID NO: 4078555 - RNA, 14 nt, Variola virus
auuuuacauuccuc

SEQ ID NO: 4078556 - RNA, 17 nt, Variola virus
auuuuacccucaaucau

SEQ ID NO: 4078557 - RNA, 18 nt, Variola virus
auuuuaccucuucugaua

SEQ ID NO: 4078558 - RNA, 18 nt, Variola virus
auuuuauaugucaaccau

SEQ ID NO: 4078559 - RNA, 15 nt, Variola virus
auuuuaucaagacau

SEQ ID NO: 4078560 - RNA, 15 nt, Variola virus
auuuuauuucaaaau

SEQ ID NO: 4078561 - RNA, 15 nt, Variola virus
auuuucaucuagaua

SEQ ID NO: 4078562 - RNA, 21 nt, Variola virus
auuuucuaacgaaacgaugaa

SEQ ID NO: 4078563 - RNA, 16 nt, Variola virus
auuuucuacaauaacu

SEQ ID NO: 4078564 - RNA, 18 nt, Variola virus
auuuucuauuuuuaauuu

SEQ ID NO: 4078565 - RNA, 15 nt, Variola virus
auuuucucuuaaaaa

SEQ ID NO: 4078566 - RNA, 15 nt, Variola virus
auuuugcuaucuuga

SEQ ID NO: 4078567 - RNA, 15 nt, Variola virus
auuuugucauuaacu

SEQ ID NO: 4078568 - RNA, 19 nt, Variola virus
auuuuuacagcgacacuau

SEQ ID NO: 4078569 - RNA, 16 nt, Variola virus
auuuuuauaaauagau

SEQ ID NO: 4078570 - RNA, 12 nt, Variola virus
auuuuuaucaua

SEQ ID NO: 4078571 - RNA, 20 nt, Variola virus
auuuuuaucauaacacuacu

SEQ ID NO: 4078572 - RNA, 16 nt, Variola virus
auuuuuguccauuacu

SEQ ID NO: 4078573 - RNA, 12 nt, Variola virus
auuuuuuguaaa

SEQ ID NO: 4078574 - RNA, 23 nt, Variola virus
auuuuuuuuaaaaaaaaauacuu

SEQ ID NO: 4078575 - RNA, 19 nt, Variola virus
caaaaaacgacgauuggaa

SEQ ID NO: 4078576 - RNA, 14 nt, Variola virus
caaaaaauccugua

SEQ ID NO: 4078577 - RNA, 13 nt, Variola virus
caaaaagacuaua

SEQ ID NO: 4078578 - RNA, 19 nt, Variola virus
caaaaagagagucaauguu

SEQ ID NO: 4078579 - RNA, 18 nt, Variola virus
caaaaagggauauauauu

SEQ ID NO: 4078580 - RNA, 18 nt, Variola virus
caaaacauaauacucugu

SEQ ID NO: 4078581 - RNA, 16 nt, Variola virus
caaaaccaauuccuuu

SEQ ID NO: 4078582 - RNA, 18 nt, Variola virus
caaaacuauuccaauguu

SEQ ID NO: 4078583 - RNA, 17 nt, Variola virus
caaaaguagaugguauu

SEQ ID NO: 4078584 - RNA, 20 nt, Variola virus
caaaagugacgucuuguauu

SEQ ID NO: 4078585 - RNA, 12 nt, Variola virus
caaaauaaugac

SEQ ID NO: 4078586 - RNA, 17 nt, Variola virus
caaaauacaaaauguua

SEQ ID NO: 4078587 - RNA, 21 nt, Variola virus
caaaauacucaggaagauauu

SEQ ID NO: 4078588 - RNA, 15 nt, Variola virus
caaaauagagccaaa

SEQ ID NO: 4078589 - RNA, 14 nt, Variola virus
caaaauccaaauuu

SEQ ID NO: 4078590 - RNA, 13 nt, Variola virus
cuaauacucuggg

SEQ ID NO: 4078591 - RNA, 13 nt, Variola virus
cuaauauaaucuu

SEQ ID NO: 4078592 - RNA, 15 nt, Variola virus
cuaauauuuuuagau

SEQ ID NO: 4078593 - RNA, 21 nt, Variola virus
cuaauguauagauuguuuuca

SEQ ID NO: 4078594 - RNA, 21 nt, Variola virus
cuaauuccuuugcuauuucua

SEQ ID NO: 4078595 - RNA, 19 nt, Variola virus
cuaauucuauauuguuaua

SEQ ID NO: 4078596 - RNA, 19 nt, Variola virus
cuaauuuauuucuucucuu

SEQ ID NO: 4078597 - RNA, 19 nt, Variola virus
cuacaaaauguugauaauc

SEQ ID NO: 4078598 - RNA, 14 nt, Variola virus
cuacaacagauauu

SEQ ID NO: 4078599 - RNA, 21 nt, Variola virus
cuacaauugucuaaugauauc

SEQ ID NO: 4078600 - RNA, 21 nt, Variola virus
cuacagaaggcgaacgcuaua

SEQ ID NO: 4078601 - RNA, 23 nt, Variola virus
cuacaguaggcauaccauuagau

SEQ ID NO: 4078602 - RNA, 19 nt, Variola virus
cuacauacauaagcaucuc

SEQ ID NO: 4078603 - RNA, 23 nt, Variola virus
cuacaugacaaagauuuaucaga

SEQ ID NO: 4078604 - RNA, 16 nt, Variola virus
cuacauuauuaaauca

SEQ ID NO: 4078605 - RNA, 12 nt, Variola virus
cuacauuguuua

SEQ ID NO: 4078606 - RNA, 15 nt, Variola virus
cuaccgaucucuuua

SEQ ID NO: 4078607 - RNA, 18 nt, Variola virus
cuaccgcaucaucaucgu

SEQ ID NO: 4078608 - RNA, 20 nt, Variola virus
cuacgauuuuauuucuuucg

SEQ ID NO: 4078609 - RNA, 17 nt, Variola virus
cuacuacacuucuagau

SEQ ID NO: 4078610 - RNA, 19 nt, Variola virus
cuacuacacuucuagauau

SEQ ID NO: 4078611 - RNA, 17 nt, Variola virus
cuacuggugaaauguga

SEQ ID NO: 4078612 - RNA, 19 nt, Variola virus
cuagaauuagaauuacaaa

SEQ ID NO: 4078613 - RNA, 24 nt, Variola virus
cuagacauuguacaauauguguua

SEQ ID NO: 4078614 - RNA, 24 nt, Variola virus
cuagacgauuaguaauauaucuca

SEQ ID NO: 4078615 - RNA, 21 nt, Variola virus
cuagacugaugaccauuuaaa

SEQ ID NO: 4078616 - RNA, 22 nt, Variola virus
cuagauacccaaucucucucaa

SEQ ID NO: 4078617 - RNA, 17 nt, Variola virus
cuagauauauuaauaac

SEQ ID NO: 4078618 - RNA, 23 nt, Variola virus
cuaguaaacuucgcguauacagu

SEQ ID NO: 4078619 - RNA, 14 nt, Variola virus
cuaguacuguaaaa

SEQ ID NO: 4078620 - RNA, 13 nt, Variola virus
cuagucagaacua

SEQ ID NO: 4078621 - RNA, 15 nt, Variola virus
cuagucauauguuua

SEQ ID NO: 4078622 - RNA, 22 nt, Variola virus
cuaguccaaagacuuacaggaa

SEQ ID NO: 4078623 - RNA, 21 nt, Variola virus
cuagugcuuguauguguuaua

SEQ ID NO: 4078624 - RNA, 21 nt, Variola virus
cuaguuaagaacaugucuuca

SEQ ID NO: 4078625 - RNA, 13 nt, Variola virus
cuaguuguagaau

SEQ ID NO: 4078626 - RNA, 13 nt, Variola virus
cuaguuguuuaug

SEQ ID NO: 4078627 - RNA, 20 nt, Variola virus
cuauaaaaaaaauaauaauu

SEQ ID NO: 4078628 - RNA, 16 nt, Variola virus
cuauaaaaaacauaau

SEQ ID NO: 4078629 - RNA, 14 nt, Variola virus
cuauaaaaaugaag

SEQ ID NO: 4078630 - RNA, 18 nt, Variola virus
cuauaaaacuacuacaau

SEQ ID NO: 4078631 - RNA, 22 nt, Variola virus
cuauaaacgaugguuuaauuug

SEQ ID NO: 4078632 - RNA, 20 nt, Variola virus
cuauaagauuaucaaaaucu

SEQ ID NO: 4078633 - RNA, 18 nt, Variola virus
cuauaauauccauuuugu

SEQ ID NO: 4078634 - RNA, 14 nt, Variola virus
cuauacauuuccga

SEQ ID NO: 4078635 - RNA, 14 nt, Variola virus
cuauagauaaugac

SEQ ID NO: 4078636 - RNA, 14 nt, Variola virus
cuauagaucaugua

SEQ ID NO: 4078637 - RNA, 16 nt, Variola virus
cuauaguuuguuuuca

SEQ ID NO: 4078638 - RNA, 21 nt, Variola virus
cuauauagcuauucuucuuua

SEQ ID NO: 4078639 - RNA, 16 nt, Variola virus
cuauaucauucucaaa

SEQ ID NO: 4078640 - RNA, 22 nt, Variola virus
cuauaucuucuaaaauuacaaa

SEQ ID NO: 4078641 - RNA, 19 nt, Variola virus
cuauaugacuguauuugga

SEQ ID NO: 4078642 - RNA, 17 nt, Variola virus
cuauauggauauucaua

SEQ ID NO: 4078643 - RNA, 20 nt, Variola virus
cuauauuuguuccuguagau

SEQ ID NO: 4078644 - RNA, 20 nt, Variola virus
cuaucauccaucauguuaag

SEQ ID NO: 4078645 - RNA, 17 nt, Variola virus
cuaucgaguuuaucaga

SEQ ID NO: 4078646 - RNA, 19 nt, Variola virus
cuaucuaugcuguagauag

SEQ ID NO: 4078647 - RNA, 16 nt, Variola virus
cuaucuucaucauauu

SEQ ID NO: 4078648 - RNA, 15 nt, Variola virus
cuaugauauuguuga

SEQ ID NO: 4078649 - RNA, 22 nt, Variola virus
cuaugaucguuuuaauauugug

SEQ ID NO: 4078650 - RNA, 15 nt, Variola virus
cuaugguacaaguug

SEQ ID NO: 4078651 - RNA, 17 nt, Variola virus
cuaugucucuuauuaga

SEQ ID NO: 4078652 - RNA, 16 nt, Variola virus
cuaugucuuuauccaa

SEQ ID NO: 4078653 - RNA, 19 nt, Variola virus
cuauguuaauauguauaua

SEQ ID NO: 4078654 - RNA, 15 nt, Variola virus
cuauguuuuuaauga

SEQ ID NO: 4078655 - RNA, 13 nt, Variola virus
cuauuaaaacuaa

SEQ ID NO: 4078656 - RNA, 16 nt, Variola virus
cuauuacguacauaac

SEQ ID NO: 4078657 - RNA, 20 nt, Variola virus
cuauuaguuguuccaauaaa

SEQ ID NO: 4078658 - RNA, 21 nt, Variola virus
cuauuaguuguuccaauaaau

SEQ ID NO: 4078659 - RNA, 13 nt, Variola virus
cuauuauuuugaa

SEQ ID NO: 4078660 - RNA, 23 nt, Variola virus
cuauucaguaguguuuacauaaa

SEQ ID NO: 4078661 - RNA, 15 nt, Variola virus
cuauuccuauuuccu

SEQ ID NO: 4078662 - RNA, 12 nt, Variola virus
cuauucucucuu

SEQ ID NO: 4078663 - RNA, 16 nt, Variola virus
cuauuggcaauuguag

SEQ ID NO: 4078664 - RNA, 20 nt, Variola virus
cuauuguuuguuuuaauaua

SEQ ID NO: 4078665 - RNA, 23 nt, Variola virus
cuauuucaaaaguuuuuaagaga

SEQ ID NO: 4078666 - RNA, 15 nt, Variola virus
cuauuucuauuucua

SEQ ID NO: 4078667 - RNA, 19 nt, Variola virus
cuauuuguguauucuucua

SEQ ID NO: 4078668 - RNA, 12 nt, Variola virus
cuauuuuaauga

SEQ ID NO: 4078669 - RNA, 16 nt, Variola virus
uaucuggcggugaaau

SEQ ID NO: 4078670 - RNA, 19 nt, Variola virus
uaucuggcucucucugcca

SEQ ID NO: 4078671 - RNA, 20 nt, Variola virus
uaucuuccgucaaggaucau

SEQ ID NO: 4078672 - RNA, 13 nt, Variola virus
uaucuucuaaaaa

SEQ ID NO: 4078673 - RNA, 13 nt, Variola virus
uaucuucuaaaau

SEQ ID NO: 4078674 - RNA, 15 nt, Variola virus
uaucuucuuuaucua

SEQ ID NO: 4078675 - RNA, 22 nt, Variola virus
uaucuuuaacuaagucaauuau

SEQ ID NO: 4078676 - RNA, 17 nt, Variola virus
uaucuuuauagaguaua

SEQ ID NO: 4078677 - RNA, 19 nt, Variola virus
uaucuuuccauuuaucaug

SEQ ID NO: 4078678 - RNA, 14 nt, Variola virus
uaucuuucuuugaa

SEQ ID NO: 4078679 - RNA, 19 nt, Variola virus
uaucuuuuucucaacgucg

SEQ ID NO: 4078680 - RNA, 13 nt, Variola virus
uaugaaaauagca

SEQ ID NO: 4078681 - RNA, 16 nt, Variola virus
uaugaaguacgauguu

SEQ ID NO: 4078682 - RNA, 12 nt, Variola virus
uaugaauuuaua

SEQ ID NO: 4078683 - RNA, 21 nt, Variola virus
uaugacaucaacuacaaauga

SEQ ID NO: 4078684 - RNA, 21 nt, Variola virus
uaugaccgguuuaauguuaua

SEQ ID NO: 4078685 - RNA, 15 nt, Variola virus
uaugacuaaacauuu

SEQ ID NO: 4078686 - RNA, 15 nt, Variola virus
uaugacuuaauagca

SEQ ID NO: 4078687 - RNA, 13 nt, Variola virus
uaugauaugugau

SEQ ID NO: 4078688 - RNA, 18 nt, Variola virus
uaugaucguuuuaauauu

SEQ ID NO: 4078689 - RNA, 13 nt, Variola virus
uaugauucuguaa

SEQ ID NO: 4078690 - RNA, 17 nt, Variola virus
uaugcacgaaauagcua

SEQ ID NO: 4078691 - RNA, 13 nt, Variola virus
uauggaauuccau

SEQ ID NO: 4078692 - RNA, 18 nt, Variola virus
uauggccauagaggaugu

SEQ ID NO: 4078693 - RNA, 14 nt, Variola virus
uauggcuucuccag

SEQ ID NO: 4078694 - RNA, 21 nt, Variola virus
uauggucagugcauaauaaag

SEQ ID NO: 4078695 - RNA, 17 nt, Variola virus
uauguaaguauuuacga

SEQ ID NO: 4078696 - RNA, 21 nt, Variola virus
uauguauuguaccaaagauuu

SEQ ID NO: 4078697 - RNA, 18 nt, Variola virus
uauguggaucugaagaag

SEQ ID NO: 4078698 - RNA, 17 nt, Variola virus
uauguguagaauuaaau

SEQ ID NO: 4078699 - RNA, 16 nt, Variola virus
uauguuuuguauacau

SEQ ID NO: 4078700 - RNA, 19 nt, Variola virus
uauguuuuuacagagacuu

SEQ ID NO: 4078701 - RNA, 13 nt, Variola virus
uauuaaaaaaugu

SEQ ID NO: 4078702 - RNA, 22 nt, Variola virus
uauuaaacaacgacauuguaaa

SEQ ID NO: 4078703 - RNA, 17 nt, Variola virus
uauuaaccacauaucug

SEQ ID NO: 4078704 - RNA, 22 nt, Variola virus
uauuaauacaggaucuagcaaa

SEQ ID NO: 4078705 - RNA, 14 nt, Variola virus
uauuaaucaaucau

SEQ ID NO: 4078706 - RNA, 22 nt, Variola virus
uauuacaagacgucauucuaaa

SEQ ID NO: 4078707 - RNA, 22 nt, Variola virus
uauuacaauuaauaaguauaaa

SEQ ID NO: 4078708 - RNA, 17 nt, Variola virus
uauuacuaggagaauua

SEQ ID NO: 4078709 - RNA, 19 nt, Variola virus
uauuacugacuuuaauauu

SEQ ID NO: 4078710 - RNA, 15 nt, Variola virus
uauuagaaauacacu

SEQ ID NO: 4078711 - RNA, 15 nt, Variola virus
uauuagaaucguguu

SEQ ID NO: 4078712 - RNA, 12 nt, Variola virus
uauuagaauuaa

SEQ ID NO: 4078713 - RNA, 22 nt, Variola virus
uauuagaauuggaauaccaaau

SEQ ID NO: 4078714 - RNA, 13 nt, Variola virus
uauuauaaucauu

SEQ ID NO: 4078715 - RNA, 20 nt, Variola virus
uauuaucaauucuggauuau

SEQ ID NO: 4078716 - RNA, 22 nt, Variola virus
uauuaucauacugucaacuaua

SEQ ID NO: 4078717 - RNA, 16 nt, Variola virus
uauuauccaauacaga

SEQ ID NO: 4078718 - RNA, 13 nt, Variola virus
uauuaucuauaaa

SEQ ID NO: 4078719 - RNA, 15 nt, Variola virus
uauuaucucaacaaa

SEQ ID NO: 4078720 - RNA, 20 nt, Variola virus
uauuaucucccauuaucuug

SEQ ID NO: 4078721 - RNA, 21 nt, Variola virus
uauuauguuaacggaaaguau

SEQ ID NO: 4078722 - RNA, 17 nt, Variola virus
uauucaagcaaaaacaa

SEQ ID NO: 4078723 - RNA, 13 nt, Variola virus
uauucacauaucg

SEQ ID NO: 4078724 - RNA, 15 nt, Variola virus
uauucacuuaacaau

SEQ ID NO: 4078725 - RNA, 16 nt, Variola virus
uauucauauucuuaaa

SEQ ID NO: 4078726 - RNA, 16 nt, Variola virus
uauuccaaucauugau

SEQ ID NO: 4078727 - RNA, 18 nt, Variola virus
uauuccagaugucaugau

SEQ ID NO: 4078728 - RNA, 17 nt, Variola virus
uauuccguauuuaucua

SEQ ID NO: 4078729 - RNA, 17 nt, Variola virus
uauuccuaguuuggauu

SEQ ID NO: 4078730 - RNA, 19 nt, Variola virus
uauuccuuucauuaacaau

SEQ ID NO: 4078731 - RNA, 13 nt, Variola virus
uauucgacacauc

SEQ ID NO: 4078732 - RNA, 23 nt, Variola virus
uauucggagcgcgcaauuuuuaa

SEQ ID NO: 4078733 - RNA, 19 nt, Variola virus
uauucuuaaaagguuucau

SEQ ID NO: 4078734 - RNA, 22 nt, Variola virus
uauucuuaauucuuuaacaaaa

SEQ ID NO: 4078735 - RNA, 16 nt, Variola virus
uauugaagauaaugug

SEQ ID NO: 4078736 - RNA, 20 nt, Variola virus
uauugcaaaucacucaauau

SEQ ID NO: 4078737 - RNA, 12 nt, Variola virus
uauugcaucaaa

SEQ ID NO: 4078738 - RNA, 14 nt, Variola virus
uauugcuacauaau

SEQ ID NO: 4078739 - RNA, 12 nt, Variola virus
uauugcuguauu

SEQ ID NO: 4078740 - RNA, 20 nt, Variola virus
uauugcuuuccuuuaucauu

SEQ ID NO: 4078741 - RNA, 18 nt, Variola virus
uauugguccgaauuacag

SEQ ID NO: 4078742 - RNA, 13 nt, Variola virus
uauuguagcauua

SEQ ID NO: 4078743 - RNA, 19 nt, Variola virus
uauuguggcgccuuauaua

SEQ ID NO: 4078744 - RNA, 19 nt, Variola virus
uauuuacaucuaauuuacu

SEQ ID NO: 4078745 - RNA, 20 nt, Variola virus
uauuuacugaacaggcauuu

SEQ ID NO: 4078746 - RNA, 18 nt, Variola virus
uauuuaucuuucuugcua

SEQ ID NO: 4078747 - RNA, 22 nt, Variola virus
uauuuaugauauauauuauaua

SEQ ID NO: 4078748 - RNA, 12 nt, Variola virus
uauuuauuucca

SEQ ID NO: 4078749 - RNA, 20 nt, Variola virus
uauuucaaaauuauuuacca

SEQ ID NO: 4078750 - RNA, 17 nt, Variola virus
uauuucacaucguauuu

SEQ ID NO: 4078751 - RNA, 23 nt, Variola virus
uauuucauugacggaugaucaua

SEQ ID NO: 4078752 - RNA, 15 nt, Variola virus
uauuuccaucaugau

SEQ ID NO: 4078753 - RNA, 18 nt, Variola virus
uauuucuauauuugacuc

SEQ ID NO: 4078754 - RNA, 23 nt, Variola virus
uauuugcgaggaugacucucaaa

SEQ ID NO: 4078755 - RNA, 19 nt, Variola virus
uauuuggcuaaauuauaua

SEQ ID NO: 4078756 - RNA, 12 nt, Variola virus
uauuuuaaugag

SEQ ID NO: 4078757 - RNA, 12 nt, Variola virus
uauuuuacacau

SEQ ID NO: 4078758 - RNA, 12 nt, Variola virus
uauuuuacuaau

SEQ ID NO: 4078759 - RNA, 13 nt, Variola virus
uauuuuacucauu

SEQ ID NO: 4078760 - RNA, 22 nt, Variola virus
uauuuucgcuccaaauauacau

SEQ ID NO: 4078761 - RNA, 12 nt, Variola virus
uauuuucuucua

SEQ ID NO: 4078762 - RNA, 21 nt, Variola virus
uauuuugauaggaucuauaau

SEQ ID NO: 4078763 - RNA, 19 nt, Variola virus
uauuuuuaacuuucaucua

SEQ ID NO: 4078764 - RNA, 19 nt, Variola virus
uauuuuucuaauacuauau

SEQ ID NO: 4078765 - RNA, 17 nt, Variola virus
uauuuuuuaucuaaaaa

SEQ ID NO: 4078766 - RNA, 18 nt, Variola virus
uauuuuuuuauacuucua

SEQ ID NO: 4078767 - RNA, 13 nt, Variola virus
ucaaaaacugaag

SEQ ID NO: 4078768 - RNA, 13 nt, Variola virus
ucaaaacaaacag

SEQ ID NO: 4078769 - RNA, 13 nt, Variola virus
ucaaaagaaaucu

SEQ ID NO: 4078770 - RNA, 14 nt, Variola virus
ucaaaagaaaucuu

SEQ ID NO: 4078771 - RNA, 12 nt, Variola virus
ucaaaagaagau

SEQ ID NO: 4078772 - RNA, 17 nt, Variola virus
ucaaaauauauagagaa

SEQ ID NO: 4078773 - RNA, 14 nt, Variola virus
ucaaaauauuucaa

SEQ ID NO: 4078774 - RNA, 18 nt, Variola virus
ucaaaaugcugauuucga

SEQ ID NO: 4078775 - RNA, 12 nt, Variola virus
ucaaaauuauuu

SEQ ID NO: 4078776 - RNA, 16 nt, Variola virus
ucaaaauuuauuugau

SEQ ID NO: 4078777 - RNA, 23 nt, Variola virus
ucaaacaaaaaagcucaauaaga

SEQ ID NO: 4078778 - RNA, 18 nt, Variola virus
ucaaacaugacauuuucc

SEQ ID NO: 4078779 - RNA, 15 nt, Variola virus
ucaaacucgauauau

SEQ ID NO: 4078780 - RNA, 12 nt, Variola virus
ucaaagaaaaag

SEQ ID NO: 4078781 - RNA, 14 nt, Variola virus
ucaaagaagaaguu

SEQ ID NO: 4078782 - RNA, 14 nt, Variola virus
ucaaagauuugaga

SEQ ID NO: 4078783 - RNA, 20 nt, Variola virus
ucaaauaauaaacuaaacaa

SEQ ID NO: 4078784 - RNA, 13 nt, Variola virus
ucaaauagauguu

SEQ ID NO: 4078785 - RNA, 16 nt, Variola virus
ucaaauuagauuucga

SEQ ID NO: 4078786 - RNA, 16 nt, Variola virus
uaacugcaguguguau

SEQ ID NO: 4078787 - RNA, 20 nt, Variola virus
uaacuguugccaaugauguu

SEQ ID NO: 4078788 - RNA, 21 nt, Variola virus
uaacuuccacauuaauacagc

SEQ ID NO: 4078789 - RNA, 22 nt, Variola virus
uaacuucgugaauaauguuucu

SEQ ID NO: 4078790 - RNA, 15 nt, Variola virus
uaacuuuucaaucau

SEQ ID NO: 4078791 - RNA, 19 nt, Variola virus
uaacuuuuucuuucucagc

SEQ ID NO: 4078792 - RNA, 22 nt, Variola virus
uaagaaaguaauucagacacuu

SEQ ID NO: 4078793 - RNA, 15 nt, Variola virus
uaagaagucauaugu

SEQ ID NO: 4078794 - RNA, 14 nt, Variola virus
uaagaaugugauaa

SEQ ID NO: 4078795 - RNA, 23 nt, Variola virus
uaagacuaaugcuugaaaaugga

SEQ ID NO: 4078796 - RNA, 16 nt, Variola virus
uaagauaguuguucau

SEQ ID NO: 4078797 - RNA, 15 nt, Variola virus
uaagauuaagugcua

SEQ ID NO: 4078798 - RNA, 17 nt, Variola virus
uaagauuuuaaauguau

SEQ ID NO: 4078799 - RNA, 23 nt, Variola virus
uaagauuuuugagauaucucauu

SEQ ID NO: 4078800 - RNA, 14 nt, Variola virus
uaagcaagaaagau

SEQ ID NO: 4078801 - RNA, 14 nt, Variola virus
uaagccaaacucau

SEQ ID NO: 4078802 - RNA, 19 nt, Variola virus
uaagcgcuauauaaaucau

SEQ ID NO: 4078803 - RNA, 18 nt, Variola virus
uaaguaauaacuauguuu

SEQ ID NO: 4078804 - RNA, 23 nt, Variola virus
uaaguaccggguaauauaucuuu

SEQ ID NO: 4078805 - RNA, 22 nt, Variola virus
uaaguaguuggaagaaucucau

SEQ ID NO: 4078806 - RNA, 15 nt, Variola virus
uaaguauaacacaaa

SEQ ID NO: 4078807 - RNA, 22 nt, Variola virus
uaaguauagcaaauaaaaucua

SEQ ID NO: 4078808 - RNA, 18 nt, Variola virus
uaagucaacguuuacauu

SEQ ID NO: 4078809 - RNA, 12 nt, Variola virus
uaagugaugcau

SEQ ID NO: 4078810 - RNA, 12 nt, Variola virus
uaaguguuuaua

SEQ ID NO: 4078811 - RNA, 20 nt, Variola virus
uaaguucauuaucugaaaua

SEQ ID NO: 4078812 - RNA, 22 nt, Variola virus
uaaguucuggaauauuaucauc

SEQ ID NO: 4078813 - RNA, 19 nt, Variola virus
uaaguuggucacauacuuu

SEQ ID NO: 4078814 - RNA, 21 nt, Variola virus
uaaguuguggguaguaucauc

SEQ ID NO: 4078815 - RNA, 13 nt, Variola virus
uaaguuucaagau

SEQ ID NO: 4078816 - RNA, 15 nt, Variola virus
uaauaaaacaaugga

SEQ ID NO: 4078817 - RNA, 13 nt, Variola virus
uaauaaauacaga

SEQ ID NO: 4078818 - RNA, 21 nt, Variola virus
uaauaaauguuucgauuucaa

SEQ ID NO: 4078819 - RNA, 22 nt, Variola virus
uaauaaauugaugacgucaugu

SEQ ID NO: 4078820 - RNA, 18 nt, Variola virus
uaauaaauuuauuauuua

SEQ ID NO: 4078821 - RNA, 16 nt, Variola virus
uaauaauagaaaccau

SEQ ID NO: 4078822 - RNA, 15 nt, Variola virus
uaauaaucucaucau

SEQ ID NO: 4078823 - RNA, 13 nt, Variola virus
uaauaaugauuca

SEQ ID NO: 4078824 - RNA, 14 nt, Variola virus
uaauaauuaaccaa

SEQ ID NO: 4078825 - RNA, 15 nt, Variola virus
uaauaauucauggaa

SEQ ID NO: 4078826 - RNA, 19 nt, Variola virus
uaauaauuuuuuaaauccu

SEQ ID NO: 4078827 - RNA, 20 nt, Variola virus
uaauacaggaauauaaucuu

SEQ ID NO: 4078828 - RNA, 18 nt, Variola virus
uaauacccguuuguuuaa

SEQ ID NO: 4078829 - RNA, 12 nt, Variola virus
uaauacuaaaua

SEQ ID NO: 4078830 - RNA, 19 nt, Variola virus
uaauagaauuuauauaucu

SEQ ID NO: 4078831 - RNA, 19 nt, Variola virus
uaauagacuauauaaaccg

SEQ ID NO: 4078832 - RNA, 22 nt, Variola virus
uaauagcaucaucuuuaucauu

SEQ ID NO: 4078833 - RNA, 21 nt, Variola virus
uaauagcuccccuguuuucau

SEQ ID NO: 4078834 - RNA, 13 nt, Variola virus
uaauaguaggaac

SEQ ID NO: 4078835 - RNA, 24 nt, Variola virus
uaauaguuuccaccaaaagacuau

SEQ ID NO: 4078836 - RNA, 16 nt, Variola virus
uaauauaaaaacauua

SEQ ID NO: 4078837 - RNA, 15 nt, Variola virus
uaauauaaaaacuua

SEQ ID NO: 4078838 - RNA, 16 nt, Variola virus
uaauauaaaagaauau

SEQ ID NO: 4078839 - RNA, 12 nt, Variola virus
uaauauaaacau

SEQ ID NO: 4078840 - RNA, 19 nt, Variola virus
uaauauaaucuagacagau

SEQ ID NO: 4078841 - RNA, 17 nt, Variola virus
uaauauagaaaauucau

SEQ ID NO: 4078842 - RNA, 18 nt, Variola virus
uaauauauugaucauaau

SEQ ID NO: 4078843 - RNA, 17 nt, Variola virus
uaauauccaaucuuauu

SEQ ID NO: 4078844 - RNA, 20 nt, Variola virus
uaauauccucuauuauacau

SEQ ID NO: 4078845 - RNA, 15 nt, Variola virus
uaauaugaguaacau

SEQ ID NO: 4078846 - RNA, 21 nt, Variola virus
uaauauucacagguauuauua

SEQ ID NO: 4078847 - RNA, 20 nt, Variola virus
uaauauucauucaauauuua

SEQ ID NO: 4078848 - RNA, 22 nt, Variola virus
uaauauuggcagcguuguuuau

SEQ ID NO: 4078849 - RNA, 15 nt, Variola virus
uaaucaaaauugucu

SEQ ID NO: 4078850 - RNA, 16 nt, Variola virus
uaaucaagucaauuau

SEQ ID NO: 4078851 - RNA, 23 nt, Variola virus
uaaucauauaggcauugauuuuu

SEQ ID NO: 4078852 - RNA, 19 nt, Variola virus
uaaucauguaaauguuuaa

SEQ ID NO: 4078853 - RNA, 18 nt, Variola virus
uaauccaaugauacuuuu

SEQ ID NO: 4078854 - RNA, 21 nt, Variola virus
uaauccagaauguacacuauu

SEQ ID NO: 4078855 - RNA, 22 nt, Variola virus
uaauccuauucuugaucucauc

SEQ ID NO: 4078856 - RNA, 15 nt, Variola virus
uaaucguuauuauca

SEQ ID NO: 4078857 - RNA, 17 nt, Variola virus
uaaucuauuuuaucauu

SEQ ID NO: 4078858 - RNA, 22 nt, Variola virus
uaaucuuuauuucguuuucgau

SEQ ID NO: 4078859 - RNA, 21 nt, Variola virus
uaaugaauuuagaaaugauug

SEQ ID NO: 4078860 - RNA, 17 nt, Variola virus
uaaugacaauaauuaug

SEQ ID NO: 4078861 - RNA, 22 nt, Variola virus
uaaugacauggacguagauguu

SEQ ID NO: 4078862 - RNA, 18 nt, Variola virus
uaaugauacagaaaaucu

SEQ ID NO: 4078863 - RNA, 22 nt, Variola virus
uaaugccuguaaaaauaaacau

SEQ ID NO: 4078864 - RNA, 18 nt, Variola virus
uaauggagauuuucuauu

SEQ ID NO: 4078865 - RNA, 14 nt, Variola virus
uaaugguguguuau

SEQ ID NO: 4078866 - RNA, 14 nt, Variola virus
uaauguaaaaucau

SEQ ID NO: 4078867 - RNA, 23 nt, Variola virus
uaauguagaaaaucauacagaca

SEQ ID NO: 4078868 - RNA, 15 nt, Variola virus
uaaugucucuauaaa

SEQ ID NO: 4078869 - RNA, 21 nt, Variola virus
uaauuaaaaguuuuacuauau

SEQ ID NO: 4078870 - RNA, 14 nt, Variola virus
uaauuaagaacuau

SEQ ID NO: 4078871 - RNA, 13 nt, Variola virus
uaauuaaugucca

SEQ ID NO: 4078872 - RNA, 16 nt, Variola virus
uaauuaggaucuucua

SEQ ID NO: 4078873 - RNA, 14 nt, Variola virus
uaauucauaagaau

SEQ ID NO: 4078874 - RNA, 14 nt, Variola virus
uaauucauacacca

SEQ ID NO: 4078875 - RNA, 18 nt, Variola virus
uaauuccaaaaauagcau

SEQ ID NO: 4078876 - RNA, 15 nt, Variola virus
uaauuccaaaagaug

SEQ ID NO: 4078877 - RNA, 12 nt, Variola virus
uaauucuaaaac

SEQ ID NO: 4078878 - RNA, 14 nt, Variola virus
uaauucuacaucca

SEQ ID NO: 4078879 - RNA, 21 nt, Variola virus
uaauugaguaaauaaaugcuc

SEQ ID NO: 4078880 - RNA, 19 nt, Variola virus
uaauugccauaauaauuac

SEQ ID NO: 4078881 - RNA, 23 nt, Variola virus
uaauugcucaaauaauacuauau

SEQ ID NO: 4078882 - RNA, 20 nt, Variola virus
uaauuggcuaguauuuaaca

SEQ ID NO: 4078883 - RNA, 18 nt, Variola virus
uaauuguccuauaugucg

SEQ ID NO: 4078884 - RNA, 17 nt, Variola virus
uaauuuaacuauuuuag

SEQ ID NO: 4078885 - RNA, 17 nt, Variola virus
uaauuuauacaaaguau

SEQ ID NO: 4078886 - RNA, 18 nt, Variola virus
uaauuucaggaacaggau

SEQ ID NO: 4078887 - RNA, 16 nt, Variola virus
uaauuugaguaagaau

SEQ ID NO: 4078888 - RNA, 19 nt, Variola virus
uaauuuguaaaccaucuua

SEQ ID NO: 4078889 - RNA, 17 nt, Variola virus
uaauuuguauauacaua

SEQ ID NO: 4078890 - RNA, 14 nt, Variola virus
uaauuuuacuagau

SEQ ID NO: 4078891 - RNA, 17 nt, Variola virus
uaauuuuauauuccucu

SEQ ID NO: 4078892 - RNA, 15 nt, Variola virus
uacaaaauauguucg

SEQ ID NO: 4078893 - RNA, 23 nt, Variola virus
uacaaaauguugauaauccuuga

SEQ ID NO: 4078894 - RNA, 18 nt, Variola virus
uacaaauauuauacauga

SEQ ID NO: 4078895 - RNA, 18 nt, Variola virus
uacaacuggucauagaaa

SEQ ID NO: 4078896 - RNA, 22 nt, Variola virus
uacaagaaauacuuccauccga

SEQ ID NO: 4078897 - RNA, 20 nt, Variola virus
uacaauaaacuccguagaga

SEQ ID NO: 4078898 - RNA, 13 nt, Variola virus
uacaauaaauguu

SEQ ID NO: 4078899 - RNA, 13 nt, Variola virus
uacaauacaugua

SEQ ID NO: 4078900 - RNA, 18 nt, Variola virus
uacaauauucauauccuu

SEQ ID NO: 4078901 - RNA, 13 nt, Variola virus
uacaauauuuccg

SEQ ID NO: 4078902 - RNA, 21 nt, Variola virus
uacaauccuucguuaucucug

SEQ ID NO: 4078903 - RNA, 20 nt, Variola virus
uacaaucguucaaacucguc

SEQ ID NO: 4078904 - RNA, 17 nt, Variola virus
uacacggcauaguuucu

SEQ ID NO: 4078905 - RNA, 12 nt, Variola virus
uacagaaaauau

SEQ ID NO: 4078906 - RNA, 20 nt, Variola virus
uacagagacuuuaucuaaau

SEQ ID NO: 4078907 - RNA, 20 nt, Variola virus
uacaguguaugguacuaaau

SEQ ID NO: 4078908 - RNA, 20 nt, Variola virus
agacguacauggaaaggaaa

SEQ ID NO: 4078909 - RNA, 23 nt, Variola virus
agacguccauaucugauuauuau

SEQ ID NO: 4078910 - RNA, 16 nt, Variola virus
agacguugccaaaaaa

SEQ ID NO: 4078911 - RNA, 13 nt, Variola virus
agacguuguacaa

SEQ ID NO: 4078912 - RNA, 20 nt, Variola virus
agacuaggugcuauggaugg

SEQ ID NO: 4078913 - RNA, 17 nt, Variola virus
agacuccguuccagaua

SEQ ID NO: 4078914 - RNA, 20 nt, Variola virus
agacugugcaucaacaguua

SEQ ID NO: 4078915 - RNA, 17 nt, Variola virus
agacuguuuauacaaga

SEQ ID NO: 4078916 - RNA, 15 nt, Variola virus
agacuuugaaauaua

SEQ ID NO: 4078917 - RNA, 22 nt, Variola virus
agacuuuuguccuaaaauacua

SEQ ID NO: 4078918 - RNA, 15 nt, Variola virus
agagaauuauauauu

SEQ ID NO: 4078919 - RNA, 16 nt, Variola virus
agagaccgauaccuau

SEQ ID NO: 4078920 - RNA, 16 nt, Variola virus
agagauaauagaaaau

SEQ ID NO: 4078921 - RNA, 14 nt, Variola virus
agagauaauauccu

SEQ ID NO: 4078922 - RNA, 15 nt, Variola virus
agagaucuacuggug

SEQ ID NO: 4078923 - RNA, 14 nt, Variola virus
agagaugaaaaauu

SEQ ID NO: 4078924 - RNA, 19 nt, Variola virus
agagauuuaacuguucauc

SEQ ID NO: 4078925 - RNA, 18 nt, Variola virus
agagauuucaacagacug

SEQ ID NO: 4078926 - RNA, 17 nt, Variola virus
agagcuucguauacucu

SEQ ID NO: 4078927 - RNA, 13 nt, Variola virus
agaggaaacuaau

SEQ ID NO: 4078928 - RNA, 16 nt, Variola virus
agaggaguuauuuacu

SEQ ID NO: 4078929 - RNA, 19 nt, Variola virus
agagucauuaaaauaugcg

SEQ ID NO: 4078930 - RNA, 22 nt, Variola virus
agaguccuauauauuugaaaau

SEQ ID NO: 4078931 - RNA, 15 nt, Variola virus
agagugauaauauau

SEQ ID NO: 4078932 - RNA, 13 nt, Variola virus
agaguucauuuau

SEQ ID NO: 4078933 - RNA, 20 nt, Variola virus
agaguuucaaaaauauucau

SEQ ID NO: 4078934 - RNA, 16 nt, Variola virus
agauaaaaaauuauau

SEQ ID NO: 4078935 - RNA, 16 nt, Variola virus
agauaaagaguucuaa

SEQ ID NO: 4078936 - RNA, 17 nt, Variola virus
agauaagaacauaauaa

SEQ ID NO: 4078937 - RNA, 23 nt, Variola virus
agauaauagggagaaaugacauu

SEQ ID NO: 4078938 - RNA, 22 nt, Variola virus
agauacaauggaugauaugaag

SEQ ID NO: 4078939 - RNA, 15 nt, Variola virus
agauacagauguaaa

SEQ ID NO: 4078940 - RNA, 21 nt, Variola virus
agauacaguuaauaucuauau

SEQ ID NO: 4078941 - RNA, 14 nt, Variola virus
agauacauauggau

SEQ ID NO: 4078942 - RNA, 21 nt, Variola virus
agauaccucagcguguuaaaa

SEQ ID NO: 4078943 - RNA, 16 nt, Variola virus
agauacguauuagaua

SEQ ID NO: 4078944 - RNA, 15 nt, Variola virus
agauacgucuauaca

SEQ ID NO: 4078945 - RNA, 12 nt, Variola virus
agauacuugaag

SEQ ID NO: 4078946 - RNA, 14 nt, Variola virus
agauaguaaauaga

SEQ ID NO: 4078947 - RNA, 16 nt, Variola virus
agauaguaaauagaua

SEQ ID NO: 4078948 - RNA, 19 nt, Variola virus
agauaguccagaaauggaa

SEQ ID NO: 4078949 - RNA, 21 nt, Variola virus
agauauaaaaugcguauucca

SEQ ID NO: 4078950 - RNA, 15 nt, Variola virus
agauaucaaaauauu

SEQ ID NO: 4078951 - RNA, 15 nt, Variola virus
agauauccagaguuu

SEQ ID NO: 4078952 - RNA, 16 nt, Variola virus
agauaugccaaaauca

SEQ ID NO: 4078953 - RNA, 22 nt, Variola virus
agauauuaucauuagucauguu

SEQ ID NO: 4078954 - RNA, 13 nt, Variola virus
agauauuaucuau

SEQ ID NO: 4078955 - RNA, 19 nt, Variola virus
agauauuuagcaauugcau

SEQ ID NO: 4078956 - RNA, 20 nt, Variola virus
agaucaaaauuaacaaaauu

SEQ ID NO: 4078957 - RNA, 16 nt, Variola virus
agaucauacagucaca

SEQ ID NO: 4078958 - RNA, 16 nt, Variola virus
agaucccaaaucuucu

SEQ ID NO: 4078959 - RNA, 20 nt, Variola virus
agauccucucuuaaaugaau

SEQ ID NO: 4078960 - RNA, 15 nt, Variola virus
agaucgaaaaaagag

SEQ ID NO: 4078961 - RNA, 22 nt, Variola virus
agaucguuggacauuggauaau

SEQ ID NO: 4078962 - RNA, 19 nt, Variola virus
agaucuacuggugaaaugu

SEQ ID NO: 4078963 - RNA, 19 nt, Variola virus
agaucugaauuaaauaugu

SEQ ID NO: 4078964 - RNA, 16 nt, Variola virus
agaucuuaagaaaauu

SEQ ID NO: 4078965 - RNA, 22 nt, Variola virus
agaugaguccaugacuugguau

SEQ ID NO: 4078966 - RNA, 13 nt, Variola virus
agaugauauguau

SEQ ID NO: 4078967 - RNA, 16 nt, Variola virus
auaauauuaucuauau

SEQ ID NO: 4078968 - RNA, 16 nt, Variola virus
auaauauuaugucuag

SEQ ID NO: 4078969 - RNA, 20 nt, Variola virus
auaauauuuguuaucaugau

SEQ ID NO: 4078970 - RNA, 19 nt, Variola virus
auaaucaaaauugucuaug

SEQ ID NO: 4078971 - RNA, 19 nt, Variola virus
auaaucauaaccauuucua

SEQ ID NO: 4078972 - RNA, 18 nt, Variola virus
auaaucaucgaauacuuu

SEQ ID NO: 4078973 - RNA, 14 nt, Variola virus
auaaucauuacugu

SEQ ID NO: 4078974 - RNA, 16 nt, Variola virus
auaauccagaauguac

SEQ ID NO: 4078975 - RNA, 18 nt, Variola virus
auaauccgauauaugaug

SEQ ID NO: 4078976 - RNA, 19 nt, Variola virus
auaauccggauguugugua

SEQ ID NO: 4078977 - RNA, 20 nt, Variola virus
auaauccugugcauaaauua

SEQ ID NO: 4078978 - RNA, 17 nt, Variola virus
auaauccuuauacaucu

SEQ ID NO: 4078979 - RNA, 15 nt, Variola virus
auaaucguuaauauu

SEQ ID NO: 4078980 - RNA, 23 nt, Variola virus
auaaucuaguaaaacuuucuagu

SEQ ID NO: 4078981 - RNA, 14 nt, Variola virus
auaaugaacauagu

SEQ ID NO: 4078982 - RNA, 20 nt, Variola virus
auaaugauacgauacuauau

SEQ ID NO: 4078983 - RNA, 17 nt, Variola virus
auaaugaugaccuauau

SEQ ID NO: 4078984 - RNA, 20 nt, Variola virus
auaauggcgcuaucuuuuaa

SEQ ID NO: 4078985 - RNA, 20 nt, Variola virus
auaauggucgaacacaguau

SEQ ID NO: 4078986 - RNA, 16 nt, Variola virus
auaauggugcuuguau

SEQ ID NO: 4078987 - RNA, 23 nt, Variola virus
auaauuacgagucucguguguaa

SEQ ID NO: 4078988 - RNA, 15 nt, Variola virus
auaauuuaacauuuu

SEQ ID NO: 4078989 - RNA, 19 nt, Variola virus
auaauuuaguguuuaaauu

SEQ ID NO: 4078990 - RNA, 21 nt, Variola virus
auaauuuugauuguacaccca

SEQ ID NO: 4078991 - RNA, 16 nt, Variola virus
auaauuuuuauguuuu

SEQ ID NO: 4078992 - RNA, 20 nt, Variola virus
auacaaaauuugcaucuaca

SEQ ID NO: 4078993 - RNA, 14 nt, Variola virus
auacaaauuuuacu

SEQ ID NO: 4078994 - RNA, 16 nt, Variola virus
auacaacuaaggagaa

SEQ ID NO: 4078995 - RNA, 16 nt, Variola virus
auacaauaaauguuua

SEQ ID NO: 4078996 - RNA, 16 nt, Variola virus
auacacaugauugaca

SEQ ID NO: 4078997 - RNA, 16 nt, Variola virus
auacacauuuaauaaa

SEQ ID NO: 4078998 - RNA, 19 nt, Variola virus
auacacguauaaaaaauau

SEQ ID NO: 4078999 - RNA, 18 nt, Variola virus
auacacuaaguauauaca

SEQ ID NO: 4079000 - RNA, 18 nt, Variola virus
auacacuguuuaaaauua

SEQ ID NO: 4079001 - RNA, 17 nt, Variola virus
auacagaaggaaacuuc

SEQ ID NO: 4079002 - RNA, 18 nt, Variola virus
auacagacaauugacaaa

SEQ ID NO: 4079003 - RNA, 15 nt, Variola virus
auacaguaaguacau

SEQ ID NO: 4079004 - RNA, 21 nt, Variola virus
auacaguguauguaaaaaugu

SEQ ID NO: 4079005 - RNA, 14 nt, Variola virus
auacauaaagaacg

SEQ ID NO: 4079006 - RNA, 20 nt, Variola virus
auacauggggaucugauggu

SEQ ID NO: 4079007 - RNA, 17 nt, Variola virus
auacauucgaaaaaucu

SEQ ID NO: 4079008 - RNA, 15 nt, Variola virus
auacauuuucaaaua

SEQ ID NO: 4079009 - RNA, 12 nt, Variola virus
auaccaaacaua

SEQ ID NO: 4079010 - RNA, 13 nt, Variola virus
auaccauguguau

SEQ ID NO: 4079011 - RNA, 16 nt, Variola virus
auaccuuguaauuaaa

SEQ ID NO: 4079012 - RNA, 17 nt, Variola virus
auaccuuuccuggaaua

SEQ ID NO: 4079013 - RNA, 18 nt, Variola virus
auacgaagaaaaaguaaa

SEQ ID NO: 4079014 - RNA, 20 nt, Variola virus
auacgaagggauugaaaaua

SEQ ID NO: 4079015 - RNA, 16 nt, Variola virus
auacgaggaugaugau

SEQ ID NO: 4079016 - RNA, 14 nt, Variola virus
auacgcguucucaa

SEQ ID NO: 4079017 - RNA, 14 nt, Variola virus
auacguauccauga

SEQ ID NO: 4079018 - RNA, 13 nt, Variola virus
auacgucuuuauu

SEQ ID NO: 4079019 - RNA, 18 nt, Variola virus
auacgugagaauauacua

SEQ ID NO: 4079020 - RNA, 12 nt, Variola virus
auacuaaauaua

SEQ ID NO: 4079021 - RNA, 22 nt, Variola virus
auacuagaguuguuaaaguuaa

SEQ ID NO: 4079022 - RNA, 15 nt, Variola virus
auacuaguuuucuaa

SEQ ID NO: 4079023 - RNA, 13 nt, Variola virus
auacuaucaaaau

SEQ ID NO: 4079024 - RNA, 22 nt, Variola virus
auacuauccaucagaauguuuc

SEQ ID NO: 4079025 - RNA, 14 nt, Variola virus
auacuauuguacau

SEQ ID NO: 4079026 - RNA, 20 nt, Variola virus
auacucaagauauuuguuaa

SEQ ID NO: 4079027 - RNA, 18 nt, Variola virus
auacucccacaaauacug

SEQ ID NO: 4079028 - RNA, 21 nt, Variola virus
auacucuacagaguugauugu

SEQ ID NO: 4079029 - RNA, 21 nt, Variola virus
auacuguagaugguucuuuaa

SEQ ID NO: 4079030 - RNA, 16 nt, Variola virus
auacugucaacuauag

SEQ ID NO: 4079031 - RNA, 20 nt, Variola virus
auacuuaaaaaaugaaaaua

SEQ ID NO: 4079032 - RNA, 14 nt, Variola virus
auacuuaaaaugua

SEQ ID NO: 4079033 - RNA, 22 nt, Variola virus
auacuuuaacaucacuaauauc

SEQ ID NO: 4079034 - RNA, 14 nt, Variola virus
auacuuuaugaaug

SEQ ID NO: 4079035 - RNA, 17 nt, Variola virus
auacuuugguaaauguu

SEQ ID NO: 4079036 - RNA, 14 nt, Variola virus
auacuuuguaacua

SEQ ID NO: 4079037 - RNA, 18 nt, Variola virus
auacuuuguaauauaaug

SEQ ID NO: 4079038 - RNA, 14 nt, Variola virus
auagaaaaugaauc

SEQ ID NO: 4079039 - RNA, 15 nt, Variola virus
auagaaauuuuggua

SEQ ID NO: 4079040 - RNA, 18 nt, Variola virus
auagaacaauauaaugua

SEQ ID NO: 4079041 - RNA, 20 nt, Variola virus
auagaacgaaguaaaaaguu

SEQ ID NO: 4079042 - RNA, 15 nt, Variola virus
auagaauuuauauau

SEQ ID NO: 4079043 - RNA, 22 nt, Variola virus
auagaccgucuacaagaaacuu

SEQ ID NO: 4079044 - RNA, 17 nt, Variola virus
auagagaguucauuuau

SEQ ID NO: 4079045 - RNA, 14 nt, Variola virus
auagaggaugaauu

SEQ ID NO: 4079046 - RNA, 17 nt, Variola virus
auagauaaguauuuacu

SEQ ID NO: 4079047 - RNA, 17 nt, Variola virus
auagauaauacaaaauu

SEQ ID NO: 4079048 - RNA, 16 nt, Variola virus
auagauaaugauauau

SEQ ID NO: 4079049 - RNA, 16 nt, Variola virus
auagauaauuguaaca

SEQ ID NO: 4079050 - RNA, 14 nt, Variola virus
auagauaucaaaau

SEQ ID NO: 4079051 - RNA, 16 nt, Variola virus
auagaucuuucauuau

SEQ ID NO: 4079052 - RNA, 13 nt, Variola virus
auagaugaaaauc

SEQ ID NO: 4079053 - RNA, 12 nt, Variola virus
auagaugaaugu

SEQ ID NO: 4079054 - RNA, 21 nt, Variola virus
auagaugagguacuauuuuau

SEQ ID NO: 4079055 - RNA, 21 nt, Variola virus
auagaugauggaagacaaguu

SEQ ID NO: 4079056 - RNA, 16 nt, Variola virus
auagaugccagauuac

SEQ ID NO: 4079057 - RNA, 13 nt, Variola virus
auagauguauaua

SEQ ID NO: 4079058 - RNA, 19 nt, Variola virus
auagauuucgaaaauacua

SEQ ID NO: 4079059 - RNA, 15 nt, Variola virus
auagcaucauugcua

SEQ ID NO: 4079060 - RNA, 14 nt, Variola virus
auagcuacaguaaa

SEQ ID NO: 4079061 - RNA, 12 nt, Variola virus
auagcuaucaag

SEQ ID NO: 4079062 - RNA, 17 nt, Variola virus
auagcuuuuauuuccac

SEQ ID NO: 4079063 - RNA, 15 nt, Variola virus
auaggcguacaaaag

SEQ ID NO: 4079064 - RNA, 16 nt, Variola virus
auagggaaucauauau

SEQ ID NO: 4079065 - RNA, 14 nt, Variola virus
auaguaaaauaaag

SEQ ID NO: 4079066 - RNA, 14 nt, Variola virus
auaguaaaauauua

SEQ ID NO: 4079067 - RNA, 16 nt, Variola virus
auaguacuaaagacua

SEQ ID NO: 4079068 - RNA, 18 nt, Variola virus
auaguaguacacaacaug

SEQ ID NO: 4079069 - RNA, 22 nt, Variola virus
auaguauauacguuauugucaa

SEQ ID NO: 4079070 - RNA, 16 nt, Variola virus
auaguauaucuacaca

SEQ ID NO: 4079071 - RNA, 23 nt, Variola virus
auaguauggcauucauugucuaa

SEQ ID NO: 4079072 - RNA, 13 nt, Variola virus
auaguaugucuua

SEQ ID NO: 4079073 - RNA, 15 nt, Variola virus
auaguuauaucacau

SEQ ID NO: 4079074 - RNA, 22 nt, Variola virus
auaguucguguacuagucauaa

SEQ ID NO: 4079075 - RNA, 19 nt, Variola virus
auaguuugggaaaagaaau

SEQ ID NO: 4079076 - RNA, 14 nt, Variola virus
auaguuuuggauca

SEQ ID NO: 4079077 - RNA, 13 nt, Variola virus
auauaaaaaauuu

SEQ ID NO: 4079078 - RNA, 16 nt, Variola virus
auauaaaauaacuaca

SEQ ID NO: 4079079 - RNA, 13 nt, Variola virus
auauaacauagaa

SEQ ID NO: 4079080 - RNA, 15 nt, Variola virus
auauaaguaauacau

SEQ ID NO: 4079081 - RNA, 18 nt, Variola virus
auauaauacuuaaaaaug

SEQ ID NO: 4079082 - RNA, 14 nt, Variola virus
auauaauccaucaa

SEQ ID NO: 4079083 - RNA, 12 nt, Variola virus
auauaaugaauu

SEQ ID NO: 4079084 - RNA, 18 nt, Variola virus
auauaauuaucacauauu

SEQ ID NO: 4079085 - RNA, 21 nt, Variola virus
auauacaacucucuaauacga

SEQ ID NO: 4079086 - RNA, 17 nt, Variola virus
auauacagaauuuguaa

SEQ ID NO: 4079087 - RNA, 14 nt, Variola virus
auauacagucuuaa

SEQ ID NO: 4079088 - RNA, 20 nt, Variola virus
auauagauuuuuuaaaggau

SEQ ID NO: 4079089 - RNA, 13 nt, Variola virus
auauagcauagau

SEQ ID NO: 4079090 - RNA, 21 nt, Variola virus
auauagcuuucacucauauaa

SEQ ID NO: 4079091 - RNA, 11 nt, Variola virus
auauaggaaaa

SEQ ID NO: 4079092 - RNA, 19 nt, Variola virus
auauaggaccacuagcaaa

SEQ ID NO: 4079093 - RNA, 17 nt, Variola virus
auauagggaaucauaua

SEQ ID NO: 4079094 - RNA, 13 nt, Variola virus
cuauauuguauuc

SEQ ID NO: 4079095 - RNA, 21 nt, Variola virus
cuaucaaccacauaauacaau

SEQ ID NO: 4079096 - RNA, 23 nt, Variola virus
cuaucagagcuaccgaaggagau

SEQ ID NO: 4079097 - RNA, 16 nt, Variola virus
cuaucagugaucuguu

SEQ ID NO: 4079098 - RNA, 18 nt, Variola virus
cuaucauuaccucaugaa

SEQ ID NO: 4079099 - RNA, 13 nt, Variola virus
cuaucauuuugag

SEQ ID NO: 4079100 - RNA, 12 nt, Variola virus
cuauccaauaaa

SEQ ID NO: 4079101 - RNA, 21 nt, Variola virus
cuaugaauaccauuaaacaau

SEQ ID NO: 4079102 - RNA, 17 nt, Variola virus
cuaugagugaaggagac

SEQ ID NO: 4079103 - RNA, 14 nt, Variola virus
cuaugcuauuugcg

SEQ ID NO: 4079104 - RNA, 22 nt, Variola virus
cuauguauucagaauuaauaga

SEQ ID NO: 4079105 - RNA, 16 nt, Variola virus
cuauguuucaguuuaa

SEQ ID NO: 4079106 - RNA, 17 nt, Variola virus
cuauuaguuguuccaau

SEQ ID NO: 4079107 - RNA, 22 nt, Variola virus
cuauuauaccagaauuaauagg

SEQ ID NO: 4079108 - RNA, 19 nt, Variola virus
cuauuauuugcgaggauga

SEQ ID NO: 4079109 - RNA, 14 nt, Variola virus
cuauucauguaaug

SEQ ID NO: 4079110 - RNA, 15 nt, Variola virus
cuauugccaaauguu

SEQ ID NO: 4079111 - RNA, 21 nt, Variola virus
cuauuguuaaucaugccacca

SEQ ID NO: 4079112 - RNA, 14 nt, Variola virus
cuauuguuuggaau

SEQ ID NO: 4079113 - RNA, 16 nt, Variola virus
cuauuuguauaauaau

SEQ ID NO: 4079114 - RNA, 20 nt, Variola virus
cuauuuuaacaaagcaucua

SEQ ID NO: 4079115 - RNA, 14 nt, Variola virus
cuauuuuuaauaua

SEQ ID NO: 4079116 - RNA, 13 nt, Variola virus
cucaaacauccuc

SEQ ID NO: 4079117 - RNA, 20 nt, Variola virus
cucaagauuuuaaaaaacug

SEQ ID NO: 4079118 - RNA, 17 nt, Variola virus
cucaauaaaaaauuaau

SEQ ID NO: 4079119 - RNA, 22 nt, Variola virus
cucagauucaguuucucaucuu

SEQ ID NO: 4079120 - RNA, 14 nt, Variola virus
cucauaauccauuu

SEQ ID NO: 4079121 - RNA, 19 nt, Variola virus
cucauaauguaaagauauu

SEQ ID NO: 4079122 - RNA, 18 nt, Variola virus
cucauauaacuucuagau

SEQ ID NO: 4079123 - RNA, 14 nt, Variola virus
cucaucaucuguuu

SEQ ID NO: 4079124 - RNA, 18 nt, Variola virus
cucaucggaucuguaaaa

SEQ ID NO: 4079125 - RNA, 15 nt, Variola virus
cucaugacuucauug

SEQ ID NO: 4079126 - RNA, 15 nt, Variola virus
cucaugucaaauugu

SEQ ID NO: 4079127 - RNA, 16 nt, Variola virus
cucauuaaaacuucua

SEQ ID NO: 4079128 - RNA, 14 nt, Variola virus
cucauuauuuccca

SEQ ID NO: 4079129 - RNA, 14 nt, Variola virus
cuccaauacuaauu

SEQ ID NO: 4079130 - RNA, 19 nt, Variola virus
cuccagaugauguuacaau

SEQ ID NO: 4079131 - RNA, 21 nt, Variola virus
cuccaucggcuuuaacaauug

SEQ ID NO: 4079132 - RNA, 14 nt, Variola virus
cuccccacauuuca

SEQ ID NO: 4079133 - RNA, 12 nt, Variola virus
cucccuuuagau

SEQ ID NO: 4079134 - RNA, 21 nt, Variola virus
cuccgcaauacauuucucaaa

SEQ ID NO: 4079135 - RNA, 19 nt, Variola virus
cuccguuuccauuaccauc

SEQ ID NO: 4079136 - RNA, 21 nt, Variola virus
cuccucauuacguuucauuuu

SEQ ID NO: 4079137 - RNA, 15 nt, Variola virus
cucgugcagauaucc

SEQ ID NO: 4079138 - RNA, 20 nt, Variola virus
cucguuaaacgccuuuagaa

SEQ ID NO: 4079139 - RNA, 16 nt, Variola virus
cucguugguauuugaa

SEQ ID NO: 4079140 - RNA, 11 nt, Variola virus
cucuaaaugag

SEQ ID NO: 4079141 - RNA, 12 nt, Variola virus
cucuaaaugagu

SEQ ID NO: 4079142 - RNA, 21 nt, Variola virus
cucuaaaugagucuacugcua

SEQ ID NO: 4079143 - RNA, 14 nt, Variola virus
cucuaacagauauu

SEQ ID NO: 4079144 - RNA, 19 nt, Variola virus
cucuacaaaaugucaugau

SEQ ID NO: 4079145 - RNA, 14 nt, Variola virus
cucuacaaauaucu

SEQ ID NO: 4079146 - RNA, 15 nt, Variola virus
cucuauaaaauacua

SEQ ID NO: 4079147 - RNA, 23 nt, Variola virus
cucuauaaaauacuaaugcaucu

SEQ ID NO: 4079148 - RNA, 22 nt, Variola virus
cucuauaguuuguuuucauuau

SEQ ID NO: 4079149 - RNA, 20 nt, Variola virus
cucuaugacuucaucaucug

SEQ ID NO: 4079150 - RNA, 19 nt, Variola virus
cucuauuggauauggauuu

SEQ ID NO: 4079151 - RNA, 22 nt, Variola virus
cucuauuggauauggauuucca

SEQ ID NO: 4079152 - RNA, 11 nt, Variola virus
cucuauuuugg

SEQ ID NO: 4079153 - RNA, 14 nt, Variola virus
cucucuaucucuua

SEQ ID NO: 4079154 - RNA, 16 nt, Variola virus
cucucuuaauuucaga

SEQ ID NO: 4079155 - RNA, 15 nt, Variola virus
cucuggagaaaagau

SEQ ID NO: 4079156 - RNA, 15 nt, Variola virus
cucuguuucuguauc

SEQ ID NO: 4079157 - RNA, 15 nt, Variola virus
cucuuaauuauaacg

SEQ ID NO: 4079158 - RNA, 20 nt, Variola virus
cugaaaaagauaucagagaa

SEQ ID NO: 4079159 - RNA, 17 nt, Variola virus
cugaaaauaaagauaaa

SEQ ID NO: 4079160 - RNA, 16 nt, Variola virus
cugaaauaauuagaac

SEQ ID NO: 4079161 - RNA, 22 nt, Variola virus
cugaagaagagguaagauaucu

SEQ ID NO: 4079162 - RNA, 20 nt, Variola virus
cugaauaaucguuauuauca

SEQ ID NO: 4079163 - RNA, 17 nt, Variola virus
cugaauagcaaaauuuu

SEQ ID NO: 4079164 - RNA, 17 nt, Variola virus
cugaauauagaacauca

SEQ ID NO: 4079165 - RNA, 16 nt, Variola virus
cugaauuuauuucaga

SEQ ID NO: 4079166 - RNA, 18 nt, Variola virus
cugacgauauuagaugau

SEQ ID NO: 4079167 - RNA, 23 nt, Variola virus
cugagauuuguuuuguuaaacaa

SEQ ID NO: 4079168 - RNA, 22 nt, Variola virus
cugaggauuuacuaaguaauua

SEQ ID NO: 4079169 - RNA, 20 nt, Variola virus
cugauaaguucuuuauacag

SEQ ID NO: 4079170 - RNA, 17 nt, Variola virus
cugauacaauuagauau

SEQ ID NO: 4079171 - RNA, 15 nt, Variola virus
cugauacgucauuaa

SEQ ID NO: 4079172 - RNA, 18 nt, Variola virus
cugauacguuauaaaggu

SEQ ID NO: 4079173 - RNA, 18 nt, Variola virus
cugauagcaauucaugua

SEQ ID NO: 4079174 - RNA, 13 nt, Variola virus
cugauauucagaa

SEQ ID NO: 4079175 - RNA, 20 nt, Variola virus
cugauuaauaagaucuucua

SEQ ID NO: 4079176 - RNA, 14 nt, Variola virus
cugauugugucuca

SEQ ID NO: 4079177 - RNA, 15 nt, Variola virus
cugauuuauuuccua

SEQ ID NO: 4079178 - RNA, 18 nt, Variola virus
cugauuuugcauguagug

SEQ ID NO: 4079179 - RNA, 21 nt, Variola virus
cugcggauauaaagucaucgu

SEQ ID NO: 4079180 - RNA, 14 nt, Variola virus
cugcuauaauuaag

SEQ ID NO: 4079181 - RNA, 16 nt, Variola virus
cugcuauauggauauu

SEQ ID NO: 4079182 - RNA, 19 nt, Variola virus
cugcuuuagaugauuuugg

SEQ ID NO: 4079183 - RNA, 13 nt, Variola virus
cugcuuucuuuua

SEQ ID NO: 4079184 - RNA, 14 nt, Variola virus
cuggaaaaaguugu

SEQ ID NO: 4079185 - RNA, 13 nt, Variola virus
cuggaauuucagu

SEQ ID NO: 4079186 - RNA, 17 nt, Variola virus
cuggagaagacacacuu

SEQ ID NO: 4079187 - RNA, 14 nt, Variola virus
cuggauauuacaaa

SEQ ID NO: 4079188 - RNA, 20 nt, Variola virus
cuggcgaauauuaaaacuau

SEQ ID NO: 4079189 - RNA, 19 nt, Variola virus
cuggcuauuucaaaauaaa

SEQ ID NO: 4079190 - RNA, 17 nt, Variola virus
cugggguaaaguaagua

SEQ ID NO: 4079191 - RNA, 20 nt, Variola virus
cuggugauuggguagaagua

SEQ ID NO: 4079192 - RNA, 20 nt, Variola virus
cugguguuaguuuauuccaa

SEQ ID NO: 4079193 - RNA, 15 nt, Variola virus
cuguaaaaaacauca

SEQ ID NO: 4079194 - RNA, 12 nt, Variola virus
cuguaaacauuu

SEQ ID NO: 4079195 - RNA, 21 nt, Variola virus
cuguaaauagaauaguauaau

SEQ ID NO: 4079196 - RNA, 18 nt, Variola virus
cuguaacuaugaauucua

SEQ ID NO: 4079197 - RNA, 16 nt, Variola virus
cuguaauuacauacuu

SEQ ID NO: 4079198 - RNA, 21 nt, Variola virus
cuguacaaauguuaaacauua

SEQ ID NO: 4079199 - RNA, 22 nt, Variola virus
cuguacaauaguuuuuaucuau

SEQ ID NO: 4079200 - RNA, 18 nt, Variola virus
cuguagaagcuaacauac

SEQ ID NO: 4079201 - RNA, 19 nt, Variola virus
cuguagaauucgaaggaag

SEQ ID NO: 4079202 - RNA, 21 nt, Variola virus
cuguagauaaacuaggauuua

SEQ ID NO: 4079203 - RNA, 19 nt, Variola virus
cuguauaucucauuaagcu

SEQ ID NO: 4079204 - RNA, 16 nt, Variola virus
cuguauuaaagauauu

SEQ ID NO: 4079205 - RNA, 20 nt, Variola virus
cuguauuguuaauagauaua

SEQ ID NO: 4079206 - RNA, 12 nt, Variola virus
cugucaacaaug

SEQ ID NO: 4079207 - RNA, 14 nt, Variola virus
cugucaauaagaca

SEQ ID NO: 4079208 - RNA, 24 nt, Variola virus
cugucuaucaagauccaugauucu

SEQ ID NO: 4079209 - RNA, 15 nt, Variola virus
cugugcaucaacagu

SEQ ID NO: 4079210 - RNA, 11 nt, Variola virus
cuguguucaag

SEQ ID NO: 4079211 - RNA, 12 nt, Variola virus
cuuaaaauguaa

SEQ ID NO: 4079212 - RNA, 17 nt, Variola virus
cuuaacaaguucucaau

SEQ ID NO: 4079213 - RNA, 19 nt, Variola virus
cuuaacaugagacauaaau

SEQ ID NO: 4079214 - RNA, 22 nt, Variola virus
cuuaacgaacgcggugugaaug

SEQ ID NO: 4079215 - RNA, 17 nt, Variola virus
cuuaacuuuuucuuucu

SEQ ID NO: 4079216 - RNA, 18 nt, Variola virus
cuuaauauugccauaauu

SEQ ID NO: 4079217 - RNA, 12 nt, Variola virus
cuuaaucaugug

SEQ ID NO: 4079218 - RNA, 13 nt, Variola virus
cuuaaugcauuuu

SEQ ID NO: 4079219 - RNA, 13 nt, Variola virus
cuuaccccuugau

SEQ ID NO: 4079220 - RNA, 13 nt, Variola virus
gcgacuaaaucag

SEQ ID NO: 4079221 - RNA, 15 nt, Variola virus
gcgauucagaacaca

SEQ ID NO: 4079222 - RNA, 13 nt, Variola virus
gcgauugauuuug

SEQ ID NO: 4079223 - RNA, 16 nt, Variola virus
gcgcuagucaucucau

SEQ ID NO: 4079224 - RNA, 22 nt, Variola virus
gcguaaaagucaaauuagauuu

SEQ ID NO: 4079225 - RNA, 21 nt, Variola virus
gcguauggcaaacgaaggaaa

SEQ ID NO: 4079226 - RNA, 15 nt, Variola virus
gcguucauuggaaaa

SEQ ID NO: 4079227 - RNA, 23 nt, Variola virus
gcguuccuugugcuuaauguuuc

SEQ ID NO: 4079228 - RNA, 16 nt, Variola virus
gcuaauaaauaaugau

SEQ ID NO: 4079229 - RNA, 14 nt, Variola virus
gcuaauauauugau

SEQ ID NO: 4079230 - RNA, 17 nt, Variola virus
gcuaauuauuucaucca

SEQ ID NO: 4079231 - RNA, 18 nt, Variola virus
gcuaauuuuuguaaauaa

SEQ ID NO: 4079232 - RNA, 21 nt, Variola virus
gcuacucguuuggaaucacaa

SEQ ID NO: 4079233 - RNA, 24 nt, Variola virus
gcuagagauaaucagauuagcuuu

SEQ ID NO: 4079234 - RNA, 14 nt, Variola virus
gcuauaaaugaauu

SEQ ID NO: 4079235 - RNA, 17 nt, Variola virus
gcuauaacuugcuucaa

SEQ ID NO: 4079236 - RNA, 14 nt, Variola virus
gcuauaaugaugau

SEQ ID NO: 4079237 - RNA, 23 nt, Variola virus
gcuauagcauuguuauguauuuc

SEQ ID NO: 4079238 - RNA, 13 nt, Variola virus
gcuauauccacca

SEQ ID NO: 4079239 - RNA, 21 nt, Variola virus
gcuaucguagaugugauuuuu

SEQ ID NO: 4079240 - RNA, 14 nt, Variola virus
gcuaugagggaaaa

SEQ ID NO: 4079241 - RNA, 13 nt, Variola virus
gcuauuacuuauu

SEQ ID NO: 4079242 - RNA, 18 nt, Variola virus
gcucaaagucgaauuaga

SEQ ID NO: 4079243 - RNA, 19 nt, Variola virus
gcucccgccgauccuguau

SEQ ID NO: 4079244 - RNA, 18 nt, Variola virus
gcucgaaucauacaaaaa

SEQ ID NO: 4079245 - RNA, 12 nt, Variola virus
gcucuagauauu

SEQ ID NO: 4079246 - RNA, 22 nt, Variola virus
gcucuagauauuaguauuuuua

SEQ ID NO: 4079247 - RNA, 17 nt, Variola virus
gcucuuucgaugauaau

SEQ ID NO: 4079248 - RNA, 17 nt, Variola virus
gcuggaaaauaaaucac

SEQ ID NO: 4079249 - RNA, 23 nt, Variola virus
gcuuaaaggaagaauaucauauu

SEQ ID NO: 4079250 - RNA, 21 nt, Variola virus
gcuucaauuacaauagauauc

SEQ ID NO: 4079251 - RNA, 20 nt, Variola virus
gcuucagaauauucuuuucu

SEQ ID NO: 4079252 - RNA, 22 nt, Variola virus
gcuuccaggcuaucaaauggau

SEQ ID NO: 4079253 - RNA, 16 nt, Variola virus
gcuugugauuuuuucu

SEQ ID NO: 4079254 - RNA, 22 nt, Variola virus
gcuuuugcgaucaauaaaugga

SEQ ID NO: 4079255 - RNA, 19 nt, Variola virus
ggaaaaaguguugaagaua

SEQ ID NO: 4079256 - RNA, 19 nt, Variola virus
ggaaaaucugaagaagaua

SEQ ID NO: 4079257 - RNA, 17 nt, Variola virus
ggaaaguucaaaaaguc

SEQ ID NO: 4079258 - RNA, 20 nt, Variola virus
ggaacuauuccguauuuauc

SEQ ID NO: 4079259 - RNA, 11 nt, Variola virus
ggaauauacaa

SEQ ID NO: 4079260 - RNA, 17 nt, Variola virus
ggacacgacauagagag

SEQ ID NO: 4079261 - RNA, 14 nt, Variola virus
ggagaauguuuccc

SEQ ID NO: 4079262 - RNA, 13 nt, Variola virus
ggaggaauugaua

SEQ ID NO: 4079263 - RNA, 16 nt, Variola virus
ggaguaucuauuuuaa

SEQ ID NO: 4079264 - RNA, 14 nt, Variola virus
ggaguuauaugaau

SEQ ID NO: 4079265 - RNA, 16 nt, Variola virus
ggauaaccuagaaaau

SEQ ID NO: 4079266 - RNA, 14 nt, Variola virus
ggauauguuuuuaa

SEQ ID NO: 4079267 - RNA, 18 nt, Variola virus
ggaugaaucauuggcaac

SEQ ID NO: 4079268 - RNA, 20 nt, Variola virus
ggauguuguucgauugauuu

SEQ ID NO: 4079269 - RNA, 10 nt, Variola virus
ggauuucaua

SEQ ID NO: 4079270 - RNA, 15 nt, Variola virus
ggauuucauauaaga

SEQ ID NO: 4079271 - RNA, 21 nt, Variola virus
ggcaauaauugcgaauguuuu

SEQ ID NO: 4079272 - RNA, 18 nt, Variola virus
ggcuagucaagaugauga

SEQ ID NO: 4079273 - RNA, 19 nt, Variola virus
gggaaaaagcucaauauug

SEQ ID NO: 4079274 - RNA, 17 nt, Variola virus
gggcaugcggaagacaa

SEQ ID NO: 4079275 - RNA, 13 nt, Variola virus
gguaagaaaguaa

SEQ ID NO: 4079276 - RNA, 14 nt, Variola virus
gguaaguucauuau

SEQ ID NO: 4079277 - RNA, 11 nt, Variola virus
gguaauaacua

SEQ ID NO: 4079278 - RNA, 19 nt, Variola virus
gguaauagauuuuucauau

SEQ ID NO: 4079279 - RNA, 17 nt, Variola virus
gguauacuaguagguaa

SEQ ID NO: 4079280 - RNA, 20 nt, Variola virus
gguauugucugagaaguuua

SEQ ID NO: 4079281 - RNA, 13 nt, Variola virus
gguauuucaucau

SEQ ID NO: 4079282 - RNA, 20 nt, Variola virus
ggucaucugguuuaggaaag

SEQ ID NO: 4079283 - RNA, 15 nt, Variola virus
ggugaauccaucucu

SEQ ID NO: 4079284 - RNA, 16 nt, Variola virus
gguggccaaauuuauu

SEQ ID NO: 4079285 - RNA, 17 nt, Variola virus
gguguaggaguacauac

SEQ ID NO: 4079286 - RNA, 16 nt, Variola virus
gguuaacaucuuauaa

SEQ ID NO: 4079287 - RNA, 19 nt, Variola virus
gguuaacucuuucuuuuga

SEQ ID NO: 4079288 - RNA, 20 nt, Variola virus
gguuaauguuguauuucauu

SEQ ID NO: 4079289 - RNA, 14 nt, Variola virus
gguucauuggaauc

SEQ ID NO: 4079290 - RNA, 18 nt, Variola virus
gguucccaauuccaaaga

SEQ ID NO: 4079291 - RNA, 23 nt, Variola virus
guaaaaagacgaagcuaauuaga

SEQ ID NO: 4079292 - RNA, 15 nt, Variola virus
guaaaaauaaaucac

SEQ ID NO: 4079293 - RNA, 23 nt, Variola virus
guaaaaguacagaauuaauuaga

SEQ ID NO: 4079294 - RNA, 14 nt, Variola virus
guaaaauauucuuu

SEQ ID NO: 4079295 - RNA, 19 nt, Variola virus
guaaaauuccuaaauuagu

SEQ ID NO: 4079296 - RNA, 21 nt, Variola virus
guaaacaauacuucugaagaa

SEQ ID NO: 4079297 - RNA, 13 nt, Variola virus
guaaagauaucua

SEQ ID NO: 4079298 - RNA, 14 nt, Variola virus
guaaauaacaauga

SEQ ID NO: 4079299 - RNA, 13 nt, Variola virus
guaaauaauacau

SEQ ID NO: 4079300 - RNA, 22 nt, Variola virus
guaaauagaauaguauaauguc

SEQ ID NO: 4079301 - RNA, 17 nt, Variola virus
guaaauugguacauaga

SEQ ID NO: 4079302 - RNA, 20 nt, Variola virus
guaacaacuaacgauaaaaa

SEQ ID NO: 4079303 - RNA, 19 nt, Variola virus
guaacauccucgugauuua

SEQ ID NO: 4079304 - RNA, 15 nt, Variola virus
guaacgcguggaaaa

SEQ ID NO: 4079305 - RNA, 22 nt, Variola virus
guaacguauacauuuaaugaau

SEQ ID NO: 4079306 - RNA, 17 nt, Variola virus
guaacucugauaaucuc

SEQ ID NO: 4079307 - RNA, 20 nt, Variola virus
guaauaucaugucuaaugau

SEQ ID NO: 4079308 - RNA, 22 nt, Variola virus
guaauauccucuauuauacauu

SEQ ID NO: 4079309 - RNA, 16 nt, Variola virus
guaauaucuuaaauaa

SEQ ID NO: 4079310 - RNA, 17 nt, Variola virus
guaaucaugaaauuaag

SEQ ID NO: 4079311 - RNA, 17 nt, Variola virus
guaaucauguaaauguu

SEQ ID NO: 4079312 - RNA, 20 nt, Variola virus
guaauguucucgaugaugau

SEQ ID NO: 4079313 - RNA, 15 nt, Variola virus
guaauuaauagauug

SEQ ID NO: 4079314 - RNA, 17 nt, Variola virus
guaauuggaaaauuagu

SEQ ID NO: 4079315 - RNA, 17 nt, Variola virus
guaauuuaacuauuuua

SEQ ID NO: 4079316 - RNA, 20 nt, Variola virus
guaauuucacgaauuugaua

SEQ ID NO: 4079317 - RNA, 22 nt, Variola virus
guacaaauucuuggauauauga

SEQ ID NO: 4079318 - RNA, 22 nt, Variola virus
guacaacaucuaacuauaugau

SEQ ID NO: 4079319 - RNA, 15 nt, Variola virus
guacaauaccuuugu

SEQ ID NO: 4079320 - RNA, 22 nt, Variola virus
guacacaacauguuauaacuaa

SEQ ID NO: 4079321 - RNA, 20 nt, Variola virus
guacacaauaucauaaacaa

SEQ ID NO: 4079322 - RNA, 12 nt, Variola virus
guacauauuaau

SEQ ID NO: 4079323 - RNA, 16 nt, Variola virus
guaccauuugauuuuc

SEQ ID NO: 4079324 - RNA, 14 nt, Variola virus
guacccaaguuauu

SEQ ID NO: 4079325 - RNA, 23 nt, Variola virus
guacccuggauacgaaauaaauu

SEQ ID NO: 4079326 - RNA, 15 nt, Variola virus
guacccuuaaucaug

SEQ ID NO: 4079327 - RNA, 21 nt, Variola virus
guaccgauucuagauacaaga

SEQ ID NO: 4079328 - RNA, 20 nt, Variola virus
guacgggcgcuguaauuaau

SEQ ID NO: 4079329 - RNA, 16 nt, Variola virus
guacuaucuagagauu

SEQ ID NO: 4079330 - RNA, 19 nt, Variola virus
guacuauugucuaaacaac

SEQ ID NO: 4079331 - RNA, 13 nt, Variola virus
guacuuaaugaag

SEQ ID NO: 4079332 - RNA, 21 nt, Variola virus
guacuucucccauaauacuuu

SEQ ID NO: 4079333 - RNA, 21 nt, Variola virus
guagacgagccuagaaaucaa

SEQ ID NO: 4079334 - RNA, 19 nt, Variola virus
guagacuuacuaaagucaa

SEQ ID NO: 4079335 - RNA, 17 nt, Variola virus
guagauaguuaccaucu

SEQ ID NO: 4079336 - RNA, 16 nt, Variola virus
guagauauauaaauaa

SEQ ID NO: 4079337 - RNA, 21 nt, Variola virus
guagauuuuucaauuaugcau

SEQ ID NO: 4079338 - RNA, 20 nt, Variola virus
guagcaagauuuuuaaacaa

SEQ ID NO: 4079339 - RNA, 18 nt, Variola virus
guagcuaaguauacgauc

SEQ ID NO: 4079340 - RNA, 15 nt, Variola virus
guaggauuuuuccaa

SEQ ID NO: 4079341 - RNA, 21 nt, Variola virus
guauaaaacaacaaaauuaua

SEQ ID NO: 4079342 - RNA, 11 nt, Variola virus
guauaaacucc

SEQ ID NO: 4079343 - RNA, 18 nt, Variola virus
guauaaauacccuuccaa

SEQ ID NO: 4079344 - RNA, 23 nt, Variola virus
guauaacaugacauuuauucauc

SEQ ID NO: 4079345 - RNA, 23 nt, Variola virus
ugacaagauccaucuacuuuucc

SEQ ID NO: 4079346 - RNA, 23 nt, Variola virus
ugacaucauacuagauaaaucgu

SEQ ID NO: 4079347 - RNA, 18 nt, Variola virus
ugacaucuaucuuugcau

SEQ ID NO: 4079348 - RNA, 15 nt, Variola virus
ugacccuauaaacau

SEQ ID NO: 4079349 - RNA, 21 nt, Variola virus
ugacgaagugacgucauuaaa

SEQ ID NO: 4079350 - RNA, 13 nt, Variola virus
ugacgacaaacag

SEQ ID NO: 4079351 - RNA, 19 nt, Variola virus
ugacggauaaaacaaaaau

SEQ ID NO: 4079352 - RNA, 13 nt, Variola virus
ugacguaaaugug

SEQ ID NO: 4079353 - RNA, 14 nt, Variola virus
ugacgucuguggau

SEQ ID NO: 4079354 - RNA, 16 nt, Variola virus
ugacuccauagagaua

SEQ ID NO: 4079355 - RNA, 23 nt, Variola virus
ugacuguagauauuauauagaua

SEQ ID NO: 4079356 - RNA, 20 nt, Variola virus
ugacuuuaucagaucaaaau

SEQ ID NO: 4079357 - RNA, 23 nt, Variola virus
ugagaaaagguucuaucaacaau

SEQ ID NO: 4079358 - RNA, 13 nt, Variola virus
ugagaaauuauuc

SEQ ID NO: 4079359 - RNA, 19 nt, Variola virus
ugagaauccgcugcauauu

SEQ ID NO: 4079360 - RNA, 13 nt, Variola virus
ugagaaugugauu

SEQ ID NO: 4079361 - RNA, 23 nt, Variola virus
ugagaguauugguaauguacaaa

SEQ ID NO: 4079362 - RNA, 13 nt, Variola virus
ugagauucuccau

SEQ ID NO: 4079363 - RNA, 14 nt, Variola virus
ugagcacugaaaac

SEQ ID NO: 4079364 - RNA, 15 nt, Variola virus
ugaggugguugcaga

SEQ ID NO: 4079365 - RNA, 14 nt, Variola virus
ugagugauaaacuu

SEQ ID NO: 4079366 - RNA, 19 nt, Variola virus
ugaguucugugcagaucau

SEQ ID NO: 4079367 - RNA, 14 nt, Variola virus
ugauaaauuguaca

SEQ ID NO: 4079368 - RNA, 16 nt, Variola virus
ugauaacacauauuca

SEQ ID NO: 4079369 - RNA, 16 nt, Variola virus
ugauaaggauuccucc

SEQ ID NO: 4079370 - RNA, 12 nt, Variola virus
ugauaauaacuu

SEQ ID NO: 4079371 - RNA, 14 nt, Variola virus
ugauacauuuugaa

SEQ ID NO: 4079372 - RNA, 19 nt, Variola virus
ugauacucuuauagaugua

SEQ ID NO: 4079373 - RNA, 17 nt, Variola virus
ugauagccguagaucuu

SEQ ID NO: 4079374 - RNA, 14 nt, Variola virus
ugauagcuccacca

SEQ ID NO: 4079375 - RNA, 19 nt, Variola virus
ugauaguauggcauucauu

SEQ ID NO: 4079376 - RNA, 17 nt, Variola virus
ugauaucgagaacagau

SEQ ID NO: 4079377 - RNA, 20 nt, Variola virus
ugauaucgcauagaaauaca

SEQ ID NO: 4079378 - RNA, 21 nt, Variola virus
ugauaugaugucguuaaauuu

SEQ ID NO: 4079379 - RNA, 22 nt, Variola virus
ugauaugauuuuuaaucaagau

SEQ ID NO: 4079380 - RNA, 18 nt, Variola virus
ugauauuuauuuugcuau

SEQ ID NO: 4079381 - RNA, 13 nt, Variola virus
ugauauuuucuau

SEQ ID NO: 4079382 - RNA, 20 nt, Variola virus
ugauauuuucuauaauauca

SEQ ID NO: 4079383 - RNA, 16 nt, Variola virus
ugaucaaaaagagauu

SEQ ID NO: 4079384 - RNA, 19 nt, Variola virus
ugauccaaauucuggaaua

SEQ ID NO: 4079385 - RNA, 20 nt, Variola virus
ugauccaucugcucaacaau

SEQ ID NO: 4079386 - RNA, 16 nt, Variola virus
ugaucucguguguaca

SEQ ID NO: 4079387 - RNA, 17 nt, Variola virus
ugaugaacuaauaaagg

SEQ ID NO: 4079388 - RNA, 18 nt, Variola virus
ugaugaauaauuuagaua

SEQ ID NO: 4079389 - RNA, 18 nt, Variola virus
ugauggauuuaaacaucg

SEQ ID NO: 4079390 - RNA, 16 nt, Variola virus
ugauguaaaauuuuug

SEQ ID NO: 4079391 - RNA, 16 nt, Variola virus
ugauguaaucucuaaa

SEQ ID NO: 4079392 - RNA, 21 nt, Variola virus
ugauguaaucucuaaauucau

SEQ ID NO: 4079393 - RNA, 18 nt, Variola virus
ugauguacaccaucaaau

SEQ ID NO: 4079394 - RNA, 20 nt, Variola virus
ugauuaaugugugacacauu

SEQ ID NO: 4079395 - RNA, 15 nt, Variola virus
ugauuagaauucauc

SEQ ID NO: 4079396 - RNA, 17 nt, Variola virus
ugauuaguauuuucuau

SEQ ID NO: 4079397 - RNA, 17 nt, Variola virus
ugauuauucuagccauu

SEQ ID NO: 4079398 - RNA, 16 nt, Variola virus
ugauuauucuccacca

SEQ ID NO: 4079399 - RNA, 17 nt, Variola virus
ugauuauuuuuugguau

SEQ ID NO: 4079400 - RNA, 23 nt, Variola virus
ugauucgaauuuaguuucuucga

SEQ ID NO: 4079401 - RNA, 18 nt, Variola virus
ugauuuauaauguggaua

SEQ ID NO: 4079402 - RNA, 17 nt, Variola virus
ugcaaagucuaaauauu

SEQ ID NO: 4079403 - RNA, 14 nt, Variola virus
ugcaaugaauaucu

SEQ ID NO: 4079404 - RNA, 14 nt, Variola virus
ugcaugacgugaua

SEQ ID NO: 4079405 - RNA, 22 nt, Variola virus
ugcauucuccguuaguguuuga

SEQ ID NO: 4079406 - RNA, 19 nt, Variola virus
ugccaaaguuuaaacugaa

SEQ ID NO: 4079407 - RNA, 18 nt, Variola virus
ugccacugaucaugauug

SEQ ID NO: 4079408 - RNA, 22 nt, Variola virus
ugccauaauucucauauauuga

SEQ ID NO: 4079409 - RNA, 14 nt, Variola virus
ugccauuaagaaac

SEQ ID NO: 4079410 - RNA, 16 nt, Variola virus
ugccgaauagaguucu

SEQ ID NO: 4079411 - RNA, 22 nt, Variola virus
ugccguuuauaggucuagccac

SEQ ID NO: 4079412 - RNA, 14 nt, Variola virus
ugccugccuguauu

SEQ ID NO: 4079413 - RNA, 17 nt, Variola virus
ugccuguaauaauuucu

SEQ ID NO: 4079414 - RNA, 16 nt, Variola virus
ugcgguacuacagaua

SEQ ID NO: 4079415 - RNA, 20 nt, Variola virus
ugcguacuucagguuucuua

SEQ ID NO: 4079416 - RNA, 21 nt, Variola virus
ugcuaauauacaauuauccuu

SEQ ID NO: 4079417 - RNA, 14 nt, Variola virus
ugcuauuaagguua

SEQ ID NO: 4079418 - RNA, 19 nt, Variola virus
ugcuauuaagguuaaggau

SEQ ID NO: 4079419 - RNA, 23 nt, Variola virus
ugcuguacuaaauucaauaucuu

SEQ ID NO: 4079420 - RNA, 13 nt, Variola virus
ugcuuccauaaua

SEQ ID NO: 4079421 - RNA, 23 nt, Variola virus
ugcuuuccuuguugaugaaggau

SEQ ID NO: 4079422 - RNA, 19 nt, Variola virus
uggaaacaauucauaauua

SEQ ID NO: 4079423 - RNA, 21 nt, Variola virus
uggaagacgcuauaucaaaau

SEQ ID NO: 4079424 - RNA, 15 nt, Variola virus
uggaauaaauuauua

SEQ ID NO: 4079425 - RNA, 18 nt, Variola virus
uggaauagcgaauguaug

SEQ ID NO: 4079426 - RNA, 16 nt, Variola virus
uggaauaguaaaaucu

SEQ ID NO: 4079427 - RNA, 12 nt, Variola virus
uggaauauacau

SEQ ID NO: 4079428 - RNA, 24 nt, Variola virus
uggacaacauuaauacaaacgaua

SEQ ID NO: 4079429 - RNA, 14 nt, Variola virus
uggacauaaagaua

SEQ ID NO: 4079430 - RNA, 14 nt, Variola virus
uggagaucuagaaa

SEQ ID NO: 4079431 - RNA, 18 nt, Variola virus
uggauaagcguaugaaau

SEQ ID NO: 4079432 - RNA, 20 nt, Variola virus
uggauacggcacuagguaca

SEQ ID NO: 4079433 - RNA, 22 nt, Variola virus
uggauauaauauauuagauauu

SEQ ID NO: 4079434 - RNA, 13 nt, Variola virus
uggauauaugaua

SEQ ID NO: 4079435 - RNA, 17 nt, Variola virus
uggaucaucgugugaua

SEQ ID NO: 4079436 - RNA, 15 nt, Variola virus
uggauccaaaugcug

SEQ ID NO: 4079437 - RNA, 16 nt, Variola virus
uggauccuaacaauga

SEQ ID NO: 4079438 - RNA, 13 nt, Variola virus
uggaugaccauau

SEQ ID NO: 4079439 - RNA, 13 nt, Variola virus
uggauguagauuu

SEQ ID NO: 4079440 - RNA, 20 nt, Variola virus
uggauuaagcaauagugaua

SEQ ID NO: 4079441 - RNA, 16 nt, Variola virus
uggauuaccauggaua

SEQ ID NO: 4079442 - RNA, 21 nt, Variola virus
uggauuauaaauaucgauguu

SEQ ID NO: 4079443 - RNA, 20 nt, Variola virus
uggauuugguaacuuugaua

SEQ ID NO: 4079444 - RNA, 22 nt, Variola virus
uggcaacgacuauuuuagaaau

SEQ ID NO: 4079445 - RNA, 15 nt, Variola virus
uggccaagaaaauag

SEQ ID NO: 4079446 - RNA, 22 nt, Variola virus
uggcggaguaaguguugagcuc

SEQ ID NO: 4079447 - RNA, 21 nt, Variola virus
uggcguguggauuugguaaga

SEQ ID NO: 4079448 - RNA, 14 nt, Variola virus
uggcuucuuccaua

SEQ ID NO: 4079449 - RNA, 18 nt, Variola virus
ugggacuauauaauuuug

SEQ ID NO: 4079450 - RNA, 16 nt, Variola virus
ugggcucaaugucuua

SEQ ID NO: 4079451 - RNA, 17 nt, Variola virus
ugguaauaaaauuauuc

SEQ ID NO: 4079452 - RNA, 17 nt, Variola virus
ugguacgaaauauauug

SEQ ID NO: 4079453 - RNA, 16 nt, Variola virus
ugguaucaagaaguau

SEQ ID NO: 4079454 - RNA, 14 nt, Variola virus
uggucauagaaaau

SEQ ID NO: 4079455 - RNA, 14 nt, Variola virus
ugguguuacaaaac

SEQ ID NO: 4079456 - RNA, 19 nt, Variola virus
ugguuguagcgguuggaua

SEQ ID NO: 4079457 - RNA, 17 nt, Variola virus
ugguuuagauauuccua

SEQ ID NO: 4079458 - RNA, 16 nt, Variola virus
ugguuuaguucaucua

SEQ ID NO: 4079459 - RNA, 15 nt, Variola virus
ugguuuauaccuaac

SEQ ID NO: 4079460 - RNA, 16 nt, Variola virus
ugguuuccuuaucauu

SEQ ID NO: 4079461 - RNA, 18 nt, Variola virus
uguaaaaagauaaacuuu

SEQ ID NO: 4079462 - RNA, 13 nt, Variola virus
uguaaauaucuuu

SEQ ID NO: 4079463 - RNA, 21 nt, Variola virus
uguaaauguaacguauuuaga

SEQ ID NO: 4079464 - RNA, 15 nt, Variola virus
uguaaauguaguauu

SEQ ID NO: 4079465 - RNA, 19 nt, Variola virus
uguaaauuaggagaaacaa

SEQ ID NO: 4079466 - RNA, 14 nt, Variola virus
uguaacaaaguuuc

SEQ ID NO: 4079467 - RNA, 19 nt, Variola virus
uguaacccacguaacauua

SEQ ID NO: 4079468 - RNA, 20 nt, Variola virus
uguaacuauucaguaguguu

SEQ ID NO: 4079469 - RNA, 20 nt, Variola virus
uguaacuucacuagguagua

SEQ ID NO: 4079470 - RNA, 13 nt, Variola virus
uguaagauacuug

SEQ ID NO: 4079471 - RNA, 21 nt, Variola virus
acaauauuacaauacauagau

SEQ ID NO: 4079472 - RNA, 23 nt, Variola virus
acaauauuuaguuuauucauaau

SEQ ID NO: 4079473 - RNA, 18 nt, Variola virus
acaaugcucaguaaaugu

SEQ ID NO: 4079474 - RNA, 18 nt, Variola virus
acaauguuucuuacauau

SEQ ID NO: 4079475 - RNA, 14 nt, Variola virus
acaauuaucaaauu

SEQ ID NO: 4079476 - RNA, 19 nt, Variola virus
acaauuauccuuuugauua

SEQ ID NO: 4079477 - RNA, 19 nt, Variola virus
acaauuauuauauaauucu

SEQ ID NO: 4079478 - RNA, 14 nt, Variola virus
acaauucauuucca

SEQ ID NO: 4079479 - RNA, 18 nt, Variola virus
acaauuuauauguucauu

SEQ ID NO: 4079480 - RNA, 17 nt, Variola virus
acaauuuauucagagag

SEQ ID NO: 4079481 - RNA, 18 nt, Variola virus
acaauuugaccaaaucua

SEQ ID NO: 4079482 - RNA, 19 nt, Variola virus
acaauuuucgccuugaauu

SEQ ID NO: 4079483 - RNA, 13 nt, Variola virus
acacaucaaaaua

SEQ ID NO: 4079484 - RNA, 18 nt, Variola virus
acacauccugaacaauaa

SEQ ID NO: 4079485 - RNA, 20 nt, Variola virus
acaccaaccuguauacugua

SEQ ID NO: 4079486 - RNA, 16 nt, Variola virus
acaccgccucuagaua

SEQ ID NO: 4079487 - RNA, 12 nt, Variola virus
acacuaauuaag

SEQ ID NO: 4079488 - RNA, 21 nt, Variola virus
acacucaacggaaaacauuuu

SEQ ID NO: 4079489 - RNA, 18 nt, Variola virus
acacugcgaucugaauaa

SEQ ID NO: 4079490 - RNA, 16 nt, Variola virus
acacuuagagaacuua

SEQ ID NO: 4079491 - RNA, 14 nt, Variola virus
acagaaauauauau

SEQ ID NO: 4079492 - RNA, 22 nt, Variola virus
acagaagauagcaaagagauga

SEQ ID NO: 4079493 - RNA, 15 nt, Variola virus
acagacaucacagac

SEQ ID NO: 4079494 - RNA, 15 nt, Variola virus
acagacuacuuuccu

SEQ ID NO: 4079495 - RNA, 18 nt, Variola virus
acagaguuuucagaagau

SEQ ID NO: 4079496 - RNA, 14 nt, Variola virus
acagauaaauggaa

SEQ ID NO: 4079497 - RNA, 19 nt, Variola virus
acagauauuacaaccagug

SEQ ID NO: 4079498 - RNA, 16 nt, Variola virus
acagaugauauaucca

SEQ ID NO: 4079499 - RNA, 20 nt, Variola virus
acagcacuguggaugugaca

SEQ ID NO: 4079500 - RNA, 15 nt, Variola virus
acagcagaaaaagac

SEQ ID NO: 4079501 - RNA, 24 nt, Variola virus
acagcagaaaaagacgagaucuga

SEQ ID NO: 4079502 - RNA, 19 nt, Variola virus
acagcuaacgaaagcaaag

SEQ ID NO: 4079503 - RNA, 20 nt, Variola virus
acagguagaauuuauaaaca

SEQ ID NO: 4079504 - RNA, 14 nt, Variola virus
acaguacauaguau

SEQ ID NO: 4079505 - RNA, 19 nt, Variola virus
acaguacauaguauugaca

SEQ ID NO: 4079506 - RNA, 22 nt, Variola virus
acagugcaaccucuauuggaua

SEQ ID NO: 4079507 - RNA, 20 nt, Variola virus
acaguguaugaaaaguuaca

SEQ ID NO: 4079508 - RNA, 21 nt, Variola virus
acaguuacgguuguacauuau

SEQ ID NO: 4079509 - RNA, 22 nt, Variola virus
acauaaauaauucuagaggaga

SEQ ID NO: 4079510 - RNA, 15 nt, Variola virus
acauaauacucaaua

SEQ ID NO: 4079511 - RNA, 16 nt, Variola virus
acauaccguuagauaa

SEQ ID NO: 4079512 - RNA, 17 nt, Variola virus
acauacuaguauuuaca

SEQ ID NO: 4079513 - RNA, 16 nt, Variola virus
acauacuaucuuuaau

SEQ ID NO: 4079514 - RNA, 15 nt, Variola virus
acauagauaauaaua

SEQ ID NO: 4079515 - RNA, 21 nt, Variola virus
acauagaugaaccaaaugaua

SEQ ID NO: 4079516 - RNA, 18 nt, Variola virus
acauaggauuaaaaauaa

SEQ ID NO: 4079517 - RNA, 22 nt, Variola virus
acauaguuugggaaaagaaauc

SEQ ID NO: 4079518 - RNA, 15 nt, Variola virus
acauauccuccauaa

SEQ ID NO: 4079519 - RNA, 16 nt, Variola virus
acauaucuaaaugaau

SEQ ID NO: 4079520 - RNA, 23 nt, Variola virus
acauauggaauauaucuauaauu

SEQ ID NO: 4079521 - RNA, 21 nt, Variola virus
acaucaacuaccuaaggaaua

SEQ ID NO: 4079522 - RNA, 19 nt, Variola virus
acauccucacuauucaugg

SEQ ID NO: 4079523 - RNA, 17 nt, Variola virus
acauccuuccaagaaga

SEQ ID NO: 4079524 - RNA, 19 nt, Variola virus
acauccuuccaagaagaag

SEQ ID NO: 4079525 - RNA, 19 nt, Variola virus
acaucgaugccuuaacauc

SEQ ID NO: 4079526 - RNA, 22 nt, Variola virus
acaucguauaucgucuuuguua

SEQ ID NO: 4079527 - RNA, 18 nt, Variola virus
acaucuaccuuauuuccc

SEQ ID NO: 4079528 - RNA, 13 nt, Variola virus
acaucuaguucuu

SEQ ID NO: 4079529 - RNA, 14 nt, Variola virus
acaucucuuuucca

SEQ ID NO: 4079530 - RNA, 13 nt, Variola virus
acaucuguuugag

SEQ ID NO: 4079531 - RNA, 21 nt, Variola virus
acaugauaggaaauuuugugc

SEQ ID NO: 4079532 - RNA, 19 nt, Variola virus
acaugaugauugccuuaag

SEQ ID NO: 4079533 - RNA, 18 nt, Variola virus
acaugcuacaaaauaugu

SEQ ID NO: 4079534 - RNA, 22 nt, Variola virus
acauguaaacuugacaaaaauu

SEQ ID NO: 4079535 - RNA, 20 nt, Variola virus
acaugucgccgacaugaaug

SEQ ID NO: 4079536 - RNA, 14 nt, Variola virus
acaugucuuaaagu

SEQ ID NO: 4079537 - RNA, 17 nt, Variola virus
acauguguuuuaauaua

SEQ ID NO: 4079538 - RNA, 13 nt, Variola virus
acauguuaguaga

SEQ ID NO: 4079539 - RNA, 14 nt, Variola virus
acauguuuaauaua

SEQ ID NO: 4079540 - RNA, 15 nt, Variola virus
aacuuauccauuuau

SEQ ID NO: 4079541 - RNA, 15 nt, Variola virus
aacuucguaaaauau

SEQ ID NO: 4079542 - RNA, 23 nt, Variola virus
aacuucuaaaacagcugugaaua

SEQ ID NO: 4079543 - RNA, 16 nt, Variola virus
aacuucuaaucuugua

SEQ ID NO: 4079544 - RNA, 22 nt, Variola virus
aacuucuagucuagaaauaaua

SEQ ID NO: 4079545 - RNA, 21 nt, Variola virus
aacuucuugcgugucuuucug

SEQ ID NO: 4079546 - RNA, 14 nt, Variola virus
aacuugacaaaaau

SEQ ID NO: 4079547 - RNA, 13 nt, Variola virus
aacuugaucuuua

SEQ ID NO: 4079548 - RNA, 21 nt, Variola virus
aacuuggaaacaucucuucua

SEQ ID NO: 4079549 - RNA, 20 nt, Variola virus
aacuuggggauaaugauaca

SEQ ID NO: 4079550 - RNA, 14 nt, Variola virus
aacuuugaaauugu

SEQ ID NO: 4079551 - RNA, 17 nt, Variola virus
aacuuuguuguuacauu

SEQ ID NO: 4079552 - RNA, 12 nt, Variola virus
aacuuuugcaua

SEQ ID NO: 4079553 - RNA, 14 nt, Variola virus
aagaaauauaugug

SEQ ID NO: 4079554 - RNA, 14 nt, Variola virus
aagaaauuaauaga

SEQ ID NO: 4079555 - RNA, 16 nt, Variola virus
aagaacaguacucaau

SEQ ID NO: 4079556 - RNA, 11 nt, Variola virus
aagaagagaau

SEQ ID NO: 4079557 - RNA, 13 nt, Variola virus
aagaagagaauua

SEQ ID NO: 4079558 - RNA, 20 nt, Variola virus
aagaagugucuauaaaugua

SEQ ID NO: 4079559 - RNA, 21 nt, Variola virus
aagaaugcuucggaauuagaa

SEQ ID NO: 4079560 - RNA, 17 nt, Variola virus
aagaauucggaaaugua

SEQ ID NO: 4079561 - RNA, 16 nt, Variola virus
aagaauugcaauuuug

SEQ ID NO: 4079562 - RNA, 17 nt, Variola virus
aagaauugucuguaaac

SEQ ID NO: 4079563 - RNA, 20 nt, Variola virus
aagaauuuguuguuucuauu

SEQ ID NO: 4079564 - RNA, 21 nt, Variola virus
aagacagagauacuaaauaua

SEQ ID NO: 4079565 - RNA, 18 nt, Variola virus
aagacaucauauauagaa

SEQ ID NO: 4079566 - RNA, 19 nt, Variola virus
aagaccaaacgaugauaca

SEQ ID NO: 4079567 - RNA, 21 nt, Variola virus
aagacguuguacaauaugaac

SEQ ID NO: 4079568 - RNA, 17 nt, Variola virus
aagacuaugucaaagua

SEQ ID NO: 4079569 - RNA, 19 nt, Variola virus
aagacucagaagaggauua

SEQ ID NO: 4079570 - RNA, 18 nt, Variola virus
aagacugcuaaauguauc

SEQ ID NO: 4079571 - RNA, 17 nt, Variola virus
aagagcaaauaucucau

SEQ ID NO: 4079572 - RNA, 15 nt, Variola virus
aagaggguugguaaa

SEQ ID NO: 4079573 - RNA, 20 nt, Variola virus
aagaguuaauaaauaucauu

SEQ ID NO: 4079574 - RNA, 16 nt, Variola virus
aagaguuucaaaaaua

SEQ ID NO: 4079575 - RNA, 20 nt, Variola virus
aagauaccgcaccauaugcu

SEQ ID NO: 4079576 - RNA, 17 nt, Variola virus
aagauacuguuuagaga

SEQ ID NO: 4079577 - RNA, 22 nt, Variola virus
aagauaugguaaaauuaaauag

SEQ ID NO: 4079578 - RNA, 19 nt, Variola virus
aagaucacuaauucuaguc

SEQ ID NO: 4079579 - RNA, 20 nt, Variola virus
aagauggauggaugaugcau

SEQ ID NO: 4079580 - RNA, 21 nt, Variola virus
aagauuaacuccauaaugucu

SEQ ID NO: 4079581 - RNA, 19 nt, Variola virus
aagauuaugauccaaugug

SEQ ID NO: 4079582 - RNA, 13 nt, Variola virus
aagauuguagaau

SEQ ID NO: 4079583 - RNA, 16 nt, Variola virus
aagauuguguagaaau

SEQ ID NO: 4079584 - RNA, 21 nt, Variola virus
aagauuguuuaagaagagaau

SEQ ID NO: 4079585 - RNA, 15 nt, Variola virus
aagauuuuaaaugua

SEQ ID NO: 4079586 - RNA, 20 nt, Variola virus
aagcaagaaagauacaggua

SEQ ID NO: 4079587 - RNA, 18 nt, Variola virus
aagcagacuagaaauaac

SEQ ID NO: 4079588 - RNA, 21 nt, Variola virus
aagccaucuguauuaaagaua

SEQ ID NO: 4079589 - RNA, 19 nt, Variola virus
aagccgucuuuucugaagu

SEQ ID NO: 4079590 - RNA, 23 nt, Variola virus
aagcguguuauauauacaagucu

SEQ ID NO: 4079591 - RNA, 15 nt, Variola virus
aagcuuuuagaauau

SEQ ID NO: 4079592 - RNA, 12 nt, Variola virus
aaggaacuagaa

SEQ ID NO: 4079593 - RNA, 16 nt, Variola virus
aaggaauugaugaagu

SEQ ID NO: 4079594 - RNA, 21 nt, Variola virus
aaggacagaaaaauguuagaa

SEQ ID NO: 4079595 - RNA, 16 nt, Variola virus
aaggagauauugaaac

SEQ ID NO: 4079596 - RNA, 18 nt, Variola virus
aaggauaaccuagaaaau

SEQ ID NO: 4079597 - RNA, 17 nt, Variola virus
aaggauacuaaacauug

SEQ ID NO: 4079598 - RNA, 19 nt, Variola virus
aaggauauucucauggaaa

SEQ ID NO: 4079599 - RNA, 14 nt, Variola virus
aaggcaauaagucu

SEQ ID NO: 4079600 - RNA, 15 nt, Variola virus
aaggcacuaugucca

SEQ ID NO: 4079601 - RNA, 18 nt, Variola virus
aagguguugauuaccauu

SEQ ID NO: 4079602 - RNA, 15 nt, Variola virus
aaguaaaaaagaaaa

SEQ ID NO: 4079603 - RNA, 15 nt, Variola virus
aaguaaacaauuuua

SEQ ID NO: 4079604 - RNA, 16 nt, Variola virus
aaguaaagaaaagaua

SEQ ID NO: 4079605 - RNA, 14 nt, Variola virus
aaguaaucaugaaa

SEQ ID NO: 4079606 - RNA, 16 nt, Variola virus
aaguaauucagacacu

SEQ ID NO: 4079607 - RNA, 18 nt, Variola virus
aaguacagauuuuaaaaa

SEQ ID NO: 4079608 - RNA, 14 nt, Variola virus
aaguagaaaauaua

SEQ ID NO: 4079609 - RNA, 13 nt, Variola virus
aaguaucaaaucu

SEQ ID NO: 4079610 - RNA, 22 nt, Variola virus
aaguaucuaguuagcaauuuuc

SEQ ID NO: 4079611 - RNA, 22 nt, Variola virus
aaguauuucuuacucaaaugaa

SEQ ID NO: 4079612 - RNA, 15 nt, Variola virus
aaguauuuguuguau

SEQ ID NO: 4079613 - RNA, 12 nt, Variola virus
aagucaauaaua

SEQ ID NO: 4079614 - RNA, 17 nt, Variola virus
aagucuuaaaaauacuu

SEQ ID NO: 4079615 - RNA, 17 nt, Variola virus
aagucuuacaauguuug

SEQ ID NO: 4079616 - RNA, 22 nt, Variola virus
aaguuaaugagagcaaaauaua

SEQ ID NO: 4079617 - RNA, 22 nt, Variola virus
aaguuacaaacaacuaggaaau

SEQ ID NO: 4079618 - RNA, 23 nt, Variola virus
aaguuagaagagucauuaaaaua

SEQ ID NO: 4079619 - RNA, 13 nt, Variola virus
aaguuaugacauu

SEQ ID NO: 4079620 - RNA, 17 nt, Variola virus
aaguuauuguacuaucg

SEQ ID NO: 4079621 - RNA, 13 nt, Variola virus
aaguugaucucaa

SEQ ID NO: 4079622 - RNA, 18 nt, Variola virus
aaguugggacugacagau

SEQ ID NO: 4079623 - RNA, 13 nt, Variola virus
aaguuguuaaaaa

SEQ ID NO: 4079624 - RNA, 15 nt, Variola virus
aaguuuaaaaaagac

SEQ ID NO: 4079625 - RNA, 18 nt, Variola virus
aaguuucguacaaauaca

SEQ ID NO: 4079626 - RNA, 14 nt, Variola virus
aaguuucugaaaua

SEQ ID NO: 4079627 - RNA, 17 nt, Variola virus
aaguuuggagaaaugga

SEQ ID NO: 4079628 - RNA, 16 nt, Variola virus
aaguuuggaugucuua

SEQ ID NO: 4079629 - RNA, 19 nt, Variola virus
aaguuuucccauacuaacu

SEQ ID NO: 4079630 - RNA, 22 nt, Variola virus
aaguuuucuuucaaaauagcua

SEQ ID NO: 4079631 - RNA, 12 nt, Variola virus
aauaaaaacaag

SEQ ID NO: 4079632 - RNA, 17 nt, Variola virus
aauaaacaauuucacaa

SEQ ID NO: 4079633 - RNA, 18 nt, Variola virus
aauaaacaucaacauugu

SEQ ID NO: 4079634 - RNA, 20 nt, Variola virus
aauaaaggcagaaauacaau

SEQ ID NO: 4079635 - RNA, 17 nt, Variola virus
aauaaauaguucaacau

SEQ ID NO: 4079636 - RNA, 15 nt, Variola virus
aauaaauguauacau

SEQ ID NO: 4079637 - RNA, 20 nt, Variola virus
aauaaauguuucgauuucaa

SEQ ID NO: 4079638 - RNA, 12 nt, Variola virus
aauaacaaauac

SEQ ID NO: 4079639 - RNA, 16 nt, Variola virus
aauaacaauuaacaau

SEQ ID NO: 4079640 - RNA, 17 nt, Variola virus
aauaacaggcuaaaaug

SEQ ID NO: 4079641 - RNA, 17 nt, Variola virus
aauaacauaggauuaaa

SEQ ID NO: 4079642 - RNA, 20 nt, Variola virus
aauaacuauguuuuaaaaau

SEQ ID NO: 4079643 - RNA, 21 nt, Variola virus
aauaacuucacuauugaucaa

SEQ ID NO: 4079644 - RNA, 17 nt, Variola virus
aauaacuuguuagauaa

SEQ ID NO: 4079645 - RNA, 12 nt, Variola virus
aauaagaaauac

SEQ ID NO: 4079646 - RNA, 20 nt, Variola virus
aauaagaaauaugaaaucua

SEQ ID NO: 4079647 - RNA, 21 nt, Variola virus
aauaagaacaaaguaaugccu

SEQ ID NO: 4079648 - RNA, 23 nt, Variola virus
aauaagaacuauaaaaaaaauaa

SEQ ID NO: 4079649 - RNA, 15 nt, Variola virus
aauaagcuauauaau

SEQ ID NO: 4079650 - RNA, 20 nt, Variola virus
aauaaucauaaauuauuuca

SEQ ID NO: 4079651 - RNA, 14 nt, Variola virus
aauaaucauacaau

SEQ ID NO: 4079652 - RNA, 15 nt, Variola virus
aauaaucguuauuau

SEQ ID NO: 4079653 - RNA, 18 nt, Variola virus
aauaaucguuauuaucau

SEQ ID NO: 4079654 - RNA, 12 nt, Variola virus
aauaauguucaa

SEQ ID NO: 4079655 - RNA, 14 nt, Variola virus
aauaauucuagacg

SEQ ID NO: 4079656 - RNA, 19 nt, Variola virus
aauaauuuauguauuucga

SEQ ID NO: 4079657 - RNA, 23 nt, Variola virus
aauacaaaacagaaaacaaaguc

SEQ ID NO: 4079658 - RNA, 16 nt, Variola virus
aauacaaaaguuaaua

SEQ ID NO: 4079659 - RNA, 13 nt, Variola virus
aauacaauacaua

SEQ ID NO: 4079660 - RNA, 16 nt, Variola virus
aauacauuaauugcca

SEQ ID NO: 4079661 - RNA, 16 nt, Variola virus
aauaccaaugcucaag

SEQ ID NO: 4079662 - RNA, 13 nt, Variola virus
aauaccaauuuuu

SEQ ID NO: 4079663 - RNA, 20 nt, Variola virus
aauacgacgguuuaauacac

SEQ ID NO: 4079664 - RNA, 20 nt, Variola virus
aauacgguaccgcaauuuug

SEQ ID NO: 4079665 - RNA, 19 nt, Variola virus
aauacucccacaaauacug

SEQ ID NO: 4079666 - RNA, 13 nt, Variola virus
agaugaugauaua

SEQ ID NO: 4079667 - RNA, 15 nt, Variola virus
agaugaugcaaauaa

SEQ ID NO: 4079668 - RNA, 21 nt, Variola virus
agaugccaagauaucuauaua

SEQ ID NO: 4079669 - RNA, 21 nt, Variola virus
agaugccauaucauacaugau

SEQ ID NO: 4079670 - RNA, 17 nt, Variola virus
agaugccgguacuuaug

SEQ ID NO: 4079671 - RNA, 13 nt, Variola virus
agaugcuauguau

SEQ ID NO: 4079672 - RNA, 20 nt, Variola virus
agaugguaaaauacaaaaua

SEQ ID NO: 4079673 - RNA, 14 nt, Variola virus
agauggucugaaau

SEQ ID NO: 4079674 - RNA, 12 nt, Variola virus
agaugucauuau

SEQ ID NO: 4079675 - RNA, 16 nt, Variola virus
agauguguauaauucu

SEQ ID NO: 4079676 - RNA, 16 nt, Variola virus
agauguuauuaaaugu

SEQ ID NO: 4079677 - RNA, 17 nt, Variola virus
agauguugcuccuggau

SEQ ID NO: 4079678 - RNA, 13 nt, Variola virus
agauuaaaaaugg

SEQ ID NO: 4079679 - RNA, 14 nt, Variola virus
agauuaaaaauggu

SEQ ID NO: 4079680 - RNA, 17 nt, Variola virus
agauuaggaaauguuuc

SEQ ID NO: 4079681 - RNA, 18 nt, Variola virus
agauuauaucauaaauaa

SEQ ID NO: 4079682 - RNA, 19 nt, Variola virus
agauuaucaaaaucuuguc

SEQ ID NO: 4079683 - RNA, 16 nt, Variola virus
agauuauucuuaaaug

SEQ ID NO: 4079684 - RNA, 19 nt, Variola virus
agauucuacaaguaacaac

SEQ ID NO: 4079685 - RNA, 16 nt, Variola virus
agauucuuauauaccg

SEQ ID NO: 4079686 - RNA, 15 nt, Variola virus
agauugaaauuauau

SEQ ID NO: 4079687 - RNA, 19 nt, Variola virus
agauugaaugccauuuacg

SEQ ID NO: 4079688 - RNA, 17 nt, Variola virus
agauugaucauguagaa

SEQ ID NO: 4079689 - RNA, 22 nt, Variola virus
agauuggguguagaucuagaug

SEQ ID NO: 4079690 - RNA, 20 nt, Variola virus
agauuggguuaauaaauaca

SEQ ID NO: 4079691 - RNA, 19 nt, Variola virus
agauuuacuguuuaucuaa

SEQ ID NO: 4079692 - RNA, 14 nt, Variola virus
agauuuagaaaugu

SEQ ID NO: 4079693 - RNA, 18 nt, Variola virus
agauuuaguuguuuaauu

SEQ ID NO: 4079694 - RNA, 19 nt, Variola virus
agauuucaacagacuguuu

SEQ ID NO: 4079695 - RNA, 19 nt, Variola virus
agauuucagaaucuagauu

SEQ ID NO: 4079696 - RNA, 18 nt, Variola virus
agauuuguaucucuuuuc

SEQ ID NO: 4079697 - RNA, 14 nt, Variola virus
agauuuuacuaacu

SEQ ID NO: 4079698 - RNA, 19 nt, Variola virus
agauuuugacuuacauaaa

SEQ ID NO: 4079699 - RNA, 23 nt, Variola virus
agauuuugacuuacauaaauguc

SEQ ID NO: 4079700 - RNA, 14 nt, Variola virus
agcaaaaaaugaua

SEQ ID NO: 4079701 - RNA, 17 nt, Variola virus
agcaaaacaguuacuau

SEQ ID NO: 4079702 - RNA, 16 nt, Variola virus
agcaaaagaaucauca

SEQ ID NO: 4079703 - RNA, 15 nt, Variola virus
agcaaaggaaauugu

SEQ ID NO: 4079704 - RNA, 18 nt, Variola virus
agcaaucaugaaacaaua

SEQ ID NO: 4079705 - RNA, 21 nt, Variola virus
agcaaucuuuuagaugaugau

SEQ ID NO: 4079706 - RNA, 22 nt, Variola virus
agcaauuagugccguauacuuu

SEQ ID NO: 4079707 - RNA, 13 nt, Variola virus
agcacaaaucaaa

SEQ ID NO: 4079708 - RNA, 13 nt, Variola virus
agcacagaacaca

SEQ ID NO: 4079709 - RNA, 16 nt, Variola virus
agcacuaucauaauua

SEQ ID NO: 4079710 - RNA, 17 nt, Variola virus
agcacuauuucuaaauc

SEQ ID NO: 4079711 - RNA, 17 nt, Variola virus
agcacuguggaugugac

SEQ ID NO: 4079712 - RNA, 19 nt, Variola virus
agcagcugcagcaacuucu

SEQ ID NO: 4079713 - RNA, 14 nt, Variola virus
agcauaaacuauac

SEQ ID NO: 4079714 - RNA, 19 nt, Variola virus
agcauacaaauuacaauaa

SEQ ID NO: 4079715 - RNA, 22 nt, Variola virus
agcauagauccgugagaaauac

SEQ ID NO: 4079716 - RNA, 19 nt, Variola virus
agcauaucacgaacuauau

SEQ ID NO: 4079717 - RNA, 21 nt, Variola virus
agcauauuccuaaauacaucu

SEQ ID NO: 4079718 - RNA, 15 nt, Variola virus
agcaucauaucuugu

SEQ ID NO: 4079719 - RNA, 14 nt, Variola virus
agcaucuaguugau

SEQ ID NO: 4079720 - RNA, 17 nt, Variola virus
agcauuauucuugaauu

SEQ ID NO: 4079721 - RNA, 20 nt, Variola virus
agcauuauugguauucuucu

SEQ ID NO: 4079722 - RNA, 17 nt, Variola virus
agcauugcuuucauuau

SEQ ID NO: 4079723 - RNA, 17 nt, Variola virus
agcauuguuauguauuu

SEQ ID NO: 4079724 - RNA, 18 nt, Variola virus
agccgcuggguuguaaac

SEQ ID NO: 4079725 - RNA, 20 nt, Variola virus
agccuuaagaaaacuagaua

SEQ ID NO: 4079726 - RNA, 18 nt, Variola virus
agcgaaaaauaauuauuc

SEQ ID NO: 4079727 - RNA, 20 nt, Variola virus
agcgagaaauaaucauaaau

SEQ ID NO: 4079728 - RNA, 22 nt, Variola virus
auauagucgaacguuaguucca

SEQ ID NO: 4079729 - RNA, 13 nt, Variola virus
auauaguuauaga

SEQ ID NO: 4079730 - RNA, 21 nt, Variola virus
auauauaagacacagaaauac

SEQ ID NO: 4079731 - RNA, 15 nt, Variola virus
auauaucaugaugau

SEQ ID NO: 4079732 - RNA, 15 nt, Variola virus
auauauuaacucaga

SEQ ID NO: 4079733 - RNA, 16 nt, Variola virus
auauauuaagaaguuc

SEQ ID NO: 4079734 - RNA, 15 nt, Variola virus
auauauuagaaauac

SEQ ID NO: 4079735 - RNA, 14 nt, Variola virus
auauauucaaacaa

SEQ ID NO: 4079736 - RNA, 18 nt, Variola virus
auauauugcuuacuagau

SEQ ID NO: 4079737 - RNA, 13 nt, Variola virus
auauauugucuaa

SEQ ID NO: 4079738 - RNA, 22 nt, Variola virus
auauauuuauagaagauauuac

SEQ ID NO: 4079739 - RNA, 14 nt, Variola virus
auauauuuggauuu

SEQ ID NO: 4079740 - RNA, 17 nt, Variola virus
auauauuuucauuuaaa

SEQ ID NO: 4079741 - RNA, 16 nt, Variola virus
auauauuuuucuagau

SEQ ID NO: 4079742 - RNA, 22 nt, Variola virus
auaucacaucaaguacaaaaua

SEQ ID NO: 4079743 - RNA, 18 nt, Variola virus
auaucagcauugcuuuca

SEQ ID NO: 4079744 - RNA, 17 nt, Variola virus
auaucauaaucuaaaau

SEQ ID NO: 4079745 - RNA, 19 nt, Variola virus
auaucauauauauacugaa

SEQ ID NO: 4079746 - RNA, 17 nt, Variola virus
auaucaucaaaauacug

SEQ ID NO: 4079747 - RNA, 14 nt, Variola virus
auaucaucaaacaa

SEQ ID NO: 4079748 - RNA, 14 nt, Variola virus
auaucauuaaugau

SEQ ID NO: 4079749 - RNA, 18 nt, Variola virus
auaucauugucuaauaga

SEQ ID NO: 4079750 - RNA, 15 nt, Variola virus
auauccauaggaaag

SEQ ID NO: 4079751 - RNA, 19 nt, Variola virus
auaucccacauugucaucu

SEQ ID NO: 4079752 - RNA, 14 nt, Variola virus
auauccuuuuguau

SEQ ID NO: 4079753 - RNA, 13 nt, Variola virus
auaucgaugugga

SEQ ID NO: 4079754 - RNA, 14 nt, Variola virus
auaucguguucauu

SEQ ID NO: 4079755 - RNA, 16 nt, Variola virus
auaucguucucuaaau

SEQ ID NO: 4079756 - RNA, 19 nt, Variola virus
auaucuagacuuucuguua

SEQ ID NO: 4079757 - RNA, 14 nt, Variola virus
auaucuaguauuga

SEQ ID NO: 4079758 - RNA, 16 nt, Variola virus
auaucuauauauguau

SEQ ID NO: 4079759 - RNA, 16 nt, Variola virus
auaucuauaucuacau

SEQ ID NO: 4079760 - RNA, 14 nt, Variola virus
auaucucaaagaug

SEQ ID NO: 4079761 - RNA, 14 nt, Variola virus
auaucucuaauaga

SEQ ID NO: 4079762 - RNA, 15 nt, Variola virus
auaucugauguuguu

SEQ ID NO: 4079763 - RNA, 13 nt, Variola virus
auaucuggauaau

SEQ ID NO: 4079764 - RNA, 21 nt, Variola virus
auaucuuagugcaaaaguaua

SEQ ID NO: 4079765 - RNA, 16 nt, Variola virus
auaucuucuccuguaa

SEQ ID NO: 4079766 - RNA, 17 nt, Variola virus
auaucuucuuuuuucca

SEQ ID NO: 4079767 - RNA, 14 nt, Variola virus
auaucuuguucuau

SEQ ID NO: 4079768 - RNA, 17 nt, Variola virus
auaugaaaaacaugucu

SEQ ID NO: 4079769 - RNA, 21 nt, Variola virus
auaugaaaaacaugucucucu

SEQ ID NO: 4079770 - RNA, 14 nt, Variola virus
auaugacuaaacau

SEQ ID NO: 4079771 - RNA, 22 nt, Variola virus
auaugacuauuuucacauguac

SEQ ID NO: 4079772 - RNA, 17 nt, Variola virus
auaugauaaacaaagau

SEQ ID NO: 4079773 - RNA, 16 nt, Variola virus
auaugaucaaaaagag

SEQ ID NO: 4079774 - RNA, 13 nt, Variola virus
auaugauccaugc

SEQ ID NO: 4079775 - RNA, 14 nt, Variola virus
auaugauuacuaga

SEQ ID NO: 4079776 - RNA, 21 nt, Variola virus
auaugauuucagauacuauau

SEQ ID NO: 4079777 - RNA, 14 nt, Variola virus
auaugcaacuauaa

SEQ ID NO: 4079778 - RNA, 18 nt, Variola virus
auaugccuccagaaguug

SEQ ID NO: 4079779 - RNA, 20 nt, Variola virus
auaugcgccuagagaauugc

SEQ ID NO: 4079780 - RNA, 14 nt, Variola virus
auaugcuacaagau

SEQ ID NO: 4079781 - RNA, 21 nt, Variola virus
auaugcucauauauuuauaga

SEQ ID NO: 4079782 - RNA, 19 nt, Variola virus
auaugcuuuuauuuuugga

SEQ ID NO: 4079783 - RNA, 17 nt, Variola virus
auauggauauucauaga

SEQ ID NO: 4079784 - RNA, 15 nt, Variola virus
auauguauacauaau

SEQ ID NO: 4079785 - RNA, 13 nt, Variola virus
auaugugaauaug

SEQ ID NO: 4079786 - RNA, 19 nt, Variola virus
auaugugcuaaaaaguuuu

SEQ ID NO: 4079787 - RNA, 19 nt, Variola virus
auaugugguguuacaguua

SEQ ID NO: 4079788 - RNA, 14 nt, Variola virus
auauuaaaaauaca

SEQ ID NO: 4079789 - RNA, 15 nt, Variola virus
auauuaaaauagcua

SEQ ID NO: 4079790 - RNA, 18 nt, Variola virus
auauuaaacacuaguaua

SEQ ID NO: 4079791 - RNA, 18 nt, Variola virus
auauuaaaguaaaaucua

SEQ ID NO: 4079792 - RNA, 20 nt, Variola virus
auauuaacgaguuccauuua

SEQ ID NO: 4079793 - RNA, 21 nt, Variola virus
auauuaacgaguuccauuuau

SEQ ID NO: 4079794 - RNA, 20 nt, Variola virus
auauuacaaacuauagaaau

SEQ ID NO: 4079795 - RNA, 23 nt, Variola virus
auauuacgaauuacauuucuugu

SEQ ID NO: 4079796 - RNA, 19 nt, Variola virus
auauuacuaaacacacauu

SEQ ID NO: 4079797 - RNA, 13 nt, Variola virus
auauuagaauuua

SEQ ID NO: 4079798 - RNA, 14 nt, Variola virus
auauuagauuuacu

SEQ ID NO: 4079799 - RNA, 22 nt, Variola virus
auauuaggcacagucaaacauu

SEQ ID NO: 4079800 - RNA, 22 nt, Variola virus
auauuaucaucccauuguaaag

SEQ ID NO: 4079801 - RNA, 16 nt, Variola virus
auauuaucguuuguaa

SEQ ID NO: 4079802 - RNA, 13 nt, Variola virus
auauuauuaauaa

SEQ ID NO: 4079803 - RNA, 23 nt, Variola virus
auauuauugggugguaaacuaga

SEQ ID NO: 4079804 - RNA, 20 nt, Variola virus
auauuauuuuuauguuuuau

SEQ ID NO: 4079805 - RNA, 19 nt, Variola virus
auauucauacaccugcaua

SEQ ID NO: 4079806 - RNA, 14 nt, Variola virus
auauucaucagaua

SEQ ID NO: 4079807 - RNA, 20 nt, Variola virus
auauuccgacaaaggauuga

SEQ ID NO: 4079808 - RNA, 21 nt, Variola virus
auauuccgacaugcaaaaaug

SEQ ID NO: 4079809 - RNA, 16 nt, Variola virus
auauuccucuacacca

SEQ ID NO: 4079810 - RNA, 14 nt, Variola virus
auauucuaugaauu

SEQ ID NO: 4079811 - RNA, 15 nt, Variola virus
auauucucauggaaa

SEQ ID NO: 4079812 - RNA, 18 nt, Variola virus
auauucucuauuuuggug

SEQ ID NO: 4079813 - RNA, 21 nt, Variola virus
auauucuuaaaagguuucaua

SEQ ID NO: 4079814 - RNA, 15 nt, Variola virus
auauugaaaaugaca

SEQ ID NO: 4079815 - RNA, 22 nt, Variola virus
auauugauaauauuuuaauaga

SEQ ID NO: 4079816 - RNA, 19 nt, Variola virus
auauuguacgguagaauug

SEQ ID NO: 4079817 - RNA, 20 nt, Variola virus
auauuguacgguagaauuga

SEQ ID NO: 4079818 - RNA, 16 nt, Variola virus
auauuuaaaauaucua

SEQ ID NO: 4079819 - RNA, 17 nt, Variola virus
auauuuacacacauaau

SEQ ID NO: 4079820 - RNA, 16 nt, Variola virus
auauuuauaagaauga

SEQ ID NO: 4079821 - RNA, 21 nt, Variola virus
auauuucuguaucaaaugcua

SEQ ID NO: 4079822 - RNA, 21 nt, Variola virus
auauuuggaaucagacacaga

SEQ ID NO: 4079823 - RNA, 20 nt, Variola virus
auauuuguuaucaugaugac

SEQ ID NO: 4079824 - RNA, 21 nt, Variola virus
auauuuguuccuguagauaau

SEQ ID NO: 4079825 - RNA, 14 nt, Variola virus
auauuuuacagcca

SEQ ID NO: 4079826 - RNA, 14 nt, Variola virus
auauuuuaguuuug

SEQ ID NO: 4079827 - RNA, 14 nt, Variola virus
auauuuuuaauagc

SEQ ID NO: 4079828 - RNA, 22 nt, Variola virus
auauuuuucuauguuaggaaua

SEQ ID NO: 4079829 - RNA, 17 nt, Variola virus
auauuuuucuuaacaag

SEQ ID NO: 4079830 - RNA, 16 nt, Variola virus
auauuuuuuaacuagu

SEQ ID NO: 4079831 - RNA, 12 nt, Variola virus
aucaaaaaauuu

SEQ ID NO: 4079832 - RNA, 17 nt, Variola virus
aucaaaaaguaagauau

SEQ ID NO: 4079833 - RNA, 14 nt, Variola virus
aucaaaacaaaauu

SEQ ID NO: 4079834 - RNA, 14 nt, Variola virus
aucaaauucauuau

SEQ ID NO: 4079835 - RNA, 16 nt, Variola virus
aucaacaauuuuguau

SEQ ID NO: 4079836 - RNA, 14 nt, Variola virus
aucaacagaaauau

SEQ ID NO: 4079837 - RNA, 20 nt, Variola virus
aucaacgaguuaaaaaagac

SEQ ID NO: 4079838 - RNA, 21 nt, Variola virus
aucaacugcguugauuaaaaa

SEQ ID NO: 4079839 - RNA, 16 nt, Variola virus
aucaacuuauucuuaa

SEQ ID NO: 4079840 - RNA, 14 nt, Variola virus
aucaagaaacauuu

SEQ ID NO: 4079841 - RNA, 21 nt, Variola virus
aucaagaguaacuauugacuu

SEQ ID NO: 4079842 - RNA, 23 nt, Variola virus
aucaagucuuuauacaaugacau

SEQ ID NO: 4079843 - RNA, 14 nt, Variola virus
aucaaguggauaaa

SEQ ID NO: 4079844 - RNA, 13 nt, Variola virus
aucaauaaaugug

SEQ ID NO: 4079845 - RNA, 21 nt, Variola virus
aucaauaccaaagaaggaaga

SEQ ID NO: 4079846 - RNA, 21 nt, Variola virus
aucaauaccuuuucuggcuaa

SEQ ID NO: 4079847 - RNA, 14 nt, Variola virus
aucaaucaaaagac

SEQ ID NO: 4079848 - RNA, 12 nt, Variola virus
aucaauguacau

SEQ ID NO: 4079849 - RNA, 22 nt, Variola virus
aucacaaaaaaaacuucucuaa

SEQ ID NO: 4079850 - RNA, 13 nt, Variola virus
aucacaaacauua

SEQ ID NO: 4079851 - RNA, 14 nt, Variola virus
aucacaaaccacca

SEQ ID NO: 4079852 - RNA, 19 nt, Variola virus
aucacagucuguuuuggua

SEQ ID NO: 4079853 - RNA, 16 nt, Variola virus
aucacauaugcaaaga

SEQ ID NO: 4079854 - RNA, 17 nt, Variola virus
cuuagaaaucaacaauc

SEQ ID NO: 4079855 - RNA, 22 nt, Variola virus
cuuauaaaacuauauuuggaau

SEQ ID NO: 4079856 - RNA, 17 nt, Variola virus
cuuauacaggucauuac

SEQ ID NO: 4079857 - RNA, 22 nt, Variola virus
cuuauauaccgccucaaacucu

SEQ ID NO: 4079858 - RNA, 18 nt, Variola virus
cuuaugaaagaacgcauu

SEQ ID NO: 4079859 - RNA, 22 nt, Variola virus
cuuaugauauaaggaaacagcu

SEQ ID NO: 4079860 - RNA, 15 nt, Variola virus
cuuauuauauuuccc

SEQ ID NO: 4079861 - RNA, 16 nt, Variola virus
cuuauucauauuuuag

SEQ ID NO: 4079862 - RNA, 16 nt, Variola virus
cuuauucuuaaaaucu

SEQ ID NO: 4079863 - RNA, 17 nt, Variola virus
cuuauuuuuaaaaauua

SEQ ID NO: 4079864 - RNA, 15 nt, Variola virus
cuucaauagauaccu

SEQ ID NO: 4079865 - RNA, 22 nt, Variola virus
cuucacagauagaucauuuuga

SEQ ID NO: 4079866 - RNA, 18 nt, Variola virus
cuucaggagauccugcau

SEQ ID NO: 4079867 - RNA, 20 nt, Variola virus
cuucauaaaagaaaauacua

SEQ ID NO: 4079868 - RNA, 12 nt, Variola virus
cuucaucuguaa

SEQ ID NO: 4079869 - RNA, 20 nt, Variola virus
cuucauucguaaaucuuuuc

SEQ ID NO: 4079870 - RNA, 16 nt, Variola virus
cuucuaaugcuguacu

SEQ ID NO: 4079871 - RNA, 19 nt, Variola virus
cuucuaggacggcgauucu

SEQ ID NO: 4079872 - RNA, 12 nt, Variola virus
cuucuauacaaa

SEQ ID NO: 4079873 - RNA, 17 nt, Variola virus
cuucucuguuuaaugaa

SEQ ID NO: 4079874 - RNA, 16 nt, Variola virus
cuugaaauacauguaa

SEQ ID NO: 4079875 - RNA, 15 nt, Variola virus
cuugaaccaaacauu

SEQ ID NO: 4079876 - RNA, 22 nt, Variola virus
cuugauaaccuuggcugucuca

SEQ ID NO: 4079877 - RNA, 12 nt, Variola virus
cuugaucauuuc

SEQ ID NO: 4079878 - RNA, 15 nt, Variola virus
cuugauuacauucuc

SEQ ID NO: 4079879 - RNA, 23 nt, Variola virus
cuugauuauucuauaaguauaaa

SEQ ID NO: 4079880 - RNA, 20 nt, Variola virus
cuuggaugaccauauauuua

SEQ ID NO: 4079881 - RNA, 15 nt, Variola virus
cuuguauauauuguu

SEQ ID NO: 4079882 - RNA, 13 nt, Variola virus
cuuguauuuugau

SEQ ID NO: 4079883 - RNA, 20 nt, Variola virus
cuuguuugauaaauguagcu

SEQ ID NO: 4079884 - RNA, 12 nt, Variola virus
cuuuaaaaauuu

SEQ ID NO: 4079885 - RNA, 15 nt, Variola virus
cuuuaaaagaaacug

SEQ ID NO: 4079886 - RNA, 15 nt, Variola virus
cuuuauaacugaacu

SEQ ID NO: 4079887 - RNA, 16 nt, Variola virus
cuuuauaauuaaugaa

SEQ ID NO: 4079888 - RNA, 15 nt, Variola virus
cuuuauuuuaucuau

SEQ ID NO: 4079889 - RNA, 18 nt, Variola virus
cuuucuguauccagguag

SEQ ID NO: 4079890 - RNA, 15 nt, Variola virus
cuuugaagagauauu

SEQ ID NO: 4079891 - RNA, 13 nt, Variola virus
cuuugauuaauga

SEQ ID NO: 4079892 - RNA, 19 nt, Variola virus
cuuuggagucucaucuuua

SEQ ID NO: 4079893 - RNA, 18 nt, Variola virus
cuuugguucuuuaaaaga

SEQ ID NO: 4079894 - RNA, 17 nt, Variola virus
cuuugguuuaauuauuu

SEQ ID NO: 4079895 - RNA, 18 nt, Variola virus
cuuuguagagaaaaauuc

SEQ ID NO: 4079896 - RNA, 13 nt, Variola virus
cuuuguuaaaaac

SEQ ID NO: 4079897 - RNA, 15 nt, Variola virus
cuuuguuggaagaau

SEQ ID NO: 4079898 - RNA, 20 nt, Variola virus
cuuuuagaagugauucuuug

SEQ ID NO: 4079899 - RNA, 22 nt, Variola virus
cuuuuagaagugauucuuugau

SEQ ID NO: 4079900 - RNA, 22 nt, Variola virus
cuuuuagagguucccaauucca

SEQ ID NO: 4079901 - RNA, 11 nt, Variola virus
cuuuuuaggaa

SEQ ID NO: 4079902 - RNA, 23 nt, Variola virus
cuuuuuugacaggaucagguucu

SEQ ID NO: 4079903 - RNA, 23 nt, Variola virus
cuuuuuuuagagaugaaaaauuu

SEQ ID NO: 4079904 - RNA, 12 nt, Variola virus
gaaaaaauaacu

SEQ ID NO: 4079905 - RNA, 12 nt, Variola virus
gaaaaaauagcu

SEQ ID NO: 4079906 - RNA, 13 nt, Variola virus
gaaaaacacauuu

SEQ ID NO: 4079907 - RNA, 23 nt, Variola virus
gaaaacgagaagcggauaaugau

SEQ ID NO: 4079908 - RNA, 20 nt, Variola virus
gaaaacgagccaguaaucuu

SEQ ID NO: 4079909 - RNA, 18 nt, Variola virus
gaaaagcuuaaaauagcu

SEQ ID NO: 4079910 - RNA, 16 nt, Variola virus
gaaaauaaauaauggu

SEQ ID NO: 4079911 - RNA, 14 nt, Variola virus
gaaaauaaauacaa

SEQ ID NO: 4079912 - RNA, 12 nt, Variola virus
gaaaauaaugac

SEQ ID NO: 4079913 - RNA, 17 nt, Variola virus
gaaaauacuaaaucaga

SEQ ID NO: 4079914 - RNA, 12 nt, Variola virus
gaaaauauuaaa

SEQ ID NO: 4079915 - RNA, 22 nt, Variola virus
gaaaauauuuaaaaaauaucua

SEQ ID NO: 4079916 - RNA, 16 nt, Variola virus
gaaaaucauacagaca

SEQ ID NO: 4079917 - RNA, 22 nt, Variola virus
gaaaaugugcuucuaugagauu

SEQ ID NO: 4079918 - RNA, 22 nt, Variola virus
gaaaauucuaauggaugauguu

SEQ ID NO: 4079919 - RNA, 21 nt, Variola virus
gaaaauuuuuaauuauaauau

SEQ ID NO: 4079920 - RNA, 18 nt, Variola virus
gaaacuauagauaaugau

SEQ ID NO: 4079921 - RNA, 20 nt, Variola virus
gaaacuaugucaaaaauugu

SEQ ID NO: 4079922 - RNA, 20 nt, Variola virus
gaaagaaucaaaagaaugau

SEQ ID NO: 4079923 - RNA, 16 nt, Variola virus
gaaagacgaauauuau

SEQ ID NO: 4079924 - RNA, 18 nt, Variola virus
gaaagauaccgaucacgu

SEQ ID NO: 4079925 - RNA, 21 nt, Variola virus
gaaagcaguugcgaacaacaa

SEQ ID NO: 4079926 - RNA, 20 nt, Variola virus
gaaagcuguaaugguuuaua

SEQ ID NO: 4079927 - RNA, 16 nt, Variola virus
gaaaguuuuauaugua

SEQ ID NO: 4079928 - RNA, 23 nt, Variola virus
gaaauacuuuauuacuccauuaa

SEQ ID NO: 4079929 - RNA, 15 nt, Variola virus
gaaauagauaaugaa

SEQ ID NO: 4079930 - RNA, 14 nt, Variola virus
gaaauauaccgaua

SEQ ID NO: 4079931 - RNA, 22 nt, Variola virus
gaaauauauacauauuuuaguu

SEQ ID NO: 4079932 - RNA, 17 nt, Variola virus
gaaauauaugagaugua

SEQ ID NO: 4079933 - RNA, 16 nt, Variola virus
gaaauauauuguuaaa

SEQ ID NO: 4079934 - RNA, 20 nt, Variola virus
gaaauauguauacauaauau

SEQ ID NO: 4079935 - RNA, 11 nt, Variola virus
gaaauauuaaa

SEQ ID NO: 4079936 - RNA, 14 nt, Variola virus
gaaaucuaguucug

SEQ ID NO: 4079937 - RNA, 19 nt, Variola virus
gaaaucuaucuuauauaca

SEQ ID NO: 4079938 - RNA, 13 nt, Variola virus
gaaauuagaaaau

SEQ ID NO: 4079939 - RNA, 20 nt, Variola virus
gaaauucuaucucuaagacg

SEQ ID NO: 4079940 - RNA, 19 nt, Variola virus
gaaauugguuuauaaugua

SEQ ID NO: 4079941 - RNA, 22 nt, Variola virus
gaaauugucacuacuaaaucaa

SEQ ID NO: 4079942 - RNA, 16 nt, Variola virus
gaaauuuaaaauuaga

SEQ ID NO: 4079943 - RNA, 18 nt, Variola virus
gaaauuuauacucaucau

SEQ ID NO: 4079944 - RNA, 16 nt, Variola virus
gaacaauaaacaaaau

SEQ ID NO: 4079945 - RNA, 14 nt, Variola virus
gaacaauuuacuuu

SEQ ID NO: 4079946 - RNA, 21 nt, Variola virus
gaacacgauuauuauaaaaua

SEQ ID NO: 4079947 - RNA, 13 nt, Variola virus
gaacagaugauau

SEQ ID NO: 4079948 - RNA, 20 nt, Variola virus
gaacauaugguauuauucua

SEQ ID NO: 4079949 - RNA, 20 nt, Variola virus
gaacaucaguacuauuguug

SEQ ID NO: 4079950 - RNA, 22 nt, Variola virus
gaacauccuccggaguauuaau

SEQ ID NO: 4079951 - RNA, 21 nt, Variola virus
gaacaucuugauuauaauaua

SEQ ID NO: 4079952 - RNA, 12 nt, Variola virus
gaacaugaugau

SEQ ID NO: 4079953 - RNA, 16 nt, Variola virus
gaacccaauuacgaua

SEQ ID NO: 4079954 - RNA, 16 nt, Variola virus
gaacgauaaacaaauu

SEQ ID NO: 4079955 - RNA, 16 nt, Variola virus
gaacgguuuauuucua

SEQ ID NO: 4079956 - RNA, 13 nt, Variola virus
gaacuaagagaaa

SEQ ID NO: 4079957 - RNA, 12 nt, Variola virus
gaacuaauaaag

SEQ ID NO: 4079958 - RNA, 13 nt, Variola virus
gaacuaauaugau

SEQ ID NO: 4079959 - RNA, 18 nt, Variola virus
gaacuaauccacauauga

SEQ ID NO: 4079960 - RNA, 17 nt, Variola virus
gaacuagacaauaaugu

SEQ ID NO: 4079961 - RNA, 17 nt, Variola virus
gaacuagauauauuaau

SEQ ID NO: 4079962 - RNA, 22 nt, Variola virus
gaacuauaaaaaaaauaauaau

SEQ ID NO: 4079963 - RNA, 13 nt, Variola virus
gaacuauauuaag

SEQ ID NO: 4079964 - RNA, 23 nt, Variola virus
gaacucccacccaugauaaugaa

SEQ ID NO: 4079965 - RNA, 13 nt, Variola virus
gaacucuguuucu

SEQ ID NO: 4079966 - RNA, 14 nt, Variola virus
gaacugaugccuau

SEQ ID NO: 4079967 - RNA, 19 nt, Variola virus
gaacuuuaaacagaaauau

SEQ ID NO: 4079968 - RNA, 17 nt, Variola virus
gaagaauuaauaaacaa

SEQ ID NO: 4079969 - RNA, 13 nt, Variola virus
gaagacaaucaag

SEQ ID NO: 4079970 - RNA, 16 nt, Variola virus
gaagagaaaagucaau

SEQ ID NO: 4079971 - RNA, 22 nt, Variola virus
gaagagauuccugacuuugcau

SEQ ID NO: 4079972 - RNA, 22 nt, Variola virus
gaagagucgcgaauaacgauau

SEQ ID NO: 4079973 - RNA, 16 nt, Variola virus
gaagauguuagaaaaa

SEQ ID NO: 4079974 - RNA, 16 nt, Variola virus
gaaggagauacuauca

SEQ ID NO: 4079975 - RNA, 15 nt, Variola virus
gaagugguuaaucuu

SEQ ID NO: 4079976 - RNA, 16 nt, Variola virus
gaaguuguauacuauc

SEQ ID NO: 4079977 - RNA, 22 nt, Variola virus
gaauaacuuugauaauaaggau

SEQ ID NO: 4079978 - RNA, 16 nt, Variola virus
gaauaaucguuauuau

SEQ ID NO: 4079979 - RNA, 18 nt, Variola virus
gaauaaucguuauuauca

SEQ ID NO: 4079980 - RNA, 13 nt, Variola virus
guauaaucuuuaa

SEQ ID NO: 4079981 - RNA, 19 nt, Variola virus
guauacauaauauuaucau

SEQ ID NO: 4079982 - RNA, 16 nt, Variola virus
guauacgcagaaaaga

SEQ ID NO: 4079983 - RNA, 14 nt, Variola virus
guauacucuauucg

SEQ ID NO: 4079984 - RNA, 16 nt, Variola virus
guauacuugucaucau

SEQ ID NO: 4079985 - RNA, 17 nt, Variola virus
guauauaucaugaugau

SEQ ID NO: 4079986 - RNA, 18 nt, Variola virus
guauaugugaauaugaca

SEQ ID NO: 4079987 - RNA, 13 nt, Variola virus
guauauuauucau

SEQ ID NO: 4079988 - RNA, 15 nt, Variola virus
guaucauauauuaaa

SEQ ID NO: 4079989 - RNA, 16 nt, Variola virus
guaucaugaacucuaa

SEQ ID NO: 4079990 - RNA, 15 nt, Variola virus
guauccauaaacaau

SEQ ID NO: 4079991 - RNA, 17 nt, Variola virus
guaucgaaaaacuuuaa

SEQ ID NO: 4079992 - RNA, 20 nt, Variola virus
guaucgacaucuuuauuauu

SEQ ID NO: 4079993 - RNA, 19 nt, Variola virus
guaucgauaauuauuucug

SEQ ID NO: 4079994 - RNA, 19 nt, Variola virus
guaucuaauauagauuuua

SEQ ID NO: 4079995 - RNA, 16 nt, Variola virus
guaucuacgauuuuua

SEQ ID NO: 4079996 - RNA, 14 nt, Variola virus
guaucuuuacuaga

SEQ ID NO: 4079997 - RNA, 17 nt, Variola virus
guaugauagcuccacca

SEQ ID NO: 4079998 - RNA, 13 nt, Variola virus
guaugauauguau

SEQ ID NO: 4079999 - RNA, 19 nt, Variola virus
guauggaauauaauaaucu

SEQ ID NO: 4080000 - RNA, 18 nt, Variola virus
guaugucuuauguauauu

SEQ ID NO: 4080001 - RNA, 21 nt, Variola virus
guaugugugugugguauagau

SEQ ID NO: 4080002 - RNA, 15 nt, Variola virus
guauuaacuauauca

SEQ ID NO: 4080003 - RNA, 17 nt, Variola virus
guauucaguuucaucaa

SEQ ID NO: 4080004 - RNA, 19 nt, Variola virus
guauucauuuaucacaaaa

SEQ ID NO: 4080005 - RNA, 13 nt, Variola virus
guauucuuggaua

SEQ ID NO: 4080006 - RNA, 21 nt, Variola virus
guauugacaauacuguauuau

SEQ ID NO: 4080007 - RNA, 16 nt, Variola virus
guauuggauguaugca

SEQ ID NO: 4080008 - RNA, 19 nt, Variola virus
guauuguuaauagauauau

SEQ ID NO: 4080009 - RNA, 11 nt, Variola virus
guauuuaagag

SEQ ID NO: 4080010 - RNA, 16 nt, Variola virus
guauuugaaaauggaa

SEQ ID NO: 4080011 - RNA, 16 nt, Variola virus
guauuuuauuuuggaa

SEQ ID NO: 4080012 - RNA, 18 nt, Variola virus
guauuuuuggugauaaau

SEQ ID NO: 4080013 - RNA, 22 nt, Variola virus
guauuuuuguuagaguauauaa

SEQ ID NO: 4080014 - RNA, 20 nt, Variola virus
guauuuuuuaugacaaacuu

SEQ ID NO: 4080015 - RNA, 14 nt, Variola virus
gucaacaaaaaugu

SEQ ID NO: 4080016 - RNA, 22 nt, Variola virus
gucaaccuuuguuguacaaauu

SEQ ID NO: 4080017 - RNA, 14 nt, Variola virus
gucaagaugaugaa

SEQ ID NO: 4080018 - RNA, 14 nt, Variola virus
gucaauauucuguu

SEQ ID NO: 4080019 - RNA, 15 nt, Variola virus
gucaauauuguuuua

SEQ ID NO: 4080020 - RNA, 16 nt, Variola virus
gucaaucuaauauuaa

SEQ ID NO: 4080021 - RNA, 19 nt, Variola virus
gucaauggaccccaacauc

SEQ ID NO: 4080022 - RNA, 16 nt, Variola virus
gucaauggagaaauac

SEQ ID NO: 4080023 - RNA, 15 nt, Variola virus
gucaauugauucuua

SEQ ID NO: 4080024 - RNA, 18 nt, Variola virus
gucaauuggaguaucauc

SEQ ID NO: 4080025 - RNA, 23 nt, Variola virus
gucacuaacugauaccaugaaau

SEQ ID NO: 4080026 - RNA, 19 nt, Variola virus
gucacuacguaauaaaagu

SEQ ID NO: 4080027 - RNA, 17 nt, Variola virus
gucauaacuuaguucuu

SEQ ID NO: 4080028 - RNA, 16 nt, Variola virus
gucauauucucauaau

SEQ ID NO: 4080029 - RNA, 20 nt, Variola virus
gucaucaaguagugauuuug

SEQ ID NO: 4080030 - RNA, 17 nt, Variola virus
gucaucgcguuguuuua

SEQ ID NO: 4080031 - RNA, 17 nt, Variola virus
gucaucuuauguuuuua

SEQ ID NO: 4080032 - RNA, 16 nt, Variola virus
gucauguugauacauc

SEQ ID NO: 4080033 - RNA, 16 nt, Variola virus
guccauuaucaguaau

SEQ ID NO: 4080034 - RNA, 15 nt, Variola virus
guccguuauauaauc

SEQ ID NO: 4080035 - RNA, 12 nt, Variola virus
gucgcacgcucc

SEQ ID NO: 4080036 - RNA, 18 nt, Variola virus
gucggaaaucuuaaccaa

SEQ ID NO: 4080037 - RNA, 19 nt, Variola virus
gucggaguaguacaagaaa

SEQ ID NO: 4080038 - RNA, 22 nt, Variola virus
gucgucgaaauaucuuuccaac

SEQ ID NO: 4080039 - RNA, 21 nt, Variola virus
gucguucuuccucaaguucuc

SEQ ID NO: 4080040 - RNA, 21 nt, Variola virus
gucuaaacguuguuuacucau

SEQ ID NO: 4080041 - RNA, 20 nt, Variola virus
gucuaaagaugacugauauu

SEQ ID NO: 4080042 - RNA, 13 nt, Variola virus
gucuaaugaugaa

SEQ ID NO: 4080043 - RNA, 16 nt, Variola virus
gucuacuuaaauguau

SEQ ID NO: 4080044 - RNA, 22 nt, Variola virus
gucuagagcaucaauguccugc

SEQ ID NO: 4080045 - RNA, 15 nt, Variola virus
gucuaucaauaacug

SEQ ID NO: 4080046 - RNA, 20 nt, Variola virus
gucuauccauuguuucacau

SEQ ID NO: 4080047 - RNA, 19 nt, Variola virus
gucuaugaauaugauuuuu

SEQ ID NO: 4080048 - RNA, 15 nt, Variola virus
gucuaugauauccuc

SEQ ID NO: 4080049 - RNA, 19 nt, Variola virus
gucuauucaacacuacuau

SEQ ID NO: 4080050 - RNA, 13 nt, Variola virus
gucuauuguuaau

SEQ ID NO: 4080051 - RNA, 23 nt, Variola virus
gucucaugucgcaauaaauauga

SEQ ID NO: 4080052 - RNA, 15 nt, Variola virus
gucuccaauauauga

SEQ ID NO: 4080053 - RNA, 13 nt, Variola virus
gucucuuaaagga

SEQ ID NO: 4080054 - RNA, 14 nt, Variola virus
gucugaacaucaau

SEQ ID NO: 4080055 - RNA, 15 nt, Variola virus
gucugucucagaauc

SEQ ID NO: 4080056 - RNA, 15 nt, Variola virus
gucuguuaauagaca

SEQ ID NO: 4080057 - RNA, 17 nt, Variola virus
gucuuaccuuacuaucu

SEQ ID NO: 4080058 - RNA, 22 nt, Variola virus
gucuuauaugaagucuauacag

SEQ ID NO: 4080059 - RNA, 12 nt, Variola virus
gucuuauccauu

SEQ ID NO: 4080060 - RNA, 13 nt, Variola virus
gucuuggaagcaa

SEQ ID NO: 4080061 - RNA, 17 nt, Variola virus
gucuuuucugaaguagg

SEQ ID NO: 4080062 - RNA, 20 nt, Variola virus
gugaauagauagguauuuua

SEQ ID NO: 4080063 - RNA, 19 nt, Variola virus
gugagaacuuguuaaagaa

SEQ ID NO: 4080064 - RNA, 22 nt, Variola virus
gugauaaacuugugcuaaucuc

SEQ ID NO: 4080065 - RNA, 17 nt, Variola virus
gugauaaguaauaacua

SEQ ID NO: 4080066 - RNA, 21 nt, Variola virus
gugauaccgauagugauuuug

SEQ ID NO: 4080067 - RNA, 16 nt, Variola virus
gugaucaauuuccaac

SEQ ID NO: 4080068 - RNA, 16 nt, Variola virus
gugauuguucaaucaa

SEQ ID NO: 4080069 - RNA, 15 nt, Variola virus
gugcagauaaucauu

SEQ ID NO: 4080070 - RNA, 18 nt, Variola virus
gugcucaaacaaaaugug

SEQ ID NO: 4080071 - RNA, 14 nt, Variola virus
gugcuuaauguuuc

SEQ ID NO: 4080072 - RNA, 23 nt, Variola virus
guggaggauggucccgaugauga

SEQ ID NO: 4080073 - RNA, 12 nt, Variola virus
gugggaugaugu

SEQ ID NO: 4080074 - RNA, 16 nt, Variola virus
guguaauguaaucaua

SEQ ID NO: 4080075 - RNA, 21 nt, Variola virus
guguacguauauuuagauguu

SEQ ID NO: 4080076 - RNA, 21 nt, Variola virus
guguacuagucauaauaucuu

SEQ ID NO: 4080077 - RNA, 17 nt, Variola virus
guguauaaaauauacug

SEQ ID NO: 4080078 - RNA, 19 nt, Variola virus
guguauacaguauaggaaa

SEQ ID NO: 4080079 - RNA, 19 nt, Variola virus
guguauuaaauagaauauu

SEQ ID NO: 4080080 - RNA, 21 nt, Variola virus
gugucaaacuguguagcuaga

SEQ ID NO: 4080081 - RNA, 15 nt, Variola virus
guguccauaauccuc

SEQ ID NO: 4080082 - RNA, 13 nt, Variola virus
guguuauaauauu

SEQ ID NO: 4080083 - RNA, 22 nt, Variola virus
guguuccggagaaucaguaaag

SEQ ID NO: 4080084 - RNA, 14 nt, Variola virus
guguucuauacguc

SEQ ID NO: 4080085 - RNA, 13 nt, Variola virus
guguuuagauauu

SEQ ID NO: 4080086 - RNA, 18 nt, Variola virus
guuaaaaaaauuauccua

SEQ ID NO: 4080087 - RNA, 17 nt, Variola virus
guuaaacugugaauguc

SEQ ID NO: 4080088 - RNA, 14 nt, Variola virus
guuaaagaaauuaa

SEQ ID NO: 4080089 - RNA, 23 nt, Variola virus
guuaaaugguucgauauaaagga

SEQ ID NO: 4080090 - RNA, 19 nt, Variola virus
guuaaauuuuacaaaucua

SEQ ID NO: 4080091 - RNA, 16 nt, Variola virus
guuaacauuuuauuau

SEQ ID NO: 4080092 - RNA, 17 nt, Variola virus
guuaacauuuuauuauu

SEQ ID NO: 4080093 - RNA, 19 nt, Variola virus
guuaacuuugauuauccua

SEQ ID NO: 4080094 - RNA, 11 nt, Variola virus
guuaauacagg

SEQ ID NO: 4080095 - RNA, 22 nt, Variola virus
guuaauacuuauucauauuuua

SEQ ID NO: 4080096 - RNA, 23 nt, Variola virus
guuaaucgucgaacguucuagua

SEQ ID NO: 4080097 - RNA, 19 nt, Variola virus
guuaauuuaucacauauca

SEQ ID NO: 4080098 - RNA, 12 nt, Variola virus
guuaauuuuacu

SEQ ID NO: 4080099 - RNA, 19 nt, Variola virus
guuacauuuccaugucaaa

SEQ ID NO: 4080100 - RNA, 22 nt, Variola virus
guuaccucguucugauaauaga

SEQ ID NO: 4080101 - RNA, 14 nt, Variola virus
guuacgaugaugaa

SEQ ID NO: 4080102 - RNA, 19 nt, Variola virus
guuagaacgguuauagcau

SEQ ID NO: 4080103 - RNA, 20 nt, Variola virus
guuagaucgucuauauauga

SEQ ID NO: 4080104 - RNA, 19 nt, Variola virus
guuagcugucguucaagau

SEQ ID NO: 4080105 - RNA, 13 nt, Variola virus
guuaguaaucaug

SEQ ID NO: 4080106 - RNA, 16 nt, Variola virus
uguaauagaauuuaua

SEQ ID NO: 4080107 - RNA, 18 nt, Variola virus
uguaauuuagaauacguu

SEQ ID NO: 4080108 - RNA, 17 nt, Variola virus
uguacauuaauaaauga

SEQ ID NO: 4080109 - RNA, 14 nt, Variola virus
uguacauuauuaca

SEQ ID NO: 4080110 - RNA, 16 nt, Variola virus
uguacuaucuagagau

SEQ ID NO: 4080111 - RNA, 17 nt, Variola virus
uguacuuaacaugauua

SEQ ID NO: 4080112 - RNA, 17 nt, Variola virus
uguagauggauguagca

SEQ ID NO: 4080113 - RNA, 14 nt, Variola virus
uguaggaaaaagau

SEQ ID NO: 4080114 - RNA, 18 nt, Variola virus
uguauaaaaacagaaaua

SEQ ID NO: 4080115 - RNA, 18 nt, Variola virus
uguauacaccaacuguau

SEQ ID NO: 4080116 - RNA, 17 nt, Variola virus
uguauaucuauaauguu

SEQ ID NO: 4080117 - RNA, 19 nt, Variola virus
uguaucaaacaguuuggua

SEQ ID NO: 4080118 - RNA, 21 nt, Variola virus
uguaucauauucaacauguuu

SEQ ID NO: 4080119 - RNA, 16 nt, Variola virus
uguauccauacauaca

SEQ ID NO: 4080120 - RNA, 19 nt, Variola virus
uguaucgagacguggagau

SEQ ID NO: 4080121 - RNA, 18 nt, Variola virus
uguauggguaauaguguu

SEQ ID NO: 4080122 - RNA, 18 nt, Variola virus
uguauguuuaaacacucu

SEQ ID NO: 4080123 - RNA, 12 nt, Variola virus
uguauuaaauag

SEQ ID NO: 4080124 - RNA, 21 nt, Variola virus
uguauuuggaucuuuuguaca

SEQ ID NO: 4080125 - RNA, 20 nt, Variola virus
ugucacauacacuagugaua

SEQ ID NO: 4080126 - RNA, 18 nt, Variola virus
ugucaucaguuauguacg

SEQ ID NO: 4080127 - RNA, 22 nt, Variola virus
uguccuauuucaaaaguuuuua

SEQ ID NO: 4080128 - RNA, 20 nt, Variola virus
ugucuacacauccuuuugua

SEQ ID NO: 4080129 - RNA, 23 nt, Variola virus
ugucuagaacggcaauugucuua

SEQ ID NO: 4080130 - RNA, 18 nt, Variola virus
ugucucagaaucaaauau

SEQ ID NO: 4080131 - RNA, 14 nt, Variola virus
ugucucuguuuuua

SEQ ID NO: 4080132 - RNA, 16 nt, Variola virus
ugucugcuuucuuuua

SEQ ID NO: 4080133 - RNA, 20 nt, Variola virus
ugucuggagaucuaaagaua

SEQ ID NO: 4080134 - RNA, 23 nt, Variola virus
ugucuuggaagcaauuacagauu

SEQ ID NO: 4080135 - RNA, 18 nt, Variola virus
ugugaagguuuagauguc

SEQ ID NO: 4080136 - RNA, 17 nt, Variola virus
ugugacuagacugauuu

SEQ ID NO: 4080137 - RNA, 14 nt, Variola virus
ugugauuguucaau

SEQ ID NO: 4080138 - RNA, 23 nt, Variola virus
uguggccucgaauacaaauuuua

SEQ ID NO: 4080139 - RNA, 17 nt, Variola virus
uguguaguuuucacaau

SEQ ID NO: 4080140 - RNA, 14 nt, Variola virus
ugugucuacauaaa

SEQ ID NO: 4080141 - RNA, 17 nt, Variola virus
ugugucuccauguacau

SEQ ID NO: 4080142 - RNA, 13 nt, Variola virus
ugugucuguuaau

SEQ ID NO: 4080143 - RNA, 15 nt, Variola virus
ugugugugugguaua

SEQ ID NO: 4080144 - RNA, 18 nt, Variola virus
uguuaaaaauaugugcuc

SEQ ID NO: 4080145 - RNA, 16 nt, Variola virus
uguuaauuauuucuaa

SEQ ID NO: 4080146 - RNA, 13 nt, Variola virus
uguuaauuuugaa

SEQ ID NO: 4080147 - RNA, 23 nt, Variola virus
uguuacucaguugaacagaugau

SEQ ID NO: 4080148 - RNA, 15 nt, Variola virus
uguuauaaguuuuua

SEQ ID NO: 4080149 - RNA, 21 nt, Variola virus
uguuauacacggucuagagca

SEQ ID NO: 4080150 - RNA, 13 nt, Variola virus
uguucacauccuu

SEQ ID NO: 4080151 - RNA, 21 nt, Variola virus
uguugcuucauccagaucauu

SEQ ID NO: 4080152 - RNA, 18 nt, Variola virus
uguuguaaggauccuggu

SEQ ID NO: 4080153 - RNA, 16 nt, Variola virus
uguuguuacauuucca

SEQ ID NO: 4080154 - RNA, 21 nt, Variola virus
uguuuaacaaagauauuacca

SEQ ID NO: 4080155 - RNA, 23 nt, Variola virus
uguuuaacauucuuuuuuggaga

SEQ ID NO: 4080156 - RNA, 22 nt, Variola virus
uguuuagaaauagcucuuagua

SEQ ID NO: 4080157 - RNA, 21 nt, Variola virus
uguuucaucuaucauagauuu

SEQ ID NO: 4080158 - RNA, 21 nt, Variola virus
uguuucuacuccauaauacuc

SEQ ID NO: 4080159 - RNA, 19 nt, Variola virus
uguuugcugcguguauaac

SEQ ID NO: 4080160 - RNA, 20 nt, Variola virus
uguuuuugaacuguucaaaa

SEQ ID NO: 4080161 - RNA, 21 nt, Variola virus
uguuuuugaacuguucaaaau

SEQ ID NO: 4080162 - RNA, 19 nt, Variola virus
uuaaaaaaaaauacuuauu

SEQ ID NO: 4080163 - RNA, 13 nt, Variola virus
uuaaaaaaauuaa

SEQ ID NO: 4080164 - RNA, 16 nt, Variola virus
uuaaaaaguuaucuuu

SEQ ID NO: 4080165 - RNA, 13 nt, Variola virus
uuaaaauauuguu

SEQ ID NO: 4080166 - RNA, 12 nt, Variola virus
uuaaaaugagua

SEQ ID NO: 4080167 - RNA, 16 nt, Variola virus
uuaaaaugauuauucc

SEQ ID NO: 4080168 - RNA, 12 nt, Variola virus
uuaaaauuauuu

SEQ ID NO: 4080169 - RNA, 21 nt, Variola virus
uuaaacaaauaaguauuauca

SEQ ID NO: 4080170 - RNA, 18 nt, Variola virus
uuaaacgauuuauaaaaa

SEQ ID NO: 4080171 - RNA, 22 nt, Variola virus
uuaaacuguaucgaucauucuu

SEQ ID NO: 4080172 - RNA, 19 nt, Variola virus
uuaaacuucgcaauauuca

SEQ ID NO: 4080173 - RNA, 14 nt, Variola virus
uuaaagaauguaua

SEQ ID NO: 4080174 - RNA, 22 nt, Variola virus
uuaaagagacuacaauauauuc

SEQ ID NO: 4080175 - RNA, 21 nt, Variola virus
uuaaagaugacaauauuauua

SEQ ID NO: 4080176 - RNA, 14 nt, Variola virus
uuaaagauggagua

SEQ ID NO: 4080177 - RNA, 22 nt, Variola virus
uuaaaggauaaaauauuaucca

SEQ ID NO: 4080178 - RNA, 24 nt, Variola virus
uuaaaggauggcgaaauuauugca

SEQ ID NO: 4080179 - RNA, 14 nt, Variola virus
uuaaaguuauuaau

SEQ ID NO: 4080180 - RNA, 15 nt, Variola virus
uuaaauaauguauca

SEQ ID NO: 4080181 - RNA, 13 nt, Variola virus
uuaaauauugauc

SEQ ID NO: 4080182 - RNA, 15 nt, Variola virus
uuaaaucguuguucu

SEQ ID NO: 4080183 - RNA, 17 nt, Variola virus
uuaaaugucauauuaau

SEQ ID NO: 4080184 - RNA, 13 nt, Variola virus
uuaaauguuuucu

SEQ ID NO: 4080185 - RNA, 23 nt, Variola virus
uuaaauuaauaauggauauagua

SEQ ID NO: 4080186 - RNA, 13 nt, Variola virus
uuaaauucuuuaa

SEQ ID NO: 4080187 - RNA, 23 nt, Variola virus
uuaacaaaugguucaaagacuag

SEQ ID NO: 4080188 - RNA, 20 nt, Variola virus
uuaacaccuccacaguuuuu

SEQ ID NO: 4080189 - RNA, 11 nt, Variola virus
uuaacaucuug

SEQ ID NO: 4080190 - RNA, 20 nt, Variola virus
uuaacauuuuggcaaauuga

SEQ ID NO: 4080191 - RNA, 17 nt, Variola virus
uuaaccaacugauuaau

SEQ ID NO: 4080192 - RNA, 20 nt, Variola virus
uuaacccacgauuuaauauu

SEQ ID NO: 4080193 - RNA, 19 nt, Variola virus
uuaaccuuuuuaguaaaug

SEQ ID NO: 4080194 - RNA, 18 nt, Variola virus
uuaacgcaccuauaaaga

SEQ ID NO: 4080195 - RNA, 21 nt, Variola virus
uuaacuaagucaauuauuuca

SEQ ID NO: 4080196 - RNA, 14 nt, Variola virus
uuaacuaauaaaaa

SEQ ID NO: 4080197 - RNA, 16 nt, Variola virus
uuaacuagauuauaca

SEQ ID NO: 4080198 - RNA, 17 nt, Variola virus
uuaacuccucuauuaau

SEQ ID NO: 4080199 - RNA, 15 nt, Variola virus
uuaacuguucaucgu

SEQ ID NO: 4080200 - RNA, 22 nt, Variola virus
uuaagagauccgauaaacauug

SEQ ID NO: 4080201 - RNA, 22 nt, Variola virus
uuaagagauuuagaaaacauua

SEQ ID NO: 4080202 - RNA, 14 nt, Variola virus
uuaagaucuaauau

SEQ ID NO: 4080203 - RNA, 18 nt, Variola virus
uuaauaaauaucauuaac

SEQ ID NO: 4080204 - RNA, 20 nt, Variola virus
uuaauaagacuuugaacauu

SEQ ID NO: 4080205 - RNA, 22 nt, Variola virus
uuaauaaugaucaucuagauaa

SEQ ID NO: 4080206 - RNA, 15 nt, Variola virus
uuaauaauuguauug

SEQ ID NO: 4080207 - RNA, 16 nt, Variola virus
uuaauacaucaucuaa

SEQ ID NO: 4080208 - RNA, 17 nt, Variola virus
uuaauagauauauuaau

SEQ ID NO: 4080209 - RNA, 15 nt, Variola virus
uuaauagauuaacau

SEQ ID NO: 4080210 - RNA, 13 nt, Variola virus
uuaauaguuuuua

SEQ ID NO: 4080211 - RNA, 12 nt, Variola virus
uuaauauuauca

SEQ ID NO: 4080212 - RNA, 16 nt, Variola virus
uuaauccuucuagaau

SEQ ID NO: 4080213 - RNA, 18 nt, Variola virus
uuaauccuuugauuauca

SEQ ID NO: 4080214 - RNA, 20 nt, Variola virus
uuaaugaagaacacauauuu

SEQ ID NO: 4080215 - RNA, 23 nt, Variola virus
uuaaugauacacacuauacuguc

SEQ ID NO: 4080216 - RNA, 14 nt, Variola virus
uuaauggaaacuau

SEQ ID NO: 4080217 - RNA, 15 nt, Variola virus
uuaauguauaucuuu

SEQ ID NO: 4080218 - RNA, 17 nt, Variola virus
uuaauuaauacaauguc

SEQ ID NO: 4080219 - RNA, 16 nt, Variola virus
uuaauuaguaacuguu

SEQ ID NO: 4080220 - RNA, 12 nt, Variola virus
uuaauugccaua

SEQ ID NO: 4080221 - RNA, 19 nt, Variola virus
uuaauuuguacauucuuaa

SEQ ID NO: 4080222 - RNA, 19 nt, Variola virus
uuacaaaaaaaucaauuaa

SEQ ID NO: 4080223 - RNA, 11 nt, Variola virus
uuacaaacauu

SEQ ID NO: 4080224 - RNA, 16 nt, Variola virus
uuacaaacauuacuag

SEQ ID NO: 4080225 - RNA, 14 nt, Variola virus
uuacaaauaaaagu

SEQ ID NO: 4080226 - RNA, 17 nt, Variola virus
uuacaaauauucacaag

SEQ ID NO: 4080227 - RNA, 13 nt, Variola virus
uuacaauacauag

SEQ ID NO: 4080228 - RNA, 15 nt, Variola virus
uuacacuaacuguau

SEQ ID NO: 4080229 - RNA, 21 nt, Variola virus
uuacagaauaauauucacagg

SEQ ID NO: 4080230 - RNA, 15 nt, Variola virus
uuacagccaagaaac

SEQ ID NO: 4080231 - RNA, 21 nt, Variola virus
uuacauaaaaaaaauguaaua

SEQ ID NO: 4080232 - RNA, 23 nt, Variola virus
uuacauacuuuguccguaaaaca

SEQ ID NO: 4080233 - RNA, 18 nt, Variola virus
uuacauaguugauaaaaa

SEQ ID NO: 4080234 - RNA, 18 nt, Variola virus
uuacaugugauacauuuu

SEQ ID NO: 4080235 - RNA, 13 nt, Variola virus
uuacauuucuugu

SEQ ID NO: 4080236 - RNA, 17 nt, Variola virus
uuacauuucuuguuuuu

SEQ ID NO: 4080237 - RNA, 12 nt, Variola virus
uuaccaacaaua

SEQ ID NO: 4080238 - RNA, 16 nt, Variola virus
uuaccagaauacuauu

SEQ ID NO: 4080239 - RNA, 12 nt, Variola virus
uuaccuauucac

SEQ ID NO: 4080240 - RNA, 23 nt, Variola virus
uuaccucuucugauaucauuaau

SEQ ID NO: 4080241 - RNA, 19 nt, Variola virus
uuacgacgugcuaaucuag

SEQ ID NO: 4080242 - RNA, 17 nt, Variola virus
uuacgauagaaauagau

SEQ ID NO: 4080243 - RNA, 18 nt, Variola virus
uuacuaacgugauuauua

SEQ ID NO: 4080244 - RNA, 15 nt, Variola virus
uuacuagauuaaaaa

SEQ ID NO: 4080245 - RNA, 19 nt, Variola virus
uuacuaucggcucaaagag

SEQ ID NO: 4080246 - RNA, 12 nt, Variola virus
uuacuauuuugg

SEQ ID NO: 4080247 - RNA, 16 nt, Variola virus
uuacuguuucuucacu

SEQ ID NO: 4080248 - RNA, 20 nt, Variola virus
uuacuuaauaggugaaaaga

SEQ ID NO: 4080249 - RNA, 19 nt, Variola virus
uuacuuugaccacauccuu

SEQ ID NO: 4080250 - RNA, 23 nt, Variola virus
uuacuuuuaguuuuuuuagaaaa

SEQ ID NO: 4080251 - RNA, 17 nt, Variola virus
uuagaauacuaaauuga

SEQ ID NO: 4080252 - RNA, 18 nt, Variola virus
uuagacggcaacauagaa

SEQ ID NO: 4080253 - RNA, 19 nt, Variola virus
uuagaguaguaucauuaaa

SEQ ID NO: 4080254 - RNA, 13 nt, Variola virus
uuagauacauagu

SEQ ID NO: 4080255 - RNA, 21 nt, Variola virus
uuagaucauuaacucuagaaa

SEQ ID NO: 4080256 - RNA, 19 nt, Variola virus
uuagaugagaaauuauucc

SEQ ID NO: 4080257 - RNA, 17 nt, Variola virus
uuagaugguuucuuuuu

SEQ ID NO: 4080258 - RNA, 22 nt, Variola virus
uuagauuuauuuuuauaaaguu

SEQ ID NO: 4080259 - RNA, 20 nt, Variola virus
uuaguaaaaaauuuauuucu

SEQ ID NO: 4080260 - RNA, 22 nt, Variola virus
uuaguaaaaaauuuauuucuaa

SEQ ID NO: 4080261 - RNA, 19 nt, Variola virus
uuaguaaggcuuuagaaac

SEQ ID NO: 4080262 - RNA, 22 nt, Variola virus
uuaguaagugcuacaaaacaga

SEQ ID NO: 4080263 - RNA, 15 nt, Variola virus
uuaguacauucuuca

SEQ ID NO: 4080264 - RNA, 22 nt, Variola virus
uuaguagaagaacucuguuucu

SEQ ID NO: 4080265 - RNA, 14 nt, Variola virus
uuaguagacauuuu

SEQ ID NO: 4080266 - RNA, 19 nt, Variola virus
uuaguaucuagcucuguaa

SEQ ID NO: 4080267 - RNA, 22 nt, Variola virus
uuaguauuaaacagauccuuaa

SEQ ID NO: 4080268 - RNA, 19 nt, Variola virus
uuagucgccgucucuauaa

SEQ ID NO: 4080269 - RNA, 16 nt, Variola virus
uuagucuguacaaaag

SEQ ID NO: 4080270 - RNA, 19 nt, Variola virus
uuagugauguaaguauaac

SEQ ID NO: 4080271 - RNA, 14 nt, Variola virus
uuaguuauugcaau

SEQ ID NO: 4080272 - RNA, 21 nt, Variola virus
uuaguugaugugacaguuuuc

SEQ ID NO: 4080273 - RNA, 16 nt, Variola virus
uuaguuuuuuuagaaa

SEQ ID NO: 4080274 - RNA, 15 nt, Variola virus
uuauaaaacauagau

SEQ ID NO: 4080275 - RNA, 22 nt, Variola virus
uuauaaagaccgaauacauaac

SEQ ID NO: 4080276 - RNA, 17 nt, Variola virus
uuauaaaggagacuugu

SEQ ID NO: 4080277 - RNA, 14 nt, Variola virus
uuauaacauuuucc

SEQ ID NO: 4080278 - RNA, 12 nt, Variola virus
uuauaacuaaac

SEQ ID NO: 4080279 - RNA, 16 nt, Variola virus
uuauaauauacauaag

SEQ ID NO: 4080280 - RNA, 12 nt, Variola virus
uuauaauuauua

SEQ ID NO: 4080281 - RNA, 14 nt, Variola virus
uuauacaaaguuuu

SEQ ID NO: 4080282 - RNA, 18 nt, Variola virus
uuauacaggucauuacau

SEQ ID NO: 4080283 - RNA, 17 nt, Variola virus
uuauacaguguauguaa

SEQ ID NO: 4080284 - RNA, 21 nt, Variola virus
uuauacaucgaauauaaaaua

SEQ ID NO: 4080285 - RNA, 23 nt, Variola virus
uuauacuaccagacgacauagaa

SEQ ID NO: 4080286 - RNA, 18 nt, Variola virus
uuauacuaugucauuaac

SEQ ID NO: 4080287 - RNA, 21 nt, Variola virus
uuauacuucuccaacaucgau

SEQ ID NO: 4080288 - RNA, 20 nt, Variola virus
uuauagaacagugucaucua

SEQ ID NO: 4080289 - RNA, 23 nt, Variola virus
uuauagcuucuggauauaauuca

SEQ ID NO: 4080290 - RNA, 18 nt, Variola virus
uuauagggaaauacuguu

SEQ ID NO: 4080291 - RNA, 16 nt, Variola virus
uuauaguuaacauuuu

SEQ ID NO: 4080292 - RNA, 15 nt, Variola virus
uuauauaaaacauuu

SEQ ID NO: 4080293 - RNA, 16 nt, Variola virus
uuauauaaucuauaaa

SEQ ID NO: 4080294 - RNA, 17 nt, Variola virus
uuauauacacauaauua

SEQ ID NO: 4080295 - RNA, 21 nt, Variola virus
uuauaucuuuagcuaaaucgu

SEQ ID NO: 4080296 - RNA, 17 nt, Variola virus
uuaucaaagucacaaag

SEQ ID NO: 4080297 - RNA, 13 nt, Variola virus
uuaucaaaucuag

SEQ ID NO: 4080298 - RNA, 14 nt, Variola virus
uuaucacauacuag

SEQ ID NO: 4080299 - RNA, 16 nt, Variola virus
uuaucauaucuguaau

SEQ ID NO: 4080300 - RNA, 18 nt, Variola virus
uuaucaugagauguguuu

SEQ ID NO: 4080301 - RNA, 18 nt, Variola virus
uuaucauuuuuuuauuca

SEQ ID NO: 4080302 - RNA, 13 nt, Variola virus
uuauccaauacag

SEQ ID NO: 4080303 - RNA, 14 nt, Variola virus
uuauccucauuaaa

SEQ ID NO: 4080304 - RNA, 23 nt, Variola virus
uuaucgauacacguuuucaaaau

SEQ ID NO: 4080305 - RNA, 13 nt, Variola virus
uuaucuacaucuu

SEQ ID NO: 4080306 - RNA, 21 nt, Variola virus
uuaucuauuccuuucauuaac

SEQ ID NO: 4080307 - RNA, 23 nt, Variola virus
uuaucuauuucaaaaaaugauca

SEQ ID NO: 4080308 - RNA, 19 nt, Variola virus
uuaucucagugcaaagauu

SEQ ID NO: 4080309 - RNA, 17 nt, Variola virus
uuaucucuauucaucau

SEQ ID NO: 4080310 - RNA, 13 nt, Variola virus
uuaucuuucuugc

SEQ ID NO: 4080311 - RNA, 20 nt, Variola virus
uuaugaaaaaguaaaugaug

SEQ ID NO: 4080312 - RNA, 23 nt, Variola virus
uuaugaaacuuggaaacaucucu

SEQ ID NO: 4080313 - RNA, 23 nt, Variola virus
uuaugaacgaugauauguaucca

SEQ ID NO: 4080314 - RNA, 22 nt, Variola virus
uuaugaauggauaccuguauua

SEQ ID NO: 4080315 - RNA, 16 nt, Variola virus
uuaugaauugauucuu

SEQ ID NO: 4080316 - RNA, 23 nt, Variola virus
uuaugacaaaguuuacauucuuu

SEQ ID NO: 4080317 - RNA, 15 nt, Variola virus
uuaugacgauuucaa

SEQ ID NO: 4080318 - RNA, 21 nt, Variola virus
uuaugacgcaguaacauagau

SEQ ID NO: 4080319 - RNA, 17 nt, Variola virus
uuaugauagaaauuagc

SEQ ID NO: 4080320 - RNA, 12 nt, Variola virus
uuauguacuaag

SEQ ID NO: 4080321 - RNA, 16 nt, Variola virus
uuauguuggacauaag

SEQ ID NO: 4080322 - RNA, 15 nt, Variola virus
uuauguuucuuuaaa

SEQ ID NO: 4080323 - RNA, 13 nt, Variola virus
uuauuaaaaugag

SEQ ID NO: 4080324 - RNA, 18 nt, Variola virus
uuauuaacuguuucgaua

SEQ ID NO: 4080325 - RNA, 13 nt, Variola virus
uuauuacuagaau

SEQ ID NO: 4080326 - RNA, 15 nt, Variola virus
uuauuacuuuuggaa

SEQ ID NO: 4080327 - RNA, 13 nt, Variola virus
uuauuagaucuuu

SEQ ID NO: 4080328 - RNA, 17 nt, Variola virus
uuauuauuuuauauuca

SEQ ID NO: 4080329 - RNA, 15 nt, Variola virus
uuauugcaaacgaug

SEQ ID NO: 4080330 - RNA, 20 nt, Variola virus
uuauugcacgcuauuaauca

SEQ ID NO: 4080331 - RNA, 23 nt, Variola virus
uuauugggugguaaacuagauaa

SEQ ID NO: 4080332 - RNA, 14 nt, Variola virus
uuauuuaacucuuu

SEQ ID NO: 4080333 - RNA, 22 nt, Variola virus
uuauuucaaagacuaacuuaua

SEQ ID NO: 4080334 - RNA, 23 nt, Variola virus
uuauuuuaaaccuaaagaugcua

SEQ ID NO: 4080335 - RNA, 19 nt, Variola virus
uuauuuuaucuuuuacuac

SEQ ID NO: 4080336 - RNA, 21 nt, Variola virus
uuauuuuuugguauaauucua

SEQ ID NO: 4080337 - RNA, 14 nt, Variola virus
uuauuuuuuuggaa

SEQ ID NO: 4080338 - RNA, 23 nt, Variola virus
uucaaaagauaguuuucaucaga

SEQ ID NO: 4080339 - RNA, 16 nt, Variola virus
uucaaaauagcuaucu

SEQ ID NO: 4080340 - RNA, 13 nt, Variola virus
uucaacaaacuaa

SEQ ID NO: 4080341 - RNA, 15 nt, Variola virus
uucaaccauucauaa

SEQ ID NO: 4080342 - RNA, 22 nt, Variola virus
uucaacguauggaauauaauaa

SEQ ID NO: 4080343 - RNA, 13 nt, Variola virus
uucaacugucuuu

SEQ ID NO: 4080344 - RNA, 19 nt, Variola virus
uucaaguccaauguuuuua

SEQ ID NO: 4080345 - RNA, 15 nt, Variola virus
uucaauaaaugauuc

SEQ ID NO: 4080346 - RNA, 20 nt, Variola virus
uucaaugucuccuuuucaga

SEQ ID NO: 4080347 - RNA, 13 nt, Variola virus
uucaauucucgga

SEQ ID NO: 4080348 - RNA, 13 nt, Variola virus
uucacauaaaaga

SEQ ID NO: 4080349 - RNA, 18 nt, Variola virus
uucagaaagcuguggaug

SEQ ID NO: 4080350 - RNA, 14 nt, Variola virus
uucagaauuucuac

SEQ ID NO: 4080351 - RNA, 19 nt, Variola virus
uucagauauaaaaaucugu

SEQ ID NO: 4080352 - RNA, 20 nt, Variola virus
uucagauauaaaaaucuguu

SEQ ID NO: 4080353 - RNA, 18 nt, Variola virus
uucagcauuacuugauau

SEQ ID NO: 4080354 - RNA, 19 nt, Variola virus
uucaguaguguuuacauaa

SEQ ID NO: 4080355 - RNA, 12 nt, Variola virus
uucagugaagaa

SEQ ID NO: 4080356 - RNA, 17 nt, Variola virus
uucaguuucucaucuuu

SEQ ID NO: 4080357 - RNA, 14 nt, Variola virus
uucauauacugaua

SEQ ID NO: 4080358 - RNA, 22 nt, Variola virus
uucaucaauagacauaagaaau

SEQ ID NO: 4080359 - RNA, 12 nt, Variola virus
uucaucagauau

SEQ ID NO: 4080360 - RNA, 13 nt, Variola virus
uucaucauauuca

SEQ ID NO: 4080361 - RNA, 14 nt, Variola virus
uucaucauuucaca

SEQ ID NO: 4080362 - RNA, 12 nt, Variola virus
uucaucuagaau

SEQ ID NO: 4080363 - RNA, 12 nt, Variola virus
uucaucuguaag

SEQ ID NO: 4080364 - RNA, 14 nt, Variola virus
uucaucuuggauga

SEQ ID NO: 4080365 - RNA, 12 nt, Variola virus
uucauucguaaa

SEQ ID NO: 4080366 - RNA, 18 nt, Variola virus
uuccaaauauauuacuag

SEQ ID NO: 4080367 - RNA, 16 nt, Variola virus
uuccaaauucuggauu

SEQ ID NO: 4080368 - RNA, 18 nt, Variola virus
uuccaaucuauaauaucu

SEQ ID NO: 4080369 - RNA, 14 nt, Variola virus
uuccacaauacgag

SEQ ID NO: 4080370 - RNA, 21 nt, Variola virus
uuccacaauacgagucauuau

SEQ ID NO: 4080371 - RNA, 19 nt, Variola virus
uuccagaauggcauacaua

SEQ ID NO: 4080372 - RNA, 13 nt, Variola virus
uuccauaaacagu

SEQ ID NO: 4080373 - RNA, 18 nt, Variola virus
uuccauccacaauuauug

SEQ ID NO: 4080374 - RNA, 13 nt, Variola virus
uuccauuauuaau

SEQ ID NO: 4080375 - RNA, 15 nt, Variola virus
uuccauuuuuaauuu

SEQ ID NO: 4080376 - RNA, 14 nt, Variola virus
uucccaaauaauca

SEQ ID NO: 4080377 - RNA, 22 nt, Variola virus
uucccauauccagacaacaauc

SEQ ID NO: 4080378 - RNA, 17 nt, Variola virus
uucccguaauaaauuuu

SEQ ID NO: 4080379 - RNA, 21 nt, Variola virus
uuccguuggaugguaauaaac

SEQ ID NO: 4080380 - RNA, 14 nt, Variola virus
uuccugaauacuau

SEQ ID NO: 4080381 - RNA, 15 nt, Variola virus
uuccuggagauaucc

SEQ ID NO: 4080382 - RNA, 22 nt, Variola virus
uuccuguuccguuaacaucucu

SEQ ID NO: 4080383 - RNA, 12 nt, Variola virus
uuccuuauucuu

SEQ ID NO: 4080384 - RNA, 18 nt, Variola virus
uucgcaaacuauucuaau

SEQ ID NO: 4080385 - RNA, 23 nt, Variola virus
uucggacuuauauagcuuauucc

SEQ ID NO: 4080386 - RNA, 18 nt, Variola virus
uucguagaaaguaucuua

SEQ ID NO: 4080387 - RNA, 14 nt, Variola virus
uucgucaaacauua

SEQ ID NO: 4080388 - RNA, 21 nt, Variola virus
uucguuagauuuucuacagau

SEQ ID NO: 4080389 - RNA, 16 nt, Variola virus
uucuaaugcuguacua

SEQ ID NO: 4080390 - RNA, 20 nt, Variola virus
uucuaauggaugauguucua

SEQ ID NO: 4080391 - RNA, 13 nt, Variola virus
uucuacauuuuca

SEQ ID NO: 4080392 - RNA, 21 nt, Variola virus
uucuacccccguuacauuugu

SEQ ID NO: 4080393 - RNA, 16 nt, Variola virus
uucuacuccuuucuua

SEQ ID NO: 4080394 - RNA, 17 nt, Variola virus
uucuagacacaacacua

SEQ ID NO: 4080395 - RNA, 22 nt, Variola virus
uucuagcucccggauugaaaac

SEQ ID NO: 4080396 - RNA, 14 nt, Variola virus
uucuaguuaucaug

SEQ ID NO: 4080397 - RNA, 15 nt, Variola virus
uucuauaaacugaau

SEQ ID NO: 4080398 - RNA, 18 nt, Variola virus
uucuauaaagucugucaa

SEQ ID NO: 4080399 - RNA, 13 nt, Variola virus
uucuauaaucauu

SEQ ID NO: 4080400 - RNA, 19 nt, Variola virus
uucuauacgucuuuauuuu

SEQ ID NO: 4080401 - RNA, 17 nt, Variola virus
uucuauaucuauaucua

SEQ ID NO: 4080402 - RNA, 19 nt, Variola virus
uucuaucuuuaauaucuag

SEQ ID NO: 4080403 - RNA, 13 nt, Variola virus
uucuauguaucua

SEQ ID NO: 4080404 - RNA, 19 nt, Variola virus
uucuauuauuauuaauuuu

SEQ ID NO: 4080405 - RNA, 15 nt, Variola virus
uucuauuuuuauucu

SEQ ID NO: 4080406 - RNA, 16 nt, Variola virus
uucucacuagugucua

SEQ ID NO: 4080407 - RNA, 16 nt, Variola virus
uucuccaauacuaauu

SEQ ID NO: 4080408 - RNA, 23 nt, Variola virus
uucucgauagagaugagaugcuu

SEQ ID NO: 4080409 - RNA, 16 nt, Variola virus
uucucgcaacugucuu

SEQ ID NO: 4080410 - RNA, 19 nt, Variola virus
uucucucagguacagauuu

SEQ ID NO: 4080411 - RNA, 22 nt, Variola virus
uucucucauaaauacagagaug

SEQ ID NO: 4080412 - RNA, 20 nt, Variola virus
uucucucauuuaucaaaagu

SEQ ID NO: 4080413 - RNA, 14 nt, Variola virus
uucucugaauauag

SEQ ID NO: 4080414 - RNA, 17 nt, Variola virus
uucucuuugauaaaagu

SEQ ID NO: 4080415 - RNA, 17 nt, Variola virus
uucucuuuuaauucagu

SEQ ID NO: 4080416 - RNA, 19 nt, Variola virus
uucugaauagauccaccau

SEQ ID NO: 4080417 - RNA, 22 nt, Variola virus
uucugacgucguucuacauaaa

SEQ ID NO: 4080418 - RNA, 15 nt, Variola virus
uucugauuuauccuu

SEQ ID NO: 4080419 - RNA, 18 nt, Variola virus
uucugcauuacaaagaag

SEQ ID NO: 4080420 - RNA, 19 nt, Variola virus
uucuggaacauuaaaugua

SEQ ID NO: 4080421 - RNA, 17 nt, Variola virus
uucuuaaacuuauucuu

SEQ ID NO: 4080422 - RNA, 13 nt, Variola virus
uucuuaauaaucg

SEQ ID NO: 4080423 - RNA, 23 nt, Variola virus
uucuuacaguacauaguauugac

SEQ ID NO: 4080424 - RNA, 20 nt, Variola virus
uucuuacauauuuuuuucuu

SEQ ID NO: 4080425 - RNA, 20 nt, Variola virus
uucuuaccagauauuauaca

SEQ ID NO: 4080426 - RNA, 21 nt, Variola virus
uucuuagcgaaugaugcagac

SEQ ID NO: 4080427 - RNA, 16 nt, Variola virus
uucuuaugaaacuugg

SEQ ID NO: 4080428 - RNA, 14 nt, Variola virus
uucuucaaaugaag

SEQ ID NO: 4080429 - RNA, 13 nt, Variola virus
uucuuguguaauu

SEQ ID NO: 4080430 - RNA, 16 nt, Variola virus
uugaaaaugaaaucac

SEQ ID NO: 4080431 - RNA, 22 nt, Variola virus
uugaaauuguuuuuuauuuucu

SEQ ID NO: 4080432 - RNA, 22 nt, Variola virus
uugaaucaucaucgguguagua

SEQ ID NO: 4080433 - RNA, 14 nt, Variola virus
uugaaucuauuucu

SEQ ID NO: 4080434 - RNA, 15 nt, Variola virus
uugaaugauguaguu

SEQ ID NO: 4080435 - RNA, 14 nt, Variola virus
uugacaaauuauuc

SEQ ID NO: 4080436 - RNA, 23 nt, Variola virus
uugacaucuaaaaaauccuuaau

SEQ ID NO: 4080437 - RNA, 21 nt, Variola virus
uugacauuaaucuauuagaau

SEQ ID NO: 4080438 - RNA, 22 nt, Variola virus
uugaccguguguaaaaugacuc

SEQ ID NO: 4080439 - RNA, 22 nt, Variola virus
uugagauuaaauguaauaacaa

SEQ ID NO: 4080440 - RNA, 16 nt, Variola virus
uugagcaguugaugca

SEQ ID NO: 4080441 - RNA, 15 nt, Variola virus
uugaggauauacaaa

SEQ ID NO: 4080442 - RNA, 15 nt, Variola virus
uugaggauuuaaaac

SEQ ID NO: 4080443 - RNA, 16 nt, Variola virus
uugauaaaaauuaaaa

SEQ ID NO: 4080444 - RNA, 15 nt, Variola virus
uugaucuauguaguu

SEQ ID NO: 4080445 - RNA, 14 nt, Variola virus
uugaugacguguac

SEQ ID NO: 4080446 - RNA, 20 nt, Variola virus
uugaugauaucuacaucguu

SEQ ID NO: 4080447 - RNA, 22 nt, Variola virus
uugaugugaucaauuuccaaca

SEQ ID NO: 4080448 - RNA, 19 nt, Variola virus
uugauuuaaagucuagagu

SEQ ID NO: 4080449 - RNA, 23 nt, Variola virus
uugauuuggaauucuuuuucgac

SEQ ID NO: 4080450 - RNA, 14 nt, Variola virus
uugauuuucguaac

SEQ ID NO: 4080451 - RNA, 21 nt, Variola virus
uugcaauauagaccauacuuc

SEQ ID NO: 4080452 - RNA, 13 nt, Variola virus
uugcaauugguaa

SEQ ID NO: 4080453 - RNA, 16 nt, Variola virus
uugcauacaauacuag

SEQ ID NO: 4080454 - RNA, 17 nt, Variola virus
uugcuaauuaauagcau

SEQ ID NO: 4080455 - RNA, 19 nt, Variola virus
uugcuagacaccuuuucaa

SEQ ID NO: 4080456 - RNA, 14 nt, Variola virus
uugcucguaaaaga

SEQ ID NO: 4080457 - RNA, 20 nt, Variola virus
uugcuuugguuuaauuauuu

SEQ ID NO: 4080458 - RNA, 23 nt, Variola virus
uuggaggcgaugaucuuaauuuu

SEQ ID NO: 4080459 - RNA, 16 nt, Variola virus
uuggaucagucucuaa

SEQ ID NO: 4080460 - RNA, 12 nt, Variola virus
uuggauguaugc

SEQ ID NO: 4080461 - RNA, 15 nt, Variola virus
uuggauuuuguauua

SEQ ID NO: 4080462 - RNA, 14 nt, Variola virus
uuggcaaauuauuu

SEQ ID NO: 4080463 - RNA, 20 nt, Variola virus
uuggcacgaacaaaaauacg

SEQ ID NO: 4080464 - RNA, 22 nt, Variola virus
uugggcggaucuguaaacauuu

SEQ ID NO: 4080465 - RNA, 14 nt, Variola virus
uugguaaauuccau

SEQ ID NO: 4080466 - RNA, 14 nt, Variola virus
uugguucucuagau

SEQ ID NO: 4080467 - RNA, 21 nt, Variola virus
uuguaacaucgguacggguau

SEQ ID NO: 4080468 - RNA, 15 nt, Variola virus
uuguaauaucuuaaa

SEQ ID NO: 4080469 - RNA, 14 nt, Variola virus
uuguacaaauuccu

SEQ ID NO: 4080470 - RNA, 22 nt, Variola virus
uuguacacuucuauaguaucua

SEQ ID NO: 4080471 - RNA, 20 nt, Variola virus
uuguacauuaauaaaugaaa

SEQ ID NO: 4080472 - RNA, 21 nt, Variola virus
uuguacgaauccaauuuuuca

SEQ ID NO: 4080473 - RNA, 15 nt, Variola virus
uuguauagaaauuuu

SEQ ID NO: 4080474 - RNA, 13 nt, Variola virus
uuguauuauucug

SEQ ID NO: 4080475 - RNA, 20 nt, Variola virus
uuguauucugaauagaucca

SEQ ID NO: 4080476 - RNA, 16 nt, Variola virus
uugucaacuuuguaaa

SEQ ID NO: 4080477 - RNA, 21 nt, Variola virus
uugucauguugauacaucacu

SEQ ID NO: 4080478 - RNA, 18 nt, Variola virus
uuguccuaaaauacuauu

SEQ ID NO: 4080479 - RNA, 21 nt, Variola virus
uugucguaaauacaugucuaa

SEQ ID NO: 4080480 - RNA, 19 nt, Variola virus
uugucucaugaccguguau

SEQ ID NO: 4080481 - RNA, 15 nt, Variola virus
uugucuuaacuauaa

SEQ ID NO: 4080482 - RNA, 18 nt, Variola virus
uugugucauugacaucuu

SEQ ID NO: 4080483 - RNA, 22 nt, Variola virus
uuguuggcgcgccucaaaugua

SEQ ID NO: 4080484 - RNA, 18 nt, Variola virus
uuguuuuaauuuuaggac

SEQ ID NO: 4080485 - RNA, 14 nt, Variola virus
uuuaaaaaguuauc

SEQ ID NO: 4080486 - RNA, 19 nt, Variola virus
uuuaaaagacucagaagag

SEQ ID NO: 4080487 - RNA, 18 nt, Variola virus
uuuaaacacucuuucuga

SEQ ID NO: 4080488 - RNA, 14 nt, Variola virus
uuuaaaguuucuga

SEQ ID NO: 4080489 - RNA, 18 nt, Variola virus
uuuaaauagcauagauau

SEQ ID NO: 4080490 - RNA, 16 nt, Variola virus
uuuaacauauguauca

SEQ ID NO: 4080491 - RNA, 15 nt, Variola virus
uuuaagaauagacag

SEQ ID NO: 4080492 - RNA, 16 nt, Variola virus
uuuaauuuccuaguau

SEQ ID NO: 4080493 - RNA, 23 nt, Variola virus
uuuaauuuuguuauaguagauau

SEQ ID NO: 4080494 - RNA, 21 nt, Variola virus
uuuacaagauuauuaaauccu

SEQ ID NO: 4080495 - RNA, 23 nt, Variola virus
uuuacacaguaaccaaaaugaaa

SEQ ID NO: 4080496 - RNA, 15 nt, Variola virus
uuuacacguaaccau

SEQ ID NO: 4080497 - RNA, 16 nt, Variola virus
uuuacagauauauuca

SEQ ID NO: 4080498 - RNA, 21 nt, Variola virus
uuuacauggcucguaccaaca

SEQ ID NO: 4080499 - RNA, 18 nt, Variola virus
uuuaccagugauuaucca

SEQ ID NO: 4080500 - RNA, 21 nt, Variola virus
uuuacccuuugacauuaaaaa

SEQ ID NO: 4080501 - RNA, 21 nt, Variola virus
uuuaccgacaccuguuucaug

SEQ ID NO: 4080502 - RNA, 22 nt, Variola virus
uuuacgagcuauuaaacuguuu

SEQ ID NO: 4080503 - RNA, 21 nt, Variola virus
uuuacgcgcacacaauacaga

SEQ ID NO: 4080504 - RNA, 14 nt, Variola virus
uuuacuggaauuag

SEQ ID NO: 4080505 - RNA, 13 nt, Variola virus
uuuagaaacauaa

SEQ ID NO: 4080506 - RNA, 20 nt, Variola virus
uuuagaaauguuauauauaa

SEQ ID NO: 4080507 - RNA, 18 nt, Variola virus
uuuagaaggaguguuuuc

SEQ ID NO: 4080508 - RNA, 20 nt, Variola virus
uuuagaaggaguguuuucuu

SEQ ID NO: 4080509 - RNA, 17 nt, Variola virus
uuuagacgcuuauuauu

SEQ ID NO: 4080510 - RNA, 17 nt, Variola virus
uuuagacgguugagaaa

SEQ ID NO: 4080511 - RNA, 15 nt, Variola virus
uuuagacguagaaaa

SEQ ID NO: 4080512 - RNA, 18 nt, Variola virus
uuuagagaaugcuaauau

SEQ ID NO: 4080513 - RNA, 16 nt, Variola virus
uuuagaguauuucuca

SEQ ID NO: 4080514 - RNA, 16 nt, Variola virus
uuuaguuuauucauaa

SEQ ID NO: 4080515 - RNA, 20 nt, Variola virus
uuuauaaacaugaaaccacu

SEQ ID NO: 4080516 - RNA, 23 nt, Variola virus
uuuauauaauuuuuggacaaaug

SEQ ID NO: 4080517 - RNA, 14 nt, Variola virus
uuuauauuuuucuu

SEQ ID NO: 4080518 - RNA, 19 nt, Variola virus
uuuaucaaccauucaaaaa

SEQ ID NO: 4080519 - RNA, 14 nt, Variola virus
uuuauccuauauau

SEQ ID NO: 4080520 - RNA, 11 nt, Variola virus
uuuauuucuaa

SEQ ID NO: 4080521 - RNA, 13 nt, Variola virus
uuuauuucuaauu

SEQ ID NO: 4080522 - RNA, 22 nt, Variola virus
uuucaaagaaugagauacauaa

SEQ ID NO: 4080523 - RNA, 20 nt, Variola virus
uuucaaugaguuuaauaacu

SEQ ID NO: 4080524 - RNA, 22 nt, Variola virus
uuucaccauauagaucaaucau

SEQ ID NO: 4080525 - RNA, 17 nt, Variola virus
uuucacuuuaucucauu

SEQ ID NO: 4080526 - RNA, 16 nt, Variola virus
uuucagaaucuagauu

SEQ ID NO: 4080527 - RNA, 16 nt, Variola virus
uuucagaggaauacag

SEQ ID NO: 4080528 - RNA, 12 nt, Variola virus
uuucauacauau

SEQ ID NO: 4080529 - RNA, 14 nt, Variola virus
uuucaucuagauac

SEQ ID NO: 4080530 - RNA, 12 nt, Variola virus
uuucaucuucuu

SEQ ID NO: 4080531 - RNA, 22 nt, Variola virus
uuucauuccaggaucuagauaa

SEQ ID NO: 4080532 - RNA, 21 nt, Variola virus
uuuccaaaucaguaacuaugu

SEQ ID NO: 4080533 - RNA, 22 nt, Variola virus
uuuccaaguggcgaauuccaaa

SEQ ID NO: 4080534 - RNA, 11 nt, Variola virus
uuuccauccac

SEQ ID NO: 4080535 - RNA, 20 nt, Variola virus
uuuccauggcccauucuauu

SEQ ID NO: 4080536 - RNA, 22 nt, Variola virus
uuuccauuagauuauaucauaa

SEQ ID NO: 4080537 - RNA, 13 nt, Variola virus
uuuccuacauaac

SEQ ID NO: 4080538 - RNA, 14 nt, Variola virus
uuucgaauaaguuu

SEQ ID NO: 4080539 - RNA, 18 nt, Variola virus
uuucguacaaauacagaa

SEQ ID NO: 4080540 - RNA, 19 nt, Variola virus
uuucuaaauuauuccaauu

SEQ ID NO: 4080541 - RNA, 15 nt, Variola virus
uuucuaaguucuaau

SEQ ID NO: 4080542 - RNA, 21 nt, Variola virus
uuucuacaauaacuacauauu

SEQ ID NO: 4080543 - RNA, 16 nt, Variola virus
uuucuacuacuucauu

SEQ ID NO: 4080544 - RNA, 14 nt, Variola virus
uuucuauaaucauu

SEQ ID NO: 4080545 - RNA, 20 nt, Variola virus
uuucucuuuuuauccucauu

SEQ ID NO: 4080546 - RNA, 22 nt, Variola virus
uuucuggaaguggauauacaua

SEQ ID NO: 4080547 - RNA, 21 nt, Variola virus
uuucuugauuagcccaucauu

SEQ ID NO: 4080548 - RNA, 13 nt, Variola virus
uuugaacaucuug

SEQ ID NO: 4080549 - RNA, 21 nt, Variola virus
uuugacaaagauggucugaaa

SEQ ID NO: 4080550 - RNA, 21 nt, Variola virus
uuugagaaauauguauacaua

SEQ ID NO: 4080551 - RNA, 17 nt, Variola virus
uuugagaauauauacag

SEQ ID NO: 4080552 - RNA, 18 nt, Variola virus
uuugagagaucauuucua

SEQ ID NO: 4080553 - RNA, 14 nt, Variola virus
uuugagagggaaaa

SEQ ID NO: 4080554 - RNA, 15 nt, Variola virus
uuugagauuucauaa

SEQ ID NO: 4080555 - RNA, 15 nt, Variola virus
uuugcuuuuucuauu

SEQ ID NO: 4080556 - RNA, 14 nt, Variola virus
uuuggcucuucuau

SEQ ID NO: 4080557 - RNA, 20 nt, Variola virus
uuuguaccaacaaacuguuc

SEQ ID NO: 4080558 - RNA, 14 nt, Variola virus
uuuguauaaucuuu

SEQ ID NO: 4080559 - RNA, 16 nt, Variola virus
uuugucauuaacuuua

SEQ ID NO: 4080560 - RNA, 21 nt, Variola virus
uuuguccauuauuucuauauu

SEQ ID NO: 4080561 - RNA, 20 nt, Variola virus
uuugucuccuccuccguaaa

SEQ ID NO: 4080562 - RNA, 14 nt, Variola virus
uuugugaacucuuu

SEQ ID NO: 4080563 - RNA, 18 nt, Variola virus
uuuguucuuaagacuaua

SEQ ID NO: 4080564 - RNA, 18 nt, Variola virus
uuuuaaaaaucauaacag

SEQ ID NO: 4080565 - RNA, 18 nt, Variola virus
uuuuaaacaacuaaacag

SEQ ID NO: 4080566 - RNA, 20 nt, Variola virus
uuuuaacaugauguaaucuc

SEQ ID NO: 4080567 - RNA, 22 nt, Variola virus
uuuuaacuaguguagaaaacag

SEQ ID NO: 4080568 - RNA, 23 nt, Variola virus
uuuuacauggauuuaucauauca

SEQ ID NO: 4080569 - RNA, 15 nt, Variola virus
uuuuacgaauaaaag

SEQ ID NO: 4080570 - RNA, 23 nt, Variola virus
uuuuacuccucuccuuccguaaa

SEQ ID NO: 4080571 - RNA, 16 nt, Variola virus
uuuuagaaaauucuaa

SEQ ID NO: 4080572 - RNA, 20 nt, Variola virus
uuuuagccagagauaucaua

SEQ ID NO: 4080573 - RNA, 20 nt, Variola virus
uuuuaggaauccauguauua

SEQ ID NO: 4080574 - RNA, 19 nt, Variola virus
uuuuagguacucaucuacu

SEQ ID NO: 4080575 - RNA, 22 nt, Variola virus
uuuuauaaucuuuauggaucua

SEQ ID NO: 4080576 - RNA, 13 nt, Variola virus
uuuuauacauauu

SEQ ID NO: 4080577 - RNA, 20 nt, Variola virus
uuuuaucaggauaaauacau

SEQ ID NO: 4080578 - RNA, 15 nt, Variola virus
uuuuauuaaaugacg

SEQ ID NO: 4080579 - RNA, 17 nt, Variola virus
uuuuauucacauaaaag

SEQ ID NO: 4080580 - RNA, 17 nt, Variola virus
uuuucaaagaaaaaggu

SEQ ID NO: 4080581 - RNA, 20 nt, Variola virus
uuuucaaagaaaaagguuug

SEQ ID NO: 4080582 - RNA, 21 nt, Variola virus
uuuucaacacucgacugaaua

SEQ ID NO: 4080583 - RNA, 17 nt, Variola virus
uuuucaaucauagaacu

SEQ ID NO: 4080584 - RNA, 18 nt, Variola virus
uuuucauuagcaugaauc

SEQ ID NO: 4080585 - RNA, 11 nt, Variola virus
uuuucuguaaa

SEQ ID NO: 4080586 - RNA, 13 nt, Variola virus
uuuuguacauaau

SEQ ID NO: 4080587 - RNA, 24 nt, Variola virus
uuuuguggauuaguguacucucuu

SEQ ID NO: 4080588 - RNA, 22 nt, Variola virus
uuuuuaacgcaauggucuuaga

SEQ ID NO: 4080589 - RNA, 15 nt, Variola virus
uuuuuacuaaucaua

SEQ ID NO: 4080590 - RNA, 14 nt, Variola virus
uuuuuauacauauu

SEQ ID NO: 4080591 - RNA, 12 nt, Variola virus
uuuuuauuccua

SEQ ID NO: 4080592 - RNA, 11 nt, Variola virus
uuuuuauucuu

SEQ ID NO: 4080593 - RNA, 17 nt, Variola virus
uuuuucaucuuuacaua

SEQ ID NO: 4080594 - RNA, 23 nt, Variola virus
auggauuuuuuuaaaaaggaaau

SEQ ID NO: 4080595 - RNA, 15 nt, Variola virus
auggcgaaauuauug

SEQ ID NO: 4080596 - RNA, 13 nt, Variola virus
augguaaaaagac

SEQ ID NO: 4080597 - RNA, 17 nt, Variola virus
augguaaaauuaaauag

SEQ ID NO: 4080598 - RNA, 13 nt, Variola virus
augguaaauacug

SEQ ID NO: 4080599 - RNA, 23 nt, Variola virus
auggucuauauauacacuacaau

SEQ ID NO: 4080600 - RNA, 21 nt, Variola virus
auguaaagcauuauucuugaa

SEQ ID NO: 4080601 - RNA, 19 nt, Variola virus
auguaacccuuuuuaucga

SEQ ID NO: 4080602 - RNA, 21 nt, Variola virus
auguaaccuacuagaaugaua

SEQ ID NO: 4080603 - RNA, 15 nt, Variola virus
auguaauaacaaagg

SEQ ID NO: 4080604 - RNA, 23 nt, Variola virus
auguacgauccaaacaauguuuc

SEQ ID NO: 4080605 - RNA, 23 nt, Variola virus
cauaaugaugguguauacaguau

SEQ ID NO: 4080606 - RNA, 20 nt, Variola virus
cauaauguaaagauauucua

SEQ ID NO: 4080607 - RNA, 20 nt, Variola virus
cauaauuaggaucuucuaau

SEQ ID NO: 4080608 - RNA, 21 nt, Variola virus
cauaauuguuagcuguuuuca

SEQ ID NO: 4080609 - RNA, 16 nt, Variola virus
cauacaaugauuucaa

SEQ ID NO: 4080610 - RNA, 15 nt, Variola virus
cauacacuacaguaa

SEQ ID NO: 4080611 - RNA, 17 nt, Variola virus
cauacauacuaucuuua

SEQ ID NO: 4080612 - RNA, 21 nt, Variola virus
cauaccaucuaucaaacaaaa

SEQ ID NO: 4080613 - RNA, 13 nt, Variola virus
cauacuccaucaa

SEQ ID NO: 4080614 - RNA, 20 nt, Variola virus
cauagaaagguugcgucuag

SEQ ID NO: 4080615 - RNA, 17 nt, Variola virus
cauagauaauauauacg

SEQ ID NO: 4080616 - RNA, 15 nt, Variola virus
cauagaugaaauacu

SEQ ID NO: 4080617 - RNA, 14 nt, Variola virus
cauagccaauggau

SEQ ID NO: 4080618 - RNA, 16 nt, Variola virus
cauaguaaauucuguu

SEQ ID NO: 4080619 - RNA, 17 nt, Variola virus
cauaguccucguguggu

SEQ ID NO: 4080620 - RNA, 14 nt, Variola virus
cauagugcgucuaa

SEQ ID NO: 4080621 - RNA, 18 nt, Variola virus
cauaguuuguaucaauaa

SEQ ID NO: 4080622 - RNA, 14 nt, Variola virus
cauauaauaaugaa

SEQ ID NO: 4080623 - RNA, 16 nt, Variola virus
cauauacguauccaug

SEQ ID NO: 4080624 - RNA, 20 nt, Variola virus
cauauaguauucuuguauuc

SEQ ID NO: 4080625 - RNA, 21 nt, Variola virus
cauauauguuuucaucauuuc

SEQ ID NO: 4080626 - RNA, 22 nt, Variola virus
cauauauuuugcauaacaugua

SEQ ID NO: 4080627 - RNA, 15 nt, Variola virus
cauauauuuuuggau

SEQ ID NO: 4080628 - RNA, 18 nt, Variola virus
cauaucauacaugauauu

SEQ ID NO: 4080629 - RNA, 20 nt, Variola virus
cauaucuccucuuccaucac

SEQ ID NO: 4080630 - RNA, 20 nt, Variola virus
cauauguuuuaauauuuaca

SEQ ID NO: 4080631 - RNA, 15 nt, Variola virus
cauauugaucauuug

SEQ ID NO: 4080632 - RNA, 13 nt, Variola virus
cauauuuugcaau

SEQ ID NO: 4080633 - RNA, 16 nt, Variola virus
caucaaaaaacaacug

SEQ ID NO: 4080634 - RNA, 12 nt, Variola virus
caucaaauggau

SEQ ID NO: 4080635 - RNA, 19 nt, Variola virus
caucaaccgaguuguuaau

SEQ ID NO: 4080636 - RNA, 18 nt, Variola virus
caucaaccgucacauaau

SEQ ID NO: 4080637 - RNA, 21 nt, Variola virus
caucagaauaaaucaauaucu

SEQ ID NO: 4080638 - RNA, 16 nt, Variola virus
caucagacaaugcuuu

SEQ ID NO: 4080639 - RNA, 16 nt, Variola virus
caucaucgagauaauu

SEQ ID NO: 4080640 - RNA, 14 nt, Variola virus
caucauuaucauuu

SEQ ID NO: 4080641 - RNA, 12 nt, Variola virus
cauccaacaauc

SEQ ID NO: 4080642 - RNA, 24 nt, Variola virus
cauccaugagauugaaugccauuu

SEQ ID NO: 4080643 - RNA, 18 nt, Variola virus
cauccguuguuauauacc

SEQ ID NO: 4080644 - RNA, 17 nt, Variola virus
cauccuuuauuaaauca

SEQ ID NO: 4080645 - RNA, 13 nt, Variola virus
caucgaauacuuu

SEQ ID NO: 4080646 - RNA, 23 nt, Variola virus
caucgacuguacgauacauaaug

SEQ ID NO: 4080647 - RNA, 15 nt, Variola virus
caucgaugaugcauu

SEQ ID NO: 4080648 - RNA, 23 nt, Variola virus
caucguauacuuuuuaauucucu

SEQ ID NO: 4080649 - RNA, 13 nt, Variola virus
caucgucaucaag

SEQ ID NO: 4080650 - RNA, 20 nt, Variola virus
caucgucgucuacuauucua

SEQ ID NO: 4080651 - RNA, 24 nt, Variola virus
caucuaccauaauccuauucuuga

SEQ ID NO: 4080652 - RNA, 14 nt, Variola virus
caucuauaucaucu

SEQ ID NO: 4080653 - RNA, 20 nt, Variola virus
caucucguuuagauuuucca

SEQ ID NO: 4080654 - RNA, 15 nt, Variola virus
caucucuauguuuca

SEQ ID NO: 4080655 - RNA, 12 nt, Variola virus
caucugcauuau

SEQ ID NO: 4080656 - RNA, 22 nt, Variola virus
caucuguaggauaucuauuuuc

SEQ ID NO: 4080657 - RNA, 12 nt, Variola virus
caucugucauau

SEQ ID NO: 4080658 - RNA, 18 nt, Variola virus
caucugucauuacauaau

SEQ ID NO: 4080659 - RNA, 21 nt, Variola virus
caucuuaaugcggcuuaauaa

SEQ ID NO: 4080660 - RNA, 17 nt, Variola virus
caucuuacauauacaga

SEQ ID NO: 4080661 - RNA, 16 nt, Variola virus
caucuuacaugaugau

SEQ ID NO: 4080662 - RNA, 18 nt, Variola virus
caucuuggaaacauaaaa

SEQ ID NO: 4080663 - RNA, 17 nt, Variola virus
caugaaacgaacacuau

SEQ ID NO: 4080664 - RNA, 13 nt, Variola virus
caugaaagaaaga

SEQ ID NO: 4080665 - RNA, 19 nt, Variola virus
caugaaauauauuaagaaa

SEQ ID NO: 4080666 - RNA, 23 nt, Variola virus
caugaacaaucacaagaauagag

SEQ ID NO: 4080667 - RNA, 13 nt, Variola virus
caugaacauaauc

SEQ ID NO: 4080668 - RNA, 23 nt, Variola virus
caugaauuuauuucuaauucuca

SEQ ID NO: 4080669 - RNA, 20 nt, Variola virus
caugacuugguauuuggaaa

SEQ ID NO: 4080670 - RNA, 17 nt, Variola virus
caugagauugaaugcca

SEQ ID NO: 4080671 - RNA, 18 nt, Variola virus
caugaugauuuaugguga

SEQ ID NO: 4080672 - RNA, 19 nt, Variola virus
caugauggucauguuuauu

SEQ ID NO: 4080673 - RNA, 15 nt, Variola virus
caugauguaaucucu

SEQ ID NO: 4080674 - RNA, 17 nt, Variola virus
caugcauccaaauggau

SEQ ID NO: 4080675 - RNA, 21 nt, Variola virus
cauggaaaagauaaaguuuua

SEQ ID NO: 4080676 - RNA, 18 nt, Variola virus
cauggaacaauaaaagag

SEQ ID NO: 4080677 - RNA, 23 nt, Variola virus
cauggauaucuuuaaagaacuaa

SEQ ID NO: 4080678 - RNA, 15 nt, Variola virus
cauggucuagaugua

SEQ ID NO: 4080679 - RNA, 22 nt, Variola virus
cauguaaacuugacaaaaauug

SEQ ID NO: 4080680 - RNA, 17 nt, Variola virus
cauguaacaauauuaca

SEQ ID NO: 4080681 - RNA, 19 nt, Variola virus
cauguauccacuuuugagc

SEQ ID NO: 4080682 - RNA, 12 nt, Variola virus
cauguauuuccu

SEQ ID NO: 4080683 - RNA, 21 nt, Variola virus
cauguuacacuauauaacaau

SEQ ID NO: 4080684 - RNA, 12 nt, Variola virus
cauguucauagg

SEQ ID NO: 4080685 - RNA, 14 nt, Variola virus
cauguuuauuucua

SEQ ID NO: 4080686 - RNA, 13 nt, Variola virus
cauuaaauuguga

SEQ ID NO: 4080687 - RNA, 12 nt, Variola virus
cauuaacagcuu

SEQ ID NO: 4080688 - RNA, 18 nt, Variola virus
cauuacaaagaagaacug

SEQ ID NO: 4080689 - RNA, 15 nt, Variola virus
cauuaccucaugaac

SEQ ID NO: 4080690 - RNA, 16 nt, Variola virus
cauuagagaaauguac

SEQ ID NO: 4080691 - RNA, 18 nt, Variola virus
cauuagguuaaaugauuu

SEQ ID NO: 4080692 - RNA, 14 nt, Variola virus
cauuaguaaacaau

SEQ ID NO: 4080693 - RNA, 21 nt, Variola virus
cauuauggauaaucuauuuac

SEQ ID NO: 4080694 - RNA, 23 nt, Variola virus
cauucacuauuccgucacuggcu

SEQ ID NO: 4080695 - RNA, 15 nt, Variola virus
cauuccuuauacaau

SEQ ID NO: 4080696 - RNA, 12 nt, Variola virus
cauucuauuuuu

SEQ ID NO: 4080697 - RNA, 20 nt, Variola virus
cauugauacacguucacuau

SEQ ID NO: 4080698 - RNA, 15 nt, Variola virus
cauugauuuauuuga

SEQ ID NO: 4080699 - RNA, 13 nt, Variola virus
cauuguaaagccc

SEQ ID NO: 4080700 - RNA, 18 nt, Variola virus
cauugugauuaaacauua

SEQ ID NO: 4080701 - RNA, 23 nt, Variola virus
cauuguucgugauaguauguggu

SEQ ID NO: 4080702 - RNA, 17 nt, Variola virus
cauuuaaauaucauaau

SEQ ID NO: 4080703 - RNA, 15 nt, Variola virus
cauuuacaacucuau

SEQ ID NO: 4080704 - RNA, 14 nt, Variola virus
cauuuauagcauuu

SEQ ID NO: 4080705 - RNA, 14 nt, Variola virus
cauuucaacguaaa

SEQ ID NO: 4080706 - RNA, 15 nt, Variola virus
cauuucacaauucau

SEQ ID NO: 4080707 - RNA, 22 nt, Variola virus
cauuugaugauauguuuggaau

SEQ ID NO: 4080708 - RNA, 12 nt, Variola virus
cauuugaugcac

SEQ ID NO: 4080709 - RNA, 17 nt, Variola virus
cauuuucacaaauacua

SEQ ID NO: 4080710 - RNA, 16 nt, Variola virus
cauuuucuuacaauua

SEQ ID NO: 4080711 - RNA, 19 nt, Variola virus
cauuuuuuauaaaaaacuu

SEQ ID NO: 4080712 - RNA, 18 nt, Variola virus
ccaaaauacaaaauguua

SEQ ID NO: 4080713 - RNA, 19 nt, Variola virus
ccaaacuccauaauuugcu

SEQ ID NO: 4080714 - RNA, 15 nt, Variola virus
ccaaacuguaaaugu

SEQ ID NO: 4080715 - RNA, 17 nt, Variola virus
ccaaacuguaaauguag

SEQ ID NO: 4080716 - RNA, 13 nt, Variola virus
ccaaacuuuuuua

SEQ ID NO: 4080717 - RNA, 20 nt, Variola virus
ccaaaggauguuuaacauuc

SEQ ID NO: 4080718 - RNA, 13 nt, Variola virus
ccaaauaucuuua

SEQ ID NO: 4080719 - RNA, 13 nt, Variola virus
ccaaaucugguaa

SEQ ID NO: 4080720 - RNA, 19 nt, Variola virus
ccaaaugcugucugugaaa

SEQ ID NO: 4080721 - RNA, 20 nt, Variola virus
ccaaauuuguuuuguuuauu

SEQ ID NO: 4080722 - RNA, 14 nt, Variola virus
ccaacaauuguuua

SEQ ID NO: 4080723 - RNA, 16 nt, Variola virus
ccaacggaaaugguag

SEQ ID NO: 4080724 - RNA, 20 nt, Variola virus
ccaacuucgccacccuugaa

SEQ ID NO: 4080725 - RNA, 20 nt, Variola virus
ccaagaaaauagaaauuugu

SEQ ID NO: 4080726 - RNA, 16 nt, Variola virus
ccaagauagaaacuau

SEQ ID NO: 4080727 - RNA, 14 nt, Variola virus
ccaaguagauaucu

SEQ ID NO: 4080728 - RNA, 22 nt, Variola virus
ccaaguaggugcaucuggagca

SEQ ID NO: 4080729 - RNA, 12 nt, Variola virus
ccaauaaaugac

SEQ ID NO: 4080730 - RNA, 12 nt, Variola virus
ccaauaguucuc

SEQ ID NO: 4080731 - RNA, 23 nt, Variola virus
ccaauaugucuguacaaauguua

SEQ ID NO: 4080732 - RNA, 21 nt, Variola virus
ccaaucaacgaauauccacua

SEQ ID NO: 4080733 - RNA, 17 nt, Variola virus
ccaaucauugauaucuu

SEQ ID NO: 4080734 - RNA, 19 nt, Variola virus
uauaaccaccgauaaaucu

SEQ ID NO: 4080735 - RNA, 19 nt, Variola virus
uauaacguuaugaaacgaa

SEQ ID NO: 4080736 - RNA, 16 nt, Variola virus
uauaacuauuaauauu

SEQ ID NO: 4080737 - RNA, 13 nt, Variola virus
uauaagaaugauu

SEQ ID NO: 4080738 - RNA, 14 nt, Variola virus
uauaaguagauguu

SEQ ID NO: 4080739 - RNA, 15 nt, Variola virus
uauaauaaauguaua

SEQ ID NO: 4080740 - RNA, 13 nt, Variola virus
uauaauagaucuu

SEQ ID NO: 4080741 - RNA, 15 nt, Variola virus
uauaaucguuaaauu

SEQ ID NO: 4080742 - RNA, 19 nt, Variola virus
uauaauuuacucucuauaa

SEQ ID NO: 4080743 - RNA, 18 nt, Variola virus
uauaauuucaucuacaau

SEQ ID NO: 4080744 - RNA, 21 nt, Variola virus
uauaauuuuuuuucuagauaa

SEQ ID NO: 4080745 - RNA, 22 nt, Variola virus
uauacaaauccauuaauacgga

SEQ ID NO: 4080746 - RNA, 13 nt, Variola virus
uauacaacuuuua

SEQ ID NO: 4080747 - RNA, 20 nt, Variola virus
uauacaaugaacuaauauga

SEQ ID NO: 4080748 - RNA, 15 nt, Variola virus
uauacaauuaaugau

SEQ ID NO: 4080749 - RNA, 20 nt, Variola virus
uauacacguuagauuauucu

SEQ ID NO: 4080750 - RNA, 17 nt, Variola virus
uauacauaauauuauca

SEQ ID NO: 4080751 - RNA, 22 nt, Variola virus
uauacauguuagagaauauuca

SEQ ID NO: 4080752 - RNA, 21 nt, Variola virus
uauaccacuauggauaccuug

SEQ ID NO: 4080753 - RNA, 18 nt, Variola virus
uauaccuuguaauuaaau

SEQ ID NO: 4080754 - RNA, 17 nt, Variola virus
uauacgaaaaaauagca

SEQ ID NO: 4080755 - RNA, 19 nt, Variola virus
uauacgaaauagauauuca

SEQ ID NO: 4080756 - RNA, 14 nt, Variola virus
uauacgaauacuau

SEQ ID NO: 4080757 - RNA, 13 nt, Variola virus
uauacuaauauga

SEQ ID NO: 4080758 - RNA, 21 nt, Variola virus
uauacuauauaguaauaccaa

SEQ ID NO: 4080759 - RNA, 24 nt, Variola virus
uauacugaguuggcuaugaucuug

SEQ ID NO: 4080760 - RNA, 16 nt, Variola virus
uauacuucauaaaaga

SEQ ID NO: 4080761 - RNA, 12 nt, Variola virus
uauagaacauca

SEQ ID NO: 4080762 - RNA, 23 nt, Variola virus
uauagagcccacguuuaaacauu

SEQ ID NO: 4080763 - RNA, 20 nt, Variola virus
uauagauggcuuguauguca

SEQ ID NO: 4080764 - RNA, 23 nt, Variola virus
uauagauucuugguaauuaauag

SEQ ID NO: 4080765 - RNA, 17 nt, Variola virus
uauagcuaaaaauguca

SEQ ID NO: 4080766 - RNA, 17 nt, Variola virus
uauagucuggaacacua

SEQ ID NO: 4080767 - RNA, 22 nt, Variola virus
uauaguuaauaguguacuacaa

SEQ ID NO: 4080768 - RNA, 17 nt, Variola virus
uauaguucuuaaucauu

SEQ ID NO: 4080769 - RNA, 19 nt, Variola virus
uauauaauccaucaacaau

SEQ ID NO: 4080770 - RNA, 21 nt, Variola virus
uauauagagccaagacgaaca

SEQ ID NO: 4080771 - RNA, 12 nt, Variola virus
uauauagauguc

SEQ ID NO: 4080772 - RNA, 15 nt, Variola virus
uauauaguuaagauu

SEQ ID NO: 4080773 - RNA, 20 nt, Variola virus
uauauauacugaaaaguuau

SEQ ID NO: 4080774 - RNA, 16 nt, Variola virus
uauauauccuuuugua

SEQ ID NO: 4080775 - RNA, 14 nt, Variola virus
uauauauuaucaua

SEQ ID NO: 4080776 - RNA, 15 nt, Variola virus
uauauauuugaaaau

SEQ ID NO: 4080777 - RNA, 13 nt, Variola virus
uauaucaauauca

SEQ ID NO: 4080778 - RNA, 17 nt, Variola virus
uauaucauuuguuuuaa

SEQ ID NO: 4080779 - RNA, 22 nt, Variola virus
uauaucgcauauuuauaucgug

SEQ ID NO: 4080780 - RNA, 15 nt, Variola virus
uauaucguuaucauu

SEQ ID NO: 4080781 - RNA, 21 nt, Variola virus
uauaugaacgauaauaacuua

SEQ ID NO: 4080782 - RNA, 19 nt, Variola virus
uauaugacuaacuuaucua

SEQ ID NO: 4080783 - RNA, 15 nt, Variola virus
uauaugagaugacuu

SEQ ID NO: 4080784 - RNA, 19 nt, Variola virus
uauaugcccuauuaucaua

SEQ ID NO: 4080785 - RNA, 21 nt, Variola virus
uauaugguauagggagaguau

SEQ ID NO: 4080786 - RNA, 19 nt, Variola virus
uauauggucuauauauaca

SEQ ID NO: 4080787 - RNA, 13 nt, Variola virus
uauauguaacauu

SEQ ID NO: 4080788 - RNA, 14 nt, Variola virus
uauaugugucucca

SEQ ID NO: 4080789 - RNA, 13 nt, Variola virus
uauauuaaaguca

SEQ ID NO: 4080790 - RNA, 13 nt, Variola virus
uauauuacgguau

SEQ ID NO: 4080791 - RNA, 22 nt, Variola virus
uauauuacgguaucuacuagau

SEQ ID NO: 4080792 - RNA, 15 nt, Variola virus
uauauuagagaagau

SEQ ID NO: 4080793 - RNA, 17 nt, Variola virus
uauauucauuuaauauu

SEQ ID NO: 4080794 - RNA, 16 nt, Variola virus
uauauucgaauucaaa

SEQ ID NO: 4080795 - RNA, 15 nt, Variola virus
uauauucuguuuuaa

SEQ ID NO: 4080796 - RNA, 15 nt, Variola virus
uauauucuuacagua

SEQ ID NO: 4080797 - RNA, 22 nt, Variola virus
uauauuuucacuuuaucucauu

SEQ ID NO: 4080798 - RNA, 16 nt, Variola virus
uauauuuucauuuaaa

SEQ ID NO: 4080799 - RNA, 12 nt, Variola virus
uauauuuugcau

SEQ ID NO: 4080800 - RNA, 22 nt, Variola virus
uaucaaagagaaggccaaagaa

SEQ ID NO: 4080801 - RNA, 14 nt, Variola virus
uaucaauagcaguu

SEQ ID NO: 4080802 - RNA, 18 nt, Variola virus
uaucaauccaacaaaugc

SEQ ID NO: 4080803 - RNA, 17 nt, Variola virus
uaucaauuaaauaauua

SEQ ID NO: 4080804 - RNA, 12 nt, Variola virus
uaucaauuuauc

SEQ ID NO: 4080805 - RNA, 19 nt, Variola virus
uaucaccgucgcuagauaa

SEQ ID NO: 4080806 - RNA, 14 nt, Variola virus
uaucagcuauugca

SEQ ID NO: 4080807 - RNA, 15 nt, Variola virus
uaucauaauuaaauu

SEQ ID NO: 4080808 - RNA, 21 nt, Variola virus
uaucauacaucggcuaccaaa

SEQ ID NO: 4080809 - RNA, 18 nt, Variola virus
uaucaucgacacaaauga

SEQ ID NO: 4080810 - RNA, 15 nt, Variola virus
uaucaucuacgauau

SEQ ID NO: 4080811 - RNA, 14 nt, Variola virus
uaucaucuauauca

SEQ ID NO: 4080812 - RNA, 14 nt, Variola virus
uaucaucuauauga

SEQ ID NO: 4080813 - RNA, 16 nt, Variola virus
uaucaucuauuagaga

SEQ ID NO: 4080814 - RNA, 18 nt, Variola virus
uaucauuaauuaauacaa

SEQ ID NO: 4080815 - RNA, 14 nt, Variola virus
uaucauuuacuaga

SEQ ID NO: 4080816 - RNA, 20 nt, Variola virus
uauccaaggacaaggaugaa

SEQ ID NO: 4080817 - RNA, 16 nt, Variola virus
uauccaauacagaaug

SEQ ID NO: 4080818 - RNA, 17 nt, Variola virus
uauccagauccuuuucu

SEQ ID NO: 4080819 - RNA, 22 nt, Variola virus
uauccaguuaagagaauaauag

SEQ ID NO: 4080820 - RNA, 17 nt, Variola virus
uauccaguuccuuuucu

SEQ ID NO: 4080821 - RNA, 20 nt, Variola virus
uauccaguuccuuuucuagu

SEQ ID NO: 4080822 - RNA, 18 nt, Variola virus
uauccauaaacaauauua

SEQ ID NO: 4080823 - RNA, 13 nt, Variola virus
uauccauuauucu

SEQ ID NO: 4080824 - RNA, 14 nt, Variola virus
uaucccccguauuu

SEQ ID NO: 4080825 - RNA, 19 nt, Variola virus
uauccguauuuccauaaua

SEQ ID NO: 4080826 - RNA, 14 nt, Variola virus
uaucgaauuucuac

SEQ ID NO: 4080827 - RNA, 24 nt, Variola virus
uaucgauguggaaauuacacugua

SEQ ID NO: 4080828 - RNA, 21 nt, Variola virus
uaucgauuagucuuaaugaua

SEQ ID NO: 4080829 - RNA, 15 nt, Variola virus
uaucgcgacauauau

SEQ ID NO: 4080830 - RNA, 21 nt, Variola virus
uaucgcuggaagggacuauau

SEQ ID NO: 4080831 - RNA, 16 nt, Variola virus
uaucggacuacuuauu

SEQ ID NO: 4080832 - RNA, 16 nt, Variola virus
uaucggaggaauuaag

SEQ ID NO: 4080833 - RNA, 19 nt, Variola virus
uaucggcauuuauguuucu

SEQ ID NO: 4080834 - RNA, 14 nt, Variola virus
uaucuaacaucuug

SEQ ID NO: 4080835 - RNA, 13 nt, Variola virus
uaucuacaucuuc

SEQ ID NO: 4080836 - RNA, 17 nt, Variola virus
uaucuaccucuccaaaa

SEQ ID NO: 4080837 - RNA, 22 nt, Variola virus
uaucuacgauuuuuacaaaagu

SEQ ID NO: 4080838 - RNA, 15 nt, Variola virus
uaucuagcaaagauu

SEQ ID NO: 4080839 - RNA, 17 nt, Variola virus
uaucucaauaguuucau

SEQ ID NO: 4080840 - RNA, 18 nt, Variola virus
uaucucagugcaaagauu

SEQ ID NO: 4080841 - RNA, 18 nt, Variola virus
uaucucauucaaauccau

SEQ ID NO: 4080842 - RNA, 14 nt, Variola virus
uaucucuuaaugag

SEQ ID NO: 4080843 - RNA, 20 nt, Variola virus
uaucugaguauaguguucau

SEQ ID NO: 4080844 - RNA, 13 nt, Variola virus
uaucugaugauau

SEQ ID NO: 4080845 - RNA, 16 nt, Variola virus
uaucugguucuaaaag

SEQ ID NO: 4080846 - RNA, 20 nt, Variola virus
uaucuuauauacacauaauu

SEQ ID NO: 4080847 - RNA, 21 nt, Variola virus
uaucuuauguauauguuugua

SEQ ID NO: 4080848 - RNA, 12 nt, Variola virus
uaucuucucaaa

SEQ ID NO: 4080849 - RNA, 17 nt, Variola virus
uaucuugguaauacuua

SEQ ID NO: 4080850 - RNA, 13 nt, Variola virus
uaucuuucaagau

SEQ ID NO: 4080851 - RNA, 13 nt, Variola virus
uaugaaauuuaag

SEQ ID NO: 4080852 - RNA, 17 nt, Variola virus
uaugaauaaucuucauu

SEQ ID NO: 4080853 - RNA, 14 nt, Variola virus
uaugaaucauacag

SEQ ID NO: 4080854 - RNA, 12 nt, Variola virus
uaugaaugacuc

SEQ ID NO: 4080855 - RNA, 14 nt, Variola virus
uaugacuuaauagc

SEQ ID NO: 4080856 - RNA, 22 nt, Variola virus
uaugagggaaaagauucucauu

SEQ ID NO: 4080857 - RNA, 18 nt, Variola virus
uaugauagaaauuagcaa

SEQ ID NO: 4080858 - RNA, 15 nt, Variola virus
uaugauaucauguaa

SEQ ID NO: 4080859 - RNA, 13 nt, Variola virus
uaugauauucauu

SEQ ID NO: 4080860 - RNA, 19 nt, Variola virus
uaugauccaauguguuuaa

SEQ ID NO: 4080861 - RNA, 15 nt, Variola virus
ucaaggaacaaauau

SEQ ID NO: 4080862 - RNA, 16 nt, Variola virus
ucaaguaaagauuuca

SEQ ID NO: 4080863 - RNA, 17 nt, Variola virus
ucaaguaaagauuucaa

SEQ ID NO: 4080864 - RNA, 17 nt, Variola virus
ucaaguuuguaggaaag

SEQ ID NO: 4080865 - RNA, 20 nt, Variola virus
ucaauaacuggcacaacaau

SEQ ID NO: 4080866 - RNA, 14 nt, Variola virus
ucaauaauuucagg

SEQ ID NO: 4080867 - RNA, 20 nt, Variola virus
ucaauacaccaauagaugau

SEQ ID NO: 4080868 - RNA, 12 nt, Variola virus
ucaauagaagau

SEQ ID NO: 4080869 - RNA, 17 nt, Variola virus
ucaauagauuauacauc

SEQ ID NO: 4080870 - RNA, 16 nt, Variola virus
ucaauaguuucauaau

SEQ ID NO: 4080871 - RNA, 20 nt, Variola virus
ucaaucaaaagacuauacau

SEQ ID NO: 4080872 - RNA, 21 nt, Variola virus
ucaaucaaaagacuauacauu

SEQ ID NO: 4080873 - RNA, 17 nt, Variola virus
ucaaucacuacaucuuu

SEQ ID NO: 4080874 - RNA, 19 nt, Variola virus
ucaauuaauaaaguaguau

SEQ ID NO: 4080875 - RNA, 13 nt, Variola virus
ucaauuacuacaa

SEQ ID NO: 4080876 - RNA, 22 nt, Variola virus
ucacaaguaugaagaaaaaugu

SEQ ID NO: 4080877 - RNA, 15 nt, Variola virus
ucacauacuuuguaa

SEQ ID NO: 4080878 - RNA, 12 nt, Variola virus
ucaccaauaaaa

SEQ ID NO: 4080879 - RNA, 22 nt, Variola virus
ucacgauaucucuuaaaugcua

SEQ ID NO: 4080880 - RNA, 15 nt, Variola virus
ucacguaaauacaaa

SEQ ID NO: 4080881 - RNA, 17 nt, Variola virus
ucacuaacaauaacuag

SEQ ID NO: 4080882 - RNA, 18 nt, Variola virus
ucacuaauucuagucuuu

SEQ ID NO: 4080883 - RNA, 14 nt, Variola virus
ucacuagaaacuag

SEQ ID NO: 4080884 - RNA, 20 nt, Variola virus
ucacuauaagaaaucagaau

SEQ ID NO: 4080885 - RNA, 21 nt, Variola virus
ucacuuaacaauuccacaaau

SEQ ID NO: 4080886 - RNA, 16 nt, Variola virus
ucacuucugucuacau

SEQ ID NO: 4080887 - RNA, 21 nt, Variola virus
ucagaaagaguucccacaugu

SEQ ID NO: 4080888 - RNA, 17 nt, Variola virus
ucagaaagcuguggaug

SEQ ID NO: 4080889 - RNA, 22 nt, Variola virus
ucagaaauuaguuuagagucaa

SEQ ID NO: 4080890 - RNA, 22 nt, Variola virus
ucagaauaggaugaauguagua

SEQ ID NO: 4080891 - RNA, 21 nt, Variola virus
ucagaaucaaauauagaucuu

SEQ ID NO: 4080892 - RNA, 14 nt, Variola virus
ucagaaucguauau

SEQ ID NO: 4080893 - RNA, 13 nt, Variola virus
ucagacaacaucu

SEQ ID NO: 4080894 - RNA, 15 nt, Variola virus
ucagagaacuucugc

SEQ ID NO: 4080895 - RNA, 19 nt, Variola virus
ucagaguucagugaagaag

SEQ ID NO: 4080896 - RNA, 17 nt, Variola virus
ucagcauccacucauau

SEQ ID NO: 4080897 - RNA, 17 nt, Variola virus
ucagcauuacuugauau

SEQ ID NO: 4080898 - RNA, 16 nt, Variola virus
ucagcugaaaaacuau

SEQ ID NO: 4080899 - RNA, 12 nt, Variola virus
ucaggaaaugua

SEQ ID NO: 4080900 - RNA, 18 nt, Variola virus
ucagucuggaaacuauca

SEQ ID NO: 4080901 - RNA, 13 nt, Variola virus
ucaguuacaaaac

SEQ ID NO: 4080902 - RNA, 17 nt, Variola virus
ucauaaaaaaaaguuuu

SEQ ID NO: 4080903 - RNA, 20 nt, Variola virus
ucauaaaacgauuggaaucu

SEQ ID NO: 4080904 - RNA, 15 nt, Variola virus
ucauaaauucuuuaa

SEQ ID NO: 4080905 - RNA, 13 nt, Variola virus
ucauaauaaauuu

SEQ ID NO: 4080906 - RNA, 17 nt, Variola virus
ucauaauaugagauguu

SEQ ID NO: 4080907 - RNA, 20 nt, Variola virus
ucauacgauaugccuccaga

SEQ ID NO: 4080908 - RNA, 15 nt, Variola virus
ucauagauucuuuaa

SEQ ID NO: 4080909 - RNA, 14 nt, Variola virus
ucauauaacacuca

SEQ ID NO: 4080910 - RNA, 23 nt, Variola virus
ucauaucuagaaugaagauauca

SEQ ID NO: 4080911 - RNA, 12 nt, Variola virus
ucauauguagug

SEQ ID NO: 4080912 - RNA, 14 nt, Variola virus
ucaucaaaauacug

SEQ ID NO: 4080913 - RNA, 12 nt, Variola virus
ucaucaauaaag

SEQ ID NO: 4080914 - RNA, 14 nt, Variola virus
ucaucaauguagug

SEQ ID NO: 4080915 - RNA, 13 nt, Variola virus
ucaucauuucuaa

SEQ ID NO: 4080916 - RNA, 17 nt, Variola virus
ucauccagaucauuaag

SEQ ID NO: 4080917 - RNA, 16 nt, Variola virus
ucauccgauauuauug

SEQ ID NO: 4080918 - RNA, 14 nt, Variola virus
ucauccgucucauu

SEQ ID NO: 4080919 - RNA, 18 nt, Variola virus
ucauccuuguucaucauu

SEQ ID NO: 4080920 - RNA, 23 nt, Variola virus
ucaucgaacuucugaucauuaau

SEQ ID NO: 4080921 - RNA, 15 nt, Variola virus
ucaucuaagaaauag

SEQ ID NO: 4080922 - RNA, 12 nt, Variola virus
ucaucuguuuua

SEQ ID NO: 4080923 - RNA, 22 nt, Variola virus
ucaugaaucaauuaguagaguu

SEQ ID NO: 4080924 - RNA, 16 nt, Variola virus
ucauggaauacauaaa

SEQ ID NO: 4080925 - RNA, 13 nt, Variola virus
ucauguaaauguu

SEQ ID NO: 4080926 - RNA, 17 nt, Variola virus
ucauguagaaaaauucu

SEQ ID NO: 4080927 - RNA, 14 nt, Variola virus
ucauguagauaguu

SEQ ID NO: 4080928 - RNA, 16 nt, Variola virus
ucauuaacuagacguu

SEQ ID NO: 4080929 - RNA, 22 nt, Variola virus
ucauuaacucuagaaaucugaa

SEQ ID NO: 4080930 - RNA, 17 nt, Variola virus
ucauuaaucauuucuaa

SEQ ID NO: 4080931 - RNA, 15 nt, Variola virus
ucauuaauugagaaa

SEQ ID NO: 4080932 - RNA, 22 nt, Variola virus
ucauuaauugagaaaaaacuaa

SEQ ID NO: 4080933 - RNA, 15 nt, Variola virus
ucauucaagauaagc

SEQ ID NO: 4080934 - RNA, 22 nt, Variola virus
ucauuccaucauuuaagaaggc

SEQ ID NO: 4080935 - RNA, 15 nt, Variola virus
ucauucguaaaucuu

SEQ ID NO: 4080936 - RNA, 18 nt, Variola virus
ucauucuuaagacacauu

SEQ ID NO: 4080937 - RNA, 15 nt, Variola virus
ucauugcuuucuaga

SEQ ID NO: 4080938 - RNA, 15 nt, Variola virus
ucauuuccugcacgu

SEQ ID NO: 4080939 - RNA, 19 nt, Variola virus
ucauuucuccaaagaauau

SEQ ID NO: 4080940 - RNA, 15 nt, Variola virus
ucauuuuauaauugu

SEQ ID NO: 4080941 - RNA, 14 nt, Variola virus
ucauuuucuacaau

SEQ ID NO: 4080942 - RNA, 18 nt, Variola virus
ucauuuucuauuuaaaau

SEQ ID NO: 4080943 - RNA, 17 nt, Variola virus
ucauuuucuucaacaaa

SEQ ID NO: 4080944 - RNA, 18 nt, Variola virus
ucauuuuuuuaggaguau

SEQ ID NO: 4080945 - RNA, 18 nt, Variola virus
uccaaaaacacaacaaau

SEQ ID NO: 4080946 - RNA, 12 nt, Variola virus
uccaaauaacuc

SEQ ID NO: 4080947 - RNA, 17 nt, Variola virus
uccaaauugcgacacua

SEQ ID NO: 4080948 - RNA, 16 nt, Variola virus
uccaacaauagcuuua

SEQ ID NO: 4080949 - RNA, 15 nt, Variola virus
uccaaguucuauagu

SEQ ID NO: 4080950 - RNA, 22 nt, Variola virus
uccaauaaauuaucaaauacuu

SEQ ID NO: 4080951 - RNA, 15 nt, Variola virus
uccaauaaauuauuu

SEQ ID NO: 4080952 - RNA, 13 nt, Variola virus
uccaauguauuua

SEQ ID NO: 4080953 - RNA, 15 nt, Variola virus
uccaauuuuucuuaa

SEQ ID NO: 4080954 - RNA, 16 nt, Variola virus
uccacaaauaguaaau

SEQ ID NO: 4080955 - RNA, 15 nt, Variola virus
uccacuauacauucu

SEQ ID NO: 4080956 - RNA, 22 nt, Variola virus
uccacuucugcagaauaauuag

SEQ ID NO: 4080957 - RNA, 19 nt, Variola virus
uccagaacaucuuccauag

SEQ ID NO: 4080958 - RNA, 12 nt, Variola virus
uccagaauguac

SEQ ID NO: 4080959 - RNA, 23 nt, Variola virus
uccagauauauaucuuuucagcu

SEQ ID NO: 4080960 - RNA, 13 nt, Variola virus
uccagauuacuaa

SEQ ID NO: 4080961 - RNA, 15 nt, Variola virus
uccagauuucauaau

SEQ ID NO: 4080962 - RNA, 16 nt, Variola virus
uccaguuccuuuucua

SEQ ID NO: 4080963 - RNA, 14 nt, Variola virus
uccauaaacugaua

SEQ ID NO: 4080964 - RNA, 23 nt, Variola virus
uccauagacagcuucuagaaguu

SEQ ID NO: 4080965 - RNA, 12 nt, Variola virus
uccauaggaaag

SEQ ID NO: 4080966 - RNA, 17 nt, Variola virus
uccauauuuuagaauau

SEQ ID NO: 4080967 - RNA, 16 nt, Variola virus
uccaucuacuuuucca

SEQ ID NO: 4080968 - RNA, 19 nt, Variola virus
uccaugauucuaucucuaa

SEQ ID NO: 4080969 - RNA, 18 nt, Variola virus
uccaugcaacauuuccua

SEQ ID NO: 4080970 - RNA, 19 nt, Variola virus
uccauggaagaacuaccaa

SEQ ID NO: 4080971 - RNA, 16 nt, Variola virus
uccauuaaauaaugua

SEQ ID NO: 4080972 - RNA, 13 nt, Variola virus
uccauuuauacau

SEQ ID NO: 4080973 - RNA, 11 nt, Variola virus
uccauuucuag

SEQ ID NO: 4080974 - RNA, 15 nt, Variola virus
uccauuuucccaaau

SEQ ID NO: 4080975 - RNA, 20 nt, Variola virus
ucccaaauguuggaaaauag

SEQ ID NO: 4080976 - RNA, 14 nt, Variola virus
ucccacaaauacug

SEQ ID NO: 4080977 - RNA, 18 nt, Variola virus
ucccacaguguugccauu

SEQ ID NO: 4080978 - RNA, 11 nt, Variola virus
ucccagcauua

SEQ ID NO: 4080979 - RNA, 12 nt, Variola virus
ucccauguuuca

SEQ ID NO: 4080980 - RNA, 21 nt, Variola virus
uccccaaaaguaaaauaauca

SEQ ID NO: 4080981 - RNA, 15 nt, Variola virus
ucccuuguguaacgu

SEQ ID NO: 4080982 - RNA, 13 nt, Variola virus
uccgaguaaaaug

SEQ ID NO: 4080983 - RNA, 16 nt, Variola virus
uccgaugauuaaugac

SEQ ID NO: 4080984 - RNA, 20 nt, Variola virus
uccgauuuaccguuacuaau

SEQ ID NO: 4080985 - RNA, 17 nt, Variola virus
uccggagauagauuucc

SEQ ID NO: 4080986 - RNA, 20 nt, Variola virus
uccguaacggaaauuacaga

SEQ ID NO: 4080987 - RNA, 16 nt, Variola virus
uccgugagaaauacgu

SEQ ID NO: 4080988 - RNA, 15 nt, Variola virus
ucgaacauacaaaaa

SEQ ID NO: 4080989 - RNA, 14 nt, Variola virus
ucgaauaaugagua

SEQ ID NO: 4080990 - RNA, 17 nt, Variola virus
ucgaauacgauacuuau

SEQ ID NO: 4080991 - RNA, 20 nt, Variola virus
ucgacuauuuuaaauagcau

SEQ ID NO: 4080992 - RNA, 23 nt, Variola virus
ucgacucauaagaaagagaauag

SEQ ID NO: 4080993 - RNA, 20 nt, Variola virus
ucgagaugaacauucaucug

SEQ ID NO: 4080994 - RNA, 17 nt, Variola virus
ucgaggauaucauccaa

SEQ ID NO: 4080995 - RNA, 20 nt, Variola virus
ucgaugaaauaucugauguu

SEQ ID NO: 4080996 - RNA, 14 nt, Variola virus
ucgauuucuggaua

SEQ ID NO: 4080997 - RNA, 15 nt, Variola virus
ucgauuuuuagauuu

SEQ ID NO: 4080998 - RNA, 21 nt, Variola virus
ucgcccucaauuucccaaaua

SEQ ID NO: 4080999 - RNA, 20 nt, Variola virus
ucgcuaauguauagauuguu

SEQ ID NO: 4081000 - RNA, 14 nt, Variola virus
ucgcuauauguucc

SEQ ID NO: 4081001 - RNA, 15 nt, Variola virus
ucgcuuucauaguua

SEQ ID NO: 4081002 - RNA, 21 nt, Variola virus
ucgcuuucugguaacaugaua

SEQ ID NO: 4081003 - RNA, 22 nt, Variola virus
ucggcaacauacuauuguacau

SEQ ID NO: 4081004 - RNA, 19 nt, Variola virus
ucgguaucugaaguacuua

SEQ ID NO: 4081005 - RNA, 14 nt, Variola virus
ucguaaaaaguuuu

SEQ ID NO: 4081006 - RNA, 22 nt, Variola virus
ucguaauuggaaaauuaguguu

SEQ ID NO: 4081007 - RNA, 13 nt, Variola virus
ucguacauccagg

SEQ ID NO: 4081008 - RNA, 15 nt, Variola virus
ucguacuauauacaa

SEQ ID NO: 4081009 - RNA, 13 nt, Variola virus
ucguagauuuuaa

SEQ ID NO: 4081010 - RNA, 18 nt, Variola virus
ucguagauuuuaauguau

SEQ ID NO: 4081011 - RNA, 18 nt, Variola virus
ucguaguaaguuaaccaa

SEQ ID NO: 4081012 - RNA, 14 nt, Variola virus
ucguauaaaguuau

SEQ ID NO: 4081013 - RNA, 17 nt, Variola virus
ucguauaccauuucuag

SEQ ID NO: 4081014 - RNA, 19 nt, Variola virus
ucguauuggauucugaaau

SEQ ID NO: 4081015 - RNA, 12 nt, Variola virus
ucgucuuuagag

SEQ ID NO: 4081016 - RNA, 14 nt, Variola virus
ucgugaauaauguu

SEQ ID NO: 4081017 - RNA, 12 nt, Variola virus
ucguuacaaaag

SEQ ID NO: 4081018 - RNA, 21 nt, Variola virus
ucguucaacugucuuucaaga

SEQ ID NO: 4081019 - RNA, 16 nt, Variola virus
ucguucgaucuaaaau

SEQ ID NO: 4081020 - RNA, 11 nt, Variola virus
ucguuuggauu

SEQ ID NO: 4081021 - RNA, 17 nt, Variola virus
ucuaaaaacaauacagu

SEQ ID NO: 4081022 - RNA, 20 nt, Variola virus
ucuaaaauguauaacaaaug

SEQ ID NO: 4081023 - RNA, 16 nt, Variola virus
ucuaaacaacaaacaa

SEQ ID NO: 4081024 - RNA, 16 nt, Variola virus
ucuaagauuauuuuaa

SEQ ID NO: 4081025 - RNA, 21 nt, Variola virus
ucuaauauaaucuuuaguauu

SEQ ID NO: 4081026 - RNA, 19 nt, Variola virus
ucuaauuuccugauucaga

SEQ ID NO: 4081027 - RNA, 14 nt, Variola virus
ucuacaugaaauag

SEQ ID NO: 4081028 - RNA, 18 nt, Variola virus
ucuaccagcuggaaaaag

SEQ ID NO: 4081029 - RNA, 15 nt, Variola virus
ucuacgaagaaaguu

SEQ ID NO: 4081030 - RNA, 19 nt, Variola virus
ucuacgauuuuuacaaaag

SEQ ID NO: 4081031 - RNA, 19 nt, Variola virus
ucuacuagacuauuaauaa

SEQ ID NO: 4081032 - RNA, 21 nt, Variola virus
ucuagacgauuaguaauauau

SEQ ID NO: 4081033 - RNA, 15 nt, Variola virus
ucuagagauuguacu

SEQ ID NO: 4081034 - RNA, 17 nt, Variola virus
ucuagagugaguuuagg

SEQ ID NO: 4081035 - RNA, 19 nt, Variola virus
ucuagauacuagaguagua

SEQ ID NO: 4081036 - RNA, 20 nt, Variola virus
ucuagauacuagaguaguau

SEQ ID NO: 4081037 - RNA, 14 nt, Variola virus
ucuagauauuagua

SEQ ID NO: 4081038 - RNA, 18 nt, Variola virus
ucuagaucucuagaauau

SEQ ID NO: 4081039 - RNA, 14 nt, Variola virus
ucuagcauuucuag

SEQ ID NO: 4081040 - RNA, 23 nt, Variola virus
ucuagcuuauugaguggaaaguu

SEQ ID NO: 4081041 - RNA, 18 nt, Variola virus
ucuagucgcaucucuuaa

SEQ ID NO: 4081042 - RNA, 19 nt, Variola virus
ucuaguugauauuccaacc

SEQ ID NO: 4081043 - RNA, 18 nt, Variola virus
ucuauaaagucugucaaa

SEQ ID NO: 4081044 - RNA, 23 nt, Variola virus
ucuauacagcgaauaaauucaga

SEQ ID NO: 4081045 - RNA, 22 nt, Variola virus
ucuauacgauaguuuguuucua

SEQ ID NO: 4081046 - RNA, 19 nt, Variola virus
ucuauaguuuguuuucauu

SEQ ID NO: 4081047 - RNA, 24 nt, Variola virus
ucuauauauacacuacaauuuagu

SEQ ID NO: 4081048 - RNA, 14 nt, Variola virus
ucuaucauagauuu

SEQ ID NO: 4081049 - RNA, 17 nt, Variola virus
ucuauccaagauacuua

SEQ ID NO: 4081050 - RNA, 20 nt, Variola virus
ucuauccauuguuucacauu

SEQ ID NO: 4081051 - RNA, 20 nt, Variola virus
ucuaugaauauaauagaugu

SEQ ID NO: 4081052 - RNA, 19 nt, Variola virus
ucuaugaucugucuuuuaa

SEQ ID NO: 4081053 - RNA, 19 nt, Variola virus
ucuauuaaagauuguuuaa

SEQ ID NO: 4081054 - RNA, 18 nt, Variola virus
ucuauuagauguguauaa

SEQ ID NO: 4081055 - RNA, 15 nt, Variola virus
ucuauuauacauuua

SEQ ID NO: 4081056 - RNA, 18 nt, Variola virus
ucuauuauauuuaggaua

SEQ ID NO: 4081057 - RNA, 12 nt, Variola virus
ucuauucaagau

SEQ ID NO: 4081058 - RNA, 17 nt, Variola virus
ucuauuguaguguauaa

SEQ ID NO: 4081059 - RNA, 14 nt, Variola virus
ucuauuguuuggaa

SEQ ID NO: 4081060 - RNA, 15 nt, Variola virus
ucuauuuaauacuuu

SEQ ID NO: 4081061 - RNA, 20 nt, Variola virus
ucuauuucaucguuuuguau

SEQ ID NO: 4081062 - RNA, 18 nt, Variola virus
ucuauuuuaucauuuucc

SEQ ID NO: 4081063 - RNA, 15 nt, Variola virus
ucucaauacaaccaa

SEQ ID NO: 4081064 - RNA, 12 nt, Variola virus
ucucaauacuaa

SEQ ID NO: 4081065 - RNA, 17 nt, Variola virus
ucucacaaaaaaguuuu

SEQ ID NO: 4081066 - RNA, 23 nt, Variola virus
ucucaucaucagaauaaaucaau

SEQ ID NO: 4081067 - RNA, 17 nt, Variola virus
ucucauuaauuaaccau

SEQ ID NO: 4081068 - RNA, 16 nt, Variola virus
ucuccagauuucauaa

SEQ ID NO: 4081069 - RNA, 18 nt, Variola virus
ucuccauaaagaaauuag

SEQ ID NO: 4081070 - RNA, 18 nt, Variola virus
ucucccauuaucuuggua

SEQ ID NO: 4081071 - RNA, 22 nt, Variola virus
ucuccgcaauacauuucucaaa

SEQ ID NO: 4081072 - RNA, 19 nt, Variola virus
ucucguauucaguuucauc

SEQ ID NO: 4081073 - RNA, 18 nt, Variola virus
ucucuaacgguaccauaa

SEQ ID NO: 4081074 - RNA, 16 nt, Variola virus
ucucuaagaggaugag

SEQ ID NO: 4081075 - RNA, 14 nt, Variola virus
ucucuaaguuucuu

SEQ ID NO: 4081076 - RNA, 16 nt, Variola virus
ucucuauaacaaaugu

SEQ ID NO: 4081077 - RNA, 10 nt, Variola virus
ucucuauaga

SEQ ID NO: 4081078 - RNA, 14 nt, Variola virus
ucucucaaaucaga

SEQ ID NO: 4081079 - RNA, 22 nt, Variola virus
ucucugaauauagaacaucauu

SEQ ID NO: 4081080 - RNA, 15 nt, Variola virus
ucucugacauucaga

SEQ ID NO: 4081081 - RNA, 16 nt, Variola virus
ucucuguaagauuucc

SEQ ID NO: 4081082 - RNA, 22 nt, Variola virus
ucucuguuuaaugaauuacuaa

SEQ ID NO: 4081083 - RNA, 18 nt, Variola virus
ucucuuaguaaguuuauu

SEQ ID NO: 4081084 - RNA, 19 nt, Variola virus
ucugaaaauccacuaacaa

SEQ ID NO: 4081085 - RNA, 21 nt, Variola virus
ucugaaauaacauauagauuu

SEQ ID NO: 4081086 - RNA, 18 nt, Variola virus
ucugaaauuccaucuaga

SEQ ID NO: 4081087 - RNA, 13 nt, Variola virus
ucugaauaaacaa

SEQ ID NO: 4081088 - RNA, 17 nt, Variola virus
ucugaauagauccacca

SEQ ID NO: 4081089 - RNA, 18 nt, Variola virus
ucugacaauauuuaguuu

SEQ ID NO: 4081090 - RNA, 13 nt, Variola virus
ucugacauucaga

SEQ ID NO: 4081091 - RNA, 20 nt, Variola virus
ucugauaauccagucuuuaa

SEQ ID NO: 4081092 - RNA, 15 nt, Variola virus
ucugcggauuuauaa

SEQ ID NO: 4081093 - RNA, 19 nt, Variola virus
ucugcguguaaaaaguugu

SEQ ID NO: 4081094 - RNA, 18 nt, Variola virus
ucugcuccuuuuucuauu

SEQ ID NO: 4081095 - RNA, 22 nt, Variola virus
ucuggaaaaacaacacaaugua

SEQ ID NO: 4081096 - RNA, 13 nt, Variola virus
ucuggaauuaaaa

SEQ ID NO: 4081097 - RNA, 20 nt, Variola virus
ucugguaccuauucuagaaa

SEQ ID NO: 4081098 - RNA, 19 nt, Variola virus
ucuguaaaccacaauuugc

SEQ ID NO: 4081099 - RNA, 15 nt, Variola virus
ucugucagaaaauac

SEQ ID NO: 4081100 - RNA, 16 nt, Variola virus
ucugucucagaaucaa

SEQ ID NO: 4081101 - RNA, 20 nt, Variola virus
ugaugacacuagaugauuug

SEQ ID NO: 4081102 - RNA, 14 nt, Variola virus
ugaugauagagaua

SEQ ID NO: 4081103 - RNA, 17 nt, Variola virus
ugaugauauguuuggaa

SEQ ID NO: 4081104 - RNA, 21 nt, Variola virus
ugaugguagucaauugauguu

SEQ ID NO: 4081105 - RNA, 13 nt, Variola virus
ugauguucauaua

SEQ ID NO: 4081106 - RNA, 23 nt, Variola virus
ugauuaacagaaaaaacaauguu

SEQ ID NO: 4081107 - RNA, 17 nt, Variola virus
ugauuacauuuuugaua

SEQ ID NO: 4081108 - RNA, 20 nt, Variola virus
ugauuagaaaauauaaauua

SEQ ID NO: 4081109 - RNA, 20 nt, Variola virus
ugauuccuaggucuacagaa

SEQ ID NO: 4081110 - RNA, 14 nt, Variola virus
ugauucuaucuaca

SEQ ID NO: 4081111 - RNA, 11 nt, Variola virus
ugauugaagaa

SEQ ID NO: 4081112 - RNA, 19 nt, Variola virus
ugauugacaaauuauucua

SEQ ID NO: 4081113 - RNA, 19 nt, Variola virus
ugauugauuauuucaaaga

SEQ ID NO: 4081114 - RNA, 17 nt, Variola virus
ugauugcagauuugcca

SEQ ID NO: 4081115 - RNA, 18 nt, Variola virus
ugauuguaaacacagaua

SEQ ID NO: 4081116 - RNA, 13 nt, Variola virus
ugauuuacucauu

SEQ ID NO: 4081117 - RNA, 19 nt, Variola virus
ugcaaauaaaauauacugu

SEQ ID NO: 4081118 - RNA, 16 nt, Variola virus
ugcaagauacaugcua

SEQ ID NO: 4081119 - RNA, 21 nt, Variola virus
ugcacagcgaagaauucuaga

SEQ ID NO: 4081120 - RNA, 14 nt, Variola virus
uuuaaaaugaucua

SEQ ID NO: 4081121 - RNA, 19 nt, Variola virus
uuuaaaauuagaucuuuua

SEQ ID NO: 4081122 - RNA, 12 nt, Variola virus
uuuaaacugaaa

SEQ ID NO: 4081123 - RNA, 20 nt, Variola virus
uuuaaauauuauauaaacau

SEQ ID NO: 4081124 - RNA, 18 nt, Variola virus
uuuaaaucccaauucaga

SEQ ID NO: 4081125 - RNA, 18 nt, Variola virus
uuuaacaaaguuauucau

SEQ ID NO: 4081126 - RNA, 12 nt, Variola virus
uuuaacacuaua

SEQ ID NO: 4081127 - RNA, 16 nt, Variola virus
uuuaaccuauacauga

SEQ ID NO: 4081128 - RNA, 17 nt, Variola virus
uuuaacuagucuucucu

SEQ ID NO: 4081129 - RNA, 23 nt, Variola virus
uuuaacuugcgggguuaaucuca

SEQ ID NO: 4081130 - RNA, 14 nt, Variola virus
uuuaacuuuucauu

SEQ ID NO: 4081131 - RNA, 15 nt, Variola virus
uuuaagauuguacac

SEQ ID NO: 4081132 - RNA, 23 nt, Variola virus
uuuaauauccaaucuuauuacuu

SEQ ID NO: 4081133 - RNA, 13 nt, Variola virus
uuuaauauuucga

SEQ ID NO: 4081134 - RNA, 13 nt, Variola virus
uuuaauuuguuga

SEQ ID NO: 4081135 - RNA, 14 nt, Variola virus
uuuacaaaacuggu

SEQ ID NO: 4081136 - RNA, 19 nt, Variola virus
uuuacaacacuuuucuauu

SEQ ID NO: 4081137 - RNA, 15 nt, Variola virus
uuuacaagauuauua

SEQ ID NO: 4081138 - RNA, 16 nt, Variola virus
uuuacagaucuaguau

SEQ ID NO: 4081139 - RNA, 13 nt, Variola virus
uuuacauuauuua

SEQ ID NO: 4081140 - RNA, 21 nt, Variola virus
uuuaccaugugaugcuaauau

SEQ ID NO: 4081141 - RNA, 17 nt, Variola virus
uuuaccucuucugauau

SEQ ID NO: 4081142 - RNA, 14 nt, Variola virus
uuuacgcuauuaaa

SEQ ID NO: 4081143 - RNA, 22 nt, Variola virus
uuuacuccucuccuuccguaaa

SEQ ID NO: 4081144 - RNA, 18 nt, Variola virus
uuuacuguggcuagauac

SEQ ID NO: 4081145 - RNA, 18 nt, Variola virus
uuuacuuuuucaucuuua

SEQ ID NO: 4081146 - RNA, 16 nt, Variola virus
uuuagaagugauucuu

SEQ ID NO: 4081147 - RNA, 14 nt, Variola virus
uuuagauuuauuuu

SEQ ID NO: 4081148 - RNA, 15 nt, Variola virus
uuuagcaauuucuga

SEQ ID NO: 4081149 - RNA, 13 nt, Variola virus
uuuagcauuucua

SEQ ID NO: 4081150 - RNA, 17 nt, Variola virus
uuuagcguggcuagaau

SEQ ID NO: 4081151 - RNA, 21 nt, Variola virus
uuuaggauucauuagacguag

SEQ ID NO: 4081152 - RNA, 14 nt, Variola virus
uuuaguauaaacag

SEQ ID NO: 4081153 - RNA, 15 nt, Variola virus
uuuaguauuaaacag

SEQ ID NO: 4081154 - RNA, 14 nt, Variola virus
uuuagucgagauau

SEQ ID NO: 4081155 - RNA, 14 nt, Variola virus
uuuaguguagauau

SEQ ID NO: 4081156 - RNA, 14 nt, Variola virus
uuuaguuuaucaaa

SEQ ID NO: 4081157 - RNA, 16 nt, Variola virus
uuuauaaaaaacuuuu

SEQ ID NO: 4081158 - RNA, 12 nt, Variola virus
uuuauacaagau

SEQ ID NO: 4081159 - RNA, 18 nt, Variola virus
uuuauacauauucuaaug

SEQ ID NO: 4081160 - RNA, 15 nt, Variola virus
uuuauacuucuaaug

SEQ ID NO: 4081161 - RNA, 20 nt, Variola virus
uuuauaucacauuguauaua

SEQ ID NO: 4081162 - RNA, 21 nt, Variola virus
uuuauaucauuuguuuuaauu

SEQ ID NO: 4081163 - RNA, 19 nt, Variola virus
uuuauaucugauuuuucuu

SEQ ID NO: 4081164 - RNA, 23 nt, Variola virus
uuuaucagaagauggauggauga

SEQ ID NO: 4081165 - RNA, 16 nt, Variola virus
uuuaucaguauguaua

SEQ ID NO: 4081166 - RNA, 17 nt, Variola virus
uuuauccuauuauguaa

SEQ ID NO: 4081167 - RNA, 15 nt, Variola virus
uuuauuaaguguauu

SEQ ID NO: 4081168 - RNA, 18 nt, Variola virus
uuuauuagcguacacauu

SEQ ID NO: 4081169 - RNA, 15 nt, Variola virus
uuuauuccaaucauu

SEQ ID NO: 4081170 - RNA, 16 nt, Variola virus
uuuauuccacaugagu

SEQ ID NO: 4081171 - RNA, 12 nt, Variola virus
uuuauucucaaa

SEQ ID NO: 4081172 - RNA, 11 nt, Variola virus
uuuauuucuag

SEQ ID NO: 4081173 - RNA, 15 nt, Variola virus
uuucaaaacaaacag

SEQ ID NO: 4081174 - RNA, 11 nt, Variola virus
uuucaaagaug

SEQ ID NO: 4081175 - RNA, 13 nt, Variola virus
uuucaaauaauaa

SEQ ID NO: 4081176 - RNA, 24 nt, Variola virus
uuucaagaucuaauauucuagauu

SEQ ID NO: 4081177 - RNA, 17 nt, Variola virus
uuucaaucucuucuauu

SEQ ID NO: 4081178 - RNA, 16 nt, Variola virus
uuucagaauuuucuaa

SEQ ID NO: 4081179 - RNA, 23 nt, Variola virus
uuucagcaaucuaacauuuuuaa

SEQ ID NO: 4081180 - RNA, 19 nt, Variola virus
uuucagcauggauuucuca

SEQ ID NO: 4081181 - RNA, 16 nt, Variola virus
uuucaucuauaucauu

SEQ ID NO: 4081182 - RNA, 22 nt, Variola virus
uuucaucuuucuccaauacuaa

SEQ ID NO: 4081183 - RNA, 14 nt, Variola virus
uuucauggauguag

SEQ ID NO: 4081184 - RNA, 14 nt, Variola virus
uuucauguucgaaa

SEQ ID NO: 4081185 - RNA, 18 nt, Variola virus
uuuccagacauuguugaa

SEQ ID NO: 4081186 - RNA, 13 nt, Variola virus
uuucccauacuaa

SEQ ID NO: 4081187 - RNA, 17 nt, Variola virus
uuucccauagaacauaa

SEQ ID NO: 4081188 - RNA, 16 nt, Variola virus
uuuccuuuuauugcuu

SEQ ID NO: 4081189 - RNA, 12 nt, Variola virus
uuucgauuucaa

SEQ ID NO: 4081190 - RNA, 16 nt, Variola virus
uuucguacauuuuuaa

SEQ ID NO: 4081191 - RNA, 17 nt, Variola virus
uuucguauaauuuuuaa

SEQ ID NO: 4081192 - RNA, 19 nt, Variola virus
uuucuacccauaaguuauc

SEQ ID NO: 4081193 - RNA, 16 nt, Variola virus
uuucuacuaacuuuuu

SEQ ID NO: 4081194 - RNA, 22 nt, Variola virus
uuucuagaauaaguuucaagau

SEQ ID NO: 4081195 - RNA, 19 nt, Variola virus
uuucucguucccuaucaag

SEQ ID NO: 4081196 - RNA, 21 nt, Variola virus
uuucugguuuucuauaaauaa

SEQ ID NO: 4081197 - RNA, 17 nt, Variola virus
uuucuguaucuaucaac

SEQ ID NO: 4081198 - RNA, 13 nt, Variola virus
uuucuuucgaauu

SEQ ID NO: 4081199 - RNA, 14 nt, Variola virus
uuugaacauguaga

SEQ ID NO: 4081200 - RNA, 16 nt, Variola virus
uuugauacccugauau

SEQ ID NO: 4081201 - RNA, 13 nt, Variola virus
uuugauucgaauu

SEQ ID NO: 4081202 - RNA, 15 nt, Variola virus
uuugauuucuuaucu

SEQ ID NO: 4081203 - RNA, 19 nt, Variola virus
uuugcaauuucuucauagg

SEQ ID NO: 4081204 - RNA, 17 nt, Variola virus
uuuggaaacuucaaaaa

SEQ ID NO: 4081205 - RNA, 23 nt, Variola virus
uuuggagaaaggagaaacuguuu

SEQ ID NO: 4081206 - RNA, 15 nt, Variola virus
uuuggauuuggaaaa

SEQ ID NO: 4081207 - RNA, 22 nt, Variola virus
uuuggcuaaauuauauaauucu

SEQ ID NO: 4081208 - RNA, 19 nt, Variola virus
uuuguaauaaaauuuagca

SEQ ID NO: 4081209 - RNA, 12 nt, Variola virus
uuuguaauuuua

SEQ ID NO: 4081210 - RNA, 13 nt, Variola virus
uuuguacauguaa

SEQ ID NO: 4081211 - RNA, 17 nt, Variola virus
uuuguaccuuuguacau

SEQ ID NO: 4081212 - RNA, 16 nt, Variola virus
uuuguauaacgucuuu

SEQ ID NO: 4081213 - RNA, 20 nt, Variola virus
uuuguccacguucuuuaauu

SEQ ID NO: 4081214 - RNA, 21 nt, Variola virus
uuugucuuugaacaacauuuu

SEQ ID NO: 4081215 - RNA, 14 nt, Variola virus
uuuguggacauuuu

SEQ ID NO: 4081216 - RNA, 22 nt, Variola virus
uuuguguuugacuguuuguacu

SEQ ID NO: 4081217 - RNA, 16 nt, Variola virus
uuuguucuuguagaua

SEQ ID NO: 4081218 - RNA, 15 nt, Variola virus
uuuuaaagguaucua

SEQ ID NO: 4081219 - RNA, 18 nt, Variola virus
uuuuaaauuuuguauuua

SEQ ID NO: 4081220 - RNA, 21 nt, Variola virus
uuuuaacguaucauagaugcc

SEQ ID NO: 4081221 - RNA, 21 nt, Variola virus
uuuuaauauaauacuuaaaaa

SEQ ID NO: 4081222 - RNA, 20 nt, Variola virus
uuuuacagaucuaguauaau

SEQ ID NO: 4081223 - RNA, 11 nt, Variola virus
uuuuauacauu

SEQ ID NO: 4081224 - RNA, 20 nt, Variola virus
uuuuauauccaauguauuua

SEQ ID NO: 4081225 - RNA, 20 nt, Variola virus
uuuuauauguguuugaucua

SEQ ID NO: 4081226 - RNA, 19 nt, Variola virus
uuuuaucaaccauucaaaa

SEQ ID NO: 4081227 - RNA, 11 nt, Variola virus
uuuucacuuua

SEQ ID NO: 4081228 - RNA, 23 nt, Variola virus
uuuucagcuccccuacguaucua

SEQ ID NO: 4081229 - RNA, 22 nt, Variola virus
uuuucaguaccauuaucuuugu

SEQ ID NO: 4081230 - RNA, 14 nt, Variola virus
uuuucguuguuuaa

SEQ ID NO: 4081231 - RNA, 20 nt, Variola virus
uuuucuugagagacaugauu

SEQ ID NO: 4081232 - RNA, 15 nt, Variola virus
uuuucuuuguuggaa

SEQ ID NO: 4081233 - RNA, 14 nt, Variola virus
uuuugguucuucuc

SEQ ID NO: 4081234 - RNA, 13 nt, Variola virus
uuuuuagcaaggu

SEQ ID NO: 4081235 - RNA, 21 nt, Variola virus
uuuuucgcgggauacaucauc

SEQ ID NO: 4081236 - RNA, 17 nt, Variola virus
uuuuucuuucgaauuca

SEQ ID NO: 4081237 - RNA, 16 nt, Variola virus
uuuuugaagauuccca

SEQ ID NO: 4081238 - RNA, 20 nt, Variola virus
uuuuugagccauauuccaca

SEQ ID NO: 4081239 - RNA, 19 nt, Variola virus
uuuuugccaaauuuaucua

SEQ ID NO: 4081240 - RNA, 23 nt, Variola virus
guaaauaguuuuacguuauuaau

SEQ ID NO: 4081241 - RNA, 18 nt, Variola virus
guaaauauucuaaaucaa

SEQ ID NO: 4081242 - RNA, 21 nt, Variola virus
guaaauccugcacuaugucca

SEQ ID NO: 4081243 - RNA, 14 nt, Variola virus
guaaaugaugaaau

SEQ ID NO: 4081244 - RNA, 20 nt, Variola virus
guaacgcguggaaaaagcuc

SEQ ID NO: 4081245 - RNA, 23 nt, Variola virus
guaacuccagaacaucuuccaua

SEQ ID NO: 4081246 - RNA, 23 nt, Variola virus
guaacuucgucguaaagcguuaa

SEQ ID NO: 4081247 - RNA, 17 nt, Variola virus
guaaguuuaaaaaagac

SEQ ID NO: 4081248 - RNA, 17 nt, Variola virus
guaauaacuauguuuua

SEQ ID NO: 4081249 - RNA, 16 nt, Variola virus
guaauaccaaaaugau

SEQ ID NO: 4081250 - RNA, 19 nt, Variola virus
guaauaccaguuauguuca

SEQ ID NO: 4081251 - RNA, 18 nt, Variola virus
guaauaucgaauauuuua

SEQ ID NO: 4081252 - RNA, 22 nt, Variola virus
guaauaucugauuuauuuccua

SEQ ID NO: 4081253 - RNA, 18 nt, Variola virus
guaauauggaauaguguu

SEQ ID NO: 4081254 - RNA, 20 nt, Variola virus
guaauauuguacgauguaau

SEQ ID NO: 4081255 - RNA, 17 nt, Variola virus
guaauuaaguuuggaug

SEQ ID NO: 4081256 - RNA, 13 nt, Variola virus
guaauuacuuauc

SEQ ID NO: 4081257 - RNA, 17 nt, Variola virus
guaauuaguuucugguu

SEQ ID NO: 4081258 - RNA, 23 nt, Variola virus
guaauugacaucuauauauccuu

SEQ ID NO: 4081259 - RNA, 12 nt, Variola virus
guaauuggauuc

SEQ ID NO: 4081260 - RNA, 17 nt, Variola virus
guaauuguauuauuucc

SEQ ID NO: 4081261 - RNA, 18 nt, Variola virus
guaauuuuuguuucaguu

SEQ ID NO: 4081262 - RNA, 18 nt, Variola virus
guaauuuuuuuuuccaaa

SEQ ID NO: 4081263 - RNA, 17 nt, Variola virus
guacaaauguuaaacau

SEQ ID NO: 4081264 - RNA, 14 nt, Variola virus
guacaacauuccaa

SEQ ID NO: 4081265 - RNA, 20 nt, Variola virus
guacaagaaauacuuccauc

SEQ ID NO: 4081266 - RNA, 22 nt, Variola virus
guacacauauggaauauaucua

SEQ ID NO: 4081267 - RNA, 18 nt, Variola virus
guacaccaucaaauuguu

SEQ ID NO: 4081268 - RNA, 18 nt, Variola virus
guacaggacguaacuaua

SEQ ID NO: 4081269 - RNA, 20 nt, Variola virus
guaccagaaggaacauacga

SEQ ID NO: 4081270 - RNA, 22 nt, Variola virus
guaccagcauuuguaauaaucc

SEQ ID NO: 4081271 - RNA, 22 nt, Variola virus
guacuaauaaggaacuagaauu

SEQ ID NO: 4081272 - RNA, 12 nt, Variola virus
guacuacagaua

SEQ ID NO: 4081273 - RNA, 23 nt, Variola virus
guacuguucauacaugaugagau

SEQ ID NO: 4081274 - RNA, 12 nt, Variola virus
guacuuggaaag

SEQ ID NO: 4081275 - RNA, 16 nt, Variola virus
guagaacguaaauuaa

SEQ ID NO: 4081276 - RNA, 19 nt, Variola virus
guagaagaacucuguuucu

SEQ ID NO: 4081277 - RNA, 22 nt, Variola virus
guagaauuguuugagauauguu

SEQ ID NO: 4081278 - RNA, 18 nt, Variola virus
guagacauagauauucua

SEQ ID NO: 4081279 - RNA, 21 nt, Variola virus
guagauaaaaaagauacgcau

SEQ ID NO: 4081280 - RNA, 22 nt, Variola virus
guagauaagaaugugauaagau

SEQ ID NO: 4081281 - RNA, 20 nt, Variola virus
guagcaaagaaauuaauaga

SEQ ID NO: 4081282 - RNA, 15 nt, Variola virus
guagcaaauuuccua

SEQ ID NO: 4081283 - RNA, 16 nt, Variola virus
guaguccuacguuauu

SEQ ID NO: 4081284 - RNA, 13 nt, Variola virus
guauaaaaauuaa

SEQ ID NO: 4081285 - RNA, 19 nt, Variola virus
guauaauagacauaaugac

SEQ ID NO: 4081286 - RNA, 17 nt, Variola virus
guauaauauuuaaacaa

SEQ ID NO: 4081287 - RNA, 11 nt, Variola virus
guauaaucaua

SEQ ID NO: 4081288 - RNA, 24 nt, Variola virus
guauaaugugauuguauguuguua

SEQ ID NO: 4081289 - RNA, 19 nt, Variola virus
guauaauuuuuauguuuua

SEQ ID NO: 4081290 - RNA, 13 nt, Variola virus
guauacauaauau

SEQ ID NO: 4081291 - RNA, 19 nt, Variola virus
guauacucccuugcaucau

SEQ ID NO: 4081292 - RNA, 14 nt, Variola virus
guauacuucaucag

SEQ ID NO: 4081293 - RNA, 17 nt, Variola virus
guauauacauagauaua

SEQ ID NO: 4081294 - RNA, 17 nt, Variola virus
guaucauaucuucgaaa

SEQ ID NO: 4081295 - RNA, 20 nt, Variola virus
guaucauccacauauuuaua

SEQ ID NO: 4081296 - RNA, 19 nt, Variola virus
guauccagguagacauaga

SEQ ID NO: 4081297 - RNA, 22 nt, Variola virus
guauccaguuccuuuucuaguu

SEQ ID NO: 4081298 - RNA, 19 nt, Variola virus
guauccggcaauauuuauu

SEQ ID NO: 4081299 - RNA, 19 nt, Variola virus
guaucgcauuaauacuguu

SEQ ID NO: 4081300 - RNA, 19 nt, Variola virus
guaucucgucuaaauuaga

SEQ ID NO: 4081301 - RNA, 17 nt, Variola virus
guaugaauaaucuucau

SEQ ID NO: 4081302 - RNA, 16 nt, Variola virus
guaugauacaaucaag

SEQ ID NO: 4081303 - RNA, 14 nt, Variola virus
guauuaauaauauc

SEQ ID NO: 4081304 - RNA, 16 nt, Variola virus
guauuauccaauacag

SEQ ID NO: 4081305 - RNA, 15 nt, Variola virus
guauuauuaaaucau

SEQ ID NO: 4081306 - RNA, 14 nt, Variola virus
guauuccuacuuuu

SEQ ID NO: 4081307 - RNA, 14 nt, Variola virus
guauugacaaauau

SEQ ID NO: 4081308 - RNA, 15 nt, Variola virus
guauuggauaaagga

SEQ ID NO: 4081309 - RNA, 16 nt, Variola virus
guauuucauuacccaa

SEQ ID NO: 4081310 - RNA, 20 nt, Variola virus
guauuuuaucucuauucauc

SEQ ID NO: 4081311 - RNA, 15 nt, Variola virus
gucaaaaacugaagu

SEQ ID NO: 4081312 - RNA, 15 nt, Variola virus
gucaaaacauaauac

SEQ ID NO: 4081313 - RNA, 12 nt, Variola virus
gucaauacugua

SEQ ID NO: 4081314 - RNA, 19 nt, Variola virus
gucacugaguuuacagaua

SEQ ID NO: 4081315 - RNA, 12 nt, Variola virus
gucauagauaua

SEQ ID NO: 4081316 - RNA, 14 nt, Variola virus
gucauguuggaaua

SEQ ID NO: 4081317 - RNA, 21 nt, Variola virus
gucauuaaauugugaaucauc

SEQ ID NO: 4081318 - RNA, 13 nt, Variola virus
guccaaaaugaug

SEQ ID NO: 4081319 - RNA, 13 nt, Variola virus
guccaauauuaau

SEQ ID NO: 4081320 - RNA, 17 nt, Variola virus
gucccucauaauaaauu

SEQ ID NO: 4081321 - RNA, 16 nt, Variola virus
gucgagguuuaaagaa

SEQ ID NO: 4081322 - RNA, 13 nt, Variola virus
gucguaugaugaa

SEQ ID NO: 4081323 - RNA, 13 nt, Variola virus
gucgucaaaauau

SEQ ID NO: 4081324 - RNA, 21 nt, Variola virus
gucuaaauccaacuauagaca

SEQ ID NO: 4081325 - RNA, 20 nt, Variola virus
gucuaaguauagaucaaaag

SEQ ID NO: 4081326 - RNA, 17 nt, Variola virus
gucuaauagaacaaaua

SEQ ID NO: 4081327 - RNA, 12 nt, Variola virus
gucuacaucauc

SEQ ID NO: 4081328 - RNA, 22 nt, Variola virus
gucuacauucuugacuguuuua

SEQ ID NO: 4081329 - RNA, 16 nt, Variola virus
gucuaguaaguagaaa

SEQ ID NO: 4081330 - RNA, 15 nt, Variola virus
gucuagucuuaaaug

SEQ ID NO: 4081331 - RNA, 11 nt, Variola virus
gucuaguuuug

SEQ ID NO: 4081332 - RNA, 22 nt, Variola virus
gucuauacaagucgucuaaacg

SEQ ID NO: 4081333 - RNA, 19 nt, Variola virus
gucuauauaugaauaagca

SEQ ID NO: 4081334 - RNA, 14 nt, Variola virus
gucuaugucucuua

SEQ ID NO: 4081335 - RNA, 20 nt, Variola virus
gucucauauaacaacaaaua

SEQ ID NO: 4081336 - RNA, 21 nt, Variola virus
gucucauauaacaacaaauaa

SEQ ID NO: 4081337 - RNA, 18 nt, Variola virus
gucucuggauuauuuuua

SEQ ID NO: 4081338 - RNA, 20 nt, Variola virus
gucuguaacucugauaaucu

SEQ ID NO: 4081339 - RNA, 11 nt, Variola virus
aaaaaaugaua

SEQ ID NO: 4081340 - RNA, 13 nt, Variola virus
aaaaaauuauacu

SEQ ID NO: 4081341 - RNA, 18 nt, Variola virus
aaaaacauaauagcuccc

SEQ ID NO: 4081342 - RNA, 14 nt, Variola virus
aaaaacaugucucu

SEQ ID NO: 4081343 - RNA, 13 nt, Variola virus
aaaaaggaaucua

SEQ ID NO: 4081344 - RNA, 15 nt, Variola virus
aaaaaguuuuaacau

SEQ ID NO: 4081345 - RNA, 17 nt, Variola virus
aaaaauaugggaaucua

SEQ ID NO: 4081346 - RNA, 17 nt, Variola virus
aaaaauccuuaaugaua

SEQ ID NO: 4081347 - RNA, 12 nt, Variola virus
aaaaauggaugu

SEQ ID NO: 4081348 - RNA, 15 nt, Variola virus
aacuauuuuaccguu

SEQ ID NO: 4081349 - RNA, 16 nt, Variola virus
aacucaggaacuauaa

SEQ ID NO: 4081350 - RNA, 20 nt, Variola virus
aacucaguuaacauacagga

SEQ ID NO: 4081351 - RNA, 19 nt, Variola virus
aacucauuuauauauuaaa

SEQ ID NO: 4081352 - RNA, 20 nt, Variola virus
aacuccggauagagaaauau

SEQ ID NO: 4081353 - RNA, 14 nt, Variola virus
aacuccucuagaug

SEQ ID NO: 4081354 - RNA, 15 nt, Variola virus
aacucguaaaaagau

SEQ ID NO: 4081355 - RNA, 23 nt, Variola virus
aacucguuuuucuuaagaaauau

SEQ ID NO: 4081356 - RNA, 23 nt, Variola virus
aacucuaaucaaaaucuuaauau

SEQ ID NO: 4081357 - RNA, 16 nt, Variola virus
aacucucaaaaugcug

SEQ ID NO: 4081358 - RNA, 18 nt, Variola virus
aacucuugcuacaaaaug

SEQ ID NO: 4081359 - RNA, 22 nt, Variola virus
aacugaaucaccuaccuuagau

SEQ ID NO: 4081360 - RNA, 23 nt, Variola virus
aacugcguuguuucaugacaauc

SEQ ID NO: 4081361 - RNA, 14 nt, Variola virus
aacuguauaaaaug

SEQ ID NO: 4081362 - RNA, 17 nt, Variola virus
aacuguguuucagguau

SEQ ID NO: 4081363 - RNA, 21 nt, Variola virus
aacuguucaucguuuagaaua

SEQ ID NO: 4081364 - RNA, 18 nt, Variola virus
aacuuaaaaaaaauaaua

SEQ ID NO: 4081365 - RNA, 21 nt, Variola virus
aacuucaggauuuuuuacagg

SEQ ID NO: 4081366 - RNA, 16 nt, Variola virus
aacuucuagucuagaa

SEQ ID NO: 4081367 - RNA, 14 nt, Variola virus
aacuuuaucaucuu

SEQ ID NO: 4081368 - RNA, 12 nt, Variola virus
aacuuucuagaa

SEQ ID NO: 4081369 - RNA, 14 nt, Variola virus
aacuuuuaaauaca

SEQ ID NO: 4081370 - RNA, 16 nt, Variola virus
aacuuuuagaaauaua

SEQ ID NO: 4081371 - RNA, 12 nt, Variola virus
aacuuuuuggua

SEQ ID NO: 4081372 - RNA, 23 nt, Variola virus
aagaaacugacuugauaaaaaug

SEQ ID NO: 4081373 - RNA, 12 nt, Variola virus
aagaaaugagug

SEQ ID NO: 4081374 - RNA, 12 nt, Variola virus
aagaaauuauuu

SEQ ID NO: 4081375 - RNA, 21 nt, Variola virus
aagaagcuggaugugggagau

SEQ ID NO: 4081376 - RNA, 12 nt, Variola virus
aagaauaaauua

SEQ ID NO: 4081377 - RNA, 19 nt, Variola virus
aagaauaauccagaaugua

SEQ ID NO: 4081378 - RNA, 20 nt, Variola virus
aagaauaauccagaauguac

SEQ ID NO: 4081379 - RNA, 17 nt, Variola virus
aagaauagaggcacuua

SEQ ID NO: 4081380 - RNA, 14 nt, Variola virus
aagaauauagaaau

SEQ ID NO: 4081381 - RNA, 19 nt, Variola virus
aagacaugauaauauuaaa

SEQ ID NO: 4081382 - RNA, 13 nt, Variola virus
aagaccaauaaua

SEQ ID NO: 4081383 - RNA, 17 nt, Variola virus
aagacuaauuuguaaac

SEQ ID NO: 4081384 - RNA, 15 nt, Variola virus
aagacuaugcaaaga

SEQ ID NO: 4081385 - RNA, 15 nt, Variola virus
aagacuuugaaauau

SEQ ID NO: 4081386 - RNA, 13 nt, Variola virus
aagagcaaacauc

SEQ ID NO: 4081387 - RNA, 15 nt, Variola virus
aagagcaaacaucug

SEQ ID NO: 4081388 - RNA, 15 nt, Variola virus
aagauaaaagaauuc

SEQ ID NO: 4081389 - RNA, 14 nt, Variola virus
aagauaaucuucuc

SEQ ID NO: 4081390 - RNA, 19 nt, Variola virus
aagauagcugaaacaaaga

SEQ ID NO: 4081391 - RNA, 12 nt, Variola virus
aagauauaugau

SEQ ID NO: 4081392 - RNA, 19 nt, Variola virus
aagauauaugauucuaaua

SEQ ID NO: 4081393 - RNA, 22 nt, Variola virus
aagauauccagaguuuagauua

SEQ ID NO: 4081394 - RNA, 22 nt, Variola virus
aagauaugggaguaguugaaau

SEQ ID NO: 4081395 - RNA, 13 nt, Variola virus
aagauauucuaaa

SEQ ID NO: 4081396 - RNA, 23 nt, Variola virus
aagaucguuggacauuggauaau

SEQ ID NO: 4081397 - RNA, 23 nt, Variola virus
aagaugcuacagcguuuacuauu

SEQ ID NO: 4081398 - RNA, 14 nt, Variola virus
aagauguuagaaaa

SEQ ID NO: 4081399 - RNA, 19 nt, Variola virus
aagauguuccguuaccguu

SEQ ID NO: 4081400 - RNA, 15 nt, Variola virus
aagauuguagaauca

SEQ ID NO: 4081401 - RNA, 19 nt, Variola virus
aagauugucauguggauua

SEQ ID NO: 4081402 - RNA, 14 nt, Variola virus
aagauuguuuaaga

SEQ ID NO: 4081403 - RNA, 14 nt, Variola virus
aagcaagaaagaua

SEQ ID NO: 4081404 - RNA, 15 nt, Variola virus
aagcccaaaaccaaa

SEQ ID NO: 4081405 - RNA, 17 nt, Variola virus
aagcgaauuacucuguc

SEQ ID NO: 4081406 - RNA, 22 nt, Variola virus
aagcggaacaauaaacaaaaua

SEQ ID NO: 4081407 - RNA, 14 nt, Variola virus
aagcguagaaguug

SEQ ID NO: 4081408 - RNA, 18 nt, Variola virus
aaggacagaaaaauguua

SEQ ID NO: 4081409 - RNA, 15 nt, Variola virus
aaggacagaaauaua

SEQ ID NO: 4081410 - RNA, 18 nt, Variola virus
aaggcaucaaaaaaugua

SEQ ID NO: 4081411 - RNA, 14 nt, Variola virus
aaggcgaacgcuau

SEQ ID NO: 4081412 - RNA, 14 nt, Variola virus
aagggaaaaugcua

SEQ ID NO: 4081413 - RNA, 16 nt, Variola virus
aagguauaaaauacuu

SEQ ID NO: 4081414 - RNA, 11 nt, Variola virus
aagguauauaa

SEQ ID NO: 4081415 - RNA, 20 nt, Variola virus
aaguaaaagauuuauaaugu

SEQ ID NO: 4081416 - RNA, 12 nt, Variola virus
aaguaaacuucg

SEQ ID NO: 4081417 - RNA, 21 nt, Variola virus
aaguaaagaaaagauauccag

SEQ ID NO: 4081418 - RNA, 15 nt, Variola virus
aaguaaauacugaau

SEQ ID NO: 4081419 - RNA, 16 nt, Variola virus
aaguaaguaugucgaa

SEQ ID NO: 4081420 - RNA, 16 nt, Variola virus
aaguaaucaauuuuuc

SEQ ID NO: 4081421 - RNA, 20 nt, Variola virus
aaguaauuauaguauaaugu

SEQ ID NO: 4081422 - RNA, 21 nt, Variola virus
aaguaauuuucuuuguuggaa

SEQ ID NO: 4081423 - RNA, 12 nt, Variola virus
aaguacaaaaua

SEQ ID NO: 4081424 - RNA, 14 nt, Variola virus
aaguacaaaauaua

SEQ ID NO: 4081425 - RNA, 14 nt, Variola virus
aaguacaucaucua

SEQ ID NO: 4081426 - RNA, 16 nt, Variola virus
aaguacaucaucugaa

SEQ ID NO: 4081427 - RNA, 22 nt, Variola virus
aaguacuguucauacaugauga

SEQ ID NO: 4081428 - RNA, 20 nt, Variola virus
aaguagaaauuaucaaaugu

SEQ ID NO: 4081429 - RNA, 23 nt, Variola virus
aaguauaaaaauuaaacaaaacg

SEQ ID NO: 4081430 - RNA, 17 nt, Variola virus
aaguauaacacaaaaua

SEQ ID NO: 4081431 - RNA, 16 nt, Variola virus
aaguauauaaauacuu

SEQ ID NO: 4081432 - RNA, 14 nt, Variola virus
aaguauauguagga

SEQ ID NO: 4081433 - RNA, 16 nt, Variola virus
aaguaucaaaucgaua

SEQ ID NO: 4081434 - RNA, 16 nt, Variola virus
aaguauccaucacuuc

SEQ ID NO: 4081435 - RNA, 18 nt, Variola virus
aaguauccauuuagcaaa

SEQ ID NO: 4081436 - RNA, 23 nt, Variola virus
aaguauccucuacucauuucauu

SEQ ID NO: 4081437 - RNA, 23 nt, Variola virus
aaguaucuacgauuuuuacaaaa

SEQ ID NO: 4081438 - RNA, 17 nt, Variola virus
aaguaugaagaaaaaug

SEQ ID NO: 4081439 - RNA, 13 nt, Variola virus
aaguauuuacauu

SEQ ID NO: 4081440 - RNA, 17 nt, Variola virus
aagucaacguuuacauu

SEQ ID NO: 4081441 - RNA, 20 nt, Variola virus
aagucacaaagcaagaccaa

SEQ ID NO: 4081442 - RNA, 19 nt, Variola virus
aagucacgcgauuuacugg

SEQ ID NO: 4081443 - RNA, 14 nt, Variola virus
aagucauaaaucau

SEQ ID NO: 4081444 - RNA, 18 nt, Variola virus
aagucgacaaccaaacgu

SEQ ID NO: 4081445 - RNA, 16 nt, Variola virus
aagucugucaaaucau

SEQ ID NO: 4081446 - RNA, 23 nt, Variola virus
aagucuuuagucacacaauacua

SEQ ID NO: 4081447 - RNA, 18 nt, Variola virus
aagugcacguuuacauau

SEQ ID NO: 4081448 - RNA, 17 nt, Variola virus
aagugcuuaaauauuuc

SEQ ID NO: 4081449 - RNA, 15 nt, Variola virus
aaguuaaauagaaug

SEQ ID NO: 4081450 - RNA, 18 nt, Variola virus
aaguuaauucagauacua

SEQ ID NO: 4081451 - RNA, 13 nt, Variola virus
aaguuagaaucuc

SEQ ID NO: 4081452 - RNA, 17 nt, Variola virus
aaguuaguuauuuuacg

SEQ ID NO: 4081453 - RNA, 21 nt, Variola virus
aaguuuauacucacaaaacau

SEQ ID NO: 4081454 - RNA, 23 nt, Variola virus
aaguuuauuaguguuuagauaau

SEQ ID NO: 4081455 - RNA, 15 nt, Variola virus
aaguuucguacaaau

SEQ ID NO: 4081456 - RNA, 22 nt, Variola virus
aaguuuuauagagauagaugaa

SEQ ID NO: 4081457 - RNA, 19 nt, Variola virus
aauaaaaguggaagucauu

SEQ ID NO: 4081458 - RNA, 21 nt, Variola virus
aauaaaauucugauuggucaa

SEQ ID NO: 4081459 - RNA, 21 nt, Variola virus
agucaauggagaaauacuuaa

SEQ ID NO: 4081460 - RNA, 22 nt, Variola virus
agucaccaaauuuuacaaaaaa

SEQ ID NO: 4081461 - RNA, 23 nt, Variola virus
agucagcuggucuaaaauuucca

SEQ ID NO: 4081462 - RNA, 17 nt, Variola virus
agucagguccaauauua

SEQ ID NO: 4081463 - RNA, 17 nt, Variola virus
agucauacguaaugaag

SEQ ID NO: 4081464 - RNA, 12 nt, Variola virus
agucauacuaga

SEQ ID NO: 4081465 - RNA, 13 nt, Variola virus
agucauaucuaga

SEQ ID NO: 4081466 - RNA, 19 nt, Variola virus
agucauaucuagaaugaag

SEQ ID NO: 4081467 - RNA, 20 nt, Variola virus
agucauaucuagaaugaaga

SEQ ID NO: 4081468 - RNA, 18 nt, Variola virus
agucauuaacgaacaaua

SEQ ID NO: 4081469 - RNA, 21 nt, Variola virus
agucauuccaucauuuaagaa

SEQ ID NO: 4081470 - RNA, 16 nt, Variola virus
agucgaaacauauucu

SEQ ID NO: 4081471 - RNA, 13 nt, Variola virus
agucgcuauuuuu

SEQ ID NO: 4081472 - RNA, 17 nt, Variola virus
agucuaccgaucucuuu

SEQ ID NO: 4081473 - RNA, 16 nt, Variola virus
agucuauaugaucaaa

SEQ ID NO: 4081474 - RNA, 13 nt, Variola virus
agucucaaaauua

SEQ ID NO: 4081475 - RNA, 15 nt, Variola virus
agucucaaaauuaua

SEQ ID NO: 4081476 - RNA, 16 nt, Variola virus
agucucaguuaacuga

SEQ ID NO: 4081477 - RNA, 19 nt, Variola virus
agucuccgccguucuaaug

SEQ ID NO: 4081478 - RNA, 13 nt, Variola virus
agucugucaaauc

SEQ ID NO: 4081479 - RNA, 18 nt, Variola virus
agucugucaaaucaucuu

SEQ ID NO: 4081480 - RNA, 14 nt, Variola virus
agucuuaaugauac

SEQ ID NO: 4081481 - RNA, 22 nt, Variola virus
agucuuggacuaauuauacuuu

SEQ ID NO: 4081482 - RNA, 16 nt, Variola virus
agucuuggucuauuau

SEQ ID NO: 4081483 - RNA, 14 nt, Variola virus
agucuuucuccaua

SEQ ID NO: 4081484 - RNA, 13 nt, Variola virus
agugaaacaaaau

SEQ ID NO: 4081485 - RNA, 17 nt, Variola virus
agugaaucgacuauaga

SEQ ID NO: 4081486 - RNA, 15 nt, Variola virus
agugacaaaaugcua

SEQ ID NO: 4081487 - RNA, 19 nt, Variola virus
agugacacucuauaucuag

SEQ ID NO: 4081488 - RNA, 16 nt, Variola virus
agugacagauauacaa

SEQ ID NO: 4081489 - RNA, 18 nt, Variola virus
agugacuuuguagcucuc

SEQ ID NO: 4081490 - RNA, 18 nt, Variola virus
agugauauugauaucuuu

SEQ ID NO: 4081491 - RNA, 16 nt, Variola virus
agugauucaaaaggac

SEQ ID NO: 4081492 - RNA, 20 nt, Variola virus
agugcagauaaucauuuaau

SEQ ID NO: 4081493 - RNA, 21 nt, Variola virus
agugcgguuuuaccuauuuua

SEQ ID NO: 4081494 - RNA, 14 nt, Variola virus
agugcuuguaugug

SEQ ID NO: 4081495 - RNA, 15 nt, Variola virus
aguggaauugaaaau

SEQ ID NO: 4081496 - RNA, 14 nt, Variola virus
aguggaguaauuua

SEQ ID NO: 4081497 - RNA, 20 nt, Variola virus
aguggauuaucucaaagaau

SEQ ID NO: 4081498 - RNA, 17 nt, Variola virus
agugggcuuacauguau

SEQ ID NO: 4081499 - RNA, 22 nt, Variola virus
agugguaggucauacuccauca

SEQ ID NO: 4081500 - RNA, 23 nt, Variola virus
agugguaggucauacuccaucaa

SEQ ID NO: 4081501 - RNA, 17 nt, Variola virus
aguguaccaauaugcga

SEQ ID NO: 4081502 - RNA, 20 nt, Variola virus
aguguauaacaaucuuauau

SEQ ID NO: 4081503 - RNA, 20 nt, Variola virus
aguguauaacggaaaugaua

SEQ ID NO: 4081504 - RNA, 16 nt, Variola virus
agugucuauaaaugua

SEQ ID NO: 4081505 - RNA, 22 nt, Variola virus
agugugagaaaaaauaucuugu

SEQ ID NO: 4081506 - RNA, 12 nt, Variola virus
aguuaaaacuug

SEQ ID NO: 4081507 - RNA, 18 nt, Variola virus
aguuaaaacuuuaucauc

SEQ ID NO: 4081508 - RNA, 18 nt, Variola virus
aguuaagagaauaauaga

SEQ ID NO: 4081509 - RNA, 16 nt, Variola virus
aguuaaggauaauaag

SEQ ID NO: 4081510 - RNA, 18 nt, Variola virus
aguuaaguuuuuuaagaa

SEQ ID NO: 4081511 - RNA, 15 nt, Variola virus
aguuaauauauuuaa

SEQ ID NO: 4081512 - RNA, 17 nt, Variola virus
aguuaauauuauugggu

SEQ ID NO: 4081513 - RNA, 17 nt, Variola virus
aguuaaucaauuuagau

SEQ ID NO: 4081514 - RNA, 23 nt, Variola virus
aguuaucgcugaucgucuagaug

SEQ ID NO: 4081515 - RNA, 19 nt, Variola virus
aguucauuguuuucaauau

SEQ ID NO: 4081516 - RNA, 17 nt, Variola virus
aguucugcauucaauuc

SEQ ID NO: 4081517 - RNA, 17 nt, Variola virus
aguucuuuuaugucaag

SEQ ID NO: 4081518 - RNA, 14 nt, Variola virus
aguugauuguaaac

SEQ ID NO: 4081519 - RNA, 14 nt, Variola virus
aguuguaucaucua

SEQ ID NO: 4081520 - RNA, 21 nt, Variola virus
aguuguuccaauaaauuauuu

SEQ ID NO: 4081521 - RNA, 19 nt, Variola virus
aguuuaaacugaaaaugac

SEQ ID NO: 4081522 - RNA, 18 nt, Variola virus
aguuuauaauaacaagua

SEQ ID NO: 4081523 - RNA, 19 nt, Variola virus
aguuuaucguuuacauaag

SEQ ID NO: 4081524 - RNA, 19 nt, Variola virus
aguuucaucaauaaaggau

SEQ ID NO: 4081525 - RNA, 21 nt, Variola virus
aguuucucaugucucuauaua

SEQ ID NO: 4081526 - RNA, 19 nt, Variola virus
aguuucugccauuuaucca

SEQ ID NO: 4081527 - RNA, 16 nt, Variola virus
aguuuguuuucauuau

SEQ ID NO: 4081528 - RNA, 23 nt, Variola virus
aguuuucccuaccaguuuauccc

SEQ ID NO: 4081529 - RNA, 22 nt, Variola virus
aguuuucuuucaaaauagcuau

SEQ ID NO: 4081530 - RNA, 18 nt, Variola virus
aguuuuggaucaaaugga

SEQ ID NO: 4081531 - RNA, 14 nt, Variola virus
aguuuuuaacuagu

SEQ ID NO: 4081532 - RNA, 12 nt, Variola virus
aguuuuuaagag

SEQ ID NO: 4081533 - RNA, 20 nt, Variola virus
auaaaaacaauacaguauau

SEQ ID NO: 4081534 - RNA, 12 nt, Variola virus
auaaaaaguaau

SEQ ID NO: 4081535 - RNA, 14 nt, Variola virus
auaaaaauaauauu

SEQ ID NO: 4081536 - RNA, 12 nt, Variola virus
auaaaaauaugg

SEQ ID NO: 4081537 - RNA, 16 nt, Variola virus
auaaaaauuauguuuu

SEQ ID NO: 4081538 - RNA, 13 nt, Variola virus
auaaaacauucuc

SEQ ID NO: 4081539 - RNA, 19 nt, Variola virus
auaaaacuauaaauaugca

SEQ ID NO: 4081540 - RNA, 16 nt, Variola virus
auaaaaucaaaauuac

SEQ ID NO: 4081541 - RNA, 17 nt, Variola virus
auaaaauguuaauacau

SEQ ID NO: 4081542 - RNA, 14 nt, Variola virus
auaaaauuauucac

SEQ ID NO: 4081543 - RNA, 19 nt, Variola virus
auaaaauucuuaguuauau

SEQ ID NO: 4081544 - RNA, 22 nt, Variola virus
auaaacaacuaaaaugugguau

SEQ ID NO: 4081545 - RNA, 14 nt, Variola virus
auaaacauaauaaa

SEQ ID NO: 4081546 - RNA, 17 nt, Variola virus
auaaacauuguuuguau

SEQ ID NO: 4081547 - RNA, 20 nt, Variola virus
auaaacauuuguguuuguau

SEQ ID NO: 4081548 - RNA, 21 nt, Variola virus
auaaaccaaaagcuuucuagu

SEQ ID NO: 4081549 - RNA, 22 nt, Variola virus
auaaaccauccauucauauaca

SEQ ID NO: 4081550 - RNA, 17 nt, Variola virus
auaaaccgcuauugaaa

SEQ ID NO: 4081551 - RNA, 17 nt, Variola virus
auaaacgcgucugcuaa

SEQ ID NO: 4081552 - RNA, 18 nt, Variola virus
auaaacggguguaaacaa

SEQ ID NO: 4081553 - RNA, 22 nt, Variola virus
auaaacguucacguaaauacaa

SEQ ID NO: 4081554 - RNA, 18 nt, Variola virus
auaaacuaacauuguuaa

SEQ ID NO: 4081555 - RNA, 23 nt, Variola virus
auaaacuacucgaacagauaguu

SEQ ID NO: 4081556 - RNA, 18 nt, Variola virus
auaaacuaucaguaaguu

SEQ ID NO: 4081557 - RNA, 14 nt, Variola virus
auaaagaaugaaug

SEQ ID NO: 4081558 - RNA, 14 nt, Variola virus
auaaagaugauaua

SEQ ID NO: 4081559 - RNA, 21 nt, Variola virus
auaaaggagaaggaaaaugaa

SEQ ID NO: 4081560 - RNA, 18 nt, Variola virus
auaaaggauacguuguau

SEQ ID NO: 4081561 - RNA, 16 nt, Variola virus
auacugauaaaguaga

SEQ ID NO: 4081562 - RNA, 17 nt, Variola virus
auacuguguaaagaaau

SEQ ID NO: 4081563 - RNA, 23 nt, Variola virus
auacuuaaaaauggauguugugu

SEQ ID NO: 4081564 - RNA, 22 nt, Variola virus
auacuugauaagauaaaaucua

SEQ ID NO: 4081565 - RNA, 18 nt, Variola virus
auacuugucaucauuucu

SEQ ID NO: 4081566 - RNA, 21 nt, Variola virus
auacuuugcccuuuaauacau

SEQ ID NO: 4081567 - RNA, 20 nt, Variola virus
auacuuuguccguaaaacau

SEQ ID NO: 4081568 - RNA, 17 nt, Variola virus
auacuuuucuaauucua

SEQ ID NO: 4081569 - RNA, 15 nt, Variola virus
auagaaacuauagau

SEQ ID NO: 4081570 - RNA, 19 nt, Variola virus
auagaaauaaaaauuauua

SEQ ID NO: 4081571 - RNA, 12 nt, Variola virus
auagaagauuac

SEQ ID NO: 4081572 - RNA, 19 nt, Variola virus
auagaagguuuauauaaca

SEQ ID NO: 4081573 - RNA, 20 nt, Variola virus
auagaauaaauauccuugga

SEQ ID NO: 4081574 - RNA, 19 nt, Variola virus
auagacaaugcuaauauau

SEQ ID NO: 4081575 - RNA, 14 nt, Variola virus
auagacuaguguau

SEQ ID NO: 4081576 - RNA, 14 nt, Variola virus
auagagaacauaau

SEQ ID NO: 4081577 - RNA, 13 nt, Variola virus
auagauauacaau

SEQ ID NO: 4081578 - RNA, 18 nt, Variola virus
auagauauaccagaacua

SEQ ID NO: 4081579 - RNA, 19 nt, Variola virus
auagauccgugagaaauac

SEQ ID NO: 4081580 - RNA, 15 nt, Variola virus
auagaugaaauacuc

SEQ ID NO: 4081581 - RNA, 16 nt, Variola virus
auagauggaguaagua

SEQ ID NO: 4081582 - RNA, 18 nt, Variola virus
auagauuguuuucaguaa

SEQ ID NO: 4081583 - RNA, 18 nt, Variola virus
auagauuuacucugaaaa

SEQ ID NO: 4081584 - RNA, 14 nt, Variola virus
auagcacaaaugug

SEQ ID NO: 4081585 - RNA, 22 nt, Variola virus
auagcauagauauagaaacgga

SEQ ID NO: 4081586 - RNA, 21 nt, Variola virus
auagcugaaacaaagaauugc

SEQ ID NO: 4081587 - RNA, 19 nt, Variola virus
auagcuuucacucauauaa

SEQ ID NO: 4081588 - RNA, 19 nt, Variola virus
auaggaucuauaauaaugu

SEQ ID NO: 4081589 - RNA, 15 nt, Variola virus
auaguaaaaaauaua

SEQ ID NO: 4081590 - RNA, 13 nt, Variola virus
auaguaaaaucua

SEQ ID NO: 4081591 - RNA, 19 nt, Variola virus
agaugugauggaaaaauga

SEQ ID NO: 4081592 - RNA, 17 nt, Variola virus
agaugugucauacuugu

SEQ ID NO: 4081593 - RNA, 13 nt, Variola virus
agauguuaaauga

SEQ ID NO: 4081594 - RNA, 18 nt, Variola virus
agauuaaaucauuaaaug

SEQ ID NO: 4081595 - RNA, 19 nt, Variola virus
agauuaauuuugaauuugu

SEQ ID NO: 4081596 - RNA, 18 nt, Variola virus
agauuaccuauucacuua

SEQ ID NO: 4081597 - RNA, 24 nt, Variola virus
agauuaucuagucagaacuaucau

SEQ ID NO: 4081598 - RNA, 20 nt, Variola virus
agauuauugucuuauauucu

SEQ ID NO: 4081599 - RNA, 22 nt, Variola virus
agauucgcauuucuauacuugu

SEQ ID NO: 4081600 - RNA, 22 nt, Variola virus
agauucucauuugauaaaaauu

SEQ ID NO: 4081601 - RNA, 13 nt, Variola virus
agauugaaauuau

SEQ ID NO: 4081602 - RNA, 22 nt, Variola virus
agauuggccagaaucaugguau

SEQ ID NO: 4081603 - RNA, 14 nt, Variola virus
agauuuuaauguau

SEQ ID NO: 4081604 - RNA, 17 nt, Variola virus
agauuuuaguccugugu

SEQ ID NO: 4081605 - RNA, 23 nt, Variola virus
agauuuuccauccacaauuauug

SEQ ID NO: 4081606 - RNA, 21 nt, Variola virus
agcaaaaaaugauagaaauau

SEQ ID NO: 4081607 - RNA, 12 nt, Variola virus
agcaaaaacaaa

SEQ ID NO: 4081608 - RNA, 18 nt, Variola virus
agcaaaaacaaaaaacuu

SEQ ID NO: 4081609 - RNA, 18 nt, Variola virus
agcaacggggaugaugau

SEQ ID NO: 4081610 - RNA, 21 nt, Variola virus
agcaagacuaacacacaaugu

SEQ ID NO: 4081611 - RNA, 20 nt, Variola virus
agcaaugaucuaaauuauau

SEQ ID NO: 4081612 - RNA, 14 nt, Variola virus
agcaauucauguac

SEQ ID NO: 4081613 - RNA, 12 nt, Variola virus
agcacaaaauaa

SEQ ID NO: 4081614 - RNA, 16 nt, Variola virus
agcaguuuauuaucca

SEQ ID NO: 4081615 - RNA, 13 nt, Variola virus
agcauaaaugcua

SEQ ID NO: 4081616 - RNA, 21 nt, Variola virus
agcauacgccaaauaucucaa

SEQ ID NO: 4081617 - RNA, 22 nt, Variola virus
agcauacgccaaauaucucaaa

SEQ ID NO: 4081618 - RNA, 18 nt, Variola virus
agcauauucuuaauauua

SEQ ID NO: 4081619 - RNA, 20 nt, Variola virus
agcauauuguaauaucuuaa

SEQ ID NO: 4081620 - RNA, 17 nt, Variola virus
agcaucuucuucauuau

SEQ ID NO: 4081621 - RNA, 19 nt, Variola virus
agcauugaaaauacguucu

SEQ ID NO: 4081622 - RNA, 22 nt, Variola virus
agccaacaaauauaaaaugaua

SEQ ID NO: 4081623 - RNA, 16 nt, Variola virus
agccaaguaucuuguc

SEQ ID NO: 4081624 - RNA, 22 nt, Variola virus
agccaauagaaauaucauuaag

SEQ ID NO: 4081625 - RNA, 22 nt, Variola virus
agccaguagauccaguuauuaa

SEQ ID NO: 4081626 - RNA, 18 nt, Variola virus
agccaugaaacgaacacu

SEQ ID NO: 4081627 - RNA, 15 nt, Variola virus
agccggacaaauaua

SEQ ID NO: 4081628 - RNA, 20 nt, Variola virus
agccugaagcucaucuuguu

SEQ ID NO: 4081629 - RNA, 17 nt, Variola virus
agccuuuugauaaaucu

SEQ ID NO: 4081630 - RNA, 12 nt, Variola virus
agcgaauuauuu

SEQ ID NO: 4081631 - RNA, 21 nt, Variola virus
agcgucuagucuuaaauggag

SEQ ID NO: 4081632 - RNA, 15 nt, Variola virus
agcuauauagaugac

SEQ ID NO: 4081633 - RNA, 22 nt, Variola virus
agcuaugaacuuguuuaaugau

SEQ ID NO: 4081634 - RNA, 21 nt, Variola virus
agcuaugcgauuggauaagaa

SEQ ID NO: 4081635 - RNA, 14 nt, Variola virus
agcuauguuaucau

SEQ ID NO: 4081636 - RNA, 21 nt, Variola virus
agcuauguuaucaugaaaugu

SEQ ID NO: 4081637 - RNA, 15 nt, Variola virus
agcucaauauaaaug

SEQ ID NO: 4081638 - RNA, 17 nt, Variola virus
agcuccguauuccaaac

SEQ ID NO: 4081639 - RNA, 19 nt, Variola virus
agcugucguucaagaucag

SEQ ID NO: 4081640 - RNA, 17 nt, Variola virus
agcuuacaauaaacucc

SEQ ID NO: 4081641 - RNA, 14 nt, Variola virus
aggaaaaaaacaac

SEQ ID NO: 4081642 - RNA, 17 nt, Variola virus
aggaaacuuaaaauaua

SEQ ID NO: 4081643 - RNA, 22 nt, Variola virus
aggaaauaucaucacaacuuaa

SEQ ID NO: 4081644 - RNA, 18 nt, Variola virus
aggaaauugauaaugagu

SEQ ID NO: 4081645 - RNA, 16 nt, Variola virus
aggaaguauaucugag

SEQ ID NO: 4081646 - RNA, 19 nt, Variola virus
aggaauacaauacauaccu

SEQ ID NO: 4081647 - RNA, 13 nt, Variola virus
aggaauauaacgu

SEQ ID NO: 4081648 - RNA, 16 nt, Variola virus
aggaaucguuuauccg

SEQ ID NO: 4081649 - RNA, 13 nt, Variola virus
aggaaucuaucca

SEQ ID NO: 4081650 - RNA, 11 nt, Variola virus
aggacauguaa

SEQ ID NO: 4081651 - RNA, 15 nt, Variola virus
aggacguaacuauaa

SEQ ID NO: 4081652 - RNA, 13 nt, Variola virus
aggagaaguaaua

SEQ ID NO: 4081653 - RNA, 14 nt, Variola virus
aggagauauugaaa

SEQ ID NO: 4081654 - RNA, 17 nt, Variola virus
aggagauuaaaggauaa

SEQ ID NO: 4081655 - RNA, 16 nt, Variola virus
aggauacugaucuucu

SEQ ID NO: 4081656 - RNA, 22 nt, Variola virus
aggauaugauaaaaauauaauu

SEQ ID NO: 4081657 - RNA, 20 nt, Variola virus
aggauucguuuacucucaga

SEQ ID NO: 4081658 - RNA, 20 nt, Variola virus
aggcaauaagucuuucucca

SEQ ID NO: 4081659 - RNA, 17 nt, Variola virus
aggcacauaauaucuuu

SEQ ID NO: 4081660 - RNA, 18 nt, Variola virus
aggccaagcgaauuauuu

SEQ ID NO: 4081661 - RNA, 21 nt, Variola virus
aggccgcucguggauacuuau

SEQ ID NO: 4081662 - RNA, 15 nt, Variola virus
aggcgcccauuucaa

SEQ ID NO: 4081663 - RNA, 14 nt, Variola virus
aggcgucaaaauua

SEQ ID NO: 4081664 - RNA, 16 nt, Variola virus
aggcuguagucuuggu

SEQ ID NO: 4081665 - RNA, 13 nt, Variola virus
agggaaauuuaau

SEQ ID NO: 4081666 - RNA, 18 nt, Variola virus
agggagccacagaaggau

SEQ ID NO: 4081667 - RNA, 16 nt, Variola virus
aggggagguaaauaua

SEQ ID NO: 4081668 - RNA, 23 nt, Variola virus
agggucaaacuuaauaaaggaua

SEQ ID NO: 4081669 - RNA, 19 nt, Variola virus
agggugaguuaauaugcau

SEQ ID NO: 4081670 - RNA, 17 nt, Variola virus
agguaacauaaaaacug

SEQ ID NO: 4081671 - RNA, 20 nt, Variola virus
agguaagauaucuacuagaa

SEQ ID NO: 4081672 - RNA, 15 nt, Variola virus
agguacaauaccuuu

SEQ ID NO: 4081673 - RNA, 14 nt, Variola virus
agguacuaggaaaa

SEQ ID NO: 4081674 - RNA, 20 nt, Variola virus
agguacuauaauauuaaaaa

SEQ ID NO: 4081675 - RNA, 15 nt, Variola virus
agguagcaaaaaaac

SEQ ID NO: 4081676 - RNA, 13 nt, Variola virus
agguauuuauuca

SEQ ID NO: 4081677 - RNA, 22 nt, Variola virus
aggucgccauacgucaaauuua

SEQ ID NO: 4081678 - RNA, 23 nt, Variola virus
agguggauucaguacaauguuau

SEQ ID NO: 4081679 - RNA, 17 nt, Variola virus
aggugucccgucaguau

SEQ ID NO: 4081680 - RNA, 21 nt, Variola virus
agguuaaaccuuuauaaacuu

SEQ ID NO: 4081681 - RNA, 17 nt, Variola virus
agguucauuguuaucca

SEQ ID NO: 4081682 - RNA, 15 nt, Variola virus
agguuuaguaucuca

SEQ ID NO: 4081683 - RNA, 14 nt, Variola virus
aguaaaaagacuaa

SEQ ID NO: 4081684 - RNA, 21 nt, Variola virus
aguaaacucgucgacaaagua

SEQ ID NO: 4081685 - RNA, 15 nt, Variola virus
aguaaagaaaagaua

SEQ ID NO: 4081686 - RNA, 19 nt, Variola virus
aguaaagauuucaaagaug

SEQ ID NO: 4081687 - RNA, 20 nt, Variola virus
aguaaagauuucaaagaugu

SEQ ID NO: 4081688 - RNA, 12 nt, Variola virus
aguaaauacaau

SEQ ID NO: 4081689 - RNA, 21 nt, Variola virus
aguaacggacuuaacaugaga

SEQ ID NO: 4081690 - RNA, 14 nt, Variola virus
aguaacuauguaaa

SEQ ID NO: 4081691 - RNA, 16 nt, Variola virus
aguaagaguuaugaau

SEQ ID NO: 4081692 - RNA, 21 nt, Variola virus
aguaaguacaucaucuagaga

SEQ ID NO: 4081693 - RNA, 20 nt, Variola virus
aguaaguaucuauaaaacuc

SEQ ID NO: 4081694 - RNA, 23 nt, Variola virus
aguaaguaucuauaaaacucaua

SEQ ID NO: 4081695 - RNA, 17 nt, Variola virus
aguaauaccaaaaugau

SEQ ID NO: 4081696 - RNA, 17 nt, Variola virus
aguaauaucaugucuaa

SEQ ID NO: 4081697 - RNA, 13 nt, Variola virus
aguaauaucugau

SEQ ID NO: 4081698 - RNA, 16 nt, Variola virus
aguaaucauguaaaug

SEQ ID NO: 4081699 - RNA, 14 nt, Variola virus
aguaaugauugcau

SEQ ID NO: 4081700 - RNA, 18 nt, Variola virus
aguaauuaaauauaucau

SEQ ID NO: 4081701 - RNA, 19 nt, Variola virus
aguaauuauaagaaauaua

SEQ ID NO: 4081702 - RNA, 14 nt, Variola virus
aguacagaauuuuc

SEQ ID NO: 4081703 - RNA, 17 nt, Variola virus
aguacaucaucuagaga

SEQ ID NO: 4081704 - RNA, 13 nt, Variola virus
aguacggauuaaa

SEQ ID NO: 4081705 - RNA, 20 nt, Variola virus
aguacuaauaaggaacuaga

SEQ ID NO: 4081706 - RNA, 16 nt, Variola virus
aguacuguuaagaaaa

SEQ ID NO: 4081707 - RNA, 22 nt, Variola virus
aguacuguucauacaugaugag

SEQ ID NO: 4081708 - RNA, 14 nt, Variola virus
aguacuuucacaag

SEQ ID NO: 4081709 - RNA, 19 nt, Variola virus
aguagaaaauaauauagau

SEQ ID NO: 4081710 - RNA, 14 nt, Variola virus
aguagaauaauaga

SEQ ID NO: 4081711 - RNA, 18 nt, Variola virus
aguagacauuuuuaacau

SEQ ID NO: 4081712 - RNA, 16 nt, Variola virus
aguagcaaauuuccua

SEQ ID NO: 4081713 - RNA, 13 nt, Variola virus
aguaguucauuau

SEQ ID NO: 4081714 - RNA, 17 nt, Variola virus
aguauagaucaaaagaa

SEQ ID NO: 4081715 - RNA, 16 nt, Variola virus
aguauaucuacuauau

SEQ ID NO: 4081716 - RNA, 21 nt, Variola virus
aguauccacaaauaguaaaug

SEQ ID NO: 4081717 - RNA, 19 nt, Variola virus
aaauguguggauuuuggug

SEQ ID NO: 4081718 - RNA, 15 nt, Variola virus
aaauguugucauuau

SEQ ID NO: 4081719 - RNA, 23 nt, Variola virus
aaauuaaaaaauaacuuaauuua

SEQ ID NO: 4081720 - RNA, 19 nt, Variola virus
aaauuaaaggagcauguau

SEQ ID NO: 4081721 - RNA, 22 nt, Variola virus
aaauuaauuuaccaucguguau

SEQ ID NO: 4081722 - RNA, 21 nt, Variola virus
aaauuacgagccaaaucuucu

SEQ ID NO: 4081723 - RNA, 23 nt, Variola virus
aaauuagagcucaucuaagaaau

SEQ ID NO: 4081724 - RNA, 15 nt, Variola virus
aaauuagaucaaaga

SEQ ID NO: 4081725 - RNA, 15 nt, Variola virus
aaauuauaaugaaua

SEQ ID NO: 4081726 - RNA, 14 nt, Variola virus
aaauuauccuauca

SEQ ID NO: 4081727 - RNA, 19 nt, Variola virus
aaauuauccuaucauguau

SEQ ID NO: 4081728 - RNA, 18 nt, Variola virus
aaauuaugaaaaaaagau

SEQ ID NO: 4081729 - RNA, 20 nt, Variola virus
aaauuauuccuaauuaagaa

SEQ ID NO: 4081730 - RNA, 19 nt, Variola virus
aaauucaguugcuggaauu

SEQ ID NO: 4081731 - RNA, 18 nt, Variola virus
aaauucuaggcucaguau

SEQ ID NO: 4081732 - RNA, 16 nt, Variola virus
aaauugguacauagau

SEQ ID NO: 4081733 - RNA, 14 nt, Variola virus
aaauugguucuuua

SEQ ID NO: 4081734 - RNA, 15 nt, Variola virus
aaauuuaaaaugagu

SEQ ID NO: 4081735 - RNA, 19 nt, Variola virus
aaauuucuagugcuuguau

SEQ ID NO: 4081736 - RNA, 17 nt, Variola virus
aaauuugaaagaacuac

SEQ ID NO: 4081737 - RNA, 16 nt, Variola virus
aaauuuuaaaaaaugg

SEQ ID NO: 4081738 - RNA, 21 nt, Variola virus
aaauuuuacaaaucuauaaca

SEQ ID NO: 4081739 - RNA, 17 nt, Variola virus
aaauuuuuugaaguaau

SEQ ID NO: 4081740 - RNA, 23 nt, Variola virus
aacaaaaucuaacagauacaaau

SEQ ID NO: 4081741 - RNA, 23 nt, Variola virus
aacaaacagacuauucuuuauua

SEQ ID NO: 4081742 - RNA, 23 nt, Variola virus
aacaaacuauuuaucagaacacu

SEQ ID NO: 4081743 - RNA, 16 nt, Variola virus
aacaaauauuggcaua

SEQ ID NO: 4081744 - RNA, 21 nt, Variola virus
aacaaauucuuuguugaacgu

SEQ ID NO: 4081745 - RNA, 23 nt, Variola virus
aacaacgaccgauaauaaaauua

SEQ ID NO: 4081746 - RNA, 20 nt, Variola virus
aacaagagaagagauuucaa

SEQ ID NO: 4081747 - RNA, 18 nt, Variola virus
aacaagagcagauaucua

SEQ ID NO: 4081748 - RNA, 19 nt, Variola virus
aacaagaucgauagacacu

SEQ ID NO: 4081749 - RNA, 21 nt, Variola virus
aacaaguaugacauuguaaaa

SEQ ID NO: 4081750 - RNA, 22 nt, Variola virus
aacaauacaguauauaacuauu

SEQ ID NO: 4081751 - RNA, 20 nt, Variola virus
aacaauaguuauuacuuuuc

SEQ ID NO: 4081752 - RNA, 13 nt, Variola virus
aacaaucuagaca

SEQ ID NO: 4081753 - RNA, 16 nt, Variola virus
aacaauguauacaaau

SEQ ID NO: 4081754 - RNA, 11 nt, Variola virus
aacaauguuuc

SEQ ID NO: 4081755 - RNA, 16 nt, Variola virus
aacaauuccacaaauu

SEQ ID NO: 4081756 - RNA, 11 nt, Variola virus
aacacaaauau

SEQ ID NO: 4081757 - RNA, 19 nt, Variola virus
aacacaagucuaauaaugu

SEQ ID NO: 4081758 - RNA, 20 nt, Variola virus
aacacacuaaacaguuuauu

SEQ ID NO: 4081759 - RNA, 21 nt, Variola virus
aacacccauuuauuguacaaa

SEQ ID NO: 4081760 - RNA, 16 nt, Variola virus
aacacuacaacagaua

SEQ ID NO: 4081761 - RNA, 17 nt, Variola virus
aacacugauucagaaau

SEQ ID NO: 4081762 - RNA, 13 nt, Variola virus
aacagaaaaaaca

SEQ ID NO: 4081763 - RNA, 17 nt, Variola virus
aacagaaaaaacaaugu

SEQ ID NO: 4081764 - RNA, 18 nt, Variola virus
aacagaaaacaaagucua

SEQ ID NO: 4081765 - RNA, 15 nt, Variola virus
auagacgguuccaaa

SEQ ID NO: 4081766 - RNA, 18 nt, Variola virus
auauucucuauuaaauac

SEQ ID NO: 4081767 - RNA, 21 nt, Variola virus
auauucugccguguuuaaaaa

SEQ ID NO: 4081768 - RNA, 17 nt, Variola virus
caggauacuaugcuauu

SEQ ID NO: 4081769 - RNA, 19 nt, Variola virus
caggaucuccaacaaauuu

SEQ ID NO: 4081770 - RNA, 22 nt, Variola virus
caggcaaauguuuauaguauua

SEQ ID NO: 4081771 - RNA, 15 nt, Variola virus
cagggagccacagaa

SEQ ID NO: 4081772 - RNA, 19 nt, Variola virus
cagguaaaaguacagaauu

SEQ ID NO: 4081773 - RNA, 20 nt, Variola virus
cagguaugauagcuccacca

SEQ ID NO: 4081774 - RNA, 19 nt, Variola virus
caggugcugauguaaaugg

SEQ ID NO: 4081775 - RNA, 19 nt, Variola virus
caguaaaaauaacuagaau

SEQ ID NO: 4081776 - RNA, 21 nt, Variola virus
caguaauagcuccauaaacug

SEQ ID NO: 4081777 - RNA, 14 nt, Variola virus
caguaauuaaugag

SEQ ID NO: 4081778 - RNA, 14 nt, Variola virus
caguaguucauuau

SEQ ID NO: 4081779 - RNA, 14 nt, Variola virus
caguauaaugauuu

SEQ ID NO: 4081780 - RNA, 16 nt, Variola virus
cagucaaauucgguaa

SEQ ID NO: 4081781 - RNA, 14 nt, Variola virus
cagucacagacacu

SEQ ID NO: 4081782 - RNA, 15 nt, Variola virus
cagucauuccaucau

SEQ ID NO: 4081783 - RNA, 18 nt, Variola virus
caguccgguucuuaauau

SEQ ID NO: 4081784 - RNA, 16 nt, Variola virus
cagugacagauauaca

SEQ ID NO: 4081785 - RNA, 15 nt, Variola virus
caguuaauauauuua

SEQ ID NO: 4081786 - RNA, 13 nt, Variola virus
caguuaucaucua

SEQ ID NO: 4081787 - RNA, 22 nt, Variola virus
caguuauguucaacuuugaaau

SEQ ID NO: 4081788 - RNA, 12 nt, Variola virus
caguugaacaga

SEQ ID NO: 4081789 - RNA, 22 nt, Variola virus
caguugcgaacaacaacaaaau

SEQ ID NO: 4081790 - RNA, 17 nt, Variola virus
caguuucucaucuuuua

SEQ ID NO: 4081791 - RNA, 13 nt, Variola virus
cauaaaacauaau

SEQ ID NO: 4081792 - RNA, 14 nt, Variola virus
cauaaaacaucauu

SEQ ID NO: 4081793 - RNA, 21 nt, Variola virus
cauaaaauaacucuguagacg

SEQ ID NO: 4081794 - RNA, 18 nt, Variola virus
cauaaaauacaagagaau

SEQ ID NO: 4081795 - RNA, 14 nt, Variola virus
cauaaaauuuaaga

SEQ ID NO: 4081796 - RNA, 13 nt, Variola virus
cauaaacauuauu

SEQ ID NO: 4081797 - RNA, 21 nt, Variola virus
cauaaacgauugcugcuguuc

SEQ ID NO: 4081798 - RNA, 18 nt, Variola virus
cauaaaggaauauacaaa

SEQ ID NO: 4081799 - RNA, 23 nt, Variola virus
cauaaaugagaugagaagauauu

SEQ ID NO: 4081800 - RNA, 14 nt, Variola virus
cauaacauuguuua

SEQ ID NO: 4081801 - RNA, 13 nt, Variola virus
cauaagcgcuaua

SEQ ID NO: 4081802 - RNA, 20 nt, Variola virus
cauaagcuugacuacauuug

SEQ ID NO: 4081803 - RNA, 17 nt, Variola virus
cauaagucuaauagacu

SEQ ID NO: 4081804 - RNA, 17 nt, Variola virus
cauaauaaauuuuucca

SEQ ID NO: 4081805 - RNA, 19 nt, Variola virus
cauaauacuaucuauguua

SEQ ID NO: 4081806 - RNA, 22 nt, Variola virus
cauaauacucccacaaauacug

SEQ ID NO: 4081807 - RNA, 16 nt, Variola virus
cauaauagaauguauu

SEQ ID NO: 4081808 - RNA, 13 nt, Variola virus
cauaauaucuuua

SEQ ID NO: 4081809 - RNA, 15 nt, Variola virus
cauaauauuaucaaa

SEQ ID NO: 4081810 - RNA, 20 nt, Variola virus
cauaaucaucacugucauca

SEQ ID NO: 4081811 - RNA, 21 nt, Variola virus
cauaaucaucacugucaucag

SEQ ID NO: 4081812 - RNA, 15 nt, Variola virus
cauaauccauuucca

SEQ ID NO: 4081813 - RNA, 12 nt, Variola virus
cauaauccucua

SEQ ID NO: 4081814 - RNA, 18 nt, Variola virus
cauaauccuuguaaugau

SEQ ID NO: 4081815 - RNA, 14 nt, Variola virus
gaaaucguauauaa

SEQ ID NO: 4081816 - RNA, 19 nt, Variola virus
gaaaugggucauauuauca

SEQ ID NO: 4081817 - RNA, 14 nt, Variola virus
gaaaugguacagaa

SEQ ID NO: 4081818 - RNA, 18 nt, Variola virus
gaaauugguuuauaaugu

SEQ ID NO: 4081819 - RNA, 18 nt, Variola virus
gaaauuugaaagaacuac

SEQ ID NO: 4081820 - RNA, 17 nt, Variola virus
gaacaauaaaagagaau

SEQ ID NO: 4081821 - RNA, 20 nt, Variola virus
gaacacauaaccaauuuaua

SEQ ID NO: 4081822 - RNA, 16 nt, Variola virus
gaacacguuaaacaaa

SEQ ID NO: 4081823 - RNA, 16 nt, Variola virus
gaacagauaguuuauc

SEQ ID NO: 4081824 - RNA, 20 nt, Variola virus
gaacauaucuauauaauuau

SEQ ID NO: 4081825 - RNA, 19 nt, Variola virus
gaacauggguuacauauca

SEQ ID NO: 4081826 - RNA, 21 nt, Variola virus
gaaccaguaccagaucuuaau

SEQ ID NO: 4081827 - RNA, 19 nt, Variola virus
gaaccauuacaaauauuau

SEQ ID NO: 4081828 - RNA, 23 nt, Variola virus
gaacccauaaauacaccaaauau

SEQ ID NO: 4081829 - RNA, 21 nt, Variola virus
gaacgauauuugugaaaauau

SEQ ID NO: 4081830 - RNA, 19 nt, Variola virus
gaacguauuaauacuuaau

SEQ ID NO: 4081831 - RNA, 19 nt, Variola virus
gaacuaaaaaacgaaauau

SEQ ID NO: 4081832 - RNA, 19 nt, Variola virus
gaacuaauccacauaugau

SEQ ID NO: 4081833 - RNA, 22 nt, Variola virus
gaacuauaaguguguuguaaac

SEQ ID NO: 4081834 - RNA, 18 nt, Variola virus
gaacuggacuguauaucu

SEQ ID NO: 4081835 - RNA, 21 nt, Variola virus
gaacuuacugacaaaguuaag

SEQ ID NO: 4081836 - RNA, 15 nt, Variola virus
gaacuuguuaaagaa

SEQ ID NO: 4081837 - RNA, 16 nt, Variola virus
gaagaacgauaaugaa

SEQ ID NO: 4081838 - RNA, 13 nt, Variola virus
gaagaaguuaaua

SEQ ID NO: 4081839 - RNA, 19 nt, Variola virus
gaagaauggaacuaaaaaa

SEQ ID NO: 4081840 - RNA, 20 nt, Variola virus
gaagaauucuagaucaagaa

SEQ ID NO: 4081841 - RNA, 14 nt, Variola virus
gaagacuccuggua

SEQ ID NO: 4081842 - RNA, 19 nt, Variola virus
gaagagauuucaacagacu

SEQ ID NO: 4081843 - RNA, 13 nt, Variola virus
gaagagguuauau

SEQ ID NO: 4081844 - RNA, 22 nt, Variola virus
gaagaugauuuugcuagagaua

SEQ ID NO: 4081845 - RNA, 12 nt, Variola virus
gaagcaaaauau

SEQ ID NO: 4081846 - RNA, 23 nt, Variola virus
gaagcagcugcagcaacuucugu

SEQ ID NO: 4081847 - RNA, 16 nt, Variola virus
gaagcauuggaagcaa

SEQ ID NO: 4081848 - RNA, 14 nt, Variola virus
gaagguauuuccau

SEQ ID NO: 4081849 - RNA, 17 nt, Variola virus
gaaguaaaagauuuaua

SEQ ID NO: 4081850 - RNA, 17 nt, Variola virus
gaagucggauuauguaa

SEQ ID NO: 4081851 - RNA, 15 nt, Variola virus
gaaguuguauacuau

SEQ ID NO: 4081852 - RNA, 21 nt, Variola virus
gaaguuuuguauuguauauac

SEQ ID NO: 4081853 - RNA, 21 nt, Variola virus
gaauaacuguaauuuuauucu

SEQ ID NO: 4081854 - RNA, 19 nt, Variola virus
gaauaagaguguaguauca

SEQ ID NO: 4081855 - RNA, 13 nt, Variola virus
gaauaagcuauau

SEQ ID NO: 4081856 - RNA, 18 nt, Variola virus
gaauaauguucaaaucua

SEQ ID NO: 4081857 - RNA, 17 nt, Variola virus
gaauacauaaagaacga

SEQ ID NO: 4081858 - RNA, 14 nt, Variola virus
gaauacuaaauuga

SEQ ID NO: 4081859 - RNA, 13 nt, Variola virus
gaauagaaaucuu

SEQ ID NO: 4081860 - RNA, 14 nt, Variola virus
gaauagacuuucug

SEQ ID NO: 4081861 - RNA, 23 nt, Variola virus
gaauagcagauagauaaagucuu

SEQ ID NO: 4081862 - RNA, 17 nt, Variola virus
gaauaguaguagcucua

SEQ ID NO: 4081863 - RNA, 16 nt, Variola virus
gaauauaaaauaacua

SEQ ID NO: 4081864 - RNA, 14 nt, Variola virus
gaauauacaaguau

SEQ ID NO: 4081865 - RNA, 12 nt, Variola virus
gaauauaugauu

SEQ ID NO: 4081866 - RNA, 15 nt, Variola virus
gaauauauguuuaua

SEQ ID NO: 4081867 - RNA, 13 nt, Variola virus
gaauauauuuaua

SEQ ID NO: 4081868 - RNA, 19 nt, Variola virus
gaauaucacauaucauguu

SEQ ID NO: 4081869 - RNA, 14 nt, Variola virus
gaauaucauauuac

SEQ ID NO: 4081870 - RNA, 17 nt, Variola virus
gaauaucuacaauauau

SEQ ID NO: 4081871 - RNA, 17 nt, Variola virus
gaauaucugaugauauu

SEQ ID NO: 4081872 - RNA, 16 nt, Variola virus
gaauaucuuuauucau

SEQ ID NO: 4081873 - RNA, 12 nt, Variola virus
gaauauugauuu

SEQ ID NO: 4081874 - RNA, 19 nt, Variola virus
gaauauuuugauaaugaac

SEQ ID NO: 4081875 - RNA, 22 nt, Variola virus
gaauauuuugauaaugaacgaa

SEQ ID NO: 4081876 - RNA, 13 nt, Variola virus
gaaucacaaacau

SEQ ID NO: 4081877 - RNA, 19 nt, Variola virus
gaaucaguuaauaaauuca

SEQ ID NO: 4081878 - RNA, 15 nt, Variola virus
gaaucauacaaaaau

SEQ ID NO: 4081879 - RNA, 14 nt, Variola virus
gaaucauuuuugca

SEQ ID NO: 4081880 - RNA, 15 nt, Variola virus
gaaucccuacauauu

SEQ ID NO: 4081881 - RNA, 15 nt, Variola virus
gaauccuauacucug

SEQ ID NO: 4081882 - RNA, 16 nt, Variola virus
gaaucggauaguuuaa

SEQ ID NO: 4081883 - RNA, 24 nt, Variola virus
gaaucuagaucgaugauaacuucu

SEQ ID NO: 4081884 - RNA, 22 nt, Variola virus
gaaugcuaaugucaaguuuauu

SEQ ID NO: 4081885 - RNA, 17 nt, Variola virus
gaaugggugucaucuau

SEQ ID NO: 4081886 - RNA, 18 nt, Variola virus
gaauguggaauuugcuau

SEQ ID NO: 4081887 - RNA, 14 nt, Variola virus
gaauguguauucuc

SEQ ID NO: 4081888 - RNA, 16 nt, Variola virus
gaauuaauagauauau

SEQ ID NO: 4081889 - RNA, 15 nt, Variola virus
gaauuaauguccuga

SEQ ID NO: 4081890 - RNA, 20 nt, Variola virus
gaauuagucgucgaauauau

SEQ ID NO: 4081891 - RNA, 22 nt, Variola virus
gaauuauuacuuaaguuguaaa

SEQ ID NO: 4081892 - RNA, 13 nt, Variola virus
gaauucaaaauau

SEQ ID NO: 4081893 - RNA, 14 nt, Variola virus
gaauugacaaauaa

SEQ ID NO: 4081894 - RNA, 14 nt, Variola virus
gaauuguaacuuga

SEQ ID NO: 4081895 - RNA, 12 nt, Variola virus
gaauuguauauu

SEQ ID NO: 4081896 - RNA, 14 nt, Variola virus
gaauuuagaaauau

SEQ ID NO: 4081897 - RNA, 14 nt, Variola virus
gaauuuaguaauau

SEQ ID NO: 4081898 - RNA, 15 nt, Variola virus
gaauuuauuaauaca

SEQ ID NO: 4081899 - RNA, 23 nt, Variola virus
gacaaaaucaacuacauaaucuu

SEQ ID NO: 4081900 - RNA, 13 nt, Variola virus
gacaaaaugugau

SEQ ID NO: 4081901 - RNA, 11 nt, Variola virus
gacaaauguaa

SEQ ID NO: 4081902 - RNA, 14 nt, Variola virus
gacaaauuauucua

SEQ ID NO: 4081903 - RNA, 20 nt, Variola virus
gacaacuuaaucugaugaau

SEQ ID NO: 4081904 - RNA, 20 nt, Variola virus
gacaagauauauauacucua

SEQ ID NO: 4081905 - RNA, 16 nt, Variola virus
gacaauacuguauuau

SEQ ID NO: 4081906 - RNA, 18 nt, Variola virus
gacaauaguguucugaau

SEQ ID NO: 4081907 - RNA, 20 nt, Variola virus
gacacauucuuuagaacuuc

SEQ ID NO: 4081908 - RNA, 17 nt, Variola virus
gacacuaguuaagaaca

SEQ ID NO: 4081909 - RNA, 17 nt, Variola virus
gacacuauucauguaau

SEQ ID NO: 4081910 - RNA, 22 nt, Variola virus
gacacucuauaucuagaaauaa

SEQ ID NO: 4081911 - RNA, 22 nt, Variola virus
gacacugccguauauaggaaaa

SEQ ID NO: 4081912 - RNA, 19 nt, Variola virus
gacagaagaauaugaugau

SEQ ID NO: 4081913 - RNA, 15 nt, Variola virus
gacauaguaauacau

SEQ ID NO: 4081914 - RNA, 17 nt, Variola virus
gacauauccgaugaugu

SEQ ID NO: 4081915 - RNA, 17 nt, Variola virus
gacaucaauaugccaau

SEQ ID NO: 4081916 - RNA, 23 nt, Variola virus
gacauccaugguggaauaaacua

SEQ ID NO: 4081917 - RNA, 11 nt, Variola virus
gacaugaugau

SEQ ID NO: 4081918 - RNA, 23 nt, Variola virus
gacauuaugcuaccaucaugaau

SEQ ID NO: 4081919 - RNA, 21 nt, Variola virus
gacauugauauauauauuaag

SEQ ID NO: 4081920 - RNA, 16 nt, Variola virus
gacauugucagaaauu

SEQ ID NO: 4081921 - RNA, 13 nt, Variola virus
gacauuuucuagu

SEQ ID NO: 4081922 - RNA, 20 nt, Variola virus
gaccaauuacugauaaugua

SEQ ID NO: 4081923 - RNA, 17 nt, Variola virus
gaccaauuuauuacuug

SEQ ID NO: 4081924 - RNA, 19 nt, Variola virus
gaccguccauaguuuguau

SEQ ID NO: 4081925 - RNA, 14 nt, Variola virus
gaccuccuccacca

SEQ ID NO: 4081926 - RNA, 14 nt, Variola virus
gaccuuuuccuuau

SEQ ID NO: 4081927 - RNA, 20 nt, Variola virus
gaccuuuuccuuaucuucau

SEQ ID NO: 4081928 - RNA, 17 nt, Variola virus
gacgaugauuucugaau

SEQ ID NO: 4081929 - RNA, 17 nt, Variola virus
gacgcguucauuggaaa

SEQ ID NO: 4081930 - RNA, 21 nt, Variola virus
gacgcuuguuaauaaguaaau

SEQ ID NO: 4081931 - RNA, 12 nt, Variola virus
gacguaaaugug

SEQ ID NO: 4081932 - RNA, 17 nt, Variola virus
gacgucucuucgugaau

SEQ ID NO: 4081933 - RNA, 22 nt, Variola virus
gacuaaaucagauuaugaggau

SEQ ID NO: 4081934 - RNA, 21 nt, Variola virus
gacuaccuggcucauugauua

SEQ ID NO: 4081935 - RNA, 15 nt, Variola virus
gacuaucuuuugaaa

SEQ ID NO: 4081936 - RNA, 21 nt, Variola virus
gacucgcguuuagaggaguga

SEQ ID NO: 4081937 - RNA, 23 nt, Variola virus
gacucucaguaagaguuaugaau

SEQ ID NO: 4081938 - RNA, 12 nt, Variola virus
gacuguacgaua

SEQ ID NO: 4081939 - RNA, 19 nt, Variola virus
gacuguagaacucaugaau

SEQ ID NO: 4081940 - RNA, 21 nt, Variola virus
gacuuauuaaaaaacauauau

SEQ ID NO: 4081941 - RNA, 22 nt, Variola virus
gacuuguuaaaucuauauacca

SEQ ID NO: 4081942 - RNA, 18 nt, Variola virus
gacuuuaaccuauacaug

SEQ ID NO: 4081943 - RNA, 15 nt, Variola virus
gagaaaauagauauc

SEQ ID NO: 4081944 - RNA, 14 nt, Variola virus
gagaaauuauuccu

SEQ ID NO: 4081945 - RNA, 23 nt, Variola virus
gagaacauacauuuguaaaagua

SEQ ID NO: 4081946 - RNA, 13 nt, Variola virus
gagaauaauagau

SEQ ID NO: 4081947 - RNA, 14 nt, Variola virus
gagacuuaaacaac

SEQ ID NO: 4081948 - RNA, 19 nt, Variola virus
gagagucaauaucauuaau

SEQ ID NO: 4081949 - RNA, 15 nt, Variola virus
gagauaauagaaaau

SEQ ID NO: 4081950 - RNA, 21 nt, Variola virus
gagauaucccguuagaaauau

SEQ ID NO: 4081951 - RNA, 20 nt, Variola virus
gagauccugcauagaaauau

SEQ ID NO: 4081952 - RNA, 18 nt, Variola virus
gagauguuauuaaauguu

SEQ ID NO: 4081953 - RNA, 21 nt, Variola virus
gagauuuguuuuguuaaacaa

SEQ ID NO: 4081954 - RNA, 20 nt, Variola virus
gagcaaaaguaguucaacau

SEQ ID NO: 4081955 - RNA, 23 nt, Variola virus
gagcuaauuuuuguaaauaacua

SEQ ID NO: 4081956 - RNA, 19 nt, Variola virus
gagcucaucuaagaaauag

SEQ ID NO: 4081957 - RNA, 20 nt, Variola virus
gaggaguuauugauauuaac

SEQ ID NO: 4081958 - RNA, 16 nt, Variola virus
gaggaugagagucaau

SEQ ID NO: 4081959 - RNA, 21 nt, Variola virus
gaguacauuucacagaaacac

SEQ ID NO: 4081960 - RNA, 16 nt, Variola virus
gaguaggugcaacaau

SEQ ID NO: 4081961 - RNA, 20 nt, Variola virus
gaguauaaaacauuaaaugu

SEQ ID NO: 4081962 - RNA, 14 nt, Variola virus
gaguauauauuaag

SEQ ID NO: 4081963 - RNA, 14 nt, Variola virus
gagugauucuaguu

SEQ ID NO: 4081964 - RNA, 19 nt, Variola virus
gaguuagauauuaauaaca

SEQ ID NO: 4081965 - RNA, 15 nt, Variola virus
gaguugauuguaaac

SEQ ID NO: 4081966 - RNA, 15 nt, Variola virus
gaguuggauaucauc

SEQ ID NO: 4081967 - RNA, 12 nt, Variola virus
gaguuuaaaacu

SEQ ID NO: 4081968 - RNA, 21 nt, Variola virus
gaguuuagauuaguuaauaca

SEQ ID NO: 4081969 - RNA, 20 nt, Variola virus
gaguuuaucacuaaguucug

SEQ ID NO: 4081970 - RNA, 22 nt, Variola virus
gauaaaagaugcauauauuaga

SEQ ID NO: 4081971 - RNA, 15 nt, Variola virus
gauaaaaucaaacuu

SEQ ID NO: 4081972 - RNA, 18 nt, Variola virus
gauaaaauccuccuauca

SEQ ID NO: 4081973 - RNA, 16 nt, Variola virus
gauaaacgugaacagg

SEQ ID NO: 4081974 - RNA, 15 nt, Variola virus
gauaaagauauauga

SEQ ID NO: 4081975 - RNA, 17 nt, Variola virus
gauaaauuaaugaucua

SEQ ID NO: 4081976 - RNA, 17 nt, Variola virus
gauaacaauuuguuaau

SEQ ID NO: 4081977 - RNA, 16 nt, Variola virus
gauaacacauuuucau

SEQ ID NO: 4081978 - RNA, 22 nt, Variola virus
gauaacagcauuuguguaguuu

SEQ ID NO: 4081979 - RNA, 21 nt, Variola virus
gauaacuagaaucagaaucua

SEQ ID NO: 4081980 - RNA, 16 nt, Variola virus
gauaagauaaaaucua

SEQ ID NO: 4081981 - RNA, 17 nt, Variola virus
gauaaguccuucaaaau

SEQ ID NO: 4081982 - RNA, 22 nt, Variola virus
gauaaguuuaaggcguuugcau

SEQ ID NO: 4081983 - RNA, 13 nt, Variola virus
gauaauaaaucaa

SEQ ID NO: 4081984 - RNA, 20 nt, Variola virus
gauaauacauuuucuuacaa

SEQ ID NO: 4081985 - RNA, 16 nt, Variola virus
gauaauauaaauauga

SEQ ID NO: 4081986 - RNA, 13 nt, Variola virus
gauaaucauuuaa

SEQ ID NO: 4081987 - RNA, 20 nt, Variola virus
gauaaugauacgauacuaua

SEQ ID NO: 4081988 - RNA, 13 nt, Variola virus
gauaauuauccau

SEQ ID NO: 4081989 - RNA, 23 nt, Variola virus
gauaccaauaaguuuuagauauu

SEQ ID NO: 4081990 - RNA, 21 nt, Variola virus
gauaccgaucacguucuaguu

SEQ ID NO: 4081991 - RNA, 19 nt, Variola virus
gauaccucauuuaucaugu

SEQ ID NO: 4081992 - RNA, 14 nt, Variola virus
gauacgaugaugac

SEQ ID NO: 4081993 - RNA, 15 nt, Variola virus
gauagaaacauaugc

SEQ ID NO: 4081994 - RNA, 15 nt, Variola virus
gauagaacaaaauac

SEQ ID NO: 4081995 - RNA, 13 nt, Variola virus
gauagacuuucuc

SEQ ID NO: 4081996 - RNA, 20 nt, Variola virus
gauagaugaacugacauaua

SEQ ID NO: 4081997 - RNA, 21 nt, Variola virus
gauagaugauucgauaaauaa

SEQ ID NO: 4081998 - RNA, 19 nt, Variola virus
gauagcuuccagauuuaaa

SEQ ID NO: 4081999 - RNA, 15 nt, Variola virus
gauaguaaaauaaag

SEQ ID NO: 4082000 - RNA, 19 nt, Variola virus
gauaguauucaagucaaag

SEQ ID NO: 4082001 - RNA, 16 nt, Variola virus
gauaguugaucagaau

SEQ ID NO: 4082002 - RNA, 16 nt, Variola virus
gauaguuguugugaca

SEQ ID NO: 4082003 - RNA, 16 nt, Variola virus
gauauacuacuucucc

SEQ ID NO: 4082004 - RNA, 20 nt, Variola virus
gauauagaaaucggaaauuu

SEQ ID NO: 4082005 - RNA, 20 nt, Variola virus
gauauaguauauuccaguuc

SEQ ID NO: 4082006 - RNA, 23 nt, Variola virus
gauauaucaaaauuagacuggag

SEQ ID NO: 4082007 - RNA, 22 nt, Variola virus
gauaucaacauggaguauauca

SEQ ID NO: 4082008 - RNA, 14 nt, Variola virus
gauaucuccauuaa

SEQ ID NO: 4082009 - RNA, 15 nt, Variola virus
gauauggauuuccag

SEQ ID NO: 4082010 - RNA, 12 nt, Variola virus
gauauuaguaca

SEQ ID NO: 4082011 - RNA, 21 nt, Variola virus
gauauucagaaagcuguggau

SEQ ID NO: 4082012 - RNA, 20 nt, Variola virus
gauauuuucguguuuuaguu

SEQ ID NO: 4082013 - RNA, 17 nt, Variola virus
gauauuuugcaaaauag

SEQ ID NO: 4082014 - RNA, 15 nt, Variola virus
gaucaaauuauugau

SEQ ID NO: 4082015 - RNA, 16 nt, Variola virus
gaucagguaaaacaau

SEQ ID NO: 4082016 - RNA, 15 nt, Variola virus
gaucauacauuauga

SEQ ID NO: 4082017 - RNA, 14 nt, Variola virus
gaucauucuuuuag

SEQ ID NO: 4082018 - RNA, 15 nt, Variola virus
gauccaaaacauaga

SEQ ID NO: 4082019 - RNA, 14 nt, Variola virus
gauccaacacuauu

SEQ ID NO: 4082020 - RNA, 21 nt, Variola virus
gauccaauaaauuaucaaaua

SEQ ID NO: 4082021 - RNA, 23 nt, Variola virus
gauccacaugcuguacaggccag

SEQ ID NO: 4082022 - RNA, 18 nt, Variola virus
gauccaucaaaaaacaac

SEQ ID NO: 4082023 - RNA, 13 nt, Variola virus
gaucguuaaugaa

SEQ ID NO: 4082024 - RNA, 15 nt, Variola virus
gaucuaaaaaaaacu

SEQ ID NO: 4082025 - RNA, 16 nt, Variola virus
gaucuaauagaugaau

SEQ ID NO: 4082026 - RNA, 22 nt, Variola virus
gaucuaauagaugaauauauca

SEQ ID NO: 4082027 - RNA, 12 nt, Variola virus
gaucuauaaaaa

SEQ ID NO: 4082028 - RNA, 20 nt, Variola virus
gaucuauauguuuuauuaau

SEQ ID NO: 4082029 - RNA, 23 nt, Variola virus
gaucuccucuaucuguacuaucu

SEQ ID NO: 4082030 - RNA, 14 nt, Variola virus
gaucuggaaaauaa

SEQ ID NO: 4082031 - RNA, 16 nt, Variola virus
gaucuuaccaucuucu

SEQ ID NO: 4082032 - RNA, 17 nt, Variola virus
gaugaaggaauaaucuc

SEQ ID NO: 4082033 - RNA, 19 nt, Variola virus
gaugaaggugggacuauau

SEQ ID NO: 4082034 - RNA, 18 nt, Variola virus
gaugaauugauuaauguu

SEQ ID NO: 4082035 - RNA, 17 nt, Variola virus
gaugagaacagaagcgu

SEQ ID NO: 4082036 - RNA, 17 nt, Variola virus
gaugaggaagcauauuc

SEQ ID NO: 4082037 - RNA, 18 nt, Variola virus
gaugaggugguugcagaa

SEQ ID NO: 4082038 - RNA, 13 nt, Variola virus
gaugaguauauau

SEQ ID NO: 4082039 - RNA, 22 nt, Variola virus
gaugauaucaguauauuauuau

SEQ ID NO: 4082040 - RNA, 14 nt, Variola virus
gaugccucuuuuag

SEQ ID NO: 4082041 - RNA, 22 nt, Variola virus
gauggauauauuaaagucaaau

SEQ ID NO: 4082042 - RNA, 18 nt, Variola virus
gauggguucgauauuaau

SEQ ID NO: 4082043 - RNA, 19 nt, Variola virus
gauguacugaagguauuau

SEQ ID NO: 4082044 - RNA, 18 nt, Variola virus
gaugucaaugguauguau

SEQ ID NO: 4082045 - RNA, 18 nt, Variola virus
gaugucuacucguauauu

SEQ ID NO: 4082046 - RNA, 16 nt, Variola virus
gaugucuugacuaccu

SEQ ID NO: 4082047 - RNA, 13 nt, Variola virus
gauguuagauaua

SEQ ID NO: 4082048 - RNA, 16 nt, Variola virus
gauguuuguaucaugc

SEQ ID NO: 4082049 - RNA, 14 nt, Variola virus
gauguuuguucauu

SEQ ID NO: 4082050 - RNA, 19 nt, Variola virus
gauuaaaaauaaaguuauc

SEQ ID NO: 4082051 - RNA, 14 nt, Variola virus
gauuaauaauucau

SEQ ID NO: 4082052 - RNA, 21 nt, Variola virus
gauuaauaguuuuauuugaag

SEQ ID NO: 4082053 - RNA, 23 nt, Variola virus
gauuaaugcuacagauauuauca

SEQ ID NO: 4082054 - RNA, 15 nt, Variola virus
gauuaauuagauaua

SEQ ID NO: 4082055 - RNA, 19 nt, Variola virus
gauuauaaauaucgauguu

SEQ ID NO: 4082056 - RNA, 20 nt, Variola virus
gauuauaauccuuauacauc

SEQ ID NO: 4082057 - RNA, 20 nt, Variola virus
gauucacaaaacguauauag

SEQ ID NO: 4082058 - RNA, 17 nt, Variola virus
gauucaugauaguuuua

SEQ ID NO: 4082059 - RNA, 17 nt, Variola virus
gauucuaguaucuuuug

SEQ ID NO: 4082060 - RNA, 13 nt, Variola virus
gauucuuauucac

SEQ ID NO: 4082061 - RNA, 19 nt, Variola virus
gauucuucacaagugaaau

SEQ ID NO: 4082062 - RNA, 22 nt, Variola virus
gauuggauaaacuaaaauuaaa

SEQ ID NO: 4082063 - RNA, 22 nt, Variola virus
gauuggauaagaaaacauaucu

SEQ ID NO: 4082064 - RNA, 21 nt, Variola virus
gauugggaaccagucaugaau

SEQ ID NO: 4082065 - RNA, 22 nt, Variola virus
gauuguacacccaucauggaau

SEQ ID NO: 4082066 - RNA, 22 nt, Variola virus
gauuguccggcauaucauguag

SEQ ID NO: 4082067 - RNA, 16 nt, Variola virus
gauuguugccguaaau

SEQ ID NO: 4082068 - RNA, 18 nt, Variola virus
gauuguuuaagaagagaa

SEQ ID NO: 4082069 - RNA, 17 nt, Variola virus
gauuuaucuaguuuauc

SEQ ID NO: 4082070 - RNA, 21 nt, Variola virus
gauuuauuugauaaucauguu

SEQ ID NO: 4082071 - RNA, 14 nt, Variola virus
gauuucuauuuuua

SEQ ID NO: 4082072 - RNA, 13 nt, Variola virus
acauuaauacaaa

SEQ ID NO: 4082073 - RNA, 19 nt, Variola virus
acauuaaucuauuagaauu

SEQ ID NO: 4082074 - RNA, 14 nt, Variola virus
acauuaauugauua

SEQ ID NO: 4082075 - RNA, 18 nt, Variola virus
acauuagauacaauggau

SEQ ID NO: 4082076 - RNA, 20 nt, Variola virus
acauuaguagggauagaaug

SEQ ID NO: 4082077 - RNA, 20 nt, Variola virus
acauuaguucccaaugaauc

SEQ ID NO: 4082078 - RNA, 15 nt, Variola virus
acauuauaugaugau

SEQ ID NO: 4082079 - RNA, 13 nt, Variola virus
acauucagaaaga

SEQ ID NO: 4082080 - RNA, 14 nt, Variola virus
acauucuaggaaug

SEQ ID NO: 4082081 - RNA, 21 nt, Variola virus
acauucuuaaccauauaucca

SEQ ID NO: 4082082 - RNA, 14 nt, Variola virus
acauugauuaaauu

SEQ ID NO: 4082083 - RNA, 17 nt, Variola virus
acauugugauuaaacau

SEQ ID NO: 4082084 - RNA, 15 nt, Variola virus
acauugugccaauaa

SEQ ID NO: 4082085 - RNA, 20 nt, Variola virus
acauuucagcaaucuaacau

SEQ ID NO: 4082086 - RNA, 13 nt, Variola virus
acauuuccuacau

SEQ ID NO: 4082087 - RNA, 16 nt, Variola virus
acauuuguauaaucuu

SEQ ID NO: 4082088 - RNA, 19 nt, Variola virus
acauuuuccauuuauaaca

SEQ ID NO: 4082089 - RNA, 17 nt, Variola virus
acauuuuuauaaauaga

SEQ ID NO: 4082090 - RNA, 20 nt, Variola virus
acauuuuuuaaagcuaaaau

SEQ ID NO: 4082091 - RNA, 15 nt, Variola virus
acauuuuuuaguaga

SEQ ID NO: 4082092 - RNA, 14 nt, Variola virus
accaaaaucaauau

SEQ ID NO: 4082093 - RNA, 12 nt, Variola virus
accaaauuauca

SEQ ID NO: 4082094 - RNA, 14 nt, Variola virus
accaaguagaaauu

SEQ ID NO: 4082095 - RNA, 21 nt, Variola virus
accaaguuaaauuuuacuuua

SEQ ID NO: 4082096 - RNA, 18 nt, Variola virus
accaauaauaguagaauu

SEQ ID NO: 4082097 - RNA, 22 nt, Variola virus
accaauaugucuguacaaaugu

SEQ ID NO: 4082098 - RNA, 23 nt, Variola virus
accaaucugggcguauaaugaau

SEQ ID NO: 4082099 - RNA, 23 nt, Variola virus
accaaugaauggauuaccguguu

SEQ ID NO: 4082100 - RNA, 19 nt, Variola virus
accaauuacugauaaugua

SEQ ID NO: 4082101 - RNA, 23 nt, Variola virus
accaauuacugauaauguagaaa

SEQ ID NO: 4082102 - RNA, 19 nt, Variola virus
accaauuguuuuuguacau

SEQ ID NO: 4082103 - RNA, 15 nt, Variola virus
accacaggagaaugg

SEQ ID NO: 4082104 - RNA, 14 nt, Variola virus
accacauaauacaa

SEQ ID NO: 4082105 - RNA, 17 nt, Variola virus
accaccaaauaaaauuc

SEQ ID NO: 4082106 - RNA, 13 nt, Variola virus
accacuucucuau

SEQ ID NO: 4082107 - RNA, 22 nt, Variola virus
accagaguuaucaagagaaaau

SEQ ID NO: 4082108 - RNA, 16 nt, Variola virus
accagcggcuacuaaa

SEQ ID NO: 4082109 - RNA, 22 nt, Variola virus
accauaacuguauaaaauggag

SEQ ID NO: 4082110 - RNA, 14 nt, Variola virus
accauauacugagu

SEQ ID NO: 4082111 - RNA, 21 nt, Variola virus
accauccuuuaaaaaaaauga

SEQ ID NO: 4082112 - RNA, 14 nt, Variola virus
accaucgauuguuu

SEQ ID NO: 4082113 - RNA, 14 nt, Variola virus
accauuaaaaauug

SEQ ID NO: 4082114 - RNA, 19 nt, Variola virus
accauuagauaaaguugau

SEQ ID NO: 4082115 - RNA, 19 nt, Variola virus
acccaaagagaccaaugaa

SEQ ID NO: 4082116 - RNA, 16 nt, Variola virus
acccaugauaaugaau

SEQ ID NO: 4082117 - RNA, 14 nt, Variola virus
acccauuacauaua

SEQ ID NO: 4082118 - RNA, 19 nt, Variola virus
acccgcauacuuuaacaaa

SEQ ID NO: 4082119 - RNA, 18 nt, Variola virus
accgaguuuaaaacuucu

SEQ ID NO: 4082120 - RNA, 22 nt, Variola virus
accggacgacauauuaaucuuu

SEQ ID NO: 4082121 - RNA, 19 nt, Variola virus
accguauuacucuacagua

SEQ ID NO: 4082122 - RNA, 18 nt, Variola virus
accgucggcguuaauagu

SEQ ID NO: 4082123 - RNA, 14 nt, Variola virus
accuagaacaaugu

SEQ ID NO: 4082124 - RNA, 13 nt, Variola virus
accucgagaaugu

SEQ ID NO: 4082125 - RNA, 17 nt, Variola virus
accucuaguuucagaau

SEQ ID NO: 4082126 - RNA, 21 nt, Variola virus
accugccauaaauaaaugcuu

SEQ ID NO: 4082127 - RNA, 14 nt, Variola virus
accuguauacugua

SEQ ID NO: 4082128 - RNA, 23 nt, Variola virus
accuuugguucuuuaaaagaaac

SEQ ID NO: 4082129 - RNA, 14 nt, Variola virus
acgaaagcaaagaa

SEQ ID NO: 4082130 - RNA, 20 nt, Variola virus
acgaaauaucucaucaagaa

SEQ ID NO: 4082131 - RNA, 23 nt, Variola virus
acgaacgucuccaauauaugaua

SEQ ID NO: 4082132 - RNA, 18 nt, Variola virus
acgacucuugagacuuua

SEQ ID NO: 4082133 - RNA, 19 nt, Variola virus
acgagaauacguaauaauu

SEQ ID NO: 4082134 - RNA, 18 nt, Variola virus
acgagugaacguaauaga

SEQ ID NO: 4082135 - RNA, 17 nt, Variola virus
acgauacuaugcauauu

SEQ ID NO: 4082136 - RNA, 22 nt, Variola virus
acgauauagacaacguagaauu

SEQ ID NO: 4082137 - RNA, 13 nt, Variola virus
acgaucaaccaaa

SEQ ID NO: 4082138 - RNA, 15 nt, Variola virus
acgaugaaaaugaug

SEQ ID NO: 4082139 - RNA, 17 nt, Variola virus
acgaugaaaaugugcuu

SEQ ID NO: 4082140 - RNA, 21 nt, Variola virus
acgaugguuuucacauuuaac

SEQ ID NO: 4082141 - RNA, 18 nt, Variola virus
acgaugucaauaaugccg

SEQ ID NO: 4082142 - RNA, 22 nt, Variola virus
acgauuacaucaccucuaacau

SEQ ID NO: 4082143 - RNA, 14 nt, Variola virus
acgcagauagcuau

SEQ ID NO: 4082144 - RNA, 17 nt, Variola virus
acgcauaaaaaugccac

SEQ ID NO: 4082145 - RNA, 15 nt, Variola virus
acgcauccauccaaa

SEQ ID NO: 4082146 - RNA, 23 nt, Variola virus
acgccauagacauugaaaaugaa

SEQ ID NO: 4082147 - RNA, 17 nt, Variola virus
acgcccuuguauguuuu

SEQ ID NO: 4082148 - RNA, 19 nt, Variola virus
acggagauacaucuucaau

SEQ ID NO: 4082149 - RNA, 22 nt, Variola virus
acggagucauaacuauuuuacc

SEQ ID NO: 4082150 - RNA, 21 nt, Variola virus
acggaugaaaauaagaaaaau

SEQ ID NO: 4082151 - RNA, 20 nt, Variola virus
acggcaaaccaaaaacauuu

SEQ ID NO: 4082152 - RNA, 17 nt, Variola virus
acggcaacuggaaaguc

SEQ ID NO: 4082153 - RNA, 22 nt, Variola virus
acgggaaaggaauuaauuauuc

SEQ ID NO: 4082154 - RNA, 15 nt, Variola virus
acggguucucaauau

SEQ ID NO: 4082155 - RNA, 15 nt, Variola virus
acgguaauaaaaugu

SEQ ID NO: 4082156 - RNA, 16 nt, Variola virus
acguaaccaagaaguu

SEQ ID NO: 4082157 - RNA, 18 nt, Variola virus
acguacauaacauuguuu

SEQ ID NO: 4082158 - RNA, 15 nt, Variola virus
acguagaaaacggau

SEQ ID NO: 4082159 - RNA, 19 nt, Variola virus
acguauacauuuaaugaau

SEQ ID NO: 4082160 - RNA, 17 nt, Variola virus
acguauugauaaauaga

SEQ ID NO: 4082161 - RNA, 21 nt, Variola virus
acgucaucgcuucaucuauca

SEQ ID NO: 4082162 - RNA, 19 nt, Variola virus
acguccaucagcauuguuu

SEQ ID NO: 4082163 - RNA, 21 nt, Variola virus
acgucuccaauauaugauaac

SEQ ID NO: 4082164 - RNA, 12 nt, Variola virus
acgucuguaguc

SEQ ID NO: 4082165 - RNA, 13 nt, Variola virus
acgugauagcucc

SEQ ID NO: 4082166 - RNA, 21 nt, Variola virus
acgugauggauauauuaaagu

SEQ ID NO: 4082167 - RNA, 23 nt, Variola virus
acgugucaauggcaguauuggga

SEQ ID NO: 4082168 - RNA, 22 nt, Variola virus
acguuuagccgccuuuaauaga

SEQ ID NO: 4082169 - RNA, 16 nt, Variola virus
acguuuauucucaaau

SEQ ID NO: 4082170 - RNA, 23 nt, Variola virus
acguuucauuuuuugucuauaau

SEQ ID NO: 4082171 - RNA, 19 nt, Variola virus
acguuucugucaacaaugu

SEQ ID NO: 4082172 - RNA, 13 nt, Variola virus
acuaaaacugaag

SEQ ID NO: 4082173 - RNA, 16 nt, Variola virus
acuaaacuaacuccuu

SEQ ID NO: 4082174 - RNA, 12 nt, Variola virus
acuaaagacuau

SEQ ID NO: 4082175 - RNA, 17 nt, Variola virus
acuaaauacauuaucau

SEQ ID NO: 4082176 - RNA, 14 nt, Variola virus
acuaaauccgagaa

SEQ ID NO: 4082177 - RNA, 15 nt, Variola virus
acuaaaucuucacau

SEQ ID NO: 4082178 - RNA, 14 nt, Variola virus
acuaaauugaacac

SEQ ID NO: 4082179 - RNA, 14 nt, Variola virus
acuaacacacaaug

SEQ ID NO: 4082180 - RNA, 13 nt, Variola virus
acuaacuauugaa

SEQ ID NO: 4082181 - RNA, 12 nt, Variola virus
acuaagaaaguu

SEQ ID NO: 4082182 - RNA, 21 nt, Variola virus
acuaauagaacaugugugaaa

SEQ ID NO: 4082183 - RNA, 23 nt, Variola virus
acuaauaucauuaguauacucua

SEQ ID NO: 4082184 - RNA, 18 nt, Variola virus
acuaauauuuuauuucaa

SEQ ID NO: 4082185 - RNA, 13 nt, Variola virus
acuaaucaaugaa

SEQ ID NO: 4082186 - RNA, 17 nt, Variola virus
acuaaucucuguaagau

SEQ ID NO: 4082187 - RNA, 20 nt, Variola virus
acuaauguauacauuuucca

SEQ ID NO: 4082188 - RNA, 15 nt, Variola virus
acuaauuauacuuug

SEQ ID NO: 4082189 - RNA, 20 nt, Variola virus
acuacaaagggaaaaugcua

SEQ ID NO: 4082190 - RNA, 16 nt, Variola virus
acuacaacuagugaag

SEQ ID NO: 4082191 - RNA, 12 nt, Variola virus
acuacaauaauu

SEQ ID NO: 4082192 - RNA, 22 nt, Variola virus
acuacauaaucuucgucuggaa

SEQ ID NO: 4082193 - RNA, 19 nt, Variola virus
acuaccgaguuuaaaacuu

SEQ ID NO: 4082194 - RNA, 14 nt, Variola virus
acuacuuuagaaga

SEQ ID NO: 4082195 - RNA, 18 nt, Variola virus
acuacuuuccuaucccuc

SEQ ID NO: 4082196 - RNA, 13 nt, Variola virus
acuagaagagaau

SEQ ID NO: 4082197 - RNA, 21 nt, Variola virus
acuagacguuuauucucaaau

SEQ ID NO: 4082198 - RNA, 23 nt, Variola virus
acuagaguaguauauugucacau

SEQ ID NO: 4082199 - RNA, 19 nt, Variola virus
acuagaguuguuaaaguua

SEQ ID NO: 4082200 - RNA, 20 nt, Variola virus
acuagauacaaaauuugcau

SEQ ID NO: 4082201 - RNA, 23 nt, Variola virus
acuaggaaauugguuuauaaugu

SEQ ID NO: 4082202 - RNA, 17 nt, Variola virus
acuaguaacagucugaa

SEQ ID NO: 4082203 - RNA, 23 nt, Variola virus
acuagugucuagcauuuuagagc

SEQ ID NO: 4082204 - RNA, 16 nt, Variola virus
acuaguuguagaauuu

SEQ ID NO: 4082205 - RNA, 17 nt, Variola virus
acuauaauaguacuaga

SEQ ID NO: 4082206 - RNA, 23 nt, Variola virus
acuauacauucuucuguuaauuu

SEQ ID NO: 4082207 - RNA, 16 nt, Variola virus
acuauacgaaauagau

SEQ ID NO: 4082208 - RNA, 15 nt, Variola virus
acuauagaucuuuca

SEQ ID NO: 4082209 - RNA, 16 nt, Variola virus
acuauauguaaauaau

SEQ ID NO: 4082210 - RNA, 21 nt, Variola virus
acuaucacuguagaaaaauuu

SEQ ID NO: 4082211 - RNA, 21 nt, Variola virus
acuaucauaauuaaauuauug

SEQ ID NO: 4082212 - RNA, 22 nt, Variola virus
acuauccaauaaacagucuuua

SEQ ID NO: 4082213 - RNA, 19 nt, Variola virus
acuaucguuggaaaaugau

SEQ ID NO: 4082214 - RNA, 21 nt, Variola virus
acuaucuccucuauucauaau

SEQ ID NO: 4082215 - RNA, 22 nt, Variola virus
acuaucugauaagauaucuucu

SEQ ID NO: 4082216 - RNA, 13 nt, Variola virus
acuaucuguaaaa

SEQ ID NO: 4082217 - RNA, 14 nt, Variola virus
acuaucuuuaacau

SEQ ID NO: 4082218 - RNA, 19 nt, Variola virus
acuaucuuuuuaggaaugu

SEQ ID NO: 4082219 - RNA, 20 nt, Variola virus
acuaugccaagcguaugcug

SEQ ID NO: 4082220 - RNA, 16 nt, Variola virus
acuauggcaauaauug

SEQ ID NO: 4082221 - RNA, 16 nt, Variola virus
acuauguguuaaaaga

SEQ ID NO: 4082222 - RNA, 12 nt, Variola virus
acuauuaaaacu

SEQ ID NO: 4082223 - RNA, 23 nt, Variola virus
acuauuaaaacuaacaaauccgu

SEQ ID NO: 4082224 - RNA, 13 nt, Variola virus
acuauuauugaag

SEQ ID NO: 4082225 - RNA, 16 nt, Variola virus
acuauuccaaaugaug

SEQ ID NO: 4082226 - RNA, 17 nt, Variola virus
acuauugacuuaauagg

SEQ ID NO: 4082227 - RNA, 12 nt, Variola virus
acuauugccauc

SEQ ID NO: 4082228 - RNA, 22 nt, Variola virus
acuauuuuaacgucuaaaugua

SEQ ID NO: 4082229 - RNA, 15 nt, Variola virus
acucauuaaaacuuc

SEQ ID NO: 4082230 - RNA, 22 nt, Variola virus
acucauuauuucccaaaauuug

SEQ ID NO: 4082231 - RNA, 18 nt, Variola virus
acucauugcuuucuagaa

SEQ ID NO: 4082232 - RNA, 18 nt, Variola virus
acuccagaacaucuucca

SEQ ID NO: 4082233 - RNA, 18 nt, Variola virus
acuccauccguaaaaaug

SEQ ID NO: 4082234 - RNA, 19 nt, Variola virus
acuccugguaauacugaug

SEQ ID NO: 4082235 - RNA, 22 nt, Variola virus
acucuaccaguuaagucaauaa

SEQ ID NO: 4082236 - RNA, 22 nt, Variola virus
acucuaucauggcaauaauaca

SEQ ID NO: 4082237 - RNA, 15 nt, Variola virus
acucucaaauuauua

SEQ ID NO: 4082238 - RNA, 20 nt, Variola virus
acucucuacccuaaacuuua

SEQ ID NO: 4082239 - RNA, 18 nt, Variola virus
acucucuauaacaaaugu

SEQ ID NO: 4082240 - RNA, 17 nt, Variola virus
acucugggucauauuau

SEQ ID NO: 4082241 - RNA, 13 nt, Variola virus
acucuuaauuaug

SEQ ID NO: 4082242 - RNA, 18 nt, Variola virus
acucuuggaauuaauagu

SEQ ID NO: 4082243 - RNA, 13 nt, Variola virus
acugaaacuauac

SEQ ID NO: 4082244 - RNA, 12 nt, Variola virus
aaaaaaauaaua

SEQ ID NO: 4082245 - RNA, 19 nt, Variola virus
aaaaacuguuuaacaaggu

SEQ ID NO: 4082246 - RNA, 18 nt, Variola virus
aaaaagacuaaaucuuca

SEQ ID NO: 4082247 - RNA, 20 nt, Variola virus
aaaaagcuccauauuacaaa

SEQ ID NO: 4082248 - RNA, 16 nt, Variola virus
aaaaaggagaauacua

SEQ ID NO: 4082249 - RNA, 15 nt, Variola virus
aaaaagugaaacaug

SEQ ID NO: 4082250 - RNA, 14 nt, Variola virus
aaaaauaauauuca

SEQ ID NO: 4082251 - RNA, 23 nt, Variola virus
aaaaauacaucuguuucagcuaa

SEQ ID NO: 4082252 - RNA, 12 nt, Variola virus
aaaaaucuguuu

SEQ ID NO: 4082253 - RNA, 20 nt, Variola virus
aaaaauuagaucaaagaaua

SEQ ID NO: 4082254 - RNA, 22 nt, Variola virus
aaaaauuauccuaucauguauu

SEQ ID NO: 4082255 - RNA, 20 nt, Variola virus
aaaaauugaauugaugauau

SEQ ID NO: 4082256 - RNA, 18 nt, Variola virus
aaaacauggauuugguaa

SEQ ID NO: 4082257 - RNA, 16 nt, Variola virus
aaaacauuaaucaaua

SEQ ID NO: 4082258 - RNA, 20 nt, Variola virus
aaaacauuauaauaauauaa

SEQ ID NO: 4082259 - RNA, 15 nt, Variola virus
aaaaccuaugauauc

SEQ ID NO: 4082260 - RNA, 15 nt, Variola virus
aaaacgauuaaacaa

SEQ ID NO: 4082261 - RNA, 19 nt, Variola virus
aaaacuuuuuagaaauguu

SEQ ID NO: 4082262 - RNA, 14 nt, Variola virus
aaaagaaaauuugu

SEQ ID NO: 4082263 - RNA, 20 nt, Variola virus
aaaagacuauacauuuccga

SEQ ID NO: 4082264 - RNA, 16 nt, Variola virus
aaaagauacguacugu

SEQ ID NO: 4082265 - RNA, 22 nt, Variola virus
aaaagauuuauaaugucuacau

SEQ ID NO: 4082266 - RNA, 17 nt, Variola virus
aaaaggucauaacaagu

SEQ ID NO: 4082267 - RNA, 19 nt, Variola virus
aaaaguacucaaucuguac

SEQ ID NO: 4082268 - RNA, 14 nt, Variola virus
aaaaguaggaauua

SEQ ID NO: 4082269 - RNA, 16 nt, Variola virus
aaaagugugcugauuu

SEQ ID NO: 4082270 - RNA, 12 nt, Variola virus
aaaaguuauuau

SEQ ID NO: 4082271 - RNA, 23 nt, Variola virus
aaaaguuuuccaucuauguagaa

SEQ ID NO: 4082272 - RNA, 13 nt, Variola virus
aaaauacauaaag

SEQ ID NO: 4082273 - RNA, 14 nt, Variola virus
aaaauauaaugaua

SEQ ID NO: 4082274 - RNA, 17 nt, Variola virus
aaaauauaguagaauuu

SEQ ID NO: 4082275 - RNA, 20 nt, Variola virus
aaaauaugaaauaaguacaa

SEQ ID NO: 4082276 - RNA, 13 nt, Variola virus
aaaauauguauaa

SEQ ID NO: 4082277 - RNA, 12 nt, Variola virus
aaaauauuagaa

SEQ ID NO: 4082278 - RNA, 18 nt, Variola virus
aaaauauuuauuagaaca

SEQ ID NO: 4082279 - RNA, 19 nt, Variola virus
aaaaucaauauaucaucua

SEQ ID NO: 4082280 - RNA, 16 nt, Variola virus
aaaaucauugggauuu

SEQ ID NO: 4082281 - RNA, 11 nt, Variola virus
aaaauccacuu

SEQ ID NO: 4082282 - RNA, 23 nt, Variola virus
aaaaugaaucuaaacaaaaucua

SEQ ID NO: 4082283 - RNA, 15 nt, Variola virus
aaaauggauuacuua

SEQ ID NO: 4082284 - RNA, 16 nt, Variola virus
aaaaugugauauagaa

SEQ ID NO: 4082285 - RNA, 11 nt, Variola virus
aaaauuauucu

SEQ ID NO: 4082286 - RNA, 18 nt, Variola virus
aaaauuauugauauguau

SEQ ID NO: 4082287 - RNA, 22 nt, Variola virus
aaaauucauuagaauauauguc

SEQ ID NO: 4082288 - RNA, 15 nt, Variola virus
aaaauuccuaaauua

SEQ ID NO: 4082289 - RNA, 17 nt, Variola virus
aaaauucuaagguagaa

SEQ ID NO: 4082290 - RNA, 12 nt, Variola virus
aaaauucuccac

SEQ ID NO: 4082291 - RNA, 20 nt, Variola virus
aaaauucuuaaaauaauuua

SEQ ID NO: 4082292 - RNA, 20 nt, Variola virus
aaaauuuaaagaauguauaa

SEQ ID NO: 4082293 - RNA, 18 nt, Variola virus
aaaauuuaagaaaaugau

SEQ ID NO: 4082294 - RNA, 21 nt, Variola virus
aaaauuuguauuuuuaaucua

SEQ ID NO: 4082295 - RNA, 16 nt, Variola virus
aaacaaaauuagaaag

SEQ ID NO: 4082296 - RNA, 14 nt, Variola virus
aaacaacauauaca

SEQ ID NO: 4082297 - RNA, 13 nt, Variola virus
agaaauauauauu

SEQ ID NO: 4082298 - RNA, 19 nt, Variola virus
agaaaucauccguuguuau

SEQ ID NO: 4082299 - RNA, 21 nt, Variola virus
agaaaucauguuauaguguuu

SEQ ID NO: 4082300 - RNA, 22 nt, Variola virus
agaaaugguaaauaaauacuuu

SEQ ID NO: 4082301 - RNA, 23 nt, Variola virus
agaaauuacauaaaaaaaaugua

SEQ ID NO: 4082302 - RNA, 14 nt, Variola virus
agaaauuauaacau

SEQ ID NO: 4082303 - RNA, 18 nt, Variola virus
agaaauuuaccaacgaua

SEQ ID NO: 4082304 - RNA, 16 nt, Variola virus
agaacaaaauaaacaa

SEQ ID NO: 4082305 - RNA, 18 nt, Variola virus
agaacaaaccaaauauau

SEQ ID NO: 4082306 - RNA, 16 nt, Variola virus
agaacaaauguuguag

SEQ ID NO: 4082307 - RNA, 17 nt, Variola virus
agaacaaugucaaaaua

SEQ ID NO: 4082308 - RNA, 15 nt, Variola virus
agaaccaaaugauua

SEQ ID NO: 4082309 - RNA, 17 nt, Variola virus
agaaccaguaacauaua

SEQ ID NO: 4082310 - RNA, 20 nt, Variola virus
agaacccauuagguuaaaug

SEQ ID NO: 4082311 - RNA, 13 nt, Variola virus
agaacccuuaaua

SEQ ID NO: 4082312 - RNA, 18 nt, Variola virus
agaacggagaauaucuau

SEQ ID NO: 4082313 - RNA, 13 nt, Variola virus
agaacguaaauua

SEQ ID NO: 4082314 - RNA, 17 nt, Variola virus
agaacuaccaauauguc

SEQ ID NO: 4082315 - RNA, 19 nt, Variola virus
agaacucuugaagaugauu

SEQ ID NO: 4082316 - RNA, 12 nt, Variola virus
agaacucuuuuc

SEQ ID NO: 4082317 - RNA, 22 nt, Variola virus
agaacuuaacuuuuucuuucuc

SEQ ID NO: 4082318 - RNA, 16 nt, Variola virus
agaacuuauuaaugaa

SEQ ID NO: 4082319 - RNA, 23 nt, Variola virus
agaagaauucaagucaggaacua

SEQ ID NO: 4082320 - RNA, 14 nt, Variola virus
agaaggaaacuucu

SEQ ID NO: 4082321 - RNA, 14 nt, Variola virus
agaaggaguguuuu

SEQ ID NO: 4082322 - RNA, 21 nt, Variola virus
agaaggauuggucuuaaaaga

SEQ ID NO: 4082323 - RNA, 16 nt, Variola virus
agaagucgucaagcau

SEQ ID NO: 4082324 - RNA, 18 nt, Variola virus
agaagugaguauacuugu

SEQ ID NO: 4082325 - RNA, 14 nt, Variola virus
agaaguuuuaucca

SEQ ID NO: 4082326 - RNA, 14 nt, Variola virus
agaauaaaaugauu

SEQ ID NO: 4082327 - RNA, 16 nt, Variola virus
agaauaauauacuucu

SEQ ID NO: 4082328 - RNA, 20 nt, Variola virus
agaauaccaguauuguuuaa

SEQ ID NO: 4082329 - RNA, 23 nt, Variola virus
agaauacgaugauauuaaaauua

SEQ ID NO: 4082330 - RNA, 21 nt, Variola virus
agaauagaaugcuaaugucaa

SEQ ID NO: 4082331 - RNA, 16 nt, Variola virus
agaauauaaauuauau

SEQ ID NO: 4082332 - RNA, 22 nt, Variola virus
agaauauaaauuauauauggau

SEQ ID NO: 4082333 - RNA, 12 nt, Variola virus
agaauauacucu

SEQ ID NO: 4082334 - RNA, 18 nt, Variola virus
agaauauacuuuguguuu

SEQ ID NO: 4082335 - RNA, 14 nt, Variola virus
agaauaucuauaca

SEQ ID NO: 4082336 - RNA, 21 nt, Variola virus
agaauaugucucuuaacuauu

SEQ ID NO: 4082337 - RNA, 13 nt, Variola virus
agaaucaaaggau

SEQ ID NO: 4082338 - RNA, 22 nt, Variola virus
agaaucaagcuaggcuggaaac

SEQ ID NO: 4082339 - RNA, 18 nt, Variola virus
agaaucaauauuaauauu

SEQ ID NO: 4082340 - RNA, 17 nt, Variola virus
agaaucagcucuagcua

SEQ ID NO: 4082341 - RNA, 19 nt, Variola virus
agaaucaugguauauggau

SEQ ID NO: 4082342 - RNA, 16 nt, Variola virus
agaauccauaaaacaa

SEQ ID NO: 4082343 - RNA, 17 nt, Variola virus
agaaugcauaaauuugu

SEQ ID NO: 4082344 - RNA, 20 nt, Variola virus
agaaugcucuuaaauaaugu

SEQ ID NO: 4082345 - RNA, 19 nt, Variola virus
agaaugcuguuauauacau

SEQ ID NO: 4082346 - RNA, 18 nt, Variola virus
agaauguuccuaauguau

SEQ ID NO: 4082347 - RNA, 19 nt, Variola virus
agaauuaaaucuaacgaga

SEQ ID NO: 4082348 - RNA, 19 nt, Variola virus
agaauuaacgaaacaaugu

SEQ ID NO: 4082349 - RNA, 19 nt, Variola virus
agaauuaauaggaacuauu

SEQ ID NO: 4082350 - RNA, 18 nt, Variola virus
agaauuaggagaacuuau

SEQ ID NO: 4082351 - RNA, 13 nt, Variola virus
agaauucuaaaug

SEQ ID NO: 4082352 - RNA, 21 nt, Variola virus
agaauugcaauuuugauguau

SEQ ID NO: 4082353 - RNA, 16 nt, Variola virus
agaauuucuacauaau

SEQ ID NO: 4082354 - RNA, 14 nt, Variola virus
agaauuucuguuca

SEQ ID NO: 4082355 - RNA, 21 nt, Variola virus
agacaaauggucaaugauaug

SEQ ID NO: 4082356 - RNA, 18 nt, Variola virus
agacaaugcuuuaauaaa

SEQ ID NO: 4082357 - RNA, 13 nt, Variola virus
agacacugucaca

SEQ ID NO: 4082358 - RNA, 15 nt, Variola virus
agacagagauacuaa

SEQ ID NO: 4082359 - RNA, 13 nt, Variola virus
agacauaauacua

SEQ ID NO: 4082360 - RNA, 17 nt, Variola virus
agacauaugauaaaacg

SEQ ID NO: 4082361 - RNA, 21 nt, Variola virus
agacaucaacacuuauauucu

SEQ ID NO: 4082362 - RNA, 22 nt, Variola virus
agacauuagaccguuuaauaga

SEQ ID NO: 4082363 - RNA, 14 nt, Variola virus
agacauucuaaauc

SEQ ID NO: 4082364 - RNA, 21 nt, Variola virus
agacauuguacaauauguguu

SEQ ID NO: 4082365 - RNA, 14 nt, Variola virus
agaccaauaauaaa

SEQ ID NO: 4082366 - RNA, 16 nt, Variola virus
agaccaucuaacagaa

SEQ ID NO: 4082367 - RNA, 22 nt, Variola virus
agacgaggagauuuagaaaugu

SEQ ID NO: 4082368 - RNA, 21 nt, Variola virus
agacgauccacaaucaaaaaa

SEQ ID NO: 4082369 - RNA, 19 nt, Variola virus
agacggauaagaaauauau

SEQ ID NO: 4082370 - RNA, 16 nt, Variola virus
agacguacuccagaua

SEQ ID NO: 4082371 - RNA, 13 nt, Variola virus
agacuaaagaaac

SEQ ID NO: 4082372 - RNA, 14 nt, Variola virus
agacuaugggaaua

SEQ ID NO: 4082373 - RNA, 20 nt, Variola virus
agacuaugucaaaguauuug

SEQ ID NO: 4082374 - RNA, 18 nt, Variola virus
agacuuacaggaauagau

SEQ ID NO: 4082375 - RNA, 16 nt, Variola virus
agacuuuaucuagauc

SEQ ID NO: 4082376 - RNA, 18 nt, Variola virus
agagaaaagucaauuaug

SEQ ID NO: 4082377 - RNA, 18 nt, Variola virus
agagaaggcuauaaagua

SEQ ID NO: 4082378 - RNA, 21 nt, Variola virus
agagaauugcugcaauauauu

SEQ ID NO: 4082379 - RNA, 17 nt, Variola virus
agagacaaaaugugaua

SEQ ID NO: 4082380 - RNA, 16 nt, Variola virus
agagacaaacuauuaa

SEQ ID NO: 4082381 - RNA, 17 nt, Variola virus
agagacggaaaaauagu

SEQ ID NO: 4082382 - RNA, 19 nt, Variola virus
agagacuuuauaacagaua

SEQ ID NO: 4082383 - RNA, 23 nt, Variola virus
agagauccacugucacuggaaag

SEQ ID NO: 4082384 - RNA, 20 nt, Variola virus
agagaucuucguuaaaaagu

SEQ ID NO: 4082385 - RNA, 14 nt, Variola virus
agagauuauaugau

SEQ ID NO: 4082386 - RNA, 12 nt, Variola virus
agagauuuuacu

SEQ ID NO: 4082387 - RNA, 13 nt, Variola virus
agagcaaacaucu

SEQ ID NO: 4082388 - RNA, 20 nt, Variola virus
agagcauauuucauuuccaa

SEQ ID NO: 4082389 - RNA, 22 nt, Variola virus
agaggaccguugggaauuuuau

SEQ ID NO: 4082390 - RNA, 13 nt, Variola virus
agaggauaaagua

SEQ ID NO: 4082391 - RNA, 15 nt, Variola virus
agaggauguuauuau

SEQ ID NO: 4082392 - RNA, 20 nt, Variola virus
agagguucccaauuccaaag

SEQ ID NO: 4082393 - RNA, 22 nt, Variola virus
agagguucccaauuccaaagau

SEQ ID NO: 4082394 - RNA, 21 nt, Variola virus
agaguauaaaacauuaaaugu

SEQ ID NO: 4082395 - RNA, 18 nt, Variola virus
agaguauuccaagaguuu

SEQ ID NO: 4082396 - RNA, 13 nt, Variola virus
agagucaauguuu

SEQ ID NO: 4082397 - RNA, 19 nt, Variola virus
agagugaucaaaucauuau

SEQ ID NO: 4082398 - RNA, 18 nt, Variola virus
agaguuaauaaauaucau

SEQ ID NO: 4082399 - RNA, 14 nt, Variola virus
agaguuuaauacua

SEQ ID NO: 4082400 - RNA, 16 nt, Variola virus
agaguuuccucauuau

SEQ ID NO: 4082401 - RNA, 12 nt, Variola virus
agauaaaacaag

SEQ ID NO: 4082402 - RNA, 19 nt, Variola virus
agauaaacuaggauuuaaa

SEQ ID NO: 4082403 - RNA, 13 nt, Variola virus
agauaaacuuuau

SEQ ID NO: 4082404 - RNA, 12 nt, Variola virus
agauaaauggaa

SEQ ID NO: 4082405 - RNA, 13 nt, Variola virus
agauaacaaccuu

SEQ ID NO: 4082406 - RNA, 15 nt, Variola virus
agauaauacaaaauu

SEQ ID NO: 4082407 - RNA, 13 nt, Variola virus
agauaaugauaua

SEQ ID NO: 4082408 - RNA, 14 nt, Variola virus
agauaaugugaauu

SEQ ID NO: 4082409 - RNA, 14 nt, Variola virus
agauacaaauaugu

SEQ ID NO: 4082410 - RNA, 23 nt, Variola virus
agauacaaauuuuaagaaauggu

SEQ ID NO: 4082411 - RNA, 22 nt, Variola virus
agauacuacaggaccguauuag

SEQ ID NO: 4082412 - RNA, 16 nt, Variola virus
agauacuaucaaaaua

SEQ ID NO: 4082413 - RNA, 19 nt, Variola virus
agauacuaucaaaauaucu

SEQ ID NO: 4082414 - RNA, 14 nt, Variola virus
agauacuguauaua

SEQ ID NO: 4082415 - RNA, 14 nt, Variola virus
agauagaaaugaau

SEQ ID NO: 4082416 - RNA, 18 nt, Variola virus
agauaguuuuaguuucca

SEQ ID NO: 4082417 - RNA, 20 nt, Variola virus
agauauaaaauagaaaauaa

SEQ ID NO: 4082418 - RNA, 23 nt, Variola virus
agauauacccgaagauauacaca

SEQ ID NO: 4082419 - RNA, 13 nt, Variola virus
agauauauauacu

SEQ ID NO: 4082420 - RNA, 15 nt, Variola virus
agauauauauacucu

SEQ ID NO: 4082421 - RNA, 14 nt, Variola virus
agauaucuucucaa

SEQ ID NO: 4082422 - RNA, 22 nt, Variola virus
agauaugauaaaacuauuguuu

SEQ ID NO: 4082423 - RNA, 20 nt, Variola virus
auaacaauaguuagauacaa

SEQ ID NO: 4082424 - RNA, 13 nt, Variola virus
auaacaauggcug

SEQ ID NO: 4082425 - RNA, 18 nt, Variola virus
auaacagcauuuguguag

SEQ ID NO: 4082426 - RNA, 22 nt, Variola virus
auaacagcuuagauuuaacguu

SEQ ID NO: 4082427 - RNA, 19 nt, Variola virus
auaacauguuaauuuccga

SEQ ID NO: 4082428 - RNA, 14 nt, Variola virus
auaacauuacuagu

SEQ ID NO: 4082429 - RNA, 18 nt, Variola virus
auaacauucuaggaaugu

SEQ ID NO: 4082430 - RNA, 22 nt, Variola virus
auaacauucuaggaauguuguu

SEQ ID NO: 4082431 - RNA, 18 nt, Variola virus
auaaccggcgcugucaug

SEQ ID NO: 4082432 - RNA, 19 nt, Variola virus
auaaccggcgcugucaugu

SEQ ID NO: 4082433 - RNA, 17 nt, Variola virus
auaaccuagaaaauaua

SEQ ID NO: 4082434 - RNA, 19 nt, Variola virus
auaaccucuccuauaugaa

SEQ ID NO: 4082435 - RNA, 21 nt, Variola virus
auaaccuuauuauuauaguac

SEQ ID NO: 4082436 - RNA, 18 nt, Variola virus
auaacguauuaaauauua

SEQ ID NO: 4082437 - RNA, 16 nt, Variola virus
auaacguuagccacca

SEQ ID NO: 4082438 - RNA, 20 nt, Variola virus
auaacguuaucauuuucuac

SEQ ID NO: 4082439 - RNA, 14 nt, Variola virus
auaacuaaaaaugu

SEQ ID NO: 4082440 - RNA, 15 nt, Variola virus
auaacuacauauucu

SEQ ID NO: 4082441 - RNA, 17 nt, Variola virus
auaacucugauuucuug

SEQ ID NO: 4082442 - RNA, 19 nt, Variola virus
auaacuggauauagaacug

SEQ ID NO: 4082443 - RNA, 16 nt, Variola virus
auaacuguuuagaaau

SEQ ID NO: 4082444 - RNA, 22 nt, Variola virus
auaacuuuuuaccucauaugaa

SEQ ID NO: 4082445 - RNA, 13 nt, Variola virus
auaagaaacaauu

SEQ ID NO: 4082446 - RNA, 14 nt, Variola virus
auaagaaacuauaa

SEQ ID NO: 4082447 - RNA, 16 nt, Variola virus
auaagaaauauauacu

SEQ ID NO: 4082448 - RNA, 16 nt, Variola virus
auaagaagagaaaagu

SEQ ID NO: 4082449 - RNA, 22 nt, Variola virus
auaagaguguaguaucauagau

SEQ ID NO: 4082450 - RNA, 22 nt, Variola virus
auaagcuauauaauaaauguau

SEQ ID NO: 4082451 - RNA, 15 nt, Variola virus
auaaguauuaucaaa

SEQ ID NO: 4082452 - RNA, 19 nt, Variola virus
auaagugcgaugauuguac

SEQ ID NO: 4082453 - RNA, 16 nt, Variola virus
auaauaaauuuuucca

SEQ ID NO: 4082454 - RNA, 18 nt, Variola virus
auaauaagaugcaaacau

SEQ ID NO: 4082455 - RNA, 22 nt, Variola virus
auaauaccuaucuauaagauua

SEQ ID NO: 4082456 - RNA, 15 nt, Variola virus
auaauacuauauaca

SEQ ID NO: 4082457 - RNA, 23 nt, Variola virus
auaauagguguaaaucuagaaau

SEQ ID NO: 4082458 - RNA, 12 nt, Variola virus
auaauauacaaa

SEQ ID NO: 4082459 - RNA, 20 nt, Variola virus
auaauauccauuuuguuuau

SEQ ID NO: 4082460 - RNA, 22 nt, Variola virus
auaauaucggucuuauucuuaa

SEQ ID NO: 4082461 - RNA, 17 nt, Variola virus
auaauaugacucaugau

SEQ ID NO: 4082462 - RNA, 21 nt, Variola virus
auaaucagucauaacaaaugu

SEQ ID NO: 4082463 - RNA, 14 nt, Variola virus
auaaucauaaauua

SEQ ID NO: 4082464 - RNA, 21 nt, Variola virus
auaaucccauucuaauacuuu

SEQ ID NO: 4082465 - RNA, 15 nt, Variola virus
auaauccuuguaaug

SEQ ID NO: 4082466 - RNA, 17 nt, Variola virus
auaaucgcuuuguuguu

SEQ ID NO: 4082467 - RNA, 16 nt, Variola virus
auaaucggagaauguu

SEQ ID NO: 4082468 - RNA, 19 nt, Variola virus
auaaucggguucugcuuca

SEQ ID NO: 4082469 - RNA, 18 nt, Variola virus
auaaucuaaaauaguucu

SEQ ID NO: 4082470 - RNA, 15 nt, Variola virus
auaaucuguguuguu

SEQ ID NO: 4082471 - RNA, 15 nt, Variola virus
auaaugauagaauua

SEQ ID NO: 4082472 - RNA, 14 nt, Variola virus
auaaugauauauau

SEQ ID NO: 4082473 - RNA, 15 nt, Variola virus
auaaugaucauauag

SEQ ID NO: 4082474 - RNA, 23 nt, Variola virus
auaauggugacaggguuagcauu

SEQ ID NO: 4082475 - RNA, 15 nt, Variola virus
auaaugugauuguau

SEQ ID NO: 4082476 - RNA, 13 nt, Variola virus
auaauguuucuau

SEQ ID NO: 4082477 - RNA, 18 nt, Variola virus
auaauuauuauaauacag

SEQ ID NO: 4082478 - RNA, 20 nt, Variola virus
auaauuauuucaauauacua

SEQ ID NO: 4082479 - RNA, 19 nt, Variola virus
auaauucauaagaaucuac

SEQ ID NO: 4082480 - RNA, 21 nt, Variola virus
auaauucuccagucgaaacau

SEQ ID NO: 4082481 - RNA, 15 nt, Variola virus
auaauucuucuguau

SEQ ID NO: 4082482 - RNA, 19 nt, Variola virus
auaauucuuuauaacugaa

SEQ ID NO: 4082483 - RNA, 19 nt, Variola virus
auaauugagauugauguaa

SEQ ID NO: 4082484 - RNA, 17 nt, Variola virus
auaauuuagauacuuua

SEQ ID NO: 4082485 - RNA, 21 nt, Variola virus
auaauuugaccugauuacauu

SEQ ID NO: 4082486 - RNA, 17 nt, Variola virus
auaauuuguauauacau

SEQ ID NO: 4082487 - RNA, 11 nt, Variola virus
auaauuuuacc

SEQ ID NO: 4082488 - RNA, 12 nt, Variola virus
auaauuuuacca

SEQ ID NO: 4082489 - RNA, 13 nt, Variola virus
auaauuuugugaa

SEQ ID NO: 4082490 - RNA, 18 nt, Variola virus
auaauuuuuggacaaaug

SEQ ID NO: 4082491 - RNA, 14 nt, Variola virus
auacaaaaguuaau

SEQ ID NO: 4082492 - RNA, 15 nt, Variola virus
auacaaaauaauaga

SEQ ID NO: 4082493 - RNA, 17 nt, Variola virus
auacaaaauuuucaguu

SEQ ID NO: 4082494 - RNA, 20 nt, Variola virus
auacaacgugaaauacuuua

SEQ ID NO: 4082495 - RNA, 14 nt, Variola virus
auacaauaaauguu

SEQ ID NO: 4082496 - RNA, 17 nt, Variola virus
auacaaucguucaaacu

SEQ ID NO: 4082497 - RNA, 18 nt, Variola virus
auacaauggaauacuuca

SEQ ID NO: 4082498 - RNA, 16 nt, Variola virus
auacacacaaaguaau

SEQ ID NO: 4082499 - RNA, 21 nt, Variola virus
auacacaugauugacaaauua

SEQ ID NO: 4082500 - RNA, 23 nt, Variola virus
auacacguuagauuauucucaaa

SEQ ID NO: 4082501 - RNA, 19 nt, Variola virus
auacauaauucuucuguua

SEQ ID NO: 4082502 - RNA, 22 nt, Variola virus
auacauagaguuaagagaaauu

SEQ ID NO: 4082503 - RNA, 14 nt, Variola virus
auacauauuguuua

SEQ ID NO: 4082504 - RNA, 22 nt, Variola virus
auacaucggcuaccaaaguuau

SEQ ID NO: 4082505 - RNA, 19 nt, Variola virus
auacauuauuacuaaacau

SEQ ID NO: 4082506 - RNA, 21 nt, Variola virus
auacauugaucuauguaguuu

SEQ ID NO: 4082507 - RNA, 14 nt, Variola virus
auaccaaucauuua

SEQ ID NO: 4082508 - RNA, 18 nt, Variola virus
auaccaucgauuguuuau

SEQ ID NO: 4082509 - RNA, 14 nt, Variola virus
auaccauuucuagu

SEQ ID NO: 4082510 - RNA, 17 nt, Variola virus
auacccuccuguauaug

SEQ ID NO: 4082511 - RNA, 19 nt, Variola virus
auaccuuuaacuucuggaa

SEQ ID NO: 4082512 - RNA, 19 nt, Variola virus
auaccuuuccuggaauauc

SEQ ID NO: 4082513 - RNA, 23 nt, Variola virus
auaccuuugguucuuuaaaagaa

SEQ ID NO: 4082514 - RNA, 14 nt, Variola virus
auacgaaaauagau

SEQ ID NO: 4082515 - RNA, 23 nt, Variola virus
auacgaagacagacauacaguag

SEQ ID NO: 4082516 - RNA, 14 nt, Variola virus
auacgauuaauagc

SEQ ID NO: 4082517 - RNA, 17 nt, Variola virus
auacgcauguagaaugu

SEQ ID NO: 4082518 - RNA, 19 nt, Variola virus
auacguaaaacucauuacu

SEQ ID NO: 4082519 - RNA, 19 nt, Variola virus
auacguaaacuuuaauagu

SEQ ID NO: 4082520 - RNA, 14 nt, Variola virus
auacguaaugaagu

SEQ ID NO: 4082521 - RNA, 15 nt, Variola virus
auacgucaaggaaag

SEQ ID NO: 4082522 - RNA, 13 nt, Variola virus
auacuaaagaaac

SEQ ID NO: 4082523 - RNA, 18 nt, Variola virus
auacuaauacuaauacua

SEQ ID NO: 4082524 - RNA, 21 nt, Variola virus
auacuacuacuuguaagaaug

SEQ ID NO: 4082525 - RNA, 23 nt, Variola virus
auacuauccaucagaauguuucc

SEQ ID NO: 4082526 - RNA, 21 nt, Variola virus
auacucccuugcaucauauac

SEQ ID NO: 4082527 - RNA, 14 nt, Variola virus
auacucuaaucuuu

SEQ ID NO: 4082528 - RNA, 16 nt, Variola virus
auacucuauucgaaaa

SEQ ID NO: 4082529 - RNA, 17 nt, Variola virus
auacugaguuggcuaug

SEQ ID NO: 4082530 - RNA, 18 nt, Variola virus
auacugcaauaaaacauu

SEQ ID NO: 4082531 - RNA, 16 nt, Variola virus
auacugucgaauuuga

SEQ ID NO: 4082532 - RNA, 14 nt, Variola virus
auacuuaaaaaugg

SEQ ID NO: 4082533 - RNA, 22 nt, Variola virus
auacuucauuucuaaaauagua

SEQ ID NO: 4082534 - RNA, 18 nt, Variola virus
auacuuuaaagcaaaaug

SEQ ID NO: 4082535 - RNA, 21 nt, Variola virus
auacuuuaaagcaaaaugguu

SEQ ID NO: 4082536 - RNA, 13 nt, Variola virus
auacuuuaacauc

SEQ ID NO: 4082537 - RNA, 21 nt, Variola virus
auacuuuguaaucuagacaua

SEQ ID NO: 4082538 - RNA, 13 nt, Variola virus
auagaaaaugauu

SEQ ID NO: 4082539 - RNA, 14 nt, Variola virus
auagaaacauauau

SEQ ID NO: 4082540 - RNA, 16 nt, Variola virus
auagaagauauuacau

SEQ ID NO: 4082541 - RNA, 23 nt, Variola virus
auagaagauguuagaaaaaugau

SEQ ID NO: 4082542 - RNA, 13 nt, Variola virus
auagacaaaauag

SEQ ID NO: 4082543 - RNA, 16 nt, Variola virus
auagacauugaaaaug

SEQ ID NO: 4082544 - RNA, 15 nt, Variola virus
auagagaacauaaug

SEQ ID NO: 4082545 - RNA, 23 nt, Variola virus
auagagccaagacgaacaaaauc

SEQ ID NO: 4082546 - RNA, 22 nt, Variola virus
auagagcccacguuuaaacauu

SEQ ID NO: 4082547 - RNA, 17 nt, Variola virus
auagagcccguaaaugc

SEQ ID NO: 4082548 - RNA, 22 nt, Variola virus
auguguguccggaguuagaaag

SEQ ID NO: 4082549 - RNA, 18 nt, Variola virus
auguguuuuaauauauau

SEQ ID NO: 4082550 - RNA, 20 nt, Variola virus
auguuaaaacuacaaaaaug

SEQ ID NO: 4082551 - RNA, 22 nt, Variola virus
auguuaauaacaucagaaaaug

SEQ ID NO: 4082552 - RNA, 22 nt, Variola virus
auguuaauugggguauuaauaa

SEQ ID NO: 4082553 - RNA, 17 nt, Variola virus
auguuagaaaaaugaug

SEQ ID NO: 4082554 - RNA, 18 nt, Variola virus
auguuagagaauauucaa

SEQ ID NO: 4082555 - RNA, 22 nt, Variola virus
auguuauagaauauaaauuaua

SEQ ID NO: 4082556 - RNA, 12 nt, Variola virus
auguucaagcag

SEQ ID NO: 4082557 - RNA, 14 nt, Variola virus
auguugauaaaaug

SEQ ID NO: 4082558 - RNA, 15 nt, Variola virus
auguuggaaauacua

SEQ ID NO: 4082559 - RNA, 16 nt, Variola virus
auguuguuaaaauaua

SEQ ID NO: 4082560 - RNA, 21 nt, Variola virus
auguuuauuagcguacacauu

SEQ ID NO: 4082561 - RNA, 21 nt, Variola virus
auguuugauaaaaauauguau

SEQ ID NO: 4082562 - RNA, 13 nt, Variola virus
auguuuguaucau

SEQ ID NO: 4082563 - RNA, 18 nt, Variola virus
auguuuucugucagaaaa

SEQ ID NO: 4082564 - RNA, 23 nt, Variola virus
auuaaaaacaaacuuuuuauccu

SEQ ID NO: 4082565 - RNA, 16 nt, Variola virus
auuaaaaguuaaugag

SEQ ID NO: 4082566 - RNA, 21 nt, Variola virus
auuaaaauucuuaaaauaauu

SEQ ID NO: 4082567 - RNA, 23 nt, Variola virus
auuaaacuuaccacguaaaacuu

SEQ ID NO: 4082568 - RNA, 21 nt, Variola virus
auuaaaggcuuuuuauaucau

SEQ ID NO: 4082569 - RNA, 18 nt, Variola virus
auuaaaguuaaauugugu

SEQ ID NO: 4082570 - RNA, 18 nt, Variola virus
auuaaauagaauauuuaa

SEQ ID NO: 4082571 - RNA, 16 nt, Variola virus
auuaaauauuaaugag

SEQ ID NO: 4082572 - RNA, 17 nt, Variola virus
auuaaauauuuuaaaau

SEQ ID NO: 4082573 - RNA, 17 nt, Variola virus
auuaaaucuuucauuuc

SEQ ID NO: 4082574 - RNA, 19 nt, Variola virus
auuaaauguauauuuucca

SEQ ID NO: 4082575 - RNA, 14 nt, Variola virus
auuaaauuauugau

SEQ ID NO: 4082576 - RNA, 16 nt, Variola virus
auuaaauuauugauau

SEQ ID NO: 4082577 - RNA, 19 nt, Variola virus
auuaacaaaagugaauaua

SEQ ID NO: 4082578 - RNA, 23 nt, Variola virus
auuaacacuccggaaaaauaauu

SEQ ID NO: 4082579 - RNA, 15 nt, Variola virus
auuaacagaaaaaac

SEQ ID NO: 4082580 - RNA, 20 nt, Variola virus
auuaacagauuaguaugaag

SEQ ID NO: 4082581 - RNA, 19 nt, Variola virus
auuaacaucuugaaccauu

SEQ ID NO: 4082582 - RNA, 18 nt, Variola virus
auuaacgaguucaaauau

SEQ ID NO: 4082583 - RNA, 17 nt, Variola virus
auuaacggguucucaau

SEQ ID NO: 4082584 - RNA, 22 nt, Variola virus
auuaacuacggauaacaaaaua

SEQ ID NO: 4082585 - RNA, 14 nt, Variola virus
auuaacuaucugua

SEQ ID NO: 4082586 - RNA, 18 nt, Variola virus
auuaacuucguuauuuau

SEQ ID NO: 4082587 - RNA, 22 nt, Variola virus
auuaagaacccguuuauacagu

SEQ ID NO: 4082588 - RNA, 15 nt, Variola virus
auuaagacauauauu

SEQ ID NO: 4082589 - RNA, 15 nt, Variola virus
auuaaguaaauccuu

SEQ ID NO: 4082590 - RNA, 12 nt, Variola virus
auuaaguucuuu

SEQ ID NO: 4082591 - RNA, 17 nt, Variola virus
auuaauaaugucuauau

SEQ ID NO: 4082592 - RNA, 18 nt, Variola virus
auuaauaauuguuuugaa

SEQ ID NO: 4082593 - RNA, 14 nt, Variola virus
auuaauacauuauu

SEQ ID NO: 4082594 - RNA, 19 nt, Variola virus
auuaauaguuuuauuugaa

SEQ ID NO: 4082595 - RNA, 18 nt, Variola virus
auuaauauuuaguaauua

SEQ ID NO: 4082596 - RNA, 13 nt, Variola virus
auuaaucauauac

SEQ ID NO: 4082597 - RNA, 18 nt, Variola virus
auuaaugggcuuaguaaa

SEQ ID NO: 4082598 - RNA, 14 nt, Variola virus
auuaauuaauacaa

SEQ ID NO: 4082599 - RNA, 12 nt, Variola virus
auuacaaacaug

SEQ ID NO: 4082600 - RNA, 14 nt, Variola virus
auuacaaaccuguc

SEQ ID NO: 4082601 - RNA, 16 nt, Variola virus
auuacaauacauagau

SEQ ID NO: 4082602 - RNA, 19 nt, Variola virus
auuaccacagccguauuuu

SEQ ID NO: 4082603 - RNA, 23 nt, Variola virus
auuaccauagaagauguuagaaa

SEQ ID NO: 4082604 - RNA, 18 nt, Variola virus
auuaccaucguuguugaa

SEQ ID NO: 4082605 - RNA, 13 nt, Variola virus
auuaccuuaauaa

SEQ ID NO: 4082606 - RNA, 13 nt, Variola virus
auuacguauuaua

SEQ ID NO: 4082607 - RNA, 14 nt, Variola virus
auuacuaaacauuu

SEQ ID NO: 4082608 - RNA, 23 nt, Variola virus
auuacuaucuuuaacauauguau

SEQ ID NO: 4082609 - RNA, 18 nt, Variola virus
auuacucuccuagguuuc

SEQ ID NO: 4082610 - RNA, 20 nt, Variola virus
auuacugcaacguucauaga

SEQ ID NO: 4082611 - RNA, 13 nt, Variola virus
auuacugcauauu

SEQ ID NO: 4082612 - RNA, 13 nt, Variola virus
auuacugucucca

SEQ ID NO: 4082613 - RNA, 12 nt, Variola virus
auuacuuaaaaa

SEQ ID NO: 4082614 - RNA, 13 nt, Variola virus
auuagaaauggau

SEQ ID NO: 4082615 - RNA, 14 nt, Variola virus
auuagacauuuaac

SEQ ID NO: 4082616 - RNA, 19 nt, Variola virus
auuagacguaguuuaucau

SEQ ID NO: 4082617 - RNA, 16 nt, Variola virus
auuagagguaaugaug

SEQ ID NO: 4082618 - RNA, 16 nt, Variola virus
auuagagguaugggau

SEQ ID NO: 4082619 - RNA, 15 nt, Variola virus
auuagaugagaaauu

SEQ ID NO: 4082620 - RNA, 19 nt, Variola virus
auuagauuauaucauaaau

SEQ ID NO: 4082621 - RNA, 22 nt, Variola virus
auuagcggcauaggaacauuuc

SEQ ID NO: 4082622 - RNA, 20 nt, Variola virus
auuaggcaugucgauggcaa

SEQ ID NO: 4082623 - RNA, 19 nt, Variola virus
auuaguaacgacuauuaaa

SEQ ID NO: 4082624 - RNA, 22 nt, Variola virus
auuaguaaggcuuuagaaacuu

SEQ ID NO: 4082625 - RNA, 15 nt, Variola virus
auuagugacggaaaa

SEQ ID NO: 4082626 - RNA, 13 nt, Variola virus
auuaguuaaauau

SEQ ID NO: 4082627 - RNA, 12 nt, Variola virus
auuaguuauuau

SEQ ID NO: 4082628 - RNA, 22 nt, Variola virus
auuaguuuccuuguuuagagau

SEQ ID NO: 4082629 - RNA, 18 nt, Variola virus
auuauaauaguuuaucau

SEQ ID NO: 4082630 - RNA, 15 nt, Variola virus
auuauaauauuuccu

SEQ ID NO: 4082631 - RNA, 13 nt, Variola virus
auuauaauuauua

SEQ ID NO: 4082632 - RNA, 14 nt, Variola virus
auuauaauuauuau

SEQ ID NO: 4082633 - RNA, 15 nt, Variola virus
auuauacaaaaauuu

SEQ ID NO: 4082634 - RNA, 14 nt, Variola virus
auuauacacauuau

SEQ ID NO: 4082635 - RNA, 12 nt, Variola virus
auuauaccaaaa

SEQ ID NO: 4082636 - RNA, 15 nt, Variola virus
auuauaccaauagau

SEQ ID NO: 4082637 - RNA, 15 nt, Variola virus
auuauaccuaaugag

SEQ ID NO: 4082638 - RNA, 18 nt, Variola virus
auuauacuuugguaaaug

SEQ ID NO: 4082639 - RNA, 13 nt, Variola virus
auuauagauguau

SEQ ID NO: 4082640 - RNA, 15 nt, Variola virus
auuauagauguguau

SEQ ID NO: 4082641 - RNA, 14 nt, Variola virus
auuauauauggauu

SEQ ID NO: 4082642 - RNA, 16 nt, Variola virus
auuauaucguuaucau

SEQ ID NO: 4082643 - RNA, 19 nt, Variola virus
auuauauucucaucuauca

SEQ ID NO: 4082644 - RNA, 13 nt, Variola virus
auuaucaaaauua

SEQ ID NO: 4082645 - RNA, 18 nt, Variola virus
auuaucaaaauuuggaaa

SEQ ID NO: 4082646 - RNA, 15 nt, Variola virus
auuaucaagaugugu

SEQ ID NO: 4082647 - RNA, 12 nt, Variola virus
auuaucaguaau

SEQ ID NO: 4082648 - RNA, 14 nt, Variola virus
auuauccaauagau

SEQ ID NO: 4082649 - RNA, 17 nt, Variola virus
auuauccaucuaacaaa

SEQ ID NO: 4082650 - RNA, 23 nt, Variola virus
auuaucguuccugguauauagau

SEQ ID NO: 4082651 - RNA, 21 nt, Variola virus
auuaugaaaauuauaaugaau

SEQ ID NO: 4082652 - RNA, 15 nt, Variola virus
auuaugauagaaauu

SEQ ID NO: 4082653 - RNA, 22 nt, Variola virus
auuaugaucuugauuuauagau

SEQ ID NO: 4082654 - RNA, 17 nt, Variola virus
auuaugaugauacauuu

SEQ ID NO: 4082655 - RNA, 17 nt, Variola virus
auuaugcaaauuugaau

SEQ ID NO: 4082656 - RNA, 20 nt, Variola virus
auuaugucucugaacuauau

SEQ ID NO: 4082657 - RNA, 12 nt, Variola virus
auuauuaaauau

SEQ ID NO: 4082658 - RNA, 16 nt, Variola virus
auuauuaauaugagug

SEQ ID NO: 4082659 - RNA, 17 nt, Variola virus
auuauuaaucagaauac

SEQ ID NO: 4082660 - RNA, 13 nt, Variola virus
auuauuacagagu

SEQ ID NO: 4082661 - RNA, 19 nt, Variola virus
auuauucagauacgucuau

SEQ ID NO: 4082662 - RNA, 12 nt, Variola virus
auuauucauuuu

SEQ ID NO: 4082663 - RNA, 18 nt, Variola virus
auuauucuacuaucaaag

SEQ ID NO: 4082664 - RNA, 21 nt, Variola virus
auuauucuuuggauccaaaug

SEQ ID NO: 4082665 - RNA, 23 nt, Variola virus
auuauugaacaggcauugcuaaa

SEQ ID NO: 4082666 - RNA, 20 nt, Variola virus
auuauugaguuaaaaucagu

SEQ ID NO: 4082667 - RNA, 13 nt, Variola virus
auuauugaugcaa

SEQ ID NO: 4082668 - RNA, 13 nt, Variola virus
auuauugcauaua

SEQ ID NO: 4082669 - RNA, 14 nt, Variola virus
auuauuuauaccuc

SEQ ID NO: 4082670 - RNA, 14 nt, Variola virus
auuauuucuaaauu

SEQ ID NO: 4082671 - RNA, 22 nt, Variola virus
auuauuuuaauuucugaugugc

SEQ ID NO: 4082672 - RNA, 21 nt, Variola virus
auuauuuugugcaaauagaug

SEQ ID NO: 4082673 - RNA, 21 nt, Variola virus
auuauuuuucaccauauagau

SEQ ID NO: 4082674 - RNA, 13 nt, Variola virus
auucaauaacuaa

SEQ ID NO: 4082675 - RNA, 18 nt, Variola virus
ggaaauguuauagaaaau

SEQ ID NO: 4082676 - RNA, 16 nt, Variola virus
ggaacaguaaugauug

SEQ ID NO: 4082677 - RNA, 22 nt, Variola virus
ggaacaguucuaccaccaguaa

SEQ ID NO: 4082678 - RNA, 18 nt, Variola virus
ggaacgugauaguuucuc

SEQ ID NO: 4082679 - RNA, 14 nt, Variola virus
ggaagaguaggaag

SEQ ID NO: 4082680 - RNA, 18 nt, Variola virus
ggaauaaauuauuaucca

SEQ ID NO: 4082681 - RNA, 21 nt, Variola virus
ggaauuaaucuaguagaaaag

SEQ ID NO: 4082682 - RNA, 14 nt, Variola virus
ggaauuguauuuuc

SEQ ID NO: 4082683 - RNA, 20 nt, Variola virus
ggacaaaauccauauuucuu

SEQ ID NO: 4082684 - RNA, 16 nt, Variola virus
ggacaaauucuuuuga

SEQ ID NO: 4082685 - RNA, 16 nt, Variola virus
ggacagcuauauucuc

SEQ ID NO: 4082686 - RNA, 21 nt, Variola virus
ggacaucaacgccuuagaaau

SEQ ID NO: 4082687 - RNA, 23 nt, Variola virus
ggaccuaaaucuaacauugauuu

SEQ ID NO: 4082688 - RNA, 17 nt, Variola virus
ggaccuauaauugauua

SEQ ID NO: 4082689 - RNA, 22 nt, Variola virus
ggacuacuuauucuauuuuaca

SEQ ID NO: 4082690 - RNA, 23 nt, Variola virus
ggagaauacaaagcguacagaua

SEQ ID NO: 4082691 - RNA, 12 nt, Variola virus
ggagaauguuuc

SEQ ID NO: 4082692 - RNA, 15 nt, Variola virus
ggagaucuaaagaua

SEQ ID NO: 4082693 - RNA, 20 nt, Variola virus
ggauaauuuuaccagaauac

SEQ ID NO: 4082694 - RNA, 18 nt, Variola virus
ggauaggagauuguauug

SEQ ID NO: 4082695 - RNA, 20 nt, Variola virus
ggauauaaacuaauauggau

SEQ ID NO: 4082696 - RNA, 23 nt, Variola virus
ggauaucuuagugcaaaaguaua

SEQ ID NO: 4082697 - RNA, 21 nt, Variola virus
ggauauuuguucauuggauug

SEQ ID NO: 4082698 - RNA, 22 nt, Variola virus
ggaucacaacaauuuauuucua

SEQ ID NO: 4082699 - RNA, 14 nt, Variola virus
ggaugauaugaaga

SEQ ID NO: 4082700 - RNA, 20 nt, Variola virus
ggauuagaauccauaaaaca

SEQ ID NO: 4082701 - RNA, 18 nt, Variola virus
ggauuaucaaaucuuuaa

SEQ ID NO: 4082702 - RNA, 22 nt, Variola virus
ggauuauuuuuauuauauucag

SEQ ID NO: 4082703 - RNA, 21 nt, Variola virus
ggauucauccuuaaauguuuu

SEQ ID NO: 4082704 - RNA, 18 nt, Variola virus
ggauuuggucauaauaga

SEQ ID NO: 4082705 - RNA, 23 nt, Variola virus
ggauuuuauucguagaaaguauc

SEQ ID NO: 4082706 - RNA, 16 nt, Variola virus
ggauuuuguauuaccu

SEQ ID NO: 4082707 - RNA, 13 nt, Variola virus
ggcaaaagaauac

SEQ ID NO: 4082708 - RNA, 17 nt, Variola virus
ggcaaagucaaaugauu

SEQ ID NO: 4082709 - RNA, 11 nt, Variola virus
ggcaucuuuuu

SEQ ID NO: 4082710 - RNA, 15 nt, Variola virus
ggccguuuguuuccu

SEQ ID NO: 4082711 - RNA, 19 nt, Variola virus
gggacgcguauauguuucu

SEQ ID NO: 4082712 - RNA, 14 nt, Variola virus
ggguuguaaacaac

SEQ ID NO: 4082713 - RNA, 23 nt, Variola virus
gguaacauuauagauucuuuuaa

SEQ ID NO: 4082714 - RNA, 19 nt, Variola virus
gguaaggucuuagaaauag

SEQ ID NO: 4082715 - RNA, 18 nt, Variola virus
gguauuggcgauugauuu

SEQ ID NO: 4082716 - RNA, 13 nt, Variola virus
ggucaauagcgac

SEQ ID NO: 4082717 - RNA, 16 nt, Variola virus
ggucuuaguauuuuua

SEQ ID NO: 4082718 - RNA, 14 nt, Variola virus
gguggauauuucug

SEQ ID NO: 4082719 - RNA, 22 nt, Variola virus
gguugccgcaaauagauagaac

SEQ ID NO: 4082720 - RNA, 15 nt, Variola virus
gguuuaaagaaauac

SEQ ID NO: 4082721 - RNA, 13 nt, Variola virus
guaaaaaauguac

SEQ ID NO: 4082722 - RNA, 16 nt, Variola virus
guaaaacaaaauuaga

SEQ ID NO: 4082723 - RNA, 14 nt, Variola virus
guaaaauaaucaua

SEQ ID NO: 4082724 - RNA, 22 nt, Variola virus
guaaaauggccaagaaaauaga

SEQ ID NO: 4082725 - RNA, 22 nt, Variola virus
guaaacauugacggauaaaaca

SEQ ID NO: 4082726 - RNA, 23 nt, Variola virus
guaaacauugacggauaaaacaa

SEQ ID NO: 4082727 - RNA, 18 nt, Variola virus
guaaaccgauuaaacguc

SEQ ID NO: 4082728 - RNA, 19 nt, Variola virus
guaaacuucgcguauacag

SEQ ID NO: 4082729 - RNA, 17 nt, Variola virus
guaaagcguuaaaucaa

SEQ ID NO: 4082730 - RNA, 21 nt, Variola virus
guaaauagaauaguauaaugu

SEQ ID NO: 4082731 - RNA, 13 nt, Variola virus
guaaauaguuuua

SEQ ID NO: 4082732 - RNA, 16 nt, Variola virus
guaaauccuaguucug

SEQ ID NO: 4082733 - RNA, 19 nt, Variola virus
guaaauguuuaauguuuua

SEQ ID NO: 4082734 - RNA, 13 nt, Variola virus
guaacacuuuuaa

SEQ ID NO: 4082735 - RNA, 17 nt, Variola virus
guaacuauguaaaugau

SEQ ID NO: 4082736 - RNA, 14 nt, Variola virus
guaagcauuuccuu

SEQ ID NO: 4082737 - RNA, 17 nt, Variola virus
guaauaauuuauguauu

SEQ ID NO: 4082738 - RNA, 16 nt, Variola virus
guaauacccauguuua

SEQ ID NO: 4082739 - RNA, 15 nt, Variola virus
guaauaucugauuua

SEQ ID NO: 4082740 - RNA, 22 nt, Variola virus
guaauauuguuaauuauuucua

SEQ ID NO: 4082741 - RNA, 16 nt, Variola virus
guaauuaauuguuuua

SEQ ID NO: 4082742 - RNA, 18 nt, Variola virus
guacaaacaggauaucua

SEQ ID NO: 4082743 - RNA, 12 nt, Variola virus
guacaaucagau

SEQ ID NO: 4082744 - RNA, 19 nt, Variola virus
guacagaauuaauuagacg

SEQ ID NO: 4082745 - RNA, 21 nt, Variola virus
guacagcguaguacauggcau

SEQ ID NO: 4082746 - RNA, 12 nt, Variola virus
guacauaauaga

SEQ ID NO: 4082747 - RNA, 21 nt, Variola virus
guacauuagccggacaaauau

SEQ ID NO: 4082748 - RNA, 19 nt, Variola virus
guacauugcucguaaaaga

SEQ ID NO: 4082749 - RNA, 18 nt, Variola virus
guacauuuuuaaacuguu

SEQ ID NO: 4082750 - RNA, 13 nt, Variola virus
guaccaaauuaau

SEQ ID NO: 4082751 - RNA, 17 nt, Variola virus
guacccacugaugagau

SEQ ID NO: 4082752 - RNA, 22 nt, Variola virus
guaccuaucaaggaacaaauau

SEQ ID NO: 4082753 - RNA, 18 nt, Variola virus
guaccuauucuagaaaau

SEQ ID NO: 4082754 - RNA, 18 nt, Variola virus
guacuacugaagaacuaa

SEQ ID NO: 4082755 - RNA, 13 nt, Variola virus
guacuauaauauu

SEQ ID NO: 4082756 - RNA, 14 nt, Variola virus
guacucuuaagaga

SEQ ID NO: 4082757 - RNA, 17 nt, Variola virus
guacuucucccauaaua

SEQ ID NO: 4082758 - RNA, 17 nt, Variola virus
guacuuugaugauuuuu

SEQ ID NO: 4082759 - RNA, 21 nt, Variola virus
guagaaacuauacgaaauaga

SEQ ID NO: 4082760 - RNA, 17 nt, Variola virus
guagaauuuuuuaaaaa

SEQ ID NO: 4082761 - RNA, 13 nt, Variola virus
guaguaacucuaa

SEQ ID NO: 4082762 - RNA, 16 nt, Variola virus
guagucaauaaaagag

SEQ ID NO: 4082763 - RNA, 19 nt, Variola virus
guagugaugguuuucuaaa

SEQ ID NO: 4082764 - RNA, 20 nt, Variola virus
guagugcgggcuuaaagcaa

SEQ ID NO: 4082765 - RNA, 17 nt, Variola virus
guaguugcguauuucuc

SEQ ID NO: 4082766 - RNA, 22 nt, Variola virus
guauaauagaccacgauaauau

SEQ ID NO: 4082767 - RNA, 18 nt, Variola virus
guauaauauuuaaacaau

SEQ ID NO: 4082768 - RNA, 23 nt, Variola virus
guauagaguuugcggauaaugau

SEQ ID NO: 4082769 - RNA, 14 nt, Variola virus
guauauaguuuaua

SEQ ID NO: 4082770 - RNA, 22 nt, Variola virus
guauaucaacaucuaccuuauu

SEQ ID NO: 4082771 - RNA, 15 nt, Variola virus
guauaucuauaucaa

SEQ ID NO: 4082772 - RNA, 13 nt, Variola virus
guauauguuucua

SEQ ID NO: 4082773 - RNA, 15 nt, Variola virus
guaucauuuaaacau

SEQ ID NO: 4082774 - RNA, 23 nt, Variola virus
guauccacuuuaauaauaucaua

SEQ ID NO: 4082775 - RNA, 15 nt, Variola virus
guauccguauaaaaa

SEQ ID NO: 4082776 - RNA, 19 nt, Variola virus
guaucgacgguaaauggaa

SEQ ID NO: 4082777 - RNA, 14 nt, Variola virus
guauuaauacauca

SEQ ID NO: 4082778 - RNA, 14 nt, Variola virus
guauuaguaggaaa

SEQ ID NO: 4082779 - RNA, 14 nt, Variola virus
guauuauauaugua

SEQ ID NO: 4082780 - RNA, 20 nt, Variola virus
guauucaguagccaauccua

SEQ ID NO: 4082781 - RNA, 14 nt, Variola virus
guauucuaauuuua

SEQ ID NO: 4082782 - RNA, 23 nt, Variola virus
guauucucagaguugacgaauau

SEQ ID NO: 4082783 - RNA, 13 nt, Variola virus
guauugauaaaau

SEQ ID NO: 4082784 - RNA, 18 nt, Variola virus
guauuguuuaauaaaaca

SEQ ID NO: 4082785 - RNA, 10 nt, Variola virus
guauuuccau

SEQ ID NO: 4082786 - RNA, 13 nt, Variola virus
guauuugauuuug

SEQ ID NO: 4082787 - RNA, 22 nt, Variola virus
guauuuggaucuuuuguacauc

SEQ ID NO: 4082788 - RNA, 22 nt, Variola virus
guauuuuaacacuaauuaagau

SEQ ID NO: 4082789 - RNA, 22 nt, Variola virus
guauuuuuuaugacaaacuuua

SEQ ID NO: 4082790 - RNA, 16 nt, Variola virus
gucaaaaucuaaacaa

SEQ ID NO: 4082791 - RNA, 19 nt, Variola virus
gucaaauuuaucuauuuua

SEQ ID NO: 4082792 - RNA, 22 nt, Variola virus
gucaacaaguuggaugauauua

SEQ ID NO: 4082793 - RNA, 12 nt, Variola virus
gucaauaaaaga

SEQ ID NO: 4082794 - RNA, 12 nt, Variola virus
gucaaucauguu

SEQ ID NO: 4082795 - RNA, 17 nt, Variola virus
gucaauuauuucaucaa

SEQ ID NO: 4082796 - RNA, 13 nt, Variola virus
gucaauugauucu

SEQ ID NO: 4082797 - RNA, 20 nt, Variola virus
gucaauuggaguaucaucua

SEQ ID NO: 4082798 - RNA, 16 nt, Variola virus
gucacauaguguuuua

SEQ ID NO: 4082799 - RNA, 20 nt, Variola virus
gucacauaucgcuacaaaac

SEQ ID NO: 4082800 - RNA, 16 nt, Variola virus
gucacguuuauacauc

SEQ ID NO: 4082801 - RNA, 15 nt, Variola virus
uaccuagaacaaugu

SEQ ID NO: 4082802 - RNA, 16 nt, Variola virus
uaccuagaacaauguc

SEQ ID NO: 4082803 - RNA, 20 nt, Variola virus
uaccuauauucuugauguag

SEQ ID NO: 4082804 - RNA, 19 nt, Variola virus
uaccuauuaauacaucgua

SEQ ID NO: 4082805 - RNA, 16 nt, Variola virus
uaccucuucugauauc

SEQ ID NO: 4082806 - RNA, 15 nt, Variola virus
uaccuggaauguaaa

SEQ ID NO: 4082807 - RNA, 19 nt, Variola virus
uaccuggaauguaaagccc

SEQ ID NO: 4082808 - RNA, 11 nt, Variola virus
uaccuguuuuu

SEQ ID NO: 4082809 - RNA, 19 nt, Variola virus
uaccuugaaaauaaauaca

SEQ ID NO: 4082810 - RNA, 15 nt, Variola virus
uaccuuuaaaauaua

SEQ ID NO: 4082811 - RNA, 18 nt, Variola virus
uaccuuucuacaugaaau

SEQ ID NO: 4082812 - RNA, 16 nt, Variola virus
uacgaacaauaucuua

SEQ ID NO: 4082813 - RNA, 20 nt, Variola virus
uacgaagggauugaaaauag

SEQ ID NO: 4082814 - RNA, 15 nt, Variola virus
uacgaggauucaaaa

SEQ ID NO: 4082815 - RNA, 14 nt, Variola virus
uacgauacuuauaa

SEQ ID NO: 4082816 - RNA, 22 nt, Variola virus
uacgcauucacucauacaugua

SEQ ID NO: 4082817 - RNA, 15 nt, Variola virus
uacgcgcacacaaua

SEQ ID NO: 4082818 - RNA, 17 nt, Variola virus
uacggauaucuaauaau

SEQ ID NO: 4082819 - RNA, 12 nt, Variola virus
uacguaaagaag

SEQ ID NO: 4082820 - RNA, 17 nt, Variola virus
uacguaucaccaacgga

SEQ ID NO: 4082821 - RNA, 20 nt, Variola virus
uacgucagcugcaucuaaau

SEQ ID NO: 4082822 - RNA, 20 nt, Variola virus
uacuaaaucuguauaucuuu

SEQ ID NO: 4082823 - RNA, 22 nt, Variola virus
uacuaauaggucuaaaaaccaa

SEQ ID NO: 4082824 - RNA, 23 nt, Variola virus
uacuacaauacgguuuaccgaaa

SEQ ID NO: 4082825 - RNA, 15 nt, Variola virus
uacuacuauuauuga

SEQ ID NO: 4082826 - RNA, 16 nt, Variola virus
uacuacuuuaccaaaa

SEQ ID NO: 4082827 - RNA, 17 nt, Variola virus
uacuaggagaauuauuu

SEQ ID NO: 4082828 - RNA, 17 nt, Variola virus
uacuauaauaguacuag

SEQ ID NO: 4082829 - RNA, 19 nt, Variola virus
uacuauauacaauaucacu

SEQ ID NO: 4082830 - RNA, 16 nt, Variola virus
uacuauccaucagaau

SEQ ID NO: 4082831 - RNA, 16 nt, Variola virus
uacuauuacagaaguu

SEQ ID NO: 4082832 - RNA, 17 nt, Variola virus
uacucaaucaauagcaa

SEQ ID NO: 4082833 - RNA, 15 nt, Variola virus
uacucagaggauuac

SEQ ID NO: 4082834 - RNA, 21 nt, Variola virus
uacucagauucaguuucucau

SEQ ID NO: 4082835 - RNA, 20 nt, Variola virus
uacucuuggucuaauacuga

SEQ ID NO: 4082836 - RNA, 22 nt, Variola virus
uacugaagaagaaaacaaacau

SEQ ID NO: 4082837 - RNA, 23 nt, Variola virus
uacugagaauuaacgaaacaaug

SEQ ID NO: 4082838 - RNA, 22 nt, Variola virus
uacuguuaaauguacuguauau

SEQ ID NO: 4082839 - RNA, 13 nt, Variola virus
uacuuacaucauu

SEQ ID NO: 4082840 - RNA, 13 nt, Variola virus
uacuuauguaugu

SEQ ID NO: 4082841 - RNA, 16 nt, Variola virus
uacuucucccauaaua

SEQ ID NO: 4082842 - RNA, 17 nt, Variola virus
uacuugaaauucuccag

SEQ ID NO: 4082843 - RNA, 19 nt, Variola virus
uacuugacugacuuaaaac

SEQ ID NO: 4082844 - RNA, 14 nt, Variola virus
uacuugauaagaua

SEQ ID NO: 4082845 - RNA, 22 nt, Variola virus
uacuuuaacauguguauuacau

SEQ ID NO: 4082846 - RNA, 18 nt, Variola virus
uacuuuauaauuaaugaa

SEQ ID NO: 4082847 - RNA, 23 nt, Variola virus
uacuuuaugaauggauaccugua

SEQ ID NO: 4082848 - RNA, 19 nt, Variola virus
uacuuucaaugagauaaau

SEQ ID NO: 4082849 - RNA, 15 nt, Variola virus
uacuuugacaaaugu

SEQ ID NO: 4082850 - RNA, 10 nt, Variola virus
uacuuuucua

SEQ ID NO: 4082851 - RNA, 16 nt, Variola virus
uacuuuuguuacuaau

SEQ ID NO: 4082852 - RNA, 14 nt, Variola virus
uacuuuuuacuaau

SEQ ID NO: 4082853 - RNA, 21 nt, Variola virus
uagaaaaaauuacuccaugga

SEQ ID NO: 4082854 - RNA, 19 nt, Variola virus
uagaaaaacuauaucuaug

SEQ ID NO: 4082855 - RNA, 22 nt, Variola virus
uagaaaacagagauaguaaaua

SEQ ID NO: 4082856 - RNA, 15 nt, Variola virus
uagaaaaucauacag

SEQ ID NO: 4082857 - RNA, 18 nt, Variola virus
uagaaaaugauucacaau

SEQ ID NO: 4082858 - RNA, 13 nt, Variola virus
uagaaaauggauu

SEQ ID NO: 4082859 - RNA, 21 nt, Variola virus
uagaaaccacggaucguaaua

SEQ ID NO: 4082860 - RNA, 17 nt, Variola virus
uagaaacuucaaagauu

SEQ ID NO: 4082861 - RNA, 21 nt, Variola virus
uagaaagcagauuagaugaca

SEQ ID NO: 4082862 - RNA, 18 nt, Variola virus
uagaaauaaaaauuauua

SEQ ID NO: 4082863 - RNA, 14 nt, Variola virus
uagaaaucaacaau

SEQ ID NO: 4082864 - RNA, 14 nt, Variola virus
uagaaaucauauau

SEQ ID NO: 4082865 - RNA, 12 nt, Variola virus
uagaaauuauuu

SEQ ID NO: 4082866 - RNA, 12 nt, Variola virus
uagaacaaaaua

SEQ ID NO: 4082867 - RNA, 13 nt, Variola virus
uagaacaacucuc

SEQ ID NO: 4082868 - RNA, 18 nt, Variola virus
uagaacaaugucaaaaua

SEQ ID NO: 4082869 - RNA, 14 nt, Variola virus
uagaacagaaauac

SEQ ID NO: 4082870 - RNA, 18 nt, Variola virus
uagaacagauuuaacaau

SEQ ID NO: 4082871 - RNA, 14 nt, Variola virus
uagaacauguguga

SEQ ID NO: 4082872 - RNA, 14 nt, Variola virus
uagaacucuuuuca

SEQ ID NO: 4082873 - RNA, 23 nt, Variola virus
uagaacuguagagggucaacaau

SEQ ID NO: 4082874 - RNA, 13 nt, Variola virus
uagaagagaauac

SEQ ID NO: 4082875 - RNA, 17 nt, Variola virus
uagaauauuguaacaau

SEQ ID NO: 4082876 - RNA, 19 nt, Variola virus
uagaauguauuuuaacacu

SEQ ID NO: 4082877 - RNA, 22 nt, Variola virus
uagaauuuauagacgacucauu

SEQ ID NO: 4082878 - RNA, 16 nt, Variola virus
uagaauuugaucuauu

SEQ ID NO: 4082879 - RNA, 15 nt, Variola virus
uagacauaauacuau

SEQ ID NO: 4082880 - RNA, 18 nt, Variola virus
uagacauuagauaugcca

SEQ ID NO: 4082881 - RNA, 13 nt, Variola virus
uagacauuuacca

SEQ ID NO: 4082882 - RNA, 13 nt, Variola virus
uagacgaugauuu

SEQ ID NO: 4082883 - RNA, 18 nt, Variola virus
uagacgguuccaaagauc

SEQ ID NO: 4082884 - RNA, 16 nt, Variola virus
uagacuugauuauucu

SEQ ID NO: 4082885 - RNA, 14 nt, Variola virus
uagacuuguuaaua

SEQ ID NO: 4082886 - RNA, 20 nt, Variola virus
uagacuuuaauggauauaca

SEQ ID NO: 4082887 - RNA, 14 nt, Variola virus
uagagaacauaaug

SEQ ID NO: 4082888 - RNA, 16 nt, Variola virus
uagagauaaaacaagu

SEQ ID NO: 4082889 - RNA, 22 nt, Variola virus
uagagauaaaacaaguuuucau

SEQ ID NO: 4082890 - RNA, 19 nt, Variola virus
uagagauaccaaagacuuu

SEQ ID NO: 4082891 - RNA, 12 nt, Variola virus
uagagaugaugc

SEQ ID NO: 4082892 - RNA, 14 nt, Variola virus
uagaggagaaguaa

SEQ ID NO: 4082893 - RNA, 22 nt, Variola virus
uagauaauaauaucguccuuaa

SEQ ID NO: 4082894 - RNA, 13 nt, Variola virus
uagauacaaaauc

SEQ ID NO: 4082895 - RNA, 20 nt, Variola virus
uagauacauuggccguaaua

SEQ ID NO: 4082896 - RNA, 21 nt, Variola virus
uagauacucuaccauuucugc

SEQ ID NO: 4082897 - RNA, 16 nt, Variola virus
uagauagaaauuuaua

SEQ ID NO: 4082898 - RNA, 14 nt, Variola virus
uagauauuaaacaa

SEQ ID NO: 4082899 - RNA, 17 nt, Variola virus
uagauauuaguaaauua

SEQ ID NO: 4082900 - RNA, 13 nt, Variola virus
uagaucaaacuua

SEQ ID NO: 4082901 - RNA, 17 nt, Variola virus
uagaucgucauauguca

SEQ ID NO: 4082902 - RNA, 14 nt, Variola virus
uagaucucuagaau

SEQ ID NO: 4082903 - RNA, 14 nt, Variola virus
uagaugaauuauua

SEQ ID NO: 4082904 - RNA, 15 nt, Variola virus
uagaugagaacagaa

SEQ ID NO: 4082905 - RNA, 20 nt, Variola virus
uagauguuaaaaaaacaucg

SEQ ID NO: 4082906 - RNA, 19 nt, Variola virus
uagauuauaucauaaauaa

SEQ ID NO: 4082907 - RNA, 17 nt, Variola virus
uagauuaugaagaauac

SEQ ID NO: 4082908 - RNA, 16 nt, Variola virus
uagauuauucuuaaau

SEQ ID NO: 4082909 - RNA, 17 nt, Variola virus
uagauucagaaaugcua

SEQ ID NO: 4082910 - RNA, 23 nt, Variola virus
uagauucuauugugucuguuaau

SEQ ID NO: 4082911 - RNA, 14 nt, Variola virus
uagauuguuuucag

SEQ ID NO: 4082912 - RNA, 13 nt, Variola virus
uagauuuacuaau

SEQ ID NO: 4082913 - RNA, 15 nt, Variola virus
uagauuuauuugaua

SEQ ID NO: 4082914 - RNA, 16 nt, Variola virus
uagauuucgaaaauac

SEQ ID NO: 4082915 - RNA, 13 nt, Variola virus
uagauuuuggaua

SEQ ID NO: 4082916 - RNA, 14 nt, Variola virus
uagcauaaaugcua

SEQ ID NO: 4082917 - RNA, 17 nt, Variola virus
uagcaugugguucuuca

SEQ ID NO: 4082918 - RNA, 18 nt, Variola virus
uagccgcgguaacuuuua

SEQ ID NO: 4082919 - RNA, 20 nt, Variola virus
uagcguguuuuaaauccuua

SEQ ID NO: 4082920 - RNA, 21 nt, Variola virus
uagcuaaagauuugucacaau

SEQ ID NO: 4082921 - RNA, 15 nt, Variola virus
uagcuaaugaugcag

SEQ ID NO: 4082922 - RNA, 21 nt, Variola virus
uagcuaucgguuuugucagau

SEQ ID NO: 4082923 - RNA, 18 nt, Variola virus
uagcuccccuguuuucau

SEQ ID NO: 4082924 - RNA, 18 nt, Variola virus
uagcucuguauucuguau

SEQ ID NO: 4082925 - RNA, 20 nt, Variola virus
uagcugaaacaaagaauugc

SEQ ID NO: 4082926 - RNA, 15 nt, Variola virus
uagcugaauguuaua

SEQ ID NO: 4082927 - RNA, 23 nt, Variola virus
uaggaaaacccucacacauaaac

SEQ ID NO: 4082928 - RNA, 20 nt, Variola virus
uuuucaauuaugcaucaaua

SEQ ID NO: 4082929 - RNA, 21 nt, Variola virus
uuuucacuuuuuauaauuuua

SEQ ID NO: 4082930 - RNA, 14 nt, Variola virus
uuuucaucauuuca

SEQ ID NO: 4082931 - RNA, 13 nt, Variola virus
uuuucaucuuuua

SEQ ID NO: 4082932 - RNA, 15 nt, Variola virus
uuuucggguuccaaa

SEQ ID NO: 4082933 - RNA, 22 nt, Variola virus
uuuucuacugaugcauguauuu

SEQ ID NO: 4082934 - RNA, 16 nt, Variola virus
uuuugauacuauccaa

SEQ ID NO: 4082935 - RNA, 23 nt, Variola virus
uuuuguucacaaaaauacauaaa

SEQ ID NO: 4082936 - RNA, 17 nt, Variola virus
uuuuguucuauaaacug

SEQ ID NO: 4082937 - RNA, 21 nt, Variola virus
uuuuuagaaaaaacaucauuu

SEQ ID NO: 4082938 - RNA, 23 nt, Variola virus
uuuuuagccggaauaacaucauc

SEQ ID NO: 4082939 - RNA, 19 nt, Variola virus
uuuuuauaaaaaaaucauu

SEQ ID NO: 4082940 - RNA, 23 nt, Variola virus
uuuuuauucaugguaucauagaa

SEQ ID NO: 4082941 - RNA, 15 nt, Variola virus
uuuuucaaauucuca

SEQ ID NO: 4082942 - RNA, 12 nt, Variola virus
uuuuucagauuu

SEQ ID NO: 4082943 - RNA, 16 nt, Variola virus
uuuuucaguuaucauc

SEQ ID NO: 4082944 - RNA, 23 nt, Variola virus
uuuuucguuuacaaaaucaaaua

SEQ ID NO: 4082945 - RNA, 19 nt, Variola virus
uuuuucuucauuuauuaua

SEQ ID NO: 4082946 - RNA, 22 nt, Variola virus
uuuuugugggaagugauucaaa

SEQ ID NO: 4082947 - RNA, 18 nt, Variola virus
uuuuuuagauguaguauc

SEQ ID NO: 4082948 - RNA, 11 nt, Variola virus
uuuuuuggaau

SEQ ID NO: 4082949 - RNA, 24 nt, Variola virus
aagacgagaucugaauggugaguu

SEQ ID NO: 4082950 - RNA, 14 nt, Variola virus
aagacggggauuuc

SEQ ID NO: 4082951 - RNA, 19 nt, Variola virus
aagacuccuaccgguguau

SEQ ID NO: 4082952 - RNA, 22 nt, Variola virus
aagaguuucaaaaauauucauu

SEQ ID NO: 4082953 - RNA, 13 nt, Variola virus
aagauaaugugaa

SEQ ID NO: 4082954 - RNA, 14 nt, Variola virus
aagauaaugugaau

SEQ ID NO: 4082955 - RNA, 21 nt, Variola virus
aagauacucuaccagcuaaag

SEQ ID NO: 4082956 - RNA, 14 nt, Variola virus
aagauauaaaugac

SEQ ID NO: 4082957 - RNA, 20 nt, Variola virus
aagauauagaugaggugguu

SEQ ID NO: 4082958 - RNA, 17 nt, Variola virus
aagauaugguaaaauua

SEQ ID NO: 4082959 - RNA, 19 nt, Variola virus
aagauauucuaaaauggua

SEQ ID NO: 4082960 - RNA, 17 nt, Variola virus
aagauauuuuucuaagc

SEQ ID NO: 4082961 - RNA, 23 nt, Variola virus
aagaucacuaauucuagucuuua

SEQ ID NO: 4082962 - RNA, 14 nt, Variola virus
aagaugaaaugauu

SEQ ID NO: 4082963 - RNA, 16 nt, Variola virus
aagaugagcauaaaca

SEQ ID NO: 4082964 - RNA, 16 nt, Variola virus
aagaugauauaaguua

SEQ ID NO: 4082965 - RNA, 19 nt, Variola virus
aagaugaugaaucuucauu

SEQ ID NO: 4082966 - RNA, 17 nt, Variola virus
aagaugcaaacauuaug

SEQ ID NO: 4082967 - RNA, 22 nt, Variola virus
aagaugcaaacauuauguagua

SEQ ID NO: 4082968 - RNA, 18 nt, Variola virus
aagauggaguauaaucuu

SEQ ID NO: 4082969 - RNA, 21 nt, Variola virus
aagauguuuucugucagaaaa

SEQ ID NO: 4082970 - RNA, 13 nt, Variola virus
aagauuaggaaau

SEQ ID NO: 4082971 - RNA, 16 nt, Variola virus
aagauucuacaaguaa

SEQ ID NO: 4082972 - RNA, 14 nt, Variola virus
aagauuguguagaa

SEQ ID NO: 4082973 - RNA, 15 nt, Variola virus
aagauuuaaauccua

SEQ ID NO: 4082974 - RNA, 13 nt, Variola virus
aagauuuguagaa

SEQ ID NO: 4082975 - RNA, 22 nt, Variola virus
aagcauauucuuaauauuagaa

SEQ ID NO: 4082976 - RNA, 22 nt, Variola virus
aagccacguaggaguuaucaca

SEQ ID NO: 4082977 - RNA, 18 nt, Variola virus
aagccuuaugcauccaaa

SEQ ID NO: 4082978 - RNA, 20 nt, Variola virus
aagcguguaaacgaaaacua

SEQ ID NO: 4082979 - RNA, 19 nt, Variola virus
aagcgugucccuaucuugu

SEQ ID NO: 4082980 - RNA, 21 nt, Variola virus
aaggaaugggguauggagaca

SEQ ID NO: 4082981 - RNA, 19 nt, Variola virus
aaggauaaaauauuaucca

SEQ ID NO: 4082982 - RNA, 14 nt, Variola virus
aaggaugauacauu

SEQ ID NO: 4082983 - RNA, 23 nt, Variola virus
aaggaugcaaacuuacagaaaca

SEQ ID NO: 4082984 - RNA, 18 nt, Variola virus
aaggauucauugacauau

SEQ ID NO: 4082985 - RNA, 20 nt, Variola virus
aaggcaacaaagaaauuuuu

SEQ ID NO: 4082986 - RNA, 12 nt, Variola virus
aaggcagaaaua

SEQ ID NO: 4082987 - RNA, 15 nt, Variola virus
aaggcuuuaaaagua

SEQ ID NO: 4082988 - RNA, 12 nt, Variola virus
aaguaaauacug

SEQ ID NO: 4082989 - RNA, 11 nt, Variola virus
aaguaaaugaa

SEQ ID NO: 4082990 - RNA, 14 nt, Variola virus
aaguacagaauuaa

SEQ ID NO: 4082991 - RNA, 20 nt, Variola virus
aaguagaucaucugaaaauc

SEQ ID NO: 4082992 - RNA, 13 nt, Variola virus
aaguauaaauacc

SEQ ID NO: 4082993 - RNA, 11 nt, Variola virus
aaguauaacga

SEQ ID NO: 4082994 - RNA, 20 nt, Variola virus
aaguauagcuaaugaugcag

SEQ ID NO: 4082995 - RNA, 21 nt, Variola virus
aaguauauaugagauacacgu

SEQ ID NO: 4082996 - RNA, 15 nt, Variola virus
aaguauuuauacaaa

SEQ ID NO: 4082997 - RNA, 19 nt, Variola virus
aaguauuugaacauguaga

SEQ ID NO: 4082998 - RNA, 20 nt, Variola virus
aaguauuugaacauguagau

SEQ ID NO: 4082999 - RNA, 16 nt, Variola virus
aagucacuaacugaua

SEQ ID NO: 4083000 - RNA, 19 nt, Variola virus
aagucugauauucagaaag

SEQ ID NO: 4083001 - RNA, 18 nt, Variola virus
aagucugcuaucagugau

SEQ ID NO: 4083002 - RNA, 21 nt, Variola virus
aagugacauuauaauuuuacc

SEQ ID NO: 4083003 - RNA, 20 nt, Variola virus
aagugaguauacuugucauc

SEQ ID NO: 4083004 - RNA, 21 nt, Variola virus
aaguuaucucuaacaaaacua

SEQ ID NO: 4083005 - RNA, 18 nt, Variola virus
aaguucauaaaaauaaua

SEQ ID NO: 4083006 - RNA, 20 nt, Variola virus
aaguuccuccuuguauuugu

SEQ ID NO: 4083007 - RNA, 19 nt, Variola virus
aaguuucaagauaaauaau

SEQ ID NO: 4083008 - RNA, 17 nt, Variola virus
aaguuucguacaaauac

SEQ ID NO: 4083009 - RNA, 23 nt, Variola virus
aaguuucuuuacuguaucuacua

SEQ ID NO: 4083010 - RNA, 21 nt, Variola virus
aaguuugaaacgagugaaaaa

SEQ ID NO: 4083011 - RNA, 19 nt, Variola virus
aaguuugagauuucauaau

SEQ ID NO: 4083012 - RNA, 19 nt, Variola virus
aaguuuggguaaauaacua

SEQ ID NO: 4083013 - RNA, 22 nt, Variola virus
aaguuuuaucucuuucucucuu

SEQ ID NO: 4083014 - RNA, 16 nt, Variola virus
aaguuuuuauucucuu

SEQ ID NO: 4083015 - RNA, 14 nt, Variola virus
aauaaaaauguuuu

SEQ ID NO: 4083016 - RNA, 12 nt, Variola virus
aauaaaauggau

SEQ ID NO: 4083017 - RNA, 20 nt, Variola virus
aauaaaauguuaauacauca

SEQ ID NO: 4083018 - RNA, 17 nt, Variola virus
aauaaacguucacguaa

SEQ ID NO: 4083019 - RNA, 18 nt, Variola virus
aauaaacuagaaaaacuu

SEQ ID NO: 4083020 - RNA, 16 nt, Variola virus
aauaaacuauuucuaa

SEQ ID NO: 4083021 - RNA, 15 nt, Variola virus
aauaaauaacaaugg

SEQ ID NO: 4083022 - RNA, 18 nt, Variola virus
aauaaauagauauaaaau

SEQ ID NO: 4083023 - RNA, 17 nt, Variola virus
aauaaauauaacuuauu

SEQ ID NO: 4083024 - RNA, 22 nt, Variola virus
aauaaauggagaauaauuggaa

SEQ ID NO: 4083025 - RNA, 20 nt, Variola virus
aauaaauguccacuauacau

SEQ ID NO: 4083026 - RNA, 21 nt, Variola virus
aauaaauuuucucuuaaaaau

SEQ ID NO: 4083027 - RNA, 13 nt, Variola virus
aauaacaggcuaa

SEQ ID NO: 4083028 - RNA, 19 nt, Variola virus
aauaacauaggauuaaaaa

SEQ ID NO: 4083029 - RNA, 15 nt, Variola virus
aauaacuaugauauc

SEQ ID NO: 4083030 - RNA, 14 nt, Variola virus
aauaagaacaaagu

SEQ ID NO: 4083031 - RNA, 23 nt, Variola virus
aauaagagcagcacaaacucauu

SEQ ID NO: 4083032 - RNA, 22 nt, Variola virus
aauaagcuauauaauaaaugua

SEQ ID NO: 4083033 - RNA, 19 nt, Variola virus
aauaaguuuuagauauuca

SEQ ID NO: 4083034 - RNA, 18 nt, Variola virus
aaugccacaucaaagaua

SEQ ID NO: 4083035 - RNA, 22 nt, Variola virus
aaugcgacgaguuagaaagaua

SEQ ID NO: 4083036 - RNA, 17 nt, Variola virus
aaugcgaggaaauguau

SEQ ID NO: 4083037 - RNA, 17 nt, Variola virus
aaugcggauuuagaaaa

SEQ ID NO: 4083038 - RNA, 20 nt, Variola virus
aaugcuaauauauucuuaca

SEQ ID NO: 4083039 - RNA, 13 nt, Variola virus
aaugcuaauguuc

SEQ ID NO: 4083040 - RNA, 17 nt, Variola virus
aaugcucaguaaaugua

SEQ ID NO: 4083041 - RNA, 18 nt, Variola virus
aauggauauucgaacauu

SEQ ID NO: 4083042 - RNA, 22 nt, Variola virus
aauggauuuugaugauauuaaa

SEQ ID NO: 4083043 - RNA, 22 nt, Variola virus
aauggcaauaacuaaaaaugua

SEQ ID NO: 4083044 - RNA, 21 nt, Variola virus
aaugguacuucuuaccaacau

SEQ ID NO: 4083045 - RNA, 18 nt, Variola virus
aaugguuucgaagaucuu

SEQ ID NO: 4083046 - RNA, 12 nt, Variola virus
aauguaaagaua

SEQ ID NO: 4083047 - RNA, 13 nt, Variola virus
aauguaacaucua

SEQ ID NO: 4083048 - RNA, 17 nt, Variola virus
aauguaaucauauaaau

SEQ ID NO: 4083049 - RNA, 14 nt, Variola virus
aauguaauucuaaa

SEQ ID NO: 4083050 - RNA, 12 nt, Variola virus
aauguauaacag

SEQ ID NO: 4083051 - RNA, 16 nt, Variola virus
aauguauacaaaugua

SEQ ID NO: 4083052 - RNA, 21 nt, Variola virus
aauguaugaacaucauggaau

SEQ ID NO: 4083053 - RNA, 18 nt, Variola virus
aauguauuaguaggaaau

SEQ ID NO: 4083054 - RNA, 22 nt, Variola virus
aauguauuaguuaaauauuaaa

SEQ ID NO: 4083055 - RNA, 14 nt, Variola virus
aauguccacaaaug

SEQ ID NO: 4083056 - RNA, 22 nt, Variola virus
aaugugaauuuagcauauagua

SEQ ID NO: 4083057 - RNA, 22 nt, Variola virus
aaugugguaugucuccauuaca

SEQ ID NO: 4083058 - RNA, 18 nt, Variola virus
aauguuagaauuagaaaa

SEQ ID NO: 4083059 - RNA, 15 nt, Variola virus
aauguuauagaaaau

SEQ ID NO: 4083060 - RNA, 15 nt, Variola virus
aauguucucaagaac

SEQ ID NO: 4083061 - RNA, 20 nt, Variola virus
aauguugauaaaaugcauga

SEQ ID NO: 4083062 - RNA, 17 nt, Variola virus
aauguuugaaaacauua

SEQ ID NO: 4083063 - RNA, 15 nt, Variola virus
aauuaaaaaucgaua

SEQ ID NO: 4083064 - RNA, 22 nt, Variola virus
aauuaauuuuuccuuacacaau

SEQ ID NO: 4083065 - RNA, 15 nt, Variola virus
aauuacacauuucca

SEQ ID NO: 4083066 - RNA, 20 nt, Variola virus
aauuacgacgagcauauuca

SEQ ID NO: 4083067 - RNA, 19 nt, Variola virus
aauuacgcucuacaaaaug

SEQ ID NO: 4083068 - RNA, 15 nt, Variola virus
aauuacuaaaauaua

SEQ ID NO: 4083069 - RNA, 15 nt, Variola virus
aauuacuuaaagaua

SEQ ID NO: 4083070 - RNA, 15 nt, Variola virus
aauuagaaagugaua

SEQ ID NO: 4083071 - RNA, 23 nt, Variola virus
aauuagaacagggaauuacuuua

SEQ ID NO: 4083072 - RNA, 19 nt, Variola virus
aauuaguagaaaauacaac

SEQ ID NO: 4083073 - RNA, 12 nt, Variola virus
aauuaguuuauu

SEQ ID NO: 4083074 - RNA, 15 nt, Variola virus
aauuauacaagagau

SEQ ID NO: 4083075 - RNA, 22 nt, Variola virus
aauuauaccaauagauaauugu

SEQ ID NO: 4083076 - RNA, 12 nt, Variola virus
aauuauauuguc

SEQ ID NO: 4083077 - RNA, 15 nt, Variola virus
aauuaucaaauacuu

SEQ ID NO: 4083078 - RNA, 15 nt, Variola virus
aauuaugauagaaau

SEQ ID NO: 4083079 - RNA, 17 nt, Variola virus
aauuaugauagaaauua

SEQ ID NO: 4083080 - RNA, 13 nt, Variola virus
aauuauuaccaua

SEQ ID NO: 4083081 - RNA, 21 nt, Variola virus
aauuauuccuaauuaagaaaa

SEQ ID NO: 4083082 - RNA, 13 nt, Variola virus
aauuauuuaacuu

SEQ ID NO: 4083083 - RNA, 14 nt, Variola virus
aauuauuuuuacua

SEQ ID NO: 4083084 - RNA, 17 nt, Variola virus
aauucaaauagauguuc

SEQ ID NO: 4083085 - RNA, 14 nt, Variola virus
aauucaauaucuuu

SEQ ID NO: 4083086 - RNA, 19 nt, Variola virus
aauucaccuucacaaaaua

SEQ ID NO: 4083087 - RNA, 18 nt, Variola virus
aauucauagcugagaaua

SEQ ID NO: 4083088 - RNA, 21 nt, Variola virus
aauucauccguccuucagaca

SEQ ID NO: 4083089 - RNA, 14 nt, Variola virus
aauucauuccuaua

SEQ ID NO: 4083090 - RNA, 16 nt, Variola virus
aauucauucucuagaa

SEQ ID NO: 4083091 - RNA, 13 nt, Variola virus
aauucauuuccau

SEQ ID NO: 4083092 - RNA, 17 nt, Variola virus
aauucgacaaugaugcg

SEQ ID NO: 4083093 - RNA, 15 nt, Variola virus
aauucgagaaagaua

SEQ ID NO: 4083094 - RNA, 14 nt, Variola virus
aauucggaaaugua

SEQ ID NO: 4083095 - RNA, 14 nt, Variola virus
aauucuaaaugaug

SEQ ID NO: 4083096 - RNA, 12 nt, Variola virus
aauucuagcauc

SEQ ID NO: 4083097 - RNA, 15 nt, Variola virus
aauucuaucucuaag

SEQ ID NO: 4083098 - RNA, 23 nt, Variola virus
aauucucuuacgucgauauuucu

SEQ ID NO: 4083099 - RNA, 22 nt, Variola virus
aauucuuaguuauauauacucu

SEQ ID NO: 4083100 - RNA, 17 nt, Variola virus
aauugaccguguaauau

SEQ ID NO: 4083101 - RNA, 22 nt, Variola virus
aauugauucuuauucacuauau

SEQ ID NO: 4083102 - RNA, 13 nt, Variola virus
aauugauucuuga

SEQ ID NO: 4083103 - RNA, 14 nt, Variola virus
aauuggacaaguau

SEQ ID NO: 4083104 - RNA, 13 nt, Variola virus
aauugguauaaau

SEQ ID NO: 4083105 - RNA, 13 nt, Variola virus
aauugucuagaua

SEQ ID NO: 4083106 - RNA, 16 nt, Variola virus
aauugucuauaaauua

SEQ ID NO: 4083107 - RNA, 14 nt, Variola virus
aauugucuguaaac

SEQ ID NO: 4083108 - RNA, 23 nt, Variola virus
aauuguguccgaaacuuagaaga

SEQ ID NO: 4083109 - RNA, 13 nt, Variola virus
aauuuaaaauaua

SEQ ID NO: 4083110 - RNA, 14 nt, Variola virus
aauuuaaagaaugu

SEQ ID NO: 4083111 - RNA, 17 nt, Variola virus
aauuuaagaaaaugauu

SEQ ID NO: 4083112 - RNA, 12 nt, Variola virus
aauuuauacaaa

SEQ ID NO: 4083113 - RNA, 23 nt, Variola virus
aauuuauagaugauggaagacaa

SEQ ID NO: 4083114 - RNA, 21 nt, Variola virus
aauuuauuucuaauucucaga

SEQ ID NO: 4083115 - RNA, 21 nt, Variola virus
aauuuccccauugauagaaaa

SEQ ID NO: 4083116 - RNA, 19 nt, Variola virus
aauuuccgucuaucaucua

SEQ ID NO: 4083117 - RNA, 18 nt, Variola virus
aauuuccugauucagaua

SEQ ID NO: 4083118 - RNA, 16 nt, Variola virus
aauuucguuagucaua

SEQ ID NO: 4083119 - RNA, 15 nt, Variola virus
aauuugauaaagaua

SEQ ID NO: 4083120 - RNA, 20 nt, Variola virus
aauuuguagauuuuguuaua

SEQ ID NO: 4083121 - RNA, 23 nt, Variola virus
aauuuguauguuugggagaauua

SEQ ID NO: 4083122 - RNA, 19 nt, Variola virus
aauuuguccacguucuuua

SEQ ID NO: 4083123 - RNA, 16 nt, Variola virus
aauuuguucaaaauag

SEQ ID NO: 4083124 - RNA, 17 nt, Variola virus
aauuuuaagaaauggug

SEQ ID NO: 4083125 - RNA, 13 nt, Variola virus
aauuuuagauaau

SEQ ID NO: 4083126 - RNA, 18 nt, Variola virus
aauuuuauucuagaauug

SEQ ID NO: 4083127 - RNA, 22 nt, Variola virus
aauuuuguuuuuguacuuucua

SEQ ID NO: 4083128 - RNA, 17 nt, Variola virus
aauuuuucuacagauau

SEQ ID NO: 4083129 - RNA, 12 nt, Variola virus
aauuuuucuuaa

SEQ ID NO: 4083130 - RNA, 23 nt, Variola virus
aauuuuuugguagguuuuagaga

SEQ ID NO: 4083131 - RNA, 15 nt, Variola virus
acaaaaaauaaaaga

SEQ ID NO: 4083132 - RNA, 15 nt, Variola virus
acaaaaauacauaaa

SEQ ID NO: 4083133 - RNA, 16 nt, Variola virus
acaaaaauuaugaaau

SEQ ID NO: 4083134 - RNA, 21 nt, Variola virus
acaaaaccgauaaauggaaau

SEQ ID NO: 4083135 - RNA, 13 nt, Variola virus
acaaaauaaugua

SEQ ID NO: 4083136 - RNA, 15 nt, Variola virus
acaaaaucaaauaau

SEQ ID NO: 4083137 - RNA, 22 nt, Variola virus
acaaaauccaaacauuacaaau

SEQ ID NO: 4083138 - RNA, 20 nt, Variola virus
acaaaauucauuagaauaua

SEQ ID NO: 4083139 - RNA, 17 nt, Variola virus
acaaacaacuaggaaau

SEQ ID NO: 4083140 - RNA, 18 nt, Variola virus
acaaacacuacaacagau

SEQ ID NO: 4083141 - RNA, 17 nt, Variola virus
acaaacauacucuaaua

SEQ ID NO: 4083142 - RNA, 15 nt, Variola virus
acaaacauauuacca

SEQ ID NO: 4083143 - RNA, 13 nt, Variola virus
acaaacaucucac

SEQ ID NO: 4083144 - RNA, 21 nt, Variola virus
acaaacauguucaaugcaaua

SEQ ID NO: 4083145 - RNA, 18 nt, Variola virus
acaaacgcuacuauauau

SEQ ID NO: 4083146 - RNA, 16 nt, Variola virus
acaaacuauagaaauu

SEQ ID NO: 4083147 - RNA, 23 nt, Variola virus
acaaaguacuguucauacaugau

SEQ ID NO: 4083148 - RNA, 17 nt, Variola virus
acaaauauaaaaugaua

SEQ ID NO: 4083149 - RNA, 21 nt, Variola virus
acaaauauaugcaaaauaaua

SEQ ID NO: 4083150 - RNA, 15 nt, Variola virus
acaaaucuauaacau

SEQ ID NO: 4083151 - RNA, 14 nt, Variola virus
acaaaugauaauca

SEQ ID NO: 4083152 - RNA, 19 nt, Variola virus
acaaaugcaccaaaguuau

SEQ ID NO: 4083153 - RNA, 18 nt, Variola virus
acaaauggauguuaaugu

SEQ ID NO: 4083154 - RNA, 17 nt, Variola virus
acaaauggucaaugaua

SEQ ID NO: 4083155 - RNA, 22 nt, Variola virus
acaaauguuaaacauuaauuga

SEQ ID NO: 4083156 - RNA, 19 nt, Variola virus
acaaauuaaauucuggaau

SEQ ID NO: 4083157 - RNA, 12 nt, Variola virus
acaacaaaugau

SEQ ID NO: 4083158 - RNA, 13 nt, Variola virus
acaacaaaugaua

SEQ ID NO: 4083159 - RNA, 18 nt, Variola virus
acaacaaugucucgaaau

SEQ ID NO: 4083160 - RNA, 18 nt, Variola virus
accaacuuaaacaaaaua

SEQ ID NO: 4083161 - RNA, 21 nt, Variola virus
accaauaaaaauaaacuagaa

SEQ ID NO: 4083162 - RNA, 18 nt, Variola virus
accaguaucaauuuauca

SEQ ID NO: 4083163 - RNA, 22 nt, Variola virus
accauaauccuauucuugaucu

SEQ ID NO: 4083164 - RNA, 23 nt, Variola virus
accauagauucauucuuuauaga

SEQ ID NO: 4083165 - RNA, 22 nt, Variola virus
accauccuuuaaaaaaaaugau

SEQ ID NO: 4083166 - RNA, 19 nt, Variola virus
accaucugugguacgaaug

SEQ ID NO: 4083167 - RNA, 14 nt, Variola virus
accaugaaagaaag

SEQ ID NO: 4083168 - RNA, 18 nt, Variola virus
accauggacauaaagaua

SEQ ID NO: 4083169 - RNA, 18 nt, Variola virus
accccauugaugacuuua

SEQ ID NO: 4083170 - RNA, 13 nt, Variola virus
accgaaauuauca

SEQ ID NO: 4083171 - RNA, 18 nt, Variola virus
accgaagagcagcuauau

SEQ ID NO: 4083172 - RNA, 19 nt, Variola virus
accgaaggagauacuauca

SEQ ID NO: 4083173 - RNA, 20 nt, Variola virus
accgacaucacuucagaaau

SEQ ID NO: 4083174 - RNA, 18 nt, Variola virus
accgauaauaaaauuacu

SEQ ID NO: 4083175 - RNA, 15 nt, Variola virus
accggucauauuaau

SEQ ID NO: 4083176 - RNA, 13 nt, Variola virus
accguacaaguau

SEQ ID NO: 4083177 - RNA, 22 nt, Variola virus
accuaaauaauuauacuuugua

SEQ ID NO: 4083178 - RNA, 13 nt, Variola virus
accuaagaagaau

SEQ ID NO: 4083179 - RNA, 17 nt, Variola virus
accuaagcaagaaagau

SEQ ID NO: 4083180 - RNA, 22 nt, Variola virus
accuacuuuagcauugaaaaua

SEQ ID NO: 4083181 - RNA, 21 nt, Variola virus
accuguagaucuuaucuaucc

SEQ ID NO: 4083182 - RNA, 24 nt, Variola virus
accuuuuccuuaucuucauaaaau

SEQ ID NO: 4083183 - RNA, 16 nt, Variola virus
acgaaaguaauuauua

SEQ ID NO: 4083184 - RNA, 19 nt, Variola virus
acgaagauacuauccauca

SEQ ID NO: 4083185 - RNA, 23 nt, Variola virus
acgaaucauccauaaauuauacu

SEQ ID NO: 4083186 - RNA, 21 nt, Variola virus
acgacgacauauuaguaacug

SEQ ID NO: 4083187 - RNA, 19 nt, Variola virus
acgagauugugaacauugu

SEQ ID NO: 4083188 - RNA, 13 nt, Variola virus
acgaguauagcau

SEQ ID NO: 4083189 - RNA, 17 nt, Variola virus
acgaguugaucuucaaa

SEQ ID NO: 4083190 - RNA, 11 nt, Variola virus
acgauaaaaga

SEQ ID NO: 4083191 - RNA, 17 nt, Variola virus
acgauaacauucuagga

SEQ ID NO: 4083192 - RNA, 18 nt, Variola virus
acgauauuuguuggauuu

SEQ ID NO: 4083193 - RNA, 19 nt, Variola virus
acgaucaaccaaaaaggau

SEQ ID NO: 4083194 - RNA, 14 nt, Variola virus
acgaucuauuagaa

SEQ ID NO: 4083195 - RNA, 17 nt, Variola virus
acgauuuauauucacca

SEQ ID NO: 4083196 - RNA, 22 nt, Variola virus
acgcagaaaagauaccacgagu

SEQ ID NO: 4083197 - RNA, 15 nt, Variola virus
acgcgucuuuaacuc

SEQ ID NO: 4083198 - RNA, 15 nt, Variola virus
acgcuauuaaucuuu

SEQ ID NO: 4083199 - RNA, 12 nt, Variola virus
acggagaagaau

SEQ ID NO: 4083200 - RNA, 18 nt, Variola virus
acggagccccaggaucuc

SEQ ID NO: 4083201 - RNA, 18 nt, Variola virus
acggaugcagaugucuuu

SEQ ID NO: 4083202 - RNA, 14 nt, Variola virus
acggugaauacaau

SEQ ID NO: 4083203 - RNA, 13 nt, Variola virus
acguacauggaaa

SEQ ID NO: 4083204 - RNA, 22 nt, Variola virus
acguauauagaugucaaugaag

SEQ ID NO: 4083205 - RNA, 13 nt, Variola virus
acguauuaaauau

SEQ ID NO: 4083206 - RNA, 18 nt, Variola virus
acgucauaaaaauguuua

SEQ ID NO: 4083207 - RNA, 21 nt, Variola virus
acguccugcaggguauuguuu

SEQ ID NO: 4083208 - RNA, 23 nt, Variola virus
acgucuagaguuuauaucaauaa

SEQ ID NO: 4083209 - RNA, 16 nt, Variola virus
acguugaaaaaaauug

SEQ ID NO: 4083210 - RNA, 15 nt, Variola virus
acguuggcacaugau

SEQ ID NO: 4083211 - RNA, 19 nt, Variola virus
acguuuuucgaaaaaauua

SEQ ID NO: 4083212 - RNA, 13 nt, Variola virus
acuaaacacauua

SEQ ID NO: 4083213 - RNA, 19 nt, Variola virus
acuaaacuaacuccuuggu

SEQ ID NO: 4083214 - RNA, 21 nt, Variola virus
acuaaacuaacuccuugguuu

SEQ ID NO: 4083215 - RNA, 18 nt, Variola virus
acuaaagacuaugucaaa

SEQ ID NO: 4083216 - RNA, 19 nt, Variola virus
acuaaaggcaacaaagaaa

SEQ ID NO: 4083217 - RNA, 12 nt, Variola virus
acuaaauacuac

SEQ ID NO: 4083218 - RNA, 18 nt, Variola virus
acuaacucucuaauggau

SEQ ID NO: 4083219 - RNA, 19 nt, Variola virus
acuaaguauauacacagaa

SEQ ID NO: 4083220 - RNA, 13 nt, Variola virus
acuaauaaagaag

SEQ ID NO: 4083221 - RNA, 17 nt, Variola virus
acuaaucgauuuugcau

SEQ ID NO: 4083222 - RNA, 23 nt, Variola virus
acuaaucgauuuugcauacucua

SEQ ID NO: 4083223 - RNA, 17 nt, Variola virus
acuaaugacaauaauua

SEQ ID NO: 4083224 - RNA, 19 nt, Variola virus
acuaaugcaucuauuucau

SEQ ID NO: 4083225 - RNA, 16 nt, Variola virus
acuaauguauauuuua

SEQ ID NO: 4083226 - RNA, 19 nt, Variola virus
acuaauuaguaacgacuau

SEQ ID NO: 4083227 - RNA, 16 nt, Variola virus
acuaauuauacacauu

SEQ ID NO: 4083228 - RNA, 23 nt, Variola virus
acuaauucauuuucaauaauaua

SEQ ID NO: 4083229 - RNA, 18 nt, Variola virus
acuacauacgcgacugua

SEQ ID NO: 4083230 - RNA, 20 nt, Variola virus
acuaccgaguuuaaaacuuc

SEQ ID NO: 4083231 - RNA, 18 nt, Variola virus
acuacgcgauuauuuuca

SEQ ID NO: 4083232 - RNA, 15 nt, Variola virus
acuacguugaagauc

SEQ ID NO: 4083233 - RNA, 13 nt, Variola virus
acuagaagaaagu

SEQ ID NO: 4083234 - RNA, 16 nt, Variola virus
acuagacuauuaauaa

SEQ ID NO: 4083235 - RNA, 17 nt, Variola virus
acuagacugauuucucu

SEQ ID NO: 4083236 - RNA, 14 nt, Variola virus
acuagaguauauaa

SEQ ID NO: 4083237 - RNA, 17 nt, Variola virus
acuagauaaaucguuug

SEQ ID NO: 4083238 - RNA, 17 nt, Variola virus
acuagauauauuaauaa

SEQ ID NO: 4083239 - RNA, 18 nt, Variola virus
acuaggauuagagaagau

SEQ ID NO: 4083240 - RNA, 18 nt, Variola virus
acuagucgcguuaauagu

SEQ ID NO: 4083241 - RNA, 21 nt, Variola virus
acuagugauaucauuaauaca

SEQ ID NO: 4083242 - RNA, 18 nt, Variola virus
acuauaaauggagaaugu

SEQ ID NO: 4083243 - RNA, 12 nt, Variola virus
acuauaaugaaa

SEQ ID NO: 4083244 - RNA, 15 nt, Variola virus
acuauaauuuuguga

SEQ ID NO: 4083245 - RNA, 22 nt, Variola virus
acuauacauuuccgaaugaaug

SEQ ID NO: 4083246 - RNA, 14 nt, Variola virus
acuauagacauaau

SEQ ID NO: 4083247 - RNA, 22 nt, Variola virus
acuauauaguuuaaauuaagca

SEQ ID NO: 4083248 - RNA, 19 nt, Variola virus
acuauaucgacauauuuca

SEQ ID NO: 4083249 - RNA, 18 nt, Variola virus
acuauccaauaaacaguc

SEQ ID NO: 4083250 - RNA, 20 nt, Variola virus
acuaucguuggaaaaugaug

SEQ ID NO: 4083251 - RNA, 18 nt, Variola virus
acuaugcgaugucuugga

SEQ ID NO: 4083252 - RNA, 22 nt, Variola virus
acuauggacgcaugauaagaau

SEQ ID NO: 4083253 - RNA, 19 nt, Variola virus
acuauuacagaaguuuuaa

SEQ ID NO: 4083254 - RNA, 17 nt, Variola virus
acuauuauguuuaaaga

SEQ ID NO: 4083255 - RNA, 18 nt, Variola virus
acuauuuagaaauugaaa

SEQ ID NO: 4083256 - RNA, 16 nt, Variola virus
acuauuuggauagaca

SEQ ID NO: 4083257 - RNA, 18 nt, Variola virus
acuauuugucuuaauaga

SEQ ID NO: 4083258 - RNA, 20 nt, Variola virus
acuauuuuaaauagcauaga

SEQ ID NO: 4083259 - RNA, 18 nt, Variola virus
acucaacggaaaacauuu

SEQ ID NO: 4083260 - RNA, 15 nt, Variola virus
acucaauuaguauau

SEQ ID NO: 4083261 - RNA, 18 nt, Variola virus
acucaggaagauauuuua

SEQ ID NO: 4083262 - RNA, 16 nt, Variola virus
acucauaaaauacaag

SEQ ID NO: 4083263 - RNA, 22 nt, Variola virus
acucaugaaucuaaaagaauug

SEQ ID NO: 4083264 - RNA, 22 nt, Variola virus
acuccaaugacugaauacauua

SEQ ID NO: 4083265 - RNA, 15 nt, Variola virus
acuccuauauuuccc

SEQ ID NO: 4083266 - RNA, 14 nt, Variola virus
acuccuugacuauc

SEQ ID NO: 4083267 - RNA, 22 nt, Variola virus
acucuaagaacuuauuaaugaa

SEQ ID NO: 4083268 - RNA, 16 nt, Variola virus
acucuacguaucucgu

SEQ ID NO: 4083269 - RNA, 16 nt, Variola virus
acucuauucuucaaga

SEQ ID NO: 4083270 - RNA, 18 nt, Variola virus
acucucuaucucuuaaug

SEQ ID NO: 4083271 - RNA, 20 nt, Variola virus
acucucuaucucuuaaugag

SEQ ID NO: 4083272 - RNA, 16 nt, Variola virus
acucugaaaagaaagu

SEQ ID NO: 4083273 - RNA, 21 nt, Variola virus
acucuguuucuguaucuauca

SEQ ID NO: 4083274 - RNA, 20 nt, Variola virus
acucuuggucuaauacugau

SEQ ID NO: 4083275 - RNA, 14 nt, Variola virus
acugaauauauuua

SEQ ID NO: 4083276 - RNA, 22 nt, Variola virus
acugauuaauaagaucuucuau

SEQ ID NO: 4083277 - RNA, 20 nt, Variola virus
acugcaaaacuuaaauguua

SEQ ID NO: 4083278 - RNA, 21 nt, Variola virus
acugcauauugucccaauguu

SEQ ID NO: 4083279 - RNA, 22 nt, Variola virus
acuggauauucgauaacagcau

SEQ ID NO: 4083280 - RNA, 15 nt, Variola virus
acuggcguuguucaa

SEQ ID NO: 4083281 - RNA, 19 nt, Variola virus
acuggucauagaaaaugau

SEQ ID NO: 4083282 - RNA, 17 nt, Variola virus
acuguauccucaaacau

SEQ ID NO: 4083283 - RNA, 18 nt, Variola virus
acuguauccucaaacauc

SEQ ID NO: 4083284 - RNA, 15 nt, Variola virus
acuguggauguaaua

SEQ ID NO: 4083285 - RNA, 20 nt, Variola virus
acucauauaguauugaacag

SEQ ID NO: 4083286 - RNA, 20 nt, Variola virus
acucauguagcauagguaau

SEQ ID NO: 4083287 - RNA, 16 nt, Variola virus
acucauuuaacagaug

SEQ ID NO: 4083288 - RNA, 23 nt, Variola virus
acucauuucauuauaauaguuua

SEQ ID NO: 4083289 - RNA, 14 nt, Variola virus
acuccguagagaaa

SEQ ID NO: 4083290 - RNA, 21 nt, Variola virus
acuccucuauuuaauacuuua

SEQ ID NO: 4083291 - RNA, 15 nt, Variola virus
acuccuugguuucaa

SEQ ID NO: 4083292 - RNA, 18 nt, Variola virus
acucgucgacaaaguacu

SEQ ID NO: 4083293 - RNA, 12 nt, Variola virus
acucuaaaauau

SEQ ID NO: 4083294 - RNA, 23 nt, Variola virus
acucuacaaggaauugaugaagu

SEQ ID NO: 4083295 - RNA, 21 nt, Variola virus
uauucaucgucgacuaucaac

SEQ ID NO: 4083296 - RNA, 14 nt, Variola virus
uauucauucaaugu

SEQ ID NO: 4083297 - RNA, 15 nt, Variola virus
uauuccaauguuuaa

SEQ ID NO: 4083298 - RNA, 24 nt, Variola virus
uauuccaugaauaagugcgaugau

SEQ ID NO: 4083299 - RNA, 20 nt, Variola virus
uauuccgacaaaggauugau

SEQ ID NO: 4083300 - RNA, 23 nt, Variola virus
uauuccgcucaucacuaaucaua

SEQ ID NO: 4083301 - RNA, 16 nt, Variola virus
uauuccuguuaucauc

SEQ ID NO: 4083302 - RNA, 13 nt, Variola virus
uauuccuuucauu

SEQ ID NO: 4083303 - RNA, 19 nt, Variola virus
uauucgagaugaacauuca

SEQ ID NO: 4083304 - RNA, 22 nt, Variola virus
uauucuaucccccguauuuaca

SEQ ID NO: 4083305 - RNA, 14 nt, Variola virus
uauucuauuucgaa

SEQ ID NO: 4083306 - RNA, 23 nt, Variola virus
uauucucuggagaaaagauauca

SEQ ID NO: 4083307 - RNA, 11 nt, Variola virus
uauucucuuuc

SEQ ID NO: 4083308 - RNA, 12 nt, Variola virus
uauucuucauaa

SEQ ID NO: 4083309 - RNA, 17 nt, Variola virus
uauucuuuauuaucaga

SEQ ID NO: 4083310 - RNA, 17 nt, Variola virus
uauugaaauuaaucaua

SEQ ID NO: 4083311 - RNA, 20 nt, Variola virus
uauugauaaagaucuaaaaa

SEQ ID NO: 4083312 - RNA, 21 nt, Variola virus
uauugccacguaccuuuaaaa

SEQ ID NO: 4083313 - RNA, 20 nt, Variola virus
uauuggaaaggcguuaucua

SEQ ID NO: 4083314 - RNA, 21 nt, Variola virus
uauuggauucguguaaucaua

SEQ ID NO: 4083315 - RNA, 14 nt, Variola virus
uauuguuacacaac

SEQ ID NO: 4083316 - RNA, 13 nt, Variola virus
uauuguuaucgua

SEQ ID NO: 4083317 - RNA, 21 nt, Variola virus
uauuguuuggguaaaacagau

SEQ ID NO: 4083318 - RNA, 14 nt, Variola virus
uauuguuuuauaua

SEQ ID NO: 4083319 - RNA, 15 nt, Variola virus
uauuuaacaauuugg

SEQ ID NO: 4083320 - RNA, 23 nt, Variola virus
uauuuacacacauaauccauucu

SEQ ID NO: 4083321 - RNA, 13 nt, Variola virus
uauuuauacuacu

SEQ ID NO: 4083322 - RNA, 18 nt, Variola virus
uauuuaucaauucuucua

SEQ ID NO: 4083323 - RNA, 14 nt, Variola virus
uauuuaucuaacau

SEQ ID NO: 4083324 - RNA, 17 nt, Variola virus
uauuucaggaacaggau

SEQ ID NO: 4083325 - RNA, 19 nt, Variola virus
uauuuccaguuuuauuaua

SEQ ID NO: 4083326 - RNA, 18 nt, Variola virus
uauuucguuucuuaaaua

SEQ ID NO: 4083327 - RNA, 14 nt, Variola virus
uauuucuaauaaca

SEQ ID NO: 4083328 - RNA, 17 nt, Variola virus
uauuucuauuucuacua

SEQ ID NO: 4083329 - RNA, 18 nt, Variola virus
uauuuggcuagucaagau

SEQ ID NO: 4083330 - RNA, 16 nt, Variola virus
uauuuguauuuaucua

SEQ ID NO: 4083331 - RNA, 21 nt, Variola virus
uauuuuaggaucauauuuaca

SEQ ID NO: 4083332 - RNA, 21 nt, Variola virus
uauuuucgaaacucguaaaaa

SEQ ID NO: 4083333 - RNA, 20 nt, Variola virus
uauuuucuggaaguggauau

SEQ ID NO: 4083334 - RNA, 21 nt, Variola virus
uauuuugcuacaccuguugaa

SEQ ID NO: 4083335 - RNA, 23 nt, Variola virus
uauuuuuaauagcugcucuuugu

SEQ ID NO: 4083336 - RNA, 14 nt, Variola virus
uauuuuucuaugau

SEQ ID NO: 4083337 - RNA, 21 nt, Variola virus
uauuuuugacgaugucaagau

SEQ ID NO: 4083338 - RNA, 15 nt, Variola virus
uauuuuuuuuaucaa

SEQ ID NO: 4083339 - RNA, 18 nt, Variola virus
ucaaaaaaagauuauucg

SEQ ID NO: 4083340 - RNA, 21 nt, Variola virus
ucaaaaaacaauuuauucaga

SEQ ID NO: 4083341 - RNA, 23 nt, Variola virus
ucaaaaagggugcgguacuacag

SEQ ID NO: 4083342 - RNA, 23 nt, Variola virus
ucaaaaaugucgaugaaauaucu

SEQ ID NO: 4083343 - RNA, 18 nt, Variola virus
ucaaaaguuaauuucuau

SEQ ID NO: 4083344 - RNA, 16 nt, Variola virus
ucaaaaucaucauuau

SEQ ID NO: 4083345 - RNA, 19 nt, Variola virus
ucaaacaucugcauuauca

SEQ ID NO: 4083346 - RNA, 16 nt, Variola virus
ucaaacgaauaaacaa

SEQ ID NO: 4083347 - RNA, 19 nt, Variola virus
ucaaagggaccuaaaucua

SEQ ID NO: 4083348 - RNA, 17 nt, Variola virus
ucaaaguauuugguauu

SEQ ID NO: 4083349 - RNA, 17 nt, Variola virus
ucaaagucacaaagcaa

SEQ ID NO: 4083350 - RNA, 19 nt, Variola virus
ucaaauagauguucaucau

SEQ ID NO: 4083351 - RNA, 21 nt, Variola virus
ucaaauccaugaauaaaguau

SEQ ID NO: 4083352 - RNA, 21 nt, Variola virus
ucaaaugccuuccaaaguuua

SEQ ID NO: 4083353 - RNA, 15 nt, Variola virus
ucaaauuagauuucg

SEQ ID NO: 4083354 - RNA, 21 nt, Variola virus
ucaacaaucguuaauaaaucu

SEQ ID NO: 4083355 - RNA, 15 nt, Variola virus
ucaacaccauuauua

SEQ ID NO: 4083356 - RNA, 19 nt, Variola virus
ucaacacuacccaauaaau

SEQ ID NO: 4083357 - RNA, 19 nt, Variola virus
ucaacacuacuauuauuga

SEQ ID NO: 4083358 - RNA, 21 nt, Variola virus
ucaacauaaugucauaguuga

SEQ ID NO: 4083359 - RNA, 22 nt, Variola virus
ucaacgcuggaaucaauacuca

SEQ ID NO: 4083360 - RNA, 22 nt, Variola virus
ucaagaacuacaaaaguuuucu

SEQ ID NO: 4083361 - RNA, 20 nt, Variola virus
ucaagaaggaaaucaaaucu

SEQ ID NO: 4083362 - RNA, 17 nt, Variola virus
ucaagccggcuauauau

SEQ ID NO: 4083363 - RNA, 20 nt, Variola virus
ucaagccggcuauauauucu

SEQ ID NO: 4083364 - RNA, 23 nt, Variola virus
ucaagccggcuauauauucugcu

SEQ ID NO: 4083365 - RNA, 15 nt, Variola virus
ucaagucaaagaaau

SEQ ID NO: 4083366 - RNA, 15 nt, Variola virus
ucaaguucuccgcgu

SEQ ID NO: 4083367 - RNA, 15 nt, Variola virus
ucaauaaaugauuca

SEQ ID NO: 4083368 - RNA, 14 nt, Variola virus
ucaauaacuacaca

SEQ ID NO: 4083369 - RNA, 22 nt, Variola virus
ucaauagaauaaaccauuuugu

SEQ ID NO: 4083370 - RNA, 18 nt, Variola virus
ucaauagcaaucaugaaa

SEQ ID NO: 4083371 - RNA, 21 nt, Variola virus
ucaauauacuauucuugugau

SEQ ID NO: 4083372 - RNA, 14 nt, Variola virus
ucaaucauguacua

SEQ ID NO: 4083373 - RNA, 20 nt, Variola virus
ucaaucggauacagacacuc

SEQ ID NO: 4083374 - RNA, 22 nt, Variola virus
ucaaucguuuaaaguaaacuuc

SEQ ID NO: 4083375 - RNA, 21 nt, Variola virus
ucaaugaguuuaauaacuuga

SEQ ID NO: 4083376 - RNA, 23 nt, Variola virus
ucaauguccugcuauacuucggc

SEQ ID NO: 4083377 - RNA, 22 nt, Variola virus
ucaaugucuuaauaagaagugu

SEQ ID NO: 4083378 - RNA, 16 nt, Variola virus
ucaauucgagaaagau

SEQ ID NO: 4083379 - RNA, 21 nt, Variola virus
ucaauuucccaaauaacacca

SEQ ID NO: 4083380 - RNA, 22 nt, Variola virus
ucacaaagauggcugaaauuag

SEQ ID NO: 4083381 - RNA, 15 nt, Variola virus
ucacaaauacuacaa

SEQ ID NO: 4083382 - RNA, 20 nt, Variola virus
ucacaacaauuuauuucuaa

SEQ ID NO: 4083383 - RNA, 17 nt, Variola virus
ucacaaguaugaagaaa

SEQ ID NO: 4083384 - RNA, 15 nt, Variola virus
ucacaccuccauuaa

SEQ ID NO: 4083385 - RNA, 18 nt, Variola virus
ucacacuacugaaaaaag

SEQ ID NO: 4083386 - RNA, 14 nt, Variola virus
ucacagucuguuuu

SEQ ID NO: 4083387 - RNA, 17 nt, Variola virus
ucacauaucgcuacaaa

SEQ ID NO: 4083388 - RNA, 21 nt, Variola virus
ucaccaauaaaaauaaacuag

SEQ ID NO: 4083389 - RNA, 17 nt, Variola virus
ucaccauggacauaaag

SEQ ID NO: 4083390 - RNA, 18 nt, Variola virus
ucaccugccauaaauaaa

SEQ ID NO: 4083391 - RNA, 15 nt, Variola virus
ucacuauagaaaaug

SEQ ID NO: 4083392 - RNA, 19 nt, Variola virus
ucacuauguguaagaagau

SEQ ID NO: 4083393 - RNA, 23 nt, Variola virus
ucacuuauagauagauaguacau

SEQ ID NO: 4083394 - RNA, 14 nt, Variola virus
ucacuucaauaaau

SEQ ID NO: 4083395 - RNA, 12 nt, Variola virus
ucacuucagaaa

SEQ ID NO: 4083396 - RNA, 21 nt, Variola virus
ucacuucucuucauuacuacu

SEQ ID NO: 4083397 - RNA, 18 nt, Variola virus
ucagaaaauaccauccaa

SEQ ID NO: 4083398 - RNA, 17 nt, Variola virus
ucagaaauacgguuuuu

SEQ ID NO: 4083399 - RNA, 23 nt, Variola virus
ucagaaauuacaaacacuacaac

SEQ ID NO: 4083400 - RNA, 17 nt, Variola virus
ucagaacuaucauagau

SEQ ID NO: 4083401 - RNA, 21 nt, Variola virus
ucagaauauucuuuucuaaga

SEQ ID NO: 4083402 - RNA, 16 nt, Variola virus
ucagaaucacauagau

SEQ ID NO: 4083403 - RNA, 22 nt, Variola virus
ucagaauuuucauggauguaga

SEQ ID NO: 4083404 - RNA, 14 nt, Variola virus
ucagacaaccaucu

SEQ ID NO: 4083405 - RNA, 23 nt, Variola virus
ucagauaacauguuaauuuccga

SEQ ID NO: 4083406 - RNA, 21 nt, Variola virus
ucagccgcuacagaaacauau

SEQ ID NO: 4083407 - RNA, 22 nt, Variola virus
ucagcugcuuuagaugauuuug

SEQ ID NO: 4083408 - RNA, 21 nt, Variola virus
ucaggaacauaaacaaauucu

SEQ ID NO: 4083409 - RNA, 20 nt, Variola virus
ucaggaauccaaagagcuau

SEQ ID NO: 4083410 - RNA, 22 nt, Variola virus
ucagguucaucgaucucuauaa

SEQ ID NO: 4083411 - RNA, 16 nt, Variola virus
ucaguaacuauguuca

SEQ ID NO: 4083412 - RNA, 21 nt, Variola virus
ucagugcaaagauuacuacac

SEQ ID NO: 4083413 - RNA, 18 nt, Variola virus
ucaguguagauaguaaau

SEQ ID NO: 4083414 - RNA, 20 nt, Variola virus
ucaguguccaucauuucauu

SEQ ID NO: 4083415 - RNA, 12 nt, Variola virus
ucaguuaucauc

SEQ ID NO: 4083416 - RNA, 13 nt, Variola virus
ucauaaaaaccau

SEQ ID NO: 4083417 - RNA, 18 nt, Variola virus
ucauaaaaucgucacaau

SEQ ID NO: 4083418 - RNA, 13 nt, Variola virus
ucauaaagaacag

SEQ ID NO: 4083419 - RNA, 20 nt, Variola virus
ucuaaugaugaacacaaaug

SEQ ID NO: 4083420 - RNA, 20 nt, Variola virus
ucuaauugugacauuauguu

SEQ ID NO: 4083421 - RNA, 22 nt, Variola virus
ucuacaaauagagauaaaacaa

SEQ ID NO: 4083422 - RNA, 20 nt, Variola virus
ucuacaguaauguccaaauc

SEQ ID NO: 4083423 - RNA, 21 nt, Variola virus
ucuacauaugguggauuagua

SEQ ID NO: 4083424 - RNA, 22 nt, Variola virus
ucuaccgcggagccgaaaauau

SEQ ID NO: 4083425 - RNA, 17 nt, Variola virus
ucuacuaaucucuguaa

SEQ ID NO: 4083426 - RNA, 12 nt, Variola virus
ucuagaaugaag

SEQ ID NO: 4083427 - RNA, 22 nt, Variola virus
ucuagacuccgcaucaacacca

SEQ ID NO: 4083428 - RNA, 15 nt, Variola virus
ucuagauagaaguau

SEQ ID NO: 4083429 - RNA, 14 nt, Variola virus
ucuagauguagaag

SEQ ID NO: 4083430 - RNA, 20 nt, Variola virus
ucuagauucgagaucucuaa

SEQ ID NO: 4083431 - RNA, 16 nt, Variola virus
ucuagcuuucacuuaa

SEQ ID NO: 4083432 - RNA, 22 nt, Variola virus
ucuaggcgguggauauuucuga

SEQ ID NO: 4083433 - RNA, 23 nt, Variola virus
ucuaggcgguggauauuucugaa

SEQ ID NO: 4083434 - RNA, 18 nt, Variola virus
ucuauaaaaaauaaguau

SEQ ID NO: 4083435 - RNA, 15 nt, Variola virus
ucuauaauagauggu

SEQ ID NO: 4083436 - RNA, 14 nt, Variola virus
ucuauagucagaau

SEQ ID NO: 4083437 - RNA, 19 nt, Variola virus
ucuauaucuagaaauaagu

SEQ ID NO: 4083438 - RNA, 19 nt, Variola virus
ucuauaugugagagaauau

SEQ ID NO: 4083439 - RNA, 13 nt, Variola virus
ucuaucaauaacu

SEQ ID NO: 4083440 - RNA, 22 nt, Variola virus
ucuaucccccguauuuacauua

SEQ ID NO: 4083441 - RNA, 16 nt, Variola virus
ucuaucuuuagaguau

SEQ ID NO: 4083442 - RNA, 18 nt, Variola virus
ucuaucuuuaguaguguu

SEQ ID NO: 4083443 - RNA, 16 nt, Variola virus
ucuaugaauaugauuu

SEQ ID NO: 4083444 - RNA, 19 nt, Variola virus
ucuauguuaauauguauau

SEQ ID NO: 4083445 - RNA, 19 nt, Variola virus
ucuauuaauuauagaugua

SEQ ID NO: 4083446 - RNA, 15 nt, Variola virus
ucuauuagaugugua

SEQ ID NO: 4083447 - RNA, 16 nt, Variola virus
ucuauuauugaugcaa

SEQ ID NO: 4083448 - RNA, 17 nt, Variola virus
ucuauuguuuguuuuaa

SEQ ID NO: 4083449 - RNA, 11 nt, Variola virus
ucuauuucuau

SEQ ID NO: 4083450 - RNA, 12 nt, Variola virus
ucuauuugcuaa

SEQ ID NO: 4083451 - RNA, 19 nt, Variola virus
ucuauuugucaauauguca

SEQ ID NO: 4083452 - RNA, 21 nt, Variola virus
ucucaaaugaauaaguuuauu

SEQ ID NO: 4083453 - RNA, 14 nt, Variola virus
ucucaaguuacauu

SEQ ID NO: 4083454 - RNA, 18 nt, Variola virus
ucucagaaucaaauauag

SEQ ID NO: 4083455 - RNA, 14 nt, Variola virus
ucucagguacagau

SEQ ID NO: 4083456 - RNA, 17 nt, Variola virus
ucucagguacagauuuu

SEQ ID NO: 4083457 - RNA, 14 nt, Variola virus
ucucauaaauacag

SEQ ID NO: 4083458 - RNA, 24 nt, Variola virus
ucucauaauguaaagauauucuaa

SEQ ID NO: 4083459 - RNA, 14 nt, Variola virus
ucucauguucuuaa

SEQ ID NO: 4083460 - RNA, 16 nt, Variola virus
ucuccaauauaugaua

SEQ ID NO: 4083461 - RNA, 14 nt, Variola virus
ucuccagaaaucug

SEQ ID NO: 4083462 - RNA, 16 nt, Variola virus
ucucccaauaccuguc

SEQ ID NO: 4083463 - RNA, 19 nt, Variola virus
ucuccggccacuauuauug

SEQ ID NO: 4083464 - RNA, 15 nt, Variola virus
ucucgaugaaaauaa

SEQ ID NO: 4083465 - RNA, 12 nt, Variola virus
ucucgauuucua

SEQ ID NO: 4083466 - RNA, 14 nt, Variola virus
ucucuaucaaugau

SEQ ID NO: 4083467 - RNA, 16 nt, Variola virus
ucucucaauacagauu

SEQ ID NO: 4083468 - RNA, 17 nt, Variola virus
ucucucagguacagauu

SEQ ID NO: 4083469 - RNA, 15 nt, Variola virus
ucucugguuugcuac

SEQ ID NO: 4083470 - RNA, 22 nt, Variola virus
ucucuguaauaguuuccaccaa

SEQ ID NO: 4083471 - RNA, 14 nt, Variola virus
ucugaaaauguaua

SEQ ID NO: 4083472 - RNA, 23 nt, Variola virus
ucugaaauaacguauuuaaacaa

SEQ ID NO: 4083473 - RNA, 15 nt, Variola virus
ucugaaauaaucaug

SEQ ID NO: 4083474 - RNA, 12 nt, Variola virus
ucugaauuauug

SEQ ID NO: 4083475 - RNA, 19 nt, Variola virus
ucugccuuuuuauacauau

SEQ ID NO: 4083476 - RNA, 22 nt, Variola virus
ucuggauauguuuuuaauaaag

SEQ ID NO: 4083477 - RNA, 14 nt, Variola virus
ucugguuuaggaaa

SEQ ID NO: 4083478 - RNA, 19 nt, Variola virus
ucuguaauaguuuccacca

SEQ ID NO: 4083479 - RNA, 16 nt, Variola virus
ucuguacaaauuauug

SEQ ID NO: 4083480 - RNA, 20 nt, Variola virus
ucuguugguuuucuuauaua

SEQ ID NO: 4083481 - RNA, 18 nt, Variola virus
ucuuaacaaguucucaau

SEQ ID NO: 4083482 - RNA, 12 nt, Variola virus
ucuuacaauguu

SEQ ID NO: 4083483 - RNA, 17 nt, Variola virus
ucuuacuuuguucuauu

SEQ ID NO: 4083484 - RNA, 18 nt, Variola virus
ucuuauauagauuucgaa

SEQ ID NO: 4083485 - RNA, 14 nt, Variola virus
ucuuaucaauaaca

SEQ ID NO: 4083486 - RNA, 13 nt, Variola virus
ucuuauucuuaaa

SEQ ID NO: 4083487 - RNA, 17 nt, Variola virus
ucuucaaaugaaguagg

SEQ ID NO: 4083488 - RNA, 14 nt, Variola virus
ucuucaacacaaag

SEQ ID NO: 4083489 - RNA, 13 nt, Variola virus
ucuucauuaauaa

SEQ ID NO: 4083490 - RNA, 17 nt, Variola virus
ucuuccaauaaaugucc

SEQ ID NO: 4083491 - RNA, 16 nt, Variola virus
ucuuccauuuaaauau

SEQ ID NO: 4083492 - RNA, 20 nt, Variola virus
ucuucccaaaauguuagaga

SEQ ID NO: 4083493 - RNA, 22 nt, Variola virus
ucuucgcccucaauuucccaaa

SEQ ID NO: 4083494 - RNA, 23 nt, Variola virus
ucuucguaaaaagauucuugaaa

SEQ ID NO: 4083495 - RNA, 14 nt, Variola virus
ucuucuacauuauu

SEQ ID NO: 4083496 - RNA, 13 nt, Variola virus
ucuucuauuucua

SEQ ID NO: 4083497 - RNA, 13 nt, Variola virus
ucuucucaaaaga

SEQ ID NO: 4083498 - RNA, 22 nt, Variola virus
ucuucucgcuaguuuacuaugu

SEQ ID NO: 4083499 - RNA, 19 nt, Variola virus
ucuucucuaagagcuacgu

SEQ ID NO: 4083500 - RNA, 14 nt, Variola virus
ucuucuucuacauu

SEQ ID NO: 4083501 - RNA, 16 nt, Variola virus
ucuuggauuucauaua

SEQ ID NO: 4083502 - RNA, 17 nt, Variola virus
ucuugugcuguuauaua

SEQ ID NO: 4083503 - RNA, 22 nt, Variola virus
ucuuuaaguuuuccguuagaaa

SEQ ID NO: 4083504 - RNA, 22 nt, Variola virus
ucuuuacuagagagaaagcuuu

SEQ ID NO: 4083505 - RNA, 17 nt, Variola virus
ucuuuagcuucugaaau

SEQ ID NO: 4083506 - RNA, 20 nt, Variola virus
ucuuugaugguguuagcaua

SEQ ID NO: 4083507 - RNA, 14 nt, Variola virus
ucuuuguuauuaua

SEQ ID NO: 4083508 - RNA, 22 nt, Variola virus
ucuuuuaaaucccaauucagaa

SEQ ID NO: 4083509 - RNA, 23 nt, Variola virus
ugaaaacagaaacaucuuauuca

SEQ ID NO: 4083510 - RNA, 12 nt, Variola virus
ugaaaauuggag

SEQ ID NO: 4083511 - RNA, 12 nt, Variola virus
ugaaacaaagaa

SEQ ID NO: 4083512 - RNA, 13 nt, Variola virus
ugaaauaacucuu

SEQ ID NO: 4083513 - RNA, 13 nt, Variola virus
ugaacaauugucu

SEQ ID NO: 4083514 - RNA, 17 nt, Variola virus
ugaacacacaacgcauc

SEQ ID NO: 4083515 - RNA, 21 nt, Variola virus
ugaacagacauuguauuauga

SEQ ID NO: 4083516 - RNA, 17 nt, Variola virus
ugaacauaguaagaaau

SEQ ID NO: 4083517 - RNA, 14 nt, Variola virus
ugaaccaaacauuc

SEQ ID NO: 4083518 - RNA, 23 nt, Variola virus
ugaacccguuaauguauaucuuu

SEQ ID NO: 4083519 - RNA, 22 nt, Variola virus
ugaaccguauuacucuacagua

SEQ ID NO: 4083520 - RNA, 23 nt, Variola virus
ugaacgguaucuucuugauuucu

SEQ ID NO: 4083521 - RNA, 20 nt, Variola virus
ugaacuauuucuugaaugag

SEQ ID NO: 4083522 - RNA, 21 nt, Variola virus
ugaagaagagguaagauaucu

SEQ ID NO: 4083523 - RNA, 22 nt, Variola virus
ugaagaagugucuauaaaugua

SEQ ID NO: 4083524 - RNA, 20 nt, Variola virus
ugaagaauuuauauaaauua

SEQ ID NO: 4083525 - RNA, 15 nt, Variola virus
ugaagauaaugugaa

SEQ ID NO: 4083526 - RNA, 18 nt, Variola virus
ugaagauguagcauucca

SEQ ID NO: 4083527 - RNA, 21 nt, Variola virus
ugaagauucccaaauaaucau

SEQ ID NO: 4083528 - RNA, 20 nt, Variola virus
ugaagcauuggaagcaacua

SEQ ID NO: 4083529 - RNA, 16 nt, Variola virus
ugaagccauugaaaac

SEQ ID NO: 4083530 - RNA, 14 nt, Variola virus
ugaauacauuauca

SEQ ID NO: 4083531 - RNA, 20 nt, Variola virus
ugaauaccauacaauuuaug

SEQ ID NO: 4083532 - RNA, 17 nt, Variola virus
ugaauaccauuaaacaa

SEQ ID NO: 4083533 - RNA, 22 nt, Variola virus
ugaauauagaacaucauuucca

SEQ ID NO: 4083534 - RNA, 20 nt, Variola virus
ugaauaucuacaaauuggag

SEQ ID NO: 4083535 - RNA, 14 nt, Variola virus
ugaauauuaaacac

SEQ ID NO: 4083536 - RNA, 22 nt, Variola virus
ugaaucaaauguaacuauucaa

SEQ ID NO: 4083537 - RNA, 14 nt, Variola virus
ugaaugaauacaga

SEQ ID NO: 4083538 - RNA, 20 nt, Variola virus
ugaaugcugaugaacagguu

SEQ ID NO: 4083539 - RNA, 15 nt, Variola virus
ugaauggauuuauca

SEQ ID NO: 4083540 - RNA, 17 nt, Variola virus
ugaauguucucaagaac

SEQ ID NO: 4083541 - RNA, 14 nt, Variola virus
ugaauuguuucuuu

SEQ ID NO: 4083542 - RNA, 15 nt, Variola virus
ugaauuuaccagaua

SEQ ID NO: 4083543 - RNA, 14 nt, Variola virus
ugacaaaaauugug

SEQ ID NO: 4083544 - RNA, 13 nt, Variola virus
ugacaaauuauuc

SEQ ID NO: 4083545 - RNA, 19 nt, Variola virus
cacaugaagaaaaacaccu

SEQ ID NO: 4083546 - RNA, 13 nt, Variola virus
cacaugaaugaaa

SEQ ID NO: 4083547 - RNA, 18 nt, Variola virus
cacauuguauauaguuua

SEQ ID NO: 4083548 - RNA, 20 nt, Variola virus
cacauuucagcaaucuaaca

SEQ ID NO: 4083549 - RNA, 13 nt, Variola virus
caccaaacauauu

SEQ ID NO: 4083550 - RNA, 19 nt, Variola virus
caccauauagaucaaucau

SEQ ID NO: 4083551 - RNA, 23 nt, Variola virus
cacggauccguaucuccaacaag

SEQ ID NO: 4083552 - RNA, 21 nt, Variola virus
cacguaaccauucuaaacaau

SEQ ID NO: 4083553 - RNA, 16 nt, Variola virus
cacguugucuuucaag

SEQ ID NO: 4083554 - RNA, 14 nt, Variola virus
cacguuuaaacauu

SEQ ID NO: 4083555 - RNA, 13 nt, Variola virus
cacuaauaucaau

SEQ ID NO: 4083556 - RNA, 14 nt, Variola virus
cacuagaaaccacg

SEQ ID NO: 4083557 - RNA, 13 nt, Variola virus
cacuaucauaauu

SEQ ID NO: 4083558 - RNA, 14 nt, Variola virus
cacuauucauguaa

SEQ ID NO: 4083559 - RNA, 17 nt, Variola virus
cacucucccuauaucuu

SEQ ID NO: 4083560 - RNA, 14 nt, Variola virus
cacugauauuauga

SEQ ID NO: 4083561 - RNA, 15 nt, Variola virus
cagaaagcuguggau

SEQ ID NO: 4083562 - RNA, 21 nt, Variola virus
cagaaauauaugagauguagu

SEQ ID NO: 4083563 - RNA, 12 nt, Variola virus
cagaaaugauuu

SEQ ID NO: 4083564 - RNA, 23 nt, Variola virus
cagaaaugauuuuggaaaaauug

SEQ ID NO: 4083565 - RNA, 21 nt, Variola virus
cagaaauugugucauugacau

SEQ ID NO: 4083566 - RNA, 21 nt, Variola virus
cagaacgaauuaugauagaaa

SEQ ID NO: 4083567 - RNA, 22 nt, Variola virus
cagaagucauacuagaauaaag

SEQ ID NO: 4083568 - RNA, 21 nt, Variola virus
cagaagugugaauaugaucuu

SEQ ID NO: 4083569 - RNA, 21 nt, Variola virus
cagaaucgcaacgcuaaaaga

SEQ ID NO: 4083570 - RNA, 22 nt, Variola virus
cagacaauaagagcagcacaaa

SEQ ID NO: 4083571 - RNA, 22 nt, Variola virus
cagacacugucacauacacuag

SEQ ID NO: 4083572 - RNA, 14 nt, Variola virus
cagaggaaacuaau

SEQ ID NO: 4083573 - RNA, 13 nt, Variola virus
cagauacauacua

SEQ ID NO: 4083574 - RNA, 21 nt, Variola virus
cagauauagggauagaaguag

SEQ ID NO: 4083575 - RNA, 13 nt, Variola virus
cagaugucauuau

SEQ ID NO: 4083576 - RNA, 21 nt, Variola virus
cagauuagaugacaugacauu

SEQ ID NO: 4083577 - RNA, 21 nt, Variola virus
cagauuagcagaauagauauu

SEQ ID NO: 4083578 - RNA, 18 nt, Variola virus
cagauuuugauauucuau

SEQ ID NO: 4083579 - RNA, 20 nt, Variola virus
cagcaacuucuguacuagug

SEQ ID NO: 4083580 - RNA, 19 nt, Variola virus
cagcaggaauaccaacaaa

SEQ ID NO: 4083581 - RNA, 15 nt, Variola virus
cagcauaaacacaaa

SEQ ID NO: 4083582 - RNA, 14 nt, Variola virus
cagcauuaacugau

SEQ ID NO: 4083583 - RNA, 22 nt, Variola virus
cagcauuugacuauuauguuua

SEQ ID NO: 4083584 - RNA, 21 nt, Variola virus
cagcuacuugagauaccaaag

SEQ ID NO: 4083585 - RNA, 22 nt, Variola virus
caggaaacgcuguauauggaaa

SEQ ID NO: 4083586 - RNA, 22 nt, Variola virus
caggaagauuagucagaccauu

SEQ ID NO: 4083587 - RNA, 16 nt, Variola virus
caggaauaugacuauu

SEQ ID NO: 4083588 - RNA, 21 nt, Variola virus
caggauuccuauucauuuuga

SEQ ID NO: 4083589 - RNA, 16 nt, Variola virus
cagguaggcaguuuua

SEQ ID NO: 4083590 - RNA, 17 nt, Variola virus
caguacaucuaucacag

SEQ ID NO: 4083591 - RNA, 16 nt, Variola virus
caguacuaauuuccaa

SEQ ID NO: 4083592 - RNA, 15 nt, Variola virus
caguacuuauacaau

SEQ ID NO: 4083593 - RNA, 14 nt, Variola virus
caguauccuuuuug

SEQ ID NO: 4083594 - RNA, 20 nt, Variola virus
caguauugacaauacuguau

SEQ ID NO: 4083595 - RNA, 15 nt, Variola virus
caguauuuuuggaau

SEQ ID NO: 4083596 - RNA, 23 nt, Variola virus
cagucauuccaucauuuaagaag

SEQ ID NO: 4083597 - RNA, 15 nt, Variola virus
cagucgaaacauauu

SEQ ID NO: 4083598 - RNA, 16 nt, Variola virus
cagucuaauauccauu

SEQ ID NO: 4083599 - RNA, 23 nt, Variola virus
cagucuggaaacuaucacguuua

SEQ ID NO: 4083600 - RNA, 17 nt, Variola virus
cagugacuguaucacac

SEQ ID NO: 4083601 - RNA, 22 nt, Variola virus
caguggaucgguucagcauuua

SEQ ID NO: 4083602 - RNA, 19 nt, Variola virus
caguuaagucaauaauauu

SEQ ID NO: 4083603 - RNA, 16 nt, Variola virus
caguucguuuaacgau

SEQ ID NO: 4083604 - RNA, 23 nt, Variola virus
caguuuuuaauuucuuugguaau

SEQ ID NO: 4083605 - RNA, 21 nt, Variola virus
cauaaaauuaucgaggauauu

SEQ ID NO: 4083606 - RNA, 12 nt, Variola virus
cauaaacaaauu

SEQ ID NO: 4083607 - RNA, 14 nt, Variola virus
cauaaacugauacg

SEQ ID NO: 4083608 - RNA, 21 nt, Variola virus
cauaaauaaaugcuugauauu

SEQ ID NO: 4083609 - RNA, 19 nt, Variola virus
cauaaauaguaaauacaau

SEQ ID NO: 4083610 - RNA, 14 nt, Variola virus
cauaacaaauguau

SEQ ID NO: 4083611 - RNA, 16 nt, Variola virus
cauaacagauaguuua

SEQ ID NO: 4083612 - RNA, 13 nt, Variola virus
cauaagcaucucc

SEQ ID NO: 4083613 - RNA, 14 nt, Variola virus
cauaaguguauaua

SEQ ID NO: 4083614 - RNA, 13 nt, Variola virus
cauaauauauaca

SEQ ID NO: 4083615 - RNA, 18 nt, Variola virus
cauaauauggauccucau

SEQ ID NO: 4083616 - RNA, 16 nt, Variola virus
cauaauauuaaacacu

SEQ ID NO: 4083617 - RNA, 21 nt, Variola virus
cauaaucgucgacaaaguacu

SEQ ID NO: 4083618 - RNA, 21 nt, Variola virus
cauacaugaaaugaucucuau

SEQ ID NO: 4083619 - RNA, 20 nt, Variola virus
cauacauguuauuaucacac

SEQ ID NO: 4083620 - RNA, 21 nt, Variola virus
cauacguaccagcuauguuua

SEQ ID NO: 4083621 - RNA, 13 nt, Variola virus
cauacuauguuuu

SEQ ID NO: 4083622 - RNA, 16 nt, Variola virus
cauacuguaccaauaa

SEQ ID NO: 4083623 - RNA, 15 nt, Variola virus
cauagaauaaauauc

SEQ ID NO: 4083624 - RNA, 15 nt, Variola virus
cauagauuuccgaag

SEQ ID NO: 4083625 - RNA, 16 nt, Variola virus
cauagcauuaauaauu

SEQ ID NO: 4083626 - RNA, 19 nt, Variola virus
cauaguggacaacauuaau

SEQ ID NO: 4083627 - RNA, 15 nt, Variola virus
cauaguugcucaaaa

SEQ ID NO: 4083628 - RNA, 13 nt, Variola virus
cauaguuggauuu

SEQ ID NO: 4083629 - RNA, 15 nt, Variola virus
cauauaaauauaauu

SEQ ID NO: 4083630 - RNA, 19 nt, Variola virus
cauauaacguaaccagaau

SEQ ID NO: 4083631 - RNA, 19 nt, Variola virus
cauauaagaaacuauaaag

SEQ ID NO: 4083632 - RNA, 16 nt, Variola virus
cauauagaucaaucau

SEQ ID NO: 4083633 - RNA, 22 nt, Variola virus
cauauaguuuggauuaauaauu

SEQ ID NO: 4083634 - RNA, 12 nt, Variola virus
cauauaucacau

SEQ ID NO: 4083635 - RNA, 17 nt, Variola virus
cauauauuagaaauaca

SEQ ID NO: 4083636 - RNA, 16 nt, Variola virus
cauaugccaacaugca

SEQ ID NO: 4083637 - RNA, 20 nt, Variola virus
cauauuaucaccuauugcca

SEQ ID NO: 4083638 - RNA, 13 nt, Variola virus
cauauucucauaa

SEQ ID NO: 4083639 - RNA, 19 nt, Variola virus
cauauuuauucuauggaug

SEQ ID NO: 4083640 - RNA, 15 nt, Variola virus
cauauuucauuucca

SEQ ID NO: 4083641 - RNA, 22 nt, Variola virus
caucaaaaauaaguaaaaagug

SEQ ID NO: 4083642 - RNA, 21 nt, Variola virus
caucauaugacauuucaugaa

SEQ ID NO: 4083643 - RNA, 15 nt, Variola virus
cauccaagucaauau

SEQ ID NO: 4083644 - RNA, 20 nt, Variola virus
cauccuuugauaauuuucca

SEQ ID NO: 4083645 - RNA, 16 nt, Variola virus
caucgaugaugcauuu

SEQ ID NO: 4083646 - RNA, 21 nt, Variola virus
caucgguacggguauucauuu

SEQ ID NO: 4083647 - RNA, 14 nt, Variola virus
caucuaacagaauu

SEQ ID NO: 4083648 - RNA, 24 nt, Variola virus
caucuaacuauaugauauccacua

SEQ ID NO: 4083649 - RNA, 14 nt, Variola virus
caucuacuuuucca

SEQ ID NO: 4083650 - RNA, 20 nt, Variola virus
caucuaguccuuuaauucca

SEQ ID NO: 4083651 - RNA, 19 nt, Variola virus
caucuauagacgaugauuu

SEQ ID NO: 4083652 - RNA, 16 nt, Variola virus
caucuaucacaguuaa

SEQ ID NO: 4083653 - RNA, 14 nt, Variola virus
caucugauuccaua

SEQ ID NO: 4083654 - RNA, 22 nt, Variola virus
caucuuuaguaaacauaucaua

SEQ ID NO: 4083655 - RNA, 20 nt, Variola virus
caucuuuugccaacacagag

SEQ ID NO: 4083656 - RNA, 16 nt, Variola virus
caugaagaaaaacacc

SEQ ID NO: 4083657 - RNA, 16 nt, Variola virus
caugaaucuaaaagaa

SEQ ID NO: 4083658 - RNA, 16 nt, Variola virus
caugauaagaauaauu

SEQ ID NO: 4083659 - RNA, 13 nt, Variola virus
caugauaguuuua

SEQ ID NO: 4083660 - RNA, 22 nt, Variola virus
caugauccuauucuaaauggau

SEQ ID NO: 4083661 - RNA, 17 nt, Variola virus
caugauuccguauucug

SEQ ID NO: 4083662 - RNA, 17 nt, Variola virus
cauggaaaaauauuaca

SEQ ID NO: 4083663 - RNA, 13 nt, Variola virus
cauggcaauaaua

SEQ ID NO: 4083664 - RNA, 17 nt, Variola virus
cauggcuucuuccauag

SEQ ID NO: 4083665 - RNA, 15 nt, Variola virus
caugggacuauauaa

SEQ ID NO: 4083666 - RNA, 12 nt, Variola virus
cauguauacaau

SEQ ID NO: 4083667 - RNA, 22 nt, Variola virus
caugucuaauguguuaaaaaaa

SEQ ID NO: 4083668 - RNA, 20 nt, Variola virus
caugugaauauaauaauaca

SEQ ID NO: 4083669 - RNA, 23 nt, Variola virus
caugugacuuuucucuaaaugau

SEQ ID NO: 4083670 - RNA, 16 nt, Variola virus
cauguugucuauuuuc

SEQ ID NO: 4083671 - RNA, 22 nt, Variola virus
cauuaaacccucgaucaugaau

SEQ ID NO: 4083672 - RNA, 18 nt, Variola virus
cauuaaaucuauuauauu

SEQ ID NO: 4083673 - RNA, 14 nt, Variola virus
cauuaaauguauuu

SEQ ID NO: 4083674 - RNA, 21 nt, Variola virus
cauuaacaucauacaucaauu

SEQ ID NO: 4083675 - RNA, 17 nt, Variola virus
cauuaacuuuaaugugu

SEQ ID NO: 4083676 - RNA, 20 nt, Variola virus
cauuaauugccauaauaauu

SEQ ID NO: 4083677 - RNA, 20 nt, Variola virus
cauuagaggauuuaucacau

SEQ ID NO: 4083678 - RNA, 17 nt, Variola virus
cauuaucauuuuguaau

SEQ ID NO: 4083679 - RNA, 11 nt, Variola virus
cauuaugaauu

SEQ ID NO: 4083680 - RNA, 18 nt, Variola virus
cauuauucuauuucgaau

SEQ ID NO: 4083681 - RNA, 11 nt, Variola virus
cauuauuggaa

SEQ ID NO: 4083682 - RNA, 20 nt, Variola virus
cauuauuuauuuaugauaua

SEQ ID NO: 4083683 - RNA, 20 nt, Variola virus
cauuccaagucacuaugugu

SEQ ID NO: 4083684 - RNA, 15 nt, Variola virus
cauuccaguauucuu

SEQ ID NO: 4083685 - RNA, 14 nt, Variola virus
cauuccaucauuua

SEQ ID NO: 4083686 - RNA, 17 nt, Variola virus
cauuccuaugaugaugu

SEQ ID NO: 4083687 - RNA, 15 nt, Variola virus
cauucgaagacgcua

SEQ ID NO: 4083688 - RNA, 17 nt, Variola virus
cauucuaauguucauaa

SEQ ID NO: 4083689 - RNA, 20 nt, Variola virus
cauucuacguccuauggaug

SEQ ID NO: 4083690 - RNA, 14 nt, Variola virus
cauucuaucucaaa

SEQ ID NO: 4083691 - RNA, 17 nt, Variola virus
cauugaugacacuagau

SEQ ID NO: 4083692 - RNA, 12 nt, Variola virus
cauuggaagcaa

SEQ ID NO: 4083693 - RNA, 14 nt, Variola virus
cauuguccuauuuc

SEQ ID NO: 4083694 - RNA, 12 nt, Variola virus
cauuuaaaguua

SEQ ID NO: 4083695 - RNA, 19 nt, Variola virus
cauuuaaaguuacaaacaa

SEQ ID NO: 4083696 - RNA, 11 nt, Variola virus
cauuuaauagg

SEQ ID NO: 4083697 - RNA, 16 nt, Variola virus
cauuuaucacaaaaaa

SEQ ID NO: 4083698 - RNA, 18 nt, Variola virus
cauuuggucuauacaaau

SEQ ID NO: 4083699 - RNA, 13 nt, Variola virus
cauuuguaauaau

SEQ ID NO: 4083700 - RNA, 17 nt, Variola virus
cauuuguauaaucuuua

SEQ ID NO: 4083701 - RNA, 18 nt, Variola virus
cauuuuaggauaugcuuu

SEQ ID NO: 4083702 - RNA, 19 nt, Variola virus
cauuuuauaaauauauaau

SEQ ID NO: 4083703 - RNA, 16 nt, Variola virus
cauuuuauuguggaau

SEQ ID NO: 4083704 - RNA, 15 nt, Variola virus
cauuuucuaucuuua

SEQ ID NO: 4083705 - RNA, 13 nt, Variola virus
cauuuucuucaac

SEQ ID NO: 4083706 - RNA, 17 nt, Variola virus
cauuuuuuaaguauuug

SEQ ID NO: 4083707 - RNA, 12 nt, Variola virus
ccaaaagacuau

SEQ ID NO: 4083708 - RNA, 17 nt, Variola virus
ccaaacauuaacagauu

SEQ ID NO: 4083709 - RNA, 17 nt, Variola virus
ccaaaucaaaacaaaau

SEQ ID NO: 4083710 - RNA, 19 nt, Variola virus
ccaaaucuaguuguggaaa

SEQ ID NO: 4083711 - RNA, 14 nt, Variola virus
ccaaauguuggaaa

SEQ ID NO: 4083712 - RNA, 13 nt, Variola virus
ccaaauuaaugag

SEQ ID NO: 4083713 - RNA, 14 nt, Variola virus
ccaaauuuaaauac

SEQ ID NO: 4083714 - RNA, 18 nt, Variola virus
ccaaauuuguuuuguuua

SEQ ID NO: 4083715 - RNA, 14 nt, Variola virus
ccaacaaacauauu

SEQ ID NO: 4083716 - RNA, 18 nt, Variola virus
ccaacauguauauuugga

SEQ ID NO: 4083717 - RNA, 17 nt, Variola virus
ccaacguaauaaugaag

SEQ ID NO: 4083718 - RNA, 21 nt, Variola virus
ccaacuguagacguaguucua

SEQ ID NO: 4083719 - RNA, 21 nt, Variola virus
ccaagaaaucguauauaacua

SEQ ID NO: 4083720 - RNA, 20 nt, Variola virus
ccaaggacagaaaaauguua

SEQ ID NO: 4083721 - RNA, 18 nt, Variola virus
ccaaguaaugaucaucua

SEQ ID NO: 4083722 - RNA, 16 nt, Variola virus
ccaagugcuuaaauau

SEQ ID NO: 4083723 - RNA, 14 nt, Variola virus
ccaaguuauugcuu

SEQ ID NO: 4083724 - RNA, 23 nt, Variola virus
ccaauaacggaaaucccaaaugu

SEQ ID NO: 4083725 - RNA, 16 nt, Variola virus
ccaauauggcaauuau

SEQ ID NO: 4083726 - RNA, 16 nt, Variola virus
ccaauuauuugaacaa

SEQ ID NO: 4083727 - RNA, 19 nt, Variola virus
ccacagauaauauuagaca

SEQ ID NO: 4083728 - RNA, 18 nt, Variola virus
ccacaugccgccacuacc

SEQ ID NO: 4083729 - RNA, 18 nt, Variola virus
ccaccuccgucaucaucu

SEQ ID NO: 4083730 - RNA, 19 nt, Variola virus
ccaccuccgucaucaucuc

SEQ ID NO: 4083731 - RNA, 16 nt, Variola virus
ccacuuugguaaaauc

SEQ ID NO: 4083732 - RNA, 15 nt, Variola virus
ccagaacuauuuuua

SEQ ID NO: 4083733 - RNA, 17 nt, Variola virus
ccagaauacuauuuggu

SEQ ID NO: 4083734 - RNA, 19 nt, Variola virus
ccagaguguucgaaugcca

SEQ ID NO: 4083735 - RNA, 16 nt, Variola virus
ccagauagaaaauauc

SEQ ID NO: 4083736 - RNA, 15 nt, Variola virus
ccagauauauaucuu

SEQ ID NO: 4083737 - RNA, 20 nt, Variola virus
ccagggaaaucaaagaagaa

SEQ ID NO: 4083738 - RNA, 20 nt, Variola virus
ccagucaugaaucaauuagu

SEQ ID NO: 4083739 - RNA, 20 nt, Variola virus
ccagucugaacaucaaucuu

SEQ ID NO: 4083740 - RNA, 20 nt, Variola virus
ccagugcuauaucucccugu

SEQ ID NO: 4083741 - RNA, 21 nt, Variola virus
ccauaaaacaaaaucuaacag

SEQ ID NO: 4083742 - RNA, 15 nt, Variola virus
ccauaaacuauuuua

SEQ ID NO: 4083743 - RNA, 17 nt, Variola virus
ccauaacauaauuuucu

SEQ ID NO: 4083744 - RNA, 17 nt, Variola virus
ccauauaucuguaucau

SEQ ID NO: 4083745 - RNA, 13 nt, Variola virus
ccauauauguuuu

SEQ ID NO: 4083746 - RNA, 22 nt, Variola virus
ccaucaaaagcauuaauacagu

SEQ ID NO: 4083747 - RNA, 19 nt, Variola virus
ccaucguguuaaauuuucu

SEQ ID NO: 4083748 - RNA, 17 nt, Variola virus
ccaucucuauguuucag

SEQ ID NO: 4083749 - RNA, 15 nt, Variola virus
ccaugaaagaaagaa

SEQ ID NO: 4083750 - RNA, 23 nt, Variola virus
ccaugagauuguagaagcuuugg

SEQ ID NO: 4083751 - RNA, 14 nt, Variola virus
ccaugguaaacucu

SEQ ID NO: 4083752 - RNA, 21 nt, Variola virus
ccaugucaaaacuuguucaau

SEQ ID NO: 4083753 - RNA, 16 nt, Variola virus
ccauuaaagaauucuu

SEQ ID NO: 4083754 - RNA, 17 nt, Variola virus
ccauuauuagaaauuua

SEQ ID NO: 4083755 - RNA, 14 nt, Variola virus
ccauugaaaacuau

SEQ ID NO: 4083756 - RNA, 16 nt, Variola virus
ccauuggcaaaguauc

SEQ ID NO: 4083757 - RNA, 17 nt, Variola virus
ccauuucaacaguuucu

SEQ ID NO: 4083758 - RNA, 19 nt, Variola virus
ccauuuuuaugaucgucuu

SEQ ID NO: 4083759 - RNA, 23 nt, Variola virus
cccagauguucuauaaacuuggc

SEQ ID NO: 4083760 - RNA, 17 nt, Variola virus
cccgcuucuauuuacuc

SEQ ID NO: 4083761 - RNA, 18 nt, Variola virus
cccguaguuuuaacugga

SEQ ID NO: 4083762 - RNA, 15 nt, Variola virus
ccgaaaauauugugu

SEQ ID NO: 4083763 - RNA, 23 nt, Variola virus
ccggcauuauagauguguauaca

SEQ ID NO: 4083764 - RNA, 17 nt, Variola virus
ccggugagaacaugaga

SEQ ID NO: 4083765 - RNA, 14 nt, Variola virus
ccguagaaauacua

SEQ ID NO: 4083766 - RNA, 14 nt, Variola virus
ccguucucugaaua

SEQ ID NO: 4083767 - RNA, 22 nt, Variola virus
ccguuuauuaucuuguuccaua

SEQ ID NO: 4083768 - RNA, 17 nt, Variola virus
ccuauaaacaugaauuu

SEQ ID NO: 4083769 - RNA, 18 nt, Variola virus
ccucagaggauauguuug

SEQ ID NO: 4083770 - RNA, 15 nt, Variola virus
ccucagguagguuua

SEQ ID NO: 4083771 - RNA, 22 nt, Variola virus
ccucuauuauacauuuaauguu

SEQ ID NO: 4083772 - RNA, 20 nt, Variola virus
ccugucuccuagcaauuagu

SEQ ID NO: 4083773 - RNA, 17 nt, Variola virus
ccuuaaauguaucuuua

SEQ ID NO: 4083774 - RNA, 15 nt, Variola virus
ccuuaagaauaucca

SEQ ID NO: 4083775 - RNA, 16 nt, Variola virus
ccuuggcuaauugucu

SEQ ID NO: 4083776 - RNA, 11 nt, Variola virus
ccuuguaacuu

SEQ ID NO: 4083777 - RNA, 21 nt, Variola virus
ccuuuaaaaguaaucaugaaa

SEQ ID NO: 4083778 - RNA, 20 nt, Variola virus
ccuuuacaucucgcaauaau

SEQ ID NO: 4083779 - RNA, 15 nt, Variola virus
ccuuugcuauuucua

SEQ ID NO: 4083780 - RNA, 15 nt, Variola virus
ccuuuuuauuuucua

SEQ ID NO: 4083781 - RNA, 18 nt, Variola virus
cgaaacacgucaaagguu

SEQ ID NO: 4083782 - RNA, 21 nt, Variola virus
cgaaauaguuaauaauucugu

SEQ ID NO: 4083783 - RNA, 16 nt, Variola virus
cgaacguauuacuaug

SEQ ID NO: 4083784 - RNA, 12 nt, Variola virus
cgaauaaaagau

SEQ ID NO: 4083785 - RNA, 18 nt, Variola virus
cgaauaaguuugcagaca

SEQ ID NO: 4083786 - RNA, 19 nt, Variola virus
cgaauaauucuaauaaacu

SEQ ID NO: 4083787 - RNA, 16 nt, Variola virus
cgaauaccauggauug

SEQ ID NO: 4083788 - RNA, 16 nt, Variola virus
cgaauauauaaaagac

SEQ ID NO: 4083789 - RNA, 22 nt, Variola virus
cgaauauuauaauaccaugacu

SEQ ID NO: 4083790 - RNA, 19 nt, Variola virus
cgaaugccaauguuaauuu

SEQ ID NO: 4083791 - RNA, 17 nt, Variola virus
cgacaaaaagauauaaa

SEQ ID NO: 4083792 - RNA, 20 nt, Variola virus
cgacgauaacgaaguauuua

SEQ ID NO: 4083793 - RNA, 16 nt, Variola virus
cgacucaguauacaaa

SEQ ID NO: 4083794 - RNA, 17 nt, Variola virus
cgagaauaugauagaaa

SEQ ID NO: 4083795 - RNA, 21 nt, Variola virus
cgagaauguugggauccagag

SEQ ID NO: 4083796 - RNA, 16 nt, Variola virus
uacaaaugauacugau

SEQ ID NO: 4083797 - RNA, 22 nt, Variola virus
uacaacacaggauaaauuauuu

SEQ ID NO: 4083798 - RNA, 15 nt, Variola virus
uacaacacuuuucua

SEQ ID NO: 4083799 - RNA, 11 nt, Variola virus
uacaacagaua

SEQ ID NO: 4083800 - RNA, 18 nt, Variola virus
uacaacauuccaaagauc

SEQ ID NO: 4083801 - RNA, 22 nt, Variola virus
uacaaccguuuccuccguuucc

SEQ ID NO: 4083802 - RNA, 22 nt, Variola virus
uacaagauugaaauuauauucu

SEQ ID NO: 4083803 - RNA, 17 nt, Variola virus
uacaaguggcugcuauu

SEQ ID NO: 4083804 - RNA, 15 nt, Variola virus
uacaauauuuacauu

SEQ ID NO: 4083805 - RNA, 22 nt, Variola virus
uacaaugaacgauaauauucua

SEQ ID NO: 4083806 - RNA, 14 nt, Variola virus
uacacaaauaauua

SEQ ID NO: 4083807 - RNA, 13 nt, Variola virus
uacacagaaucag

SEQ ID NO: 4083808 - RNA, 19 nt, Variola virus
uacacaucuaucaagugau

SEQ ID NO: 4083809 - RNA, 23 nt, Variola virus
uacaccauuaauagauaaaacga

SEQ ID NO: 4083810 - RNA, 20 nt, Variola virus
uacacguuagauuauucuca

SEQ ID NO: 4083811 - RNA, 13 nt, Variola virus
uacagaauuauug

SEQ ID NO: 4083812 - RNA, 21 nt, Variola virus
uacagauuguaguucuauaau

SEQ ID NO: 4083813 - RNA, 17 nt, Variola virus
uacagcguuuacuauuc

SEQ ID NO: 4083814 - RNA, 17 nt, Variola virus
uacaguaaaaauaacua

SEQ ID NO: 4083815 - RNA, 18 nt, Variola virus
uacagucuaauauccauu

SEQ ID NO: 4083816 - RNA, 13 nt, Variola virus
uacaguucuuggc

SEQ ID NO: 4083817 - RNA, 14 nt, Variola virus
uacauaacaucuuu

SEQ ID NO: 4083818 - RNA, 19 nt, Variola virus
uacauauaugcaauucgcu

SEQ ID NO: 4083819 - RNA, 17 nt, Variola virus
uacauauuauucaaaau

SEQ ID NO: 4083820 - RNA, 17 nt, Variola virus
uacauccaaaauacaaa

SEQ ID NO: 4083821 - RNA, 21 nt, Variola virus
uacauccugccauuaagaaac

SEQ ID NO: 4083822 - RNA, 20 nt, Variola virus
uacaucuaaauuuuuacuau

SEQ ID NO: 4083823 - RNA, 22 nt, Variola virus
uacaucugaaacauacaacaaa

SEQ ID NO: 4083824 - RNA, 18 nt, Variola virus
uacaugagcugaaugaca

SEQ ID NO: 4083825 - RNA, 18 nt, Variola virus
uacaugauaggaagaaaa

SEQ ID NO: 4083826 - RNA, 16 nt, Variola virus
uacaugauuaauacau

SEQ ID NO: 4083827 - RNA, 21 nt, Variola virus
uacaugguuaaaguacaugua

SEQ ID NO: 4083828 - RNA, 20 nt, Variola virus
uacauguaaugauuuaaaau

SEQ ID NO: 4083829 - RNA, 20 nt, Variola virus
uacauuauuacauagaugua

SEQ ID NO: 4083830 - RNA, 14 nt, Variola virus
uacauuuguaucua

SEQ ID NO: 4083831 - RNA, 18 nt, Variola virus
uaccaauaggaauacaag

SEQ ID NO: 4083832 - RNA, 20 nt, Variola virus
uaccacguaaaacuuaaaau

SEQ ID NO: 4083833 - RNA, 20 nt, Variola virus
uaccagauauuauacaaaau

SEQ ID NO: 4083834 - RNA, 11 nt, Variola virus
uaccauacuua

SEQ ID NO: 4083835 - RNA, 18 nt, Variola virus
uaccauggaaaaauauua

SEQ ID NO: 4083836 - RNA, 19 nt, Variola virus
uacccaaaucugaaaauaa

SEQ ID NO: 4083837 - RNA, 15 nt, Variola virus
uacccaauaaaaugu

SEQ ID NO: 4083838 - RNA, 13 nt, Variola virus
uacccaucuuaau

SEQ ID NO: 4083839 - RNA, 22 nt, Variola virus
uaccgcuaguacccuuaaucau

SEQ ID NO: 4083840 - RNA, 21 nt, Variola virus
uaccuaucaaggaacaaauau

SEQ ID NO: 4083841 - RNA, 13 nt, Variola virus
uaccuguuuuuau

SEQ ID NO: 4083842 - RNA, 13 nt, Variola virus
uaccuuaaucaug

SEQ ID NO: 4083843 - RNA, 21 nt, Variola virus
uaccuuugguucuuuaaaaga

SEQ ID NO: 4083844 - RNA, 22 nt, Variola virus
uacgaagaaaaaguaaauacug

SEQ ID NO: 4083845 - RNA, 13 nt, Variola virus
uacgaauaaaaga

SEQ ID NO: 4083846 - RNA, 21 nt, Variola virus
uacgagccaaaucuucuucua

SEQ ID NO: 4083847 - RNA, 18 nt, Variola virus
uacgauuuucuucuuuga

SEQ ID NO: 4083848 - RNA, 13 nt, Variola virus
uacgcguucucaa

SEQ ID NO: 4083849 - RNA, 21 nt, Variola virus
uacgcuauuaaucuuuaaaau

SEQ ID NO: 4083850 - RNA, 20 nt, Variola virus
uacgcucucuggaggauugu

SEQ ID NO: 4083851 - RNA, 14 nt, Variola virus
uacggaaagaacca

SEQ ID NO: 4083852 - RNA, 18 nt, Variola virus
uacgguugauucaaaaau

SEQ ID NO: 4083853 - RNA, 17 nt, Variola virus
uacguauuauauaugua

SEQ ID NO: 4083854 - RNA, 16 nt, Variola virus
uacgucuauacagaua

SEQ ID NO: 4083855 - RNA, 15 nt, Variola virus
uacgucuucuaaaaa

SEQ ID NO: 4083856 - RNA, 14 nt, Variola virus
uacguuacuaaaau

SEQ ID NO: 4083857 - RNA, 17 nt, Variola virus
uacguuauugucaaaau

SEQ ID NO: 4083858 - RNA, 20 nt, Variola virus
uacuaaacgaucaaccaaaa

SEQ ID NO: 4083859 - RNA, 15 nt, Variola virus
uacuaaagaaacugu

SEQ ID NO: 4083860 - RNA, 22 nt, Variola virus
uacuaaagacuaugucaaagua

SEQ ID NO: 4083861 - RNA, 12 nt, Variola virus
uacuaagaaagu

SEQ ID NO: 4083862 - RNA, 18 nt, Variola virus
uacuaauacuaauacuaa

SEQ ID NO: 4083863 - RNA, 16 nt, Variola virus
uacuacacauuauucc

SEQ ID NO: 4083864 - RNA, 15 nt, Variola virus
uacuaguuccaacau

SEQ ID NO: 4083865 - RNA, 13 nt, Variola virus
uacuauaauauua

SEQ ID NO: 4083866 - RNA, 22 nt, Variola virus
uacuauauuaacaucuaaacau

SEQ ID NO: 4083867 - RNA, 12 nt, Variola virus
uacuaucaaaau

SEQ ID NO: 4083868 - RNA, 15 nt, Variola virus
uacuaucuuuaacau

SEQ ID NO: 4083869 - RNA, 19 nt, Variola virus
uacuaugcacauuauucua

SEQ ID NO: 4083870 - RNA, 14 nt, Variola virus
uacuauuaaucagu

SEQ ID NO: 4083871 - RNA, 15 nt, Variola virus
uacuauuguacauua

SEQ ID NO: 4083872 - RNA, 14 nt, Variola virus
uacuauuuugguau

SEQ ID NO: 4083873 - RNA, 23 nt, Variola virus
uacucacggcuacggcauuagau

SEQ ID NO: 4083874 - RNA, 14 nt, Variola virus
uacucauuaucaua

SEQ ID NO: 4083875 - RNA, 17 nt, Variola virus
uacucccacaaauacug

SEQ ID NO: 4083876 - RNA, 13 nt, Variola virus
uacuccguuuuau

SEQ ID NO: 4083877 - RNA, 19 nt, Variola virus
uacuccuuucuuaaugcau

SEQ ID NO: 4083878 - RNA, 17 nt, Variola virus
uacucguguccauaauc

SEQ ID NO: 4083879 - RNA, 19 nt, Variola virus
uacucuagauaaaaucacu

SEQ ID NO: 4083880 - RNA, 17 nt, Variola virus
uacucuauaaaauacua

SEQ ID NO: 4083881 - RNA, 18 nt, Variola virus
uacugaggggaaaaucaa

SEQ ID NO: 4083882 - RNA, 21 nt, Variola virus
uacugcaauaauuuucaaaag

SEQ ID NO: 4083883 - RNA, 16 nt, Variola virus
uacugcuggaaaauaa

SEQ ID NO: 4083884 - RNA, 14 nt, Variola virus
uacugucuuuugug

SEQ ID NO: 4083885 - RNA, 14 nt, Variola virus
uacuguuaaaugua

SEQ ID NO: 4083886 - RNA, 16 nt, Variola virus
uacuguucauacauga

SEQ ID NO: 4083887 - RNA, 19 nt, Variola virus
uacuguugaguaaaucagu

SEQ ID NO: 4083888 - RNA, 11 nt, Variola virus
uacuuaaugaa

SEQ ID NO: 4083889 - RNA, 18 nt, Variola virus
uacuuauuaguaaaacua

SEQ ID NO: 4083890 - RNA, 17 nt, Variola virus
uacuucagguuucuuag

SEQ ID NO: 4083891 - RNA, 15 nt, Variola virus
uacuucuauacaaaa

SEQ ID NO: 4083892 - RNA, 17 nt, Variola virus
uacuugacaucuaaaaa

SEQ ID NO: 4083893 - RNA, 22 nt, Variola virus
uacuuggaaaguuuuauaugua

SEQ ID NO: 4083894 - RNA, 23 nt, Variola virus
uacuuuuucuuuaccuuaagaau

SEQ ID NO: 4083895 - RNA, 18 nt, Variola virus
uacuuuuugcguauacau

SEQ ID NO: 4083896 - RNA, 14 nt, Variola virus
uagaaaaaauuacu

SEQ ID NO: 4083897 - RNA, 13 nt, Variola virus
uagaaaaaugcua

SEQ ID NO: 4083898 - RNA, 19 nt, Variola virus
uagaaaauaauauagauuu

SEQ ID NO: 4083899 - RNA, 21 nt, Variola virus
uagaaagaaacgauuauuucu

SEQ ID NO: 4083900 - RNA, 22 nt, Variola virus
uagaaauaagagacuuaaacaa

SEQ ID NO: 4083901 - RNA, 14 nt, Variola virus
uagaaauacaaaag

SEQ ID NO: 4083902 - RNA, 19 nt, Variola virus
uagaaauaucuaggacaau

SEQ ID NO: 4083903 - RNA, 21 nt, Variola virus
uagaaaugugcuacuaagaua

SEQ ID NO: 4083904 - RNA, 20 nt, Variola virus
uagaaauuuaucaauaucca

SEQ ID NO: 4083905 - RNA, 22 nt, Variola virus
uagaacacauaaccaauuuaua

SEQ ID NO: 4083906 - RNA, 20 nt, Variola virus
uagaagaaauugaacuccuc

SEQ ID NO: 4083907 - RNA, 15 nt, Variola virus
uagaagcuaacauac

SEQ ID NO: 4083908 - RNA, 17 nt, Variola virus
uagaaggaguguuuucu

SEQ ID NO: 4083909 - RNA, 17 nt, Variola virus
uagaauaaauauccuug

SEQ ID NO: 4083910 - RNA, 13 nt, Variola virus
uagaauaucacau

SEQ ID NO: 4083911 - RNA, 18 nt, Variola virus
uagaauuuauaaacauca

SEQ ID NO: 4083912 - RNA, 16 nt, Variola virus
uagaauuucauuuugu

SEQ ID NO: 4083913 - RNA, 13 nt, Variola virus
uagacaaaacuau

SEQ ID NO: 4083914 - RNA, 21 nt, Variola virus
uagaccggauacuagacaucu

SEQ ID NO: 4083915 - RNA, 20 nt, Variola virus
uagacgagggguuagauggu

SEQ ID NO: 4083916 - RNA, 21 nt, Variola virus
uagacugaaugcuuucuugga

SEQ ID NO: 4083917 - RNA, 22 nt, Variola virus
uagagacaaacuauuaacuauc

SEQ ID NO: 4083918 - RNA, 20 nt, Variola virus
uagagaccgcgucuguuaua

SEQ ID NO: 4083919 - RNA, 14 nt, Variola virus
uagagagauucauu

SEQ ID NO: 4083920 - RNA, 21 nt, Variola virus
uagagaggcugcugaaaauaa

SEQ ID NO: 4083921 - RNA, 15 nt, Variola virus
uagagauaauuuauc

SEQ ID NO: 4083922 - RNA, 13 nt, Variola virus
uauaguuuggauu

SEQ ID NO: 4083923 - RNA, 22 nt, Variola virus
uauauaagacacagaaauacug

SEQ ID NO: 4083924 - RNA, 24 nt, Variola virus
uauauaagacacagaaauacugua

SEQ ID NO: 4083925 - RNA, 14 nt, Variola virus
uauauaagacguau

SEQ ID NO: 4083926 - RNA, 22 nt, Variola virus
uauauagcuauucuucuuuaaa

SEQ ID NO: 4083927 - RNA, 21 nt, Variola virus
uauauaguuuuuacacauaga

SEQ ID NO: 4083928 - RNA, 15 nt, Variola virus
uauauaucuauuaca

SEQ ID NO: 4083929 - RNA, 17 nt, Variola virus
uauauccuuauuaacuu

SEQ ID NO: 4083930 - RNA, 16 nt, Variola virus
uauaucuaacaucuug

SEQ ID NO: 4083931 - RNA, 21 nt, Variola virus
uauaucuagaguaauguuuaa

SEQ ID NO: 4083932 - RNA, 16 nt, Variola virus
uauaugagauguaguu

SEQ ID NO: 4083933 - RNA, 14 nt, Variola virus
uauaugauuaucaa

SEQ ID NO: 4083934 - RNA, 19 nt, Variola virus
uauaugcaugauagaagau

SEQ ID NO: 4083935 - RNA, 12 nt, Variola virus
uauaugucuacc

SEQ ID NO: 4083936 - RNA, 14 nt, Variola virus
auguaaagaaggag

SEQ ID NO: 4083937 - RNA, 13 nt, Variola virus
auguaacgcguau

SEQ ID NO: 4083938 - RNA, 17 nt, Variola virus
auguaauucuuucucca

SEQ ID NO: 4083939 - RNA, 17 nt, Variola virus
auguagugacgauguau

SEQ ID NO: 4083940 - RNA, 20 nt, Variola virus
auguauaaaacaacaaaauu

SEQ ID NO: 4083941 - RNA, 13 nt, Variola virus
auguauaaaccuu

SEQ ID NO: 4083942 - RNA, 23 nt, Variola virus
auguauaacaaaugcagaaauua

SEQ ID NO: 4083943 - RNA, 16 nt, Variola virus
auguaucgugccucau

SEQ ID NO: 4083944 - RNA, 16 nt, Variola virus
auguaugcuaauagcg

SEQ ID NO: 4083945 - RNA, 19 nt, Variola virus
auguauuuuuuaugauaua

SEQ ID NO: 4083946 - RNA, 18 nt, Variola virus
augucaaaacuuguucaa

SEQ ID NO: 4083947 - RNA, 22 nt, Variola virus
augucauaaacuguaaaugauu

SEQ ID NO: 4083948 - RNA, 15 nt, Variola virus
augucauaaauucuu

SEQ ID NO: 4083949 - RNA, 20 nt, Variola virus
augucugauggcgacauaau

SEQ ID NO: 4083950 - RNA, 18 nt, Variola virus
augucuguacaaauguua

SEQ ID NO: 4083951 - RNA, 13 nt, Variola virus
augugaaacagac

SEQ ID NO: 4083952 - RNA, 22 nt, Variola virus
augugacccaguaaugcauuua

SEQ ID NO: 4083953 - RNA, 23 nt, Variola virus
augugacuuuucucuaaaugaug

SEQ ID NO: 4083954 - RNA, 16 nt, Variola virus
augugcuaaaaucacu

SEQ ID NO: 4083955 - RNA, 21 nt, Variola virus
auguguauacaucgguaaaua

SEQ ID NO: 4083956 - RNA, 20 nt, Variola virus
augugucucucacucucucu

SEQ ID NO: 4083957 - RNA, 14 nt, Variola virus
auguuaauauguau

SEQ ID NO: 4083958 - RNA, 16 nt, Variola virus
auguuacaaugucuag

SEQ ID NO: 4083959 - RNA, 14 nt, Variola virus
auguuagaaaaaug

SEQ ID NO: 4083960 - RNA, 15 nt, Variola virus
auguuaggaaauauu

SEQ ID NO: 4083961 - RNA, 14 nt, Variola virus
auguuaguaggaau

SEQ ID NO: 4083962 - RNA, 14 nt, Variola virus
auguuauaaaaaug

SEQ ID NO: 4083963 - RNA, 21 nt, Variola virus
auguuaucuacauauuuacca

SEQ ID NO: 4083964 - RNA, 20 nt, Variola virus
auguuccauuuauaagaaau

SEQ ID NO: 4083965 - RNA, 22 nt, Variola virus
auguucucaagaacuacaaaag

SEQ ID NO: 4083966 - RNA, 23 nt, Variola virus
auguucuuaauagucuaggaaug

SEQ ID NO: 4083967 - RNA, 16 nt, Variola virus
auguugauagaaguua

SEQ ID NO: 4083968 - RNA, 17 nt, Variola virus
auguuggcaacgacaaa

SEQ ID NO: 4083969 - RNA, 19 nt, Variola virus
auguuuaaacaucaaacau

SEQ ID NO: 4083970 - RNA, 20 nt, Variola virus
auguuuaauguuuuaaauuu

SEQ ID NO: 4083971 - RNA, 23 nt, Variola virus
auguuuacggcugcguuaaacau

SEQ ID NO: 4083972 - RNA, 17 nt, Variola virus
auguuugacugaauaua

SEQ ID NO: 4083973 - RNA, 23 nt, Variola virus
auguuuggaaugacgaauccugu

SEQ ID NO: 4083974 - RNA, 17 nt, Variola virus
auguuugggagaauuaa

SEQ ID NO: 4083975 - RNA, 15 nt, Variola virus
auuccgcauuaaaug

SEQ ID NO: 4083976 - RNA, 20 nt, Variola virus
auuccuaccaaacaaaauuu

SEQ ID NO: 4083977 - RNA, 20 nt, Variola virus
auuccuuugcuauuucuaug

SEQ ID NO: 4083978 - RNA, 15 nt, Variola virus
auucgaauucaaaug

SEQ ID NO: 4083979 - RNA, 18 nt, Variola virus
auucgacucaacauaaau

SEQ ID NO: 4083980 - RNA, 16 nt, Variola virus
auucgauaagauagau

SEQ ID NO: 4083981 - RNA, 20 nt, Variola virus
auucgcaaacuauucuaaua

SEQ ID NO: 4083982 - RNA, 22 nt, Variola virus
auucuaccuuuuuauuuucuaa

SEQ ID NO: 4083983 - RNA, 15 nt, Variola virus
auucuagaccaaaaa

SEQ ID NO: 4083984 - RNA, 13 nt, Variola virus
auucuaugaugaa

SEQ ID NO: 4083985 - RNA, 18 nt, Variola virus
auucucucauuuaucaaa

SEQ ID NO: 4083986 - RNA, 15 nt, Variola virus
auucugaugcaucaa

SEQ ID NO: 4083987 - RNA, 22 nt, Variola virus
auucugccguguuuaaaaauuc

SEQ ID NO: 4083988 - RNA, 17 nt, Variola virus
auucuggagcuauuuuc

SEQ ID NO: 4083989 - RNA, 17 nt, Variola virus
auucuguuacuacuuua

SEQ ID NO: 4083990 - RNA, 14 nt, Variola virus
auucuuaucaauaa

SEQ ID NO: 4083991 - RNA, 16 nt, Variola virus
auucuucccaugaaug

SEQ ID NO: 4083992 - RNA, 22 nt, Variola virus
auucuugaaacuuuucagaaua

SEQ ID NO: 4083993 - RNA, 19 nt, Variola virus
auucuugguaauuaauaga

SEQ ID NO: 4083994 - RNA, 20 nt, Variola virus
auucuuuggauccaaaugcu

SEQ ID NO: 4083995 - RNA, 15 nt, Variola virus
auucuuuuaugaaua

SEQ ID NO: 4083996 - RNA, 20 nt, Variola virus
auugaaauuaaucauauaca

SEQ ID NO: 4083997 - RNA, 13 nt, Variola virus
auugaagaaggag

SEQ ID NO: 4083998 - RNA, 17 nt, Variola virus
auugaauaggaguuuga

SEQ ID NO: 4083999 - RNA, 17 nt, Variola virus
auugacauauguaaaua

SEQ ID NO: 4084000 - RNA, 14 nt, Variola virus
auugacgacuuugg

SEQ ID NO: 4084001 - RNA, 16 nt, Variola virus
auugacuaagaauuau

SEQ ID NO: 4084002 - RNA, 20 nt, Variola virus
auugacuaauaaauuaaaua

SEQ ID NO: 4084003 - RNA, 21 nt, Variola virus
auugacuaauaaauuaaauau

SEQ ID NO: 4084004 - RNA, 15 nt, Variola virus
auugagguuucugac

SEQ ID NO: 4084005 - RNA, 23 nt, Variola virus
auugauaacucugauuucuugaa

SEQ ID NO: 4084006 - RNA, 17 nt, Variola virus
auugcauauuuaucuuu

SEQ ID NO: 4084007 - RNA, 23 nt, Variola virus
auuggauucguguaaucauauau

SEQ ID NO: 4084008 - RNA, 15 nt, Variola virus
auuggauuggauaau

SEQ ID NO: 4084009 - RNA, 15 nt, Variola virus
auuggcuaguauuua

SEQ ID NO: 4084010 - RNA, 22 nt, Variola virus
auugguaaauuccauagaauau

SEQ ID NO: 4084011 - RNA, 14 nt, Variola virus
auugguacauagau

SEQ ID NO: 4084012 - RNA, 20 nt, Variola virus
auugguucuuuaccagaaaa

SEQ ID NO: 4084013 - RNA, 14 nt, Variola virus
auuguaacaauaug

SEQ ID NO: 4084014 - RNA, 20 nt, Variola virus
auuguacgguagaauugaua

SEQ ID NO: 4084015 - RNA, 16 nt, Variola virus
auuguagauaaugaaa

SEQ ID NO: 4084016 - RNA, 19 nt, Variola virus
auuguagcuauuuaaaugg

SEQ ID NO: 4084017 - RNA, 11 nt, Variola virus
auuguauauag

SEQ ID NO: 4084018 - RNA, 23 nt, Variola virus
auuguaugacuuaauagcaucau

SEQ ID NO: 4084019 - RNA, 23 nt, Variola virus
auuguccaucuauuacaaacaug

SEQ ID NO: 4084020 - RNA, 16 nt, Variola virus
auugucccaauguuuc

SEQ ID NO: 4084021 - RNA, 20 nt, Variola virus
auugucuagauaaaauacug

SEQ ID NO: 4084022 - RNA, 15 nt, Variola virus
auugugcgacacuag

SEQ ID NO: 4084023 - RNA, 15 nt, Variola virus
auuguuuaagaucac

SEQ ID NO: 4084024 - RNA, 13 nt, Variola virus
auuuaaaaugaua

SEQ ID NO: 4084025 - RNA, 12 nt, Variola virus
auuuaacuagau

SEQ ID NO: 4084026 - RNA, 16 nt, Variola virus
auuuaagguacuagau

SEQ ID NO: 4084027 - RNA, 17 nt, Variola virus
auuuaagugaugcauuc

SEQ ID NO: 4084028 - RNA, 16 nt, Variola virus
auuuaauuuuagauaa

SEQ ID NO: 4084029 - RNA, 19 nt, Variola virus
auuuacaggcuguuagcug

SEQ ID NO: 4084030 - RNA, 15 nt, Variola virus
auuuacgcgcacaca

SEQ ID NO: 4084031 - RNA, 15 nt, Variola virus
auuuacucucuauaa

SEQ ID NO: 4084032 - RNA, 22 nt, Variola virus
auuuagaaaacucucuaucucu

SEQ ID NO: 4084033 - RNA, 14 nt, Variola virus
auuuagaaauguug

SEQ ID NO: 4084034 - RNA, 15 nt, Variola virus
auuuagacgagagau

SEQ ID NO: 4084035 - RNA, 22 nt, Variola virus
auuuagauuaaauccagaaguu

SEQ ID NO: 4084036 - RNA, 13 nt, Variola virus
auuuauaaaaaug

SEQ ID NO: 4084037 - RNA, 17 nt, Variola virus
auuuauacguaucauuu

SEQ ID NO: 4084038 - RNA, 18 nt, Variola virus
auuuauaucuaaaaauua

SEQ ID NO: 4084039 - RNA, 17 nt, Variola virus
auuuauccaucgucaaa

SEQ ID NO: 4084040 - RNA, 19 nt, Variola virus
auuuaucgauuagucuuaa

SEQ ID NO: 4084041 - RNA, 21 nt, Variola virus
auuuaucgauuagucuuaaug

SEQ ID NO: 4084042 - RNA, 16 nt, Variola virus
auuuaucuaacauagu

SEQ ID NO: 4084043 - RNA, 14 nt, Variola virus
auuuaucuauuuua

SEQ ID NO: 4084044 - RNA, 20 nt, Variola virus
auuuauuaaugcuuuaguga

SEQ ID NO: 4084045 - RNA, 14 nt, Variola virus
auuuauuaucuugu

SEQ ID NO: 4084046 - RNA, 18 nt, Variola virus
auuuauuguaacaguauu

SEQ ID NO: 4084047 - RNA, 19 nt, Variola virus
auuuauuuucggguuuaaa

SEQ ID NO: 4084048 - RNA, 23 nt, Variola virus
auuuauuuucggguuuaaauucu

SEQ ID NO: 4084049 - RNA, 16 nt, Variola virus
auuucaaaaaaugauc

SEQ ID NO: 4084050 - RNA, 19 nt, Variola virus
auuucaaaauguuaaauca

SEQ ID NO: 4084051 - RNA, 21 nt, Variola virus
auuucaaauaggucuucgucu

SEQ ID NO: 4084052 - RNA, 16 nt, Variola virus
auuucaaucaaacaaa

SEQ ID NO: 4084053 - RNA, 15 nt, Variola virus
auuucacaaauggau

SEQ ID NO: 4084054 - RNA, 20 nt, Variola virus
auuucagauacuauauuugu

SEQ ID NO: 4084055 - RNA, 21 nt, Variola virus
auuucauagacuuuaucuaga

SEQ ID NO: 4084056 - RNA, 17 nt, Variola virus
auuucaucguuuuguau

SEQ ID NO: 4084057 - RNA, 20 nt, Variola virus
auuucaucuccguaaauaua

SEQ ID NO: 4084058 - RNA, 22 nt, Variola virus
auuuccacauuagaugguaaau

SEQ ID NO: 4084059 - RNA, 15 nt, Variola virus
auuucgaaaauacua

SEQ ID NO: 4084060 - RNA, 23 nt, Variola virus
auuucgauaauauacgguaaucu

SEQ ID NO: 4084061 - RNA, 17 nt, Variola virus
auuucguuaaaacauuc

SEQ ID NO: 4084062 - RNA, 23 nt, Variola virus
auuucuacauaauuauauauugu

SEQ ID NO: 4084063 - RNA, 23 nt, Variola virus
auuucuccaaagaauauaucuaa

SEQ ID NO: 4084064 - RNA, 14 nt, Variola virus
auuucuuacauaaa

SEQ ID NO: 4084065 - RNA, 13 nt, Variola virus
auuucuuaucugu

SEQ ID NO: 4084066 - RNA, 23 nt, Variola virus
auuucuuuaccacaggagaaugg

SEQ ID NO: 4084067 - RNA, 22 nt, Variola virus
auuucuuuuuucuggcauaacu

SEQ ID NO: 4084068 - RNA, 21 nt, Variola virus
auuugacuaaaucuuaauagu

SEQ ID NO: 4084069 - RNA, 16 nt, Variola virus
auuugauuauuuugaa

SEQ ID NO: 4084070 - RNA, 20 nt, Variola virus
auuugguuauuaaacaguau

SEQ ID NO: 4084071 - RNA, 17 nt, Variola virus
auuuguaggaaaaagau

SEQ ID NO: 4084072 - RNA, 13 nt, Variola virus
auuuguauauaca

SEQ ID NO: 4084073 - RNA, 16 nt, Variola virus
auuuguaucuuaguau

SEQ ID NO: 4084074 - RNA, 21 nt, Variola virus
auuugucuuccuuaacuauau

SEQ ID NO: 4084075 - RNA, 22 nt, Variola virus
auuuguuaaagugggacaugau

SEQ ID NO: 4084076 - RNA, 12 nt, Variola virus
auuuguuaauga

SEQ ID NO: 4084077 - RNA, 15 nt, Variola virus
auuuuaacauaugau

SEQ ID NO: 4084078 - RNA, 18 nt, Variola virus
auuuuaagauuuuaaaug

SEQ ID NO: 4084079 - RNA, 22 nt, Variola virus
auuuuaauucuccuauuacaua

SEQ ID NO: 4084080 - RNA, 22 nt, Variola virus
auuuuacccucaaucauguacu

SEQ ID NO: 4084081 - RNA, 19 nt, Variola virus
auuuuacucauuuuuuaua

SEQ ID NO: 4084082 - RNA, 13 nt, Variola virus
auuuuagacacua

SEQ ID NO: 4084083 - RNA, 15 nt, Variola virus
auuuuauauacuuuu

SEQ ID NO: 4084084 - RNA, 17 nt, Variola virus
auuuuaucuuuuagagg

SEQ ID NO: 4084085 - RNA, 17 nt, Variola virus
auuuuauguacagaggu

SEQ ID NO: 4084086 - RNA, 16 nt, Variola virus
auuuucauuuaaauga

SEQ ID NO: 4084087 - RNA, 16 nt, Variola virus
auuuucuauaacugaa

SEQ ID NO: 4084088 - RNA, 22 nt, Variola virus
auuuucugacaaaguuagaaaa

SEQ ID NO: 4084089 - RNA, 22 nt, Variola virus
auuuucuuacaauuaacgagaa

SEQ ID NO: 4084090 - RNA, 15 nt, Variola virus
auuuucuuucuaaua

SEQ ID NO: 4084091 - RNA, 17 nt, Variola virus
auuuugaagauauagau

SEQ ID NO: 4084092 - RNA, 14 nt, Variola virus
auuuugacaaagau

SEQ ID NO: 4084093 - RNA, 15 nt, Variola virus
auuuugacuuacaua

SEQ ID NO: 4084094 - RNA, 18 nt, Variola virus
auuuugacuuacauaaau

SEQ ID NO: 4084095 - RNA, 19 nt, Variola virus
auuuugcauuagauuuacu

SEQ ID NO: 4084096 - RNA, 15 nt, Variola virus
auuuuggaaaaauug

SEQ ID NO: 4084097 - RNA, 20 nt, Variola virus
auuuugggcaaaucuaaaua

SEQ ID NO: 4084098 - RNA, 12 nt, Variola virus
auuuuguaacug

SEQ ID NO: 4084099 - RNA, 21 nt, Variola virus
auuuugucuuuaaguauauac

SEQ ID NO: 4084100 - RNA, 17 nt, Variola virus
auuuuuagacauuagau

SEQ ID NO: 4084101 - RNA, 19 nt, Variola virus
auuuuuauucagcauuacu

SEQ ID NO: 4084102 - RNA, 19 nt, Variola virus
auuuuugauaacacuguau

SEQ ID NO: 4084103 - RNA, 18 nt, Variola virus
auuuuuguacauuaauaa

SEQ ID NO: 4084104 - RNA, 14 nt, Variola virus
auuuuuuacaauuu

SEQ ID NO: 4084105 - RNA, 18 nt, Variola virus
auuuuuuauaaacaugaa

SEQ ID NO: 4084106 - RNA, 16 nt, Variola virus
auuuuuuaugaauauc

SEQ ID NO: 4084107 - RNA, 22 nt, Variola virus
auuuuuuguucuauaaacugaa

SEQ ID NO: 4084108 - RNA, 23 nt, Variola virus
auuuuuuuaaaaaggaaauacuu

SEQ ID NO: 4084109 - RNA, 12 nt, Variola virus
caaaaaauaaua

SEQ ID NO: 4084110 - RNA, 16 nt, Variola virus
caaaaagauauaaaau

SEQ ID NO: 4084111 - RNA, 13 nt, Variola virus
caaaaauaaugac

SEQ ID NO: 4084112 - RNA, 18 nt, Variola virus
caaaaauuuaaaaugagu

SEQ ID NO: 4084113 - RNA, 13 nt, Variola virus
caaaacuauuuca

SEQ ID NO: 4084114 - RNA, 18 nt, Variola virus
caaaacuucacagaugau

SEQ ID NO: 4084115 - RNA, 13 nt, Variola virus
caaaagaacauga

SEQ ID NO: 4084116 - RNA, 20 nt, Variola virus
caaaaggcgguaauagaaua

SEQ ID NO: 4084117 - RNA, 18 nt, Variola virus
caaaaguaguauagcaau

SEQ ID NO: 4084118 - RNA, 23 nt, Variola virus
caaaaguaguucaacauaauauu

SEQ ID NO: 4084119 - RNA, 16 nt, Variola virus
caaaaguuaauuucua

SEQ ID NO: 4084120 - RNA, 15 nt, Variola virus
caaaauacaauuguu

SEQ ID NO: 4084121 - RNA, 20 nt, Variola virus
caaaauaguaaaguaacgau

SEQ ID NO: 4084122 - RNA, 17 nt, Variola virus
caaaauauaauguugua

SEQ ID NO: 4084123 - RNA, 17 nt, Variola virus
caaaauccuauauugua

SEQ ID NO: 4084124 - RNA, 21 nt, Variola virus
caaaauguauguguugaacau

SEQ ID NO: 4084125 - RNA, 14 nt, Variola virus
caaaaugugauauu

SEQ ID NO: 4084126 - RNA, 13 nt, Variola virus
caaaauuaucaau

SEQ ID NO: 4084127 - RNA, 16 nt, Variola virus
caaacaauuuuaacag

SEQ ID NO: 4084128 - RNA, 18 nt, Variola virus
caaacaggaaagaaguau

SEQ ID NO: 4084129 - RNA, 23 nt, Variola virus
caaacaucacucuucgaaaagaa

SEQ ID NO: 4084130 - RNA, 14 nt, Variola virus
caaacauccucuau

SEQ ID NO: 4084131 - RNA, 15 nt, Variola virus
caaacaugacauuuu

SEQ ID NO: 4084132 - RNA, 14 nt, Variola virus
caaacaugcgaaau

SEQ ID NO: 4084133 - RNA, 16 nt, Variola virus
caaacauuauguagua

SEQ ID NO: 4084134 - RNA, 14 nt, Variola virus
caaaccuagaugca

SEQ ID NO: 4084135 - RNA, 14 nt, Variola virus
caaacucuauuuua

SEQ ID NO: 4084136 - RNA, 16 nt, Variola virus
caaacucuauuuuaaa

SEQ ID NO: 4084137 - RNA, 20 nt, Variola virus
caaacuuaaucuuauuagaa

SEQ ID NO: 4084138 - RNA, 18 nt, Variola virus
caaacuuacagaaacaau

SEQ ID NO: 4084139 - RNA, 19 nt, Variola virus
caaagaauuuuagacacua

SEQ ID NO: 4084140 - RNA, 18 nt, Variola virus
caaagagaccaaugaauu

SEQ ID NO: 4084141 - RNA, 18 nt, Variola virus
caaaggaugaaagaaagc

SEQ ID NO: 4084142 - RNA, 16 nt, Variola virus
caaagguuauagugua

SEQ ID NO: 4084143 - RNA, 20 nt, Variola virus
caaauaaaauggauaauggu

SEQ ID NO: 4084144 - RNA, 23 nt, Variola virus
caaauacuugauuccuaggucua

SEQ ID NO: 4084145 - RNA, 20 nt, Variola virus
caaauagcuacaguaaaaau

SEQ ID NO: 4084146 - RNA, 13 nt, Variola virus
caaauaugauaug

SEQ ID NO: 4084147 - RNA, 14 nt, Variola virus
caaauauuauacau

SEQ ID NO: 4084148 - RNA, 22 nt, Variola virus
caaauccgugauuuugguaaug

SEQ ID NO: 4084149 - RNA, 16 nt, Variola virus
caaauggauguuaaug

SEQ ID NO: 4084150 - RNA, 14 nt, Variola virus
caaauuaaauucug

SEQ ID NO: 4084151 - RNA, 19 nt, Variola virus
caaauugcauauuuggaag

SEQ ID NO: 4084152 - RNA, 15 nt, Variola virus
caaauuuaucuacua

SEQ ID NO: 4084153 - RNA, 20 nt, Variola virus
caacaagucaaaacauaaua

SEQ ID NO: 4084154 - RNA, 19 nt, Variola virus
caacaaguuggaugauauu

SEQ ID NO: 4084155 - RNA, 13 nt, Variola virus
caacagaaaauau

SEQ ID NO: 4084156 - RNA, 18 nt, Variola virus
caacauaauauuaaacac

SEQ ID NO: 4084157 - RNA, 17 nt, Variola virus
caacaucuauaaaagua

SEQ ID NO: 4084158 - RNA, 22 nt, Variola virus
caacaucuuaagcguagaaguu

SEQ ID NO: 4084159 - RNA, 13 nt, Variola virus
caacauuccaaag

SEQ ID NO: 4084160 - RNA, 17 nt, Variola virus
caaccaaaaaggauaaa

SEQ ID NO: 4084161 - RNA, 15 nt, Variola virus
caaccgaaaucaugg

SEQ ID NO: 4084162 - RNA, 15 nt, Variola virus
caacguaauaaugaa

SEQ ID NO: 4084163 - RNA, 12 nt, Variola virus
caacuacaguag

SEQ ID NO: 4084164 - RNA, 18 nt, Variola virus
caacuaguaucaucucua

SEQ ID NO: 4084165 - RNA, 18 nt, Variola virus
caacucaucguuccauag

SEQ ID NO: 4084166 - RNA, 19 nt, Variola virus
caacucucaaguauccauc

SEQ ID NO: 4084167 - RNA, 13 nt, Variola virus
caacucucuuuuu

SEQ ID NO: 4084168 - RNA, 15 nt, Variola virus
caacugaaaaaguua

SEQ ID NO: 4084169 - RNA, 20 nt, Variola virus
caacuuauccauuuauacau

SEQ ID NO: 4084170 - RNA, 20 nt, Variola virus
caagaaauauggauccucua

SEQ ID NO: 4084171 - RNA, 22 nt, Variola virus
caagagugauuugagaacaucc

SEQ ID NO: 4084172 - RNA, 15 nt, Variola virus
caagauaagcaaacg

SEQ ID NO: 4084173 - RNA, 16 nt, Variola virus
caagauuuuuaaacaa

SEQ ID NO: 4084174 - RNA, 20 nt, Variola virus
caaguaggauuuuuccaaag

SEQ ID NO: 4084175 - RNA, 13 nt, Variola virus
caaguauaaugau

SEQ ID NO: 4084176 - RNA, 21 nt, Variola virus
caaguaugaagaaaaauguug

SEQ ID NO: 4084177 - RNA, 16 nt, Variola virus
caaguaugacauugua

SEQ ID NO: 4084178 - RNA, 15 nt, Variola virus
caagucauaaaucau

SEQ ID NO: 4084179 - RNA, 15 nt, Variola virus
caagugacuauuauc

SEQ ID NO: 4084180 - RNA, 15 nt, Variola virus
caauaaaaaaaauug

SEQ ID NO: 4084181 - RNA, 20 nt, Variola virus
caauaacacaaucaugauuu

SEQ ID NO: 4084182 - RNA, 16 nt, Variola virus
caauaagcauuaugau

SEQ ID NO: 4084183 - RNA, 19 nt, Variola virus
caauaagcauuaugauuug

SEQ ID NO: 4084184 - RNA, 13 nt, Variola virus
caauaaguaguau

SEQ ID NO: 4084185 - RNA, 22 nt, Variola virus
caauacagauuguacuauacau

SEQ ID NO: 4084186 - RNA, 19 nt, Variola virus
caauacguguugauaauau

SEQ ID NO: 4084187 - RNA, 13 nt, Variola virus
caauagaaucugu

SEQ ID NO: 4084188 - RNA, 20 nt, Variola virus
caauagauaauuguaacaau

SEQ ID NO: 4084189 - RNA, 15 nt, Variola virus
caauagauuauacau

SEQ ID NO: 4084190 - RNA, 23 nt, Variola virus
caauauagucuguguuacauaau

SEQ ID NO: 4084191 - RNA, 13 nt, Variola virus
caauauauucuau

SEQ ID NO: 4084192 - RNA, 21 nt, Variola virus
caauaucuucguaaaaagauu

SEQ ID NO: 4084193 - RNA, 17 nt, Variola virus
caauaugcgaaucauuu

SEQ ID NO: 4084194 - RNA, 13 nt, Variola virus
caauauuuacaau

SEQ ID NO: 4084195 - RNA, 18 nt, Variola virus
caaucaaaccuauaacau

SEQ ID NO: 4084196 - RNA, 18 nt, Variola virus
aaaaaugcauacuuguua

SEQ ID NO: 4084197 - RNA, 21 nt, Variola virus
aaaaauguaaaauauuuuucu

SEQ ID NO: 4084198 - RNA, 15 nt, Variola virus
aaaaauguuaauuua

SEQ ID NO: 4084199 - RNA, 17 nt, Variola virus
aaaaauuuaaagaaugu

SEQ ID NO: 4084200 - RNA, 14 nt, Variola virus
aaaacaauacagug

SEQ ID NO: 4084201 - RNA, 18 nt, Variola virus
aaaacagaauaucccaaa

SEQ ID NO: 4084202 - RNA, 16 nt, Variola virus
aaaacagauaaugaua

SEQ ID NO: 4084203 - RNA, 22 nt, Variola virus
aaaacagggacguguuaauaaa

SEQ ID NO: 4084204 - RNA, 21 nt, Variola virus
aaaacauaaaggaauauacaa

SEQ ID NO: 4084205 - RNA, 11 nt, Variola virus
aaaacauaaua

SEQ ID NO: 4084206 - RNA, 16 nt, Variola virus
aaaacauucaaauguu

SEQ ID NO: 4084207 - RNA, 13 nt, Variola virus
aaaaccaaaucuu

SEQ ID NO: 4084208 - RNA, 16 nt, Variola virus
aaaaccguuaaaaugu

SEQ ID NO: 4084209 - RNA, 14 nt, Variola virus
aaaacgaaauauau

SEQ ID NO: 4084210 - RNA, 20 nt, Variola virus
aaaacuauaugucuguagaa

SEQ ID NO: 4084211 - RNA, 22 nt, Variola virus
aaaacuauuacuaggagaauua

SEQ ID NO: 4084212 - RNA, 21 nt, Variola virus
aaaacucugauuauugucuaa

SEQ ID NO: 4084213 - RNA, 22 nt, Variola virus
aaaacugguuuagcuaauacua

SEQ ID NO: 4084214 - RNA, 16 nt, Variola virus
aaaacuuuaauaacaa

SEQ ID NO: 4084215 - RNA, 20 nt, Variola virus
aaaagaaauauauguggugu

SEQ ID NO: 4084216 - RNA, 13 nt, Variola virus
aaaagagaauaua

SEQ ID NO: 4084217 - RNA, 13 nt, Variola virus
aaaagauaauaca

SEQ ID NO: 4084218 - RNA, 14 nt, Variola virus
aaaagauauccaga

SEQ ID NO: 4084219 - RNA, 13 nt, Variola virus
aaaagaucaacau

SEQ ID NO: 4084220 - RNA, 14 nt, Variola virus
aaaagcauacguac

SEQ ID NO: 4084221 - RNA, 23 nt, Variola virus
aaaaggaauuuaccagugauuau

SEQ ID NO: 4084222 - RNA, 15 nt, Variola virus
aaaaguacagaauua

SEQ ID NO: 4084223 - RNA, 16 nt, Variola virus
aaaaguccuagaauua

SEQ ID NO: 4084224 - RNA, 18 nt, Variola virus
aaaaguuccagaaaaugu

SEQ ID NO: 4084225 - RNA, 18 nt, Variola virus
aaaauaaacacauagaaa

SEQ ID NO: 4084226 - RNA, 20 nt, Variola virus
aaaauaaacacauagaaaua

SEQ ID NO: 4084227 - RNA, 13 nt, Variola virus
aaaauaaaguuau

SEQ ID NO: 4084228 - RNA, 15 nt, Variola virus
aaaauaauaugauua

SEQ ID NO: 4084229 - RNA, 19 nt, Variola virus
aaaauaaucauacaaucua

SEQ ID NO: 4084230 - RNA, 15 nt, Variola virus
aaaauaguucuguaa

SEQ ID NO: 4084231 - RNA, 16 nt, Variola virus
aaaauauuuauuagaa

SEQ ID NO: 4084232 - RNA, 13 nt, Variola virus
aaaauauuuuacu

SEQ ID NO: 4084233 - RNA, 14 nt, Variola virus
aaaaucaauccacu

SEQ ID NO: 4084234 - RNA, 21 nt, Variola virus
aaaaucgucuucauaaagcau

SEQ ID NO: 4084235 - RNA, 21 nt, Variola virus
aaaaucguguuuguguaguuu

SEQ ID NO: 4084236 - RNA, 17 nt, Variola virus
aaaaucuaaacaaauau

SEQ ID NO: 4084237 - RNA, 15 nt, Variola virus
aaaaucuacagauga

SEQ ID NO: 4084238 - RNA, 24 nt, Variola virus
aaaaugaaaacacuuuaguaauua

SEQ ID NO: 4084239 - RNA, 21 nt, Variola virus
aaaaugaagauccaagauuug

SEQ ID NO: 4084240 - RNA, 22 nt, Variola virus
aaaaugaugcuauuagaauuua

SEQ ID NO: 4084241 - RNA, 19 nt, Variola virus
aaaaugcauguacagaauc

SEQ ID NO: 4084242 - RNA, 15 nt, Variola virus
aaaaugcuaauauua

SEQ ID NO: 4084243 - RNA, 20 nt, Variola virus
aaaaugcuacuuuagcuaag

SEQ ID NO: 4084244 - RNA, 18 nt, Variola virus
aaaauggcauaugcuuua

SEQ ID NO: 4084245 - RNA, 19 nt, Variola virus
aaaauguauagauaaacua

SEQ ID NO: 4084246 - RNA, 20 nt, Variola virus
aaaaugugauauugguguag

SEQ ID NO: 4084247 - RNA, 20 nt, Variola virus
aaaauguucuuaauagucua

SEQ ID NO: 4084248 - RNA, 22 nt, Variola virus
aaaauuauuaaacaauacucua

SEQ ID NO: 4084249 - RNA, 20 nt, Variola virus
aaaauuauuacuagaaucuc

SEQ ID NO: 4084250 - RNA, 13 nt, Variola virus
aaaauuauucucc

SEQ ID NO: 4084251 - RNA, 15 nt, Variola virus
aaaauuuaaagaaug

SEQ ID NO: 4084252 - RNA, 14 nt, Variola virus
aaaauuuugaucau

SEQ ID NO: 4084253 - RNA, 20 nt, Variola virus
aaaauuuuuuagauguagua

SEQ ID NO: 4084254 - RNA, 12 nt, Variola virus
aaacaacucuuc

SEQ ID NO: 4084255 - RNA, 18 nt, Variola virus
aaacaaguuuucauauca

SEQ ID NO: 4084256 - RNA, 20 nt, Variola virus
aaacacauauugaugugucu

SEQ ID NO: 4084257 - RNA, 18 nt, Variola virus
aaacacugauucagaaau

SEQ ID NO: 4084258 - RNA, 20 nt, Variola virus
aaacacugauucagaaaugg

SEQ ID NO: 4084259 - RNA, 23 nt, Variola virus
aaacagauauaguuuuucuggaa

SEQ ID NO: 4084260 - RNA, 16 nt, Variola virus
aaacaguauguuguac

SEQ ID NO: 4084261 - RNA, 14 nt, Variola virus
aaacauauucuaug

SEQ ID NO: 4084262 - RNA, 13 nt, Variola virus
aaacaucucuucu

SEQ ID NO: 4084263 - RNA, 20 nt, Variola virus
aaacauuauaucguuaucau

SEQ ID NO: 4084264 - RNA, 17 nt, Variola virus
aaacauucaaccacucu

SEQ ID NO: 4084265 - RNA, 22 nt, Variola virus
aaacauucuuuauuaaguguuu

SEQ ID NO: 4084266 - RNA, 20 nt, Variola virus
aaacauuuuauauacuuuuc

SEQ ID NO: 4084267 - RNA, 22 nt, Variola virus
aaacauuuuauauacuuuucua

SEQ ID NO: 4084268 - RNA, 18 nt, Variola virus
aaacauuuugacugaaua

SEQ ID NO: 4084269 - RNA, 20 nt, Variola virus
aaaccaauguaggucuaaau

SEQ ID NO: 4084270 - RNA, 19 nt, Variola virus
aaaccaauuaacaagaaua

SEQ ID NO: 4084271 - RNA, 14 nt, Variola virus
aaaccaauuuguau

SEQ ID NO: 4084272 - RNA, 16 nt, Variola virus
aaaccaucgucugaau

SEQ ID NO: 4084273 - RNA, 20 nt, Variola virus
aaaccuauaacauuaauauc

SEQ ID NO: 4084274 - RNA, 23 nt, Variola virus
aaaccuuugacuaguuguagaau

SEQ ID NO: 4084275 - RNA, 21 nt, Variola virus
aaacgaacgucuccaauauau

SEQ ID NO: 4084276 - RNA, 20 nt, Variola virus
aaacgacauacuauauguaa

SEQ ID NO: 4084277 - RNA, 15 nt, Variola virus
aaacgacuuaccgaa

SEQ ID NO: 4084278 - RNA, 17 nt, Variola virus
aaacgauuaaacaauau

SEQ ID NO: 4084279 - RNA, 18 nt, Variola virus
aaacgauuauuucuaaau

SEQ ID NO: 4084280 - RNA, 23 nt, Variola virus
aaacggcaaaccaaaaacauuug

SEQ ID NO: 4084281 - RNA, 17 nt, Variola virus
aaacuaguucugagaaa

SEQ ID NO: 4084282 - RNA, 17 nt, Variola virus
aaacucaauuauacucu

SEQ ID NO: 4084283 - RNA, 16 nt, Variola virus
aaacucgcuuaauauc

SEQ ID NO: 4084284 - RNA, 18 nt, Variola virus
aaacucguaaaaagauua

SEQ ID NO: 4084285 - RNA, 18 nt, Variola virus
aaacugguuaaaacagua

SEQ ID NO: 4084286 - RNA, 17 nt, Variola virus
aaacuguaaauguagua

SEQ ID NO: 4084287 - RNA, 19 nt, Variola virus
aaacuuuacgauagacuuu

SEQ ID NO: 4084288 - RNA, 22 nt, Variola virus
aaacuuucuagaacauacugag

SEQ ID NO: 4084289 - RNA, 17 nt, Variola virus
aaacuuuucagaauauc

SEQ ID NO: 4084290 - RNA, 15 nt, Variola virus
aaacuuuuuagaaau

SEQ ID NO: 4084291 - RNA, 17 nt, Variola virus
aaagaacggagaauugu

SEQ ID NO: 4084292 - RNA, 14 nt, Variola virus
aaagaauccuacau

SEQ ID NO: 4084293 - RNA, 16 nt, Variola virus
aaagacuaugcaaaga

SEQ ID NO: 4084294 - RNA, 22 nt, Variola virus
aaagacuuucguuaauuugucu

SEQ ID NO: 4084295 - RNA, 14 nt, Variola virus
aaagagaauuauau

SEQ ID NO: 4084296 - RNA, 22 nt, Variola virus
aaagaguaugguaaaugacucu

SEQ ID NO: 4084297 - RNA, 20 nt, Variola virus
aaagauauuaccaguugugg

SEQ ID NO: 4084298 - RNA, 12 nt, Variola virus
aaagauauuguu

SEQ ID NO: 4084299 - RNA, 15 nt, Variola virus
aaagauguauuaccu

SEQ ID NO: 4084300 - RNA, 16 nt, Variola virus
aaagauuaauacauua

SEQ ID NO: 4084301 - RNA, 16 nt, Variola virus
aaagauuguguagaaa

SEQ ID NO: 4084302 - RNA, 19 nt, Variola virus
aaagauuugcuucuaaaau

SEQ ID NO: 4084303 - RNA, 19 nt, Variola virus
aaagcaauugacuaauaaa

SEQ ID NO: 4084304 - RNA, 12 nt, Variola virus
aaagcauauguu

SEQ ID NO: 4084305 - RNA, 16 nt, Variola virus
aaagcgugauuuuaau

SEQ ID NO: 4084306 - RNA, 17 nt, Variola virus
aaagggaccuaaaucua

SEQ ID NO: 4084307 - RNA, 15 nt, Variola virus
aaagguagaccuaau

SEQ ID NO: 4084308 - RNA, 14 nt, Variola virus
aaaguaauaaucuu

SEQ ID NO: 4084309 - RNA, 18 nt, Variola virus
aaaguacuguucauacau

SEQ ID NO: 4084310 - RNA, 20 nt, Variola virus
aaaguagaaaauauauucua

SEQ ID NO: 4084311 - RNA, 12 nt, Variola virus
aaaguauaugua

SEQ ID NO: 4084312 - RNA, 13 nt, Variola virus
aaaguauauguag

SEQ ID NO: 4084313 - RNA, 19 nt, Variola virus
aaaguauccucuacucauu

SEQ ID NO: 4084314 - RNA, 20 nt, Variola virus
aaaguaucgcccuaauauua

SEQ ID NO: 4084315 - RNA, 18 nt, Variola virus
aaagucuacauugucauu

SEQ ID NO: 4084316 - RNA, 20 nt, Variola virus
aaagucuacauugucauuau

SEQ ID NO: 4084317 - RNA, 12 nt, Variola virus
aaaguggauaaa

SEQ ID NO: 4084318 - RNA, 22 nt, Variola virus
aaaguuaaggugcgaguauuaa

SEQ ID NO: 4084319 - RNA, 16 nt, Variola virus
aaaguuaauauuuucu

SEQ ID NO: 4084320 - RNA, 12 nt, Variola virus
aaaguuuaagaa

SEQ ID NO: 4084321 - RNA, 22 nt, Variola virus
aaauaaaacaaggauucguuua

SEQ ID NO: 4084322 - RNA, 18 nt, Variola virus
aacucaucuaccauuuca

SEQ ID NO: 4084323 - RNA, 18 nt, Variola virus
aacuccauauauguuuuc

SEQ ID NO: 4084324 - RNA, 18 nt, Variola virus
aacuccguagagaaauau

SEQ ID NO: 4084325 - RNA, 19 nt, Variola virus
aacucgcuuaauaucuucu

SEQ ID NO: 4084326 - RNA, 15 nt, Variola virus
aacucgguuguguau

SEQ ID NO: 4084327 - RNA, 13 nt, Variola virus
aacucuaaucaaa

SEQ ID NO: 4084328 - RNA, 12 nt, Variola virus
aacucuguuuua

SEQ ID NO: 4084329 - RNA, 16 nt, Variola virus
aacucuugaagaugau

SEQ ID NO: 4084330 - RNA, 16 nt, Variola virus
aacucuuuaaacgaua

SEQ ID NO: 4084331 - RNA, 18 nt, Variola virus
aacucuuuagucgagaua

SEQ ID NO: 4084332 - RNA, 22 nt, Variola virus
aacugacguauuggaugaugca

SEQ ID NO: 4084333 - RNA, 22 nt, Variola virus
aacugcguugauuaaaaaagau

SEQ ID NO: 4084334 - RNA, 16 nt, Variola virus
aacuguugugaauauu

SEQ ID NO: 4084335 - RNA, 12 nt, Variola virus
aacuuaaaagaa

SEQ ID NO: 4084336 - RNA, 14 nt, Variola virus
aacuuaaacaaaau

SEQ ID NO: 4084337 - RNA, 20 nt, Variola virus
aacuuaacaaaucuuaauau

SEQ ID NO: 4084338 - RNA, 21 nt, Variola virus
aacuuaggcauggacauacua

SEQ ID NO: 4084339 - RNA, 13 nt, Variola virus
aacuuaucaaaga

SEQ ID NO: 4084340 - RNA, 17 nt, Variola virus
aacuucucuaaaugagu

SEQ ID NO: 4084341 - RNA, 16 nt, Variola virus
aacuugauuucaaaau

SEQ ID NO: 4084342 - RNA, 19 nt, Variola virus
aacuuuaaacagaaauaua

SEQ ID NO: 4084343 - RNA, 23 nt, Variola virus
aacuuuaaauaauuuacaaaaau

SEQ ID NO: 4084344 - RNA, 15 nt, Variola virus
aacuuucaucuaaua

SEQ ID NO: 4084345 - RNA, 15 nt, Variola virus
aacuuugauuauccu

SEQ ID NO: 4084346 - RNA, 15 nt, Variola virus
aacuuuguucauuua

SEQ ID NO: 4084347 - RNA, 19 nt, Variola virus
aacuuuuaaauacaaauau

SEQ ID NO: 4084348 - RNA, 13 nt, Variola virus
aacuuuucagaau

SEQ ID NO: 4084349 - RNA, 15 nt, Variola virus
aagaaaacaaacauu

SEQ ID NO: 4084350 - RNA, 18 nt, Variola virus
aagaacgauguacaacug

SEQ ID NO: 4084351 - RNA, 18 nt, Variola virus
aagaagagaauuaaaaga

SEQ ID NO: 4084352 - RNA, 18 nt, Variola virus
aagaagaugguuaaaaau

SEQ ID NO: 4084353 - RNA, 15 nt, Variola virus
aagaagccauuuuau

SEQ ID NO: 4084354 - RNA, 15 nt, Variola virus
aagaaguuagaaagu

SEQ ID NO: 4084355 - RNA, 19 nt, Variola virus
aagaaugcuguuauauaca

SEQ ID NO: 4084356 - RNA, 13 nt, Variola virus
aagaauucuuaug

SEQ ID NO: 4084357 - RNA, 13 nt, Variola virus
aagacauaugcac

SEQ ID NO: 4084358 - RNA, 17 nt, Variola virus
gauuucugauuauucac

SEQ ID NO: 4084359 - RNA, 18 nt, Variola virus
gauuugagaacauccucc

SEQ ID NO: 4084360 - RNA, 19 nt, Variola virus
gauuugucacaauaugaau

SEQ ID NO: 4084361 - RNA, 20 nt, Variola virus
gauuuuccaaaucaguaacu

SEQ ID NO: 4084362 - RNA, 14 nt, Variola virus
gauuuuuccaaagu

SEQ ID NO: 4084363 - RNA, 22 nt, Variola virus
gauuuuuuuaucccauguuuca

SEQ ID NO: 4084364 - RNA, 22 nt, Variola virus
gcaaaaaaucugauagaaagaa

SEQ ID NO: 4084365 - RNA, 23 nt, Variola virus
gcaaacaauguauacaaauguac

SEQ ID NO: 4084366 - RNA, 20 nt, Variola virus
gcaaacacuuuccugauuua

SEQ ID NO: 4084367 - RNA, 15 nt, Variola virus
gcaaagaaugaugac

SEQ ID NO: 4084368 - RNA, 18 nt, Variola virus
gcaaaucuaguaaaucaa

SEQ ID NO: 4084369 - RNA, 17 nt, Variola virus
gcaaauguauaaaacaa

SEQ ID NO: 4084370 - RNA, 21 nt, Variola virus
gcaaauuauuucuucugaauu

SEQ ID NO: 4084371 - RNA, 22 nt, Variola virus
gcaacgaauaacaaaauacaag

SEQ ID NO: 4084372 - RNA, 15 nt, Variola virus
gcaacuaguaauaaa

SEQ ID NO: 4084373 - RNA, 23 nt, Variola virus
gcaacuauauaguuuaaauuaag

SEQ ID NO: 4084374 - RNA, 15 nt, Variola virus
gcaacuaucauuuua

SEQ ID NO: 4084375 - RNA, 16 nt, Variola virus
gcaagacuaacacaca

SEQ ID NO: 4084376 - RNA, 14 nt, Variola virus
gcaauaaauaugau

SEQ ID NO: 4084377 - RNA, 23 nt, Variola virus
gcaauagucagacuguaguucua

SEQ ID NO: 4084378 - RNA, 16 nt, Variola virus
gcaauuucugauucua

SEQ ID NO: 4084379 - RNA, 23 nt, Variola virus
gcaauuuuauugcuaauaaugac

SEQ ID NO: 4084380 - RNA, 13 nt, Variola virus
gcacaaugauaau

SEQ ID NO: 4084381 - RNA, 12 nt, Variola virus
gcacuauuucua

SEQ ID NO: 4084382 - RNA, 16 nt, Variola virus
gcagaauaauuagaaa

SEQ ID NO: 4084383 - RNA, 12 nt, Variola virus
gcagaugaugau

SEQ ID NO: 4084384 - RNA, 13 nt, Variola virus
gcagccauuuaac

SEQ ID NO: 4084385 - RNA, 16 nt, Variola virus
gcaggagauagauauc

SEQ ID NO: 4084386 - RNA, 17 nt, Variola virus
gcaggcaaauguuuaua

SEQ ID NO: 4084387 - RNA, 17 nt, Variola virus
gcagucggauuggaaca

SEQ ID NO: 4084388 - RNA, 19 nt, Variola virus
gcaguggaguuauaugaau

SEQ ID NO: 4084389 - RNA, 18 nt, Variola virus
gcaguuacaagauuuuua

SEQ ID NO: 4084390 - RNA, 21 nt, Variola virus
gcaguuuuauuuuaucuuuua

SEQ ID NO: 4084391 - RNA, 18 nt, Variola virus
gcauaaacuauacuauga

SEQ ID NO: 4084392 - RNA, 17 nt, Variola virus
gcauaagucauaacugu

SEQ ID NO: 4084393 - RNA, 22 nt, Variola virus
gcauaauaccuaucuauaagau

SEQ ID NO: 4084394 - RNA, 17 nt, Variola virus
gcauauauuagaaauac

SEQ ID NO: 4084395 - RNA, 13 nt, Variola virus
gcauaucaugaaa

SEQ ID NO: 4084396 - RNA, 20 nt, Variola virus
gcauauucuauagucagaau

SEQ ID NO: 4084397 - RNA, 15 nt, Variola virus
gcaucauauaacuaa

SEQ ID NO: 4084398 - RNA, 23 nt, Variola virus
gcauccacucauauagaagaugc

SEQ ID NO: 4084399 - RNA, 14 nt, Variola virus
gcaucuguaaaaga

SEQ ID NO: 4084400 - RNA, 15 nt, Variola virus
gcaucuucacaaauu

SEQ ID NO: 4084401 - RNA, 21 nt, Variola virus
gcaucuuggaaacauaaaaua

SEQ ID NO: 4084402 - RNA, 15 nt, Variola virus
gcauuaaaugaugaa

SEQ ID NO: 4084403 - RNA, 14 nt, Variola virus
gcauuaauaacauc

SEQ ID NO: 4084404 - RNA, 13 nt, Variola virus
gcauuaauaaugu

SEQ ID NO: 4084405 - RNA, 13 nt, Variola virus
gcauuaauacagu

SEQ ID NO: 4084406 - RNA, 18 nt, Variola virus
gcauuaauacuguuuucu

SEQ ID NO: 4084407 - RNA, 17 nt, Variola virus
gcauuaaugagaagaau

SEQ ID NO: 4084408 - RNA, 17 nt, Variola virus
gcauuacagaauaauau

SEQ ID NO: 4084409 - RNA, 21 nt, Variola virus
gcauucuauucgaauaaugag

SEQ ID NO: 4084410 - RNA, 17 nt, Variola virus
gcauuggcaucaaaaga

SEQ ID NO: 4084411 - RNA, 15 nt, Variola virus
gcauugugaauauau

SEQ ID NO: 4084412 - RNA, 17 nt, Variola virus
gcauuugucgauaaaga

SEQ ID NO: 4084413 - RNA, 15 nt, Variola virus
gccaaaaugauagau

SEQ ID NO: 4084414 - RNA, 14 nt, Variola virus
gccaaaucuucuuc

SEQ ID NO: 4084415 - RNA, 14 nt, Variola virus
gccaacuauacauc

SEQ ID NO: 4084416 - RNA, 21 nt, Variola virus
gccaacucucaaaaugcugau

SEQ ID NO: 4084417 - RNA, 21 nt, Variola virus
gccaagauaucuauauaauua

SEQ ID NO: 4084418 - RNA, 22 nt, Variola virus
gccaauucuuccauugauguua

SEQ ID NO: 4084419 - RNA, 15 nt, Variola virus
gccagauuuaagaaa

SEQ ID NO: 4084420 - RNA, 16 nt, Variola virus
gccauggacuaagaua

SEQ ID NO: 4084421 - RNA, 20 nt, Variola virus
gccauuaagaaacuaguuua

SEQ ID NO: 4084422 - RNA, 23 nt, Variola virus
gccauuuaguuauugaaauuaau

SEQ ID NO: 4084423 - RNA, 22 nt, Variola virus
gccccaggaucuccaacaaauu

SEQ ID NO: 4084424 - RNA, 22 nt, Variola virus
gccccgcuucuauuuacucccg

SEQ ID NO: 4084425 - RNA, 14 nt, Variola virus
gccgaacuaaaaaa

SEQ ID NO: 4084426 - RNA, 15 nt, Variola virus
gccgauaaacaaauc

SEQ ID NO: 4084427 - RNA, 22 nt, Variola virus
gccgcuuggaccauuauuuuua

SEQ ID NO: 4084428 - RNA, 19 nt, Variola virus
gccuauaaaguaauaaucu

SEQ ID NO: 4084429 - RNA, 18 nt, Variola virus
gccuccacuagaagagaa

SEQ ID NO: 4084430 - RNA, 19 nt, Variola virus
gccuccacuagaagagaau

SEQ ID NO: 4084431 - RNA, 17 nt, Variola virus
gccuuauauagcacuuu

SEQ ID NO: 4084432 - RNA, 14 nt, Variola virus
gcgaauuacucugu

SEQ ID NO: 4084433 - RNA, 20 nt, Variola virus
gcgacacgguauauuagaug

SEQ ID NO: 4084434 - RNA, 23 nt, Variola virus
gcgauaucuccauuaauaaugau

SEQ ID NO: 4084435 - RNA, 16 nt, Variola virus
gcgaugucuuggaagc

SEQ ID NO: 4084436 - RNA, 14 nt, Variola virus
gcgcauaucuuuuu

SEQ ID NO: 4084437 - RNA, 13 nt, Variola virus
gcgcuauaguauu

SEQ ID NO: 4084438 - RNA, 21 nt, Variola virus
gcggguguuauucacaacauc

SEQ ID NO: 4084439 - RNA, 22 nt, Variola virus
gcgguuaaaauaguuuauaaca

SEQ ID NO: 4084440 - RNA, 23 nt, Variola virus
gcgguugccauagaauauacguc

SEQ ID NO: 4084441 - RNA, 14 nt, Variola virus
gcguauauagucua

SEQ ID NO: 4084442 - RNA, 13 nt, Variola virus
gcguauuuaagag

SEQ ID NO: 4084443 - RNA, 17 nt, Variola virus
gcgucauuguaaaggaa

SEQ ID NO: 4084444 - RNA, 13 nt, Variola virus
gcgucuaaaucaa

SEQ ID NO: 4084445 - RNA, 22 nt, Variola virus
gcguucaacauuuuauggaaac

SEQ ID NO: 4084446 - RNA, 19 nt, Variola virus
gcguucaagauuaucuuua

SEQ ID NO: 4084447 - RNA, 21 nt, Variola virus
gcguugauuaaaaaagaucaa

SEQ ID NO: 4084448 - RNA, 17 nt, Variola virus
gcuaaaaucuucaucaa

SEQ ID NO: 4084449 - RNA, 18 nt, Variola virus
gcuaaagauuugucacaa

SEQ ID NO: 4084450 - RNA, 20 nt, Variola virus
gcuaacauacgagacauguu

SEQ ID NO: 4084451 - RNA, 17 nt, Variola virus
gcuaauaucuauauauu

SEQ ID NO: 4084452 - RNA, 13 nt, Variola virus
gcuaaugaugcag

SEQ ID NO: 4084453 - RNA, 16 nt, Variola virus
gcuacagaaacauaua

SEQ ID NO: 4084454 - RNA, 20 nt, Variola virus
gcuaguuaauaguaaaugaa

SEQ ID NO: 4084455 - RNA, 22 nt, Variola virus
gcuauagaggacaauaauauua

SEQ ID NO: 4084456 - RNA, 17 nt, Variola virus
gcuauguuaucaugaaa

SEQ ID NO: 4084457 - RNA, 13 nt, Variola virus
gcucuaucuuuua

SEQ ID NO: 4084458 - RNA, 21 nt, Variola virus
gcucuuuguccauuauuucua

SEQ ID NO: 4084459 - RNA, 12 nt, Variola virus
gcugaaaugaga

SEQ ID NO: 4084460 - RNA, 15 nt, Variola virus
gcugacuauaacaga

SEQ ID NO: 4084461 - RNA, 17 nt, Variola virus
gcugguucaaaauuaau

SEQ ID NO: 4084462 - RNA, 12 nt, Variola virus
gcugucauguau

SEQ ID NO: 4084463 - RNA, 16 nt, Variola virus
gcuguccguauuguau

SEQ ID NO: 4084464 - RNA, 13 nt, Variola virus
gcuuccauaauau

SEQ ID NO: 4084465 - RNA, 19 nt, Variola virus
gcuucuuccaacucuguuu

SEQ ID NO: 4084466 - RNA, 18 nt, Variola virus
gcuugauaauuagauaua

SEQ ID NO: 4084467 - RNA, 14 nt, Variola virus
gcuugauauuaaag

SEQ ID NO: 4084468 - RNA, 22 nt, Variola virus
gcuugcauuacagaauaauauu

SEQ ID NO: 4084469 - RNA, 21 nt, Variola virus
gcuuuucuauaaucauuuuua

SEQ ID NO: 4084470 - RNA, 15 nt, Variola virus
gcuuuucucuuuuaa

SEQ ID NO: 4084471 - RNA, 21 nt, Variola virus
ggaaaagucaaagucguuuaa

SEQ ID NO: 4084472 - RNA, 11 nt, Variola virus
ggaaaaugcua

SEQ ID NO: 4084473 - RNA, 23 nt, Variola virus
ggaaagcuagacuugauuauucu

SEQ ID NO: 4084474 - RNA, 19 nt, Variola virus
ggaaaggaugauucaucaa

SEQ ID NO: 4084475 - RNA, 21 nt, Variola virus
ggaagcaauuacagauuucuc

SEQ ID NO: 4084476 - RNA, 22 nt, Variola virus
ggaauacuaauuauacacauua

SEQ ID NO: 4084477 - RNA, 17 nt, Variola virus
ggaauaugacuauuuuc

SEQ ID NO: 4084478 - RNA, 16 nt, Variola virus
ggacaaauauaugcaa

SEQ ID NO: 4084479 - RNA, 19 nt, Variola virus
ggacaaccuuaauugguug

SEQ ID NO: 4084480 - RNA, 23 nt, Variola virus
ggacacgguguauuguauuucuc

SEQ ID NO: 4084481 - RNA, 23 nt, Variola virus
ggacauaagucgccucaaagaua

SEQ ID NO: 4084482 - RNA, 22 nt, Variola virus
ggagaguauccucuaugaagaa

SEQ ID NO: 4084483 - RNA, 14 nt, Variola virus
ggaguaauugauua

SEQ ID NO: 4084484 - RNA, 14 nt, Variola virus
ggauagagaaauau

SEQ ID NO: 4084485 - RNA, 20 nt, Variola virus
ggauauagauauuaaacaag

SEQ ID NO: 4084486 - RNA, 15 nt, Variola virus
ggauaugucuagaac

SEQ ID NO: 4084487 - RNA, 16 nt, Variola virus
ggaucuaguauuauug

SEQ ID NO: 4084488 - RNA, 20 nt, Variola virus
ggaucuccaucauccacaug

SEQ ID NO: 4084489 - RNA, 14 nt, Variola virus
ggaucuuaccaucu

SEQ ID NO: 4084490 - RNA, 18 nt, Variola virus
ggaucuucuaauggauug

SEQ ID NO: 4084491 - RNA, 15 nt, Variola virus
ggaugaaaauaagaa

SEQ ID NO: 4084492 - RNA, 20 nt, Variola virus
ggaugucauagauucuuuaa

SEQ ID NO: 4084493 - RNA, 18 nt, Variola virus
ggauuaauauaugucaua

SEQ ID NO: 4084494 - RNA, 13 nt, Variola virus
ggauucaaaaaga

SEQ ID NO: 4084495 - RNA, 19 nt, Variola virus
ggcaauaacuaaaaaugua

SEQ ID NO: 4084496 - RNA, 16 nt, Variola virus
ggcaauuguagauaua

SEQ ID NO: 4084497 - RNA, 14 nt, Variola virus
ggcauguguuuccc

SEQ ID NO: 4084498 - RNA, 13 nt, Variola virus
ggccaaaaugaua

SEQ ID NO: 4084499 - RNA, 18 nt, Variola virus
ggcuaaaacauauuucuu

SEQ ID NO: 4084500 - RNA, 15 nt, Variola virus
gggaggcuugaagug

SEQ ID NO: 4084501 - RNA, 11 nt, Variola virus
gguaauacuua

SEQ ID NO: 4084502 - RNA, 15 nt, Variola virus
gguacaacauuccaa

SEQ ID NO: 4084503 - RNA, 13 nt, Variola virus
gguacuauuucua

SEQ ID NO: 4084504 - RNA, 13 nt, Variola virus
gguaggagaaaga

SEQ ID NO: 4084505 - RNA, 17 nt, Variola virus
ggucuaaagaauaucuu

SEQ ID NO: 4084506 - RNA, 23 nt, Variola virus
ggugccgcggcaagcauacagac

SEQ ID NO: 4084507 - RNA, 12 nt, Variola virus
gguguaaaagau

SEQ ID NO: 4084508 - RNA, 21 nt, Variola virus
gguuuauauaacauagaaaaa

SEQ ID NO: 4084509 - RNA, 22 nt, Variola virus
gguuucgaagaucuucuuauuu

SEQ ID NO: 4084510 - RNA, 20 nt, Variola virus
guaaaaaaaccuauaaugau

SEQ ID NO: 4084511 - RNA, 17 nt, Variola virus
guaaaagucaaauuaga

SEQ ID NO: 4084512 - RNA, 14 nt, Variola virus
guaaacauaucaua

SEQ ID NO: 4084513 - RNA, 20 nt, Variola virus
guaaagacaccgaauacaaa

SEQ ID NO: 4084514 - RNA, 19 nt, Variola virus
guaaagauaucuauacuua

SEQ ID NO: 4084515 - RNA, 15 nt, Variola virus
guaaauaaauacuuu

SEQ ID NO: 4084516 - RNA, 19 nt, Variola virus
uaugaugauuuacaaaugg

SEQ ID NO: 4084517 - RNA, 17 nt, Variola virus
uaugaugucguuaaauu

SEQ ID NO: 4084518 - RNA, 16 nt, Variola virus
uaugcaaagaauuugg

SEQ ID NO: 4084519 - RNA, 21 nt, Variola virus
uaugccacaccaucuucauaa

SEQ ID NO: 4084520 - RNA, 14 nt, Variola virus
uaugcucuagauac

SEQ ID NO: 4084521 - RNA, 13 nt, Variola virus
uauggaacucaug

SEQ ID NO: 4084522 - RNA, 21 nt, Variola virus
uauggaugccaacguaguauc

SEQ ID NO: 4084523 - RNA, 21 nt, Variola virus
uauggauuuuuuuaaaaagga

SEQ ID NO: 4084524 - RNA, 17 nt, Variola virus
uauggcauucauugucu

SEQ ID NO: 4084525 - RNA, 14 nt, Variola virus
uauguauacauaau

SEQ ID NO: 4084526 - RNA, 15 nt, Variola virus
uauguaucaaucaaa

SEQ ID NO: 4084527 - RNA, 14 nt, Variola virus
uauguauucagaau

SEQ ID NO: 4084528 - RNA, 14 nt, Variola virus
uaugucacguuuau

SEQ ID NO: 4084529 - RNA, 17 nt, Variola virus
uaugucucuuaacuauu

SEQ ID NO: 4084530 - RNA, 13 nt, Variola virus
uaugugauagcaa

SEQ ID NO: 4084531 - RNA, 16 nt, Variola virus
uauguguugaacauca

SEQ ID NO: 4084532 - RNA, 17 nt, Variola virus
uauguugauuuauuaua

SEQ ID NO: 4084533 - RNA, 19 nt, Variola virus
uauguugugauucuagaau

SEQ ID NO: 4084534 - RNA, 21 nt, Variola virus
uauguuuauuagcguacacau

SEQ ID NO: 4084535 - RNA, 23 nt, Variola virus
uauuaacacuaaaaaauaaacac

SEQ ID NO: 4084536 - RNA, 17 nt, Variola virus
uauuaacgaguuccauu

SEQ ID NO: 4084537 - RNA, 21 nt, Variola virus
uauuaacgguaauacauuuau

SEQ ID NO: 4084538 - RNA, 20 nt, Variola virus
uauuaacuuuguucauuuau

SEQ ID NO: 4084539 - RNA, 19 nt, Variola virus
uauuaagaaauacaucaaa

SEQ ID NO: 4084540 - RNA, 12 nt, Variola virus
uauuaauacagg

SEQ ID NO: 4084541 - RNA, 23 nt, Variola virus
uauuaauccuuuuuucuugagau

SEQ ID NO: 4084542 - RNA, 20 nt, Variola virus
uauuaauuaauuaauuaaac

SEQ ID NO: 4084543 - RNA, 16 nt, Variola virus
uauuacaaugcucauu

SEQ ID NO: 4084544 - RNA, 22 nt, Variola virus
uauuaccaaaaaaaauaacauu

SEQ ID NO: 4084545 - RNA, 17 nt, Variola virus
uauuaccauauuucuaa

SEQ ID NO: 4084546 - RNA, 14 nt, Variola virus
uauuaccuuaauaa

SEQ ID NO: 4084547 - RNA, 16 nt, Variola virus
uauuacgaauuacauu

SEQ ID NO: 4084548 - RNA, 14 nt, Variola virus
uauuacuaaacauu

SEQ ID NO: 4084549 - RNA, 12 nt, Variola virus
uauuacuuuagu

SEQ ID NO: 4084550 - RNA, 17 nt, Variola virus
uauuacuuuucaaugcu

SEQ ID NO: 4084551 - RNA, 20 nt, Variola virus
uauuagaaauuuaucaauau

SEQ ID NO: 4084552 - RNA, 17 nt, Variola virus
uauuagagauaccaaag

SEQ ID NO: 4084553 - RNA, 22 nt, Variola virus
uauuagauaauaaacagaauag

SEQ ID NO: 4084554 - RNA, 22 nt, Variola virus
uauuagaucuccagauuucaua

SEQ ID NO: 4084555 - RNA, 21 nt, Variola virus
uauuagauuugguaaaaugaa

SEQ ID NO: 4084556 - RNA, 19 nt, Variola virus
uauuaucaucauuaucauu

SEQ ID NO: 4084557 - RNA, 22 nt, Variola virus
uauuaucuucaucgauuucuau

SEQ ID NO: 4084558 - RNA, 19 nt, Variola virus
uauuaugaugauuaugaua

SEQ ID NO: 4084559 - RNA, 20 nt, Variola virus
uauuaugcgauguaaucaua

SEQ ID NO: 4084560 - RNA, 19 nt, Variola virus
uauuaugucuagcaaugau

SEQ ID NO: 4084561 - RNA, 13 nt, Variola virus
uauuauugaagau

SEQ ID NO: 4084562 - RNA, 21 nt, Variola virus
uauucaaacuaauacaucuga

SEQ ID NO: 4084563 - RNA, 17 nt, Variola virus
uauucaagucaaagaaa

SEQ ID NO: 4084564 - RNA, 16 nt, Variola virus
uauucagauuaucaug

SEQ ID NO: 4084565 - RNA, 15 nt, Variola virus
uauucauucaacaac

SEQ ID NO: 4084566 - RNA, 14 nt, Variola virus
uauucauucaauau

SEQ ID NO: 4084567 - RNA, 15 nt, Variola virus
uauuccauuaaugac

SEQ ID NO: 4084568 - RNA, 21 nt, Variola virus
uauuccguguggcuuuccauu

SEQ ID NO: 4084569 - RNA, 17 nt, Variola virus
uauucgagaugaacauu

SEQ ID NO: 4084570 - RNA, 20 nt, Variola virus
uauucucccaccguuauaua

SEQ ID NO: 4084571 - RNA, 19 nt, Variola virus
uauucugaaacaguaugau

SEQ ID NO: 4084572 - RNA, 18 nt, Variola virus
uauucuggacuagcgaua

SEQ ID NO: 4084573 - RNA, 13 nt, Variola virus
uauucuuaaaugu

SEQ ID NO: 4084574 - RNA, 19 nt, Variola virus
uauugacuuaauaggcauc

SEQ ID NO: 4084575 - RNA, 18 nt, Variola virus
uauugagaagcauuuagu

SEQ ID NO: 4084576 - RNA, 18 nt, Variola virus
uauugauaaaauuaauga

SEQ ID NO: 4084577 - RNA, 13 nt, Variola virus
uauugauucuaga

SEQ ID NO: 4084578 - RNA, 16 nt, Variola virus
uauugcaaaucacuca

SEQ ID NO: 4084579 - RNA, 16 nt, Variola virus
uauugcauauaucucu

SEQ ID NO: 4084580 - RNA, 18 nt, Variola virus
uauugcuguauuuguaau

SEQ ID NO: 4084581 - RNA, 16 nt, Variola virus
uauuggaauuauaaua

SEQ ID NO: 4084582 - RNA, 16 nt, Variola virus
uauuggcuuuucuuua

SEQ ID NO: 4084583 - RNA, 17 nt, Variola virus
uauuguacaaaaagccc

SEQ ID NO: 4084584 - RNA, 20 nt, Variola virus
uauugugcaucgauaucuuu

SEQ ID NO: 4084585 - RNA, 19 nt, Variola virus
uauugugucuguuaauaga

SEQ ID NO: 4084586 - RNA, 14 nt, Variola virus
uauuguuacagaug

SEQ ID NO: 4084587 - RNA, 12 nt, Variola virus
uauuguuauaua

SEQ ID NO: 4084588 - RNA, 11 nt, Variola virus
uauuguuuuca

SEQ ID NO: 4084589 - RNA, 17 nt, Variola virus
uauuuaacgauucuuca

SEQ ID NO: 4084590 - RNA, 20 nt, Variola virus
uauuuacaucgcauacaaaa

SEQ ID NO: 4084591 - RNA, 22 nt, Variola virus
uauuuaccuuucuacaugaaau

SEQ ID NO: 4084592 - RNA, 13 nt, Variola virus
uauuuccauaaua

SEQ ID NO: 4084593 - RNA, 14 nt, Variola virus
uauuucguacauuu

SEQ ID NO: 4084594 - RNA, 12 nt, Variola virus
uauuucuaaaau

SEQ ID NO: 4084595 - RNA, 16 nt, Variola virus
uauuucuaauaacacu

SEQ ID NO: 4084596 - RNA, 16 nt, Variola virus
uauuucuccacuacau

SEQ ID NO: 4084597 - RNA, 20 nt, Variola virus
uauuucugucauuaaaucuu

SEQ ID NO: 4084598 - RNA, 20 nt, Variola virus
uauuuguaauuuuucucaua

SEQ ID NO: 4084599 - RNA, 20 nt, Variola virus
uauuuguacacaucuaucaa

SEQ ID NO: 4084600 - RNA, 21 nt, Variola virus
uauuuguacagguaccuacau

SEQ ID NO: 4084601 - RNA, 14 nt, Variola virus
uauuugucuuugaa

SEQ ID NO: 4084602 - RNA, 14 nt, Variola virus
uauuuguuaucaug

SEQ ID NO: 4084603 - RNA, 14 nt, Variola virus
uauuuguucaagau

SEQ ID NO: 4084604 - RNA, 19 nt, Variola virus
uauuuuaaaguuaaucaua

SEQ ID NO: 4084605 - RNA, 22 nt, Variola virus
uauuuuacauggauuuaucaua

SEQ ID NO: 4084606 - RNA, 13 nt, Variola virus
uauuuuauacauu

SEQ ID NO: 4084607 - RNA, 12 nt, Variola virus
uauuuuaucauu

SEQ ID NO: 4084608 - RNA, 16 nt, Variola virus
uauuuucuucuacaua

SEQ ID NO: 4084609 - RNA, 16 nt, Variola virus
uauuuugacauacuug

SEQ ID NO: 4084610 - RNA, 18 nt, Variola virus
uauuuuuaaaaauuacca

SEQ ID NO: 4084611 - RNA, 16 nt, Variola virus
uauuuuucuaacguug

SEQ ID NO: 4084612 - RNA, 12 nt, Variola virus
uauuuuucuuua

SEQ ID NO: 4084613 - RNA, 14 nt, Variola virus
uauuuuuuaugaua

SEQ ID NO: 4084614 - RNA, 14 nt, Variola virus
uauuuuuuauuaua

SEQ ID NO: 4084615 - RNA, 15 nt, Variola virus
uauuuuuuucuaaau

SEQ ID NO: 4084616 - RNA, 17 nt, Variola virus
ucaaaaaauaaauuaga

SEQ ID NO: 4084617 - RNA, 18 nt, Variola virus
ucaaaaauauucauuaau

SEQ ID NO: 4084618 - RNA, 13 nt, Variola virus
ucaaaaauuuaga

SEQ ID NO: 4084619 - RNA, 21 nt, Variola virus
ucaaaagaaggaauuaaacga

SEQ ID NO: 4084620 - RNA, 18 nt, Variola virus
ucaaaaucuuaauaucuu

SEQ ID NO: 4084621 - RNA, 23 nt, Variola virus
ucaaacacaucuacgaacaauau

SEQ ID NO: 4084622 - RNA, 18 nt, Variola virus
ucaaacucgauauauuca

SEQ ID NO: 4084623 - RNA, 13 nt, Variola virus
ucaaagauaauag

SEQ ID NO: 4084624 - RNA, 17 nt, Variola virus
ucaaagcaucaaaauag

SEQ ID NO: 4084625 - RNA, 19 nt, Variola virus
ucaaaggaugaaagaaagc

SEQ ID NO: 4084626 - RNA, 23 nt, Variola virus
ucaaauauagaucuuauuuagua

SEQ ID NO: 4084627 - RNA, 17 nt, Variola virus
ucaaauccgaaauuaga

SEQ ID NO: 4084628 - RNA, 17 nt, Variola virus
ucaaaucgauaguguag

SEQ ID NO: 4084629 - RNA, 19 nt, Variola virus
ucaaaugauuaauaaguau

SEQ ID NO: 4084630 - RNA, 21 nt, Variola virus
ucaaaugccacaucaaagaua

SEQ ID NO: 4084631 - RNA, 11 nt, Variola virus
ucaaauuauua

SEQ ID NO: 4084632 - RNA, 23 nt, Variola virus
ucaacaaauucugcaauaucuuc

SEQ ID NO: 4084633 - RNA, 15 nt, Variola virus
ucaacaaucguuaau

SEQ ID NO: 4084634 - RNA, 22 nt, Variola virus
ucaacauccgucaaaaccaauu

SEQ ID NO: 4084635 - RNA, 17 nt, Variola virus
ucaaccgcguuaacaua

SEQ ID NO: 4084636 - RNA, 18 nt, Variola virus
ucaacguagaaaaaauag

SEQ ID NO: 4084637 - RNA, 22 nt, Variola virus
ucaacgugauuauucuccacca

SEQ ID NO: 4084638 - RNA, 20 nt, Variola virus
ucaacuaucguuggaaaaug

SEQ ID NO: 4084639 - RNA, 13 nt, Variola virus
ucaacuuauucuu

SEQ ID NO: 4084640 - RNA, 17 nt, Variola virus
ucaagaauauagucuug

SEQ ID NO: 4084641 - RNA, 22 nt, Variola virus
ucaagccggcuauauauucugc

SEQ ID NO: 4084642 - RNA, 16 nt, Variola virus
uccuaacuuuaaacaa

SEQ ID NO: 4084643 - RNA, 15 nt, Variola virus
uccuaguacacaaua

SEQ ID NO: 4084644 - RNA, 16 nt, Variola virus
uccuauccuuguacaa

SEQ ID NO: 4084645 - RNA, 22 nt, Variola virus
uccuaucgaaugugacucugau

SEQ ID NO: 4084646 - RNA, 20 nt, Variola virus
uccucaacgugauuauucuc

SEQ ID NO: 4084647 - RNA, 12 nt, Variola virus
uccucaauaacg

SEQ ID NO: 4084648 - RNA, 18 nt, Variola virus
uccucauuacguuucauu

SEQ ID NO: 4084649 - RNA, 20 nt, Variola virus
uccuugugcuuaauguuucc

SEQ ID NO: 4084650 - RNA, 13 nt, Variola virus
uuuuuuaugauuu

SEQ ID NO: 4084651 - RNA, 12 nt, Variola virus
ucuguucaaaaa

SEQ ID NO: 4084652 - RNA, 16 nt, Variola virus
ucuguuuccuauaauc

SEQ ID NO: 4084653 - RNA, 15 nt, Variola virus
ucuuaaaaauacuua

SEQ ID NO: 4084654 - RNA, 17 nt, Variola virus
ucuuaaaagguuucaua

SEQ ID NO: 4084655 - RNA, 13 nt, Variola virus
ucuuaaaaugguu

SEQ ID NO: 4084656 - RNA, 17 nt, Variola virus
ucuuaaaauuggaucua

SEQ ID NO: 4084657 - RNA, 12 nt, Variola virus
ucuuaaaugaau

SEQ ID NO: 4084658 - RNA, 22 nt, Variola virus
ucuuaauagacauaucugccau

SEQ ID NO: 4084659 - RNA, 23 nt, Variola virus
ucuuaguaacucuaguaaaauaa

SEQ ID NO: 4084660 - RNA, 15 nt, Variola virus
ucuuauuauuaauaa

SEQ ID NO: 4084661 - RNA, 16 nt, Variola virus
ucuucaaaugaaguag

SEQ ID NO: 4084662 - RNA, 17 nt, Variola virus
ucuucaaauuccaccau

SEQ ID NO: 4084663 - RNA, 20 nt, Variola virus
ucuucaguucuaucuucuaa

SEQ ID NO: 4084664 - RNA, 14 nt, Variola virus
ucuucaucaaacag

SEQ ID NO: 4084665 - RNA, 13 nt, Variola virus
ucuucaucaucca

SEQ ID NO: 4084666 - RNA, 18 nt, Variola virus
ucuuccaucaacuuauua

SEQ ID NO: 4084667 - RNA, 16 nt, Variola virus
ucuucuaaauucauaa

SEQ ID NO: 4084668 - RNA, 17 nt, Variola virus
ucuucuauuuuaucauu

SEQ ID NO: 4084669 - RNA, 18 nt, Variola virus
ucuucuuugauuaaugau

SEQ ID NO: 4084670 - RNA, 22 nt, Variola virus
ucuugaggguuguguuaaauug

SEQ ID NO: 4084671 - RNA, 18 nt, Variola virus
ucuugauaaauuguacaa

SEQ ID NO: 4084672 - RNA, 18 nt, Variola virus
ucuugauuacaaaaccaa

SEQ ID NO: 4084673 - RNA, 15 nt, Variola virus
ucuuguauaucuuaa

SEQ ID NO: 4084674 - RNA, 17 nt, Variola virus
ucuuuaauagugucauu

SEQ ID NO: 4084675 - RNA, 23 nt, Variola virus
ucuuuaauaucgacaauuucaua

SEQ ID NO: 4084676 - RNA, 21 nt, Variola virus
ucuuuaccauaacuguauaaa

SEQ ID NO: 4084677 - RNA, 17 nt, Variola virus
ucuuucuaauacuauau

SEQ ID NO: 4084678 - RNA, 17 nt, Variola virus
ucuuucuugggaaacuc

SEQ ID NO: 4084679 - RNA, 17 nt, Variola virus
ucuuugaacuguuuaag

SEQ ID NO: 4084680 - RNA, 19 nt, Variola virus
ucuuugaucacuaccgagu

SEQ ID NO: 4084681 - RNA, 19 nt, Variola virus
ucuuuguccauuauuucua

SEQ ID NO: 4084682 - RNA, 20 nt, Variola virus
ucuuuguugaacguuucaaa

SEQ ID NO: 4084683 - RNA, 12 nt, Variola virus
ucuuuuaaccag

SEQ ID NO: 4084684 - RNA, 16 nt, Variola virus
ucuuuuucccagcauu

SEQ ID NO: 4084685 - RNA, 22 nt, Variola virus
ucuuuuugauuaccuuacucau

SEQ ID NO: 4084686 - RNA, 14 nt, Variola virus
ucuuuuuuacacau

SEQ ID NO: 4084687 - RNA, 13 nt, Variola virus
ugaaaauguaaua

SEQ ID NO: 4084688 - RNA, 21 nt, Variola virus
ugaaaauuaugugaaacagac

SEQ ID NO: 4084689 - RNA, 19 nt, Variola virus
ugaaacauacaacaaagaa

SEQ ID NO: 4084690 - RNA, 16 nt, Variola virus
ugaaacgaacacuauu

SEQ ID NO: 4084691 - RNA, 18 nt, Variola virus
ugaaacuaugucaaaaau

SEQ ID NO: 4084692 - RNA, 13 nt, Variola virus
ugaaauagaagau

SEQ ID NO: 4084693 - RNA, 24 nt, Variola virus
ugaaaugauaccaguaauuuacug

SEQ ID NO: 4084694 - RNA, 16 nt, Variola virus
ugaaaugcuacauaac

SEQ ID NO: 4084695 - RNA, 21 nt, Variola virus
ugaacaagagauauauuggag

SEQ ID NO: 4084696 - RNA, 22 nt, Variola virus
ugaacacuuuauacuucuccaa

SEQ ID NO: 4084697 - RNA, 22 nt, Variola virus
ugaacaggcauugcuaaaacuu

SEQ ID NO: 4084698 - RNA, 13 nt, Variola virus
ugaacaggcauuu

SEQ ID NO: 4084699 - RNA, 18 nt, Variola virus
ugaacauaaaacuaauau

SEQ ID NO: 4084700 - RNA, 13 nt, Variola virus
ugaacauucaucu

SEQ ID NO: 4084701 - RNA, 17 nt, Variola virus
ugaacgcuauuaaacau

SEQ ID NO: 4084702 - RNA, 13 nt, Variola virus
ugaagauacuguu

SEQ ID NO: 4084703 - RNA, 17 nt, Variola virus
ugaagauauagaugagg

SEQ ID NO: 4084704 - RNA, 16 nt, Variola virus
ugaagauaucauuaau

SEQ ID NO: 4084705 - RNA, 21 nt, Variola virus
ugaagauggauucauccuuaa

SEQ ID NO: 4084706 - RNA, 15 nt, Variola virus
ugaagcauuggaagc

SEQ ID NO: 4084707 - RNA, 14 nt, Variola virus
ugaagcucaucuug

SEQ ID NO: 4084708 - RNA, 18 nt, Variola virus
ugaauauaauagauguau

SEQ ID NO: 4084709 - RNA, 20 nt, Variola virus
ugaauaucuaggaguaauua

SEQ ID NO: 4084710 - RNA, 22 nt, Variola virus
ugaaucuauuucugucauuaaa

SEQ ID NO: 4084711 - RNA, 16 nt, Variola virus
ugaaugaauacagauc

SEQ ID NO: 4084712 - RNA, 17 nt, Variola virus
ugaaugguaaagaaugc

SEQ ID NO: 4084713 - RNA, 21 nt, Variola virus
ugaauguuuccuucuuuacca

SEQ ID NO: 4084714 - RNA, 15 nt, Variola virus
ugaauguuugaaaac

SEQ ID NO: 4084715 - RNA, 14 nt, Variola virus
ugaauguuuucaau

SEQ ID NO: 4084716 - RNA, 13 nt, Variola virus
ugaauuaauguaa

SEQ ID NO: 4084717 - RNA, 23 nt, Variola virus
ugaauuuauuucagaaauuauuc

SEQ ID NO: 4084718 - RNA, 17 nt, Variola virus
ugacaaauguaguaaau

SEQ ID NO: 4084719 - RNA, 12 nt, Variola virus
ugacacauauca

SEQ ID NO: 4084720 - RNA, 20 nt, Variola virus
ugacauggcuucuuccauag

SEQ ID NO: 4084721 - RNA, 15 nt, Variola virus
ugacauucaaagauu

SEQ ID NO: 4084722 - RNA, 20 nt, Variola virus
ugacauuuuccuuguaucca

SEQ ID NO: 4084723 - RNA, 20 nt, Variola virus
ugacgaacguauuacuauga

SEQ ID NO: 4084724 - RNA, 18 nt, Variola virus
ugacggaugaucauacau

SEQ ID NO: 4084725 - RNA, 17 nt, Variola virus
ugacguuagacauaaaa

SEQ ID NO: 4084726 - RNA, 17 nt, Variola virus
ugacuagacugauuucu

SEQ ID NO: 4084727 - RNA, 20 nt, Variola virus
ugacuaguuguagaauuuga

SEQ ID NO: 4084728 - RNA, 20 nt, Variola virus
ugacuaucuuuugaaaauau

SEQ ID NO: 4084729 - RNA, 21 nt, Variola virus
ugacuauuguguguaaaguau

SEQ ID NO: 4084730 - RNA, 16 nt, Variola virus
ugacugcuaaagaugc

SEQ ID NO: 4084731 - RNA, 20 nt, Variola virus
ugacuguagaacucaugaau

SEQ ID NO: 4084732 - RNA, 17 nt, Variola virus
ugacuuucgaaccaauu

SEQ ID NO: 4084733 - RNA, 19 nt, Variola virus
ugagauaaauaucaucaau

SEQ ID NO: 4084734 - RNA, 14 nt, Variola virus
ugagauauauacac

SEQ ID NO: 4084735 - RNA, 22 nt, Variola virus
ugagauauuacucaaaauacua

SEQ ID NO: 4084736 - RNA, 17 nt, Variola virus
ugagaucuguaaugcua

SEQ ID NO: 4084737 - RNA, 18 nt, Variola virus
ugagaugacuggaaauca

SEQ ID NO: 4084738 - RNA, 20 nt, Variola virus
ugagauguuauuaaauguug

SEQ ID NO: 4084739 - RNA, 19 nt, Variola virus
ugagauuaaauguaauaac

SEQ ID NO: 4084740 - RNA, 23 nt, Variola virus
ugagauuuguuuuguuaaacaau

SEQ ID NO: 4084741 - RNA, 14 nt, Variola virus
ugaggaaauugaua

SEQ ID NO: 4084742 - RNA, 16 nt, Variola virus
ugaggauuuaaaacuc

SEQ ID NO: 4084743 - RNA, 21 nt, Variola virus
ugaggauuuacuaaguaauua

SEQ ID NO: 4084744 - RNA, 23 nt, Variola virus
ugaguaagacuugacuaaaucgu

SEQ ID NO: 4084745 - RNA, 17 nt, Variola virus
ugaguauaucagaucau

SEQ ID NO: 4084746 - RNA, 17 nt, Variola virus
ugagucuauaucccauu

SEQ ID NO: 4084747 - RNA, 21 nt, Variola virus
ugaguuccuuguuuuugcuaa

SEQ ID NO: 4084748 - RNA, 16 nt, Variola virus
ugaguuuuuaggaaau

SEQ ID NO: 4084749 - RNA, 21 nt, Variola virus
ugauaacguuggcaauacuaa

SEQ ID NO: 4084750 - RNA, 19 nt, Variola virus
ugauaacucguuuuucuua

SEQ ID NO: 4084751 - RNA, 16 nt, Variola virus
ugauaauagauggaua

SEQ ID NO: 4084752 - RNA, 17 nt, Variola virus
ugauaaucaaacacauc

SEQ ID NO: 4084753 - RNA, 16 nt, Variola virus
ugauaauccagucuuu

SEQ ID NO: 4084754 - RNA, 13 nt, Variola virus
ugauaauuuccag

SEQ ID NO: 4084755 - RNA, 16 nt, Variola virus
ugauacaccuguaauc

SEQ ID NO: 4084756 - RNA, 16 nt, Variola virus
ugauacagaaaaucuu

SEQ ID NO: 4084757 - RNA, 20 nt, Variola virus
ugauacggugaugguuuuua

SEQ ID NO: 4084758 - RNA, 16 nt, Variola virus
ugauacuaaguauaau

SEQ ID NO: 4084759 - RNA, 18 nt, Variola virus
ugauagagguagacuucu

SEQ ID NO: 4084760 - RNA, 23 nt, Variola virus
ugauagauacgcguucucuggag

SEQ ID NO: 4084761 - RNA, 11 nt, Variola virus
ugauagauauu

SEQ ID NO: 4084762 - RNA, 21 nt, Variola virus
ugauauacaaugcucaguaaa

SEQ ID NO: 4084763 - RNA, 16 nt, Variola virus
ugauauaguaauauua

SEQ ID NO: 4084764 - RNA, 21 nt, Variola virus
ugauauauccagauuacuaac

SEQ ID NO: 4084765 - RNA, 21 nt, Variola virus
ugauaucaaauggauauugcc

SEQ ID NO: 4084766 - RNA, 22 nt, Variola virus
ugauaugaacagacauuguauu

SEQ ID NO: 4084767 - RNA, 14 nt, Variola virus
ugauaugcauacua

SEQ ID NO: 4084768 - RNA, 18 nt, Variola virus
ugauauguauauuauuca

SEQ ID NO: 4084769 - RNA, 15 nt, Variola virus
ugauauguaugucca

SEQ ID NO: 4084770 - RNA, 19 nt, Variola virus
ugauauuuauuuugcuauc

SEQ ID NO: 4084771 - RNA, 22 nt, Variola virus
ugaucagggcuaacaauaauag

SEQ ID NO: 4084772 - RNA, 20 nt, Variola virus
ugaucauuggcaaaauccua

SEQ ID NO: 4084773 - RNA, 17 nt, Variola virus
ugaucgccauggauggu

SEQ ID NO: 4084774 - RNA, 17 nt, Variola virus
ugaucuauauguuuuau

SEQ ID NO: 4084775 - RNA, 22 nt, Variola virus
ugaucuucaucuaccaaagaaa

SEQ ID NO: 4084776 - RNA, 15 nt, Variola virus
aaaaauuauaauauu

SEQ ID NO: 4084777 - RNA, 12 nt, Variola virus
aaaaauuauccu

SEQ ID NO: 4084778 - RNA, 21 nt, Variola virus
aaaaauugaauugaugauaua

SEQ ID NO: 4084779 - RNA, 21 nt, Variola virus
aaaacauuauucuauuucgaa

SEQ ID NO: 4084780 - RNA, 22 nt, Variola virus
aaaacccuuacaacuacaguag

SEQ ID NO: 4084781 - RNA, 21 nt, Variola virus
aaaacgacuuacaauauguac

SEQ ID NO: 4084782 - RNA, 17 nt, Variola virus
aaaacgauuggaaucua

SEQ ID NO: 4084783 - RNA, 18 nt, Variola virus
aaaacuaucaaugauaug

SEQ ID NO: 4084784 - RNA, 22 nt, Variola virus
aaaacuguccaaauagauguac

SEQ ID NO: 4084785 - RNA, 14 nt, Variola virus
aaaacuuaaauguu

SEQ ID NO: 4084786 - RNA, 19 nt, Variola virus
aaaagacaugauaauauua

SEQ ID NO: 4084787 - RNA, 14 nt, Variola virus
aaaagacuauacau

SEQ ID NO: 4084788 - RNA, 14 nt, Variola virus
aaaagaucauacaa

SEQ ID NO: 4084789 - RNA, 14 nt, Variola virus
aaaagauuauacaa

SEQ ID NO: 4084790 - RNA, 13 nt, Variola virus
aaaagcuuaaaau

SEQ ID NO: 4084791 - RNA, 18 nt, Variola virus
aaaaggaguucaaauagu

SEQ ID NO: 4084792 - RNA, 19 nt, Variola virus
aaaaggcgguaauagaaua

SEQ ID NO: 4084793 - RNA, 13 nt, Variola virus
aaaaguuaaaacu

SEQ ID NO: 4084794 - RNA, 15 nt, Variola virus
aaaaguuaagaauua

SEQ ID NO: 4084795 - RNA, 21 nt, Variola virus
aaaaguuccagaaaauguaga

SEQ ID NO: 4084796 - RNA, 23 nt, Variola virus
aaaauaaauuagucauacguaau

SEQ ID NO: 4084797 - RNA, 16 nt, Variola virus
aaaauaauaucguucu

SEQ ID NO: 4084798 - RNA, 13 nt, Variola virus
aaaauaauaucua

SEQ ID NO: 4084799 - RNA, 16 nt, Variola virus
aaaauacuuaaaaugu

SEQ ID NO: 4084800 - RNA, 13 nt, Variola virus
aaaauauuaucua

SEQ ID NO: 4084801 - RNA, 23 nt, Variola virus
aaaaucaggguuaucaaaguguu

SEQ ID NO: 4084802 - RNA, 18 nt, Variola virus
aaaauccaucaaaaaugu

SEQ ID NO: 4084803 - RNA, 15 nt, Variola virus
aaaaucgauaaacug

SEQ ID NO: 4084804 - RNA, 18 nt, Variola virus
aaaaucuaaacaaauauu

SEQ ID NO: 4084805 - RNA, 18 nt, Variola virus
aaaaugaugcuauuagaa

SEQ ID NO: 4084806 - RNA, 15 nt, Variola virus
aaaaugauuaaauua

SEQ ID NO: 4084807 - RNA, 18 nt, Variola virus
aaaaugcgauguuaauuu

SEQ ID NO: 4084808 - RNA, 17 nt, Variola virus
aaaauguauaacaaaug

SEQ ID NO: 4084809 - RNA, 22 nt, Variola virus
aaaauguauaacaaaugcagaa

SEQ ID NO: 4084810 - RNA, 15 nt, Variola virus
aaaauguuagaauua

SEQ ID NO: 4084811 - RNA, 13 nt, Variola virus
aaaauuauaacua

SEQ ID NO: 4084812 - RNA, 22 nt, Variola virus
aaaauuauacuguaacacaaug

SEQ ID NO: 4084813 - RNA, 13 nt, Variola virus
aaaauuaugugaa

SEQ ID NO: 4084814 - RNA, 14 nt, Variola virus
aaaauucauuagaa

SEQ ID NO: 4084815 - RNA, 16 nt, Variola virus
aaaauucauuagaaua

SEQ ID NO: 4084816 - RNA, 17 nt, Variola virus
aaaauucuaauggauga

SEQ ID NO: 4084817 - RNA, 23 nt, Variola virus
aaacaaggauucguuuacucuca

SEQ ID NO: 4084818 - RNA, 13 nt, Variola virus
aaacaauacagug

SEQ ID NO: 4084819 - RNA, 22 nt, Variola virus
aaacaauuucacaaauggaugu

SEQ ID NO: 4084820 - RNA, 16 nt, Variola virus
aaacacagauagugaa

SEQ ID NO: 4084821 - RNA, 23 nt, Variola virus
aaacacguuuauuuuauauguca

SEQ ID NO: 4084822 - RNA, 19 nt, Variola virus
aaacacuuggauauuguau

SEQ ID NO: 4084823 - RNA, 13 nt, Variola virus
aaacaugugguau

SEQ ID NO: 4084824 - RNA, 21 nt, Variola virus
aaacauugacggauaaaacaa

SEQ ID NO: 4084825 - RNA, 19 nt, Variola virus
aaacauuguucaugauaua

SEQ ID NO: 4084826 - RNA, 21 nt, Variola virus
aaaccaaaucuugauuacaaa

SEQ ID NO: 4084827 - RNA, 22 nt, Variola virus
aaaccaaucaauuauguaaaua

SEQ ID NO: 4084828 - RNA, 20 nt, Variola virus
aaaccaggcgaguguagaaa

SEQ ID NO: 4084829 - RNA, 20 nt, Variola virus
aaaccauuuuucagaaagua

SEQ ID NO: 4084830 - RNA, 21 nt, Variola virus
aaacgaacacuauuagaauua

SEQ ID NO: 4084831 - RNA, 19 nt, Variola virus
aaacgacuuaauuacagag

SEQ ID NO: 4084832 - RNA, 18 nt, Variola virus
aaacgauauucuugaaau

SEQ ID NO: 4084833 - RNA, 14 nt, Variola virus
aaacuaaacuuauu

SEQ ID NO: 4084834 - RNA, 22 nt, Variola virus
aaacucuuuagcgguauaauua

SEQ ID NO: 4084835 - RNA, 24 nt, Variola virus
aaacugguaauccacauaguugua

SEQ ID NO: 4084836 - RNA, 12 nt, Variola virus
aaacuuacagaa

SEQ ID NO: 4084837 - RNA, 21 nt, Variola virus
aaacuuagauuaaaugcugaa

SEQ ID NO: 4084838 - RNA, 18 nt, Variola virus
aaacuuauuuagaauauc

SEQ ID NO: 4084839 - RNA, 22 nt, Variola virus
aaacuucaaucuguuaagauua

SEQ ID NO: 4084840 - RNA, 20 nt, Variola virus
aaacuuccucauuaagauug

SEQ ID NO: 4084841 - RNA, 19 nt, Variola virus
aaacuucguaaaauauucu

SEQ ID NO: 4084842 - RNA, 19 nt, Variola virus
aaacuugauaauuaauaau

SEQ ID NO: 4084843 - RNA, 13 nt, Variola virus
aaacuugcaaaga

SEQ ID NO: 4084844 - RNA, 21 nt, Variola virus
aaacuuuaauaacaaagaaag

SEQ ID NO: 4084845 - RNA, 22 nt, Variola virus
aaacuuuagaagaauaucucaa

SEQ ID NO: 4084846 - RNA, 14 nt, Variola virus
aaacuuuuagaaau

SEQ ID NO: 4084847 - RNA, 14 nt, Variola virus
aaagaaccauuaca

SEQ ID NO: 4084848 - RNA, 17 nt, Variola virus
aaagaaugagauacaua

SEQ ID NO: 4084849 - RNA, 21 nt, Variola virus
aaagacaucauauauagaaug

SEQ ID NO: 4084850 - RNA, 17 nt, Variola virus
aaagacuguagaagcua

SEQ ID NO: 4084851 - RNA, 12 nt, Variola virus
aaagaucauauu

SEQ ID NO: 4084852 - RNA, 16 nt, Variola virus
aaagauuaauuauccg

SEQ ID NO: 4084853 - RNA, 13 nt, Variola virus
aaagauuuaagaa

SEQ ID NO: 4084854 - RNA, 19 nt, Variola virus
aaagcaagaccaaacaccg

SEQ ID NO: 4084855 - RNA, 13 nt, Variola virus
aaagcuguuguau

SEQ ID NO: 4084856 - RNA, 17 nt, Variola virus
aaaggacagaaauauau

SEQ ID NO: 4084857 - RNA, 16 nt, Variola virus
aaaggaugauacauua

SEQ ID NO: 4084858 - RNA, 16 nt, Variola virus
aaaggccuuguaacuu

SEQ ID NO: 4084859 - RNA, 18 nt, Variola virus
aaagggauauauauugca

SEQ ID NO: 4084860 - RNA, 19 nt, Variola virus
aaagggcaauaguuugcgu

SEQ ID NO: 4084861 - RNA, 13 nt, Variola virus
aaagguguguacu

SEQ ID NO: 4084862 - RNA, 19 nt, Variola virus
aaaguaauauucauaugua

SEQ ID NO: 4084863 - RNA, 13 nt, Variola virus
aaaguaauucauu

SEQ ID NO: 4084864 - RNA, 16 nt, Variola virus
aaaguauacauguuag

SEQ ID NO: 4084865 - RNA, 16 nt, Variola virus
aaaguaucacagaauc

SEQ ID NO: 4084866 - RNA, 22 nt, Variola virus
aaaguauccaucacuucuaucu

SEQ ID NO: 4084867 - RNA, 17 nt, Variola virus
aaagucaucucuuguau

SEQ ID NO: 4084868 - RNA, 15 nt, Variola virus
aaagucugaucuuaa

SEQ ID NO: 4084869 - RNA, 14 nt, Variola virus
aaagucuuuaguau

SEQ ID NO: 4084870 - RNA, 12 nt, Variola virus
aaaguuaaaagu

SEQ ID NO: 4084871 - RNA, 16 nt, Variola virus
aaaguuaaucauauag

SEQ ID NO: 4084872 - RNA, 16 nt, Variola virus
aacgucauaaaaaugu

SEQ ID NO: 4084873 - RNA, 14 nt, Variola virus
aacgucuaaaugua

SEQ ID NO: 4084874 - RNA, 16 nt, Variola virus
aacgugauggauauau

SEQ ID NO: 4084875 - RNA, 12 nt, Variola virus
aacgugucaucu

SEQ ID NO: 4084876 - RNA, 16 nt, Variola virus
aacguuccguaucugu

SEQ ID NO: 4084877 - RNA, 16 nt, Variola virus
aacuaaaaaucaaacu

SEQ ID NO: 4084878 - RNA, 16 nt, Variola virus
aacuaaaauuaaacau

SEQ ID NO: 4084879 - RNA, 16 nt, Variola virus
aacuaauacaucugaa

SEQ ID NO: 4084880 - RNA, 13 nt, Variola virus
aacuacuuuauca

SEQ ID NO: 4084881 - RNA, 16 nt, Variola virus
aacuagaguaaaaauc

SEQ ID NO: 4084882 - RNA, 14 nt, Variola virus
aacuaggaaauugg

SEQ ID NO: 4084883 - RNA, 21 nt, Variola virus
aacuauaaguguguuguaaac

SEQ ID NO: 4084884 - RNA, 20 nt, Variola virus
aacuauaauggugcuuguau

SEQ ID NO: 4084885 - RNA, 14 nt, Variola virus
aacuauauaaugaa

SEQ ID NO: 4084886 - RNA, 13 nt, Variola virus
aacuaucaaacaa

SEQ ID NO: 4084887 - RNA, 14 nt, Variola virus
aacuaucuguaaaa

SEQ ID NO: 4084888 - RNA, 16 nt, Variola virus
aacuauuaauauuaac

SEQ ID NO: 4084889 - RNA, 14 nt, Variola virus
aacuauucaguagu

SEQ ID NO: 4084890 - RNA, 17 nt, Variola virus
aacuauuccaauguuua

SEQ ID NO: 4084891 - RNA, 16 nt, Variola virus
aaaguuuuauauguag

SEQ ID NO: 4084892 - RNA, 22 nt, Variola virus
aaaguuuuuaagagauaaucua

SEQ ID NO: 4084893 - RNA, 20 nt, Variola virus
aaauaaaaagguagauguuc

SEQ ID NO: 4084894 - RNA, 14 nt, Variola virus
aaauaaaacuauag

SEQ ID NO: 4084895 - RNA, 16 nt, Variola virus
aaauaaaauacauuua

SEQ ID NO: 4084896 - RNA, 23 nt, Variola virus
aaauaaaccuuuggaauuaguau

SEQ ID NO: 4084897 - RNA, 15 nt, Variola virus
aaauaauuagaacua

SEQ ID NO: 4084898 - RNA, 13 nt, Variola virus
aaauacauaaaga

SEQ ID NO: 4084899 - RNA, 16 nt, Variola virus
aaauacauguaacaaa

SEQ ID NO: 4084900 - RNA, 15 nt, Variola virus
aaauagauagaacua

SEQ ID NO: 4084901 - RNA, 16 nt, Variola virus
aaauagauagaacuac

SEQ ID NO: 4084902 - RNA, 22 nt, Variola virus
aaauaggaguuagaauaauaau

SEQ ID NO: 4084903 - RNA, 16 nt, Variola virus
aaauagguacucuguu

SEQ ID NO: 4084904 - RNA, 12 nt, Variola virus
aaauauauuguu

SEQ ID NO: 4084905 - RNA, 17 nt, Variola virus
aaauaucauaaauauau

SEQ ID NO: 4084906 - RNA, 15 nt, Variola virus
aaauaucuauaugau

SEQ ID NO: 4084907 - RNA, 14 nt, Variola virus
aaauaucucaaaga

SEQ ID NO: 4084908 - RNA, 17 nt, Variola virus
aaauaucuuuaauacag

SEQ ID NO: 4084909 - RNA, 17 nt, Variola virus
aaauaugucuuuguuaa

SEQ ID NO: 4084910 - RNA, 19 nt, Variola virus
aaauauuaauaaaguauau

SEQ ID NO: 4084911 - RNA, 21 nt, Variola virus
aaaucaaaacaaaauucauua

SEQ ID NO: 4084912 - RNA, 18 nt, Variola virus
aaaucaaaauccauauca

SEQ ID NO: 4084913 - RNA, 19 nt, Variola virus
aaaucagaugcuguaaauu

SEQ ID NO: 4084914 - RNA, 20 nt, Variola virus
aaaucauuaaaugauuguau

SEQ ID NO: 4084915 - RNA, 24 nt, Variola virus
aaauccaaauugcgacacuauuca

SEQ ID NO: 4084916 - RNA, 20 nt, Variola virus
aaauccacuugauacagcca

SEQ ID NO: 4084917 - RNA, 20 nt, Variola virus
aaauccauguaaaaaaaugu

SEQ ID NO: 4084918 - RNA, 14 nt, Variola virus
aaaucccaaauguu

SEQ ID NO: 4084919 - RNA, 23 nt, Variola virus
aaaucggauggauugguaacauu

SEQ ID NO: 4084920 - RNA, 13 nt, Variola virus
aaaucuaacuucu

SEQ ID NO: 4084921 - RNA, 15 nt, Variola virus
aaaucuugauuacaa

SEQ ID NO: 4084922 - RNA, 23 nt, Variola virus
aaaugauucuaucuacaucuuca

SEQ ID NO: 4084923 - RNA, 13 nt, Variola virus
aaaugcauacuug

SEQ ID NO: 4084924 - RNA, 14 nt, Variola virus
aaauggaucucaua

SEQ ID NO: 4084925 - RNA, 17 nt, Variola virus
aaaugguaaauacugua

SEQ ID NO: 4084926 - RNA, 22 nt, Variola virus
aaaugguguaacucucuggaag

SEQ ID NO: 4084927 - RNA, 22 nt, Variola virus
aaauguauguguugaacaucag

SEQ ID NO: 4084928 - RNA, 17 nt, Variola virus
aaauguuuauaguauua

SEQ ID NO: 4084929 - RNA, 22 nt, Variola virus
aaauguuugauaaaaauaugua

SEQ ID NO: 4084930 - RNA, 14 nt, Variola virus
aaauuaaaaaagau

SEQ ID NO: 4084931 - RNA, 12 nt, Variola virus
aaauuaaagucu

SEQ ID NO: 4084932 - RNA, 14 nt, Variola virus
aaauuaauauuucu

SEQ ID NO: 4084933 - RNA, 20 nt, Variola virus
aaauuauaucuaguggauua

SEQ ID NO: 4084934 - RNA, 15 nt, Variola virus
aaauuaucaaauguu

SEQ ID NO: 4084935 - RNA, 14 nt, Variola virus
aaauuauucguuua

SEQ ID NO: 4084936 - RNA, 21 nt, Variola virus
aaauucuuaguuauauauacu

SEQ ID NO: 4084937 - RNA, 22 nt, Variola virus
aaauugcgacacuauucaugua

SEQ ID NO: 4084938 - RNA, 23 nt, Variola virus
aaauugcgacacuauucauguaa

SEQ ID NO: 4084939 - RNA, 21 nt, Variola virus
aaauugguacucuaucauaau

SEQ ID NO: 4084940 - RNA, 13 nt, Variola virus
aaauuuaccacua

SEQ ID NO: 4084941 - RNA, 14 nt, Variola virus
aaauuuauuauuua

SEQ ID NO: 4084942 - RNA, 20 nt, Variola virus
aaauuuauuuaucaauuuua

SEQ ID NO: 4084943 - RNA, 17 nt, Variola virus
aaauuuccauuagauua

SEQ ID NO: 4084944 - RNA, 19 nt, Variola virus
aaauuugcaucuacaucau

SEQ ID NO: 4084945 - RNA, 22 nt, Variola virus
aaauuuguucgucugucaugau

SEQ ID NO: 4084946 - RNA, 16 nt, Variola virus
aaauuuuuaauccaaa

SEQ ID NO: 4084947 - RNA, 19 nt, Variola virus
aaauuuuuuauuucaguau

SEQ ID NO: 4084948 - RNA, 20 nt, Variola virus
aaauuuuuuuuacaaacauu

SEQ ID NO: 4084949 - RNA, 12 nt, Variola virus
aacaaaauacuc

SEQ ID NO: 4084950 - RNA, 14 nt, Variola virus
aacaaacaucucac

SEQ ID NO: 4084951 - RNA, 17 nt, Variola virus
aacaaauagacuuuuua

SEQ ID NO: 4084952 - RNA, 17 nt, Variola virus
aacaaauguuggagaaa

SEQ ID NO: 4084953 - RNA, 18 nt, Variola virus
aacaacaaauaaaaaggu

SEQ ID NO: 4084954 - RNA, 17 nt, Variola virus
aacaaccaaaaaaauau

SEQ ID NO: 4084955 - RNA, 14 nt, Variola virus
aacaagaaaguuau

SEQ ID NO: 4084956 - RNA, 18 nt, Variola virus
aacaagguaccgaaucua

SEQ ID NO: 4084957 - RNA, 19 nt, Variola virus
aacaaggugacuauaaagu

SEQ ID NO: 4084958 - RNA, 17 nt, Variola virus
aacaauaucguuauuau

SEQ ID NO: 4084959 - RNA, 15 nt, Variola virus
aacaaucugucgaaa

SEQ ID NO: 4084960 - RNA, 14 nt, Variola virus
aacaaugucaaaau

SEQ ID NO: 4084961 - RNA, 16 nt, Variola virus
aacaauuuugucagua

SEQ ID NO: 4084962 - RNA, 16 nt, Variola virus
aacacaacaaaugaua

SEQ ID NO: 4084963 - RNA, 23 nt, Variola virus
aacacacacugagaaacagcaua

SEQ ID NO: 4084964 - RNA, 17 nt, Variola virus
aacacacgaugaaaaug

SEQ ID NO: 4084965 - RNA, 12 nt, Variola virus
aacacagccaua

SEQ ID NO: 4084966 - RNA, 17 nt, Variola virus
aacacauccgucaaaga

SEQ ID NO: 4084967 - RNA, 22 nt, Variola virus
aacaccuugugcauuauguaaa

SEQ ID NO: 4084968 - RNA, 20 nt, Variola virus
aacacguuaaacaaaaaucu

SEQ ID NO: 4084969 - RNA, 22 nt, Variola virus
aacacuaaaaaauaaacacaua

SEQ ID NO: 4084970 - RNA, 13 nt, Variola virus
aacacuauuagaa

SEQ ID NO: 4084971 - RNA, 20 nt, Variola virus
aacacuuuauacuucuccaa

SEQ ID NO: 4084972 - RNA, 15 nt, Variola virus
aacagaaaaaacaau

SEQ ID NO: 4084973 - RNA, 15 nt, Variola virus
aacagauaguuuauu

SEQ ID NO: 4084974 - RNA, 21 nt, Variola virus
aacagauauaguuuuucugga

SEQ ID NO: 4084975 - RNA, 21 nt, Variola virus
aacaggucgcuauauccacca

SEQ ID NO: 4084976 - RNA, 12 nt, Variola virus
aacaguauuauu

SEQ ID NO: 4084977 - RNA, 19 nt, Variola virus
aacagucacgauaucucuu

SEQ ID NO: 4084978 - RNA, 23 nt, Variola virus
aacagucuccuaauauaacagua

SEQ ID NO: 4084979 - RNA, 15 nt, Variola virus
aacagugaguuuauc

SEQ ID NO: 4084980 - RNA, 21 nt, Variola virus
aacaguucuaccaccaguaau

SEQ ID NO: 4084981 - RNA, 14 nt, Variola virus
aacauaaaaacugu

SEQ ID NO: 4084982 - RNA, 16 nt, Variola virus
aacaucacgaaaucua

SEQ ID NO: 4084983 - RNA, 12 nt, Variola virus
aacaucagaaac

SEQ ID NO: 4084984 - RNA, 22 nt, Variola virus
aacaucguaucuucaaaaaggu

SEQ ID NO: 4084985 - RNA, 15 nt, Variola virus
aacaucuaacuauau

SEQ ID NO: 4084986 - RNA, 22 nt, Variola virus
aacaucucagacagucuggucu

SEQ ID NO: 4084987 - RNA, 14 nt, Variola virus
aacaucuuuaaucu

SEQ ID NO: 4084988 - RNA, 21 nt, Variola virus
aacaucuuuguaaacagauau

SEQ ID NO: 4084989 - RNA, 14 nt, Variola virus
aacauuaacagauu

SEQ ID NO: 4084990 - RNA, 19 nt, Variola virus
aacauuaauacaaacgaua

SEQ ID NO: 4084991 - RNA, 20 nt, Variola virus
aacauuauaucguuaucauu

SEQ ID NO: 4084992 - RNA, 16 nt, Variola virus
aacauuccaaagauca

SEQ ID NO: 4084993 - RNA, 16 nt, Variola virus
aacauucuuucaaaga

SEQ ID NO: 4084994 - RNA, 17 nt, Variola virus
aacauuuccuacauaua

SEQ ID NO: 4084995 - RNA, 17 nt, Variola virus
aacauuuuauuucuaga

SEQ ID NO: 4084996 - RNA, 14 nt, Variola virus
aaccaacuacagaa

SEQ ID NO: 4084997 - RNA, 20 nt, Variola virus
aaccagguaggcaguuuuau

SEQ ID NO: 4084998 - RNA, 16 nt, Variola virus
aaccaugagugugaaa

SEQ ID NO: 4084999 - RNA, 14 nt, Variola virus
aaccauucauuaau

SEQ ID NO: 4085000 - RNA, 21 nt, Variola virus
aaccauucauuaauuucugau

SEQ ID NO: 4085001 - RNA, 14 nt, Variola virus
aaccauucuaaaca

SEQ ID NO: 4085002 - RNA, 22 nt, Variola virus
aaccucacuguuaaaaauaugu

SEQ ID NO: 4085003 - RNA, 15 nt, Variola virus
aacgaauaaacaauu

SEQ ID NO: 4085004 - RNA, 15 nt, Variola virus
aacgaggacaaacua

SEQ ID NO: 4085005 - RNA, 17 nt, Variola virus
aacgauaccaucuucug

SEQ ID NO: 4085006 - RNA, 14 nt, Variola virus
aacgauauuaaccu

SEQ ID NO: 4085007 - RNA, 15 nt, Variola virus
aacgauauuugugaa

SEQ ID NO: 4085008 - RNA, 19 nt, Variola virus
aacgaugccuuuuguaaau

SEQ ID NO: 4085009 - RNA, 16 nt, Variola virus
aacgauuauuucuaaa

SEQ ID NO: 4085010 - RNA, 23 nt, Variola virus
aacgauugguauuuguacaggua

SEQ ID NO: 4085011 - RNA, 22 nt, Variola virus
aacgccuauucgaaauuagaaa

SEQ ID NO: 4085012 - RNA, 14 nt, Variola virus
aacgccuuagaaau

SEQ ID NO: 4085013 - RNA, 14 nt, Variola virus
aacgccuuuagaaa

SEQ ID NO: 4085014 - RNA, 22 nt, Variola virus
aacgcguaauugguauauguau

SEQ ID NO: 4085015 - RNA, 21 nt, Variola virus
aacggagaauaucuauacaua

SEQ ID NO: 4085016 - RNA, 22 nt, Variola virus
aacggcgagaagacaauauuau

SEQ ID NO: 4085017 - RNA, 14 nt, Variola virus
aacgguauaugaau

SEQ ID NO: 4085018 - RNA, 16 nt, Variola virus
aacguacaaauggaua

SEQ ID NO: 4085019 - RNA, 18 nt, Variola virus
aacguauuaaauauuaau

SEQ ID NO: 4085020 - RNA, 19 nt, Variola virus
uucccaaauaaucauucau

SEQ ID NO: 4085021 - RNA, 15 nt, Variola virus
uucccaaauaguuuu

SEQ ID NO: 4085022 - RNA, 17 nt, Variola virus
uuccgccguauccauaa

SEQ ID NO: 4085023 - RNA, 23 nt, Variola virus
uuccuagauauuuaaaauaaucc

SEQ ID NO: 4085024 - RNA, 13 nt, Variola virus
uuccuccauaauu

SEQ ID NO: 4085025 - RNA, 21 nt, Variola virus
uuccuuuacgugauaaaucau

SEQ ID NO: 4085026 - RNA, 21 nt, Variola virus
uucgaggaauaauaagaacaa

SEQ ID NO: 4085027 - RNA, 16 nt, Variola virus
uucgauagauauucuu

SEQ ID NO: 4085028 - RNA, 15 nt, Variola virus
uucgauauauguucc

SEQ ID NO: 4085029 - RNA, 18 nt, Variola virus
uucggaucguaaaucugu

SEQ ID NO: 4085030 - RNA, 23 nt, Variola virus
uucguaaaaaaguuaaaacuugu

SEQ ID NO: 4085031 - RNA, 16 nt, Variola virus
uucgucgaauaaugua

SEQ ID NO: 4085032 - RNA, 19 nt, Variola virus
uucgucuucccaaaauguu

SEQ ID NO: 4085033 - RNA, 21 nt, Variola virus
uucuaaacccaaaauguaugu

SEQ ID NO: 4085034 - RNA, 16 nt, Variola virus
uucuaagguagaaucu

SEQ ID NO: 4085035 - RNA, 18 nt, Variola virus
uucuaauacauaauucuu

SEQ ID NO: 4085036 - RNA, 12 nt, Variola virus
uucuaauacuau

SEQ ID NO: 4085037 - RNA, 16 nt, Variola virus
uucuacaacauuauua

SEQ ID NO: 4085038 - RNA, 20 nt, Variola virus
uucuacgaaaggagagaaug

SEQ ID NO: 4085039 - RNA, 19 nt, Variola virus
uucuacgauuuuauuucuu

SEQ ID NO: 4085040 - RNA, 22 nt, Variola virus
uucuacuaugcaauuaccaaaa

SEQ ID NO: 4085041 - RNA, 22 nt, Variola virus
uucuagaaguugauacaacaua

SEQ ID NO: 4085042 - RNA, 14 nt, Variola virus
uucuagucuagaaa

SEQ ID NO: 4085043 - RNA, 22 nt, Variola virus
uucuauaacuugagacuugaua

SEQ ID NO: 4085044 - RNA, 15 nt, Variola virus
uucuauacauagaug

SEQ ID NO: 4085045 - RNA, 20 nt, Variola virus
uucuauaccaauauuauucu

SEQ ID NO: 4085046 - RNA, 13 nt, Variola virus
uucuauuauuaca

SEQ ID NO: 4085047 - RNA, 16 nt, Variola virus
uucuauuuuuaauuuu

SEQ ID NO: 4085048 - RNA, 23 nt, Variola virus
uucuccaugaauuaauacauauu

SEQ ID NO: 4085049 - RNA, 19 nt, Variola virus
uucuccggccacuauuauu

SEQ ID NO: 4085050 - RNA, 12 nt, Variola virus
uucucuagauac

SEQ ID NO: 4085051 - RNA, 13 nt, Variola virus
uucugaauuauug

SEQ ID NO: 4085052 - RNA, 21 nt, Variola virus
uucuggaauaggauaauaauu

SEQ ID NO: 4085053 - RNA, 16 nt, Variola virus
uucuggauauguuuuu

SEQ ID NO: 4085054 - RNA, 16 nt, Variola virus
uucugucaacaauguc

SEQ ID NO: 4085055 - RNA, 12 nt, Variola virus
uucuuacaauua

SEQ ID NO: 4085056 - RNA, 17 nt, Variola virus
uucuuaccaacaucuua

SEQ ID NO: 4085057 - RNA, 18 nt, Variola virus
uucuucaauaaaaugaaa

SEQ ID NO: 4085058 - RNA, 16 nt, Variola virus
uucuucagaauaauag

SEQ ID NO: 4085059 - RNA, 23 nt, Variola virus
uucuucauuuauggguaucaaaa

SEQ ID NO: 4085060 - RNA, 20 nt, Variola virus
uucuuccaacucuguuuuaa

SEQ ID NO: 4085061 - RNA, 15 nt, Variola virus
uucuuggauaaaagc

SEQ ID NO: 4085062 - RNA, 20 nt, Variola virus
uucuuggauauagaauccaa

SEQ ID NO: 4085063 - RNA, 20 nt, Variola virus
uugaaauuguuuuuuauuuu

SEQ ID NO: 4085064 - RNA, 19 nt, Variola virus
uugaauaggaguuugaaua

SEQ ID NO: 4085065 - RNA, 22 nt, Variola virus
uugaaucucuguggaaauuaga

SEQ ID NO: 4085066 - RNA, 19 nt, Variola virus
uugaauggauacuaguuuu

SEQ ID NO: 4085067 - RNA, 15 nt, Variola virus
uugacaaauuauucu

SEQ ID NO: 4085068 - RNA, 16 nt, Variola virus
uugacggccgucauca

SEQ ID NO: 4085069 - RNA, 21 nt, Variola virus
uugacuacauucaggaaacua

SEQ ID NO: 4085070 - RNA, 21 nt, Variola virus
uugacucaugacuucauugau

SEQ ID NO: 4085071 - RNA, 21 nt, Variola virus
uugagaaaagguucuaucaac

SEQ ID NO: 4085072 - RNA, 16 nt, Variola virus
uugagacuaucaacag

SEQ ID NO: 4085073 - RNA, 18 nt, Variola virus
uugauaaagauagaugau

SEQ ID NO: 4085074 - RNA, 18 nt, Variola virus
uugauaacucguuuuucu

SEQ ID NO: 4085075 - RNA, 16 nt, Variola virus
uugauacggcuauucu

SEQ ID NO: 4085076 - RNA, 15 nt, Variola virus
uugaucauguagaaa

SEQ ID NO: 4085077 - RNA, 20 nt, Variola virus
uugauccuagaacuagauau

SEQ ID NO: 4085078 - RNA, 18 nt, Variola virus
uugaugaaguucgaugau

SEQ ID NO: 4085079 - RNA, 14 nt, Variola virus
uugauuaguauaac

SEQ ID NO: 4085080 - RNA, 13 nt, Variola virus
uugauuuuggaua

SEQ ID NO: 4085081 - RNA, 20 nt, Variola virus
uugcacaauccaaacuuuuu

SEQ ID NO: 4085082 - RNA, 22 nt, Variola virus
uugccuccggagucauaaaagg

SEQ ID NO: 4085083 - RNA, 13 nt, Variola virus
uugcgacacuauu

SEQ ID NO: 4085084 - RNA, 20 nt, Variola virus
uugcguacauugcucguaaa

SEQ ID NO: 4085085 - RNA, 19 nt, Variola virus
uugcucaaauaauacuaua

SEQ ID NO: 4085086 - RNA, 22 nt, Variola virus
uuggagaaacggcaacuggaaa

SEQ ID NO: 4085087 - RNA, 13 nt, Variola virus
uugguuucuaaau

SEQ ID NO: 4085088 - RNA, 15 nt, Variola virus
uuguacauguaauga

SEQ ID NO: 4085089 - RNA, 13 nt, Variola virus
uuguauaugugau

SEQ ID NO: 4085090 - RNA, 16 nt, Variola virus
uuguauccuuaucuau

SEQ ID NO: 4085091 - RNA, 12 nt, Variola virus
uugucagauuca

SEQ ID NO: 4085092 - RNA, 13 nt, Variola virus
uugucgcacuaua

SEQ ID NO: 4085093 - RNA, 12 nt, Variola virus
uugucuagauaa

SEQ ID NO: 4085094 - RNA, 19 nt, Variola virus
uugucuccuccuccguaaa

SEQ ID NO: 4085095 - RNA, 24 nt, Variola virus
uugucuuuaaguauauacgauaag

SEQ ID NO: 4085096 - RNA, 14 nt, Variola virus
uugugauuguauuu

SEQ ID NO: 4085097 - RNA, 11 nt, Variola virus
uuuaaaaucau

SEQ ID NO: 4085098 - RNA, 19 nt, Variola virus
cacuaguuaagaacauguc

SEQ ID NO: 4085099 - RNA, 21 nt, Variola virus
cacuaucaaucgauaacaagg

SEQ ID NO: 4085100 - RNA, 19 nt, Variola virus
cacuauguuagcauuucua

SEQ ID NO: 4085101 - RNA, 16 nt, Variola virus
cacucuucgaaaagaa

SEQ ID NO: 4085102 - RNA, 13 nt, Variola virus
cacugcagcauuu

SEQ ID NO: 4085103 - RNA, 23 nt, Variola virus
cacugggguaaaguaaguaucua

SEQ ID NO: 4085104 - RNA, 21 nt, Variola virus
cacugucuggcaauaaaugau

SEQ ID NO: 4085105 - RNA, 15 nt, Variola virus
cacuguggaugugac

SEQ ID NO: 4085106 - RNA, 20 nt, Variola virus
cacuuaaaucgauauaacag

SEQ ID NO: 4085107 - RNA, 19 nt, Variola virus
cacuuaauggcauaaugau

SEQ ID NO: 4085108 - RNA, 16 nt, Variola virus
cacuuacagaaaagau

SEQ ID NO: 4085109 - RNA, 16 nt, Variola virus
cacuucuauaguaucu

SEQ ID NO: 4085110 - RNA, 13 nt, Variola virus
cagaaaaaacaau

SEQ ID NO: 4085111 - RNA, 13 nt, Variola virus
cagaaaagauauu

SEQ ID NO: 4085112 - RNA, 17 nt, Variola virus
cagaaagcuguggaugu

SEQ ID NO: 4085113 - RNA, 16 nt, Variola virus
cagaaauauauauauu

SEQ ID NO: 4085114 - RNA, 22 nt, Variola virus
cagaaauuaguuuagagucaaa

SEQ ID NO: 4085115 - RNA, 20 nt, Variola virus
cagaaauugguauaaauguu

SEQ ID NO: 4085116 - RNA, 12 nt, Variola virus
cagaacuauuag

SEQ ID NO: 4085117 - RNA, 13 nt, Variola virus
cagaacuauuuuu

SEQ ID NO: 4085118 - RNA, 18 nt, Variola virus
cagaagaauaugaugauu

SEQ ID NO: 4085119 - RNA, 22 nt, Variola virus
cagaauagcggauauagauauu

SEQ ID NO: 4085120 - RNA, 18 nt, Variola virus
cagaauauauaagacaca

SEQ ID NO: 4085121 - RNA, 17 nt, Variola virus
cagaaucaguauauauu

SEQ ID NO: 4085122 - RNA, 17 nt, Variola virus
cagaaucccuuuccaaa

SEQ ID NO: 4085123 - RNA, 21 nt, Variola virus
cagacaaucacguacaaagaa

SEQ ID NO: 4085124 - RNA, 17 nt, Variola virus
cagacacagacgauauu

SEQ ID NO: 4085125 - RNA, 14 nt, Variola virus
cagacauacaguag

SEQ ID NO: 4085126 - RNA, 14 nt, Variola virus
cagaccucucuuaa

SEQ ID NO: 4085127 - RNA, 17 nt, Variola virus
cagacucauuauuuccc

SEQ ID NO: 4085128 - RNA, 12 nt, Variola virus
cagacugugcau

SEQ ID NO: 4085129 - RNA, 21 nt, Variola virus
cagagaggcggucuugauauu

SEQ ID NO: 4085130 - RNA, 19 nt, Variola virus
cagagcagucuuucuaaag

SEQ ID NO: 4085131 - RNA, 14 nt, Variola virus
cagaggaacgccau

SEQ ID NO: 4085132 - RNA, 15 nt, Variola virus
cagaggaguuauuua

SEQ ID NO: 4085133 - RNA, 15 nt, Variola virus
cagagguuguauuua

SEQ ID NO: 4085134 - RNA, 14 nt, Variola virus
cagaguuauccauu

SEQ ID NO: 4085135 - RNA, 14 nt, Variola virus
cagaguuuagauua

SEQ ID NO: 4085136 - RNA, 17 nt, Variola virus
cagauacauuauaugau

SEQ ID NO: 4085137 - RNA, 12 nt, Variola virus
cagauagaaaau

SEQ ID NO: 4085138 - RNA, 21 nt, Variola virus
cagauauuccgacaaaggauu

SEQ ID NO: 4085139 - RNA, 22 nt, Variola virus
cagaucaaaaaauauaguucca

SEQ ID NO: 4085140 - RNA, 11 nt, Variola virus
cagaugauauc

SEQ ID NO: 4085141 - RNA, 17 nt, Variola virus
cagaugcuguaaauuau

SEQ ID NO: 4085142 - RNA, 22 nt, Variola virus
cagauguaaauauaucuacaau

SEQ ID NO: 4085143 - RNA, 16 nt, Variola virus
cagaugucaugauauu

SEQ ID NO: 4085144 - RNA, 16 nt, Variola virus
cagauuuuaaaaacug

SEQ ID NO: 4085145 - RNA, 13 nt, Variola virus
cagauuuuaauau

SEQ ID NO: 4085146 - RNA, 19 nt, Variola virus
cagcacggugguagauaua

SEQ ID NO: 4085147 - RNA, 21 nt, Variola virus
cagcauagacuuugccacaac

SEQ ID NO: 4085148 - RNA, 14 nt, Variola virus
cagcaucagcauuu

SEQ ID NO: 4085149 - RNA, 19 nt, Variola virus
cagcuauguuaucaugaaa

SEQ ID NO: 4085150 - RNA, 21 nt, Variola virus
cagcuccccuacguaucuaua

SEQ ID NO: 4085151 - RNA, 13 nt, Variola virus
caggaacuaugac

SEQ ID NO: 4085152 - RNA, 13 nt, Variola virus
caggaacuauuaa

SEQ ID NO: 4085153 - RNA, 14 nt, Variola virus
caggaauagaugua

SEQ ID NO: 4085154 - RNA, 19 nt, Variola virus
caggauuuccaaucuuuug

SEQ ID NO: 4085155 - RNA, 15 nt, Variola virus
caggcucuauuuuca

SEQ ID NO: 4085156 - RNA, 23 nt, Variola virus
cagggacacucaaacuaaauguc

SEQ ID NO: 4085157 - RNA, 16 nt, Variola virus
caggggaaugaacagc

SEQ ID NO: 4085158 - RNA, 16 nt, Variola virus
cagguauacuguucag

SEQ ID NO: 4085159 - RNA, 15 nt, Variola virus
caguaagaacauaau

SEQ ID NO: 4085160 - RNA, 20 nt, Variola virus
caguaauauacugaucccua

SEQ ID NO: 4085161 - RNA, 17 nt, Variola virus
caguacacgaaugauuu

SEQ ID NO: 4085162 - RNA, 17 nt, Variola virus
caguaccauuaucuuug

SEQ ID NO: 4085163 - RNA, 23 nt, Variola virus
caguaccuugacuaaagucuuua

SEQ ID NO: 4085164 - RNA, 17 nt, Variola virus
caguacucauuaucaua

SEQ ID NO: 4085165 - RNA, 13 nt, Variola virus
caguagucauugu

SEQ ID NO: 4085166 - RNA, 23 nt, Variola virus
caguauugggacaacuuaaucug

SEQ ID NO: 4085167 - RNA, 14 nt, Variola virus
cagucuuuaaugaa

SEQ ID NO: 4085168 - RNA, 22 nt, Variola virus
cagugaagaagugucuauaaau

SEQ ID NO: 4085169 - RNA, 17 nt, Variola virus
cagugacgucuguggau

SEQ ID NO: 4085170 - RNA, 20 nt, Variola virus
cagugacgucuguggaugga

SEQ ID NO: 4085171 - RNA, 21 nt, Variola virus
cagugggugguucuguaucac

SEQ ID NO: 4085172 - RNA, 22 nt, Variola virus
cagugguuuuauuuuauccuug

SEQ ID NO: 4085173 - RNA, 21 nt, Variola virus
caguguccgaugauuaaugac

SEQ ID NO: 4085174 - RNA, 17 nt, Variola virus
caguuuauuauccacua

SEQ ID NO: 4085175 - RNA, 16 nt, Variola virus
cauaaacaauauaaau

SEQ ID NO: 4085176 - RNA, 21 nt, Variola virus
cauaaacaauauuaaggagau

SEQ ID NO: 4085177 - RNA, 22 nt, Variola virus
cauaaauaguaaauacaauaau

SEQ ID NO: 4085178 - RNA, 19 nt, Variola virus
cauaacaaauguauacuau

SEQ ID NO: 4085179 - RNA, 12 nt, Variola virus
cauaacauaauu

SEQ ID NO: 4085180 - RNA, 15 nt, Variola virus
cauaacauguaucaa

SEQ ID NO: 4085181 - RNA, 13 nt, Variola virus
cauaauuacagaa

SEQ ID NO: 4085182 - RNA, 16 nt, Variola virus
cauacacuacaguaag

SEQ ID NO: 4085183 - RNA, 18 nt, Variola virus
cauacauuuguaaaagua

SEQ ID NO: 4085184 - RNA, 20 nt, Variola virus
cauacuaggagccaucauuu

SEQ ID NO: 4085185 - RNA, 20 nt, Variola virus
cauacuccaucaauuucaaa

SEQ ID NO: 4085186 - RNA, 13 nt, Variola virus
cauagaaaaugau

SEQ ID NO: 4085187 - RNA, 20 nt, Variola virus
cauagauauaauuaucacau

SEQ ID NO: 4085188 - RNA, 17 nt, Variola virus
cauagaugcccucuaua

SEQ ID NO: 4085189 - RNA, 15 nt, Variola virus
cauagggcuaaaugu

SEQ ID NO: 4085190 - RNA, 19 nt, Variola virus
cauaguaaaaaauauacau

SEQ ID NO: 4085191 - RNA, 18 nt, Variola virus
cauaguggacaacauuaa

SEQ ID NO: 4085192 - RNA, 20 nt, Variola virus
cauaguuuguaucaauaaua

SEQ ID NO: 4085193 - RNA, 23 nt, Variola virus
cauauacuauuacuuaucacgau

SEQ ID NO: 4085194 - RNA, 22 nt, Variola virus
cauauaguauucuuguauucua

SEQ ID NO: 4085195 - RNA, 20 nt, Variola virus
cauauauguuuucaucauuu

SEQ ID NO: 4085196 - RNA, 21 nt, Variola virus
cauauauuucgugauauacau

SEQ ID NO: 4085197 - RNA, 22 nt, Variola virus
cauaugauccaaauucuggaau

SEQ ID NO: 4085198 - RNA, 16 nt, Variola virus
caucaaaauauguuuc

SEQ ID NO: 4085199 - RNA, 23 nt, Variola virus
caucagcaaaacaguuacuauua

SEQ ID NO: 4085200 - RNA, 21 nt, Variola virus
caucauacgaaaauagauucu

SEQ ID NO: 4085201 - RNA, 21 nt, Variola virus
caucaucaaaagacuuaugau

SEQ ID NO: 4085202 - RNA, 12 nt, Variola virus
caucaucaucuu

SEQ ID NO: 4085203 - RNA, 15 nt, Variola virus
caucauuccauaauu

SEQ ID NO: 4085204 - RNA, 17 nt, Variola virus
cauccaagucaauaucu

SEQ ID NO: 4085205 - RNA, 18 nt, Variola virus
cauccuuuuuuauaucca

SEQ ID NO: 4085206 - RNA, 13 nt, Variola virus
caucgaacuucug

SEQ ID NO: 4085207 - RNA, 23 nt, Variola virus
caucgcuaaucaacacuauuuua

SEQ ID NO: 4085208 - RNA, 20 nt, Variola virus
caucggaaaaaaaucuuuuu

SEQ ID NO: 4085209 - RNA, 19 nt, Variola virus
caucguuguugaaucuauu

SEQ ID NO: 4085210 - RNA, 12 nt, Variola virus
caucuaauaauu

SEQ ID NO: 4085211 - RNA, 15 nt, Variola virus
caucuaccaauucau

SEQ ID NO: 4085212 - RNA, 20 nt, Variola virus
caucuacgccuuuaaauccu

SEQ ID NO: 4085213 - RNA, 15 nt, Variola virus
caucuauaucaucua

SEQ ID NO: 4085214 - RNA, 18 nt, Variola virus
caucuaucaaacaaaauu

SEQ ID NO: 4085215 - RNA, 13 nt, Variola virus
caucuaucaucuc

SEQ ID NO: 4085216 - RNA, 12 nt, Variola virus
caucuaugaaug

SEQ ID NO: 4085217 - RNA, 20 nt, Variola virus
caucuauuguuauauaacaa

SEQ ID NO: 4085218 - RNA, 18 nt, Variola virus
caucugaucccaaauacg

SEQ ID NO: 4085219 - RNA, 17 nt, Variola virus
aauaaauauccuuggaa

SEQ ID NO: 4085220 - RNA, 12 nt, Variola virus
aauaaaucaugg

SEQ ID NO: 4085221 - RNA, 23 nt, Variola virus
aauaaccguuagacauaaaauug

SEQ ID NO: 4085222 - RNA, 17 nt, Variola virus
aauaacuaguauaaaau

SEQ ID NO: 4085223 - RNA, 23 nt, Variola virus
aauaacuucgugaauaauguuuc

SEQ ID NO: 4085224 - RNA, 18 nt, Variola virus
aauaagagacuuaaacaa

SEQ ID NO: 4085225 - RNA, 23 nt, Variola virus
aauaagauaguucgcaacaaagu

SEQ ID NO: 4085226 - RNA, 14 nt, Variola virus
aauaaguaaaaagu

SEQ ID NO: 4085227 - RNA, 16 nt, Variola virus
aauaaguauagcaaau

SEQ ID NO: 4085228 - RNA, 23 nt, Variola virus
aauaauacaauauuuuucguuua

SEQ ID NO: 4085229 - RNA, 19 nt, Variola virus
aauaaucggagaauguuuc

SEQ ID NO: 4085230 - RNA, 15 nt, Variola virus
aauaauuauguagua

SEQ ID NO: 4085231 - RNA, 16 nt, Variola virus
aauaauucauggaaau

SEQ ID NO: 4085232 - RNA, 14 nt, Variola virus
auaaaguguucauc

SEQ ID NO: 4085233 - RNA, 17 nt, Variola virus
auaaauacaccaaauau

SEQ ID NO: 4085234 - RNA, 15 nt, Variola virus
auaaauacauuuaca

SEQ ID NO: 4085235 - RNA, 22 nt, Variola virus
auaaauacccuuccaaauaaua

SEQ ID NO: 4085236 - RNA, 13 nt, Variola virus
auaaauagacaaa

SEQ ID NO: 4085237 - RNA, 22 nt, Variola virus
auaaauaggaguuagaauaaua

SEQ ID NO: 4085238 - RNA, 23 nt, Variola virus
auaaaucacuaaauaauauccca

SEQ ID NO: 4085239 - RNA, 22 nt, Variola virus
auaaaucuacuuagauuauucu

SEQ ID NO: 4085240 - RNA, 13 nt, Variola virus
auaaaucugaugu

SEQ ID NO: 4085241 - RNA, 16 nt, Variola virus
auaaauggaauacuaa

SEQ ID NO: 4085242 - RNA, 15 nt, Variola virus
auaaauuuauucucu

SEQ ID NO: 4085243 - RNA, 22 nt, Variola virus
auaacaaccucuuuaauagccg

SEQ ID NO: 4085244 - RNA, 18 nt, Variola virus
auaacagccaauaugaga

SEQ ID NO: 4085245 - RNA, 18 nt, Variola virus
auaacaggggaaugaaca

SEQ ID NO: 4085246 - RNA, 20 nt, Variola virus
auaacaguaguuuaacuagu

SEQ ID NO: 4085247 - RNA, 23 nt, Variola virus
auaacauaggauuaaaaauaaag

SEQ ID NO: 4085248 - RNA, 14 nt, Variola virus
auaacauuguuuau

SEQ ID NO: 4085249 - RNA, 16 nt, Variola virus
auaacauuuuuuguaa

SEQ ID NO: 4085250 - RNA, 14 nt, Variola virus
auaaccauuucuau

SEQ ID NO: 4085251 - RNA, 19 nt, Variola virus
auaacuaaaguuaauacua

SEQ ID NO: 4085252 - RNA, 17 nt, Variola virus
auaacuaaauuaacaau

SEQ ID NO: 4085253 - RNA, 16 nt, Variola virus
auaacuagauuuuagu

SEQ ID NO: 4085254 - RNA, 15 nt, Variola virus
auaacuauguuuuaa

SEQ ID NO: 4085255 - RNA, 21 nt, Variola virus
auaacucauuuuuugaauaua

SEQ ID NO: 4085256 - RNA, 16 nt, Variola virus
auaacucuucgucaaa

SEQ ID NO: 4085257 - RNA, 16 nt, Variola virus
auaacuggauauagaa

SEQ ID NO: 4085258 - RNA, 14 nt, Variola virus
auaacuuuuucaau

SEQ ID NO: 4085259 - RNA, 13 nt, Variola virus
auaagaaauauga

SEQ ID NO: 4085260 - RNA, 18 nt, Variola virus
auaagaaaucaagacuac

SEQ ID NO: 4085261 - RNA, 13 nt, Variola virus
auaagaacuauau

SEQ ID NO: 4085262 - RNA, 19 nt, Variola virus
auaagaaggaugacaauaa

SEQ ID NO: 4085263 - RNA, 19 nt, Variola virus
auaagacacagaaauacug

SEQ ID NO: 4085264 - RNA, 21 nt, Variola virus
auaagacuuuacucuucuaaa

SEQ ID NO: 4085265 - RNA, 14 nt, Variola virus
auaagaugucuaug

SEQ ID NO: 4085266 - RNA, 19 nt, Variola virus
auaagaugucuaugaauau

SEQ ID NO: 4085267 - RNA, 14 nt, Variola virus
auaagauuaucaaa

SEQ ID NO: 4085268 - RNA, 15 nt, Variola virus
auaagccaaagcauu

SEQ ID NO: 4085269 - RNA, 20 nt, Variola virus
auaagcuauauaauaaaugu

SEQ ID NO: 4085270 - RNA, 17 nt, Variola virus
auaaggaacuagaauug

SEQ ID NO: 4085271 - RNA, 19 nt, Variola virus
auaaggaagugugcaaaua

SEQ ID NO: 4085272 - RNA, 14 nt, Variola virus
auaaguaaaugaaa

SEQ ID NO: 4085273 - RNA, 15 nt, Variola virus
auaaguguugucaaa

SEQ ID NO: 4085274 - RNA, 17 nt, Variola virus
auaauaaaaguuaucca

SEQ ID NO: 4085275 - RNA, 14 nt, Variola virus
auaauaaaguauau

SEQ ID NO: 4085276 - RNA, 20 nt, Variola virus
auaauaacaaguaugacauu

SEQ ID NO: 4085277 - RNA, 14 nt, Variola virus
auaauagacauaau

SEQ ID NO: 4085278 - RNA, 16 nt, Variola virus
auaauagauuuaucua

SEQ ID NO: 4085279 - RNA, 18 nt, Variola virus
auaauagauuuaucuagu

SEQ ID NO: 4085280 - RNA, 20 nt, Variola virus
auaauaggcaggagauagau

SEQ ID NO: 4085281 - RNA, 17 nt, Variola virus
auaauauaaaaacuuau

SEQ ID NO: 4085282 - RNA, 14 nt, Variola virus
auaauauacauaag

SEQ ID NO: 4085283 - RNA, 19 nt, Variola virus
auaauauauacgaagacag

SEQ ID NO: 4085284 - RNA, 18 nt, Variola virus
auaauauauuagauauuu

SEQ ID NO: 4085285 - RNA, 14 nt, Variola virus
auaauaucagaaug

SEQ ID NO: 4085286 - RNA, 22 nt, Variola virus
auaauauccugaacagcauuga

SEQ ID NO: 4085287 - RNA, 18 nt, Variola virus
auaauaucucuaauagau

SEQ ID NO: 4085288 - RNA, 15 nt, Variola virus
auaauaucuuguucu

SEQ ID NO: 4085289 - RNA, 14 nt, Variola virus
auaauauuaaauau

SEQ ID NO: 4085290 - RNA, 18 nt, Variola virus
auaauauuaucaugaauu

SEQ ID NO: 4085291 - RNA, 12 nt, Variola virus
auaaucaaacac

SEQ ID NO: 4085292 - RNA, 14 nt, Variola virus
auaaucauguugau

SEQ ID NO: 4085293 - RNA, 17 nt, Variola virus
auaaucgcgaguauuaa

SEQ ID NO: 4085294 - RNA, 16 nt, Variola virus
auaaucguauacuuca

SEQ ID NO: 4085295 - RNA, 18 nt, Variola virus
auaaucguauuuguguga

SEQ ID NO: 4085296 - RNA, 18 nt, Variola virus
auaaucucaauuagaaua

SEQ ID NO: 4085297 - RNA, 19 nt, Variola virus
auaaucugguggauacucu

SEQ ID NO: 4085298 - RNA, 20 nt, Variola virus
auaaugacauggacguagau

SEQ ID NO: 4085299 - RNA, 17 nt, Variola virus
auaaugacgauaacauu

SEQ ID NO: 4085300 - RNA, 16 nt, Variola virus
auaaugaguuagauua

SEQ ID NO: 4085301 - RNA, 15 nt, Variola virus
auaaugauuaauauu

SEQ ID NO: 4085302 - RNA, 18 nt, Variola virus
auaauguaaaaucaugau

SEQ ID NO: 4085303 - RNA, 17 nt, Variola virus
auaaugucugacaagau

SEQ ID NO: 4085304 - RNA, 22 nt, Variola virus
auaauguuguccauuguaguau

SEQ ID NO: 4085305 - RNA, 22 nt, Variola virus
auaauguuucuauguuuucuac

SEQ ID NO: 4085306 - RNA, 14 nt, Variola virus
auaauuacagaauu

SEQ ID NO: 4085307 - RNA, 16 nt, Variola virus
auaauuacagaauuau

SEQ ID NO: 4085308 - RNA, 22 nt, Variola virus
auaauuaucgcguucagauugu

SEQ ID NO: 4085309 - RNA, 15 nt, Variola virus
auaauuccaucuacu

SEQ ID NO: 4085310 - RNA, 15 nt, Variola virus
auaauucucauauau

SEQ ID NO: 4085311 - RNA, 17 nt, Variola virus
auaauugcuuuucuaau

SEQ ID NO: 4085312 - RNA, 21 nt, Variola virus
auaauuuaacauuuuggcaaa

SEQ ID NO: 4085313 - RNA, 20 nt, Variola virus
auaauuucuacuuacuuaau

SEQ ID NO: 4085314 - RNA, 12 nt, Variola virus
auaauuucuaga

SEQ ID NO: 4085315 - RNA, 13 nt, Variola virus
auaauuugaucca

SEQ ID NO: 4085316 - RNA, 18 nt, Variola virus
auaauuuuaccagaauac

SEQ ID NO: 4085317 - RNA, 12 nt, Variola virus
auaauuuucuau

SEQ ID NO: 4085318 - RNA, 16 nt, Variola virus
auacaaacuguuguua

SEQ ID NO: 4085319 - RNA, 20 nt, Variola virus
auacaaauuuuaagaaaugg

SEQ ID NO: 4085320 - RNA, 15 nt, Variola virus
auacaacaaagaaaa

SEQ ID NO: 4085321 - RNA, 15 nt, Variola virus
auacaagaacaauua

SEQ ID NO: 4085322 - RNA, 17 nt, Variola virus
auacaagcgagugcuuc

SEQ ID NO: 4085323 - RNA, 15 nt, Variola virus
auacacacuaauaaa

SEQ ID NO: 4085324 - RNA, 16 nt, Variola virus
auacaccgaacaucca

SEQ ID NO: 4085325 - RNA, 20 nt, Variola virus
auacagaagauuuaacuaga

SEQ ID NO: 4085326 - RNA, 15 nt, Variola virus
auacagaauuuguaa

SEQ ID NO: 4085327 - RNA, 21 nt, Variola virus
auacagauuguaguucuauaa

SEQ ID NO: 4085328 - RNA, 16 nt, Variola virus
auacauaaagaaaugu

SEQ ID NO: 4085329 - RNA, 21 nt, Variola virus
auacauaccugauuagaauuc

SEQ ID NO: 4085330 - RNA, 14 nt, Variola virus
auacauaguuguga

SEQ ID NO: 4085331 - RNA, 18 nt, Variola virus
auacauaguugugaucau

SEQ ID NO: 4085332 - RNA, 17 nt, Variola virus
auacaucuccaaaacua

SEQ ID NO: 4085333 - RNA, 19 nt, Variola virus
auacaugucuuagauguuc

SEQ ID NO: 4085334 - RNA, 19 nt, Variola virus
auacauuaaguaaaguaaa

SEQ ID NO: 4085335 - RNA, 14 nt, Variola virus
auacauugaauauu

SEQ ID NO: 4085336 - RNA, 15 nt, Variola virus
auacauuucucaaau

SEQ ID NO: 4085337 - RNA, 13 nt, Variola virus
auacauuuucaaa

SEQ ID NO: 4085338 - RNA, 18 nt, Variola virus
auaccacauacaaaacua

SEQ ID NO: 4085339 - RNA, 22 nt, Variola virus
auaccacuuaaugacaaaauca

SEQ ID NO: 4085340 - RNA, 15 nt, Variola virus
auaccguuaaauaua

SEQ ID NO: 4085341 - RNA, 22 nt, Variola virus
auaccuuugguucuuuaaaaga

SEQ ID NO: 4085342 - RNA, 15 nt, Variola virus
auacgaaauaaacau

SEQ ID NO: 4085343 - RNA, 22 nt, Variola virus
auacgaauaucguucucuaaau

SEQ ID NO: 4085344 - RNA, 19 nt, Variola virus
auacgaauguaucaaacag

SEQ ID NO: 4085345 - RNA, 15 nt, Variola virus
auacuaaaacugaag

SEQ ID NO: 4085346 - RNA, 21 nt, Variola virus
auacuaauaugacacgauugu

SEQ ID NO: 4085347 - RNA, 22 nt, Variola virus
auacuacauuaaaacuuaaaaa

SEQ ID NO: 4085348 - RNA, 15 nt, Variola virus
auacuagaacuauaa

SEQ ID NO: 4085349 - RNA, 14 nt, Variola virus
auacuaguaugaug

SEQ ID NO: 4085350 - RNA, 12 nt, Variola virus
auacuauauaca

SEQ ID NO: 4085351 - RNA, 19 nt, Variola virus
auacuauauaguaauacca

SEQ ID NO: 4085352 - RNA, 13 nt, Variola virus
auacuauaucuuc

SEQ ID NO: 4085353 - RNA, 20 nt, Variola virus
auacuaucuggaucuucaca

SEQ ID NO: 4085354 - RNA, 14 nt, Variola virus
auacuccaaauaca

SEQ ID NO: 4085355 - RNA, 17 nt, Variola virus
auacucuacagaguuga

SEQ ID NO: 4085356 - RNA, 21 nt, Variola virus
auacucuuuaaaguuucugaa

SEQ ID NO: 4085357 - RNA, 22 nt, Variola virus
auacucuuuaaaguuucugaaa

SEQ ID NO: 4085358 - RNA, 18 nt, Variola virus
caaaaucguuaagaaguu

SEQ ID NO: 4085359 - RNA, 15 nt, Variola virus
caaaaugaugauaua

SEQ ID NO: 4085360 - RNA, 22 nt, Variola virus
caaaauucagauucuaucuuua

SEQ ID NO: 4085361 - RNA, 21 nt, Variola virus
caaacaaguuaaugagauauu

SEQ ID NO: 4085362 - RNA, 17 nt, Variola virus
caaacaauguauacaaa

SEQ ID NO: 4085363 - RNA, 16 nt, Variola virus
caaacacuuguaaaau

SEQ ID NO: 4085364 - RNA, 16 nt, Variola virus
caaacaggauaucuau

SEQ ID NO: 4085365 - RNA, 11 nt, Variola virus
caaacauaaua

SEQ ID NO: 4085366 - RNA, 16 nt, Variola virus
caaacguuuguuaaag

SEQ ID NO: 4085367 - RNA, 23 nt, Variola virus
caaacugcguuaauguauucucu

SEQ ID NO: 4085368 - RNA, 14 nt, Variola virus
caaacuuuacucuu

SEQ ID NO: 4085369 - RNA, 18 nt, Variola virus
caaacuuuuucacagagc

SEQ ID NO: 4085370 - RNA, 21 nt, Variola virus
caaagaauuuuagacacuaac

SEQ ID NO: 4085371 - RNA, 20 nt, Variola virus
caaagauauagaacacauaa

SEQ ID NO: 4085372 - RNA, 15 nt, Variola virus
caaaggaugaaagaa

SEQ ID NO: 4085373 - RNA, 15 nt, Variola virus
caaagucguuuaaug

SEQ ID NO: 4085374 - RNA, 17 nt, Variola virus
caaaguguccuccuauu

SEQ ID NO: 4085375 - RNA, 17 nt, Variola virus
caaauaaaacuauaaau

SEQ ID NO: 4085376 - RNA, 22 nt, Variola virus
caaauaacucuugcaccaucag

SEQ ID NO: 4085377 - RNA, 22 nt, Variola virus
caaauaauaaacuaaacaaaac

SEQ ID NO: 4085378 - RNA, 23 nt, Variola virus
caaauaucuuuaugaauuacuuu

SEQ ID NO: 4085379 - RNA, 17 nt, Variola virus
caaauauuauacaugau

SEQ ID NO: 4085380 - RNA, 14 nt, Variola virus
caaaucuauuugga

SEQ ID NO: 4085381 - RNA, 11 nt, Variola virus
caaaucuucuu

SEQ ID NO: 4085382 - RNA, 22 nt, Variola virus
caaaugauaaucaaacacaucu

SEQ ID NO: 4085383 - RNA, 21 nt, Variola virus
caaaugauacugauaaaguag

SEQ ID NO: 4085384 - RNA, 21 nt, Variola virus
caaauggauguuaauguauua

SEQ ID NO: 4085385 - RNA, 15 nt, Variola virus
caaauggucaaugau

SEQ ID NO: 4085386 - RNA, 16 nt, Variola virus
caaauguaguaaauau

SEQ ID NO: 4085387 - RNA, 15 nt, Variola virus
caaauguuaaacauu

SEQ ID NO: 4085388 - RNA, 23 nt, Variola virus
caaauuacgagccaaaucuucuu

SEQ ID NO: 4085389 - RNA, 19 nt, Variola virus
caaauuauuucuucugaau

SEQ ID NO: 4085390 - RNA, 22 nt, Variola virus
caaauuccuacuuacagaagau

SEQ ID NO: 4085391 - RNA, 18 nt, Variola virus
caaauucugcaauaucuu

SEQ ID NO: 4085392 - RNA, 20 nt, Variola virus
caaauuugacuacauucagg

SEQ ID NO: 4085393 - RNA, 23 nt, Variola virus
caaauuuguuuuguuuauuaaca

SEQ ID NO: 4085394 - RNA, 14 nt, Variola virus
caacaaauuuggaa

SEQ ID NO: 4085395 - RNA, 15 nt, Variola virus
caacaaguauacaau

SEQ ID NO: 4085396 - RNA, 18 nt, Variola virus
caacaaguuggaugauau

SEQ ID NO: 4085397 - RNA, 23 nt, Variola virus
caacagguggaauaucaauuaau

SEQ ID NO: 4085398 - RNA, 24 nt, Variola virus
caacaugauuauucuacuaucaaa

SEQ ID NO: 4085399 - RNA, 16 nt, Variola virus
caacauuggaauaaua

SEQ ID NO: 4085400 - RNA, 19 nt, Variola virus
caaccaucucauaaaauag

SEQ ID NO: 4085401 - RNA, 13 nt, Variola virus
caacgaaucccua

SEQ ID NO: 4085402 - RNA, 21 nt, Variola virus
caacgugauuauucuccacca

SEQ ID NO: 4085403 - RNA, 15 nt, Variola virus
caacuacauaaucuu

SEQ ID NO: 4085404 - RNA, 16 nt, Variola virus
caacuaguaucaucuc

SEQ ID NO: 4085405 - RNA, 12 nt, Variola virus
caacucucaaaa

SEQ ID NO: 4085406 - RNA, 23 nt, Variola virus
caacugauuaauaagaucuucua

SEQ ID NO: 4085407 - RNA, 15 nt, Variola virus
caacugucuuucaag

SEQ ID NO: 4085408 - RNA, 17 nt, Variola virus
caacuuugaauccauuu

SEQ ID NO: 4085409 - RNA, 14 nt, Variola virus
caacuuuuaaauac

SEQ ID NO: 4085410 - RNA, 20 nt, Variola virus
caagaaacaccaaguagaaa

SEQ ID NO: 4085411 - RNA, 16 nt, Variola virus
caagagauauauugga

SEQ ID NO: 4085412 - RNA, 18 nt, Variola virus
caagaucgauagacacug

SEQ ID NO: 4085413 - RNA, 21 nt, Variola virus
agaaaugguguacaauuguuu

SEQ ID NO: 4085414 - RNA, 22 nt, Variola virus
agaaauuacauaaaaaaaaugu

SEQ ID NO: 4085415 - RNA, 16 nt, Variola virus
agaaauuaucaaaugu

SEQ ID NO: 4085416 - RNA, 23 nt, Variola virus
agaaauuauuuuuacuaauagaa

SEQ ID NO: 4085417 - RNA, 12 nt, Variola virus
agaacaaaauaa

SEQ ID NO: 4085418 - RNA, 12 nt, Variola virus
agaacaaauguu

SEQ ID NO: 4085419 - RNA, 20 nt, Variola virus
agaacaaugucaaaauauga

SEQ ID NO: 4085420 - RNA, 16 nt, Variola virus
agaacacacuuuucuc

SEQ ID NO: 4085421 - RNA, 15 nt, Variola virus
agaacacaugucuua

SEQ ID NO: 4085422 - RNA, 17 nt, Variola virus
agaacauaauaauauau

SEQ ID NO: 4085423 - RNA, 19 nt, Variola virus
agaacauacauuuguaaaa

SEQ ID NO: 4085424 - RNA, 23 nt, Variola virus
agaaccacuauguuaauacuuau

SEQ ID NO: 4085425 - RNA, 18 nt, Variola virus
agaaccauuacaaauauu

SEQ ID NO: 4085426 - RNA, 15 nt, Variola virus
agaacggagaauugu

SEQ ID NO: 4085427 - RNA, 22 nt, Variola virus
agaacuggacuguauaucucau

SEQ ID NO: 4085428 - RNA, 12 nt, Variola virus
agaagaacauau

SEQ ID NO: 4085429 - RNA, 13 nt, Variola virus
agaagaauaugau

SEQ ID NO: 4085430 - RNA, 23 nt, Variola virus
agaagacguggauaguuucuuaa

SEQ ID NO: 4085431 - RNA, 16 nt, Variola virus
agaagauuaaacauau

SEQ ID NO: 4085432 - RNA, 21 nt, Variola virus
agaagcauacgccaaauaucu

SEQ ID NO: 4085433 - RNA, 13 nt, Variola virus
agaaggagaagau

SEQ ID NO: 4085434 - RNA, 23 nt, Variola virus
agaagucguuuauauaacaauga

SEQ ID NO: 4085435 - RNA, 13 nt, Variola virus
agaauaauuagaa

SEQ ID NO: 4085436 - RNA, 16 nt, Variola virus
agaauaauuagaaauu

SEQ ID NO: 4085437 - RNA, 15 nt, Variola virus
agaauacgaugauau

SEQ ID NO: 4085438 - RNA, 12 nt, Variola virus
agaauacucuac

SEQ ID NO: 4085439 - RNA, 19 nt, Variola virus
agaauauaaaaaaaugauu

SEQ ID NO: 4085440 - RNA, 13 nt, Variola virus
agaauauauguau

SEQ ID NO: 4085441 - RNA, 18 nt, Variola virus
agaaucuauuuuaaugag

SEQ ID NO: 4085442 - RNA, 16 nt, Variola virus
agaaugcagaaaugau

SEQ ID NO: 4085443 - RNA, 16 nt, Variola virus
agaaugcauacugucu

SEQ ID NO: 4085444 - RNA, 21 nt, Variola virus
agaauggaaaggaaacuaucu

SEQ ID NO: 4085445 - RNA, 15 nt, Variola virus
agaauggaugauauu

SEQ ID NO: 4085446 - RNA, 14 nt, Variola virus
agaauuaaauggau

SEQ ID NO: 4085447 - RNA, 12 nt, Variola virus
agaauuagaauu

SEQ ID NO: 4085448 - RNA, 22 nt, Variola virus
agaauuaguuaaucuuauucaa

SEQ ID NO: 4085449 - RNA, 19 nt, Variola virus
agaauuauaccaauagaua

SEQ ID NO: 4085450 - RNA, 21 nt, Variola virus
agaauuauaccaauagauaau

SEQ ID NO: 4085451 - RNA, 15 nt, Variola virus
agaauucaaaauauu

SEQ ID NO: 4085452 - RNA, 15 nt, Variola virus
agaauucaacuauau

SEQ ID NO: 4085453 - RNA, 22 nt, Variola virus
agaauucuuagucaauggagaa

SEQ ID NO: 4085454 - RNA, 18 nt, Variola virus
agaauugcugcaauauau

SEQ ID NO: 4085455 - RNA, 22 nt, Variola virus
agaauugggcaagcauaagaca

SEQ ID NO: 4085456 - RNA, 13 nt, Variola virus
agaauugucuauc

SEQ ID NO: 4085457 - RNA, 15 nt, Variola virus
agaauuuucauggau

SEQ ID NO: 4085458 - RNA, 23 nt, Variola virus
agacaaaacuauuccaauguuua

SEQ ID NO: 4085459 - RNA, 21 nt, Variola virus
agacaauugacaaaauucaca

SEQ ID NO: 4085460 - RNA, 21 nt, Variola virus
agacacauaugcgaucagaua

SEQ ID NO: 4085461 - RNA, 13 nt, Variola virus
agacauaauauaa

SEQ ID NO: 4085462 - RNA, 12 nt, Variola virus
agacaucugaca

SEQ ID NO: 4085463 - RNA, 22 nt, Variola virus
agacaugauaauauuaaagaua

SEQ ID NO: 4085464 - RNA, 19 nt, Variola virus
agacauucccacaguguug

SEQ ID NO: 4085465 - RNA, 21 nt, Variola virus
agacauuguugaauucuguga

SEQ ID NO: 4085466 - RNA, 22 nt, Variola virus
agaccaagcuucgucguagaaa

SEQ ID NO: 4085467 - RNA, 16 nt, Variola virus
agaccauuuaauacga

SEQ ID NO: 4085468 - RNA, 15 nt, Variola virus
agacgaacaaaauca

SEQ ID NO: 4085469 - RNA, 23 nt, Variola virus
agacgaguuuaguauucgagaca

SEQ ID NO: 4085470 - RNA, 19 nt, Variola virus
agacgcuauaucaaaauau

SEQ ID NO: 4085471 - RNA, 23 nt, Variola virus
agacgcuauggcacgaaauaucu

SEQ ID NO: 4085472 - RNA, 18 nt, Variola virus
agacguaguucuaguaca

SEQ ID NO: 4085473 - RNA, 15 nt, Variola virus
agacgucacuauuac

SEQ ID NO: 4085474 - RNA, 18 nt, Variola virus
agacuaacaguaugcauu

SEQ ID NO: 4085475 - RNA, 17 nt, Variola virus
agacuacgaaacugaua

SEQ ID NO: 4085476 - RNA, 23 nt, Variola virus
agacuacguagacuagacuguuu

SEQ ID NO: 4085477 - RNA, 17 nt, Variola virus
agacuaugggaauauau

SEQ ID NO: 4085478 - RNA, 12 nt, Variola virus
agacucaguaau

SEQ ID NO: 4085479 - RNA, 21 nt, Variola virus
agacucuaucgcgugucuaua

SEQ ID NO: 4085480 - RNA, 15 nt, Variola virus
agacugcggacuuua

SEQ ID NO: 4085481 - RNA, 20 nt, Variola virus
agacuuuaagcuaaaauauu

SEQ ID NO: 4085482 - RNA, 20 nt, Variola virus
agacuuuauaauuucaucua

SEQ ID NO: 4085483 - RNA, 18 nt, Variola virus
agagaacauauaaaugua

SEQ ID NO: 4085484 - RNA, 15 nt, Variola virus
agagaaguauuuuau

SEQ ID NO: 4085485 - RNA, 17 nt, Variola virus
agagaagucgucaagca

SEQ ID NO: 4085486 - RNA, 17 nt, Variola virus
agagaauugcugcaaua

SEQ ID NO: 4085487 - RNA, 14 nt, Variola virus
agagacaaacuauu

SEQ ID NO: 4085488 - RNA, 19 nt, Variola virus
agagacaaacuauuaacua

SEQ ID NO: 4085489 - RNA, 15 nt, Variola virus
agagacggaaauagu

SEQ ID NO: 4085490 - RNA, 20 nt, Variola virus
agagaggcugcugaaaauaa

SEQ ID NO: 4085491 - RNA, 14 nt, Variola virus
agagauaucuaucu

SEQ ID NO: 4085492 - RNA, 22 nt, Variola virus
agagauuggguuaauaaauaca

SEQ ID NO: 4085493 - RNA, 15 nt, Variola virus
agagauuuugaaaau

SEQ ID NO: 4085494 - RNA, 22 nt, Variola virus
agagcuaccgaaggagauacua

SEQ ID NO: 4085495 - RNA, 15 nt, Variola virus
agagcuauucuugga

SEQ ID NO: 4085496 - RNA, 12 nt, Variola virus
agaggagaagua

SEQ ID NO: 4085497 - RNA, 20 nt, Variola virus
agaguauccacuaaacuauu

SEQ ID NO: 4085498 - RNA, 17 nt, Variola virus
agaguauucuuauguau

SEQ ID NO: 4085499 - RNA, 14 nt, Variola virus
agaguauuguacag

SEQ ID NO: 4085500 - RNA, 22 nt, Variola virus
agagucgacaaugaaaauggau

SEQ ID NO: 4085501 - RNA, 22 nt, Variola virus
agaguucgauccuaaagguaaa

SEQ ID NO: 4085502 - RNA, 20 nt, Variola virus
agauaaaccguuuauguauu

SEQ ID NO: 4085503 - RNA, 18 nt, Variola virus
agauaaacuuuauguauu

SEQ ID NO: 4085504 - RNA, 21 nt, Variola virus
agauaaagaguccuauauauu

SEQ ID NO: 4085505 - RNA, 12 nt, Variola virus
agauaaauaugg

SEQ ID NO: 4085506 - RNA, 21 nt, Variola virus
agauaaauuuaccacuagaac

SEQ ID NO: 4085507 - RNA, 12 nt, Variola virus
agauaauacaaa

SEQ ID NO: 4085508 - RNA, 17 nt, Variola virus
agauaauauuagacaua

SEQ ID NO: 4085509 - RNA, 21 nt, Variola virus
agauaaugacguuaauaacaa

SEQ ID NO: 4085510 - RNA, 21 nt, Variola virus
agauaaugauauauuaaacaa

SEQ ID NO: 4085511 - RNA, 13 nt, Variola virus
agauaaugugaau

SEQ ID NO: 4085512 - RNA, 18 nt, Variola virus
agauaauuguaacaauau

SEQ ID NO: 4085513 - RNA, 14 nt, Variola virus
agauacaucuauau

SEQ ID NO: 4085514 - RNA, 22 nt, Variola virus
agauacguauuagauaaaugga

SEQ ID NO: 4085515 - RNA, 16 nt, Variola virus
agauacuauccaucag

SEQ ID NO: 4085516 - RNA, 15 nt, Variola virus
agauagaaaugaauu

SEQ ID NO: 4085517 - RNA, 14 nt, Variola virus
agauagaugaugau

SEQ ID NO: 4085518 - RNA, 19 nt, Variola virus
agauagauuuccaaagaua

SEQ ID NO: 4085519 - RNA, 16 nt, Variola virus
agauaguuuucucuau

SEQ ID NO: 4085520 - RNA, 17 nt, Variola virus
agauauaguauauucca

SEQ ID NO: 4085521 - RNA, 18 nt, Variola virus
agauaucagagaacuucu

SEQ ID NO: 4085522 - RNA, 17 nt, Variola virus
agauaucuauacuuacu

SEQ ID NO: 4085523 - RNA, 14 nt, Variola virus
agauaucucauuaa

SEQ ID NO: 4085524 - RNA, 15 nt, Variola virus
agauaucucuggaua

SEQ ID NO: 4085525 - RNA, 18 nt, Variola virus
agauaugauaaaacuauu

SEQ ID NO: 4085526 - RNA, 13 nt, Variola virus
agauauguaugug

SEQ ID NO: 4085527 - RNA, 16 nt, Variola virus
agauauuuuaugggaa

SEQ ID NO: 4085528 - RNA, 17 nt, Variola virus
agaucauuugaaauuau

SEQ ID NO: 4085529 - RNA, 17 nt, Variola virus
agauccacugagaugac

SEQ ID NO: 4085530 - RNA, 15 nt, Variola virus
agauccuguuagaua

SEQ ID NO: 4085531 - RNA, 21 nt, Variola virus
agauccuuuucuucagaauaa

SEQ ID NO: 4085532 - RNA, 15 nt, Variola virus
agaucgauagacacu

SEQ ID NO: 4085533 - RNA, 18 nt, Variola virus
agaucggcaaucuuucuc

SEQ ID NO: 4085534 - RNA, 16 nt, Variola virus
agaucugagaauggau

SEQ ID NO: 4085535 - RNA, 22 nt, Variola virus
agaucugagaauggauaauucu

SEQ ID NO: 4085536 - RNA, 17 nt, Variola virus
agaugaacugacauaua

SEQ ID NO: 4085537 - RNA, 22 nt, Variola virus
agaugaaucaaauguaacuauu

SEQ ID NO: 4085538 - RNA, 14 nt, Variola virus
agaugaccauagau

SEQ ID NO: 4085539 - RNA, 18 nt, Variola virus
agaugacugauauucagg

SEQ ID NO: 4085540 - RNA, 14 nt, Variola virus
agaugacuggaaau

SEQ ID NO: 4085541 - RNA, 21 nt, Variola virus
agaugagcauaaacauaauaa

SEQ ID NO: 4085542 - RNA, 19 nt, Variola virus
auaacucggaucugcuaua

SEQ ID NO: 4085543 - RNA, 18 nt, Variola virus
auaacucguuuuucuuaa

SEQ ID NO: 4085544 - RNA, 13 nt, Variola virus
auaacuguaaaua

SEQ ID NO: 4085545 - RNA, 15 nt, Variola virus
auaacuuacuuucca

SEQ ID NO: 4085546 - RNA, 14 nt, Variola virus
auaacuuauccgaa

SEQ ID NO: 4085547 - RNA, 18 nt, Variola virus
auaacuuccgacuacaua

SEQ ID NO: 4085548 - RNA, 19 nt, Variola virus
auaacuucuagauguagaa

SEQ ID NO: 4085549 - RNA, 21 nt, Variola virus
auaacuuggaaaaaauaacua

SEQ ID NO: 4085550 - RNA, 22 nt, Variola virus
auaacuuuaccccaaucagaua

SEQ ID NO: 4085551 - RNA, 19 nt, Variola virus
auaacuuugacaaauauua

SEQ ID NO: 4085552 - RNA, 16 nt, Variola virus
auaagaaauaugaaau

SEQ ID NO: 4085553 - RNA, 14 nt, Variola virus
auaagaacaaagua

SEQ ID NO: 4085554 - RNA, 19 nt, Variola virus
auaagaagaggacaaaguu

SEQ ID NO: 4085555 - RNA, 15 nt, Variola virus
auaagaugcaaacau

SEQ ID NO: 4085556 - RNA, 15 nt, Variola virus
auaaguaaaugaaaa

SEQ ID NO: 4085557 - RNA, 14 nt, Variola virus
auaaguaauaacua

SEQ ID NO: 4085558 - RNA, 16 nt, Variola virus
auaaguguagaaauua

SEQ ID NO: 4085559 - RNA, 22 nt, Variola virus
auaauaauuuaggacuuuguaa

SEQ ID NO: 4085560 - RNA, 20 nt, Variola virus
auaauacacacguaauagau

SEQ ID NO: 4085561 - RNA, 15 nt, Variola virus
auaauacgaauauau

SEQ ID NO: 4085562 - RNA, 22 nt, Variola virus
auaauacucggccgacauaaug

SEQ ID NO: 4085563 - RNA, 19 nt, Variola virus
auaauacuggagaacuuau

SEQ ID NO: 4085564 - RNA, 11 nt, Variola virus
auaauacuuug

SEQ ID NO: 4085565 - RNA, 14 nt, Variola virus
auaauagcacuguu

SEQ ID NO: 4085566 - RNA, 16 nt, Variola virus
auaauaggguaucuaa

SEQ ID NO: 4085567 - RNA, 15 nt, Variola virus
auaauaguaacauau

SEQ ID NO: 4085568 - RNA, 13 nt, Variola virus
auaauauaaucua

SEQ ID NO: 4085569 - RNA, 14 nt, Variola virus
auaauauuaauauu

SEQ ID NO: 4085570 - RNA, 15 nt, Variola virus
auaauauuaauauua

SEQ ID NO: 4085571 - RNA, 17 nt, Variola virus
auaauauuaucaugaau

SEQ ID NO: 4085572 - RNA, 15 nt, Variola virus
auaauauucaugucu

SEQ ID NO: 4085573 - RNA, 17 nt, Variola virus
auaauauuuuaauagau

SEQ ID NO: 4085574 - RNA, 19 nt, Variola virus
auaauauuuuaauagauua

SEQ ID NO: 4085575 - RNA, 14 nt, Variola virus
auaaucagauuuac

SEQ ID NO: 4085576 - RNA, 22 nt, Variola virus
auaaucagucauaacaaaugua

SEQ ID NO: 4085577 - RNA, 22 nt, Variola virus
auaaucauuauuaacuuuauca

SEQ ID NO: 4085578 - RNA, 14 nt, Variola virus
auaaucauucuuaa

SEQ ID NO: 4085579 - RNA, 14 nt, Variola virus
auaauccagauuuu

SEQ ID NO: 4085580 - RNA, 22 nt, Variola virus
auaaucuaaaauaguucuguaa

SEQ ID NO: 4085581 - RNA, 16 nt, Variola virus
auaaucuuuaguauua

SEQ ID NO: 4085582 - RNA, 13 nt, Variola virus
auaaugaacauau

SEQ ID NO: 4085583 - RNA, 17 nt, Variola virus
auaaugauagacaagau

SEQ ID NO: 4085584 - RNA, 14 nt, Variola virus
auaaugaucauaua

SEQ ID NO: 4085585 - RNA, 23 nt, Variola virus
auaauggcuguuuguauaauaga

SEQ ID NO: 4085586 - RNA, 20 nt, Variola virus
auaaugucugacaagauccg

SEQ ID NO: 4085587 - RNA, 15 nt, Variola virus
auaauguuacucaau

SEQ ID NO: 4085588 - RNA, 21 nt, Variola virus
auaauguuauuacuuguggua

SEQ ID NO: 4085589 - RNA, 14 nt, Variola virus
auaauuauaagacu

SEQ ID NO: 4085590 - RNA, 13 nt, Variola virus
auaauuauacuuu

SEQ ID NO: 4085591 - RNA, 15 nt, Variola virus
auaauuauagaucag

SEQ ID NO: 4085592 - RNA, 15 nt, Variola virus
auaauuauuuuguaa

SEQ ID NO: 4085593 - RNA, 13 nt, Variola virus
auaauuuaacaau

SEQ ID NO: 4085594 - RNA, 16 nt, Variola virus
auaauuuagauacuuu

SEQ ID NO: 4085595 - RNA, 20 nt, Variola virus
auaauuuuaccagaauacua

SEQ ID NO: 4085596 - RNA, 22 nt, Variola virus
auaauuuuuuaagcacaaaaua

SEQ ID NO: 4085597 - RNA, 18 nt, Variola virus
auaauuuuuuuauugcau

SEQ ID NO: 4085598 - RNA, 20 nt, Variola virus
auacaaauaugucuuuguua

SEQ ID NO: 4085599 - RNA, 23 nt, Variola virus
auacaacggcguuaauuaucuaa

SEQ ID NO: 4085600 - RNA, 21 nt, Variola virus
auacaauaaauguuuaaacau

SEQ ID NO: 4085601 - RNA, 17 nt, Variola virus
auacaauggaugauaug

SEQ ID NO: 4085602 - RNA, 22 nt, Variola virus
auacacaucucuucaucuguaa

SEQ ID NO: 4085603 - RNA, 20 nt, Variola virus
auacaccauuccauuuguau

SEQ ID NO: 4085604 - RNA, 21 nt, Variola virus
auacauaucgcacauuauacu

SEQ ID NO: 4085605 - RNA, 12 nt, Variola virus
auacauauuuua

SEQ ID NO: 4085606 - RNA, 23 nt, Variola virus
auacaucgaauauaaaauaacua

SEQ ID NO: 4085607 - RNA, 15 nt, Variola virus
auacaucuuuaaucu

SEQ ID NO: 4085608 - RNA, 17 nt, Variola virus
auacauggaagaauuag

SEQ ID NO: 4085609 - RNA, 20 nt, Variola virus
auacauuauuacuaaacauu

SEQ ID NO: 4085610 - RNA, 20 nt, Variola virus
auacauuuccgaaugaaugu

SEQ ID NO: 4085611 - RNA, 16 nt, Variola virus
auacauuugaguuacu

SEQ ID NO: 4085612 - RNA, 22 nt, Variola virus
auacauuuugcauuagauuuac

SEQ ID NO: 4085613 - RNA, 23 nt, Variola virus
auaccaaaucugguaaaaguuaa

SEQ ID NO: 4085614 - RNA, 16 nt, Variola virus
auaccacuuaaugaca

SEQ ID NO: 4085615 - RNA, 22 nt, Variola virus
auaccauauccuccuguagaua

SEQ ID NO: 4085616 - RNA, 16 nt, Variola virus
auaccaucuucuggaa

SEQ ID NO: 4085617 - RNA, 19 nt, Variola virus
auaccauggaaaaauauua

SEQ ID NO: 4085618 - RNA, 15 nt, Variola virus
auaccgaaucuacau

SEQ ID NO: 4085619 - RNA, 19 nt, Variola virus
auaccgaucacguucuagu

SEQ ID NO: 4085620 - RNA, 14 nt, Variola virus
auaccgauuuuaca

SEQ ID NO: 4085621 - RNA, 20 nt, Variola virus
auaccucauaaaacaaaaaa

SEQ ID NO: 4085622 - RNA, 21 nt, Variola virus
auaccuuaccgccuucauaag

SEQ ID NO: 4085623 - RNA, 19 nt, Variola virus
auacgaaauaaauaaugaa

SEQ ID NO: 4085624 - RNA, 21 nt, Variola virus
auacgaaauaaauaaugaauu

SEQ ID NO: 4085625 - RNA, 20 nt, Variola virus
auacgaauaucguucucuaa

SEQ ID NO: 4085626 - RNA, 14 nt, Variola virus
auacgagucauuau

SEQ ID NO: 4085627 - RNA, 14 nt, Variola virus
auacgauaaacauu

SEQ ID NO: 4085628 - RNA, 17 nt, Variola virus
auacgcuccuuaucaaa

SEQ ID NO: 4085629 - RNA, 23 nt, Variola virus
auacgggaaauuacaaaaggaag

SEQ ID NO: 4085630 - RNA, 19 nt, Variola virus
auacgucuuuauuuucuau

SEQ ID NO: 4085631 - RNA, 20 nt, Variola virus
auacguuuauauucuuuuaa

SEQ ID NO: 4085632 - RNA, 13 nt, Variola virus
auacuaaacauug

SEQ ID NO: 4085633 - RNA, 21 nt, Variola virus
auacuaaaggcaacaaagaaa

SEQ ID NO: 4085634 - RNA, 21 nt, Variola virus
auacuaccaaccuacacuauu

SEQ ID NO: 4085635 - RNA, 18 nt, Variola virus
auacuacgacuuuguuaa

SEQ ID NO: 4085636 - RNA, 15 nt, Variola virus
auacuacuaaugaca

SEQ ID NO: 4085637 - RNA, 18 nt, Variola virus
auacuacuauuugucuaa

SEQ ID NO: 4085638 - RNA, 18 nt, Variola virus
auacuacuucuccaacau

SEQ ID NO: 4085639 - RNA, 19 nt, Variola virus
auacuauccaucagaaugu

SEQ ID NO: 4085640 - RNA, 16 nt, Variola virus
auacuaugaugucuag

SEQ ID NO: 4085641 - RNA, 14 nt, Variola virus
auacuauguuauau

SEQ ID NO: 4085642 - RNA, 20 nt, Variola virus
auacugcaauaauuuucaaa

SEQ ID NO: 4085643 - RNA, 21 nt, Variola virus
auacugcuccagaauuaauaa

SEQ ID NO: 4085644 - RNA, 15 nt, Variola virus
auacuguauauacua

SEQ ID NO: 4085645 - RNA, 22 nt, Variola virus
auacuguauauacuauuauaga

SEQ ID NO: 4085646 - RNA, 13 nt, Variola virus
auacugucuguaa

SEQ ID NO: 4085647 - RNA, 15 nt, Variola virus
auacuuaaaaaauga

SEQ ID NO: 4085648 - RNA, 23 nt, Variola virus
auacuucauaaaagaaaauacua

SEQ ID NO: 4085649 - RNA, 21 nt, Variola virus
auacuuuuaauugaacaaaag

SEQ ID NO: 4085650 - RNA, 15 nt, Variola virus
auacuuuuucuagaa

SEQ ID NO: 4085651 - RNA, 21 nt, Variola virus
auagaaaauaacagauauuac

SEQ ID NO: 4085652 - RNA, 18 nt, Variola virus
auagaaaauaucauaaau

SEQ ID NO: 4085653 - RNA, 22 nt, Variola virus
auagaaacauauucuaugaauu

SEQ ID NO: 4085654 - RNA, 14 nt, Variola virus
auagaaauauauau

SEQ ID NO: 4085655 - RNA, 23 nt, Variola virus
auagaacacccguagaaauacua

SEQ ID NO: 4085656 - RNA, 21 nt, Variola virus
auagaagagcaaauaucucau

SEQ ID NO: 4085657 - RNA, 22 nt, Variola virus
auagaaguuaaacugugaaugu

SEQ ID NO: 4085658 - RNA, 13 nt, Variola virus
auagaauaaauua

SEQ ID NO: 4085659 - RNA, 18 nt, Variola virus
auagaauuuauaacauga

SEQ ID NO: 4085660 - RNA, 20 nt, Variola virus
auagacagcuucuagaaguu

SEQ ID NO: 4085661 - RNA, 16 nt, Variola virus
aaagauggucugaaau

SEQ ID NO: 4085662 - RNA, 20 nt, Variola virus
aaagauucuauaauaaugaa

SEQ ID NO: 4085663 - RNA, 15 nt, Variola virus
aaagcauuaauacag

SEQ ID NO: 4085664 - RNA, 15 nt, Variola virus
aaagcuauuaucaaa

SEQ ID NO: 4085665 - RNA, 19 nt, Variola virus
aaaggauacuaaacauugu

SEQ ID NO: 4085666 - RNA, 24 nt, Variola virus
aaaggggugagaacguuccagagu

SEQ ID NO: 4085667 - RNA, 21 nt, Variola virus
aaaguacucaauaaauuaaag

SEQ ID NO: 4085668 - RNA, 22 nt, Variola virus
aaaguaucuuauauacacagua

SEQ ID NO: 4085669 - RNA, 13 nt, Variola virus
aaagucaucucuu

SEQ ID NO: 4085670 - RNA, 14 nt, Variola virus
aaagugcaaaugag

SEQ ID NO: 4085671 - RNA, 16 nt, Variola virus
aaaguuaguacagaag

SEQ ID NO: 4085672 - RNA, 15 nt, Variola virus
aaaguuucacaugaa

SEQ ID NO: 4085673 - RNA, 15 nt, Variola virus
aaaguuuuauaugua

SEQ ID NO: 4085674 - RNA, 20 nt, Variola virus
aaaguuuucuuucaaaauag

SEQ ID NO: 4085675 - RNA, 14 nt, Variola virus
aaauaaaacuauaa

SEQ ID NO: 4085676 - RNA, 15 nt, Variola virus
aaauaaaauaauaau

SEQ ID NO: 4085677 - RNA, 16 nt, Variola virus
aaauaauaauggaagu

SEQ ID NO: 4085678 - RNA, 13 nt, Variola virus
aaauaauaugauu

SEQ ID NO: 4085679 - RNA, 14 nt, Variola virus
aaauaaucauguaa

SEQ ID NO: 4085680 - RNA, 12 nt, Variola virus
aaauaauccaac

SEQ ID NO: 4085681 - RNA, 13 nt, Variola virus
aaauaaugaccaa

SEQ ID NO: 4085682 - RNA, 23 nt, Variola virus
aaauaauguaagaaauaauauua

SEQ ID NO: 4085683 - RNA, 15 nt, Variola virus
aaauaauuuaacaau

SEQ ID NO: 4085684 - RNA, 18 nt, Variola virus
aaauacaaaauaauagau

SEQ ID NO: 4085685 - RNA, 14 nt, Variola virus
aaauacaaauauau

SEQ ID NO: 4085686 - RNA, 15 nt, Variola virus
aaauacgaacuuuau

SEQ ID NO: 4085687 - RNA, 21 nt, Variola virus
aaauacgaagguccuuuuacu

SEQ ID NO: 4085688 - RNA, 19 nt, Variola virus
aaauacuacagaaacuaau

SEQ ID NO: 4085689 - RNA, 12 nt, Variola virus
aaauacuaguau

SEQ ID NO: 4085690 - RNA, 14 nt, Variola virus
aaauagaaacauau

SEQ ID NO: 4085691 - RNA, 16 nt, Variola virus
aaauagauagaaucua

SEQ ID NO: 4085692 - RNA, 14 nt, Variola virus
aaauagauuauuua

SEQ ID NO: 4085693 - RNA, 18 nt, Variola virus
aaauaggcguacaaaagg

SEQ ID NO: 4085694 - RNA, 14 nt, Variola virus
aaauagggauguuu

SEQ ID NO: 4085695 - RNA, 15 nt, Variola virus
aaauaguuauuagaa

SEQ ID NO: 4085696 - RNA, 19 nt, Variola virus
aaauauaaaaccaacuaau

SEQ ID NO: 4085697 - RNA, 15 nt, Variola virus
aaauauaaaauauau

SEQ ID NO: 4085698 - RNA, 15 nt, Variola virus
aaauauaguagaauu

SEQ ID NO: 4085699 - RNA, 14 nt, Variola virus
aaauauauaacaau

SEQ ID NO: 4085700 - RNA, 14 nt, Variola virus
aaauauauaaugaa

SEQ ID NO: 4085701 - RNA, 22 nt, Variola virus
aaauaucauuauguauaaucau

SEQ ID NO: 4085702 - RNA, 12 nt, Variola virus
aaauaucucauc

SEQ ID NO: 4085703 - RNA, 22 nt, Variola virus
aaauaucuuaaggagaaugaaa

SEQ ID NO: 4085704 - RNA, 13 nt, Variola virus
aaauaucuuguau

SEQ ID NO: 4085705 - RNA, 17 nt, Variola virus
aaauaugaaaucuaucu

SEQ ID NO: 4085706 - RNA, 16 nt, Variola virus
aaauaugauuuuguaa

SEQ ID NO: 4085707 - RNA, 14 nt, Variola virus
aaauauuaauaaca

SEQ ID NO: 4085708 - RNA, 16 nt, Variola virus
aaauauuacagauuuu

SEQ ID NO: 4085709 - RNA, 13 nt, Variola virus
aaauauucaguau

SEQ ID NO: 4085710 - RNA, 12 nt, Variola virus
aaauauuguuaa

SEQ ID NO: 4085711 - RNA, 17 nt, Variola virus
aaaucaggaaaaaagau

SEQ ID NO: 4085712 - RNA, 13 nt, Variola virus
aaaucaguaacua

SEQ ID NO: 4085713 - RNA, 23 nt, Variola virus
aaaucaguaacuauguucauuuu

SEQ ID NO: 4085714 - RNA, 18 nt, Variola virus
aaauccauuaauacggaa

SEQ ID NO: 4085715 - RNA, 22 nt, Variola virus
aaauccuuguuugauaaaugua

SEQ ID NO: 4085716 - RNA, 14 nt, Variola virus
aaaucgucaguagu

SEQ ID NO: 4085717 - RNA, 17 nt, Variola virus
aaaucguguuuguguag

SEQ ID NO: 4085718 - RNA, 16 nt, Variola virus
aaaucuagagguagaa

SEQ ID NO: 4085719 - RNA, 16 nt, Variola virus
aaaucuaguuguggaa

SEQ ID NO: 4085720 - RNA, 14 nt, Variola virus
aaaucuauacugca

SEQ ID NO: 4085721 - RNA, 19 nt, Variola virus
aaaucuucuuauaagauug

SEQ ID NO: 4085722 - RNA, 21 nt, Variola virus
aaaucuucuucuacauuuuca

SEQ ID NO: 4085723 - RNA, 22 nt, Variola virus
aaaucuugucugcuuaauacac

SEQ ID NO: 4085724 - RNA, 21 nt, Variola virus
aaaugaacuuuuacagaucua

SEQ ID NO: 4085725 - RNA, 22 nt, Variola virus
aaaugaagauccaagauuugua

SEQ ID NO: 4085726 - RNA, 17 nt, Variola virus
aaaugaguucugugcag

SEQ ID NO: 4085727 - RNA, 17 nt, Variola virus
aaaugauagaaauauau

SEQ ID NO: 4085728 - RNA, 17 nt, Variola virus
aaaugauaucuuagaau

SEQ ID NO: 4085729 - RNA, 18 nt, Variola virus
aaaugauaucuuagaaua

SEQ ID NO: 4085730 - RNA, 14 nt, Variola virus
aaaugauuuuggaa

SEQ ID NO: 4085731 - RNA, 19 nt, Variola virus
aaauggaugcgguuauuag

SEQ ID NO: 4085732 - RNA, 14 nt, Variola virus
aaaugguguaacuc

SEQ ID NO: 4085733 - RNA, 17 nt, Variola virus
aaaugguugauaccauu

SEQ ID NO: 4085734 - RNA, 18 nt, Variola virus
aaauguacuguauauaau

SEQ ID NO: 4085735 - RNA, 15 nt, Variola virus
aaauguaucuuccac

SEQ ID NO: 4085736 - RNA, 18 nt, Variola virus
aaaugucaugauuaguau

SEQ ID NO: 4085737 - RNA, 16 nt, Variola virus
aaauguccaauauguc

SEQ ID NO: 4085738 - RNA, 18 nt, Variola virus
aaauguccguuauauaau

SEQ ID NO: 4085739 - RNA, 20 nt, Variola virus
aaaugucuagcgauauuucu

SEQ ID NO: 4085740 - RNA, 13 nt, Variola virus
aaaugugauguau

SEQ ID NO: 4085741 - RNA, 23 nt, Variola virus
aaaugugguaugucuccauuaca

SEQ ID NO: 4085742 - RNA, 15 nt, Variola virus
acugaacaggcauuu

SEQ ID NO: 4085743 - RNA, 14 nt, Variola virus
acugaaucauauau

SEQ ID NO: 4085744 - RNA, 15 nt, Variola virus
acugacagauguguu

SEQ ID NO: 4085745 - RNA, 18 nt, Variola virus
acugaguuuuuaggaaau

SEQ ID NO: 4085746 - RNA, 16 nt, Variola virus
acugaucccuaauuuc

SEQ ID NO: 4085747 - RNA, 15 nt, Variola virus
acugauuaacaaaug

SEQ ID NO: 4085748 - RNA, 15 nt, Variola virus
acugauucagaaaug

SEQ ID NO: 4085749 - RNA, 17 nt, Variola virus
acugcauccuucuaaga

SEQ ID NO: 4085750 - RNA, 20 nt, Variola virus
acuggagccauugucuuaac

SEQ ID NO: 4085751 - RNA, 16 nt, Variola virus
acuguauuaagaacag

SEQ ID NO: 4085752 - RNA, 22 nt, Variola virus
acuguauuuggaucuuuuguac

SEQ ID NO: 4085753 - RNA, 21 nt, Variola virus
acugucacuggaaagaugaua

SEQ ID NO: 4085754 - RNA, 16 nt, Variola virus
acuguccaaaaugaug

SEQ ID NO: 4085755 - RNA, 21 nt, Variola virus
acugucucauacacuacagua

SEQ ID NO: 4085756 - RNA, 21 nt, Variola virus
acugucuggcaauaaaugaua

SEQ ID NO: 4085757 - RNA, 15 nt, Variola virus
acuguggaauuauuu

SEQ ID NO: 4085758 - RNA, 15 nt, Variola virus
acuguucaaaauaua

SEQ ID NO: 4085759 - RNA, 18 nt, Variola virus
acuguucccgucaauaga

SEQ ID NO: 4085760 - RNA, 21 nt, Variola virus
acuuacagauggauaaaacuu

SEQ ID NO: 4085761 - RNA, 17 nt, Variola virus
acuuacgauagaaauag

SEQ ID NO: 4085762 - RNA, 19 nt, Variola virus
acuuagucuguacaaaagu

SEQ ID NO: 4085763 - RNA, 20 nt, Variola virus
acuuagucuguacaaaaguu

SEQ ID NO: 4085764 - RNA, 14 nt, Variola virus
acuuauuuaacucu

SEQ ID NO: 4085765 - RNA, 15 nt, Variola virus
acuucacagaugaua

SEQ ID NO: 4085766 - RNA, 21 nt, Variola virus
acuucagguuucuuagcuugu

SEQ ID NO: 4085767 - RNA, 13 nt, Variola virus
acuuccauggaaa

SEQ ID NO: 4085768 - RNA, 21 nt, Variola virus
acuucuaaaacagcugugaau

SEQ ID NO: 4085769 - RNA, 23 nt, Variola virus
acuucuaaugagcaaguagaaaa

SEQ ID NO: 4085770 - RNA, 13 nt, Variola virus
acuucucuaaaug

SEQ ID NO: 4085771 - RNA, 15 nt, Variola virus
acuucucuaaaugag

SEQ ID NO: 4085772 - RNA, 15 nt, Variola virus
acuucucuaucaaug

SEQ ID NO: 4085773 - RNA, 20 nt, Variola virus
acuucucuguccuuaauaag

SEQ ID NO: 4085774 - RNA, 16 nt, Variola virus
acuucugaagaaauug

SEQ ID NO: 4085775 - RNA, 22 nt, Variola virus
acuucugcagaauaauuagaaa

SEQ ID NO: 4085776 - RNA, 15 nt, Variola virus
acuugaagacauucc

SEQ ID NO: 4085777 - RNA, 20 nt, Variola virus
acuugaaucaccauccuuua

SEQ ID NO: 4085778 - RNA, 14 nt, Variola virus
acuugauacagcca

SEQ ID NO: 4085779 - RNA, 23 nt, Variola virus
acuuguauaugccaaaguuuaaa

SEQ ID NO: 4085780 - RNA, 14 nt, Variola virus
acuuguuaaagaag

SEQ ID NO: 4085781 - RNA, 14 nt, Variola virus
acuuguuggugaaa

SEQ ID NO: 4085782 - RNA, 17 nt, Variola virus
acuuguuuaacaaaguu

SEQ ID NO: 4085783 - RNA, 19 nt, Variola virus
acuuuaaagcaaaaugguu

SEQ ID NO: 4085784 - RNA, 15 nt, Variola virus
acuuuaagcuaaaau

SEQ ID NO: 4085785 - RNA, 23 nt, Variola virus
acuuuacaaacgauguacugaag

SEQ ID NO: 4085786 - RNA, 14 nt, Variola virus
acuuuacucuucua

SEQ ID NO: 4085787 - RNA, 14 nt, Variola virus
acuuuauauuuccu

SEQ ID NO: 4085788 - RNA, 18 nt, Variola virus
acuuuaucagaucaaaau

SEQ ID NO: 4085789 - RNA, 14 nt, Variola virus
acuuugauaauaag

SEQ ID NO: 4085790 - RNA, 16 nt, Variola virus
acuuugauuucuuauc

SEQ ID NO: 4085791 - RNA, 15 nt, Variola virus
acuuugguaaauguu

SEQ ID NO: 4085792 - RNA, 17 nt, Variola virus
acuuuguggaugaugau

SEQ ID NO: 4085793 - RNA, 20 nt, Variola virus
acuuuuaacacaccuaaaug

SEQ ID NO: 4085794 - RNA, 22 nt, Variola virus
acuuuuuaacgaaauuagaaaa

SEQ ID NO: 4085795 - RNA, 15 nt, Variola virus
acuuuuuauacuaau

SEQ ID NO: 4085796 - RNA, 22 nt, Variola virus
acuuuuuguuuauauuaaauau

SEQ ID NO: 4085797 - RNA, 22 nt, Variola virus
acuuuuuuacccacuauaaaau

SEQ ID NO: 4085798 - RNA, 15 nt, Variola virus
agaaaaaauaucuug

SEQ ID NO: 4085799 - RNA, 14 nt, Variola virus
agaaaaaaugauuu

SEQ ID NO: 4085800 - RNA, 17 nt, Variola virus
agaaaaacuuaguacua

SEQ ID NO: 4085801 - RNA, 20 nt, Variola virus
agaaaaaucauuaaaaagau

SEQ ID NO: 4085802 - RNA, 17 nt, Variola virus
agaaaacucguuauuaa

SEQ ID NO: 4085803 - RNA, 20 nt, Variola virus
agaaaacucguuauuaacua

SEQ ID NO: 4085804 - RNA, 15 nt, Variola virus
agaaaaggauguauu

SEQ ID NO: 4085805 - RNA, 14 nt, Variola virus
agaaaauacuauau

SEQ ID NO: 4085806 - RNA, 14 nt, Variola virus
agaaaauauaaauu

SEQ ID NO: 4085807 - RNA, 21 nt, Variola virus
agaaaaucagaucugauaaua

SEQ ID NO: 4085808 - RNA, 15 nt, Variola virus
agaaaauuuaauaaa

SEQ ID NO: 4085809 - RNA, 18 nt, Variola virus
agaaacagauagauaugu

SEQ ID NO: 4085810 - RNA, 13 nt, Variola virus
agaaacauauucu

SEQ ID NO: 4085811 - RNA, 19 nt, Variola virus
agaaacgauaccaucuucu

SEQ ID NO: 4085812 - RNA, 18 nt, Variola virus
agaaacuaauauaguuaa

SEQ ID NO: 4085813 - RNA, 22 nt, Variola virus
agaaacuauagauaaugauaua

SEQ ID NO: 4085814 - RNA, 23 nt, Variola virus
agaaacugacuugauaaaaaugg

SEQ ID NO: 4085815 - RNA, 15 nt, Variola virus
agaaacuuuuucgaa

SEQ ID NO: 4085816 - RNA, 18 nt, Variola virus
agaaagcuguggauguuu

SEQ ID NO: 4085817 - RNA, 14 nt, Variola virus
agaaaguaugauau

SEQ ID NO: 4085818 - RNA, 15 nt, Variola virus
agaaaguaugauaua

SEQ ID NO: 4085819 - RNA, 12 nt, Variola virus
agaaauaaagua

SEQ ID NO: 4085820 - RNA, 14 nt, Variola virus
agaaauaauauuaa

SEQ ID NO: 4085821 - RNA, 16 nt, Variola virus
agaaauaucuauaauu

SEQ ID NO: 4085822 - RNA, 14 nt, Variola virus
agaaaucaacuuau

SEQ ID NO: 4085823 - RNA, 16 nt, Variola virus
agaaaucaaucuaucu

SEQ ID NO: 4085824 - RNA, 22 nt, Variola virus
agaaaucauauaugauauuccu

SEQ ID NO: 4085825 - RNA, 20 nt, Variola virus
agaaaugaaguuaugacauu

SEQ ID NO: 4085826 - RNA, 12 nt, Variola virus
agaaaugauauc

SEQ ID NO: 4085827 - RNA, 21 nt, Variola virus
agaaauggaagaguuaauaaa

SEQ ID NO: 4085828 - RNA, 23 nt, Variola virus
auauucuucuacgaucucacuaa

SEQ ID NO: 4085829 - RNA, 17 nt, Variola virus
auauucuuuuuuauaga

SEQ ID NO: 4085830 - RNA, 14 nt, Variola virus
auauuguacaguac

SEQ ID NO: 4085831 - RNA, 16 nt, Variola virus
auauugucacaugucu

SEQ ID NO: 4085832 - RNA, 15 nt, Variola virus
auauuguuacagcca

SEQ ID NO: 4085833 - RNA, 18 nt, Variola virus
auauuuauaaaaaugcua

SEQ ID NO: 4085834 - RNA, 16 nt, Variola virus
auauuuauaaaguauu

SEQ ID NO: 4085835 - RNA, 17 nt, Variola virus
auauuucuaguuuguaa

SEQ ID NO: 4085836 - RNA, 12 nt, Variola virus
auauuucugaag

SEQ ID NO: 4085837 - RNA, 15 nt, Variola virus
auauuugcuaauaau

SEQ ID NO: 4085838 - RNA, 22 nt, Variola virus
auauuuggcuaaauuauauaau

SEQ ID NO: 4085839 - RNA, 21 nt, Variola virus
auauuuuucguuuacaaaauc

SEQ ID NO: 4085840 - RNA, 21 nt, Variola virus
auauuuuugauggguaagcca

SEQ ID NO: 4085841 - RNA, 14 nt, Variola virus
auauuuuuuaacua

SEQ ID NO: 4085842 - RNA, 21 nt, Variola virus
aucaaaaauaaaauacauuua

SEQ ID NO: 4085843 - RNA, 15 nt, Variola virus
aucaaaagaaugauu

SEQ ID NO: 4085844 - RNA, 19 nt, Variola virus
aucaaaaucguauaaaguu

SEQ ID NO: 4085845 - RNA, 22 nt, Variola virus
aucaaacaaaaaagcucaauaa

SEQ ID NO: 4085846 - RNA, 15 nt, Variola virus
aucaaagaagaaguu

SEQ ID NO: 4085847 - RNA, 13 nt, Variola virus
aucaaauacuuca

SEQ ID NO: 4085848 - RNA, 20 nt, Variola virus
aucaaaugguaaauacugua

SEQ ID NO: 4085849 - RNA, 21 nt, Variola virus
aucaaauuugguguuguuaaa

SEQ ID NO: 4085850 - RNA, 18 nt, Variola virus
aucaacagaaguuaauaa

SEQ ID NO: 4085851 - RNA, 24 nt, Variola virus
aucaacauaaugucauaguugaac

SEQ ID NO: 4085852 - RNA, 15 nt, Variola virus
aucaacauauagaac

SEQ ID NO: 4085853 - RNA, 13 nt, Variola virus
aucaacauauuaa

SEQ ID NO: 4085854 - RNA, 15 nt, Variola virus
aucaacauauuaaug

SEQ ID NO: 4085855 - RNA, 16 nt, Variola virus
aucaacgaguuaaaaa

SEQ ID NO: 4085856 - RNA, 20 nt, Variola virus
aucaacgauucuagaacguc

SEQ ID NO: 4085857 - RNA, 21 nt, Variola virus
aucaacguagaaaaaauagaa

SEQ ID NO: 4085858 - RNA, 21 nt, Variola virus
aucaacuucuugcgugucuuu

SEQ ID NO: 4085859 - RNA, 18 nt, Variola virus
aucaacuuuauuagauaa

SEQ ID NO: 4085860 - RNA, 21 nt, Variola virus
aucaagucuuuauacaaugac

SEQ ID NO: 4085861 - RNA, 23 nt, Variola virus
aucaaguuuguaggaaaggacaa

SEQ ID NO: 4085862 - RNA, 16 nt, Variola virus
aucaauaauaguaaca

SEQ ID NO: 4085863 - RNA, 17 nt, Variola virus
aucaauauaucaucuau

SEQ ID NO: 4085864 - RNA, 17 nt, Variola virus
aucaaugaguaagacuu

SEQ ID NO: 4085865 - RNA, 15 nt, Variola virus
aucaaugauaugauu

SEQ ID NO: 4085866 - RNA, 19 nt, Variola virus
aucaauguguguaacucca

SEQ ID NO: 4085867 - RNA, 22 nt, Variola virus
aucaauuauguaaauaucuuua

SEQ ID NO: 4085868 - RNA, 19 nt, Variola virus
aucaauuuuaaagguauaa

SEQ ID NO: 4085869 - RNA, 19 nt, Variola virus
aucaauuuugaaaauacuu

SEQ ID NO: 4085870 - RNA, 21 nt, Variola virus
aucaauuuugaaaauacuuag

SEQ ID NO: 4085871 - RNA, 15 nt, Variola virus
aucacaaaaaaaacu

SEQ ID NO: 4085872 - RNA, 13 nt, Variola virus
aucacaagaaguu

SEQ ID NO: 4085873 - RNA, 22 nt, Variola virus
aucacauuauaugauucuguaa

SEQ ID NO: 4085874 - RNA, 22 nt, Variola virus
aucaccauggacauaaagauag

SEQ ID NO: 4085875 - RNA, 13 nt, Variola virus
aucacuaauucca

SEQ ID NO: 4085876 - RNA, 16 nt, Variola virus
aucacuacaauaauua

SEQ ID NO: 4085877 - RNA, 23 nt, Variola virus
aucacuaccgaguuuaaaacuuc

SEQ ID NO: 4085878 - RNA, 22 nt, Variola virus
aucacuaucuucaucauauuca

SEQ ID NO: 4085879 - RNA, 18 nt, Variola virus
aucagaaaggauagagca

SEQ ID NO: 4085880 - RNA, 13 nt, Variola virus
aucagagaacuuc

SEQ ID NO: 4085881 - RNA, 19 nt, Variola virus
aucagagagauagaagaac

SEQ ID NO: 4085882 - RNA, 17 nt, Variola virus
aucagauaaguaugaag

SEQ ID NO: 4085883 - RNA, 15 nt, Variola virus
aucagaucaaaauua

SEQ ID NO: 4085884 - RNA, 13 nt, Variola virus
aucagaucauauu

SEQ ID NO: 4085885 - RNA, 20 nt, Variola virus
aucagaugauaucaguauau

SEQ ID NO: 4085886 - RNA, 20 nt, Variola virus
aucagcauccacucauauag

SEQ ID NO: 4085887 - RNA, 14 nt, Variola virus
aucagcgauuccua

SEQ ID NO: 4085888 - RNA, 21 nt, Variola virus
aucaggauccaagcuuucuaa

SEQ ID NO: 4085889 - RNA, 20 nt, Variola virus
aucaguauauaaaaagaaug

SEQ ID NO: 4085890 - RNA, 20 nt, Variola virus
aucaguuauaaaaaauaaag

SEQ ID NO: 4085891 - RNA, 17 nt, Variola virus
aucauaaauaaaaauag

SEQ ID NO: 4085892 - RNA, 15 nt, Variola virus
aucauacaaugaauu

SEQ ID NO: 4085893 - RNA, 15 nt, Variola virus
aucauauauagaaug

SEQ ID NO: 4085894 - RNA, 13 nt, Variola virus
aucauaucuguaa

SEQ ID NO: 4085895 - RNA, 20 nt, Variola virus
aucaucaaccgucacauaau

SEQ ID NO: 4085896 - RNA, 18 nt, Variola virus
aucaucgaucuaauagau

SEQ ID NO: 4085897 - RNA, 18 nt, Variola virus
aucaucgugugauaugaa

SEQ ID NO: 4085898 - RNA, 21 nt, Variola virus
aucaucguuaggauuugguaa

SEQ ID NO: 4085899 - RNA, 15 nt, Variola virus
aucaugaaacaauau

SEQ ID NO: 4085900 - RNA, 14 nt, Variola virus
aucauguaaauguu

SEQ ID NO: 4085901 - RNA, 21 nt, Variola virus
aucauguagauaguuaccauc

SEQ ID NO: 4085902 - RNA, 16 nt, Variola virus
aucauguguaaaaagu

SEQ ID NO: 4085903 - RNA, 16 nt, Variola virus
aucauguuaaugucuu

SEQ ID NO: 4085904 - RNA, 15 nt, Variola virus
aucauuaauacagua

SEQ ID NO: 4085905 - RNA, 15 nt, Variola virus
aucauuaaugauaua

SEQ ID NO: 4085906 - RNA, 18 nt, Variola virus
aucauuaggaaucuaucc

SEQ ID NO: 4085907 - RNA, 17 nt, Variola virus
aucauuauaauaugaug

SEQ ID NO: 4085908 - RNA, 16 nt, Variola virus
aucauuauuuacugaa

SEQ ID NO: 4085909 - RNA, 22 nt, Variola virus
aucauuucgacauuaauuccuu

SEQ ID NO: 4085910 - RNA, 18 nt, Variola virus
auccaaaauacaaaaugu

SEQ ID NO: 4085911 - RNA, 15 nt, Variola virus
auccaaaauauuaau

SEQ ID NO: 4085912 - RNA, 12 nt, Variola virus
auccaaacauua

SEQ ID NO: 4085913 - RNA, 17 nt, Variola virus
auccaaacccuugaucu

SEQ ID NO: 4085914 - RNA, 13 nt, Variola virus
auccaauaauuua

SEQ ID NO: 4085915 - RNA, 20 nt, Variola virus
auccaauguguuuaauauau

SEQ ID NO: 4085916 - RNA, 19 nt, Variola virus
auccaauuguuugauauau

SEQ ID NO: 4085917 - RNA, 22 nt, Variola virus
auccacuauuaucaauucugga

SEQ ID NO: 4085918 - RNA, 19 nt, Variola virus
auccagaauguacacuauu

SEQ ID NO: 4085919 - RNA, 13 nt, Variola virus
auccauuucuaga

SEQ ID NO: 4085920 - RNA, 13 nt, Variola virus
aucccaaacauug

SEQ ID NO: 4085921 - RNA, 15 nt, Variola virus
aucccggauacuuuu

SEQ ID NO: 4085922 - RNA, 15 nt, Variola virus
auccgauaaacauug

SEQ ID NO: 4085923 - RNA, 19 nt, Variola virus
auccggauuuccaaagaau

SEQ ID NO: 4085924 - RNA, 22 nt, Variola virus
auccuaaagguaaauguaaauu

SEQ ID NO: 4085925 - RNA, 13 nt, Variola virus
auccuaacaauga

SEQ ID NO: 4085926 - RNA, 16 nt, Variola virus
auccucagacacagau

SEQ ID NO: 4085927 - RNA, 17 nt, Variola virus
auccucgcuuuguguau

SEQ ID NO: 4085928 - RNA, 14 nt, Variola virus
auccugauauuaau

SEQ ID NO: 4085929 - RNA, 20 nt, Variola virus
auccuucagauaaucugaaa

SEQ ID NO: 4085930 - RNA, 15 nt, Variola virus
auccuucuagaauua

SEQ ID NO: 4085931 - RNA, 20 nt, Variola virus
aucgaagugacacucuauau

SEQ ID NO: 4085932 - RNA, 14 nt, Variola virus
aucgauagacacug

SEQ ID NO: 4085933 - RNA, 18 nt, Variola virus
aucgauauugaaaaugac

SEQ ID NO: 4085934 - RNA, 20 nt, Variola virus
aucgauccucacuucgaaga

SEQ ID NO: 4085935 - RNA, 14 nt, Variola virus
aucgcaauauccuu

SEQ ID NO: 4085936 - RNA, 19 nt, Variola virus
aucgcuacaaaacuacuau

SEQ ID NO: 4085937 - RNA, 21 nt, Variola virus
aucgcuauaauucauauuaau

SEQ ID NO: 4085938 - RNA, 22 nt, Variola virus
aucggaacacuugguaguugaa

SEQ ID NO: 4085939 - RNA, 17 nt, Variola virus
aucggauacagacacuc

SEQ ID NO: 4085940 - RNA, 19 nt, Variola virus
aucggccuucuuuuuuaca

SEQ ID NO: 4085941 - RNA, 14 nt, Variola virus
aucguaaaucuguu

SEQ ID NO: 4085942 - RNA, 13 nt, Variola virus
aucguauauuaag

SEQ ID NO: 4085943 - RNA, 12 nt, Variola virus
aucguccuaaua

SEQ ID NO: 4085944 - RNA, 19 nt, Variola virus
aucgucguacguuuacaca

SEQ ID NO: 4085945 - RNA, 18 nt, Variola virus
aucgucuauauaugaaua

SEQ ID NO: 4085946 - RNA, 15 nt, Variola virus
aucguuaagaauugu

SEQ ID NO: 4085947 - RNA, 13 nt, Variola virus
aucguuacaaaag

SEQ ID NO: 4085948 - RNA, 15 nt, Variola virus
aucguuuaaaguaaa

SEQ ID NO: 4085949 - RNA, 16 nt, Variola virus
aucuaaaauugcauuu

SEQ ID NO: 4085950 - RNA, 20 nt, Variola virus
aucuaaagauaaucuucucu

SEQ ID NO: 4085951 - RNA, 23 nt, Variola virus
aucuaacaaaaauuaugaaauaa

SEQ ID NO: 4085952 - RNA, 16 nt, Variola virus
aucuaacagaaacguu

SEQ ID NO: 4085953 - RNA, 16 nt, Variola virus
aucuaacauaguuuua

SEQ ID NO: 4085954 - RNA, 16 nt, Variola virus
aucuaacaucuugauu

SEQ ID NO: 4085955 - RNA, 22 nt, Variola virus
aucuaauaaguugcgaugaaau

SEQ ID NO: 4085956 - RNA, 16 nt, Variola virus
aucuaaucagaaucuu

SEQ ID NO: 4085957 - RNA, 16 nt, Variola virus
aucuaauuuacuaucu

SEQ ID NO: 4085958 - RNA, 21 nt, Variola virus
aucuaccauaguuacagaauu

SEQ ID NO: 4085959 - RNA, 21 nt, Variola virus
aucuacgauccaucaaaaaac

SEQ ID NO: 4085960 - RNA, 18 nt, Variola virus
aucuacguucauauguau

SEQ ID NO: 4085961 - RNA, 14 nt, Variola virus
aucuagacauagau

SEQ ID NO: 4085962 - RNA, 15 nt, Variola virus
aucuagacucuauau

SEQ ID NO: 4085963 - RNA, 20 nt, Variola virus
aucuagauuguuuaauauau

SEQ ID NO: 4085964 - RNA, 20 nt, Variola virus
aucuagucaccgagggaaaa

SEQ ID NO: 4085965 - RNA, 13 nt, Variola virus
aucuaguuaccuu

SEQ ID NO: 4085966 - RNA, 20 nt, Variola virus
aucuauaaaauuuuaauuaa

SEQ ID NO: 4085967 - RNA, 21 nt, Variola virus
aucuauaaaauuuuaauuaag

SEQ ID NO: 4085968 - RNA, 21 nt, Variola virus
aucuauaauuugugaguuuuc

SEQ ID NO: 4085969 - RNA, 14 nt, Variola virus
aucuauauauguau

SEQ ID NO: 4085970 - RNA, 20 nt, Variola virus
aucuauauuuaucacagucu

SEQ ID NO: 4085971 - RNA, 17 nt, Variola virus
aucuaucaaacaaaauu

SEQ ID NO: 4085972 - RNA, 18 nt, Variola virus
aucuaucuuaaagacuau

SEQ ID NO: 4085973 - RNA, 13 nt, Variola virus
aucuauguagaau

SEQ ID NO: 4085974 - RNA, 19 nt, Variola virus
aucuauuaaagacagagau

SEQ ID NO: 4085975 - RNA, 23 nt, Variola virus
aucuauuagaagcuaacaaaauu

SEQ ID NO: 4085976 - RNA, 17 nt, Variola virus
aucuauuauugaugcaa

SEQ ID NO: 4085977 - RNA, 18 nt, Variola virus
aucuauucauaugcaucu

SEQ ID NO: 4085978 - RNA, 15 nt, Variola virus
aucuauuuuaaauac

SEQ ID NO: 4085979 - RNA, 15 nt, Variola virus
aucucaacaaaauuc

SEQ ID NO: 4085980 - RNA, 17 nt, Variola virus
aucucagugcaaagauu

SEQ ID NO: 4085981 - RNA, 14 nt, Variola virus
aucucaucauucca

SEQ ID NO: 4085982 - RNA, 22 nt, Variola virus
aucuccacacagucaaauccgu

SEQ ID NO: 4085983 - RNA, 19 nt, Variola virus
aucuccuuauuuuuaaaaa

SEQ ID NO: 4085984 - RNA, 14 nt, Variola virus
aucucgccaaaaua

SEQ ID NO: 4085985 - RNA, 16 nt, Variola virus
aucucguccuugguuu

SEQ ID NO: 4085986 - RNA, 22 nt, Variola virus
aucucuaacgagugaucaaauu

SEQ ID NO: 4085987 - RNA, 15 nt, Variola virus
aucucuuaaaugcua

SEQ ID NO: 4085988 - RNA, 16 nt, Variola virus
aucucuugacaaaaau

SEQ ID NO: 4085989 - RNA, 13 nt, Variola virus
aucucuuucagua

SEQ ID NO: 4085990 - RNA, 16 nt, Variola virus
aucucuuuuuaacuaa

SEQ ID NO: 4085991 - RNA, 20 nt, Variola virus
aucugaaauaacauauagau

SEQ ID NO: 4085992 - RNA, 13 nt, Variola virus
aucugaucuuguu

SEQ ID NO: 4085993 - RNA, 15 nt, Variola virus
aucugaugaauaauu

SEQ ID NO: 4085994 - RNA, 19 nt, Variola virus
aucuggaggauguauauau

SEQ ID NO: 4085995 - RNA, 18 nt, Variola virus
aucugguagcaaagaaau

SEQ ID NO: 4085996 - RNA, 20 nt, Variola virus
aucugguuuaggaaagacag

SEQ ID NO: 4085997 - RNA, 17 nt, Variola virus
aucuguacuucuauaca

SEQ ID NO: 4085998 - RNA, 17 nt, Variola virus
aucuguggcguugcaua

SEQ ID NO: 4085999 - RNA, 14 nt, Variola virus
aucuguuuaucauu

SEQ ID NO: 4086000 - RNA, 21 nt, Variola virus
aucuuaauccuucuagaauua

SEQ ID NO: 4086001 - RNA, 16 nt, Variola virus
aucuuaccaucuucuu

SEQ ID NO: 4086002 - RNA, 17 nt, Variola virus
aucuuauaaaacuguca

SEQ ID NO: 4086003 - RNA, 19 nt, Variola virus
aucuuauauacacauaauu

SEQ ID NO: 4086004 - RNA, 15 nt, Variola virus
aucuuauucaagcaa

SEQ ID NO: 4086005 - RNA, 14 nt, Variola virus
aucuuauuuagaga

SEQ ID NO: 4086006 - RNA, 20 nt, Variola virus
aucuucacauuguaacuauu

SEQ ID NO: 4086007 - RNA, 17 nt, Variola virus
aucuucauaaaauacua

SEQ ID NO: 4086008 - RNA, 18 nt, Variola virus
aucuucuauaucuagauu

SEQ ID NO: 4086009 - RNA, 20 nt, Variola virus
aucuucucuccgguuaauaa

SEQ ID NO: 4086010 - RNA, 20 nt, Variola virus
aucuucucuccuuucaaacu

SEQ ID NO: 4086011 - RNA, 19 nt, Variola virus
aucuugcaaguuaaauaga

SEQ ID NO: 4086012 - RNA, 15 nt, Variola virus
aucuuguucagaaau

SEQ ID NO: 4086013 - RNA, 23 nt, Variola virus
aucuuuaacgauaccuauaccua

SEQ ID NO: 4086014 - RNA, 17 nt, Variola virus
aucuuuaauagaacucu

SEQ ID NO: 4086015 - RNA, 19 nt, Variola virus
aucuuuucacguuaaauga

SEQ ID NO: 4086016 - RNA, 17 nt, Variola virus
aucuuuucacuaaauaa

SEQ ID NO: 4086017 - RNA, 17 nt, Variola virus
aucuuuuguucuagaug

SEQ ID NO: 4086018 - RNA, 21 nt, Variola virus
aucuuuuuguuggaaaaauga

SEQ ID NO: 4086019 - RNA, 14 nt, Variola virus
augaaaaaaaacac

SEQ ID NO: 4086020 - RNA, 13 nt, Variola virus
augaaaaaaagau

SEQ ID NO: 4086021 - RNA, 18 nt, Variola virus
augaaauaaguacaauga

SEQ ID NO: 4086022 - RNA, 22 nt, Variola virus
augaaauagcguucgucaacau

SEQ ID NO: 4086023 - RNA, 18 nt, Variola virus
augaaaucuaucuuauau

SEQ ID NO: 4086024 - RNA, 12 nt, Variola virus
augaaauguuug

SEQ ID NO: 4086025 - RNA, 17 nt, Variola virus
augaaauuuaaguaaca

SEQ ID NO: 4086026 - RNA, 15 nt, Variola virus
augaacaaaucaaua

SEQ ID NO: 4086027 - RNA, 19 nt, Variola virus
augaacacaaaugguguau

SEQ ID NO: 4086028 - RNA, 19 nt, Variola virus
augaacuagacaauaaugu

SEQ ID NO: 4086029 - RNA, 14 nt, Variola virus
augaacuuguuuaa

SEQ ID NO: 4086030 - RNA, 16 nt, Variola virus
augaagaauggaugau

SEQ ID NO: 4086031 - RNA, 18 nt, Variola virus
augaaguaguugcauaga

SEQ ID NO: 4086032 - RNA, 18 nt, Variola virus
augaauaucacauaucau

SEQ ID NO: 4086033 - RNA, 22 nt, Variola virus
augaauaucaggaaauguauaa

SEQ ID NO: 4086034 - RNA, 21 nt, Variola virus
augaaugcaagacucacgcau

SEQ ID NO: 4086035 - RNA, 22 nt, Variola virus
augacaucaacuacaaaugaua

SEQ ID NO: 4086036 - RNA, 22 nt, Variola virus
augacuccucuucauacagccu

SEQ ID NO: 4086037 - RNA, 16 nt, Variola virus
augacuggaaaucacu

SEQ ID NO: 4086038 - RNA, 14 nt, Variola virus
augagagucaauau

SEQ ID NO: 4086039 - RNA, 16 nt, Variola virus
augaggugguugcaga

SEQ ID NO: 4086040 - RNA, 18 nt, Variola virus
augaggugguugcagaau

SEQ ID NO: 4086041 - RNA, 15 nt, Variola virus
augaguaaugggguu

SEQ ID NO: 4086042 - RNA, 16 nt, Variola virus
augagucuuauagcau

SEQ ID NO: 4086043 - RNA, 14 nt, Variola virus
augaguuaauguau

SEQ ID NO: 4086044 - RNA, 14 nt, Variola virus
augaguuagauuac

SEQ ID NO: 4086045 - RNA, 20 nt, Variola virus
augaguuauuaagaaauaca

SEQ ID NO: 4086046 - RNA, 19 nt, Variola virus
augauaaaaacacguuuau

SEQ ID NO: 4086047 - RNA, 15 nt, Variola virus
augauaaacuaacua

SEQ ID NO: 4086048 - RNA, 18 nt, Variola virus
augauaaacuuaaugaaa

SEQ ID NO: 4086049 - RNA, 16 nt, Variola virus
augauaccugcauaug

SEQ ID NO: 4086050 - RNA, 19 nt, Variola virus
augauauacagucuuaaau

SEQ ID NO: 4086051 - RNA, 19 nt, Variola virus
augauauauuaaacaacga

SEQ ID NO: 4086052 - RNA, 21 nt, Variola virus
augauauccacuaguuuccuu

SEQ ID NO: 4086053 - RNA, 17 nt, Variola virus
augauguuuuuagaaaa

SEQ ID NO: 4086054 - RNA, 17 nt, Variola virus
augauucgauaaauaaa

SEQ ID NO: 4086055 - RNA, 16 nt, Variola virus
augauugauuagaaaa

SEQ ID NO: 4086056 - RNA, 13 nt, Variola virus
augauugcauauu

SEQ ID NO: 4086057 - RNA, 23 nt, Variola virus
augauugcauauuuaucuuucuu

SEQ ID NO: 4086058 - RNA, 16 nt, Variola virus
augauugggaaccagu

SEQ ID NO: 4086059 - RNA, 15 nt, Variola virus
augauuguaaugaac

SEQ ID NO: 4086060 - RNA, 12 nt, Variola virus
augcaaacauua

SEQ ID NO: 4086061 - RNA, 23 nt, Variola virus
augcaaacuuacagaaacaauga

SEQ ID NO: 4086062 - RNA, 14 nt, Variola virus
augcaacauuuccu

SEQ ID NO: 4086063 - RNA, 14 nt, Variola virus
augcagaaaugauu

SEQ ID NO: 4086064 - RNA, 16 nt, Variola virus
augcagacaaaaugaa

SEQ ID NO: 4086065 - RNA, 14 nt, Variola virus
augccaaaaucaua

SEQ ID NO: 4086066 - RNA, 22 nt, Variola virus
augccuauuaggacagauacua

SEQ ID NO: 4086067 - RNA, 18 nt, Variola virus
augccucagguucaucga

SEQ ID NO: 4086068 - RNA, 19 nt, Variola virus
augcuagugcucaaacaaa

SEQ ID NO: 4086069 - RNA, 13 nt, Variola virus
augcugugcuaua

SEQ ID NO: 4086070 - RNA, 20 nt, Variola virus
auggaacaauaaaagagaau

SEQ ID NO: 4086071 - RNA, 19 nt, Variola virus
auggagaauguuccuaaug

SEQ ID NO: 4086072 - RNA, 16 nt, Variola virus
auggaucuauucaaga

SEQ ID NO: 4086073 - RNA, 18 nt, Variola virus
auggaugagaacacguau

SEQ ID NO: 4086074 - RNA, 14 nt, Variola virus
auggauuacgugau

SEQ ID NO: 4086075 - RNA, 13 nt, Variola virus
caagaaugauauc

SEQ ID NO: 4086076 - RNA, 17 nt, Variola virus
caagaguaacuauugac

SEQ ID NO: 4086077 - RNA, 23 nt, Variola virus
caagauccucucuuaaaugaauc

SEQ ID NO: 4086078 - RNA, 18 nt, Variola virus
caagauuuguagaagcau

SEQ ID NO: 4086079 - RNA, 17 nt, Variola virus
caagcuaggcuggaaac

SEQ ID NO: 4086080 - RNA, 20 nt, Variola virus
caaggaacuaaauagauuua

SEQ ID NO: 4086081 - RNA, 19 nt, Variola virus
caaggacagaaaaauguua

SEQ ID NO: 4086082 - RNA, 13 nt, Variola virus
caaggaucuucua

SEQ ID NO: 4086083 - RNA, 14 nt, Variola virus
caaguauacaauuu

SEQ ID NO: 4086084 - RNA, 17 nt, Variola virus
caagucaaagaaauacg

SEQ ID NO: 4086085 - RNA, 15 nt, Variola virus
caagucauuacuaau

SEQ ID NO: 4086086 - RNA, 16 nt, Variola virus
caaguuugagauuuca

SEQ ID NO: 4086087 - RNA, 19 nt, Variola virus
caaguuuggagaaauggag

SEQ ID NO: 4086088 - RNA, 19 nt, Variola virus
caaguuuucauaucaucuu

SEQ ID NO: 4086089 - RNA, 17 nt, Variola virus
caauaaacaaaauacuc

SEQ ID NO: 4086090 - RNA, 23 nt, Variola virus
caauaaauaugauuuuguaaagu

SEQ ID NO: 4086091 - RNA, 19 nt, Variola virus
caauaaaugcauuaguuua

SEQ ID NO: 4086092 - RNA, 17 nt, Variola virus
caauaauauuaugucua

SEQ ID NO: 4086093 - RNA, 20 nt, Variola virus
caauacauguuuuauaaaau

SEQ ID NO: 4086094 - RNA, 14 nt, Variola virus
caauagauagucua

SEQ ID NO: 4086095 - RNA, 18 nt, Variola virus
caauagaugauagaauau

SEQ ID NO: 4086096 - RNA, 16 nt, Variola virus
caauaguagcuauuac

SEQ ID NO: 4086097 - RNA, 17 nt, Variola virus
caauagugguaacgcua

SEQ ID NO: 4086098 - RNA, 22 nt, Variola virus
caauagugucuacuuaaaugua

SEQ ID NO: 4086099 - RNA, 14 nt, Variola virus
caauauaucaucua

SEQ ID NO: 4086100 - RNA, 19 nt, Variola virus
caauaugccacaccaucuu

SEQ ID NO: 4086101 - RNA, 17 nt, Variola virus
caauauuaauauuucua

SEQ ID NO: 4086102 - RNA, 18 nt, Variola virus
caaucaacggauaaucug

SEQ ID NO: 4086103 - RNA, 22 nt, Variola virus
caaucuuacagaaguucaugau

SEQ ID NO: 4086104 - RNA, 22 nt, Variola virus
caaucuuuuucuacgucaaauu

SEQ ID NO: 4086105 - RNA, 17 nt, Variola virus
caaugaacuaauauuua

SEQ ID NO: 4086106 - RNA, 14 nt, Variola virus
caaugaauuaacuu

SEQ ID NO: 4086107 - RNA, 23 nt, Variola virus
caaugaauuauggaauuguauau

SEQ ID NO: 4086108 - RNA, 19 nt, Variola virus
caaugacauggaaauaucu

SEQ ID NO: 4086109 - RNA, 16 nt, Variola virus
caaugacgaugauaug

SEQ ID NO: 4086110 - RNA, 15 nt, Variola virus
caaugagauaaauau

SEQ ID NO: 4086111 - RNA, 16 nt, Variola virus
caaugagauguaucau

SEQ ID NO: 4086112 - RNA, 18 nt, Variola virus
caauguacaccguguggu

SEQ ID NO: 4086113 - RNA, 18 nt, Variola virus
auagacuuguauaugcca

SEQ ID NO: 4086114 - RNA, 16 nt, Variola virus
auagaggauauuucau

SEQ ID NO: 4086115 - RNA, 17 nt, Variola virus
auagaguauaagaaauu

SEQ ID NO: 4086116 - RNA, 20 nt, Variola virus
auagaguuaaauucauauaa

SEQ ID NO: 4086117 - RNA, 14 nt, Variola virus
auagauagaacuac

SEQ ID NO: 4086118 - RNA, 21 nt, Variola virus
auagauauaauuaucacauau

SEQ ID NO: 4086119 - RNA, 15 nt, Variola virus
auagauaucaaaaua

SEQ ID NO: 4086120 - RNA, 15 nt, Variola virus
auagauucuugguaa

SEQ ID NO: 4086121 - RNA, 15 nt, Variola virus
auagcauaaaugcua

SEQ ID NO: 4086122 - RNA, 16 nt, Variola virus
auagcaugugaauaua

SEQ ID NO: 4086123 - RNA, 21 nt, Variola virus
auagcauuguuauguauuuca

SEQ ID NO: 4086124 - RNA, 18 nt, Variola virus
auagcauuguuauuagca

SEQ ID NO: 4086125 - RNA, 15 nt, Variola virus
auagccaaaagacua

SEQ ID NO: 4086126 - RNA, 18 nt, Variola virus
auagcuuccuucaaucua

SEQ ID NO: 4086127 - RNA, 15 nt, Variola virus
auaggaccauacauu

SEQ ID NO: 4086128 - RNA, 19 nt, Variola virus
auaggauuaacaacaaugu

SEQ ID NO: 4086129 - RNA, 15 nt, Variola virus
auagguaucaaagau

SEQ ID NO: 4086130 - RNA, 14 nt, Variola virus
auaggugaaaagau

SEQ ID NO: 4086131 - RNA, 23 nt, Variola virus
auagguguaaaucuagaaauuac

SEQ ID NO: 4086132 - RNA, 15 nt, Variola virus
auaguaaaaagacua

SEQ ID NO: 4086133 - RNA, 20 nt, Variola virus
auaguauacgcagaaaagau

SEQ ID NO: 4086134 - RNA, 13 nt, Variola virus
auaguaucaaacu

SEQ ID NO: 4086135 - RNA, 18 nt, Variola virus
auagugaaacaaaauaua

SEQ ID NO: 4086136 - RNA, 21 nt, Variola virus
auaguggauacgaagauacua

SEQ ID NO: 4086137 - RNA, 14 nt, Variola virus
auaguguauacaau

SEQ ID NO: 4086138 - RNA, 17 nt, Variola virus
auaguuaucuaucuuaa

SEQ ID NO: 4086139 - RNA, 19 nt, Variola virus
auaguuaucuaucuuaaag

SEQ ID NO: 4086140 - RNA, 18 nt, Variola virus
auaguuauuacuuuucuc

SEQ ID NO: 4086141 - RNA, 17 nt, Variola virus
auaguuccauuaucuaa

SEQ ID NO: 4086142 - RNA, 21 nt, Variola virus
auaguuccccauuucaaaaug

SEQ ID NO: 4086143 - RNA, 16 nt, Variola virus
auaguuuaucuuuccc

SEQ ID NO: 4086144 - RNA, 15 nt, Variola virus
auaguuucuauuuuu

SEQ ID NO: 4086145 - RNA, 12 nt, Variola virus
auauaaagaaau

SEQ ID NO: 4086146 - RNA, 12 nt, Variola virus
auauaaauacuu

SEQ ID NO: 4086147 - RNA, 16 nt, Variola virus
auauaaauuuaauaag

SEQ ID NO: 4086148 - RNA, 19 nt, Variola virus
auauaacaauaacauaacu

SEQ ID NO: 4086149 - RNA, 13 nt, Variola virus
auauaacauaggu

SEQ ID NO: 4086150 - RNA, 15 nt, Variola virus
auauaaguaguguaa

SEQ ID NO: 4086151 - RNA, 14 nt, Variola virus
auauaaucuagaca

SEQ ID NO: 4086152 - RNA, 15 nt, Variola virus
auauacaauaucacu

SEQ ID NO: 4086153 - RNA, 13 nt, Variola virus
auauacacauaau

SEQ ID NO: 4086154 - RNA, 20 nt, Variola virus
auauacauuuucaaauaaua

SEQ ID NO: 4086155 - RNA, 17 nt, Variola virus
auauaccgauauguaca

SEQ ID NO: 4086156 - RNA, 17 nt, Variola virus
auauaccgccucaaacu

SEQ ID NO: 4086157 - RNA, 21 nt, Variola virus
auauaccgccucaaacucuau

SEQ ID NO: 4086158 - RNA, 18 nt, Variola virus
auauaccuauuaauacau

SEQ ID NO: 4086159 - RNA, 14 nt, Variola virus
auauaccucauuaa

SEQ ID NO: 4086160 - RNA, 20 nt, Variola virus
auauacgaaauaaaauagac

SEQ ID NO: 4086161 - RNA, 20 nt, Variola virus
auauacuauucuugugauaa

SEQ ID NO: 4086162 - RNA, 22 nt, Variola virus
auauacucuaaucuuuaauaga

SEQ ID NO: 4086163 - RNA, 15 nt, Variola virus
auauacucuauuuca

SEQ ID NO: 4086164 - RNA, 21 nt, Variola virus
auauagaaccugaucuggaaa

SEQ ID NO: 4086165 - RNA, 14 nt, Variola virus
auauagacaaaaau

SEQ ID NO: 4086166 - RNA, 18 nt, Variola virus
auauagcuuuuauuucca

SEQ ID NO: 4086167 - RNA, 19 nt, Variola virus
auauagucuuguuaaacgu

SEQ ID NO: 4086168 - RNA, 14 nt, Variola virus
auauaguuuaaauu

SEQ ID NO: 4086169 - RNA, 11 nt, Variola virus
auauaguuuuu

SEQ ID NO: 4086170 - RNA, 13 nt, Variola virus
auauauaaugaau

SEQ ID NO: 4086171 - RNA, 13 nt, Variola virus
auauaucuaauaa

SEQ ID NO: 4086172 - RNA, 16 nt, Variola virus
auauaucuuauaucuc

SEQ ID NO: 4086173 - RNA, 20 nt, Variola virus
auauauuaauacacauaaug

SEQ ID NO: 4086174 - RNA, 15 nt, Variola virus
auauauuauauagau

SEQ ID NO: 4086175 - RNA, 20 nt, Variola virus
auauauuauuagagguauau

SEQ ID NO: 4086176 - RNA, 15 nt, Variola virus
auauauucgcauaua

SEQ ID NO: 4086177 - RNA, 16 nt, Variola virus
auauauuuauuuccag

SEQ ID NO: 4086178 - RNA, 18 nt, Variola virus
auauauuugaaaaucguu

SEQ ID NO: 4086179 - RNA, 20 nt, Variola virus
auaucaaacaauccaaaaaa

SEQ ID NO: 4086180 - RNA, 18 nt, Variola virus
auaucaaauacgcauaua

SEQ ID NO: 4086181 - RNA, 20 nt, Variola virus
auaucacaggggcaauguuu

SEQ ID NO: 4086182 - RNA, 14 nt, Variola virus
auaucaucaaaaua

SEQ ID NO: 4086183 - RNA, 16 nt, Variola virus
auaucaucgacaaaga

SEQ ID NO: 4086184 - RNA, 23 nt, Variola virus
auaucaugaugauuugguuguau

SEQ ID NO: 4086185 - RNA, 20 nt, Variola virus
auaucauuaaguucacuaga

SEQ ID NO: 4086186 - RNA, 23 nt, Variola virus
auaucauuaggauuuaacuccuu

SEQ ID NO: 4086187 - RNA, 21 nt, Variola virus
auaucauugaaugagauacua

SEQ ID NO: 4086188 - RNA, 16 nt, Variola virus
auauccagaauguuuc

SEQ ID NO: 4086189 - RNA, 13 nt, Variola virus
auauccaucacua

SEQ ID NO: 4086190 - RNA, 19 nt, Variola virus
auauccuccuuuaaaauua

SEQ ID NO: 4086191 - RNA, 19 nt, Variola virus
auauccucguucuaauugu

SEQ ID NO: 4086192 - RNA, 22 nt, Variola virus
auauccuuuagaguauuucuca

SEQ ID NO: 4086193 - RNA, 24 nt, Variola virus
auauccuuugcauucuauuuacca

SEQ ID NO: 4086194 - RNA, 20 nt, Variola virus
auaucggacgcagaaauugg

SEQ ID NO: 4086195 - RNA, 19 nt, Variola virus
auaucgguaccguuaaaga

SEQ ID NO: 4086196 - RNA, 16 nt, Variola virus
auaucuacuagaaaga

SEQ ID NO: 4086197 - RNA, 19 nt, Variola virus
auaucuacugauaaaacug

SEQ ID NO: 4086198 - RNA, 14 nt, Variola virus
auaucuagacacaa

SEQ ID NO: 4086199 - RNA, 15 nt, Variola virus
auaucuauaggaaag

SEQ ID NO: 4086200 - RNA, 14 nt, Variola virus
auaucuauguuuaa

SEQ ID NO: 4086201 - RNA, 16 nt, Variola virus
auaucuauucauaugc

SEQ ID NO: 4086202 - RNA, 18 nt, Variola virus
auaucugagcuaucuaga

SEQ ID NO: 4086203 - RNA, 18 nt, Variola virus
auaucugaguaugaugau

SEQ ID NO: 4086204 - RNA, 15 nt, Variola virus
auaucuuguucuaug

SEQ ID NO: 4086205 - RNA, 20 nt, Variola virus
auaucuuuacuaagaaaguu

SEQ ID NO: 4086206 - RNA, 16 nt, Variola virus
auaucuuugguguaaa

SEQ ID NO: 4086207 - RNA, 18 nt, Variola virus
auaugaaccugacaugau

SEQ ID NO: 4086208 - RNA, 20 nt, Variola virus
auaugacgcgcguucaacau

SEQ ID NO: 4086209 - RNA, 12 nt, Variola virus
auaugacuguau

SEQ ID NO: 4086210 - RNA, 19 nt, Variola virus
auaugcaaagaacaaaaua

SEQ ID NO: 4086211 - RNA, 23 nt, Variola virus
auaugccgugggaugaugucaaa

SEQ ID NO: 4086212 - RNA, 17 nt, Variola virus
auaugccuccagaaguu

SEQ ID NO: 4086213 - RNA, 15 nt, Variola virus
auaugcuacauguaa

SEQ ID NO: 4086214 - RNA, 14 nt, Variola virus
auaugcucuagaua

SEQ ID NO: 4086215 - RNA, 22 nt, Variola virus
auaugggauuuuacuuaauaua

SEQ ID NO: 4086216 - RNA, 18 nt, Variola virus
auauguagcaaacaugau

SEQ ID NO: 4086217 - RNA, 14 nt, Variola virus
auauguaucauaau

SEQ ID NO: 4086218 - RNA, 13 nt, Variola virus
auauguauuuccu

SEQ ID NO: 4086219 - RNA, 12 nt, Variola virus
auauguuaauaa

SEQ ID NO: 4086220 - RNA, 14 nt, Variola virus
auauguucguguau

SEQ ID NO: 4086221 - RNA, 21 nt, Variola virus
auauguuuuaauauuuacaag

SEQ ID NO: 4086222 - RNA, 18 nt, Variola virus
auauuaaaauucacacau

SEQ ID NO: 4086223 - RNA, 21 nt, Variola virus
auauuaacaaaagugaauaua

SEQ ID NO: 4086224 - RNA, 13 nt, Variola virus
auauuaaggagau

SEQ ID NO: 4086225 - RNA, 22 nt, Variola virus
auauuaaugcagggugcauauu

SEQ ID NO: 4086226 - RNA, 15 nt, Variola virus
auauuaaugucguau

SEQ ID NO: 4086227 - RNA, 15 nt, Variola virus
auauuacaaauacuu

SEQ ID NO: 4086228 - RNA, 15 nt, Variola virus
auauuacguaauaga

SEQ ID NO: 4086229 - RNA, 20 nt, Variola virus
auauuacuauuggcaauugu

SEQ ID NO: 4086230 - RNA, 15 nt, Variola virus
auauuauacaaaaua

SEQ ID NO: 4086231 - RNA, 20 nt, Variola virus
auauuauuacacauaaacau

SEQ ID NO: 4086232 - RNA, 17 nt, Variola virus
auauucaacauguuuaa

SEQ ID NO: 4086233 - RNA, 21 nt, Variola virus
auauucauuaauuuagauaga

SEQ ID NO: 4086234 - RNA, 15 nt, Variola virus
auauuccuagaauua

SEQ ID NO: 4086235 - RNA, 15 nt, Variola virus
auauucgaguucauu

SEQ ID NO: 4086236 - RNA, 19 nt, Variola virus
auauucuaacgauaauaga

SEQ ID NO: 4086237 - RNA, 14 nt, Variola virus
auauucuaugacug

SEQ ID NO: 4086238 - RNA, 20 nt, Variola virus
auauucucauggaaauauua

SEQ ID NO: 4086239 - RNA, 19 nt, Variola virus
caauguauauuuauacaga

SEQ ID NO: 4086240 - RNA, 14 nt, Variola virus
caauguuagaguau

SEQ ID NO: 4086241 - RNA, 11 nt, Variola virus
caauuaaugau

SEQ ID NO: 4086242 - RNA, 13 nt, Variola virus
caauuacaaaaac

SEQ ID NO: 4086243 - RNA, 21 nt, Variola virus
caauuacguggauuauaacau

SEQ ID NO: 4086244 - RNA, 22 nt, Variola virus
caauuaguagaguuuuauaacg

SEQ ID NO: 4086245 - RNA, 20 nt, Variola virus
caauuauaacaauuauaaca

SEQ ID NO: 4086246 - RNA, 18 nt, Variola virus
caauuauacuagaacuau

SEQ ID NO: 4086247 - RNA, 21 nt, Variola virus
caauucauuccuauaaguuua

SEQ ID NO: 4086248 - RNA, 13 nt, Variola virus
caauuccaaagau

SEQ ID NO: 4086249 - RNA, 22 nt, Variola virus
caauugguuaugauaucaugua

SEQ ID NO: 4086250 - RNA, 21 nt, Variola virus
caauuguauuauugauacaau

SEQ ID NO: 4086251 - RNA, 16 nt, Variola virus
caauugucuauacaag

SEQ ID NO: 4086252 - RNA, 19 nt, Variola virus
caauuguggacucacuaua

SEQ ID NO: 4086253 - RNA, 12 nt, Variola virus
caauuuacaaau

SEQ ID NO: 4086254 - RNA, 23 nt, Variola virus
caauuucauacgcuccucuuuug

SEQ ID NO: 4086255 - RNA, 18 nt, Variola virus
caauuuguauuauccaau

SEQ ID NO: 4086256 - RNA, 21 nt, Variola virus
caauuuuacccucaaucaugu

SEQ ID NO: 4086257 - RNA, 18 nt, Variola virus
caauuuuaucaucuucua

SEQ ID NO: 4086258 - RNA, 22 nt, Variola virus
caauuuucaguaccauuaucuu

SEQ ID NO: 4086259 - RNA, 21 nt, Variola virus
caauuuuguauuauucugaau

SEQ ID NO: 4086260 - RNA, 21 nt, Variola virus
cacaaagaauuuuagacacua

SEQ ID NO: 4086261 - RNA, 14 nt, Variola virus
cacaacuuaaugaa

SEQ ID NO: 4086262 - RNA, 17 nt, Variola virus
cacacacgauuaauuuu

SEQ ID NO: 4086263 - RNA, 20 nt, Variola virus
cacauagaccuccuccacca

SEQ ID NO: 4086264 - RNA, 11 nt, Variola virus
cacaucaucug

SEQ ID NO: 4086265 - RNA, 13 nt, Variola virus
cacaugaugauuu

SEQ ID NO: 4086266 - RNA, 23 nt, Variola virus
cacaugucacacaggauccauuu

SEQ ID NO: 4086267 - RNA, 16 nt, Variola virus
caccaagaaagcugua

SEQ ID NO: 4086268 - RNA, 20 nt, Variola virus
caccaucauaugacauuuca

SEQ ID NO: 4086269 - RNA, 18 nt, Variola virus
caccaucuucauaauaaa

SEQ ID NO: 4086270 - RNA, 15 nt, Variola virus
caccguaguguauau

SEQ ID NO: 4086271 - RNA, 19 nt, Variola virus
caccuuauccucagacaca

SEQ ID NO: 4086272 - RNA, 22 nt, Variola virus
cacgaccaaaucgauuacuaug

SEQ ID NO: 4086273 - RNA, 22 nt, Variola virus
cacguguagugggaacuauugc

SEQ ID NO: 4086274 - RNA, 20 nt, Variola virus
cacuaaaaugauuaaacaau

SEQ ID NO: 4086275 - RNA, 18 nt, Variola virus
cacuaacgcgcaugauuu

SEQ ID NO: 4086276 - RNA, 23 nt, Variola virus
cacuacaguaaguacaucaucug

SEQ ID NO: 4086277 - RNA, 12 nt, Variola virus
cacuacaucuuu

SEQ ID NO: 4086278 - RNA, 16 nt, Variola virus
cacuagguacaucauu

SEQ ID NO: 4086279 - RNA, 12 nt, Variola virus
cacuaucuucug

SEQ ID NO: 4086280 - RNA, 15 nt, Variola virus
cacucucgaaaucac

SEQ ID NO: 4086281 - RNA, 14 nt, Variola virus
cacugagaaacagc

SEQ ID NO: 4086282 - RNA, 15 nt, Variola virus
cacugucuaaaugua

SEQ ID NO: 4086283 - RNA, 23 nt, Variola virus
cacugucucauacacuacaguaa

SEQ ID NO: 4086284 - RNA, 20 nt, Variola virus
cacugucuggcaauaaauga

SEQ ID NO: 4086285 - RNA, 22 nt, Variola virus
cacuuagaacagauuuaacaau

SEQ ID NO: 4086286 - RNA, 21 nt, Variola virus
cacuucuucaacuaccaaaaa

SEQ ID NO: 4086287 - RNA, 15 nt, Variola virus
cacuuggauauugua

SEQ ID NO: 4086288 - RNA, 18 nt, Variola virus
cacuuuuuuauaaagaug

SEQ ID NO: 4086289 - RNA, 22 nt, Variola virus
cagaaagaggaucguacaucca

SEQ ID NO: 4086290 - RNA, 20 nt, Variola virus
cagaaccuguguuuauagug

SEQ ID NO: 4086291 - RNA, 22 nt, Variola virus
cagaagauagcaaagagaugau

SEQ ID NO: 4086292 - RNA, 15 nt, Variola virus
cagaaggaaacuucu

SEQ ID NO: 4086293 - RNA, 16 nt, Variola virus
cagaaggaaacuucuu

SEQ ID NO: 4086294 - RNA, 18 nt, Variola virus
cagaaucccuuuccaaag

SEQ ID NO: 4086295 - RNA, 15 nt, Variola virus
cagaauguuucaaag

SEQ ID NO: 4086296 - RNA, 20 nt, Variola virus
cagaauuguaacaacaaugu

SEQ ID NO: 4086297 - RNA, 18 nt, Variola virus
cagaauuucuacauaauu

SEQ ID NO: 4086298 - RNA, 15 nt, Variola virus
cagacaaaaugaaga

SEQ ID NO: 4086299 - RNA, 16 nt, Variola virus
cagacuauaccuagug

SEQ ID NO: 4086300 - RNA, 14 nt, Variola virus
cagagaaguauuuu

SEQ ID NO: 4086301 - RNA, 15 nt, Variola virus
cagagaccauguauu

SEQ ID NO: 4086302 - RNA, 15 nt, Variola virus
cagagcuugcucuau

SEQ ID NO: 4086303 - RNA, 19 nt, Variola virus
cagaggaacgccauauauu

SEQ ID NO: 4086304 - RNA, 14 nt, Variola virus
cagauaauaacaga

SEQ ID NO: 4086305 - RNA, 21 nt, Variola virus
cagauaauaaccuccugaaaa

SEQ ID NO: 4086306 - RNA, 19 nt, Variola virus
cagauaaucagccauaauu

SEQ ID NO: 4086307 - RNA, 17 nt, Variola virus
cagauaugguuaaauca

SEQ ID NO: 4086308 - RNA, 17 nt, Variola virus
cagaugcaccauauuua

SEQ ID NO: 4086309 - RNA, 17 nt, Variola virus
cagauguauaaguuuua

SEQ ID NO: 4086310 - RNA, 22 nt, Variola virus
cagauuaauaguuuuauuugaa

SEQ ID NO: 4086311 - RNA, 16 nt, Variola virus
cagauuauuuaacaau

SEQ ID NO: 4086312 - RNA, 16 nt, Variola virus
cagauucuuauauacc

SEQ ID NO: 4086313 - RNA, 23 nt, Variola virus
cagauuguugccguaaauccugc

SEQ ID NO: 4086314 - RNA, 22 nt, Variola virus
cagauuuaguauuaaacagauc

SEQ ID NO: 4086315 - RNA, 13 nt, Variola virus
cagccaacaaaua

SEQ ID NO: 4086316 - RNA, 16 nt, Variola virus
cagcgaacuugauauu

SEQ ID NO: 4086317 - RNA, 14 nt, Variola virus
cagcguaaaacaca

SEQ ID NO: 4086318 - RNA, 20 nt, Variola virus
cagcuauaugcaacuauaaa

SEQ ID NO: 4086319 - RNA, 22 nt, Variola virus
cagcuucccucuauacucucau

SEQ ID NO: 4086320 - RNA, 16 nt, Variola virus
aaacaacuaaacagua

SEQ ID NO: 4086321 - RNA, 23 nt, Variola virus
aaacaacugaagaaaauucucca

SEQ ID NO: 4086322 - RNA, 17 nt, Variola virus
aaacaauacagugauug

SEQ ID NO: 4086323 - RNA, 14 nt, Variola virus
aaacaauacucuac

SEQ ID NO: 4086324 - RNA, 19 nt, Variola virus
aaacaauacucuacuauua

SEQ ID NO: 4086325 - RNA, 17 nt, Variola virus
aaacaccuauggagaag

SEQ ID NO: 4086326 - RNA, 13 nt, Variola virus
aaacacgauguuu

SEQ ID NO: 4086327 - RNA, 14 nt, Variola virus
aaacagauaaugau

SEQ ID NO: 4086328 - RNA, 17 nt, Variola virus
aaacagucuuuaaguuc

SEQ ID NO: 4086329 - RNA, 15 nt, Variola virus
aaacauauauggucu

SEQ ID NO: 4086330 - RNA, 20 nt, Variola virus
aaacaucguuaucagauaac

SEQ ID NO: 4086331 - RNA, 14 nt, Variola virus
aaacauucauguac

SEQ ID NO: 4086332 - RNA, 21 nt, Variola virus
aaaccaacgaggaggaauauc

SEQ ID NO: 4086333 - RNA, 19 nt, Variola virus
aaaccaggcgaguguagaa

SEQ ID NO: 4086334 - RNA, 23 nt, Variola virus
aaaccaucuuacuuaaaauaugu

SEQ ID NO: 4086335 - RNA, 22 nt, Variola virus
aaaccauguugugaaagaguuu

SEQ ID NO: 4086336 - RNA, 16 nt, Variola virus
aaacgaauagaauaua

SEQ ID NO: 4086337 - RNA, 20 nt, Variola virus
aaacgacauugucagaaauu

SEQ ID NO: 4086338 - RNA, 14 nt, Variola virus
aaacggauaugucu

SEQ ID NO: 4086339 - RNA, 19 nt, Variola virus
aaacggauuaauauauguc

SEQ ID NO: 4086340 - RNA, 18 nt, Variola virus
aaacuaauuuuagcagaa

SEQ ID NO: 4086341 - RNA, 13 nt, Variola virus
aaacuagauacaa

SEQ ID NO: 4086342 - RNA, 17 nt, Variola virus
aaacuauaaaacagaua

SEQ ID NO: 4086343 - RNA, 12 nt, Variola virus
aaacuauacgaa

SEQ ID NO: 4086344 - RNA, 18 nt, Variola virus
aaacuaucugauguagga

SEQ ID NO: 4086345 - RNA, 23 nt, Variola virus
aaacuaugucaaaaauuguagaa

SEQ ID NO: 4086346 - RNA, 16 nt, Variola virus
aaacuccaacgagaua

SEQ ID NO: 4086347 - RNA, 20 nt, Variola virus
aaacucgcuuaauaucuucu

SEQ ID NO: 4086348 - RNA, 21 nt, Variola virus
aaacucgucuccccaaacauu

SEQ ID NO: 4086349 - RNA, 19 nt, Variola virus
aaacuuagaaccaaaugau

SEQ ID NO: 4086350 - RNA, 11 nt, Variola virus
aaacuuuaucu

SEQ ID NO: 4086351 - RNA, 14 nt, Variola virus
aaacuuuuuagaaa

SEQ ID NO: 4086352 - RNA, 24 nt, Variola virus
aaagaacggagaauaucuauacau

SEQ ID NO: 4086353 - RNA, 14 nt, Variola virus
aaagaaguauacua

SEQ ID NO: 4086354 - RNA, 15 nt, Variola virus
aaagacaucauauau

SEQ ID NO: 4086355 - RNA, 13 nt, Variola virus
aaagagacuacaa

SEQ ID NO: 4086356 - RNA, 16 nt, Variola virus
aaagaggaucguacau

SEQ ID NO: 4086357 - RNA, 14 nt, Variola virus
aaagaguuugugaa

SEQ ID NO: 4086358 - RNA, 18 nt, Variola virus
aaagauaauacauuuucu

SEQ ID NO: 4086359 - RNA, 14 nt, Variola virus
aaagauagaaauga

SEQ ID NO: 4086360 - RNA, 15 nt, Variola virus
aaagauauuccaaga

SEQ ID NO: 4086361 - RNA, 22 nt, Variola virus
ccaauaauguauagacaauuau

SEQ ID NO: 4086362 - RNA, 12 nt, Variola virus
ccaauacauguu

SEQ ID NO: 4086363 - RNA, 20 nt, Variola virus
ccaauauauaucaugaucuu

SEQ ID NO: 4086364 - RNA, 20 nt, Variola virus
ccaaucaacgaauuaaugau

SEQ ID NO: 4086365 - RNA, 15 nt, Variola virus
ccaaugaguaaaauc

SEQ ID NO: 4086366 - RNA, 17 nt, Variola virus
ccaauuacaaaaacuac

SEQ ID NO: 4086367 - RNA, 20 nt, Variola virus
ccacaaauugcauauuugga

SEQ ID NO: 4086368 - RNA, 22 nt, Variola virus
ccacuagaagagaauacacaug

SEQ ID NO: 4086369 - RNA, 20 nt, Variola virus
ccacugagaugacuggaaau

SEQ ID NO: 4086370 - RNA, 12 nt, Variola virus
ccacuuaaauau

SEQ ID NO: 4086371 - RNA, 22 nt, Variola virus
ccagaaaacgacgaagagcaaa

SEQ ID NO: 4086372 - RNA, 21 nt, Variola virus
ccagaguauuuguacacaucu

SEQ ID NO: 4086373 - RNA, 15 nt, Variola virus
ccagcauuaacugau

SEQ ID NO: 4086374 - RNA, 14 nt, Variola virus
ccaggcuauguuuc

SEQ ID NO: 4086375 - RNA, 16 nt, Variola virus
ccaguguauaaacgca

SEQ ID NO: 4086376 - RNA, 15 nt, Variola virus
ccaguuauguucaac

SEQ ID NO: 4086377 - RNA, 14 nt, Variola virus
ccaguuccuuuucu

SEQ ID NO: 4086378 - RNA, 15 nt, Variola virus
ccauaauuuucucuc

SEQ ID NO: 4086379 - RNA, 14 nt, Variola virus
ccauacuaacugau

SEQ ID NO: 4086380 - RNA, 21 nt, Variola virus
ccauagucuucaauaauucua

SEQ ID NO: 4086381 - RNA, 15 nt, Variola virus
ccauaguuuuucuac

SEQ ID NO: 4086382 - RNA, 17 nt, Variola virus
ccauauauccaauaaag

SEQ ID NO: 4086383 - RNA, 14 nt, Variola virus
ccauauuuuuugca

SEQ ID NO: 4086384 - RNA, 15 nt, Variola virus
ccaucaaauuguuua

SEQ ID NO: 4086385 - RNA, 21 nt, Variola virus
ccauccauugcguugaaugau

SEQ ID NO: 4086386 - RNA, 23 nt, Variola virus
ccauccauuuuaugcgauguuua

SEQ ID NO: 4086387 - RNA, 21 nt, Variola virus
ccaucguaauacccauguuua

SEQ ID NO: 4086388 - RNA, 17 nt, Variola virus
ccaucuccuuauuuuua

SEQ ID NO: 4086389 - RNA, 16 nt, Variola virus
ccaucugguuuaauau

SEQ ID NO: 4086390 - RNA, 18 nt, Variola virus
ccaucugucauauuuaga

SEQ ID NO: 4086391 - RNA, 21 nt, Variola virus
ccaucuuuaggcauaaacgau

SEQ ID NO: 4086392 - RNA, 17 nt, Variola virus
ccaugaaacgaacacua

SEQ ID NO: 4086393 - RNA, 17 nt, Variola virus
ccaugcaacauuuccua

SEQ ID NO: 4086394 - RNA, 21 nt, Variola virus
ccaugucaaauagaguuuaua

SEQ ID NO: 4086395 - RNA, 22 nt, Variola virus
ccaugucugaaacgagacgcua

SEQ ID NO: 4086396 - RNA, 15 nt, Variola virus
ccauuaaucacugau

SEQ ID NO: 4086397 - RNA, 19 nt, Variola virus
ccauuauuucuauauuuga

SEQ ID NO: 4086398 - RNA, 16 nt, Variola virus
ccauucuaauacuuua

SEQ ID NO: 4086399 - RNA, 18 nt, Variola virus
ccauugcuagucacuuua

SEQ ID NO: 4086400 - RNA, 12 nt, Variola virus
ccauuuaaauau

SEQ ID NO: 4086401 - RNA, 12 nt, Variola virus
ccauuuuagaga

SEQ ID NO: 4086402 - RNA, 22 nt, Variola virus
cccaauagaauaguauucucag

SEQ ID NO: 4086403 - RNA, 13 nt, Variola virus
cccaccaaucaac

SEQ ID NO: 4086404 - RNA, 16 nt, Variola virus
cccacugaugagaugu

SEQ ID NO: 4086405 - RNA, 22 nt, Variola virus
cccauuuuuugcuuucuguauc

SEQ ID NO: 4086406 - RNA, 23 nt, Variola virus
cccccguauuuacauuaaaugua

SEQ ID NO: 4086407 - RNA, 19 nt, Variola virus
cccggguacguggauauca

SEQ ID NO: 4086408 - RNA, 21 nt, Variola virus
ccgaaauugaccgagaaagaa

SEQ ID NO: 4086409 - RNA, 22 nt, Variola virus
ccggaagaucgcuauuguauuu

SEQ ID NO: 4086410 - RNA, 20 nt, Variola virus
ccggacgacauauuaaucuu

SEQ ID NO: 4086411 - RNA, 18 nt, Variola virus
ccggaguaauugauuaua

SEQ ID NO: 4086412 - RNA, 15 nt, Variola virus
ccgucuuuaucucuu

SEQ ID NO: 4086413 - RNA, 23 nt, Variola virus
ccguuuuguucuuggauuucaua

SEQ ID NO: 4086414 - RNA, 13 nt, Variola virus
ccuaauauaacag

SEQ ID NO: 4086415 - RNA, 17 nt, Variola virus
uguuauaagauuacuua

SEQ ID NO: 4086416 - RNA, 22 nt, Variola virus
uguuauacacggucuagagcau

SEQ ID NO: 4086417 - RNA, 12 nt, Variola virus
uguuauauacau

SEQ ID NO: 4086418 - RNA, 12 nt, Variola virus
uguuauauguaa

SEQ ID NO: 4086419 - RNA, 22 nt, Variola virus
uguuaucaugaaauguuugaua

SEQ ID NO: 4086420 - RNA, 22 nt, Variola virus
uguuauguauuucauuguucau

SEQ ID NO: 4086421 - RNA, 19 nt, Variola virus
uguuauuuccuuguuuuua

SEQ ID NO: 4086422 - RNA, 21 nt, Variola virus
uguucaaaaauuuagaaugau

SEQ ID NO: 4086423 - RNA, 22 nt, Variola virus
uguucaagaauauacaaguauu

SEQ ID NO: 4086424 - RNA, 20 nt, Variola virus
uguucacaaaaauacauaaa

SEQ ID NO: 4086425 - RNA, 20 nt, Variola virus
uguucccgucaauagagcaa

SEQ ID NO: 4086426 - RNA, 13 nt, Variola virus
uguucgaggauau

SEQ ID NO: 4086427 - RNA, 17 nt, Variola virus
uguucgucugucaugau

SEQ ID NO: 4086428 - RNA, 17 nt, Variola virus
uguucuaaccuaucaac

SEQ ID NO: 4086429 - RNA, 15 nt, Variola virus
uguugauaaaaugca

SEQ ID NO: 4086430 - RNA, 22 nt, Variola virus
uguugguggcauugucuaaaac

SEQ ID NO: 4086431 - RNA, 17 nt, Variola virus
uguuguaaacacauauu

SEQ ID NO: 4086432 - RNA, 19 nt, Variola virus
uguuuacggagacaaaauu

SEQ ID NO: 4086433 - RNA, 23 nt, Variola virus
uguuuaucgcacgcguuuggauc

SEQ ID NO: 4086434 - RNA, 17 nt, Variola virus
uguuuaucuauacuauu

SEQ ID NO: 4086435 - RNA, 15 nt, Variola virus
uguuuguucauugga

SEQ ID NO: 4086436 - RNA, 17 nt, Variola virus
uguuuucaccaugacuu

SEQ ID NO: 4086437 - RNA, 13 nt, Variola virus
uguuuucaucauu

SEQ ID NO: 4086438 - RNA, 14 nt, Variola virus
uguuuucaucauuu

SEQ ID NO: 4086439 - RNA, 19 nt, Variola virus
uguuuucaucauuucacaa

SEQ ID NO: 4086440 - RNA, 22 nt, Variola virus
uguuuugaauuucuuagucaua

SEQ ID NO: 4086441 - RNA, 13 nt, Variola virus
uguuuuuguacau

SEQ ID NO: 4086442 - RNA, 14 nt, Variola virus
uguuuuuuaucaua

SEQ ID NO: 4086443 - RNA, 15 nt, Variola virus
uuaaaaacaaacuuu

SEQ ID NO: 4086444 - RNA, 23 nt, Variola virus
uuaaaaacaaacuuuuuauccuu

SEQ ID NO: 4086445 - RNA, 21 nt, Variola virus
uuaaaaauaagaaugaaauaa

SEQ ID NO: 4086446 - RNA, 11 nt, Variola virus
uuaaaacauuc

SEQ ID NO: 4086447 - RNA, 15 nt, Variola virus
uuaaaacguccucua

SEQ ID NO: 4086448 - RNA, 12 nt, Variola virus
uuaaaauaucua

SEQ ID NO: 4086449 - RNA, 17 nt, Variola virus
uuaaaauauuauuuaga

SEQ ID NO: 4086450 - RNA, 15 nt, Variola virus
uuaaaauuauuaaac

SEQ ID NO: 4086451 - RNA, 14 nt, Variola virus
uuaaacuguaucga

SEQ ID NO: 4086452 - RNA, 13 nt, Variola virus
uuaaacuuauucu

SEQ ID NO: 4086453 - RNA, 18 nt, Variola virus
uuaaagucuucuauuucu

SEQ ID NO: 4086454 - RNA, 22 nt, Variola virus
uuaaauaacccaaguauugaaa

SEQ ID NO: 4086455 - RNA, 14 nt, Variola virus
uuaaauaucauaau

SEQ ID NO: 4086456 - RNA, 15 nt, Variola virus
uuaaauaucugugaa

SEQ ID NO: 4086457 - RNA, 13 nt, Variola virus
uuaaauccuuaau

SEQ ID NO: 4086458 - RNA, 23 nt, Variola virus
uuaaaugaguguccauauuuugc

SEQ ID NO: 4086459 - RNA, 16 nt, Variola virus
uuaaaugccuuauucu

SEQ ID NO: 4086460 - RNA, 11 nt, Variola virus
uuaaauuauug

SEQ ID NO: 4086461 - RNA, 16 nt, Variola virus
uuaacaaaguuauuca

SEQ ID NO: 4086462 - RNA, 17 nt, Variola virus
uuaacaauuccuuuuuu

SEQ ID NO: 4086463 - RNA, 20 nt, Variola virus
uuaacacguugucuuucaag

SEQ ID NO: 4086464 - RNA, 22 nt, Variola virus
uuaacacuauacuuauauuaau

SEQ ID NO: 4086465 - RNA, 21 nt, Variola virus
uuaacauguguauuacaugca

SEQ ID NO: 4086466 - RNA, 15 nt, Variola virus
uuaaccgauaauaga

SEQ ID NO: 4086467 - RNA, 18 nt, Variola virus
uuaacgaguucaaauaug

SEQ ID NO: 4086468 - RNA, 22 nt, Variola virus
uuaacguaucgcauuaauacug

SEQ ID NO: 4086469 - RNA, 13 nt, Variola virus
uuaacuauuuuag

SEQ ID NO: 4086470 - RNA, 22 nt, Variola virus
uuaacucauugcuuucuagaau

SEQ ID NO: 4086471 - RNA, 13 nt, Variola virus
uuaacuugacauu

SEQ ID NO: 4086472 - RNA, 17 nt, Variola virus
uuaagcauauucuuaau

SEQ ID NO: 4086473 - RNA, 22 nt, Variola virus
uuaagcauauucuuaauauuag

SEQ ID NO: 4086474 - RNA, 19 nt, Variola virus
uuaauaaaaauaauauuca

SEQ ID NO: 4086475 - RNA, 23 nt, Variola virus
uuaauaaacacggguucgucuuu

SEQ ID NO: 4086476 - RNA, 17 nt, Variola virus
uuaauaaaguaugaaca

SEQ ID NO: 4086477 - RNA, 22 nt, Variola virus
uuaauaaauccggaacuguaaa

SEQ ID NO: 4086478 - RNA, 13 nt, Variola virus
uuaauaauuguua

SEQ ID NO: 4086479 - RNA, 14 nt, Variola virus
uuaauacauuauua

SEQ ID NO: 4086480 - RNA, 15 nt, Variola virus
uuaauagaacucuuu

SEQ ID NO: 4086481 - RNA, 23 nt, Variola virus
uuaauagggauuugauguacgua

SEQ ID NO: 4086482 - RNA, 21 nt, Variola virus
uuaauagugcgaaaucauuca

SEQ ID NO: 4086483 - RNA, 13 nt, Variola virus
uuaauauauguca

SEQ ID NO: 4086484 - RNA, 15 nt, Variola virus
uuaauaucuauauau

SEQ ID NO: 4086485 - RNA, 22 nt, Variola virus
uuaauauuaaaaauacaucugu

SEQ ID NO: 4086486 - RNA, 15 nt, Variola virus
uuaauauuagaguua

SEQ ID NO: 4086487 - RNA, 14 nt, Variola virus
uuaaucaauguaca

SEQ ID NO: 4086488 - RNA, 14 nt, Variola virus
uuaauccaaauaug

SEQ ID NO: 4086489 - RNA, 13 nt, Variola virus
uuaaucuuauuca

SEQ ID NO: 4086490 - RNA, 22 nt, Variola virus
uuaaucuuggcuccauacugua

SEQ ID NO: 4086491 - RNA, 21 nt, Variola virus
uuaaugccgauuuaauacguu

SEQ ID NO: 4086492 - RNA, 16 nt, Variola virus
uuaaugcuacagauau

SEQ ID NO: 4086493 - RNA, 15 nt, Variola virus
uuaauguuuuaaauu

SEQ ID NO: 4086494 - RNA, 19 nt, Variola virus
uuaauucguucgaugagua

SEQ ID NO: 4086495 - RNA, 19 nt, Variola virus
uuaauuguuauuuuauuca

SEQ ID NO: 4086496 - RNA, 15 nt, Variola virus
uuaauuuauuauuga

SEQ ID NO: 4086497 - RNA, 15 nt, Variola virus
uuaauuucuuuggua

SEQ ID NO: 4086498 - RNA, 19 nt, Variola virus
uuaauuuggucauucuuaa

SEQ ID NO: 4086499 - RNA, 15 nt, Variola virus
uuaauuuuuuaaauu

SEQ ID NO: 4086500 - RNA, 16 nt, Variola virus
uuacaaaauucaucaa

SEQ ID NO: 4086501 - RNA, 12 nt, Variola virus
uuacaaaucuag

SEQ ID NO: 4086502 - RNA, 14 nt, Variola virus
uuacaacauaauaa

SEQ ID NO: 4086503 - RNA, 21 nt, Variola virus
uuacaagauaucucuggauau

SEQ ID NO: 4086504 - RNA, 14 nt, Variola virus
uuacaauacauaga

SEQ ID NO: 4086505 - RNA, 20 nt, Variola virus
uuacaauauauguaaucauu

SEQ ID NO: 4086506 - RNA, 14 nt, Variola virus
uuacaaucaauaau

SEQ ID NO: 4086507 - RNA, 19 nt, Variola virus
uuacaauguagaaauuaga

SEQ ID NO: 4086508 - RNA, 22 nt, Variola virus
uuacacuacauuuuuaucauaa

SEQ ID NO: 4086509 - RNA, 17 nt, Variola virus
uuacauaaaugaaaaga

SEQ ID NO: 4086510 - RNA, 22 nt, Variola virus
uuacauaggcaacaucagaaac

SEQ ID NO: 4086511 - RNA, 16 nt, Variola virus
uuacaucuaguucuuu

SEQ ID NO: 4086512 - RNA, 12 nt, Variola virus
uuacaugugauu

SEQ ID NO: 4086513 - RNA, 15 nt, Variola virus
uuacauucucauuaa

SEQ ID NO: 4086514 - RNA, 16 nt, Variola virus
uuacauucucauuaau

SEQ ID NO: 4086515 - RNA, 9 nt, Variola virus
uuaccaucg

SEQ ID NO: 4086516 - RNA, 23 nt, Variola virus
uuacggauaucuaauaauauuag

SEQ ID NO: 4086517 - RNA, 21 nt, Variola virus
uuacggcugcguuaaacauuc

SEQ ID NO: 4086518 - RNA, 17 nt, Variola virus
uuacuacauucauuaau

SEQ ID NO: 4086519 - RNA, 16 nt, Variola virus
uuacucgguuaccauu

SEQ ID NO: 4086520 - RNA, 20 nt, Variola virus
uuacucuuggucuaauacug

SEQ ID NO: 4086521 - RNA, 21 nt, Variola virus
uuacuuugacaaauguaguaa

SEQ ID NO: 4086522 - RNA, 13 nt, Variola virus
uuacuuuuggaau

SEQ ID NO: 4086523 - RNA, 9 nt, Variola virus
uuagaaaaa

SEQ ID NO: 4086524 - RNA, 20 nt, Variola virus
uuagaaauuggucuguguua

SEQ ID NO: 4086525 - RNA, 17 nt, Variola virus
uuagaagagucauuaaa

SEQ ID NO: 4086526 - RNA, 16 nt, Variola virus
uuagaagauaaugaau

SEQ ID NO: 4086527 - RNA, 17 nt, Variola virus
uuagaauagucucuuua

SEQ ID NO: 4086528 - RNA, 18 nt, Variola virus
uuagacaugaauguggua

SEQ ID NO: 4086529 - RNA, 18 nt, Variola virus
uuagacguaguucguaaa

SEQ ID NO: 4086530 - RNA, 20 nt, Variola virus
uuagagaugaugcggaauca

SEQ ID NO: 4086531 - RNA, 21 nt, Variola virus
uuagaggaacauuaaacaucg

SEQ ID NO: 4086532 - RNA, 12 nt, Variola virus
uuagaguauaaa

SEQ ID NO: 4086533 - RNA, 17 nt, Variola virus
uuagauaaaugcgguaa

SEQ ID NO: 4086534 - RNA, 20 nt, Variola virus
uuagauaaauggaauacuaa

SEQ ID NO: 4086535 - RNA, 17 nt, Variola virus
uuagauaauugugguaa

SEQ ID NO: 4086536 - RNA, 15 nt, Variola virus
uuagaugaauuauua

SEQ ID NO: 4086537 - RNA, 19 nt, Variola virus
uuagauuaguuaauacagg

SEQ ID NO: 4086538 - RNA, 16 nt, Variola virus
uuagcaauuucugauu

SEQ ID NO: 4086539 - RNA, 21 nt, Variola virus
gucuguaacucugauaaucuc

SEQ ID NO: 4086540 - RNA, 23 nt, Variola virus
gucuguauaguaacuauguaaau

SEQ ID NO: 4086541 - RNA, 19 nt, Variola virus
gucuucuaaaaauaaaagu

SEQ ID NO: 4086542 - RNA, 17 nt, Variola virus
gucuuuaaguauauacg

SEQ ID NO: 4086543 - RNA, 13 nt, Variola virus
gucuuuacagauu

SEQ ID NO: 4086544 - RNA, 15 nt, Variola virus
gugaagaauggaaac

SEQ ID NO: 4086545 - RNA, 14 nt, Variola virus
gugaaucuguucaa

SEQ ID NO: 4086546 - RNA, 21 nt, Variola virus
gugaauguauucacuuaacaa

SEQ ID NO: 4086547 - RNA, 15 nt, Variola virus
gugaauuuagaaaau

SEQ ID NO: 4086548 - RNA, 18 nt, Variola virus
gugacagauauacaaaac

SEQ ID NO: 4086549 - RNA, 19 nt, Variola virus
gugaguacggauuaaacau

SEQ ID NO: 4086550 - RNA, 21 nt, Variola virus
gugauagauaugauaaacaaa

SEQ ID NO: 4086551 - RNA, 13 nt, Variola virus
gugauaguuuaua

SEQ ID NO: 4086552 - RNA, 16 nt, Variola virus
gugauauuaucuucau

SEQ ID NO: 4086553 - RNA, 12 nt, Variola virus
gugauuaaacau

SEQ ID NO: 4086554 - RNA, 13 nt, Variola virus
gugauuguauguu

SEQ ID NO: 4086555 - RNA, 15 nt, Variola virus
gugcaguauuagaau

SEQ ID NO: 4086556 - RNA, 12 nt, Variola virus
gugcuacaaaac

SEQ ID NO: 4086557 - RNA, 20 nt, Variola virus
gugcuuguaucgaaaaacuu

SEQ ID NO: 4086558 - RNA, 22 nt, Variola virus
gugguaaguuauacacuaaaag

SEQ ID NO: 4086559 - RNA, 18 nt, Variola virus
gugguuagcauauaccuc

SEQ ID NO: 4086560 - RNA, 15 nt, Variola virus
guguauaacaucuuu

SEQ ID NO: 4086561 - RNA, 23 nt, Variola virus
guguauacaccaacuguaugaaa

SEQ ID NO: 4086562 - RNA, 17 nt, Variola virus
guguauuguucaaauca

SEQ ID NO: 4086563 - RNA, 13 nt, Variola virus
guguccauuuuua

SEQ ID NO: 4086564 - RNA, 19 nt, Variola virus
guguccguauaccaacaug

SEQ ID NO: 4086565 - RNA, 16 nt, Variola virus
guguuaucuuagauau

SEQ ID NO: 4086566 - RNA, 22 nt, Variola virus
guguucauccaaggaucuucua

SEQ ID NO: 4086567 - RNA, 19 nt, Variola virus
guguuuuauuaaucaauca

SEQ ID NO: 4086568 - RNA, 16 nt, Variola virus
guuaaaacuacaaaaa

SEQ ID NO: 4086569 - RNA, 15 nt, Variola virus
guuaaaguaaucauu

SEQ ID NO: 4086570 - RNA, 17 nt, Variola virus
guuaaauaaauccuuca

SEQ ID NO: 4086571 - RNA, 20 nt, Variola virus
guuaaauguugguauaucaa

SEQ ID NO: 4086572 - RNA, 11 nt, Variola virus
guuaaauuaau

SEQ ID NO: 4086573 - RNA, 15 nt, Variola virus
guuaagcauauccug

SEQ ID NO: 4086574 - RNA, 21 nt, Variola virus
guuaaggucuuccauuuaaau

SEQ ID NO: 4086575 - RNA, 14 nt, Variola virus
guuaaguuacucau

SEQ ID NO: 4086576 - RNA, 23 nt, Variola virus
guuaauaacugccggauaaaagu

SEQ ID NO: 4086577 - RNA, 11 nt, Variola virus
guuaauaaucu

SEQ ID NO: 4086578 - RNA, 12 nt, Variola virus
guuaauaaucuc

SEQ ID NO: 4086579 - RNA, 16 nt, Variola virus
guuaauaguaaaugaa

SEQ ID NO: 4086580 - RNA, 19 nt, Variola virus
guuaaugcaucuaaaacaa

SEQ ID NO: 4086581 - RNA, 17 nt, Variola virus
guuacauguuuaaauaa

SEQ ID NO: 4086582 - RNA, 18 nt, Variola virus
guuacauuuauacuucuu

SEQ ID NO: 4086583 - RNA, 17 nt, Variola virus
guuacguuuauaaacga

SEQ ID NO: 4086584 - RNA, 10 nt, Variola virus
guuagaaaag

SEQ ID NO: 4086585 - RNA, 19 nt, Variola virus
guuagaugauuauaaagga

SEQ ID NO: 4086586 - RNA, 17 nt, Variola virus
guuagcaauuucaaaau

SEQ ID NO: 4086587 - RNA, 15 nt, Variola virus
guuaguaaucaugua

SEQ ID NO: 4086588 - RNA, 17 nt, Variola virus
guuaguacuacugaaga

SEQ ID NO: 4086589 - RNA, 17 nt, Variola virus
guuagugaugaauaucu

SEQ ID NO: 4086590 - RNA, 14 nt, Variola virus
guuauaaucaaaga

SEQ ID NO: 4086591 - RNA, 19 nt, Variola virus
guuauacgucauuucaucu

SEQ ID NO: 4086592 - RNA, 14 nt, Variola virus
guuauauaauuauc

SEQ ID NO: 4086593 - RNA, 21 nt, Variola virus
guuauaucacaugaugauuua

SEQ ID NO: 4086594 - RNA, 18 nt, Variola virus
guuauauuauuagauauc

SEQ ID NO: 4086595 - RNA, 18 nt, Variola virus
guuaucaugaaauguuug

SEQ ID NO: 4086596 - RNA, 13 nt, Variola virus
guuauuaaauguu

SEQ ID NO: 4086597 - RNA, 15 nt, Variola virus
guuauuaucaucauu

SEQ ID NO: 4086598 - RNA, 18 nt, Variola virus
guuauuuauguugcuaaa

SEQ ID NO: 4086599 - RNA, 20 nt, Variola virus
guuauuuuguuuuauucaaa

SEQ ID NO: 4086600 - RNA, 16 nt, Variola virus
guucaaaaauaaacga

SEQ ID NO: 4086601 - RNA, 14 nt, Variola virus
guucaaauauauga

SEQ ID NO: 4086602 - RNA, 21 nt, Variola virus
guucaaaugccacaucaaaga

SEQ ID NO: 4086603 - RNA, 19 nt, Variola virus
guucacguaaauacaaaac

SEQ ID NO: 4086604 - RNA, 18 nt, Variola virus
guucaucauauaaucauc

SEQ ID NO: 4086605 - RNA, 19 nt, Variola virus
guucauccuuguucaucau

SEQ ID NO: 4086606 - RNA, 21 nt, Variola virus
guucauuaaaaacaaacuuuu

SEQ ID NO: 4086607 - RNA, 14 nt, Variola virus
guuccaacaucaua

SEQ ID NO: 4086608 - RNA, 20 nt, Variola virus
guuccaauagguaucaaaga

SEQ ID NO: 4086609 - RNA, 18 nt, Variola virus
guuccguaucuguauuua

SEQ ID NO: 4086610 - RNA, 19 nt, Variola virus
guuccguguguaauaaccu

SEQ ID NO: 4086611 - RNA, 19 nt, Variola virus
guuccuguagauaauaacu

SEQ ID NO: 4086612 - RNA, 22 nt, Variola virus
guucgaggauaucauccaaaac

SEQ ID NO: 4086613 - RNA, 13 nt, Variola virus
guucguaaacgaa

SEQ ID NO: 4086614 - RNA, 17 nt, Variola virus
guucguaaauaauaacu

SEQ ID NO: 4086615 - RNA, 13 nt, Variola virus
guucguucuggga

SEQ ID NO: 4086616 - RNA, 13 nt, Variola virus
guucuaacaucau

SEQ ID NO: 4086617 - RNA, 20 nt, Variola virus
guucuaaugccgaucuuuga

SEQ ID NO: 4086618 - RNA, 19 nt, Variola virus
guucuacauaaaacaucau

SEQ ID NO: 4086619 - RNA, 21 nt, Variola virus
guucuagcccucuucaagaac

SEQ ID NO: 4086620 - RNA, 21 nt, Variola virus
guucuaucuucuaaaaaaucu

SEQ ID NO: 4086621 - RNA, 16 nt, Variola virus
guucucaauacaccaa

SEQ ID NO: 4086622 - RNA, 18 nt, Variola virus
guucucaauauuacuuuu

SEQ ID NO: 4086623 - RNA, 19 nt, Variola virus
guucugauuuuaucuuuua

SEQ ID NO: 4086624 - RNA, 19 nt, Variola virus
guucuucgcagaugaugau

SEQ ID NO: 4086625 - RNA, 22 nt, Variola virus
guugaaucaacauauagaaaag

SEQ ID NO: 4086626 - RNA, 21 nt, Variola virus
guugauaauaucuauauauga

SEQ ID NO: 4086627 - RNA, 13 nt, Variola virus
guugauaaucauc

SEQ ID NO: 4086628 - RNA, 22 nt, Variola virus
guugaugaggcacauaauaucu

SEQ ID NO: 4086629 - RNA, 16 nt, Variola virus
guugauuacucuuuuu

SEQ ID NO: 4086630 - RNA, 21 nt, Variola virus
guugcaauaauaaaaguuauc

SEQ ID NO: 4086631 - RNA, 18 nt, Variola virus
guuggcuaugaucuugua

SEQ ID NO: 4086632 - RNA, 21 nt, Variola virus
guuguaugaguuuaucguuua

SEQ ID NO: 4086633 - RNA, 17 nt, Variola virus
guuguuaaaaaauuaag

SEQ ID NO: 4086634 - RNA, 19 nt, Variola virus
guuuaaaaauauagauauu

SEQ ID NO: 4086635 - RNA, 14 nt, Variola virus
guuuaaaacuucua

SEQ ID NO: 4086636 - RNA, 19 nt, Variola virus
guuuaaaaugaucuauaug

SEQ ID NO: 4086637 - RNA, 20 nt, Variola virus
guuuaaaguaaacuucguaa

SEQ ID NO: 4086638 - RNA, 16 nt, Variola virus
guuuaaauuaagcauc

SEQ ID NO: 4086639 - RNA, 18 nt, Variola virus
guuuaagagauucaauuu

SEQ ID NO: 4086640 - RNA, 14 nt, Variola virus
guuuagaugucgaa

SEQ ID NO: 4086641 - RNA, 19 nt, Variola virus
guuuauuuagauacagaug

SEQ ID NO: 4086642 - RNA, 19 nt, Variola virus
guuucacuaguaccuuuau

SEQ ID NO: 4086643 - RNA, 15 nt, Variola virus
guuucagcgugauuu

SEQ ID NO: 4086644 - RNA, 23 nt, Variola virus
guuuccacauuaaccaaguaaug

SEQ ID NO: 4086645 - RNA, 14 nt, Variola virus
guuuccuguauucu

SEQ ID NO: 4086646 - RNA, 15 nt, Variola virus
guuucucaucuuuua

SEQ ID NO: 4086647 - RNA, 16 nt, Variola virus
guuuggauuaauaauu

SEQ ID NO: 4086648 - RNA, 22 nt, Variola virus
guuuuaacgaauuauauagucu

SEQ ID NO: 4086649 - RNA, 20 nt, Variola virus
guuuuaccuauuuuaucauc

SEQ ID NO: 4086650 - RNA, 20 nt, Variola virus
guuuuagagacuuugaagcu

SEQ ID NO: 4086651 - RNA, 19 nt, Variola virus
guuuuggauuauaaucauc

SEQ ID NO: 4086652 - RNA, 23 nt, Variola virus
uaaaaaaaugauugaagaaggag

SEQ ID NO: 4086653 - RNA, 16 nt, Variola virus
uaaaaaccaucgucug

SEQ ID NO: 4086654 - RNA, 20 nt, Variola virus
uaaaaaguuuaaguuucuca

SEQ ID NO: 4086655 - RNA, 17 nt, Variola virus
uaaaaaguuuuaacaug

SEQ ID NO: 4086656 - RNA, 19 nt, Variola virus
uaaaaauaaacaucaacau

SEQ ID NO: 4086657 - RNA, 16 nt, Variola virus
uaaaaauaauauuguu

SEQ ID NO: 4086658 - RNA, 21 nt, Variola virus
uaaaaauagagcccaaagcua

SEQ ID NO: 4086659 - RNA, 14 nt, Variola virus
uaaaaauaugugcu

SEQ ID NO: 4086660 - RNA, 15 nt, Variola virus
uaaaaauuaauacau

SEQ ID NO: 4086661 - RNA, 12 nt, Variola virus
uaaaaauuauua

SEQ ID NO: 4086662 - RNA, 22 nt, Variola virus
uaaaaauuuuuuagauguagua

SEQ ID NO: 4086663 - RNA, 14 nt, Variola virus
uaaaacagauuucu

SEQ ID NO: 4086664 - RNA, 13 nt, Variola virus
uaaaacaugguga

SEQ ID NO: 4086665 - RNA, 16 nt, Variola virus
uaaaacgauuaaacaa

SEQ ID NO: 4086666 - RNA, 23 nt, Variola virus
uaaaacuaucguuauaucugucu

SEQ ID NO: 4086667 - RNA, 13 nt, Variola virus
uaaaagaaaauac

SEQ ID NO: 4086668 - RNA, 21 nt, Variola virus
uaaaagaauuuuuucggguuc

SEQ ID NO: 4086669 - RNA, 17 nt, Variola virus
uaaaaguaucaaaucuu

SEQ ID NO: 4086670 - RNA, 13 nt, Variola virus
uaaaagucaacau

SEQ ID NO: 4086671 - RNA, 23 nt, Variola virus
uaaaagucugaucuuaacuccuc

SEQ ID NO: 4086672 - RNA, 15 nt, Variola virus
uaaaaguuaggguuc

SEQ ID NO: 4086673 - RNA, 16 nt, Variola virus
uaaaaguuuuacuaua

SEQ ID NO: 4086674 - RNA, 13 nt, Variola virus
uaaaauaaauauu

SEQ ID NO: 4086675 - RNA, 15 nt, Variola virus
uaaaauaaauauucu

SEQ ID NO: 4086676 - RNA, 23 nt, Variola virus
uaaaauaacucuguagacgauac

SEQ ID NO: 4086677 - RNA, 12 nt, Variola virus
uaaaauaguucu

SEQ ID NO: 4086678 - RNA, 18 nt, Variola virus
uaaaauccuccuaucaau

SEQ ID NO: 4086679 - RNA, 18 nt, Variola virus
uaaaaugaucuauauguu

SEQ ID NO: 4086680 - RNA, 19 nt, Variola virus
uaaaaugguaaacuuuugc

SEQ ID NO: 4086681 - RNA, 14 nt, Variola virus
uaaaauuacaaaca

SEQ ID NO: 4086682 - RNA, 22 nt, Variola virus
uaaaauuaucuacacaaauaga

SEQ ID NO: 4086683 - RNA, 11 nt, Variola virus
uaaaauuauug

SEQ ID NO: 4086684 - RNA, 23 nt, Variola virus
uaaaauuauuuaauuuaauacau

SEQ ID NO: 4086685 - RNA, 14 nt, Variola virus
uaaaauucacacau

SEQ ID NO: 4086686 - RNA, 21 nt, Variola virus
uaaaauuuaaaaaguauuuac

SEQ ID NO: 4086687 - RNA, 14 nt, Variola virus
uaaaauuuagcauu

SEQ ID NO: 4086688 - RNA, 16 nt, Variola virus
uaaaauuuauaacauu

SEQ ID NO: 4086689 - RNA, 21 nt, Variola virus
uaaacaaacuaauaaacauuc

SEQ ID NO: 4086690 - RNA, 23 nt, Variola virus
uaaacaacaaugccaucuuacau

SEQ ID NO: 4086691 - RNA, 20 nt, Variola virus
uaaacaaucugucgaaaaag

SEQ ID NO: 4086692 - RNA, 17 nt, Variola virus
uaaacacgauauagaca

SEQ ID NO: 4086693 - RNA, 18 nt, Variola virus
uaaacaguuuaauagucu

SEQ ID NO: 4086694 - RNA, 17 nt, Variola virus
uaaacauugauuaaauu

SEQ ID NO: 4086695 - RNA, 16 nt, Variola virus
uaaacgaaaacuauau

SEQ ID NO: 4086696 - RNA, 14 nt, Variola virus
uaaacgcguguaau

SEQ ID NO: 4086697 - RNA, 23 nt, Variola virus
uaaacuaauucauuuucaauaau

SEQ ID NO: 4086698 - RNA, 13 nt, Variola virus
uaaacuauucucg

SEQ ID NO: 4086699 - RNA, 16 nt, Variola virus
uaaacucagauaauag

SEQ ID NO: 4086700 - RNA, 23 nt, Variola virus
uaaacucuccaccauuuccgcau

SEQ ID NO: 4086701 - RNA, 16 nt, Variola virus
uaaacuguuuguauaa

SEQ ID NO: 4086702 - RNA, 12 nt, Variola virus
uaaacuuuaaug

SEQ ID NO: 4086703 - RNA, 16 nt, Variola virus
uaaagaacaaauguug

SEQ ID NO: 4086704 - RNA, 22 nt, Variola virus
uaaagaaugcuguuauauacau

SEQ ID NO: 4086705 - RNA, 18 nt, Variola virus
uaaagacacuccacaugc

SEQ ID NO: 4086706 - RNA, 19 nt, Variola virus
uaaagauacaaauaugucu

SEQ ID NO: 4086707 - RNA, 12 nt, Variola virus
uaaagauauucu

SEQ ID NO: 4086708 - RNA, 18 nt, Variola virus
uaaagccgguguaacauu

SEQ ID NO: 4086709 - RNA, 17 nt, Variola virus
uaaagcuaaaauagucu

SEQ ID NO: 4086710 - RNA, 14 nt, Variola virus
uaaagguaaaugua

SEQ ID NO: 4086711 - RNA, 23 nt, Variola virus
uaaaguggaagaguauuguacag

SEQ ID NO: 4086712 - RNA, 16 nt, Variola virus
uaaauaaauccaaauu

SEQ ID NO: 4086713 - RNA, 13 nt, Variola virus
uaaauaaaugucc

SEQ ID NO: 4086714 - RNA, 16 nt, Variola virus
uaaauaccauuaauca

SEQ ID NO: 4086715 - RNA, 15 nt, Variola virus
uaaauagacaaacaa

SEQ ID NO: 4086716 - RNA, 16 nt, Variola virus
uaaauaggacuauugu

SEQ ID NO: 4086717 - RNA, 13 nt, Variola virus
uaaauauaaacac

SEQ ID NO: 4086718 - RNA, 20 nt, Variola virus
uaaauaucauaaucuaaaau

SEQ ID NO: 4086719 - RNA, 18 nt, Variola virus
uaaauauuaauaaaguau

SEQ ID NO: 4086720 - RNA, 13 nt, Variola virus
uaaauauuucauu

SEQ ID NO: 4086721 - RNA, 20 nt, Variola virus
uaaauauuuuaaaauuuaua

SEQ ID NO: 4086722 - RNA, 22 nt, Variola virus
uaaauauuuuucuaccuuuuca

SEQ ID NO: 4086723 - RNA, 17 nt, Variola virus
uaaaucaucgauuuuca

SEQ ID NO: 4086724 - RNA, 14 nt, Variola virus
uaaaucauggauuu

SEQ ID NO: 4086725 - RNA, 15 nt, Variola virus
uaaauccgagaauau

SEQ ID NO: 4086726 - RNA, 23 nt, Variola virus
uaaauccucuauuuauugacauu

SEQ ID NO: 4086727 - RNA, 18 nt, Variola virus
uaaaucuguuucuaaaga

SEQ ID NO: 4086728 - RNA, 18 nt, Variola virus
uaaaugaaaaaaaacuag

SEQ ID NO: 4086729 - RNA, 20 nt, Variola virus
uaaaugaaucccaaacauug

SEQ ID NO: 4086730 - RNA, 16 nt, Variola virus
uaaaugaauucucauu

SEQ ID NO: 4086731 - RNA, 13 nt, Variola virus
uaaauguauacau

SEQ ID NO: 4086732 - RNA, 18 nt, Variola virus
uaaauguuguaauuguau

SEQ ID NO: 4086733 - RNA, 19 nt, Variola virus
uaaauguuuaaacaucaaa

SEQ ID NO: 4086734 - RNA, 22 nt, Variola virus
uaaauguuuaaacaucaaacau

SEQ ID NO: 4086735 - RNA, 18 nt, Variola virus
uaaauuauauauggauuu

SEQ ID NO: 4086736 - RNA, 22 nt, Variola virus
uaaauuauuccaucgauacauc

SEQ ID NO: 4086737 - RNA, 20 nt, Variola virus
uaaauucagaauuucuacau

SEQ ID NO: 4086738 - RNA, 17 nt, Variola virus
uaaauuccauagaauau

SEQ ID NO: 4086739 - RNA, 18 nt, Variola virus
uaaauuuacgaauuaaga

SEQ ID NO: 4086740 - RNA, 17 nt, Variola virus
uaaauuuaucaauaaau

SEQ ID NO: 4086741 - RNA, 20 nt, Variola virus
uaaauuuaucaauaaaugug

SEQ ID NO: 4086742 - RNA, 18 nt, Variola virus
uaacaaaaauuaugaaau

SEQ ID NO: 4086743 - RNA, 17 nt, Variola virus
uaacaacaucuauucca

SEQ ID NO: 4086744 - RNA, 17 nt, Variola virus
uaacaacucaaacaucu

SEQ ID NO: 4086745 - RNA, 19 nt, Variola virus
uaacaacugucaaugaauu

SEQ ID NO: 4086746 - RNA, 15 nt, Variola virus
uaacaacuuccguaa

SEQ ID NO: 4086747 - RNA, 21 nt, Variola virus
uaacaagaucgauagacacug

SEQ ID NO: 4086748 - RNA, 22 nt, Variola virus
uaacagaacauuugcaaagauu

SEQ ID NO: 4086749 - RNA, 18 nt, Variola virus
uaacaugcgguucaaaau

SEQ ID NO: 4086750 - RNA, 17 nt, Variola virus
uaacauuaaguaaaucc

SEQ ID NO: 4086751 - RNA, 18 nt, Variola virus
uaacauuacauauuauau

SEQ ID NO: 4086752 - RNA, 14 nt, Variola virus
uaacauucauuagu

SEQ ID NO: 4086753 - RNA, 17 nt, Variola virus
uaaccaugaaagaaaga

SEQ ID NO: 4086754 - RNA, 18 nt, Variola virus
uaacccauuauaaaacuu

SEQ ID NO: 4086755 - RNA, 23 nt, Variola virus
uaaccuuggcugucucauucaau

SEQ ID NO: 4086756 - RNA, 18 nt, Variola virus
uaacgaauuauauagucu

SEQ ID NO: 4086757 - RNA, 21 nt, Variola virus
uaacgagugaucaaauuauug

SEQ ID NO: 4086758 - RNA, 21 nt, Variola virus
uaacgaguucaaauaugaaau

SEQ ID NO: 4086759 - RNA, 19 nt, Variola virus
uaacgaguuccauuuauau

SEQ ID NO: 4086760 - RNA, 15 nt, Variola virus
uaacgaugucuauau

SEQ ID NO: 4086761 - RNA, 21 nt, Variola virus
uaacgcaccuauaaagacuuu

SEQ ID NO: 4086762 - RNA, 15 nt, Variola virus
uaacgcauuaaugag

SEQ ID NO: 4086763 - RNA, 21 nt, Variola virus
uaacggaugaaaauaagaaaa

SEQ ID NO: 4086764 - RNA, 15 nt, Variola virus
uaacguuaaacauua

SEQ ID NO: 4086765 - RNA, 20 nt, Variola virus
uaacuacgcgauuauuuuca

SEQ ID NO: 4086766 - RNA, 22 nt, Variola virus
uaacuaucuguaaaagcauaug

SEQ ID NO: 4086767 - RNA, 13 nt, Variola virus
uaacuauuugcau

SEQ ID NO: 4086768 - RNA, 17 nt, Variola virus
uaacuccucuauuaaug

SEQ ID NO: 4086769 - RNA, 13 nt, Variola virus
uaacuccuugguu

SEQ ID NO: 4086770 - RNA, 14 nt, Variola virus
uaacucuguuuuau

SEQ ID NO: 4086771 - RNA, 11 nt, Variola virus
uaacugaagaa

SEQ ID NO: 4086772 - RNA, 12 nt, Variola virus
uaacugaagaaa

SEQ ID NO: 4086773 - RNA, 15 nt, Variola virus
uaacuguuaucucuu

SEQ ID NO: 4086774 - RNA, 20 nt, Variola virus
uaacuuaaaagaauuacuua

SEQ ID NO: 4086775 - RNA, 22 nt, Variola virus
uaacuuuuauuuuuagaaagua

SEQ ID NO: 4086776 - RNA, 23 nt, Variola virus
uaacuuuuuaccucauaugaacu

SEQ ID NO: 4086777 - RNA, 22 nt, Variola virus
uaagaaauccaaauaaaaugga

SEQ ID NO: 4086778 - RNA, 21 nt, Variola virus
uaagaacuccuaauauguucg

SEQ ID NO: 4086779 - RNA, 12 nt, Variola virus
uaagaauugucu

SEQ ID NO: 4086780 - RNA, 23 nt, Variola virus
uaagacguuguaucucuuuuucc

SEQ ID NO: 4086781 - RNA, 16 nt, Variola virus
uaagagaucaaagcau

SEQ ID NO: 4086782 - RNA, 21 nt, Variola virus
uaagaguguaguaucauagau

SEQ ID NO: 4086783 - RNA, 12 nt, Variola virus
uaagauacugug

SEQ ID NO: 4086784 - RNA, 18 nt, Variola virus
uaagauguuugagaauau

SEQ ID NO: 4086785 - RNA, 17 nt, Variola virus
uaagauuguagaaucag

SEQ ID NO: 4086786 - RNA, 19 nt, Variola virus
uaagauuuccuccuccgcu

SEQ ID NO: 4086787 - RNA, 12 nt, Variola virus
uaagcauauucu

SEQ ID NO: 4086788 - RNA, 12 nt, Variola virus
uaaggauucauu

SEQ ID NO: 4086789 - RNA, 18 nt, Variola virus
uaagguagaaucucuauu

SEQ ID NO: 4086790 - RNA, 23 nt, Variola virus
uaaguagagauucggguacugua

SEQ ID NO: 4086791 - RNA, 21 nt, Variola virus
uaaguaucuauaaaacucaua

SEQ ID NO: 4086792 - RNA, 19 nt, Variola virus
uaaguucauuaucugaaau

SEQ ID NO: 4086793 - RNA, 19 nt, Variola virus
uaauaaaaaaaauuauuua

SEQ ID NO: 4086794 - RNA, 22 nt, Variola virus
uaauaaacauuccacauucaga

SEQ ID NO: 4086795 - RNA, 16 nt, Variola virus
uaauaaauugguaaau

SEQ ID NO: 4086796 - RNA, 23 nt, Variola virus
ugcagcaacuucuguacuagugg

SEQ ID NO: 4086797 - RNA, 13 nt, Variola virus
ugccaaaaugaua

SEQ ID NO: 4086798 - RNA, 12 nt, Variola virus
ugccaauaauga

SEQ ID NO: 4086799 - RNA, 21 nt, Variola virus
ugccacgaauaaaaaauacuu

SEQ ID NO: 4086800 - RNA, 22 nt, Variola virus
ugccacgaauaaaaaauacuua

SEQ ID NO: 4086801 - RNA, 15 nt, Variola virus
ugccacgguuccaag

SEQ ID NO: 4086802 - RNA, 17 nt, Variola virus
ugccauaucauacauga

SEQ ID NO: 4086803 - RNA, 21 nt, Variola virus
ugccauauguuggaaauacua

SEQ ID NO: 4086804 - RNA, 22 nt, Variola virus
ugccauauguuggaaauacuag

SEQ ID NO: 4086805 - RNA, 13 nt, Variola virus
ugccauuaugaua

SEQ ID NO: 4086806 - RNA, 22 nt, Variola virus
ugccauugcuggauuacaucua

SEQ ID NO: 4086807 - RNA, 17 nt, Variola virus
ugccauuuuuaacguag

SEQ ID NO: 4086808 - RNA, 19 nt, Variola virus
ugcccccauucuuaauaau

SEQ ID NO: 4086809 - RNA, 19 nt, Variola virus
ugccgguauugguauacag

SEQ ID NO: 4086810 - RNA, 18 nt, Variola virus
ugccuauuaggacagaua

SEQ ID NO: 4086811 - RNA, 13 nt, Variola virus
ugccuccacauau

SEQ ID NO: 4086812 - RNA, 15 nt, Variola virus
ugccuccacauaucg

SEQ ID NO: 4086813 - RNA, 22 nt, Variola virus
ugcgaaccgauuaaacauaaau

SEQ ID NO: 4086814 - RNA, 15 nt, Variola virus
ugcgacacuauucau

SEQ ID NO: 4086815 - RNA, 11 nt, Variola virus
ugcgauacauu

SEQ ID NO: 4086816 - RNA, 18 nt, Variola virus
ugcguuaagaucuaauau

SEQ ID NO: 4086817 - RNA, 21 nt, Variola virus
ugcuaauauucccaaacauac

SEQ ID NO: 4086818 - RNA, 21 nt, Variola virus
ugcuauuucggcugucagagu

SEQ ID NO: 4086819 - RNA, 12 nt, Variola virus
ugcucuuuacau

SEQ ID NO: 4086820 - RNA, 17 nt, Variola virus
ugcuguuccucuguaaa

SEQ ID NO: 4086821 - RNA, 15 nt, Variola virus
ugcuuaauguuucca

SEQ ID NO: 4086822 - RNA, 18 nt, Variola virus
ugcuucaacgaggaagau

SEQ ID NO: 4086823 - RNA, 21 nt, Variola virus
ugcuugcaacauuaacaucuu

SEQ ID NO: 4086824 - RNA, 19 nt, Variola virus
ugcuugcuagacaccuuuu

SEQ ID NO: 4086825 - RNA, 20 nt, Variola virus
uggaaagauaucagauaagu

SEQ ID NO: 4086826 - RNA, 16 nt, Variola virus
uggaaaggaaauuaug

SEQ ID NO: 4086827 - RNA, 19 nt, Variola virus
uggaaauguuauagaaaau

SEQ ID NO: 4086828 - RNA, 20 nt, Variola virus
uggaaauuacacuguaucca

SEQ ID NO: 4086829 - RNA, 23 nt, Variola virus
uggaacuccuauuggaauuauuu

SEQ ID NO: 4086830 - RNA, 15 nt, Variola virus
uggaagguauuucca

SEQ ID NO: 4086831 - RNA, 21 nt, Variola virus
uggaaucagaagaugauucca

SEQ ID NO: 4086832 - RNA, 15 nt, Variola virus
uggacauacuaauau

SEQ ID NO: 4086833 - RNA, 22 nt, Variola virus
uggagaauguuccuaauguaua

SEQ ID NO: 4086834 - RNA, 14 nt, Variola virus
uggaggaauuuaua

SEQ ID NO: 4086835 - RNA, 15 nt, Variola virus
uggaggcucaacaag

SEQ ID NO: 4086836 - RNA, 16 nt, Variola virus
uggaguaucaucuauu

SEQ ID NO: 4086837 - RNA, 17 nt, Variola virus
uggaucagauguagaua

SEQ ID NO: 4086838 - RNA, 23 nt, Variola virus
uggaucaucgugugauaugaaca

SEQ ID NO: 4086839 - RNA, 15 nt, Variola virus
uggaucguuuagaau

SEQ ID NO: 4086840 - RNA, 22 nt, Variola virus
uggauucaguacaauguuauau

SEQ ID NO: 4086841 - RNA, 14 nt, Variola virus
uggauuucauauaa

SEQ ID NO: 4086842 - RNA, 15 nt, Variola virus
uggcaauguuucaua

SEQ ID NO: 4086843 - RNA, 22 nt, Variola virus
uggccauuauuagaaauuuauc

SEQ ID NO: 4086844 - RNA, 22 nt, Variola virus
uggcuaauugucuuucucuuuu

SEQ ID NO: 4086845 - RNA, 18 nt, Variola virus
ugggguaaaguaaguauc

SEQ ID NO: 4086846 - RNA, 15 nt, Variola virus
uggguguaaggaaau

SEQ ID NO: 4086847 - RNA, 18 nt, Variola virus
uggguuaauaaauacaga

SEQ ID NO: 4086848 - RNA, 19 nt, Variola virus
ugguaaguucauuaucuga

SEQ ID NO: 4086849 - RNA, 15 nt, Variola virus
uggucaaaaacugaa

SEQ ID NO: 4086850 - RNA, 20 nt, Variola virus
uggucaaucccuaagucuuu

SEQ ID NO: 4086851 - RNA, 23 nt, Variola virus
ugguguaauaaaaaaaauuauuu

SEQ ID NO: 4086852 - RNA, 16 nt, Variola virus
ugguuaaaaccuuugc

SEQ ID NO: 4086853 - RNA, 16 nt, Variola virus
ugguucgcucaagaau

SEQ ID NO: 4086854 - RNA, 15 nt, Variola virus
ugguugauaguuguu

SEQ ID NO: 4086855 - RNA, 12 nt, Variola virus
ugguuucaauuc

SEQ ID NO: 4086856 - RNA, 18 nt, Variola virus
uguaaaaaauuauacugu

SEQ ID NO: 4086857 - RNA, 18 nt, Variola virus
uguaaaaguaaaaaagaa

SEQ ID NO: 4086858 - RNA, 22 nt, Variola virus
uguaaaguaucuagcaaagauu

SEQ ID NO: 4086859 - RNA, 13 nt, Variola virus
uguaaauguagua

SEQ ID NO: 4086860 - RNA, 19 nt, Variola virus
uguaacugucggaguagua

SEQ ID NO: 4086861 - RNA, 12 nt, Variola virus
uguaagaaauaa

SEQ ID NO: 4086862 - RNA, 22 nt, Variola virus
uguaauauuguacgauguaaua

SEQ ID NO: 4086863 - RNA, 23 nt, Variola virus
uguaaucgauaacacaauuuaug

SEQ ID NO: 4086864 - RNA, 13 nt, Variola virus
uguaauuaaauuu

SEQ ID NO: 4086865 - RNA, 17 nt, Variola virus
uguaauugugacaucau

SEQ ID NO: 4086866 - RNA, 21 nt, Variola virus
uguaauugugggaacauaauu

SEQ ID NO: 4086867 - RNA, 14 nt, Variola virus
uguaauuuuauucu

SEQ ID NO: 4086868 - RNA, 15 nt, Variola virus
uguaauuuuauucuu

SEQ ID NO: 4086869 - RNA, 16 nt, Variola virus
uguaauuuuuguuuca

SEQ ID NO: 4086870 - RNA, 17 nt, Variola virus
uguacaauacauguaca

SEQ ID NO: 4086871 - RNA, 21 nt, Variola virus
uguacauauuuguacauuauu

SEQ ID NO: 4086872 - RNA, 18 nt, Variola virus
uguacccuguuuaacaug

SEQ ID NO: 4086873 - RNA, 13 nt, Variola virus
uguacuuaacaug

SEQ ID NO: 4086874 - RNA, 10 nt, Variola virus
uguagaaaag

SEQ ID NO: 4086875 - RNA, 22 nt, Variola virus
uguagaacucaugaaucuaaaa

SEQ ID NO: 4086876 - RNA, 15 nt, Variola virus
uguagauaugugaua

SEQ ID NO: 4086877 - RNA, 14 nt, Variola virus
uguagauuuggaua

SEQ ID NO: 4086878 - RNA, 20 nt, Variola virus
uguagcauuacgcucucugg

SEQ ID NO: 4086879 - RNA, 16 nt, Variola virus
uguaguaaagaugcua

SEQ ID NO: 4086880 - RNA, 14 nt, Variola virus
uguauaaauaauua

SEQ ID NO: 4086881 - RNA, 21 nt, Variola virus
uguauaacaaucuuauaucuu

SEQ ID NO: 4086882 - RNA, 19 nt, Variola virus
uguauaacaugacauuuau

SEQ ID NO: 4086883 - RNA, 20 nt, Variola virus
uguauaauaagaugcaaaca

SEQ ID NO: 4086884 - RNA, 14 nt, Variola virus
uguauacacaugau

SEQ ID NO: 4086885 - RNA, 13 nt, Variola virus
uguauauacuguc

SEQ ID NO: 4086886 - RNA, 20 nt, Variola virus
uguauauaucaugaugauuu

SEQ ID NO: 4086887 - RNA, 18 nt, Variola virus
uguauaugugaauaugac

SEQ ID NO: 4086888 - RNA, 14 nt, Variola virus
uguaucaaucaaaa

SEQ ID NO: 4086889 - RNA, 22 nt, Variola virus
uguaucaaucgguguguagaaa

SEQ ID NO: 4086890 - RNA, 20 nt, Variola virus
uguaucauuuagcgauucaa

SEQ ID NO: 4086891 - RNA, 23 nt, Variola virus
uguaucgauugcguuguaacauu

SEQ ID NO: 4086892 - RNA, 14 nt, Variola virus
uguaucuauaucug

SEQ ID NO: 4086893 - RNA, 13 nt, Variola virus
uguaugagugaua

SEQ ID NO: 4086894 - RNA, 19 nt, Variola virus
uguaugagugauauugaua

SEQ ID NO: 4086895 - RNA, 17 nt, Variola virus
uguaugcguuaauauua

SEQ ID NO: 4086896 - RNA, 21 nt, Variola virus
uaauaaggaaggcgucaaaau

SEQ ID NO: 4086897 - RNA, 20 nt, Variola virus
uaauaauaaacggaagagau

SEQ ID NO: 4086898 - RNA, 18 nt, Variola virus
uaauaccaguuauguuca

SEQ ID NO: 4086899 - RNA, 15 nt, Variola virus
uaauacuaucuggau

SEQ ID NO: 4086900 - RNA, 14 nt, Variola virus
uaauacuguuuucu

SEQ ID NO: 4086901 - RNA, 22 nt, Variola virus
uaauacuuauucauauuuuagu

SEQ ID NO: 4086902 - RNA, 13 nt, Variola virus
uaauagaacucuu

SEQ ID NO: 4086903 - RNA, 23 nt, Variola virus
uaauagcagaaagcuauaacuug

SEQ ID NO: 4086904 - RNA, 15 nt, Variola virus
uaauagcgucuacau

SEQ ID NO: 4086905 - RNA, 17 nt, Variola virus
uaauaguuuaucauacu

SEQ ID NO: 4086906 - RNA, 23 nt, Variola virus
uaauauaaaauucccaaucuugu

SEQ ID NO: 4086907 - RNA, 15 nt, Variola virus
uaauauccaaucuua

SEQ ID NO: 4086908 - RNA, 19 nt, Variola virus
uaauaucuuggaucuuauu

SEQ ID NO: 4086909 - RNA, 20 nt, Variola virus
uaauaugagugauaaaaucc

SEQ ID NO: 4086910 - RNA, 19 nt, Variola virus
uaauauuaaagauaaagcg

SEQ ID NO: 4086911 - RNA, 19 nt, Variola virus
uaauauucccagaaaagau

SEQ ID NO: 4086912 - RNA, 17 nt, Variola virus
uaauauugaaaauacua

SEQ ID NO: 4086913 - RNA, 22 nt, Variola virus
uaauauuuaugauuuaauguau

SEQ ID NO: 4086914 - RNA, 12 nt, Variola virus
uaaucauuauua

SEQ ID NO: 4086915 - RNA, 12 nt, Variola virus
uaauccaaauau

SEQ ID NO: 4086916 - RNA, 17 nt, Variola virus
uaauccagucuuuaaug

SEQ ID NO: 4086917 - RNA, 17 nt, Variola virus
uaauccaucaacaaugu

SEQ ID NO: 4086918 - RNA, 23 nt, Variola virus
uaauccugaauauauugauuuuc

SEQ ID NO: 4086919 - RNA, 17 nt, Variola virus
uaauccugguacauacg

SEQ ID NO: 4086920 - RNA, 14 nt, Variola virus
uaauccuuguaaug

SEQ ID NO: 4086921 - RNA, 15 nt, Variola virus
uaaucgaguacgcca

SEQ ID NO: 4086922 - RNA, 17 nt, Variola virus
uaaucggagaauguuuc

SEQ ID NO: 4086923 - RNA, 19 nt, Variola virus
uaaucuauaggcaacgaug

SEQ ID NO: 4086924 - RNA, 23 nt, Variola virus
uaaucuauuuuaccucuucugau

SEQ ID NO: 4086925 - RNA, 17 nt, Variola virus
uaaucucuccagaguau

SEQ ID NO: 4086926 - RNA, 13 nt, Variola virus
uaaucugaugaau

SEQ ID NO: 4086927 - RNA, 15 nt, Variola virus
uaaugaauagauguc

SEQ ID NO: 4086928 - RNA, 22 nt, Variola virus
uaaugacguuaauaacaaaaau

SEQ ID NO: 4086929 - RNA, 15 nt, Variola virus
uaaugaucaucuauu

SEQ ID NO: 4086930 - RNA, 22 nt, Variola virus
uaaugauguauguuuaaacacu

SEQ ID NO: 4086931 - RNA, 22 nt, Variola virus
uaaugcagggugcauauuauua

SEQ ID NO: 4086932 - RNA, 22 nt, Variola virus
uaaugccuuacucgguguauau

SEQ ID NO: 4086933 - RNA, 14 nt, Variola virus
uaaugcuacagaua

SEQ ID NO: 4086934 - RNA, 18 nt, Variola virus
uaauggauauucugaaua

SEQ ID NO: 4086935 - RNA, 15 nt, Variola virus
uaauggaucuucuag

SEQ ID NO: 4086936 - RNA, 17 nt, Variola virus
uaauguuguauuucauu

SEQ ID NO: 4086937 - RNA, 21 nt, Variola virus
uaauguugugaaccauguacu

SEQ ID NO: 4086938 - RNA, 14 nt, Variola virus
uaauuaaauuauug

SEQ ID NO: 4086939 - RNA, 15 nt, Variola virus
uaauuaaucuaaaau

SEQ ID NO: 4086940 - RNA, 16 nt, Variola virus
uaauuagguuguuuau

SEQ ID NO: 4086941 - RNA, 19 nt, Variola virus
uaauucaaauuguuaaauu

SEQ ID NO: 4086942 - RNA, 15 nt, Variola virus
uaauuccuuugcuau

SEQ ID NO: 4086943 - RNA, 17 nt, Variola virus
uaauucuccuauuacau

SEQ ID NO: 4086944 - RNA, 15 nt, Variola virus
uaauucucuauagaa

SEQ ID NO: 4086945 - RNA, 22 nt, Variola virus
uaauucuuaucaauaacauauu

SEQ ID NO: 4086946 - RNA, 16 nt, Variola virus
uaauugggugaagaau

SEQ ID NO: 4086947 - RNA, 15 nt, Variola virus
uaauugucuauaaau

SEQ ID NO: 4086948 - RNA, 20 nt, Variola virus
uaauuguuauuuuauucaua

SEQ ID NO: 4086949 - RNA, 21 nt, Variola virus
uaauuuacaaaaauuuaaaau

SEQ ID NO: 4086950 - RNA, 13 nt, Variola virus
uaauuucacgaau

SEQ ID NO: 4086951 - RNA, 16 nt, Variola virus
uaauuucaucuacaau

SEQ ID NO: 4086952 - RNA, 22 nt, Variola virus
uaauuuccaacccuucagaaua

SEQ ID NO: 4086953 - RNA, 15 nt, Variola virus
uaauuucuagaauau

SEQ ID NO: 4086954 - RNA, 15 nt, Variola virus
uaauuuguucaaaau

SEQ ID NO: 4086955 - RNA, 17 nt, Variola virus
uaauuuuagcagaauau

SEQ ID NO: 4086956 - RNA, 23 nt, Variola virus
uaauuuuauuaacgguaauacau

SEQ ID NO: 4086957 - RNA, 22 nt, Variola virus
uaauuuucuauaacugaacgau

SEQ ID NO: 4086958 - RNA, 17 nt, Variola virus
uacaaaauguugauaau

SEQ ID NO: 4086959 - RNA, 22 nt, Variola virus
uacaaaauguugauaauccuug

SEQ ID NO: 4086960 - RNA, 20 nt, Variola virus
uacaaaauuugcaucuacau

SEQ ID NO: 4086961 - RNA, 18 nt, Variola virus
uacaaacaacuaggaaau

SEQ ID NO: 4086962 - RNA, 21 nt, Variola virus
uacaaacuauagaaauuauuu

SEQ ID NO: 4086963 - RNA, 12 nt, Variola virus
uacaaauuauug

SEQ ID NO: 4086964 - RNA, 19 nt, Variola virus
uacaacuaguuuucaucaa

SEQ ID NO: 4086965 - RNA, 20 nt, Variola virus
uacaauaauuauaauuauua

SEQ ID NO: 4086966 - RNA, 21 nt, Variola virus
uacaaucaaaccuauaacauu

SEQ ID NO: 4086967 - RNA, 17 nt, Variola virus
uacaauuucauaaugag

SEQ ID NO: 4086968 - RNA, 16 nt, Variola virus
uacacaauauaaacac

SEQ ID NO: 4086969 - RNA, 18 nt, Variola virus
uacacaucagcaucuuga

SEQ ID NO: 4086970 - RNA, 19 nt, Variola virus
uacacaugguguuacaaaa

SEQ ID NO: 4086971 - RNA, 17 nt, Variola virus
uacacggacucauuaaa

SEQ ID NO: 4086972 - RNA, 16 nt, Variola virus
uacagaacgaauuaug

SEQ ID NO: 4086973 - RNA, 23 nt, Variola virus
uacagaagcugccaauauagucu

SEQ ID NO: 4086974 - RNA, 22 nt, Variola virus
uacagauauauucauaguaguu

SEQ ID NO: 4086975 - RNA, 19 nt, Variola virus
uacaggaguucaguuuuau

SEQ ID NO: 4086976 - RNA, 16 nt, Variola virus
uacaguaauuaaugag

SEQ ID NO: 4086977 - RNA, 14 nt, Variola virus
uacauaagaaucaa

SEQ ID NO: 4086978 - RNA, 12 nt, Variola virus
uacauaauauua

SEQ ID NO: 4086979 - RNA, 16 nt, Variola virus
uacauaauucuucugu

SEQ ID NO: 4086980 - RNA, 18 nt, Variola virus
uacauacgaauaacaaaa

SEQ ID NO: 4086981 - RNA, 15 nt, Variola virus
uacauacuaauauua

SEQ ID NO: 4086982 - RNA, 16 nt, Variola virus
uacaucaaucuuacag

SEQ ID NO: 4086983 - RNA, 23 nt, Variola virus
uacauucucauuaauuaaccauu

SEQ ID NO: 4086984 - RNA, 17 nt, Variola virus
uacauuguauaaaaagc

SEQ ID NO: 4086985 - RNA, 14 nt, Variola virus
uacauuucucaaau

SEQ ID NO: 4086986 - RNA, 15 nt, Variola virus
uacauuuucuuacaa

SEQ ID NO: 4086987 - RNA, 13 nt, Variola virus
uaccaauaugucu

SEQ ID NO: 4086988 - RNA, 23 nt, Variola virus
uaccaauaugucuguacaaaugu

SEQ ID NO: 4086989 - RNA, 14 nt, Variola virus
uaccacauacaaaa

SEQ ID NO: 4086990 - RNA, 18 nt, Variola virus
uaccacuuauuacuccau

SEQ ID NO: 4086991 - RNA, 21 nt, Variola virus
uaccacuuauuacuccauuau

SEQ ID NO: 4086992 - RNA, 16 nt, Variola virus
uaccagaauacuauuu

SEQ ID NO: 4086993 - RNA, 19 nt, Variola virus
uaccaguuaagucaauaau

SEQ ID NO: 4086994 - RNA, 15 nt, Variola virus
uaccaucuucuuuga

SEQ ID NO: 4086995 - RNA, 19 nt, Variola virus
uaccauuaaagaauucuua

SEQ ID NO: 4086996 - RNA, 18 nt, Variola virus
uaccauuagauaaucuag

SEQ ID NO: 4086997 - RNA, 15 nt, Variola virus
uaccauuucauugau

SEQ ID NO: 4086998 - RNA, 21 nt, Variola virus
uaccgauuuaucaucauacac

SEQ ID NO: 4086999 - RNA, 13 nt, Variola virus
uaccuaauacuaa

SEQ ID NO: 4087000 - RNA, 16 nt, Variola virus
uaccucauuuaucaug

SEQ ID NO: 4087001 - RNA, 15 nt, Variola virus
uaccucucuuaaaau

SEQ ID NO: 4087002 - RNA, 14 nt, Variola virus
uacgaaaaaacuuu

SEQ ID NO: 4087003 - RNA, 16 nt, Variola virus
uacgaggauucaaaaa

SEQ ID NO: 4087004 - RNA, 19 nt, Variola virus
uacgcauucacucauacau

SEQ ID NO: 4087005 - RNA, 19 nt, Variola virus
uacgcgcauuaaacuuuuc

SEQ ID NO: 4087006 - RNA, 20 nt, Variola virus
uacgguuccacagacucauu

SEQ ID NO: 4087007 - RNA, 16 nt, Variola virus
uacguaucauaucuuc

SEQ ID NO: 4087008 - RNA, 20 nt, Variola virus
uacgucgcagaauucuaaau

SEQ ID NO: 4087009 - RNA, 14 nt, Variola virus
uacgucgucaaaau

SEQ ID NO: 4087010 - RNA, 16 nt, Variola virus
uacguugauuucuagc

SEQ ID NO: 4087011 - RNA, 21 nt, Variola virus
uacguuuaucgauguacacau

SEQ ID NO: 4087012 - RNA, 22 nt, Variola virus
uacguuugauucguucaaaaau

SEQ ID NO: 4087013 - RNA, 14 nt, Variola virus
uacuaaaggaugag

SEQ ID NO: 4087014 - RNA, 19 nt, Variola virus
uacuaaauucaauaucuuu

SEQ ID NO: 4087015 - RNA, 18 nt, Variola virus
uacuaagccaacaaauau

SEQ ID NO: 4087016 - RNA, 18 nt, Variola virus
uacuaaugacaauaauua

SEQ ID NO: 4087017 - RNA, 18 nt, Variola virus
uacuaauuacaaaccugu

SEQ ID NO: 4087018 - RNA, 15 nt, Variola virus
uacuacuucauuaau

SEQ ID NO: 4087019 - RNA, 14 nt, Variola virus
uacuagaguacuua

SEQ ID NO: 4087020 - RNA, 14 nt, Variola virus
uacuagcauauuug

SEQ ID NO: 4087021 - RNA, 19 nt, Variola virus
uacuagugguaucaagaag

SEQ ID NO: 4087022 - RNA, 14 nt, Variola virus
uacuauacacaaug

SEQ ID NO: 4087023 - RNA, 24 nt, Variola virus
uacuauacacaauguuacucacau

SEQ ID NO: 4087024 - RNA, 16 nt, Variola virus
uacuauuuuauaccuu

SEQ ID NO: 4087025 - RNA, 14 nt, Variola virus
uacucaaauagcac

SEQ ID NO: 4087026 - RNA, 20 nt, Variola virus
uacucaguugaacagaugau

SEQ ID NO: 4087027 - RNA, 20 nt, Variola virus
uacuccucauuacguuucau

SEQ ID NO: 4087028 - RNA, 13 nt, Variola virus
uacugcaauaaaa

SEQ ID NO: 4087029 - RNA, 17 nt, Variola virus
uacuggagccauugucu

SEQ ID NO: 4087030 - RNA, 18 nt, Variola virus
uacugggauaagauuucu

SEQ ID NO: 4087031 - RNA, 17 nt, Variola virus
uacuguauuaagaacag

SEQ ID NO: 4087032 - RNA, 16 nt, Variola virus
uacugucgcuaucauu

SEQ ID NO: 4087033 - RNA, 15 nt, Variola virus
uacuuaaaaaaugaa

SEQ ID NO: 4087034 - RNA, 15 nt, Variola virus
uacuuaugacaaagu

SEQ ID NO: 4087035 - RNA, 22 nt, Variola virus
uacuuauucuauuuuacaaaua

SEQ ID NO: 4087036 - RNA, 19 nt, Variola virus
uacuucuuuacgguaucua

SEQ ID NO: 4087037 - RNA, 15 nt, Variola virus
uacuugaaauaaucg

SEQ ID NO: 4087038 - RNA, 20 nt, Variola virus
uacuuguuaguaguuagaua

SEQ ID NO: 4087039 - RNA, 16 nt, Variola virus
uacuuguuggugaaau

SEQ ID NO: 4087040 - RNA, 21 nt, Variola virus
uacuuuaauaaccguuagaca

SEQ ID NO: 4087041 - RNA, 13 nt, Variola virus
uacuuuacauaua

SEQ ID NO: 4087042 - RNA, 16 nt, Variola virus
uacuuuauuacuccau

SEQ ID NO: 4087043 - RNA, 17 nt, Variola virus
uacuuuuuaauucucua

SEQ ID NO: 4087044 - RNA, 16 nt, Variola virus
uagaaaaauucuugga

SEQ ID NO: 4087045 - RNA, 18 nt, Variola virus
uagaaacaugucuagaaa

SEQ ID NO: 4087046 - RNA, 21 nt, Variola virus
uagaaacgauaccaucuucug

SEQ ID NO: 4087047 - RNA, 17 nt, Variola virus
uagaaacuauacgaaau

SEQ ID NO: 4087048 - RNA, 20 nt, Variola virus
uagaaacuauacgaaauaga

SEQ ID NO: 4087049 - RNA, 21 nt, Variola virus
uagaacguuuaacgaggauuu

SEQ ID NO: 4087050 - RNA, 19 nt, Variola virus
uagaacuaccaauaugucu

SEQ ID NO: 4087051 - RNA, 13 nt, Variola virus
uagaacuuaacuu

SEQ ID NO: 4087052 - RNA, 21 nt, Variola virus
uagaacuuacugacaaaguua

SEQ ID NO: 4087053 - RNA, 18 nt, Variola virus
uagaauuauaccaauaga

SEQ ID NO: 4087054 - RNA, 17 nt, Variola virus
uagaauuguauaguucu

SEQ ID NO: 4087055 - RNA, 20 nt, Variola virus
uagaauuuagcauaucucuu

SEQ ID NO: 4087056 - RNA, 19 nt, Variola virus
uagaauuuauauaucuauu

SEQ ID NO: 4087057 - RNA, 12 nt, Variola virus
uagaauuuccaa

SEQ ID NO: 4087058 - RNA, 15 nt, Variola virus
uagacauaauaguca

SEQ ID NO: 4087059 - RNA, 12 nt, Variola virus
uagacauaucug

SEQ ID NO: 4087060 - RNA, 22 nt, Variola virus
uagacugacuucuaacaaacau

SEQ ID NO: 4087061 - RNA, 19 nt, Variola virus
uagagacagauuaaguucu

SEQ ID NO: 4087062 - RNA, 17 nt, Variola virus
uagagauacaauauuua

SEQ ID NO: 4087063 - RNA, 20 nt, Variola virus
uagaggaacauuaaacaucg

SEQ ID NO: 4087064 - RNA, 24 nt, Variola virus
uagaggaagggacggauacugucu

SEQ ID NO: 4087065 - RNA, 23 nt, Variola virus
uagaggaaguauaaaaauuaaac

SEQ ID NO: 4087066 - RNA, 14 nt, Variola virus
uagaggaugaauuu

SEQ ID NO: 4087067 - RNA, 20 nt, Variola virus
uagagugaguuuaggauuca

SEQ ID NO: 4087068 - RNA, 23 nt, Variola virus
uagauaguuuuuuugagccauau

SEQ ID NO: 4087069 - RNA, 16 nt, Variola virus
uagauauaacuucugg

SEQ ID NO: 4087070 - RNA, 16 nt, Variola virus
uagauauaccagaacu

SEQ ID NO: 4087071 - RNA, 18 nt, Variola virus
uagaucacccuaaucuua

SEQ ID NO: 4087072 - RNA, 16 nt, Variola virus
uagaucugaauuaaau

SEQ ID NO: 4087073 - RNA, 20 nt, Variola virus
uagaugauaauuuauacaaa

SEQ ID NO: 4087074 - RNA, 15 nt, Variola virus
uagaugauauuguaa

SEQ ID NO: 4087075 - RNA, 13 nt, Variola virus
uagauuuaucuag

SEQ ID NO: 4087076 - RNA, 16 nt, Variola virus
uagauuuguaucucuu

SEQ ID NO: 4087077 - RNA, 18 nt, Variola virus
uagauuuguaucucuuuu

SEQ ID NO: 4087078 - RNA, 16 nt, Variola virus
uagauuuuccauccac

SEQ ID NO: 4087079 - RNA, 15 nt, Variola virus
uagauuuuguugaga

SEQ ID NO: 4087080 - RNA, 13 nt, Variola virus
uagcaaaauuaac

SEQ ID NO: 4087081 - RNA, 23 nt, Variola virus
uagcaaacaugauagcugugaua

SEQ ID NO: 4087082 - RNA, 18 nt, Variola virus
uagcaaaggaaauugugc

SEQ ID NO: 4087083 - RNA, 13 nt, Variola virus
uagcaaauauucu

SEQ ID NO: 4087084 - RNA, 13 nt, Variola virus
uagcaauugcauu

SEQ ID NO: 4087085 - RNA, 20 nt, Variola virus
uagcaauuucugauucuaga

SEQ ID NO: 4087086 - RNA, 22 nt, Variola virus
uagcagcugauacgucauuaac

SEQ ID NO: 4087087 - RNA, 14 nt, Variola virus
uagcaucaaaacua

SEQ ID NO: 4087088 - RNA, 21 nt, Variola virus
uagcauuguuauguauuucau

SEQ ID NO: 4087089 - RNA, 23 nt, Variola virus
uagcauuucuaccaaccaagaau

SEQ ID NO: 4087090 - RNA, 17 nt, Variola virus
uagcccucuucaagaac

SEQ ID NO: 4087091 - RNA, 14 nt, Variola virus
uagcgacaggugau

SEQ ID NO: 4087092 - RNA, 17 nt, Variola virus
uagcugagaauaucuuu

SEQ ID NO: 4087093 - RNA, 13 nt, Variola virus
uagcuguuuucau

SEQ ID NO: 4087094 - RNA, 15 nt, Variola virus
uaggaccacuagcaa

SEQ ID NO: 4087095 - RNA, 14 nt, Variola virus
uaggauaauaauua

SEQ ID NO: 4087096 - RNA, 14 nt, Variola virus
uaggauacaagauc

SEQ ID NO: 4087097 - RNA, 21 nt, Variola virus
uaggcauaccauuagauaauc

SEQ ID NO: 4087098 - RNA, 16 nt, Variola virus
uaggcuauaaauauua

SEQ ID NO: 4087099 - RNA, 21 nt, Variola virus
uagggagaguauaaaacauua

SEQ ID NO: 4087100 - RNA, 19 nt, Variola virus
uagggaugauaaauauuua

SEQ ID NO: 4087101 - RNA, 14 nt, Variola virus
uaggguaucuaauu

SEQ ID NO: 4087102 - RNA, 15 nt, Variola virus
uagguaucaaagaua

SEQ ID NO: 4087103 - RNA, 16 nt, Variola virus
uagguauuguuuucac

SEQ ID NO: 4087104 - RNA, 18 nt, Variola virus
uagguuuaguaucucaau

SEQ ID NO: 4087105 - RNA, 14 nt, Variola virus
uagguuucuauaau

SEQ ID NO: 4087106 - RNA, 20 nt, Variola virus
uaguaaaauaaucauacaau

SEQ ID NO: 4087107 - RNA, 17 nt, Variola virus
uaguaacugacuuaaua

SEQ ID NO: 4087108 - RNA, 16 nt, Variola virus
uaguaauaaaauuucu

SEQ ID NO: 4087109 - RNA, 20 nt, Variola virus
uaguaauuaaauauaucaug

SEQ ID NO: 4087110 - RNA, 13 nt, Variola virus
uaguacaugaaug

SEQ ID NO: 4087111 - RNA, 17 nt, Variola virus
uaguaccuagaacaaug

SEQ ID NO: 4087112 - RNA, 12 nt, Variola virus
uaguagaugcua

SEQ ID NO: 4087113 - RNA, 18 nt, Variola virus
uaguagcgaaaacuauau

SEQ ID NO: 4087114 - RNA, 14 nt, Variola virus
uaguauaauauuua

SEQ ID NO: 4087115 - RNA, 17 nt, Variola virus
uaguaucauccacauau

SEQ ID NO: 4087116 - RNA, 13 nt, Variola virus
uaguaucuaaaac

SEQ ID NO: 4087117 - RNA, 16 nt, Variola virus
uaguaucuaaaacuac

SEQ ID NO: 4087118 - RNA, 19 nt, Variola virus
uaguaucuagcucuguaaa

SEQ ID NO: 4087119 - RNA, 21 nt, Variola virus
uaguaugaagauaaacacuca

SEQ ID NO: 4087120 - RNA, 16 nt, Variola virus
uaguauugacaaauau

SEQ ID NO: 4087121 - RNA, 19 nt, Variola virus
uagucgguuaauguuguau

SEQ ID NO: 4087122 - RNA, 15 nt, Variola virus
uagucuauaugauca

SEQ ID NO: 4087123 - RNA, 15 nt, Variola virus
uagucuguacaaaag

SEQ ID NO: 4087124 - RNA, 15 nt, Variola virus
uagugaaacaaaaua

SEQ ID NO: 4087125 - RNA, 15 nt, Variola virus
uagugacaauacuau

SEQ ID NO: 4087126 - RNA, 13 nt, Variola virus
uagugauagauuu

SEQ ID NO: 4087127 - RNA, 23 nt, Variola virus
uagugccaucagaauaggaugaa

SEQ ID NO: 4087128 - RNA, 13 nt, Variola virus
uaguggacaacau

SEQ ID NO: 4087129 - RNA, 17 nt, Variola virus
uaguggaucucaaugac

SEQ ID NO: 4087130 - RNA, 18 nt, Variola virus
uaguguaaagaacaaaug

SEQ ID NO: 4087131 - RNA, 17 nt, Variola virus
uaguguaucgacaucuu

SEQ ID NO: 4087132 - RNA, 16 nt, Variola virus
uaguuaauaaaaucua

SEQ ID NO: 4087133 - RNA, 17 nt, Variola virus
uaguuacuuuaauaacc

SEQ ID NO: 4087134 - RNA, 20 nt, Variola virus
uaguuagggaucacaugaau

SEQ ID NO: 4087135 - RNA, 19 nt, Variola virus
uaguuauagguaauacgcu

SEQ ID NO: 4087136 - RNA, 17 nt, Variola virus
uaguuauaucacaugau

SEQ ID NO: 4087137 - RNA, 17 nt, Variola virus
uaguuauuacuuuucuc

SEQ ID NO: 4087138 - RNA, 18 nt, Variola virus
uaguucguguacuaguca

SEQ ID NO: 4087139 - RNA, 22 nt, Variola virus
uaguugauagaacaaaauacau

SEQ ID NO: 4087140 - RNA, 18 nt, Variola virus
uaguuguaaaguuaaaau

SEQ ID NO: 4087141 - RNA, 21 nt, Variola virus
uaguuguauacugagaauuaa

SEQ ID NO: 4087142 - RNA, 16 nt, Variola virus
uaguuuaucauacuua

SEQ ID NO: 4087143 - RNA, 18 nt, Variola virus
uaguuucagaauuuucua

SEQ ID NO: 4087144 - RNA, 20 nt, Variola virus
uaguuuguaauuuuaacaua

SEQ ID NO: 4087145 - RNA, 15 nt, Variola virus
uaguuuuacuaucau

SEQ ID NO: 4087146 - RNA, 16 nt, Variola virus
uaguuuuacuaucaua

SEQ ID NO: 4087147 - RNA, 21 nt, Variola virus
uaguuuucucuauucugaaau

SEQ ID NO: 4087148 - RNA, 22 nt, Variola virus
uaguuuucucuuuuuauccuca

SEQ ID NO: 4087149 - RNA, 14 nt, Variola virus
uauaaaauauucua

SEQ ID NO: 4087150 - RNA, 17 nt, Variola virus
uauaaaaucuguaucga

SEQ ID NO: 4087151 - RNA, 21 nt, Variola virus
uauaaagucugucaaaucauc

SEQ ID NO: 4087152 - RNA, 22 nt, Variola virus
uauaaauaaaagacaaaucuug

SEQ ID NO: 4087153 - RNA, 23 nt, Variola virus
aauacuccucauuacguuucauu

SEQ ID NO: 4087154 - RNA, 14 nt, Variola virus
aauacuuaaaaaug

SEQ ID NO: 4087155 - RNA, 15 nt, Variola virus
aauacuuaaaaugua

SEQ ID NO: 4087156 - RNA, 20 nt, Variola virus
aauacuuaccccuugaucgu

SEQ ID NO: 4087157 - RNA, 15 nt, Variola virus
aauacuuaguuucca

SEQ ID NO: 4087158 - RNA, 15 nt, Variola virus
aauacuuuacgcuau

SEQ ID NO: 4087159 - RNA, 21 nt, Variola virus
aauacuuuuguuacuaauauc

SEQ ID NO: 4087160 - RNA, 22 nt, Variola virus
aauacuuuuuuuauuaaaugac

SEQ ID NO: 4087161 - RNA, 17 nt, Variola virus
aauagaaaaaacaugug

SEQ ID NO: 4087162 - RNA, 18 nt, Variola virus
aauagauagucuaccauu

SEQ ID NO: 4087163 - RNA, 19 nt, Variola virus
aauagcauagauauagaaa

SEQ ID NO: 4087164 - RNA, 21 nt, Variola virus
aauagcaucaucuuuaucauu

SEQ ID NO: 4087165 - RNA, 15 nt, Variola virus
aauagccguuucaug

SEQ ID NO: 4087166 - RNA, 15 nt, Variola virus
aauagcucaauauaa

SEQ ID NO: 4087167 - RNA, 16 nt, Variola virus
aauaggaauggauaau

SEQ ID NO: 4087168 - RNA, 19 nt, Variola virus
aauaggagugauagaacug

SEQ ID NO: 4087169 - RNA, 16 nt, Variola virus
aauaggugaugaugca

SEQ ID NO: 4087170 - RNA, 18 nt, Variola virus
aauaguauacgcagaaaa

SEQ ID NO: 4087171 - RNA, 22 nt, Variola virus
aauaguauacgcagaaaagaua

SEQ ID NO: 4087172 - RNA, 13 nt, Variola virus
aauaguaucaucu

SEQ ID NO: 4087173 - RNA, 17 nt, Variola virus
aauagugccaucagaau

SEQ ID NO: 4087174 - RNA, 15 nt, Variola virus
aauaguguuagauaa

SEQ ID NO: 4087175 - RNA, 16 nt, Variola virus
aauaguuauuagaaua

SEQ ID NO: 4087176 - RNA, 23 nt, Variola virus
aauaguucucccuuuuuaaaggu

SEQ ID NO: 4087177 - RNA, 22 nt, Variola virus
aauaguuuacagauauuuucca

SEQ ID NO: 4087178 - RNA, 17 nt, Variola virus
aauaguuuauaacauua

SEQ ID NO: 4087179 - RNA, 14 nt, Variola virus
aauaguuucauaau

SEQ ID NO: 4087180 - RNA, 23 nt, Variola virus
aauaguuuguuuuggaaauagau

SEQ ID NO: 4087181 - RNA, 12 nt, Variola virus
aauauaaaacua

SEQ ID NO: 4087182 - RNA, 16 nt, Variola virus
aauauaaugaaagaua

SEQ ID NO: 4087183 - RNA, 18 nt, Variola virus
aauauaaugauauacaau

SEQ ID NO: 4087184 - RNA, 12 nt, Variola virus
aauauagaauau

SEQ ID NO: 4087185 - RNA, 14 nt, Variola virus
aauauaugauuauc

SEQ ID NO: 4087186 - RNA, 21 nt, Variola virus
aauauauguaaucauuaucca

SEQ ID NO: 4087187 - RNA, 17 nt, Variola virus
aauaucacauaucaugu

SEQ ID NO: 4087188 - RNA, 15 nt, Variola virus
aauaucagaaaggau

SEQ ID NO: 4087189 - RNA, 14 nt, Variola virus
aauaucagagagau

SEQ ID NO: 4087190 - RNA, 16 nt, Variola virus
aauaucaggaaaugua

SEQ ID NO: 4087191 - RNA, 23 nt, Variola virus
aauauccaaguauuuuaauucua

SEQ ID NO: 4087192 - RNA, 17 nt, Variola virus
aauauccauuuuacauu

SEQ ID NO: 4087193 - RNA, 19 nt, Variola virus
aauaucccacauugucauc

SEQ ID NO: 4087194 - RNA, 14 nt, Variola virus
aauaucuuaaauaa

SEQ ID NO: 4087195 - RNA, 22 nt, Variola virus
aauauggagagguguauuucca

SEQ ID NO: 4087196 - RNA, 23 nt, Variola virus
aauauggagagguguauuuccau

SEQ ID NO: 4087197 - RNA, 20 nt, Variola virus
aauauggauccgguuaauuu

SEQ ID NO: 4087198 - RNA, 21 nt, Variola virus
aauaugguauggguucugaua

SEQ ID NO: 4087199 - RNA, 21 nt, Variola virus
aauaugucaucuauggaauua

SEQ ID NO: 4087200 - RNA, 18 nt, Variola virus
aauauuacgaauuacauu

SEQ ID NO: 4087201 - RNA, 13 nt, Variola virus
aauauuacuacau

SEQ ID NO: 4087202 - RNA, 12 nt, Variola virus
aauauuaggaau

SEQ ID NO: 4087203 - RNA, 19 nt, Variola virus
aauauuauauaaacauuug

SEQ ID NO: 4087204 - RNA, 13 nt, Variola virus
aauauuauuacca

SEQ ID NO: 4087205 - RNA, 14 nt, Variola virus
aauauuauuaucca

SEQ ID NO: 4087206 - RNA, 19 nt, Variola virus
aauauuauucuuugauucg

SEQ ID NO: 4087207 - RNA, 13 nt, Variola virus
aauauucagaaaa

SEQ ID NO: 4087208 - RNA, 13 nt, Variola virus
aauauucauuaau

SEQ ID NO: 4087209 - RNA, 21 nt, Variola virus
aauauucauucaauauuuaca

SEQ ID NO: 4087210 - RNA, 17 nt, Variola virus
aauauucuuuucuaaga

SEQ ID NO: 4087211 - RNA, 16 nt, Variola virus
aguaaucucaauaauu

SEQ ID NO: 4087212 - RNA, 20 nt, Variola virus
aguaauggguuauuguggau

SEQ ID NO: 4087213 - RNA, 14 nt, Variola virus
aguaauuauaagaa

SEQ ID NO: 4087214 - RNA, 18 nt, Variola virus
aguaauucagacacuucu

SEQ ID NO: 4087215 - RNA, 16 nt, Variola virus
aguacaaugaacgaua

SEQ ID NO: 4087216 - RNA, 18 nt, Variola virus
aguacagaauuaauuaga

SEQ ID NO: 4087217 - RNA, 15 nt, Variola virus
aguacaucuaucaca

SEQ ID NO: 4087218 - RNA, 22 nt, Variola virus
aguacuacugaagaacuaaaag

SEQ ID NO: 4087219 - RNA, 14 nt, Variola virus
aguacuuauuaaaa

SEQ ID NO: 4087220 - RNA, 18 nt, Variola virus
aguaggauauauuaaagu

SEQ ID NO: 4087221 - RNA, 19 nt, Variola virus
aguaguuuaacuagucuuc

SEQ ID NO: 4087222 - RNA, 17 nt, Variola virus
aguauaaaguuuauaca

SEQ ID NO: 4087223 - RNA, 12 nt, Variola virus
aguauacauguu

SEQ ID NO: 4087224 - RNA, 17 nt, Variola virus
aguauaccaaacauagu

SEQ ID NO: 4087225 - RNA, 19 nt, Variola virus
aguauaguuuuaaacuaau

SEQ ID NO: 4087226 - RNA, 14 nt, Variola virus
aguauauaauaaag

SEQ ID NO: 4087227 - RNA, 15 nt, Variola virus
aguaucauuaaaucu

SEQ ID NO: 4087228 - RNA, 20 nt, Variola virus
aguaucuuuuguucuagaug

SEQ ID NO: 4087229 - RNA, 16 nt, Variola virus
aguauggcgacauuga

SEQ ID NO: 4087230 - RNA, 17 nt, Variola virus
aguauggcgacauugau

SEQ ID NO: 4087231 - RNA, 13 nt, Variola virus
aguauguaacaga

SEQ ID NO: 4087232 - RNA, 23 nt, Variola virus
aguaugucgaaucuaaacuagug

SEQ ID NO: 4087233 - RNA, 15 nt, Variola virus
aguaugucuuaauaa

SEQ ID NO: 4087234 - RNA, 15 nt, Variola virus
aguaugugaauagau

SEQ ID NO: 4087235 - RNA, 22 nt, Variola virus
aguauuaaccaugaaagaaaga

SEQ ID NO: 4087236 - RNA, 18 nt, Variola virus
aguauugacaauacugua

SEQ ID NO: 4087237 - RNA, 16 nt, Variola virus
aguauuucuuacucaa

SEQ ID NO: 4087238 - RNA, 13 nt, Variola virus
aguauuugucaaa

SEQ ID NO: 4087239 - RNA, 16 nt, Variola virus
aguauuuuuaccuaau

SEQ ID NO: 4087240 - RNA, 15 nt, Variola virus
agucaacaucuaaag

SEQ ID NO: 4087241 - RNA, 15 nt, Variola virus
agucaauauauuaag

SEQ ID NO: 4087242 - RNA, 20 nt, Variola virus
agucaauggagaaauacuua

SEQ ID NO: 4087243 - RNA, 22 nt, Variola virus
agucacgaucaccacuuucaua

SEQ ID NO: 4087244 - RNA, 21 nt, Variola virus
agucaucuuauguuuuuaaga

SEQ ID NO: 4087245 - RNA, 21 nt, Variola virus
agucaugcuuauugauaaaga

SEQ ID NO: 4087246 - RNA, 15 nt, Variola virus
agucauguuaaaaau

SEQ ID NO: 4087247 - RNA, 16 nt, Variola virus
agucauuacuaauaga

SEQ ID NO: 4087248 - RNA, 19 nt, Variola virus
aguccuaguuguauacuga

SEQ ID NO: 4087249 - RNA, 16 nt, Variola virus
aguccuauauauuuga

SEQ ID NO: 4087250 - RNA, 21 nt, Variola virus
agucguaugugguaugauaca

SEQ ID NO: 4087251 - RNA, 18 nt, Variola virus
agucuacauugucauuau

SEQ ID NO: 4087252 - RNA, 24 nt, Variola virus
agucuagagucuuugcaaacauaa

SEQ ID NO: 4087253 - RNA, 20 nt, Variola virus
agucuagcagccaauacuuu

SEQ ID NO: 4087254 - RNA, 23 nt, Variola virus
agucuauaugaucaaaaagagau

SEQ ID NO: 4087255 - RNA, 17 nt, Variola virus
agucuccagaaaucugu

SEQ ID NO: 4087256 - RNA, 16 nt, Variola virus
agucugucuguagaua

SEQ ID NO: 4087257 - RNA, 20 nt, Variola virus
agucuguugagcuugaucau

SEQ ID NO: 4087258 - RNA, 23 nt, Variola virus
agugauauagaucccaaaucuuc

SEQ ID NO: 4087259 - RNA, 15 nt, Variola virus
agugcaaugaauauc

SEQ ID NO: 4087260 - RNA, 15 nt, Variola virus
agugcacuuagucca

SEQ ID NO: 4087261 - RNA, 18 nt, Variola virus
agugcagauaaucauuua

SEQ ID NO: 4087262 - RNA, 18 nt, Variola virus
agugcgaugauuguacac

SEQ ID NO: 4087263 - RNA, 22 nt, Variola virus
agugcuacaaaacagaaauaug

SEQ ID NO: 4087264 - RNA, 23 nt, Variola virus
aguggaucgguucagcauuuaau

SEQ ID NO: 4087265 - RNA, 14 nt, Variola virus
aguggauucuucua

SEQ ID NO: 4087266 - RNA, 22 nt, Variola virus
agugggaugaaauccuauuuua

SEQ ID NO: 4087267 - RNA, 19 nt, Variola virus
agugguuaaucuuagaaau

SEQ ID NO: 4087268 - RNA, 15 nt, Variola virus
aguguaaaacuauau

SEQ ID NO: 4087269 - RNA, 16 nt, Variola virus
aguguaccaauaugcg

SEQ ID NO: 4087270 - RNA, 16 nt, Variola virus
agugucuacuuaaaug

SEQ ID NO: 4087271 - RNA, 18 nt, Variola virus
agugucuacuuaaaugua

SEQ ID NO: 4087272 - RNA, 23 nt, Variola virus
agugugaauaugaucuucaucua

SEQ ID NO: 4087273 - RNA, 17 nt, Variola virus
aguguuaaaaaauggau

SEQ ID NO: 4087274 - RNA, 19 nt, Variola virus
aguuaaaacuuguaagaag

SEQ ID NO: 4087275 - RNA, 20 nt, Variola virus
aguuaauggaauaucaaauc

SEQ ID NO: 4087276 - RNA, 17 nt, Variola virus
aguuacaacuauuacaa

SEQ ID NO: 4087277 - RNA, 16 nt, Variola virus
aguuacaggaacuuaa

SEQ ID NO: 4087278 - RNA, 17 nt, Variola virus
aguuacgacugaaauaa

SEQ ID NO: 4087279 - RNA, 16 nt, Variola virus
aguuagaaaguauuuu

SEQ ID NO: 4087280 - RNA, 14 nt, Variola virus
aguuaguuuuagau

SEQ ID NO: 4087281 - RNA, 22 nt, Variola virus
aguuaucugguaaguucauuau

SEQ ID NO: 4087282 - RNA, 15 nt, Variola virus
aguuauuuacuuuga

SEQ ID NO: 4087283 - RNA, 19 nt, Variola virus
aguucauauuuauuagaua

SEQ ID NO: 4087284 - RNA, 17 nt, Variola virus
aguucauuauaaauucu

SEQ ID NO: 4087285 - RNA, 15 nt, Variola virus
aguucauuaucugaa

SEQ ID NO: 4087286 - RNA, 14 nt, Variola virus
aguuccuuuucuag

SEQ ID NO: 4087287 - RNA, 17 nt, Variola virus
aguucugcgcaaggcau

SEQ ID NO: 4087288 - RNA, 18 nt, Variola virus
aguugaacagaugauaua

SEQ ID NO: 4087289 - RNA, 12 nt, Variola virus
aguuguaaaugu

SEQ ID NO: 4087290 - RNA, 19 nt, Variola virus
aguugucuauauuaacucu

SEQ ID NO: 4087291 - RNA, 19 nt, Variola virus
aguuuaauacuaauacuaa

SEQ ID NO: 4087292 - RNA, 16 nt, Variola virus
aguuuaucauacuuag

SEQ ID NO: 4087293 - RNA, 18 nt, Variola virus
aguuuauuaucuuuacca

SEQ ID NO: 4087294 - RNA, 19 nt, Variola virus
aguuucauaucguaacuga

SEQ ID NO: 4087295 - RNA, 16 nt, Variola virus
aguuucuauacugucu

SEQ ID NO: 4087296 - RNA, 20 nt, Variola virus
aguuugccuuuuuuaguaga

SEQ ID NO: 4087297 - RNA, 14 nt, Variola virus
aguuuuaacuggua

SEQ ID NO: 4087298 - RNA, 20 nt, Variola virus
aguuuuauauccuuuagagu

SEQ ID NO: 4087299 - RNA, 13 nt, Variola virus
aguuuuauuggga

SEQ ID NO: 4087300 - RNA, 21 nt, Variola virus
aguuuucagaagauaauuauc

SEQ ID NO: 4087301 - RNA, 15 nt, Variola virus
aguuuuuacacauag

SEQ ID NO: 4087302 - RNA, 15 nt, Variola virus
auaaaaaauauaaca

SEQ ID NO: 4087303 - RNA, 15 nt, Variola virus
auaaaacaaaaucua

SEQ ID NO: 4087304 - RNA, 20 nt, Variola virus
auaaaacaauggaacaauua

SEQ ID NO: 4087305 - RNA, 11 nt, Variola virus
auaaaacauua

SEQ ID NO: 4087306 - RNA, 20 nt, Variola virus
auaaaaccaugaaauauauu

SEQ ID NO: 4087307 - RNA, 19 nt, Variola virus
auaaaacucauauaguuaa

SEQ ID NO: 4087308 - RNA, 19 nt, Variola virus
auaaaauccaugagaucua

SEQ ID NO: 4087309 - RNA, 13 nt, Variola virus
auaaaaucuauau

SEQ ID NO: 4087310 - RNA, 15 nt, Variola virus
auaaaauuaauaaua

SEQ ID NO: 4087311 - RNA, 17 nt, Variola virus
auaaaauuaaugagauu

SEQ ID NO: 4087312 - RNA, 17 nt, Variola virus
auaaacaacuaaaaugu

SEQ ID NO: 4087313 - RNA, 21 nt, Variola virus
auaaacagucuccuaauauaa

SEQ ID NO: 4087314 - RNA, 15 nt, Variola virus
auaaacaugucuauu

SEQ ID NO: 4087315 - RNA, 16 nt, Variola virus
auaaaccauuguauaa

SEQ ID NO: 4087316 - RNA, 23 nt, Variola virus
auaaacucacauuucaaauauau

SEQ ID NO: 4087317 - RNA, 20 nt, Variola virus
auaaacucagauaauagcaa

SEQ ID NO: 4087318 - RNA, 22 nt, Variola virus
auaaagaaaugucuacauaaau

SEQ ID NO: 4087319 - RNA, 17 nt, Variola virus
auaaagauaaaaacgau

SEQ ID NO: 4087320 - RNA, 17 nt, Variola virus
auaaagguagaccuaau

SEQ ID NO: 4087321 - RNA, 17 nt, Variola virus
auaaaguauauaugaga

SEQ ID NO: 4087322 - RNA, 20 nt, Variola virus
auaaagucuuuaguaugaca

SEQ ID NO: 4087323 - RNA, 21 nt, Variola virus
auaaauacccuuccaaauaau

SEQ ID NO: 4087324 - RNA, 17 nt, Variola virus
auaaauaguaaauacaa

SEQ ID NO: 4087325 - RNA, 18 nt, Variola virus
auaaauaguaucaucuau

SEQ ID NO: 4087326 - RNA, 19 nt, Variola virus
auaaauaucauuaauauau

SEQ ID NO: 4087327 - RNA, 13 nt, Variola virus
auaaaucauauaa

SEQ ID NO: 4087328 - RNA, 20 nt, Variola virus
auaaaucauauaaaaaauga

SEQ ID NO: 4087329 - RNA, 21 nt, Variola virus
auaaaugcucugcaauaacua

SEQ ID NO: 4087330 - RNA, 15 nt, Variola virus
auaaauuaaaauaca

SEQ ID NO: 4087331 - RNA, 13 nt, Variola virus
auaaauuuauuau

SEQ ID NO: 4087332 - RNA, 14 nt, Variola virus
auaacaaaauacaa

SEQ ID NO: 4087333 - RNA, 14 nt, Variola virus
auaacaaauguaua

SEQ ID NO: 4087334 - RNA, 16 nt, Variola virus
auaacaacucaaacau

SEQ ID NO: 4087335 - RNA, 23 nt, Variola virus
auaacaagagauuuauuguguau

SEQ ID NO: 4087336 - RNA, 22 nt, Variola virus
auaacaauuaacaauuaucaaa

SEQ ID NO: 4087337 - RNA, 17 nt, Variola virus
auaacacuaauuuguaa

SEQ ID NO: 4087338 - RNA, 17 nt, Variola virus
auaacaggcuaaaaugu

SEQ ID NO: 4087339 - RNA, 18 nt, Variola virus
auaacauauuuuucuaug

SEQ ID NO: 4087340 - RNA, 17 nt, Variola virus
auaacauguaucaauau

SEQ ID NO: 4087341 - RNA, 15 nt, Variola virus
auaacauguuaauuu

SEQ ID NO: 4087342 - RNA, 16 nt, Variola virus
auaacauuaauaucaa

SEQ ID NO: 4087343 - RNA, 18 nt, Variola virus
auaacauuuuuuguaaau

SEQ ID NO: 4087344 - RNA, 18 nt, Variola virus
auaacccaaguauugaaa

SEQ ID NO: 4087345 - RNA, 21 nt, Variola virus
auaaccgguaagaauaguaaa

SEQ ID NO: 4087346 - RNA, 17 nt, Variola virus
auaaccuccugaaaaug

SEQ ID NO: 4087347 - RNA, 19 nt, Variola virus
auaacguaaccagaauugu

SEQ ID NO: 4087348 - RNA, 18 nt, Variola virus
auguagagguaaaaagac

SEQ ID NO: 4087349 - RNA, 18 nt, Variola virus
auguagauaaaaaagaua

SEQ ID NO: 4087350 - RNA, 16 nt, Variola virus
auguagcaaacaugau

SEQ ID NO: 4087351 - RNA, 14 nt, Variola virus
auguauacauuuau

SEQ ID NO: 4087352 - RNA, 19 nt, Variola virus
auguauauauccaggaauu

SEQ ID NO: 4087353 - RNA, 14 nt, Variola virus
auguauauuuucca

SEQ ID NO: 4087354 - RNA, 19 nt, Variola virus
auguauuguuuaguuacuc

SEQ ID NO: 4087355 - RNA, 21 nt, Variola virus
auguauuugagagucuuauau

SEQ ID NO: 4087356 - RNA, 22 nt, Variola virus
auguauuuugaggaaauugaua

SEQ ID NO: 4087357 - RNA, 21 nt, Variola virus
auguauuuuuuucuaaauaua

SEQ ID NO: 4087358 - RNA, 20 nt, Variola virus
augucaaaacuuguucaauu

SEQ ID NO: 4087359 - RNA, 13 nt, Variola virus
augucauuuguau

SEQ ID NO: 4087360 - RNA, 18 nt, Variola virus
augucauuuuuuuauccg

SEQ ID NO: 4087361 - RNA, 22 nt, Variola virus
auguccaaaucuaguuguggaa

SEQ ID NO: 4087362 - RNA, 17 nt, Variola virus
augucgccgacaugaau

SEQ ID NO: 4087363 - RNA, 21 nt, Variola virus
augucgguuggcauucuauuu

SEQ ID NO: 4087364 - RNA, 18 nt, Variola virus
augucguuauucugaaac

SEQ ID NO: 4087365 - RNA, 18 nt, Variola virus
augugaauuuagcauaua

SEQ ID NO: 4087366 - RNA, 23 nt, Variola virus
augugauuguucaaucaauauua

SEQ ID NO: 4087367 - RNA, 20 nt, Variola virus
auguggaaauuacacuguau

SEQ ID NO: 4087368 - RNA, 13 nt, Variola virus
auguguagaauua

SEQ ID NO: 4087369 - RNA, 15 nt, Variola virus
auguguuaaaaagaa

SEQ ID NO: 4087370 - RNA, 21 nt, Variola virus
auguguuuacacuaacuguau

SEQ ID NO: 4087371 - RNA, 21 nt, Variola virus
auguguuucccaaacaaaaug

SEQ ID NO: 4087372 - RNA, 14 nt, Variola virus
auguuaaaaaaaca

SEQ ID NO: 4087373 - RNA, 14 nt, Variola virus
auguuaaaaaugac

SEQ ID NO: 4087374 - RNA, 19 nt, Variola virus
auguuaaaacuacaaaaau

SEQ ID NO: 4087375 - RNA, 17 nt, Variola virus
auguuacucacauuuau

SEQ ID NO: 4087376 - RNA, 15 nt, Variola virus
auguuauaaaaucua

SEQ ID NO: 4087377 - RNA, 14 nt, Variola virus
auguuauuaaaugu

SEQ ID NO: 4087378 - RNA, 19 nt, Variola virus
auguucugauuuuaucuuu

SEQ ID NO: 4087379 - RNA, 14 nt, Variola virus
auguuggaaauacu

SEQ ID NO: 4087380 - RNA, 14 nt, Variola virus
auguuuaucuucuu

SEQ ID NO: 4087381 - RNA, 13 nt, Variola virus
auguuucaaucau

SEQ ID NO: 4087382 - RNA, 15 nt, Variola virus
auguuucauaaaaug

SEQ ID NO: 4087383 - RNA, 18 nt, Variola virus
auguuuccgagaaauaua

SEQ ID NO: 4087384 - RNA, 19 nt, Variola virus
auguuucuuuaaaagucaa

SEQ ID NO: 4087385 - RNA, 23 nt, Variola virus
auguuugcugaagucaaauacga

SEQ ID NO: 4087386 - RNA, 13 nt, Variola virus
auguuuucacaau

SEQ ID NO: 4087387 - RNA, 14 nt, Variola virus
auguuuuuaauagc

SEQ ID NO: 4087388 - RNA, 18 nt, Variola virus
auguuuuuagaaaaucua

SEQ ID NO: 4087389 - RNA, 12 nt, Variola virus
auuaaaaaagau

SEQ ID NO: 4087390 - RNA, 17 nt, Variola virus
auuaaaaaauaacuuaa

SEQ ID NO: 4087391 - RNA, 14 nt, Variola virus
auuaaaaaaucacu

SEQ ID NO: 4087392 - RNA, 21 nt, Variola virus
auuaaaacuaccaauaagaag

SEQ ID NO: 4087393 - RNA, 21 nt, Variola virus
auuaaaauaaauauucuucau

SEQ ID NO: 4087394 - RNA, 19 nt, Variola virus
auuaaauauagguauauuu

SEQ ID NO: 4087395 - RNA, 14 nt, Variola virus
auuaaaucaugaag

SEQ ID NO: 4087396 - RNA, 19 nt, Variola virus
auuaaaugauuguauuaac

SEQ ID NO: 4087397 - RNA, 19 nt, Variola virus
auuaacaaauuuuaaacaa

SEQ ID NO: 4087398 - RNA, 14 nt, Variola virus
auuaacauuuugaa

SEQ ID NO: 4087399 - RNA, 18 nt, Variola virus
auuaaccgauaaaaagac

SEQ ID NO: 4087400 - RNA, 20 nt, Variola virus
auuaacgaguucaaauauga

SEQ ID NO: 4087401 - RNA, 20 nt, Variola virus
auuaacgcaccuauaaagac

SEQ ID NO: 4087402 - RNA, 20 nt, Variola virus
auuaacucuuuuauuuucca

SEQ ID NO: 4087403 - RNA, 15 nt, Variola virus
auuaacugaggauga

SEQ ID NO: 4087404 - RNA, 20 nt, Variola virus
auuaacuguugccaaugaug

SEQ ID NO: 4087405 - RNA, 14 nt, Variola virus
auuaagacauauau

SEQ ID NO: 4087406 - RNA, 16 nt, Variola virus
auuaagcaacaugucu

SEQ ID NO: 4087407 - RNA, 19 nt, Variola virus
auuaagccgccauugauua

SEQ ID NO: 4087408 - RNA, 15 nt, Variola virus
auuaagugacauuau

SEQ ID NO: 4087409 - RNA, 17 nt, Variola virus
auuaaguguuauaagau

SEQ ID NO: 4087410 - RNA, 15 nt, Variola virus
auuaauaagaaugac

SEQ ID NO: 4087411 - RNA, 18 nt, Variola virus
auuaauacacauaaugaa

SEQ ID NO: 4087412 - RNA, 13 nt, Variola virus
auuaauacauuua

SEQ ID NO: 4087413 - RNA, 19 nt, Variola virus
auuaauacggcagcaacua

SEQ ID NO: 4087414 - RNA, 12 nt, Variola virus
auuaauacuuuu

SEQ ID NO: 4087415 - RNA, 12 nt, Variola virus
auuaauauuaac

SEQ ID NO: 4087416 - RNA, 18 nt, Variola virus
auuaauauuacuguuaau

SEQ ID NO: 4087417 - RNA, 23 nt, Variola virus
auuaauauuacuguuaauaacug

SEQ ID NO: 4087418 - RNA, 16 nt, Variola virus
auuaauauuuaugauu

SEQ ID NO: 4087419 - RNA, 19 nt, Variola virus
auuaaucauucuaaaacua

SEQ ID NO: 4087420 - RNA, 16 nt, Variola virus
auuaaucguuuuugaa

SEQ ID NO: 4087421 - RNA, 14 nt, Variola virus
auuaaucuuuacca

SEQ ID NO: 4087422 - RNA, 13 nt, Variola virus
auuaaugagauug

SEQ ID NO: 4087423 - RNA, 12 nt, Variola virus
auuaauuacaau

SEQ ID NO: 4087424 - RNA, 14 nt, Variola virus
auuaauuauacuau

SEQ ID NO: 4087425 - RNA, 23 nt, Variola virus
auuaauuucuaaaggagcaaaug

SEQ ID NO: 4087426 - RNA, 14 nt, Variola virus
auuacaaaaucacc

SEQ ID NO: 4087427 - RNA, 19 nt, Variola virus
auuacaaacuauagaaauu

SEQ ID NO: 4087428 - RNA, 23 nt, Variola virus
auuacaaaucuagagguagaacu

SEQ ID NO: 4087429 - RNA, 14 nt, Variola virus
auuacaacauaaua

SEQ ID NO: 4087430 - RNA, 21 nt, Variola virus
auuacaacauggccaaaauuu

SEQ ID NO: 4087431 - RNA, 19 nt, Variola virus
auuacaagaaauauggauc

SEQ ID NO: 4087432 - RNA, 15 nt, Variola virus
auuacaagucaaaga

SEQ ID NO: 4087433 - RNA, 20 nt, Variola virus
auuacauucucauuaauuaa

SEQ ID NO: 4087434 - RNA, 17 nt, Variola virus
auuaccugugguuaaaa

SEQ ID NO: 4087435 - RNA, 18 nt, Variola virus
auuacgcaucuguaaaag

SEQ ID NO: 4087436 - RNA, 14 nt, Variola virus
auuacgugauguga

SEQ ID NO: 4087437 - RNA, 16 nt, Variola virus
auuacguucuaccaau

SEQ ID NO: 4087438 - RNA, 19 nt, Variola virus
auuacuaaaucuguauauc

SEQ ID NO: 4087439 - RNA, 20 nt, Variola virus
auuacuuuacauauaauauc

SEQ ID NO: 4087440 - RNA, 12 nt, Variola virus
auuagaauguau

SEQ ID NO: 4087441 - RNA, 15 nt, Variola virus
auuagcauccuuaua

SEQ ID NO: 4087442 - RNA, 14 nt, Variola virus
auuagguacagaaa

SEQ ID NO: 4087443 - RNA, 16 nt, Variola virus
auuagguuaaaugauu

SEQ ID NO: 4087444 - RNA, 15 nt, Variola virus
auuaguaaaaaauuu

SEQ ID NO: 4087445 - RNA, 20 nt, Variola virus
auuaguaaggcuuuagaaac

SEQ ID NO: 4087446 - RNA, 18 nt, Variola virus
auuaguuuauauuacuga

SEQ ID NO: 4087447 - RNA, 22 nt, Variola virus
auuauacacauuauaauaggug

SEQ ID NO: 4087448 - RNA, 12 nt, Variola virus
auuauacaugau

SEQ ID NO: 4087449 - RNA, 22 nt, Variola virus
auuauacuguaacacaaugaag

SEQ ID NO: 4087450 - RNA, 13 nt, Variola virus
auuauacuuguau

SEQ ID NO: 4087451 - RNA, 19 nt, Variola virus
auuauagcaauauguguaa

SEQ ID NO: 4087452 - RNA, 19 nt, Variola virus
auuauagcuucuggauaua

SEQ ID NO: 4087453 - RNA, 14 nt, Variola virus
auuauauaauguau

SEQ ID NO: 4087454 - RNA, 19 nt, Variola virus
auuauauaauguauaaaug

SEQ ID NO: 4087455 - RNA, 16 nt, Variola virus
auuaucaaauguuguu

SEQ ID NO: 4087456 - RNA, 23 nt, Variola virus
auuaucaggaacauuaucaauuu

SEQ ID NO: 4087457 - RNA, 12 nt, Variola virus
auuaucaucaaa

SEQ ID NO: 4087458 - RNA, 12 nt, Variola virus
auuauccuaauc

SEQ ID NO: 4087459 - RNA, 15 nt, Variola virus
auuaucgacauaggu

SEQ ID NO: 4087460 - RNA, 20 nt, Variola virus
auuaucgaggauauuucaaa

SEQ ID NO: 4087461 - RNA, 19 nt, Variola virus
auuaucgcuaauugacaca

SEQ ID NO: 4087462 - RNA, 19 nt, Variola virus
auuaucuagucacugacug

SEQ ID NO: 4087463 - RNA, 13 nt, Variola virus
auuaucugaaaug

SEQ ID NO: 4087464 - RNA, 16 nt, Variola virus
auuaucuugucuuggu

SEQ ID NO: 4087465 - RNA, 20 nt, Variola virus
auuaugaaaaaaagauguau

SEQ ID NO: 4087466 - RNA, 17 nt, Variola virus
auuauuaaacaauacuc

SEQ ID NO: 4087467 - RNA, 18 nt, Variola virus
auuauuagauuuaauagc

SEQ ID NO: 4087468 - RNA, 18 nt, Variola virus
auuauuaucuuuagaaau

SEQ ID NO: 4087469 - RNA, 14 nt, Variola virus
auuauucuauccaa

SEQ ID NO: 4087470 - RNA, 21 nt, Variola virus
auuauucuccaccacauagac

SEQ ID NO: 4087471 - RNA, 14 nt, Variola virus
auuauucuuuggau

SEQ ID NO: 4087472 - RNA, 15 nt, Variola virus
auuauuugacuuugu

SEQ ID NO: 4087473 - RNA, 13 nt, Variola virus
auucaaaaaagaa

SEQ ID NO: 4087474 - RNA, 20 nt, Variola virus
auucaaaaaggaauuuacca

SEQ ID NO: 4087475 - RNA, 16 nt, Variola virus
auucacaaauaugacg

SEQ ID NO: 4087476 - RNA, 19 nt, Variola virus
auucacagacucucaagau

SEQ ID NO: 4087477 - RNA, 15 nt, Variola virus
auucacgcuuccaaa

SEQ ID NO: 4087478 - RNA, 13 nt, Variola virus
auucagaaaugga

SEQ ID NO: 4087479 - RNA, 19 nt, Variola virus
auucagaguccucuaauug

SEQ ID NO: 4087480 - RNA, 23 nt, Variola virus
auucagauaaucagccauaauua

SEQ ID NO: 4087481 - RNA, 16 nt, Variola virus
auucauaaaacauaau

SEQ ID NO: 4087482 - RNA, 18 nt, Variola virus
auucauaacgucauugau

SEQ ID NO: 4087483 - RNA, 15 nt, Variola virus
auucauaagaaucua

SEQ ID NO: 4087484 - RNA, 18 nt, Variola virus
auucauaguaguugugac

SEQ ID NO: 4087485 - RNA, 15 nt, Variola virus
auucaugaaaaugua

SEQ ID NO: 4087486 - RNA, 18 nt, Variola virus
auucauggaguuagaaaa

SEQ ID NO: 4087487 - RNA, 18 nt, Variola virus
auucauuaauuuucaguc

SEQ ID NO: 4087488 - RNA, 22 nt, Variola virus
auucauuacucuugauaaauug

SEQ ID NO: 4087489 - RNA, 22 nt, Variola virus
auuccaaauuuguggcaaugaa

SEQ ID NO: 4087490 - RNA, 17 nt, Variola virus
auuccaauuauuugaac

SEQ ID NO: 4087491 - RNA, 22 nt, Variola virus
auuccaguuuuaaacaaaauac

SEQ ID NO: 4087492 - RNA, 13 nt, Variola virus
auucccaaaauuu

SEQ ID NO: 4087493 - RNA, 22 nt, Variola virus
auuccuagagguacaacucauu

SEQ ID NO: 4087494 - RNA, 21 nt, Variola virus
auuccuucucguaggcacaca

SEQ ID NO: 4087495 - RNA, 17 nt, Variola virus
auucgaaaacucuaaga

SEQ ID NO: 4087496 - RNA, 16 nt, Variola virus
auucgaaauuagaaag

SEQ ID NO: 4087497 - RNA, 15 nt, Variola virus
auucgauacaaacuc

SEQ ID NO: 4087498 - RNA, 15 nt, Variola virus
auucgcauuucuaua

SEQ ID NO: 4087499 - RNA, 14 nt, Variola virus
auucguagaaagua

SEQ ID NO: 4087500 - RNA, 23 nt, Variola virus
auucgugacagauccaugucuga

SEQ ID NO: 4087501 - RNA, 19 nt, Variola virus
auucuaaaacuauaaaaca

SEQ ID NO: 4087502 - RNA, 18 nt, Variola virus
auucuaacgauaauagau

SEQ ID NO: 4087503 - RNA, 12 nt, Variola virus
auucuaaugaug

SEQ ID NO: 4087504 - RNA, 23 nt, Variola virus
auucuacaaguaacaacaaaaaa

SEQ ID NO: 4087505 - RNA, 19 nt, Variola virus
auucuagacuccgcaucaa

SEQ ID NO: 4087506 - RNA, 14 nt, Variola virus
auucuagucuuaac

SEQ ID NO: 4087507 - RNA, 22 nt, Variola virus
auucuagugccgaacauuaaca

SEQ ID NO: 4087508 - RNA, 14 nt, Variola virus
auucuaucucuaag

SEQ ID NO: 4087509 - RNA, 15 nt, Variola virus
auucuaucucuaaga

SEQ ID NO: 4087510 - RNA, 13 nt, Variola virus
auucuaugauggu

SEQ ID NO: 4087511 - RNA, 16 nt, Variola virus
auucuaugucuauuau

SEQ ID NO: 4087512 - RNA, 19 nt, Variola virus
auucucaaauccgaaauua

SEQ ID NO: 4087513 - RNA, 22 nt, Variola virus
auucucaucuaucaucuccaca

SEQ ID NO: 4087514 - RNA, 19 nt, Variola virus
auucucugaaaauguaaau

SEQ ID NO: 4087515 - RNA, 20 nt, Variola virus
auucucugacauucagaaag

SEQ ID NO: 4087516 - RNA, 23 nt, Variola virus
auucucuuacaaauauucacaag

SEQ ID NO: 4087517 - RNA, 19 nt, Variola virus
auucugaugauauuagaac

SEQ ID NO: 4087518 - RNA, 18 nt, Variola virus
auucugauuggucaaugu

SEQ ID NO: 4087519 - RNA, 23 nt, Variola virus
auucugauuggucaaugugaaug

SEQ ID NO: 4087520 - RNA, 15 nt, Variola virus
auucuucgguaacuu

SEQ ID NO: 4087521 - RNA, 21 nt, Variola virus
auucuugcacacuauugacga

SEQ ID NO: 4087522 - RNA, 16 nt, Variola virus
auucuugguaauuaau

SEQ ID NO: 4087523 - RNA, 13 nt, Variola virus
auucuugguuaaa

SEQ ID NO: 4087524 - RNA, 19 nt, Variola virus
auucuuuguauuuuggcau

SEQ ID NO: 4087525 - RNA, 18 nt, Variola virus
auucuuuuucauuaacua

SEQ ID NO: 4087526 - RNA, 14 nt, Variola virus
auugaaaauacuaa

SEQ ID NO: 4087527 - RNA, 14 nt, Variola virus
auugaaaauuauuu

SEQ ID NO: 4087528 - RNA, 18 nt, Variola virus
auugacauaguuaaauaa

SEQ ID NO: 4087529 - RNA, 15 nt, Variola virus
auugacgaugucaau

SEQ ID NO: 4087530 - RNA, 15 nt, Variola virus
auugaguggaaaguu

SEQ ID NO: 4087531 - RNA, 13 nt, Variola virus
auugauagauuac

SEQ ID NO: 4087532 - RNA, 19 nt, Variola virus
auugauccuagaacuagau

SEQ ID NO: 4087533 - RNA, 20 nt, Variola virus
auugaucuauuauuuaauga

SEQ ID NO: 4087534 - RNA, 17 nt, Variola virus
auugaugcgaauagcag

SEQ ID NO: 4087535 - RNA, 16 nt, Variola virus
auugccaacucucaaa

SEQ ID NO: 4087536 - RNA, 14 nt, Variola virus
auugccuuuaagac

SEQ ID NO: 4087537 - RNA, 14 nt, Variola virus
auugcgacacuauu

SEQ ID NO: 4087538 - RNA, 15 nt, Variola virus
auugcucaaauaaua

SEQ ID NO: 4087539 - RNA, 18 nt, Variola virus
auuggaaaucauuaacgg

SEQ ID NO: 4087540 - RNA, 15 nt, Variola virus
auuggaacauaagau

SEQ ID NO: 4087541 - RNA, 13 nt, Variola virus
auuggaauuauuu

SEQ ID NO: 4087542 - RNA, 15 nt, Variola virus
auuggcaaauuauuu

SEQ ID NO: 4087543 - RNA, 16 nt, Variola virus
auugggagucaaugaa

SEQ ID NO: 4087544 - RNA, 14 nt, Variola virus
auugguaaauccua

SEQ ID NO: 4087545 - RNA, 14 nt, Variola virus
auugguauaaaugu

SEQ ID NO: 4087546 - RNA, 19 nt, Variola virus
auugguuacucuugucauu

SEQ ID NO: 4087547 - RNA, 19 nt, Variola virus
auugguuuauaauguauaa

SEQ ID NO: 4087548 - RNA, 15 nt, Variola virus
auuguaaacacagau

SEQ ID NO: 4087549 - RNA, 15 nt, Variola virus
auuguauuaugauga

SEQ ID NO: 4087550 - RNA, 22 nt, Variola virus
auugucagaaauuacaaacacu

SEQ ID NO: 4087551 - RNA, 21 nt, Variola virus
auugucucgucaaugucuaua

SEQ ID NO: 4087552 - RNA, 19 nt, Variola virus
auugucuuuacaaaucaua

SEQ ID NO: 4087553 - RNA, 20 nt, Variola virus
auugugauuuaguauaguau

SEQ ID NO: 4087554 - RNA, 18 nt, Variola virus
auuguuuugaagaaauga

SEQ ID NO: 4087555 - RNA, 16 nt, Variola virus
auuuaaauuuaucauc

SEQ ID NO: 4087556 - RNA, 16 nt, Variola virus
auuuaacgaugucuau

SEQ ID NO: 4087557 - RNA, 22 nt, Variola virus
auuuaagagaucaaagcaucaa

SEQ ID NO: 4087558 - RNA, 17 nt, Variola virus
auuuaauacguucauua

SEQ ID NO: 4087559 - RNA, 21 nt, Variola virus
auuuaauacguucauuaaaaa

SEQ ID NO: 4087560 - RNA, 13 nt, Variola virus
auuuaauauagau

SEQ ID NO: 4087561 - RNA, 14 nt, Variola virus
auuuacaaaaauuu

SEQ ID NO: 4087562 - RNA, 21 nt, Variola virus
auuuacgaaacuaucaaaaug

SEQ ID NO: 4087563 - RNA, 17 nt, Variola virus
auuuacuaucuguaaug

SEQ ID NO: 4087564 - RNA, 21 nt, Variola virus
auuuacucugaaaagaaagua

SEQ ID NO: 4087565 - RNA, 15 nt, Variola virus
auuuagaaaaaagau

SEQ ID NO: 4087566 - RNA, 14 nt, Variola virus
auuuagaaaugaag

SEQ ID NO: 4087567 - RNA, 20 nt, Variola virus
auuuagcgauuaugaaaauu

SEQ ID NO: 4087568 - RNA, 15 nt, Variola virus
auuuaguauuaaaug

SEQ ID NO: 4087569 - RNA, 15 nt, Variola virus
auuuauaaaaugcuu

SEQ ID NO: 4087570 - RNA, 15 nt, Variola virus
auuuauauaacucau

SEQ ID NO: 4087571 - RNA, 16 nt, Variola virus
auuuauauauuaaaaa

SEQ ID NO: 4087572 - RNA, 12 nt, Variola virus
auuuaucuuucu

SEQ ID NO: 4087573 - RNA, 21 nt, Variola virus
auuuauugcacgguaaggaag

SEQ ID NO: 4087574 - RNA, 16 nt, Variola virus
auuuauuuaaaaugau

SEQ ID NO: 4087575 - RNA, 19 nt, Variola virus
auuuauuuaguauuaaaug

SEQ ID NO: 4087576 - RNA, 14 nt, Variola virus
auuucaaaauguua

SEQ ID NO: 4087577 - RNA, 15 nt, Variola virus
auuucaucuacaaug

SEQ ID NO: 4087578 - RNA, 14 nt, Variola virus
auuucauuaauagu

SEQ ID NO: 4087579 - RNA, 21 nt, Variola virus
auuucauuauaauaguuuauc

SEQ ID NO: 4087580 - RNA, 23 nt, Variola virus
auuuccaucaggaauguuugcug

SEQ ID NO: 4087581 - RNA, 17 nt, Variola virus
auuuccaucuaucuagu

SEQ ID NO: 4087582 - RNA, 15 nt, Variola virus
auuucguuagucaua

SEQ ID NO: 4087583 - RNA, 17 nt, Variola virus
auuucguucucugaaaa

SEQ ID NO: 4087584 - RNA, 14 nt, Variola virus
auuucuaauguuuc

SEQ ID NO: 4087585 - RNA, 18 nt, Variola virus
auuucucucauaaauaca

SEQ ID NO: 4087586 - RNA, 19 nt, Variola virus
auuucucucauaaauacag

SEQ ID NO: 4087587 - RNA, 22 nt, Variola virus
auuucugaacccguuaauguau

SEQ ID NO: 4087588 - RNA, 18 nt, Variola virus
auuucuucucuucguaua

SEQ ID NO: 4087589 - RNA, 18 nt, Variola virus
auuugaaauucuaucucu

SEQ ID NO: 4087590 - RNA, 15 nt, Variola virus
auuugagaaaacauu

SEQ ID NO: 4087591 - RNA, 13 nt, Variola virus
auuuggaaaagaa

SEQ ID NO: 4087592 - RNA, 11 nt, Variola virus
auuuggagaac

SEQ ID NO: 4087593 - RNA, 16 nt, Variola virus
auuuggauuaauuaga

SEQ ID NO: 4087594 - RNA, 15 nt, Variola virus
auuugguaaaaugaa

SEQ ID NO: 4087595 - RNA, 21 nt, Variola virus
auuugguauaaagagauagau

SEQ ID NO: 4087596 - RNA, 16 nt, Variola virus
auuuggucauaauaga

SEQ ID NO: 4087597 - RNA, 13 nt, Variola virus
auuuguacauuau

SEQ ID NO: 4087598 - RNA, 21 nt, Variola virus
auuuguauaaucuuuaacaaa

SEQ ID NO: 4087599 - RNA, 13 nt, Variola virus
auuuguucuugua

SEQ ID NO: 4087600 - RNA, 18 nt, Variola virus
auuuuaacacuaauuaag

SEQ ID NO: 4087601 - RNA, 21 nt, Variola virus
auuuuacuacauaguuaucua

SEQ ID NO: 4087602 - RNA, 23 nt, Variola virus
auuuuagaagaacgauaaugaau

SEQ ID NO: 4087603 - RNA, 18 nt, Variola virus
auuuuagcagugaaauaa

SEQ ID NO: 4087604 - RNA, 19 nt, Variola virus
auuuuaguuaacaacuauu

SEQ ID NO: 4087605 - RNA, 22 nt, Variola virus
auuuuauaacguuaguuaauaa

SEQ ID NO: 4087606 - RNA, 15 nt, Variola virus
auuuuauacuagagu

SEQ ID NO: 4087607 - RNA, 16 nt, Variola virus
aauauuuacuaauauc

SEQ ID NO: 4087608 - RNA, 17 nt, Variola virus
aauauuucauuagaugu

SEQ ID NO: 4087609 - RNA, 17 nt, Variola virus
aauauuuuaauagauua

SEQ ID NO: 4087610 - RNA, 20 nt, Variola virus
aauauuuuucguuuacaaaa

SEQ ID NO: 4087611 - RNA, 16 nt, Variola virus
aauauuuuuuagagaa

SEQ ID NO: 4087612 - RNA, 13 nt, Variola virus
aaucaaaaaauaa

SEQ ID NO: 4087613 - RNA, 19 nt, Variola virus
aaucaaaagaaugauucca

SEQ ID NO: 4087614 - RNA, 14 nt, Variola virus
aaucaaacaaaaaa

SEQ ID NO: 4087615 - RNA, 17 nt, Variola virus
aaucaaaccuuacugaa

SEQ ID NO: 4087616 - RNA, 16 nt, Variola virus
aaucaagauucauuuu

SEQ ID NO: 4087617 - RNA, 19 nt, Variola virus
aaucaaggaacuaaauaga

SEQ ID NO: 4087618 - RNA, 20 nt, Variola virus
aaucaccgucuaagaugaua

SEQ ID NO: 4087619 - RNA, 18 nt, Variola virus
aaucagugauagacuaga

SEQ ID NO: 4087620 - RNA, 19 nt, Variola virus
aaucauucuaaaacuauaa

SEQ ID NO: 4087621 - RNA, 19 nt, Variola virus
aaucauuuuuuuaaaacug

SEQ ID NO: 4087622 - RNA, 18 nt, Variola virus
aauccaaaaaaugaaauc

SEQ ID NO: 4087623 - RNA, 15 nt, Variola virus
aauccagauaauaac

SEQ ID NO: 4087624 - RNA, 18 nt, Variola virus
aauccagauuuuaaaacu

SEQ ID NO: 4087625 - RNA, 19 nt, Variola virus
aauccagcuagugaauaua

SEQ ID NO: 4087626 - RNA, 15 nt, Variola virus
aauccauucuaauga

SEQ ID NO: 4087627 - RNA, 18 nt, Variola virus
aauccuuaaguucauaau

SEQ ID NO: 4087628 - RNA, 18 nt, Variola virus
aaucgcauccgauaaagc

SEQ ID NO: 4087629 - RNA, 14 nt, Variola virus
aaucuaagaaauuu

SEQ ID NO: 4087630 - RNA, 16 nt, Variola virus
aaucuaauauuaagaa

SEQ ID NO: 4087631 - RNA, 16 nt, Variola virus
aaucuacugauauugu

SEQ ID NO: 4087632 - RNA, 19 nt, Variola virus
aaucuaguacucgaaauaa

SEQ ID NO: 4087633 - RNA, 16 nt, Variola virus
aaucuauaguauuauc

SEQ ID NO: 4087634 - RNA, 16 nt, Variola virus
aaucucuaucgucaca

SEQ ID NO: 4087635 - RNA, 16 nt, Variola virus
aaucucucucaaauau

SEQ ID NO: 4087636 - RNA, 14 nt, Variola virus
aaucugaaaaugua

SEQ ID NO: 4087637 - RNA, 14 nt, Variola virus
aaucugaacuuuaa

SEQ ID NO: 4087638 - RNA, 16 nt, Variola virus
aaucuguacuucuaua

SEQ ID NO: 4087639 - RNA, 18 nt, Variola virus
aaucuguauaucuuucca

SEQ ID NO: 4087640 - RNA, 14 nt, Variola virus
aaucuguuucuaaa

SEQ ID NO: 4087641 - RNA, 18 nt, Variola virus
aaucuuacugaguuuauc

SEQ ID NO: 4087642 - RNA, 15 nt, Variola virus
aaucuuauuagaaua

SEQ ID NO: 4087643 - RNA, 15 nt, Variola virus
aaucuucuuauaaga

SEQ ID NO: 4087644 - RNA, 16 nt, Variola virus
aaucuugauuacaaaa

SEQ ID NO: 4087645 - RNA, 14 nt, Variola virus
aaugaaaauggaua

SEQ ID NO: 4087646 - RNA, 17 nt, Variola virus
aaugaaacagaauuaac

SEQ ID NO: 4087647 - RNA, 19 nt, Variola virus
aaugaacauaguaagaaau

SEQ ID NO: 4087648 - RNA, 19 nt, Variola virus
aaugaacaucggaaauaua

SEQ ID NO: 4087649 - RNA, 23 nt, Variola virus
aaugaacaucggaaauauagaau

SEQ ID NO: 4087650 - RNA, 15 nt, Variola virus
aaugaauuuagaaau

SEQ ID NO: 4087651 - RNA, 19 nt, Variola virus
aaugacaaguauaaugaua

SEQ ID NO: 4087652 - RNA, 18 nt, Variola virus
aaugacaucgcauuuaua

SEQ ID NO: 4087653 - RNA, 15 nt, Variola virus
aaugacgaugauaug

SEQ ID NO: 4087654 - RNA, 22 nt, Variola virus
aaugagauuauuaaguauuuau

SEQ ID NO: 4087655 - RNA, 20 nt, Variola virus
aaugauaacuguuuagaaau

SEQ ID NO: 4087656 - RNA, 21 nt, Variola virus
aaugauacacuaaguauauac

SEQ ID NO: 4087657 - RNA, 15 nt, Variola virus
aaugauauaucuugu

SEQ ID NO: 4087658 - RNA, 14 nt, Variola virus
aaugauauauuaaa

SEQ ID NO: 4087659 - RNA, 18 nt, Variola virus
aaugaugaugaaaugaua

SEQ ID NO: 4087660 - RNA, 23 nt, Variola virus
aaugaugccucugccuuuuuaua

SEQ ID NO: 4087661 - RNA, 16 nt, Variola virus
aaugauguuaggaaau

SEQ ID NO: 4087662 - RNA, 23 nt, Variola virus
aaugauuacuaacgcaacuauau

SEQ ID NO: 4087663 - RNA, 22 nt, Variola virus
aaugcagaucuaauaaauggag

SEQ ID NO: 4087664 - RNA, 15 nt, Variola virus
aaugcauuaaauaau

SEQ ID NO: 4087665 - RNA, 18 nt, Variola virus
aaugcauuuuauaccgaa

SEQ ID NO: 4087666 - RNA, 21 nt, Variola virus
aaugccacgguugacaauaac

SEQ ID NO: 4087667 - RNA, 19 nt, Variola virus
aaugccugccuguauuaua

SEQ ID NO: 4087668 - RNA, 16 nt, Variola virus
aaugccuuauucucug

SEQ ID NO: 4087669 - RNA, 17 nt, Variola virus
agauuuaucauauuucu

SEQ ID NO: 4087670 - RNA, 15 nt, Variola virus
agauuucaaagaugu

SEQ ID NO: 4087671 - RNA, 17 nt, Variola virus
agauuucaaagauguuu

SEQ ID NO: 4087672 - RNA, 15 nt, Variola virus
agauuucgucuaaua

SEQ ID NO: 4087673 - RNA, 19 nt, Variola virus
agauuuuuagcguauuauc

SEQ ID NO: 4087674 - RNA, 16 nt, Variola virus
agauuuuuuaaaggau

SEQ ID NO: 4087675 - RNA, 12 nt, Variola virus
agcaaaaaauga

SEQ ID NO: 4087676 - RNA, 18 nt, Variola virus
agcaagauuuuuaaacaa

SEQ ID NO: 4087677 - RNA, 15 nt, Variola virus
agcaauacaacagaa

SEQ ID NO: 4087678 - RNA, 17 nt, Variola virus
agcacaugaagaaaaac

SEQ ID NO: 4087679 - RNA, 18 nt, Variola virus
agcacauggaaaaaaagu

SEQ ID NO: 4087680 - RNA, 15 nt, Variola virus
agcacgauaacuuau

SEQ ID NO: 4087681 - RNA, 22 nt, Variola virus
agcaguugcgaacaacaacaaa

SEQ ID NO: 4087682 - RNA, 19 nt, Variola virus
agcauaaacauaauaaaca

SEQ ID NO: 4087683 - RNA, 17 nt, Variola virus
agcauagaggaugaauu

SEQ ID NO: 4087684 - RNA, 21 nt, Variola virus
agcauauuccauauaaauaua

SEQ ID NO: 4087685 - RNA, 19 nt, Variola virus
agcauauuguaauaucuua

SEQ ID NO: 4087686 - RNA, 18 nt, Variola virus
agcaucaugaauacagua

SEQ ID NO: 4087687 - RNA, 22 nt, Variola virus
agcaucauguccauuuaacuaa

SEQ ID NO: 4087688 - RNA, 16 nt, Variola virus
agcauccaguaugaau

SEQ ID NO: 4087689 - RNA, 18 nt, Variola virus
agcauccucaaaaaauau

SEQ ID NO: 4087690 - RNA, 19 nt, Variola virus
agcaucuucuauaucuaga

SEQ ID NO: 4087691 - RNA, 17 nt, Variola virus
agcauuaauaauuguuu

SEQ ID NO: 4087692 - RNA, 23 nt, Variola virus
agcauuaauaauuguuuugaauu

SEQ ID NO: 4087693 - RNA, 14 nt, Variola virus
agcauuacuugaua

SEQ ID NO: 4087694 - RNA, 22 nt, Variola virus
agcauucuuuccagaacuauau

SEQ ID NO: 4087695 - RNA, 16 nt, Variola virus
agcauuguuauguauu

SEQ ID NO: 4087696 - RNA, 12 nt, Variola virus
agccaauacuuu

SEQ ID NO: 4087697 - RNA, 16 nt, Variola virus
agccaauccuaacucu

SEQ ID NO: 4087698 - RNA, 18 nt, Variola virus
agccauauuccacagaua

SEQ ID NO: 4087699 - RNA, 19 nt, Variola virus
agcgaaaaauaauuauucu

SEQ ID NO: 4087700 - RNA, 22 nt, Variola virus
agcgacuaucaucuaaacagua

SEQ ID NO: 4087701 - RNA, 23 nt, Variola virus
agcgcauguacauauuuguacau

SEQ ID NO: 4087702 - RNA, 13 nt, Variola virus
agcggaugaaaaa

SEQ ID NO: 4087703 - RNA, 19 nt, Variola virus
agcuagaggaaaugaaaga

SEQ ID NO: 4087704 - RNA, 15 nt, Variola virus
agcuaggcuggaaac

SEQ ID NO: 4087705 - RNA, 13 nt, Variola virus
agcuauuuaaaug

SEQ ID NO: 4087706 - RNA, 14 nt, Variola virus
agcuauuuaaaugg

SEQ ID NO: 4087707 - RNA, 16 nt, Variola virus
agcucgcguuuaagag

SEQ ID NO: 4087708 - RNA, 16 nt, Variola virus
agcucuuaguauggga

SEQ ID NO: 4087709 - RNA, 12 nt, Variola virus
agcugaaaugag

SEQ ID NO: 4087710 - RNA, 15 nt, Variola virus
agcugcaucuaaauu

SEQ ID NO: 4087711 - RNA, 18 nt, Variola virus
agcugugguguaaucuua

SEQ ID NO: 4087712 - RNA, 22 nt, Variola virus
agcuguuuaucuauacuauuaa

SEQ ID NO: 4087713 - RNA, 19 nt, Variola virus
agcuucuccuccuauuugu

SEQ ID NO: 4087714 - RNA, 18 nt, Variola virus
aggaaaaugauuaaauua

SEQ ID NO: 4087715 - RNA, 20 nt, Variola virus
aggaaaguuuaucaaaaaua

SEQ ID NO: 4087716 - RNA, 23 nt, Variola virus
aggaaauuaauaucgaugauauu

SEQ ID NO: 4087717 - RNA, 15 nt, Variola virus
aggaaauuaugagaa

SEQ ID NO: 4087718 - RNA, 14 nt, Variola virus
aggaagaauaucau

SEQ ID NO: 4087719 - RNA, 24 nt, Variola virus
aggaagaggaaauauucaguauau

SEQ ID NO: 4087720 - RNA, 15 nt, Variola virus
aggaauuaauuauuc

SEQ ID NO: 4087721 - RNA, 18 nt, Variola virus
aggaauucuuuuaugaau

SEQ ID NO: 4087722 - RNA, 13 nt, Variola virus
aggacaugaugau

SEQ ID NO: 4087723 - RNA, 22 nt, Variola virus
aggaccacuagcaaaagauaaa

SEQ ID NO: 4087724 - RNA, 21 nt, Variola virus
aggaccuuccaacuguggaua

SEQ ID NO: 4087725 - RNA, 15 nt, Variola virus
aggacgguauaugua

SEQ ID NO: 4087726 - RNA, 13 nt, Variola virus
aggagaccaugga

SEQ ID NO: 4087727 - RNA, 14 nt, Variola virus
aggagauuaaagga

SEQ ID NO: 4087728 - RNA, 17 nt, Variola virus
aggagcaccagaaguau

SEQ ID NO: 4087729 - RNA, 19 nt, Variola virus
aggauaaaauauuauccaa

SEQ ID NO: 4087730 - RNA, 16 nt, Variola virus
aggauacuuuaugaau

SEQ ID NO: 4087731 - RNA, 17 nt, Variola virus
aggauacuuuaugaaug

SEQ ID NO: 4087732 - RNA, 20 nt, Variola virus
aggauacuuuaugaauggau

SEQ ID NO: 4087733 - RNA, 19 nt, Variola virus
aggauauaaguagauguuc

SEQ ID NO: 4087734 - RNA, 17 nt, Variola virus
aggauauauuaaagucu

SEQ ID NO: 4087735 - RNA, 18 nt, Variola virus
aggauaucaaauacgcau

SEQ ID NO: 4087736 - RNA, 21 nt, Variola virus
aggauauuucaaaaaauaaua

SEQ ID NO: 4087737 - RNA, 18 nt, Variola virus
aggaucuagcaaaggaaa

SEQ ID NO: 4087738 - RNA, 22 nt, Variola virus
aggauguauauaucaugaugau

SEQ ID NO: 4087739 - RNA, 23 nt, Variola virus
aggauugauuacuauaaauggag

SEQ ID NO: 4087740 - RNA, 18 nt, Variola virus
aggauuggucuuaaaaga

SEQ ID NO: 4087741 - RNA, 17 nt, Variola virus
aggcaaaagaugucaag

SEQ ID NO: 4087742 - RNA, 18 nt, Variola virus
aggcacuaaugcaaauua

SEQ ID NO: 4087743 - RNA, 16 nt, Variola virus
aggcaguuaaggauaa

SEQ ID NO: 4087744 - RNA, 14 nt, Variola virus
aggcgucaaagaua

SEQ ID NO: 4087745 - RNA, 14 nt, Variola virus
aggcguuaacuaga

SEQ ID NO: 4087746 - RNA, 19 nt, Variola virus
agggaaaucaaagaagaag

SEQ ID NO: 4087747 - RNA, 23 nt, Variola virus
agggaaaucaaagaagaaguuaa

SEQ ID NO: 4087748 - RNA, 22 nt, Variola virus
agggaacuaauccacauaugau

SEQ ID NO: 4087749 - RNA, 22 nt, Variola virus
agggacacucaaacuaaauguc

SEQ ID NO: 4087750 - RNA, 16 nt, Variola virus
agggcuaaaugucuag

SEQ ID NO: 4087751 - RNA, 16 nt, Variola virus
aggggaugaaucauug

SEQ ID NO: 4087752 - RNA, 18 nt, Variola virus
aggguaucuaauuuccug

SEQ ID NO: 4087753 - RNA, 19 nt, Variola virus
agguacucaucuacucuac

SEQ ID NO: 4087754 - RNA, 12 nt, Variola virus
agguauaugcau

SEQ ID NO: 4087755 - RNA, 14 nt, Variola virus
agguauuacucuag

SEQ ID NO: 4087756 - RNA, 19 nt, Variola virus
aggucauauggaagauguu

SEQ ID NO: 4087757 - RNA, 15 nt, Variola virus
aggugacacauguac

SEQ ID NO: 4087758 - RNA, 19 nt, Variola virus
agguguguuuuuuaccauu

SEQ ID NO: 4087759 - RNA, 22 nt, Variola virus
agguguuauuuuguuuuauuca

SEQ ID NO: 4087760 - RNA, 23 nt, Variola virus
agguguuccggagaaucaguaaa

SEQ ID NO: 4087761 - RNA, 16 nt, Variola virus
agguucccaauuccaa

SEQ ID NO: 4087762 - RNA, 14 nt, Variola virus
aguaaaaucuauca

SEQ ID NO: 4087763 - RNA, 15 nt, Variola virus
aguaaccaaaaugaa

SEQ ID NO: 4087764 - RNA, 15 nt, Variola virus
aguaacgcaauacaa

SEQ ID NO: 4087765 - RNA, 19 nt, Variola virus
aguaacgcguggaaaaagc

SEQ ID NO: 4087766 - RNA, 16 nt, Variola virus
aguaacuauguaaaug

SEQ ID NO: 4087767 - RNA, 17 nt, Variola virus
aguaacuuuuuuucuau

SEQ ID NO: 4087768 - RNA, 14 nt, Variola virus
aguaagaauaagac

SEQ ID NO: 4087769 - RNA, 18 nt, Variola virus
aguaaguaucuuauguau

SEQ ID NO: 4087770 - RNA, 20 nt, Variola virus
aguaauaagaaauaugaaau

SEQ ID NO: 4087771 - RNA, 13 nt, Variola virus
aguaaucauguaa

SEQ ID NO: 4087772 - RNA, 23 nt, Variola virus
uuuucgguacucagauucaguuu

SEQ ID NO: 4087773 - RNA, 12 nt, Variola virus
uuuucuuaaaac

SEQ ID NO: 4087774 - RNA, 21 nt, Variola virus
uuuugaaggauuggacaaauc

SEQ ID NO: 4087775 - RNA, 23 nt, Variola virus
uuuugauacuauccaauaaacag

SEQ ID NO: 4087776 - RNA, 17 nt, Variola virus
uuuugccaacacagagg

SEQ ID NO: 4087777 - RNA, 16 nt, Variola virus
uuuuggugaaauccaa

SEQ ID NO: 4087778 - RNA, 12 nt, Variola virus
uuuuguaauaag

SEQ ID NO: 4087779 - RNA, 16 nt, Variola virus
uuuuguauuguauaua

SEQ ID NO: 4087780 - RNA, 18 nt, Variola virus
uuuuguggacauuuucua

SEQ ID NO: 4087781 - RNA, 19 nt, Variola virus
uuuuuaaagguaucuaaug

SEQ ID NO: 4087782 - RNA, 21 nt, Variola virus
uuuuuauaaaaugacaucguu

SEQ ID NO: 4087783 - RNA, 13 nt, Variola virus
uuuuugacauauu

SEQ ID NO: 4087784 - RNA, 19 nt, Variola virus
uuuuugcaggaaguauauc

SEQ ID NO: 4087785 - RNA, 15 nt, Variola virus
uuuuuggauuucaua

SEQ ID NO: 4087786 - RNA, 21 nt, Variola virus
uugaugacacuaguuaagaac

SEQ ID NO: 4087787 - RNA, 13 nt, Variola virus
uugaugauagcaa

SEQ ID NO: 4087788 - RNA, 13 nt, Variola virus
uugaugcaucuua

SEQ ID NO: 4087789 - RNA, 20 nt, Variola virus
uugauggaaguaaaagauuu

SEQ ID NO: 4087790 - RNA, 17 nt, Variola virus
uugaugucguuauucug

SEQ ID NO: 4087791 - RNA, 16 nt, Variola virus
uugauguuacauuaua

SEQ ID NO: 4087792 - RNA, 22 nt, Variola virus
uugauuucgaauacgauacuua

SEQ ID NO: 4087793 - RNA, 16 nt, Variola virus
uugcaaaauaugcucu

SEQ ID NO: 4087794 - RNA, 22 nt, Variola virus
uugcaaauuccggauacaugaa

SEQ ID NO: 4087795 - RNA, 13 nt, Variola virus
uugccaaguuauc

SEQ ID NO: 4087796 - RNA, 13 nt, Variola virus
uugccguaaaucc

SEQ ID NO: 4087797 - RNA, 20 nt, Variola virus
uugccguugucuguauucau

SEQ ID NO: 4087798 - RNA, 12 nt, Variola virus
uugcguauacau

SEQ ID NO: 4087799 - RNA, 16 nt, Variola virus
uugcguuuacaacacu

SEQ ID NO: 4087800 - RNA, 17 nt, Variola virus
uugcuaucgucauuaau

SEQ ID NO: 4087801 - RNA, 22 nt, Variola virus
uugcuguugaagaggcaaaaga

SEQ ID NO: 4087802 - RNA, 14 nt, Variola virus
uugcuuuucuaauc

SEQ ID NO: 4087803 - RNA, 22 nt, Variola virus
uuggaaaaaugaugaauuaaug

SEQ ID NO: 4087804 - RNA, 22 nt, Variola virus
uuggaauaaucucaauuagaau

SEQ ID NO: 4087805 - RNA, 12 nt, Variola virus
uuggaauuauuu

SEQ ID NO: 4087806 - RNA, 22 nt, Variola virus
uuggacucuauguauucagaau

SEQ ID NO: 4087807 - RNA, 20 nt, Variola virus
uuggagacgucaucuguucu

SEQ ID NO: 4087808 - RNA, 14 nt, Variola virus
uuggcaaaaacgga

SEQ ID NO: 4087809 - RNA, 15 nt, Variola virus
uugguacauuuuuca

SEQ ID NO: 4087810 - RNA, 13 nt, Variola virus
uugguauuagaau

SEQ ID NO: 4087811 - RNA, 12 nt, Variola virus
uugguuguauug

SEQ ID NO: 4087812 - RNA, 18 nt, Variola virus
uuguaaaguuaaaauugu

SEQ ID NO: 4087813 - RNA, 18 nt, Variola virus
uuguaaauguaacguauu

SEQ ID NO: 4087814 - RNA, 19 nt, Variola virus
uuguaagguuguaaauuuu

SEQ ID NO: 4087815 - RNA, 18 nt, Variola virus
uuguacauucuuaaccau

SEQ ID NO: 4087816 - RNA, 16 nt, Variola virus
uuguacuaaacacacu

SEQ ID NO: 4087817 - RNA, 16 nt, Variola virus
uuguagauuuaucaua

SEQ ID NO: 4087818 - RNA, 21 nt, Variola virus
uuguauaauaaguauaguuuu

SEQ ID NO: 4087819 - RNA, 23 nt, Variola virus
uugucauugagugauaaacuugu

SEQ ID NO: 4087820 - RNA, 15 nt, Variola virus
uuguccggcauauca

SEQ ID NO: 4087821 - RNA, 22 nt, Variola virus
uugugaucggauaguauucaag

SEQ ID NO: 4087822 - RNA, 15 nt, Variola virus
uuguuauuaacguga

SEQ ID NO: 4087823 - RNA, 16 nt, Variola virus
uuuaaaaaguuaucuu

SEQ ID NO: 4087824 - RNA, 17 nt, Variola virus
uuuaaaguaaacuucgu

SEQ ID NO: 4087825 - RNA, 16 nt, Variola virus
uuuaaauuuuguauuu

SEQ ID NO: 4087826 - RNA, 21 nt, Variola virus
uuuaaauuuuucuacagauau

SEQ ID NO: 4087827 - RNA, 11 nt, Variola virus
uuuaacuuuuc

SEQ ID NO: 4087828 - RNA, 18 nt, Variola virus
uuuaagccaucuguauua

SEQ ID NO: 4087829 - RNA, 13 nt, Variola virus
uuuaaucuaucua

SEQ ID NO: 4087830 - RNA, 13 nt, Variola virus
uuuacccacuaua

SEQ ID NO: 4087831 - RNA, 17 nt, Variola virus
uuuacgguaucuaauau

SEQ ID NO: 4087832 - RNA, 17 nt, Variola virus
uuuacuaaagauacaaa

SEQ ID NO: 4087833 - RNA, 17 nt, Variola virus
uuuacuuuaucuauuca

SEQ ID NO: 4087834 - RNA, 14 nt, Variola virus
uuuagaaaaacuuu

SEQ ID NO: 4087835 - RNA, 19 nt, Variola virus
uuuagaaaaaugcuaauau

SEQ ID NO: 4087836 - RNA, 15 nt, Variola virus
uuuagaaacuucaaa

SEQ ID NO: 4087837 - RNA, 13 nt, Variola virus
uuuagaauacuaa

SEQ ID NO: 4087838 - RNA, 14 nt, Variola virus
uuuagaauuuccaa

SEQ ID NO: 4087839 - RNA, 20 nt, Variola virus
uuuagcaaggucccuaauau

SEQ ID NO: 4087840 - RNA, 12 nt, Variola virus
uuuaguuucuuc

SEQ ID NO: 4087841 - RNA, 17 nt, Variola virus
uuuauaaaaaacuuuua

SEQ ID NO: 4087842 - RNA, 19 nt, Variola virus
uuuauaaacuuaacccauu

SEQ ID NO: 4087843 - RNA, 24 nt, Variola virus
uuuauaaagaaauacauaucgcac

SEQ ID NO: 4087844 - RNA, 22 nt, Variola virus
uuuauauccagauccuuuucuu

SEQ ID NO: 4087845 - RNA, 17 nt, Variola virus
uuuauaugguguuucua

SEQ ID NO: 4087846 - RNA, 14 nt, Variola virus
uuuauauuaaauau

SEQ ID NO: 4087847 - RNA, 20 nt, Variola virus
uuuaucauagucuaaagaug

SEQ ID NO: 4087848 - RNA, 14 nt, Variola virus
uuuaucgauguaca

SEQ ID NO: 4087849 - RNA, 21 nt, Variola virus
uuuaucuuucccccuagauac

SEQ ID NO: 4087850 - RNA, 13 nt, Variola virus
uuucaaauaccag

SEQ ID NO: 4087851 - RNA, 19 nt, Variola virus
uuucaagccggcuauauau

SEQ ID NO: 4087852 - RNA, 18 nt, Variola virus
uuucacaucguauuuuaa

SEQ ID NO: 4087853 - RNA, 14 nt, Variola virus
uuucagucauugau

SEQ ID NO: 4087854 - RNA, 19 nt, Variola virus
uuucauaguuagauacaua

SEQ ID NO: 4087855 - RNA, 21 nt, Variola virus
uuucaugaagucuaacguauu

SEQ ID NO: 4087856 - RNA, 20 nt, Variola virus
uuucauuuguauacacauaa

SEQ ID NO: 4087857 - RNA, 18 nt, Variola virus
uuuccaaguagugugcuc

SEQ ID NO: 4087858 - RNA, 15 nt, Variola virus
uuuccccacauagaa

SEQ ID NO: 4087859 - RNA, 21 nt, Variola virus
uuuccggagauagauuuccaa

SEQ ID NO: 4087860 - RNA, 19 nt, Variola virus
uuuccuaguauuugucaaa

SEQ ID NO: 4087861 - RNA, 15 nt, Variola virus
uuucgaauacuuauu

SEQ ID NO: 4087862 - RNA, 16 nt, Variola virus
uuucgaggaauaauaa

SEQ ID NO: 4087863 - RNA, 21 nt, Variola virus
uuucgauucuggcuauuucaa

SEQ ID NO: 4087864 - RNA, 17 nt, Variola virus
uuucgcgggauacauca

SEQ ID NO: 4087865 - RNA, 16 nt, Variola virus
uuucgcuguauaauaa

SEQ ID NO: 4087866 - RNA, 12 nt, Variola virus
uuucuaaauuca

SEQ ID NO: 4087867 - RNA, 12 nt, Variola virus
uuucuacauaau

SEQ ID NO: 4087868 - RNA, 15 nt, Variola virus
uuucuacuagacuau

SEQ ID NO: 4087869 - RNA, 11 nt, Variola virus
uuucuagauac

SEQ ID NO: 4087870 - RNA, 15 nt, Variola virus
uuucugguucuaauu

SEQ ID NO: 4087871 - RNA, 15 nt, Variola virus
uuucuucaacaaauu

SEQ ID NO: 4087872 - RNA, 22 nt, Variola virus
uuucuucauuuauuauauauaa

SEQ ID NO: 4087873 - RNA, 19 nt, Variola virus
uuucuugagagacaugauu

SEQ ID NO: 4087874 - RNA, 22 nt, Variola virus
uuucuugagaucccacaucauu

SEQ ID NO: 4087875 - RNA, 20 nt, Variola virus
uuugaaugaaugaauacaga

SEQ ID NO: 4087876 - RNA, 19 nt, Variola virus
uuugaauuaguuuauaauu

SEQ ID NO: 4087877 - RNA, 12 nt, Variola virus
uuugacacuauc

SEQ ID NO: 4087878 - RNA, 16 nt, Variola virus
uuugacauauuaacgu

SEQ ID NO: 4087879 - RNA, 22 nt, Variola virus
uuugacuagggaagauacauua

SEQ ID NO: 4087880 - RNA, 21 nt, Variola virus
uuugauaaagauagaugauga

SEQ ID NO: 4087881 - RNA, 18 nt, Variola virus
uuugauaaaucucuucuu

SEQ ID NO: 4087882 - RNA, 18 nt, Variola virus
uuugauagggacaaagua

SEQ ID NO: 4087883 - RNA, 18 nt, Variola virus
uuugauauaggugcaaaa

SEQ ID NO: 4087884 - RNA, 23 nt, Variola virus
uuugauauaucaguuaaugcauc

SEQ ID NO: 4087885 - RNA, 21 nt, Variola virus
uuugauuaccuuacucaugau

SEQ ID NO: 4087886 - RNA, 18 nt, Variola virus
uuugccaaccaauacaua

SEQ ID NO: 4087887 - RNA, 14 nt, Variola virus
uuugcuaauaauaa

SEQ ID NO: 4087888 - RNA, 18 nt, Variola virus
uuuggaaucguucaaaac

SEQ ID NO: 4087889 - RNA, 18 nt, Variola virus
uuuggaucuuuuguacau

SEQ ID NO: 4087890 - RNA, 14 nt, Variola virus
uuuggcauuucuaa

SEQ ID NO: 4087891 - RNA, 18 nt, Variola virus
uuugguaauggcaaugua

SEQ ID NO: 4087892 - RNA, 20 nt, Variola virus
uuugguacguugauuucuag

SEQ ID NO: 4087893 - RNA, 16 nt, Variola virus
uuugguagauucuauu

SEQ ID NO: 4087894 - RNA, 14 nt, Variola virus
uuuguauacacaua

SEQ ID NO: 4087895 - RNA, 17 nt, Variola virus
uuuguuaagaauuuaga

SEQ ID NO: 4087896 - RNA, 17 nt, Variola virus
uuuuaaauccuguauca

SEQ ID NO: 4087897 - RNA, 22 nt, Variola virus
uuuuaaauuuccgucuaucauc

SEQ ID NO: 4087898 - RNA, 14 nt, Variola virus
uuuuaauauaaacg

SEQ ID NO: 4087899 - RNA, 17 nt, Variola virus
uuuuacaauuucaucca

SEQ ID NO: 4087900 - RNA, 23 nt, Variola virus
uuuuacacaaggcauugucucua

SEQ ID NO: 4087901 - RNA, 18 nt, Variola virus
uuuuacgaacuaguugua

SEQ ID NO: 4087902 - RNA, 14 nt, Variola virus
uuuuacuaaucaua

SEQ ID NO: 4087903 - RNA, 20 nt, Variola virus
uuuuacuacauaguuaucua

SEQ ID NO: 4087904 - RNA, 16 nt, Variola virus
uuuuagaaauauacag

SEQ ID NO: 4087905 - RNA, 20 nt, Variola virus
uuuuaggauaugcuuucaua

SEQ ID NO: 4087906 - RNA, 12 nt, Variola virus
uuuuauaaacaa

SEQ ID NO: 4087907 - RNA, 13 nt, Variola virus
uuuuauguaucca

SEQ ID NO: 4087908 - RNA, 21 nt, Variola virus
uuuuauuuuuggaauaaucuc

SEQ ID NO: 4087909 - RNA, 17 nt, Variola virus
uuuucaguuaucaucua

SEQ ID NO: 4087910 - RNA, 18 nt, Variola virus
uuuucaucuuuacauacu

SEQ ID NO: 4087911 - RNA, 15 nt, Variola virus
uuuuccaaaguuuua

SEQ ID NO: 4087912 - RNA, 20 nt, Variola virus
uuuuccauaggauacuuugu

SEQ ID NO: 4087913 - RNA, 19 nt, Variola virus
uuuuccaucuauguagaau

SEQ ID NO: 4087914 - RNA, 12 nt, Variola virus
uuuuccaugaua

SEQ ID NO: 4087915 - RNA, 12 nt, Variola virus
uuagcauacaaa

SEQ ID NO: 4087916 - RNA, 20 nt, Variola virus
uuagcauauaccucauuaac

SEQ ID NO: 4087917 - RNA, 15 nt, Variola virus
uuagcaucuauuuuu

SEQ ID NO: 4087918 - RNA, 16 nt, Variola virus
uuagccguuguuugag

SEQ ID NO: 4087919 - RNA, 18 nt, Variola virus
uuagcuguuuucauuaag

SEQ ID NO: 4087920 - RNA, 16 nt, Variola virus
uuaggaucuucuaaug

SEQ ID NO: 4087921 - RNA, 17 nt, Variola virus
uuaguaacucuaguaaa

SEQ ID NO: 4087922 - RNA, 14 nt, Variola virus
uuaguaaggcuuua

SEQ ID NO: 4087923 - RNA, 15 nt, Variola virus
uuaguaaucauguaa

SEQ ID NO: 4087924 - RNA, 14 nt, Variola virus
uuagugaaacauuc

SEQ ID NO: 4087925 - RNA, 20 nt, Variola virus
uuaguguauaauuuugucau

SEQ ID NO: 4087926 - RNA, 18 nt, Variola virus
uuaguuauugcaauauag

SEQ ID NO: 4087927 - RNA, 19 nt, Variola virus
uuauaaaaaauuuuauuca

SEQ ID NO: 4087928 - RNA, 15 nt, Variola virus
uuauaaaaauacuaa

SEQ ID NO: 4087929 - RNA, 21 nt, Variola virus
uuauaaaaauuaaaaaaucac

SEQ ID NO: 4087930 - RNA, 14 nt, Variola virus
uuauaaacacagau

SEQ ID NO: 4087931 - RNA, 18 nt, Variola virus
uuauaaagauauguaugu

SEQ ID NO: 4087932 - RNA, 20 nt, Variola virus
uuauaaagaugguaaacugu

SEQ ID NO: 4087933 - RNA, 15 nt, Variola virus
uuauaauauucaugu

SEQ ID NO: 4087934 - RNA, 15 nt, Variola virus
uuauaaucaaagauu

SEQ ID NO: 4087935 - RNA, 12 nt, Variola virus
uuauacaucuua

SEQ ID NO: 4087936 - RNA, 22 nt, Variola virus
uuauacgaaaaaaaucauuaaa

SEQ ID NO: 4087937 - RNA, 20 nt, Variola virus
uuauacgcauaaauuguaaa

SEQ ID NO: 4087938 - RNA, 17 nt, Variola virus
uuauacuaugucauuaa

SEQ ID NO: 4087939 - RNA, 14 nt, Variola virus
uuauagagauagau

SEQ ID NO: 4087940 - RNA, 17 nt, Variola virus
uuauagauuuguaucuc

SEQ ID NO: 4087941 - RNA, 20 nt, Variola virus
uuauaguguuuaacaaagau

SEQ ID NO: 4087942 - RNA, 14 nt, Variola virus
uuauauaauguaua

SEQ ID NO: 4087943 - RNA, 14 nt, Variola virus
uuauauauguaaua

SEQ ID NO: 4087944 - RNA, 20 nt, Variola virus
uuauaucaauaccaaagaag

SEQ ID NO: 4087945 - RNA, 18 nt, Variola virus
uuauaucguuaucauuaa

SEQ ID NO: 4087946 - RNA, 20 nt, Variola virus
uuauaugcuugcauuacaga

SEQ ID NO: 4087947 - RNA, 21 nt, Variola virus
uuauauggcuacaauuucaua

SEQ ID NO: 4087948 - RNA, 14 nt, Variola virus
uuauauuuuucuua

SEQ ID NO: 4087949 - RNA, 15 nt, Variola virus
uuauauuuuucuuaa

SEQ ID NO: 4087950 - RNA, 19 nt, Variola virus
uuauauuuuuucauuauua

SEQ ID NO: 4087951 - RNA, 22 nt, Variola virus
uuaucaaaucuuuaaucuuauu

SEQ ID NO: 4087952 - RNA, 22 nt, Variola virus
uuaucacaaugaaauauuuugg

SEQ ID NO: 4087953 - RNA, 20 nt, Variola virus
uuaucagaagauggauggau

SEQ ID NO: 4087954 - RNA, 13 nt, Variola virus
uuaucauacuguc

SEQ ID NO: 4087955 - RNA, 13 nt, Variola virus
uuaucaucauuau

SEQ ID NO: 4087956 - RNA, 17 nt, Variola virus
uuauccaaaauauuaau

SEQ ID NO: 4087957 - RNA, 23 nt, Variola virus
uuauccacggauaccucauuuau

SEQ ID NO: 4087958 - RNA, 22 nt, Variola virus
uuauccguauuuccauaauaag

SEQ ID NO: 4087959 - RNA, 18 nt, Variola virus
uuaucgauuagucuuaau

SEQ ID NO: 4087960 - RNA, 16 nt, Variola virus
uuaucguuuacauaag

SEQ ID NO: 4087961 - RNA, 17 nt, Variola virus
uuaucguuuucaucuuu

SEQ ID NO: 4087962 - RNA, 14 nt, Variola virus
uuaucuauuauuua

SEQ ID NO: 4087963 - RNA, 17 nt, Variola virus
uuaucucauuugaaaau

SEQ ID NO: 4087964 - RNA, 20 nt, Variola virus
uuaucuucauaaaauacuaa

SEQ ID NO: 4087965 - RNA, 15 nt, Variola virus
uuaugaaucauuaaa

SEQ ID NO: 4087966 - RNA, 23 nt, Variola virus
uuaugauauaaggaaacagcuuu

SEQ ID NO: 4087967 - RNA, 14 nt, Variola virus
uuauguuauuuugu

SEQ ID NO: 4087968 - RNA, 18 nt, Variola virus
uuauuaaaggaacuaaag

SEQ ID NO: 4087969 - RNA, 17 nt, Variola virus
uuauuaauaauuguaaa

SEQ ID NO: 4087970 - RNA, 16 nt, Variola virus
uuauuagaauaagagu

SEQ ID NO: 4087971 - RNA, 17 nt, Variola virus
uuauuagagauuucagc

SEQ ID NO: 4087972 - RNA, 15 nt, Variola virus
uuauuagauuuggua

SEQ ID NO: 4087973 - RNA, 23 nt, Variola virus
uuauuauagugguggaauucagu

SEQ ID NO: 4087974 - RNA, 14 nt, Variola virus
uuauuaugaagacu

SEQ ID NO: 4087975 - RNA, 21 nt, Variola virus
uuauuccacacacucuacaau

SEQ ID NO: 4087976 - RNA, 15 nt, Variola virus
uuauucucuacgagu

SEQ ID NO: 4087977 - RNA, 15 nt, Variola virus
uuauugauauguaua

SEQ ID NO: 4087978 - RNA, 12 nt, Variola virus
uuauuguaacag

SEQ ID NO: 4087979 - RNA, 14 nt, Variola virus
uuauuguuugggua

SEQ ID NO: 4087980 - RNA, 12 nt, Variola virus
uuauuuauguca

SEQ ID NO: 4087981 - RNA, 23 nt, Variola virus
uuauuucagucgcugauuaauca

SEQ ID NO: 4087982 - RNA, 13 nt, Variola virus
uuauuucuaaaau

SEQ ID NO: 4087983 - RNA, 14 nt, Variola virus
uuauuuuugaagau

SEQ ID NO: 4087984 - RNA, 18 nt, Variola virus
uucaaaaauauucauuaa

SEQ ID NO: 4087985 - RNA, 13 nt, Variola virus
uucaaaauuauuu

SEQ ID NO: 4087986 - RNA, 16 nt, Variola virus
uucaaaauuauuuacc

SEQ ID NO: 4087987 - RNA, 15 nt, Variola virus
uucaaauaaaucacu

SEQ ID NO: 4087988 - RNA, 14 nt, Variola virus
uucaaaucuagauu

SEQ ID NO: 4087989 - RNA, 10 nt, Variola virus
uucaacaaug

SEQ ID NO: 4087990 - RNA, 14 nt, Variola virus
uucaacauguuuaa

SEQ ID NO: 4087991 - RNA, 21 nt, Variola virus
uucaagaucuaauauucuaga

SEQ ID NO: 4087992 - RNA, 15 nt, Variola virus
uucaagauuaucuuu

SEQ ID NO: 4087993 - RNA, 16 nt, Variola virus
uucaagcgaauuacuc

SEQ ID NO: 4087994 - RNA, 19 nt, Variola virus
uucaaugcugguugcaaga

SEQ ID NO: 4087995 - RNA, 13 nt, Variola virus
uucacaaauacua

SEQ ID NO: 4087996 - RNA, 21 nt, Variola virus
uucacaaucggauuaauaucu

SEQ ID NO: 4087997 - RNA, 16 nt, Variola virus
uucacuaaauaguuuu

SEQ ID NO: 4087998 - RNA, 17 nt, Variola virus
uucacuuuaauagauau

SEQ ID NO: 4087999 - RNA, 22 nt, Variola virus
uucacuuuuuauaauuuuacca

SEQ ID NO: 4088000 - RNA, 21 nt, Variola virus
uucagaaaguaauucauuaau

SEQ ID NO: 4088001 - RNA, 14 nt, Variola virus
uucagaaauuauuc

SEQ ID NO: 4088002 - RNA, 22 nt, Variola virus
uucauaauuguuagcuguuuuc

SEQ ID NO: 4088003 - RNA, 21 nt, Variola virus
uucaucagauuauuuaacaau

SEQ ID NO: 4088004 - RNA, 20 nt, Variola virus
uucaucauccaccuguuuua

SEQ ID NO: 4088005 - RNA, 22 nt, Variola virus
uucauccuuugauaauuuucca

SEQ ID NO: 4088006 - RNA, 18 nt, Variola virus
uucaucguaucuagauaa

SEQ ID NO: 4088007 - RNA, 14 nt, Variola virus
uucaugacaaucaa

SEQ ID NO: 4088008 - RNA, 21 nt, Variola virus
uucauuaaaaacaaacuuuuu

SEQ ID NO: 4088009 - RNA, 12 nt, Variola virus
uucauuaaggag

SEQ ID NO: 4088010 - RNA, 22 nt, Variola virus
uuccaaaguugggauaguauuu

SEQ ID NO: 4088011 - RNA, 15 nt, Variola virus
uuccaacucuguuuu

SEQ ID NO: 4088012 - RNA, 16 nt, Variola virus
uuccaaucuuuugcaa

SEQ ID NO: 4088013 - RNA, 17 nt, Variola virus
uuccacagacucauuau

SEQ ID NO: 4088014 - RNA, 16 nt, Variola virus
uuccacauuaauacag

SEQ ID NO: 4088015 - RNA, 20 nt, Variola virus
uuccacgaaaguaauuauua

SEQ ID NO: 4088016 - RNA, 18 nt, Variola virus
uuccacgaacuucuaauu

SEQ ID NO: 4088017 - RNA, 19 nt, Variola virus
uuccauagaauauauuaau

SEQ ID NO: 4088018 - RNA, 20 nt, Variola virus
uuccauaggauacuuuguaa

SEQ ID NO: 4088019 - RNA, 21 nt, Variola virus
uuccaucgguauaaaaaucau

SEQ ID NO: 4088020 - RNA, 19 nt, Variola virus
uuccauuguacaaacgaag

SEQ ID NO: 4088021 - RNA, 23 nt, Variola virus
uucccauagcugguucaaaauua

SEQ ID NO: 4088022 - RNA, 18 nt, Variola virus
uucccaucauuucucaau

SEQ ID NO: 4088023 - RNA, 14 nt, Variola virus
uucccauucuaaug

SEQ ID NO: 4088024 - RNA, 22 nt, Variola virus
uuccgggugccgccaacaaggg

SEQ ID NO: 4088025 - RNA, 16 nt, Variola virus
uuccguaucuguauuu

SEQ ID NO: 4088026 - RNA, 14 nt, Variola virus
uuccuaaaucgagu

SEQ ID NO: 4088027 - RNA, 23 nt, Variola virus
uuccuauagccguucuuguaauu

SEQ ID NO: 4088028 - RNA, 19 nt, Variola virus
uuccugacgucuagaguuu

SEQ ID NO: 4088029 - RNA, 19 nt, Variola virus
uuccuggaauaucauuaac

SEQ ID NO: 4088030 - RNA, 18 nt, Variola virus
uucgcaauauucauuaau

SEQ ID NO: 4088031 - RNA, 14 nt, Variola virus
uucguuuucuaauu

SEQ ID NO: 4088032 - RNA, 18 nt, Variola virus
uucguuuuuauaugugac

SEQ ID NO: 4088033 - RNA, 13 nt, Variola virus
uucuacaauaacu

SEQ ID NO: 4088034 - RNA, 14 nt, Variola virus
uucuacaauaacua

SEQ ID NO: 4088035 - RNA, 21 nt, Variola virus
uucuacuacuucauuaaucuu

SEQ ID NO: 4088036 - RNA, 21 nt, Variola virus
uucuacuaugcacauuauucu

SEQ ID NO: 4088037 - RNA, 19 nt, Variola virus
uucuacugaugcauguauu

SEQ ID NO: 4088038 - RNA, 23 nt, Variola virus
uucuagaaaacgaaaacauccua

SEQ ID NO: 4088039 - RNA, 22 nt, Variola virus
uucuagaauuagaauuacaaaa

SEQ ID NO: 4088040 - RNA, 19 nt, Variola virus
uucuaguauacggaaacac

SEQ ID NO: 4088041 - RNA, 21 nt, Variola virus
uucuagugcuuguauguguua

SEQ ID NO: 4088042 - RNA, 16 nt, Variola virus
uucuaguuaucaugua

SEQ ID NO: 4088043 - RNA, 16 nt, Variola virus
uucuauaauaaacuuu

SEQ ID NO: 4088044 - RNA, 21 nt, Variola virus
uucuauccaaggacaaggaug

SEQ ID NO: 4088045 - RNA, 20 nt, Variola virus
uucuaucccccguauuuaca

SEQ ID NO: 4088046 - RNA, 17 nt, Variola virus
uucuauuuuuaauauag

SEQ ID NO: 4088047 - RNA, 21 nt, Variola virus
uucuccaccaaacauauucuu

SEQ ID NO: 4088048 - RNA, 15 nt, Variola virus
uucucguuuccaaaa

SEQ ID NO: 4088049 - RNA, 14 nt, Variola virus
uucucuaaaugaug

SEQ ID NO: 4088050 - RNA, 15 nt, Variola virus
uucugauuuuaucuu

SEQ ID NO: 4088051 - RNA, 15 nt, Variola virus
uucugcuaaauuuuc

SEQ ID NO: 4088052 - RNA, 18 nt, Variola virus
uucuggaauauuaucauc

SEQ ID NO: 4088053 - RNA, 16 nt, Variola virus
uucuuaaacuuauucu

SEQ ID NO: 4088054 - RNA, 22 nt, Variola virus
uucuuaacaaagagaacguauu

SEQ ID NO: 4088055 - RNA, 15 nt, Variola virus
uucuuaagacacauu

SEQ ID NO: 4088056 - RNA, 14 nt, Variola virus
uucuucauuauuuu

SEQ ID NO: 4088057 - RNA, 12 nt, Variola virus
uucuucuguauc

SEQ ID NO: 4088058 - RNA, 17 nt, Variola virus
uucuuguugcacuguaa

SEQ ID NO: 4088059 - RNA, 17 nt, Variola virus
uucuuuagcgaaacagu

SEQ ID NO: 4088060 - RNA, 12 nt, Variola virus
uucuuucaaaau

SEQ ID NO: 4088061 - RNA, 12 nt, Variola virus
uucuuuguguag

SEQ ID NO: 4088062 - RNA, 14 nt, Variola virus
uucuuuuucaaaga

SEQ ID NO: 4088063 - RNA, 15 nt, Variola virus
uucuuuuucauuaac

SEQ ID NO: 4088064 - RNA, 15 nt, Variola virus
uugaaaacuauuucu

SEQ ID NO: 4088065 - RNA, 23 nt, Variola virus
uugaaacugaauagaugcaucua

SEQ ID NO: 4088066 - RNA, 14 nt, Variola virus
uugaaguaauuuuc

SEQ ID NO: 4088067 - RNA, 13 nt, Variola virus
uugaauugcgauu

SEQ ID NO: 4088068 - RNA, 21 nt, Variola virus
uugacauauguaaauauuaau

SEQ ID NO: 4088069 - RNA, 15 nt, Variola virus
uugacaucuauauau

SEQ ID NO: 4088070 - RNA, 20 nt, Variola virus
uugaguggaaaguucaaaaa

SEQ ID NO: 4088071 - RNA, 21 nt, Variola virus
uugauaaagccuuccuugcaa

SEQ ID NO: 4088072 - RNA, 21 nt, Variola virus
uugauaaauagaaucagauuu

SEQ ID NO: 4088073 - RNA, 14 nt, Variola virus
uugauaauaaauca

SEQ ID NO: 4088074 - RNA, 17 nt, Variola virus
uugauaauuacgcguau

SEQ ID NO: 4088075 - RNA, 16 nt, Variola virus
uugauaucuuuagaua

SEQ ID NO: 4088076 - RNA, 15 nt, Variola virus
uugaucagaaugaau

SEQ ID NO: 4088077 - RNA, 22 nt, Variola virus
uugaucucaucauuccauaauu

SEQ ID NO: 4088078 - RNA, 16 nt, Variola virus
uugaucuuauuauaca

SEQ ID NO: 4088079 - RNA, 17 nt, Variola virus
uugaucuuuauuaaauu

SEQ ID NO: 4088080 - RNA, 21 nt, Variola virus
uaggugccaccaauaaacuau

SEQ ID NO: 4088081 - RNA, 16 nt, Variola virus
uagguuguaauacaua

SEQ ID NO: 4088082 - RNA, 19 nt, Variola virus
uaguaaaccgauaguguau

SEQ ID NO: 4088083 - RNA, 21 nt, Variola virus
uaguaaguagaaauuaucaaa

SEQ ID NO: 4088084 - RNA, 21 nt, Variola virus
uaguaauaaugauucaacaau

SEQ ID NO: 4088085 - RNA, 19 nt, Variola virus
uaguacgggcgcuguaauu

SEQ ID NO: 4088086 - RNA, 20 nt, Variola virus
uaguacuaaaauuuguauuu

SEQ ID NO: 4088087 - RNA, 19 nt, Variola virus
uaguagucauugaucuauu

SEQ ID NO: 4088088 - RNA, 14 nt, Variola virus
uaguaguguuuccc

SEQ ID NO: 4088089 - RNA, 15 nt, Variola virus
uaguauaaauaguua

SEQ ID NO: 4088090 - RNA, 18 nt, Variola virus
uaguauauaauaaagaua

SEQ ID NO: 4088091 - RNA, 15 nt, Variola virus
uaguauauacguuau

SEQ ID NO: 4088092 - RNA, 16 nt, Variola virus
uaguauauggacaaac

SEQ ID NO: 4088093 - RNA, 21 nt, Variola virus
uaguaucaauaacacaaucau

SEQ ID NO: 4088094 - RNA, 16 nt, Variola virus
uagucagaauuuucau

SEQ ID NO: 4088095 - RNA, 17 nt, Variola virus
uagucagaccauucuug

SEQ ID NO: 4088096 - RNA, 20 nt, Variola virus
uagucaucucauuaacuauu

SEQ ID NO: 4088097 - RNA, 16 nt, Variola virus
uagucuguguuacaua

SEQ ID NO: 4088098 - RNA, 13 nt, Variola virus
uagugauuuugaa

SEQ ID NO: 4088099 - RNA, 20 nt, Variola virus
uagugguauaucuuguucua

SEQ ID NO: 4088100 - RNA, 22 nt, Variola virus
uaguuauggcacucuuauuaua

SEQ ID NO: 4088101 - RNA, 18 nt, Variola virus
uaguucaucuaugaaugu

SEQ ID NO: 4088102 - RNA, 19 nt, Variola virus
uaguucucuuuuguagaac

SEQ ID NO: 4088103 - RNA, 19 nt, Variola virus
uaguugauagaacaaaaua

SEQ ID NO: 4088104 - RNA, 23 nt, Variola virus
uaguugauagaacaaaauacaua

SEQ ID NO: 4088105 - RNA, 15 nt, Variola virus
uaguuuaucaaaaau

SEQ ID NO: 4088106 - RNA, 17 nt, Variola virus
uaguuuaucuuuuucua

SEQ ID NO: 4088107 - RNA, 13 nt, Variola virus
uaguuucuaagau

SEQ ID NO: 4088108 - RNA, 17 nt, Variola virus
uaguuucugguuuucua

SEQ ID NO: 4088109 - RNA, 14 nt, Variola virus
uaguuuuuacacau

SEQ ID NO: 4088110 - RNA, 14 nt, Variola virus
uauaaaaaacuuuu

SEQ ID NO: 4088111 - RNA, 21 nt, Variola virus
uauaaaaauuuuuuauacauu

SEQ ID NO: 4088112 - RNA, 16 nt, Variola virus
uauaaaaguguauuua

SEQ ID NO: 4088113 - RNA, 14 nt, Variola virus
uauaaaauaaacau

SEQ ID NO: 4088114 - RNA, 21 nt, Variola virus
uauaaaauacuaaugcaucua

SEQ ID NO: 4088115 - RNA, 12 nt, Variola virus
uauaaaauacuu

SEQ ID NO: 4088116 - RNA, 13 nt, Variola virus
uauaaaaugacau

SEQ ID NO: 4088117 - RNA, 22 nt, Variola virus
uauaaaccgcuauugaaacuga

SEQ ID NO: 4088118 - RNA, 20 nt, Variola virus
uauaaaggaauaaaauauga

SEQ ID NO: 4088119 - RNA, 15 nt, Variola virus
uauaaauguagacuc

SEQ ID NO: 4088120 - RNA, 12 nt, Variola virus
uauaaauuaaag

SEQ ID NO: 4088121 - RNA, 14 nt, Variola virus
uauaacaaugacuu

SEQ ID NO: 4088122 - RNA, 20 nt, Variola virus
uauaaccaccgauaaaucua

SEQ ID NO: 4088123 - RNA, 13 nt, Variola virus
uauaaccuuaaua

SEQ ID NO: 4088124 - RNA, 17 nt, Variola virus
uauaacuucuaaucuug

SEQ ID NO: 4088125 - RNA, 17 nt, Variola virus
uauaagauuaucaaaau

SEQ ID NO: 4088126 - RNA, 22 nt, Variola virus
uauaaucaguagcguguuuuaa

SEQ ID NO: 4088127 - RNA, 18 nt, Variola virus
uauaaucauuauuaacuu

SEQ ID NO: 4088128 - RNA, 20 nt, Variola virus
uauaaugcguauaauauguu

SEQ ID NO: 4088129 - RNA, 16 nt, Variola virus
uauaauguauguuuaa

SEQ ID NO: 4088130 - RNA, 23 nt, Variola virus
uauaauuaucacauauuaaaauu

SEQ ID NO: 4088131 - RNA, 22 nt, Variola virus
uauaauuauuauugauagcauu

SEQ ID NO: 4088132 - RNA, 21 nt, Variola virus
uauaauucguuuuuauaugug

SEQ ID NO: 4088133 - RNA, 15 nt, Variola virus
uauaauuuuaccauu

SEQ ID NO: 4088134 - RNA, 22 nt, Variola virus
uauacaaugcucaguaaaugua

SEQ ID NO: 4088135 - RNA, 20 nt, Variola virus
uauacagugaacacacaaua

SEQ ID NO: 4088136 - RNA, 23 nt, Variola virus
uauacauauuccagaugucauga

SEQ ID NO: 4088137 - RNA, 17 nt, Variola virus
uauaccaacaugucuga

SEQ ID NO: 4088138 - RNA, 19 nt, Variola virus
uauaccuuguaauuaaauu

SEQ ID NO: 4088139 - RNA, 17 nt, Variola virus
uauacggcaacagcuuc

SEQ ID NO: 4088140 - RNA, 17 nt, Variola virus
uauacguuauugucaaa

SEQ ID NO: 4088141 - RNA, 16 nt, Variola virus
uauacucuuauuauca

SEQ ID NO: 4088142 - RNA, 21 nt, Variola virus
uauacuugucaucauuucuaa

SEQ ID NO: 4088143 - RNA, 16 nt, Variola virus
uauagaccguuacauu

SEQ ID NO: 4088144 - RNA, 19 nt, Variola virus
uauagagcacuauuucuaa

SEQ ID NO: 4088145 - RNA, 21 nt, Variola virus
uauagagcacuauuucuaaau

SEQ ID NO: 4088146 - RNA, 22 nt, Variola virus
uauagaugaggugguugcagaa

SEQ ID NO: 4088147 - RNA, 16 nt, Variola virus
uauagguauauuugcg

SEQ ID NO: 4088148 - RNA, 17 nt, Variola virus
uauaguagaauuucauu

SEQ ID NO: 4088149 - RNA, 14 nt, Variola virus
uauaguuaacauuu

SEQ ID NO: 4088150 - RNA, 13 nt, Variola virus
uauaguuuaaauu

SEQ ID NO: 4088151 - RNA, 15 nt, Variola virus
uauauaaaaauauca

SEQ ID NO: 4088152 - RNA, 13 nt, Variola virus
uauauaaauacuu

SEQ ID NO: 4088153 - RNA, 19 nt, Variola virus
uauauaaguaauaccaaaa

SEQ ID NO: 4088154 - RNA, 22 nt, Variola virus
uauauaauuuuuggacaaaugu

SEQ ID NO: 4088155 - RNA, 17 nt, Variola virus
uauauacucuauuucaa

SEQ ID NO: 4088156 - RNA, 12 nt, Variola virus
uauauacugaaa

SEQ ID NO: 4088157 - RNA, 17 nt, Variola virus
uauauagauauuaucua

SEQ ID NO: 4088158 - RNA, 12 nt, Variola virus
uauauagaugua

SEQ ID NO: 4088159 - RNA, 14 nt, Variola virus
uauauagaugucaa

SEQ ID NO: 4088160 - RNA, 23 nt, Variola virus
uauauagccgucgccaauugugu

SEQ ID NO: 4088161 - RNA, 17 nt, Variola virus
uauauauagauggagua

SEQ ID NO: 4088162 - RNA, 13 nt, Variola virus
uauauauguagug

SEQ ID NO: 4088163 - RNA, 18 nt, Variola virus
uauauauuagauacaguu

SEQ ID NO: 4088164 - RNA, 17 nt, Variola virus
uauauccuuuagaguau

SEQ ID NO: 4088165 - RNA, 17 nt, Variola virus
uauaucuauaucuacau

SEQ ID NO: 4088166 - RNA, 17 nt, Variola virus
uauaugaaguaaaguau

SEQ ID NO: 4088167 - RNA, 15 nt, Variola virus
uauaugacuguauuu

SEQ ID NO: 4088168 - RNA, 14 nt, Variola virus
uauaugauaucuuu

SEQ ID NO: 4088169 - RNA, 17 nt, Variola virus
uauaugauauuccugga

SEQ ID NO: 4088170 - RNA, 17 nt, Variola virus
uauauuagacaauacua

SEQ ID NO: 4088171 - RNA, 16 nt, Variola virus
uauauuccgauuucaa

SEQ ID NO: 4088172 - RNA, 17 nt, Variola virus
uauauuccugagcauau

SEQ ID NO: 4088173 - RNA, 19 nt, Variola virus
uauauuucgugauauacau

SEQ ID NO: 4088174 - RNA, 15 nt, Variola virus
uauauuuuauacauu

SEQ ID NO: 4088175 - RNA, 17 nt, Variola virus
uaucaacagauagcuug

SEQ ID NO: 4088176 - RNA, 16 nt, Variola virus
uaucaagauccaugau

SEQ ID NO: 4088177 - RNA, 20 nt, Variola virus
uaucaagauguaaaauacuu

SEQ ID NO: 4088178 - RNA, 20 nt, Variola virus
uaucaagcgauucuuucaau

SEQ ID NO: 4088179 - RNA, 23 nt, Variola virus
uaucaauaacacaaucaugauuu

SEQ ID NO: 4088180 - RNA, 20 nt, Variola virus
uaucaaugauuaguuucuua

SEQ ID NO: 4088181 - RNA, 20 nt, Variola virus
uaucaccaguaagaacauaa

SEQ ID NO: 4088182 - RNA, 24 nt, Variola virus
uaucacuucaacgacaauagucaa

SEQ ID NO: 4088183 - RNA, 20 nt, Variola virus
uaucagagcagucuuucuaa

SEQ ID NO: 4088184 - RNA, 20 nt, Variola virus
uaucaucacaacuuaaugaa

SEQ ID NO: 4088185 - RNA, 16 nt, Variola virus
uaucaucauuaucauu

SEQ ID NO: 4088186 - RNA, 15 nt, Variola virus
uaucauccaauauua

SEQ ID NO: 4088187 - RNA, 17 nt, Variola virus
uaucaucucuaucauaa

SEQ ID NO: 4088188 - RNA, 16 nt, Variola virus
uaucaugucuaaugau

SEQ ID NO: 4088189 - RNA, 16 nt, Variola virus
uaucauuaauacagua

SEQ ID NO: 4088190 - RNA, 15 nt, Variola virus
uaucauuuaaacauu

SEQ ID NO: 4088191 - RNA, 20 nt, Variola virus
uauccaacuuaacaaaucuu

SEQ ID NO: 4088192 - RNA, 14 nt, Variola virus
uauccaagaaaaag

SEQ ID NO: 4088193 - RNA, 18 nt, Variola virus
uauccagucaacacuaug

SEQ ID NO: 4088194 - RNA, 21 nt, Variola virus
uauccagugcguuucuacaaa

SEQ ID NO: 4088195 - RNA, 16 nt, Variola virus
uauccaucuaacaaaa

SEQ ID NO: 4088196 - RNA, 23 nt, Variola virus
uauccauuauuugccuguuaauc

SEQ ID NO: 4088197 - RNA, 17 nt, Variola virus
uauccuauauacgaaaa

SEQ ID NO: 4088198 - RNA, 21 nt, Variola virus
uauccucaauaacguuaucau

SEQ ID NO: 4088199 - RNA, 11 nt, Variola virus
uauccuuaucc

SEQ ID NO: 4088200 - RNA, 20 nt, Variola virus
uaucgcauagaaauacaaaa

SEQ ID NO: 4088201 - RNA, 12 nt, Variola virus
uaucguuuucau

SEQ ID NO: 4088202 - RNA, 15 nt, Variola virus
uaucuaacucguaaa

SEQ ID NO: 4088203 - RNA, 17 nt, Variola virus
uaucuacacaaauagaa

SEQ ID NO: 4088204 - RNA, 18 nt, Variola virus
uaucuauaucuacaucua

SEQ ID NO: 4088205 - RNA, 20 nt, Variola virus
uaucuauuuuaacaaagcau

SEQ ID NO: 4088206 - RNA, 23 nt, Variola virus
uaucuccacucucgauaaaucua

SEQ ID NO: 4088207 - RNA, 21 nt, Variola virus
uaucucguccuugguuuacau

SEQ ID NO: 4088208 - RNA, 24 nt, Variola virus
uacauaccucuuaaauggacuagu

SEQ ID NO: 4088209 - RNA, 22 nt, Variola virus
uaggcuuccaaaaauuuuucau

SEQ ID NO: 4088210 - RNA, 16 nt, Variola virus
uaggugcaucuggagc

SEQ ID NO: 4088211 - RNA, 13 nt, Variola virus
gaauauuauaauu

SEQ ID NO: 4088212 - RNA, 21 nt, Variola virus
gaauauugggcaaagauauuu

SEQ ID NO: 4088213 - RNA, 12 nt, Variola virus
gaaucaaaaagu

SEQ ID NO: 4088214 - RNA, 13 nt, Variola virus
gaaucaguauaua

SEQ ID NO: 4088215 - RNA, 14 nt, Variola virus
gaaucauacaauga

SEQ ID NO: 4088216 - RNA, 20 nt, Variola virus
gaauccaucucuauguuuca

SEQ ID NO: 4088217 - RNA, 20 nt, Variola virus
gaauccauuuucccaaauau

SEQ ID NO: 4088218 - RNA, 13 nt, Variola virus
gaaucguauauau

SEQ ID NO: 4088219 - RNA, 15 nt, Variola virus
gaaucuaaacaaaau

SEQ ID NO: 4088220 - RNA, 17 nt, Variola virus
gaaucuagguauuucuu

SEQ ID NO: 4088221 - RNA, 19 nt, Variola virus
gaaucuauuacugacuuua

SEQ ID NO: 4088222 - RNA, 12 nt, Variola virus
gaaucuauuuua

SEQ ID NO: 4088223 - RNA, 14 nt, Variola virus
gaaucugaaaaugu

SEQ ID NO: 4088224 - RNA, 16 nt, Variola virus
gaaugagauacuaaca

SEQ ID NO: 4088225 - RNA, 16 nt, Variola virus
gaaugcccgcauauau

SEQ ID NO: 4088226 - RNA, 22 nt, Variola virus
gaaugcggugccauucaugaaa

SEQ ID NO: 4088227 - RNA, 14 nt, Variola virus
gaaugcuguuauau

SEQ ID NO: 4088228 - RNA, 17 nt, Variola virus
gaauguuauaaaaaugc

SEQ ID NO: 4088229 - RNA, 14 nt, Variola virus
gaauuaauaauauc

SEQ ID NO: 4088230 - RNA, 12 nt, Variola virus
gaauuaauacau

SEQ ID NO: 4088231 - RNA, 12 nt, Variola virus
gaauuagaaaag

SEQ ID NO: 4088232 - RNA, 16 nt, Variola virus
gaauuauuuacaaaau

SEQ ID NO: 4088233 - RNA, 17 nt, Variola virus
gaauucauuugauguau

SEQ ID NO: 4088234 - RNA, 16 nt, Variola virus
gaauuguuucuuuuag

SEQ ID NO: 4088235 - RNA, 21 nt, Variola virus
gaauuguuucuuuuagaagug

SEQ ID NO: 4088236 - RNA, 16 nt, Variola virus
gaauuuauuucuaauu

SEQ ID NO: 4088237 - RNA, 15 nt, Variola virus
gaauuugauacuguc

SEQ ID NO: 4088238 - RNA, 18 nt, Variola virus
gaauuugauccuaccaaa

SEQ ID NO: 4088239 - RNA, 13 nt, Variola virus
gacaaauuauucu

SEQ ID NO: 4088240 - RNA, 22 nt, Variola virus
gacaacaaggcuuuaauaucua

SEQ ID NO: 4088241 - RNA, 17 nt, Variola virus
gacaacauuaauacaaa

SEQ ID NO: 4088242 - RNA, 21 nt, Variola virus
gacaauaacagagugcagaua

SEQ ID NO: 4088243 - RNA, 12 nt, Variola virus
gacaauaaucuc

SEQ ID NO: 4088244 - RNA, 14 nt, Variola virus
gacaauauuuaguu

SEQ ID NO: 4088245 - RNA, 16 nt, Variola virus
gacaaugaauugcaua

SEQ ID NO: 4088246 - RNA, 15 nt, Variola virus
gacacgacauagaga

SEQ ID NO: 4088247 - RNA, 15 nt, Variola virus
gacacucuauaucua

SEQ ID NO: 4088248 - RNA, 22 nt, Variola virus
gacauaagucgccucaaagaua

SEQ ID NO: 4088249 - RNA, 23 nt, Variola virus
gacauaaugacuccauagagaua

SEQ ID NO: 4088250 - RNA, 21 nt, Variola virus
gacauagagagcuucaucaau

SEQ ID NO: 4088251 - RNA, 22 nt, Variola virus
gacauauuucgacaaaaagaua

SEQ ID NO: 4088252 - RNA, 19 nt, Variola virus
gacaugcuacaaaauaugu

SEQ ID NO: 4088253 - RNA, 18 nt, Variola virus
gacauggcuucuuccaua

SEQ ID NO: 4088254 - RNA, 12 nt, Variola virus
gacauuagaccg

SEQ ID NO: 4088255 - RNA, 13 nt, Variola virus
gacauucaucaau

SEQ ID NO: 4088256 - RNA, 23 nt, Variola virus
gacauucccacaguguugccauu

SEQ ID NO: 4088257 - RNA, 17 nt, Variola virus
gacauuccuaugaugau

SEQ ID NO: 4088258 - RNA, 19 nt, Variola virus
gacauuguauuaugaugaa

SEQ ID NO: 4088259 - RNA, 16 nt, Variola virus
gacauuuucacaaaua

SEQ ID NO: 4088260 - RNA, 13 nt, Variola virus
gacgcacauaugc

SEQ ID NO: 4088261 - RNA, 20 nt, Variola virus
gacgcagauagcuauaugau

SEQ ID NO: 4088262 - RNA, 20 nt, Variola virus
gacgcauuauauaguuuuua

SEQ ID NO: 4088263 - RNA, 16 nt, Variola virus
gacgcuuauuauuaau

SEQ ID NO: 4088264 - RNA, 18 nt, Variola virus
gacguguuaauaaaaaca

SEQ ID NO: 4088265 - RNA, 23 nt, Variola virus
gacguugccaaaaaauccuguaa

SEQ ID NO: 4088266 - RNA, 13 nt, Variola virus
gacuauaaaauau

SEQ ID NO: 4088267 - RNA, 13 nt, Variola virus
gacuauaaaugua

SEQ ID NO: 4088268 - RNA, 14 nt, Variola virus
gacuauaacagaua

SEQ ID NO: 4088269 - RNA, 19 nt, Variola virus
gacuauagacauaauacua

SEQ ID NO: 4088270 - RNA, 13 nt, Variola virus
gacuaucaacaau

SEQ ID NO: 4088271 - RNA, 22 nt, Variola virus
gacuauuggaauguguuaaaaa

SEQ ID NO: 4088272 - RNA, 19 nt, Variola virus
gacucauaagaaagagaau

SEQ ID NO: 4088273 - RNA, 21 nt, Variola virus
gacuccaucaucgaucuaaua

SEQ ID NO: 4088274 - RNA, 23 nt, Variola virus
gacugauuauugaguuaaaauca

SEQ ID NO: 4088275 - RNA, 21 nt, Variola virus
gacugcgaauccuauauuaaa

SEQ ID NO: 4088276 - RNA, 18 nt, Variola virus
gacuguacgauacauaau

SEQ ID NO: 4088277 - RNA, 13 nt, Variola virus
gacuguauuugga

SEQ ID NO: 4088278 - RNA, 16 nt, Variola virus
gacuguuuauacaaga

SEQ ID NO: 4088279 - RNA, 16 nt, Variola virus
gacuucuaacaaacau

SEQ ID NO: 4088280 - RNA, 18 nt, Variola virus
gacuuguauaugccaaag

SEQ ID NO: 4088281 - RNA, 18 nt, Variola virus
gagaaggaauagaaauaa

SEQ ID NO: 4088282 - RNA, 23 nt, Variola virus
gagaaguuuuauccaauaauuua

SEQ ID NO: 4088283 - RNA, 14 nt, Variola virus
gagaauuaaaagag

SEQ ID NO: 4088284 - RNA, 17 nt, Variola virus
gagacgaucuacuauca

SEQ ID NO: 4088285 - RNA, 20 nt, Variola virus
gagacuugauagauauuaau

SEQ ID NO: 4088286 - RNA, 13 nt, Variola virus
gagagagaaauac

SEQ ID NO: 4088287 - RNA, 18 nt, Variola virus
gagauauuggaugaugau

SEQ ID NO: 4088288 - RNA, 13 nt, Variola virus
gagauuaaugcua

SEQ ID NO: 4088289 - RNA, 13 nt, Variola virus
gagauuuucuauu

SEQ ID NO: 4088290 - RNA, 16 nt, Variola virus
gagcguaaaaguaaac

SEQ ID NO: 4088291 - RNA, 15 nt, Variola virus
gaggaagacacauua

SEQ ID NO: 4088292 - RNA, 14 nt, Variola virus
gaggacguauauaa

SEQ ID NO: 4088293 - RNA, 18 nt, Variola virus
gaggacuuggauguuugu

SEQ ID NO: 4088294 - RNA, 20 nt, Variola virus
gaggaguugcugaugaugaa

SEQ ID NO: 4088295 - RNA, 19 nt, Variola virus
gaggauguauauaucauga

SEQ ID NO: 4088296 - RNA, 23 nt, Variola virus
gaguaauauccucuauuauacau

SEQ ID NO: 4088297 - RNA, 18 nt, Variola virus
gaguaguacaagaaauac

SEQ ID NO: 4088298 - RNA, 19 nt, Variola virus
gaguauuaaccaugaaaga

SEQ ID NO: 4088299 - RNA, 13 nt, Variola virus
gagucacaaauaa

SEQ ID NO: 4088300 - RNA, 14 nt, Variola virus
gauaaaaaauuaua

SEQ ID NO: 4088301 - RNA, 18 nt, Variola virus
gauaaaacaaguuuucau

SEQ ID NO: 4088302 - RNA, 18 nt, Variola virus
gauaaaacgauaaaagau

SEQ ID NO: 4088303 - RNA, 14 nt, Variola virus
gauaaaauaucaua

SEQ ID NO: 4088304 - RNA, 15 nt, Variola virus
gauaaaauuaaugag

SEQ ID NO: 4088305 - RNA, 19 nt, Variola virus
gauaaagauagaugaugau

SEQ ID NO: 4088306 - RNA, 18 nt, Variola virus
gauaaauaguaucaucua

SEQ ID NO: 4088307 - RNA, 15 nt, Variola virus
gauaacaaauuaaag

SEQ ID NO: 4088308 - RNA, 22 nt, Variola virus
gauaacuacaauauuucaucau

SEQ ID NO: 4088309 - RNA, 11 nt, Variola virus
gauaacuguau

SEQ ID NO: 4088310 - RNA, 21 nt, Variola virus
gauaaguuucggcacauauua

SEQ ID NO: 4088311 - RNA, 22 nt, Variola virus
gauaauaaaauuacuaguauca

SEQ ID NO: 4088312 - RNA, 14 nt, Variola virus
gauaauauuauuau

SEQ ID NO: 4088313 - RNA, 17 nt, Variola virus
gauaaucguauacuuca

SEQ ID NO: 4088314 - RNA, 15 nt, Variola virus
gauaaugaacauaua

SEQ ID NO: 4088315 - RNA, 15 nt, Variola virus
gauaaugauaaugac

SEQ ID NO: 4088316 - RNA, 12 nt, Variola virus
gauaauuuccau

SEQ ID NO: 4088317 - RNA, 11 nt, Variola virus
gauacaaauau

SEQ ID NO: 4088318 - RNA, 20 nt, Variola virus
gauacaauuagauauaucua

SEQ ID NO: 4088319 - RNA, 21 nt, Variola virus
gauacacuagacauuuuuuaa

SEQ ID NO: 4088320 - RNA, 18 nt, Variola virus
gauacaugauuaauacau

SEQ ID NO: 4088321 - RNA, 14 nt, Variola virus
gauacuauaaugaa

SEQ ID NO: 4088322 - RNA, 21 nt, Variola virus
gauagguuagaagauaaugaa

SEQ ID NO: 4088323 - RNA, 13 nt, Variola virus
gauaguaaugcau

SEQ ID NO: 4088324 - RNA, 15 nt, Variola virus
gauaguguauaaaga

SEQ ID NO: 4088325 - RNA, 22 nt, Variola virus
gauaguuuucucuauucugaaa

SEQ ID NO: 4088326 - RNA, 14 nt, Variola virus
gauauaaauaauau

SEQ ID NO: 4088327 - RNA, 20 nt, Variola virus
gauauaauauauuagauauu

SEQ ID NO: 4088328 - RNA, 18 nt, Variola virus
gauauacaguauaaugau

SEQ ID NO: 4088329 - RNA, 15 nt, Variola virus
gauauauaucuuuuc

SEQ ID NO: 4088330 - RNA, 17 nt, Variola virus
gauauaucaaaauuaga

SEQ ID NO: 4088331 - RNA, 15 nt, Variola virus
gauauauuaaacaac

SEQ ID NO: 4088332 - RNA, 13 nt, Variola virus
gauauauucaaac

SEQ ID NO: 4088333 - RNA, 12 nt, Variola virus
gauaucaacaag

SEQ ID NO: 4088334 - RNA, 18 nt, Variola virus
gauauccuaucuauuauu

SEQ ID NO: 4088335 - RNA, 19 nt, Variola virus
gauaucuuuacuaagaaag

SEQ ID NO: 4088336 - RNA, 21 nt, Variola virus
gauaucuuuagauauauccac

SEQ ID NO: 4088337 - RNA, 15 nt, Variola virus
gauauuaauaaugau

SEQ ID NO: 4088338 - RNA, 17 nt, Variola virus
gauauugauaucuuuuu

SEQ ID NO: 4088339 - RNA, 13 nt, Variola virus
gauauuugcuaau

SEQ ID NO: 4088340 - RNA, 14 nt, Variola virus
gaucagacaaauaa

SEQ ID NO: 4088341 - RNA, 22 nt, Variola virus
auuaaucaaaugguaaauacug

SEQ ID NO: 4088342 - RNA, 16 nt, Variola virus
auuaaugacgauagau

SEQ ID NO: 4088343 - RNA, 19 nt, Variola virus
auuaaugucguauuugaac

SEQ ID NO: 4088344 - RNA, 15 nt, Variola virus
auuaauuuuauuaac

SEQ ID NO: 4088345 - RNA, 13 nt, Variola virus
auuacaacauaau

SEQ ID NO: 4088346 - RNA, 19 nt, Variola virus
auuacagcguaaaacacau

SEQ ID NO: 4088347 - RNA, 14 nt, Variola virus
auuaccacuuucca

SEQ ID NO: 4088348 - RNA, 17 nt, Variola virus
auuaccauagaagaugu

SEQ ID NO: 4088349 - RNA, 19 nt, Variola virus
auuaccauguaugauaaaa

SEQ ID NO: 4088350 - RNA, 18 nt, Variola virus
auuaccgacgauugucca

SEQ ID NO: 4088351 - RNA, 20 nt, Variola virus
auuaccggucauauuaauaa

SEQ ID NO: 4088352 - RNA, 20 nt, Variola virus
auuacgaauauauaaaagac

SEQ ID NO: 4088353 - RNA, 15 nt, Variola virus
auuacgcucuacaaa

SEQ ID NO: 4088354 - RNA, 19 nt, Variola virus
auuacgguaucuacuagau

SEQ ID NO: 4088355 - RNA, 21 nt, Variola virus
auuacuacauuauuaaaucau

SEQ ID NO: 4088356 - RNA, 17 nt, Variola virus
auuacuacguaaagaag

SEQ ID NO: 4088357 - RNA, 17 nt, Variola virus
auuacuaggagaauuau

SEQ ID NO: 4088358 - RNA, 13 nt, Variola virus
auuacuauaaaug

SEQ ID NO: 4088359 - RNA, 21 nt, Variola virus
auuacuauaaauggagaaugu

SEQ ID NO: 4088360 - RNA, 15 nt, Variola virus
auuacuuaucauuua

SEQ ID NO: 4088361 - RNA, 16 nt, Variola virus
auuacuuuaauaguug

SEQ ID NO: 4088362 - RNA, 14 nt, Variola virus
auuagacauaugau

SEQ ID NO: 4088363 - RNA, 13 nt, Variola virus
auuagauaaaguu

SEQ ID NO: 4088364 - RNA, 23 nt, Variola virus
auuagauauuuuaugggaaaacg

SEQ ID NO: 4088365 - RNA, 14 nt, Variola virus
auuagauccaagga

SEQ ID NO: 4088366 - RNA, 14 nt, Variola virus
auuagaucuuuuac

SEQ ID NO: 4088367 - RNA, 22 nt, Variola virus
auuaggcacagucaaacauuca

SEQ ID NO: 4088368 - RNA, 22 nt, Variola virus
auuaguaaaacuaguauugugu

SEQ ID NO: 4088369 - RNA, 17 nt, Variola virus
auuagucauguuaaaaa

SEQ ID NO: 4088370 - RNA, 22 nt, Variola virus
auuaguguauacaccaacugua

SEQ ID NO: 4088371 - RNA, 20 nt, Variola virus
auuauaaguaguaguguuuc

SEQ ID NO: 4088372 - RNA, 18 nt, Variola virus
auuauaaucauuauuaac

SEQ ID NO: 4088373 - RNA, 12 nt, Variola virus
auuauaauguau

SEQ ID NO: 4088374 - RNA, 14 nt, Variola virus
auuauacuuuguaa

SEQ ID NO: 4088375 - RNA, 19 nt, Variola virus
auuauauggcacuguguau

SEQ ID NO: 4088376 - RNA, 14 nt, Variola virus
auuaucaaaagaca

SEQ ID NO: 4088377 - RNA, 14 nt, Variola virus
auuaucaaauguug

SEQ ID NO: 4088378 - RNA, 11 nt, Variola virus
auuaucaucug

SEQ ID NO: 4088379 - RNA, 16 nt, Variola virus
auuauccguauuucca

SEQ ID NO: 4088380 - RNA, 17 nt, Variola virus
auuauccuaucauguau

SEQ ID NO: 4088381 - RNA, 14 nt, Variola virus
auuaucuacagaug

SEQ ID NO: 4088382 - RNA, 21 nt, Variola virus
auuauggggaaauaaagaaaa

SEQ ID NO: 4088383 - RNA, 14 nt, Variola virus
auuauguauaccuu

SEQ ID NO: 4088384 - RNA, 12 nt, Variola virus
auuauuagaaau

SEQ ID NO: 4088385 - RNA, 18 nt, Variola virus
auuauucauuuucuauuu

SEQ ID NO: 4088386 - RNA, 15 nt, Variola virus
auuauucgagugaaa

SEQ ID NO: 4088387 - RNA, 17 nt, Variola virus
auuauucuuaaaugccu

SEQ ID NO: 4088388 - RNA, 19 nt, Variola virus
auuauugcaugauagaaug

SEQ ID NO: 4088389 - RNA, 21 nt, Variola virus
auuauuggguaaguuuaaaaa

SEQ ID NO: 4088390 - RNA, 19 nt, Variola virus
auuauugguucauuggaau

SEQ ID NO: 4088391 - RNA, 20 nt, Variola virus
auuauugucauaaacauuau

SEQ ID NO: 4088392 - RNA, 16 nt, Variola virus
auuauuuuuacagcga

SEQ ID NO: 4088393 - RNA, 21 nt, Variola virus
auuauuuuugacgaugucaag

SEQ ID NO: 4088394 - RNA, 14 nt, Variola virus
auuauuuuuggaag

SEQ ID NO: 4088395 - RNA, 20 nt, Variola virus
auucaagauuuuauuaucga

SEQ ID NO: 4088396 - RNA, 21 nt, Variola virus
auucaagcaaaaacaaaaaac

SEQ ID NO: 4088397 - RNA, 20 nt, Variola virus
auucaauuacuacaaaaauu

SEQ ID NO: 4088398 - RNA, 21 nt, Variola virus
auucaauuacuacaaaaauua

SEQ ID NO: 4088399 - RNA, 12 nt, Variola virus
auucagacacuu

SEQ ID NO: 4088400 - RNA, 16 nt, Variola virus
auucagacacuucuua

SEQ ID NO: 4088401 - RNA, 20 nt, Variola virus
auucagacacuucuuaacga

SEQ ID NO: 4088402 - RNA, 19 nt, Variola virus
auucagauaaucagccaua

SEQ ID NO: 4088403 - RNA, 13 nt, Variola virus
auucaucaaugau

SEQ ID NO: 4088404 - RNA, 14 nt, Variola virus
auucaucaaugaug

SEQ ID NO: 4088405 - RNA, 21 nt, Variola virus
auuccaacaacaucaacugaa

SEQ ID NO: 4088406 - RNA, 19 nt, Variola virus
auuccaaugaacaagauua

SEQ ID NO: 4088407 - RNA, 20 nt, Variola virus
auuccacgaacuucuaauug

SEQ ID NO: 4088408 - RNA, 23 nt, Variola virus
auuccaggaucuagauaauuaau

SEQ ID NO: 4088409 - RNA, 13 nt, Variola virus
auuccuugauauc

SEQ ID NO: 4088410 - RNA, 18 nt, Variola virus
auucgaaauuagaaagua

SEQ ID NO: 4088411 - RNA, 15 nt, Variola virus
auucgguuaugaaug

SEQ ID NO: 4088412 - RNA, 13 nt, Variola virus
auucguaaaucuu

SEQ ID NO: 4088413 - RNA, 15 nt, Variola virus
auucuaauacauaau

SEQ ID NO: 4088414 - RNA, 19 nt, Variola virus
auucuacucccuuguguaa

SEQ ID NO: 4088415 - RNA, 16 nt, Variola virus
auucuagauacaagau

SEQ ID NO: 4088416 - RNA, 13 nt, Variola virus
auucuauacuuaa

SEQ ID NO: 4088417 - RNA, 15 nt, Variola virus
auucuccuauuacau

SEQ ID NO: 4088418 - RNA, 17 nt, Variola virus
cugaaacaguaugauuu

SEQ ID NO: 4088419 - RNA, 17 nt, Variola virus
cugaaauuagagcucau

SEQ ID NO: 4088420 - RNA, 14 nt, Variola virus
cugacauucagaaa

SEQ ID NO: 4088421 - RNA, 16 nt, Variola virus
cugaguaugaugauuu

SEQ ID NO: 4088422 - RNA, 21 nt, Variola virus
cugauaagauaucuucucaaa

SEQ ID NO: 4088423 - RNA, 20 nt, Variola virus
cugauaucauuaaugauaua

SEQ ID NO: 4088424 - RNA, 16 nt, Variola virus
cugauguuuguuuucg

SEQ ID NO: 4088425 - RNA, 17 nt, Variola virus
cugauuauucacuauaa

SEQ ID NO: 4088426 - RNA, 14 nt, Variola virus
cugauuuauguuuu

SEQ ID NO: 4088427 - RNA, 13 nt, Variola virus
cugcaauaaaaca

SEQ ID NO: 4088428 - RNA, 19 nt, Variola virus
cugcagccauuuuuaugau

SEQ ID NO: 4088429 - RNA, 13 nt, Variola virus
cugcaguaauauu

SEQ ID NO: 4088430 - RNA, 18 nt, Variola virus
cugcauuaucaauaaaua

SEQ ID NO: 4088431 - RNA, 13 nt, Variola virus
cugcauuaucuac

SEQ ID NO: 4088432 - RNA, 18 nt, Variola virus
cugccauuuauccagucu

SEQ ID NO: 4088433 - RNA, 17 nt, Variola virus
cugccauuuuagagauu

SEQ ID NO: 4088434 - RNA, 24 nt, Variola virus
cugcuagaaaucauauaugauauu

SEQ ID NO: 4088435 - RNA, 15 nt, Variola virus
cugcuagaacaucca

SEQ ID NO: 4088436 - RNA, 12 nt, Variola virus
cugcugaaaaua

SEQ ID NO: 4088437 - RNA, 17 nt, Variola virus
cuggaaccucaacaauc

SEQ ID NO: 4088438 - RNA, 15 nt, Variola virus
cuggaauagguauau

SEQ ID NO: 4088439 - RNA, 16 nt, Variola virus
cuggaggagauggauu

SEQ ID NO: 4088440 - RNA, 13 nt, Variola virus
cuggauauguuuu

SEQ ID NO: 4088441 - RNA, 20 nt, Variola virus
cuggcauuggcuagguauau

SEQ ID NO: 4088442 - RNA, 18 nt, Variola virus
cugguacaggaguucagu

SEQ ID NO: 4088443 - RNA, 19 nt, Variola virus
cugguauuuauaugugcau

SEQ ID NO: 4088444 - RNA, 14 nt, Variola virus
cugguuuagauauu

SEQ ID NO: 4088445 - RNA, 19 nt, Variola virus
cuguaaauagaacauacuu

SEQ ID NO: 4088446 - RNA, 11 nt, Variola virus
cuguagaaaaa

SEQ ID NO: 4088447 - RNA, 22 nt, Variola virus
cuguagagggucaacaaucguu

SEQ ID NO: 4088448 - RNA, 13 nt, Variola virus
cuguauagauaua

SEQ ID NO: 4088449 - RNA, 20 nt, Variola virus
cuguaucaaccggauuuaaa

SEQ ID NO: 4088450 - RNA, 17 nt, Variola virus
cuguaucaguugcauuu

SEQ ID NO: 4088451 - RNA, 16 nt, Variola virus
cugucauuaaaucuuu

SEQ ID NO: 4088452 - RNA, 16 nt, Variola virus
cugucuggcaauaaau

SEQ ID NO: 4088453 - RNA, 18 nt, Variola virus
cugucuuucgauguucau

SEQ ID NO: 4088454 - RNA, 19 nt, Variola virus
cugugaauucguaaauaca

SEQ ID NO: 4088455 - RNA, 15 nt, Variola virus
cugugacagauauca

SEQ ID NO: 4088456 - RNA, 14 nt, Variola virus
cuguuaauaucaau

SEQ ID NO: 4088457 - RNA, 13 nt, Variola virus
cuguuaaucuuua

SEQ ID NO: 4088458 - RNA, 13 nt, Variola virus
cuguuagaugagg

SEQ ID NO: 4088459 - RNA, 12 nt, Variola virus
cuguuauauaca

SEQ ID NO: 4088460 - RNA, 23 nt, Variola virus
cuguucuaucaucuacaucacug

SEQ ID NO: 4088461 - RNA, 13 nt, Variola virus
cuguuuauuuuag

SEQ ID NO: 4088462 - RNA, 16 nt, Variola virus
cuguuucgaaacuuua

SEQ ID NO: 4088463 - RNA, 18 nt, Variola virus
cuguuuuagcaucuuuuu

SEQ ID NO: 4088464 - RNA, 19 nt, Variola virus
cuuaaaauauaaugauaua

SEQ ID NO: 4088465 - RNA, 18 nt, Variola virus
cuuaaaauauguaacaau

SEQ ID NO: 4088466 - RNA, 23 nt, Variola virus
cuuaaaaucgguagaaucauauu

SEQ ID NO: 4088467 - RNA, 21 nt, Variola virus
cuuaaaauuuaaaaugguauu

SEQ ID NO: 4088468 - RNA, 17 nt, Variola virus
cuuaaagacuauaccau

SEQ ID NO: 4088469 - RNA, 20 nt, Variola virus
cuuaaauguaucuuuacuag

SEQ ID NO: 4088470 - RNA, 18 nt, Variola virus
cuuaacaucuucuacauu

SEQ ID NO: 4088471 - RNA, 18 nt, Variola virus
cuuaaccauauauccaau

SEQ ID NO: 4088472 - RNA, 19 nt, Variola virus
cuuaacuugcaaaauguaa

SEQ ID NO: 4088473 - RNA, 21 nt, Variola virus
cuuaagucuccaaucuuuugu

SEQ ID NO: 4088474 - RNA, 19 nt, Variola virus
cuuaauaacaaaacuaauu

SEQ ID NO: 4088475 - RNA, 19 nt, Variola virus
cuuaauacccugguagaag

SEQ ID NO: 4088476 - RNA, 16 nt, Variola virus
cuuaauagacaaacug

SEQ ID NO: 4088477 - RNA, 13 nt, Variola virus
cuuaaucauguga

SEQ ID NO: 4088478 - RNA, 14 nt, Variola virus
cuuaauuauaacga

SEQ ID NO: 4088479 - RNA, 16 nt, Variola virus
cuuacaaauauucaca

SEQ ID NO: 4088480 - RNA, 14 nt, Variola virus
cuuacuaucuuuuu

SEQ ID NO: 4088481 - RNA, 20 nt, Variola virus
cuuaguauuuuuagauauca

SEQ ID NO: 4088482 - RNA, 20 nt, Variola virus
cuuaucuucuauaucaucua

SEQ ID NO: 4088483 - RNA, 14 nt, Variola virus
cuuauguaugugca

SEQ ID NO: 4088484 - RNA, 20 nt, Variola virus
cuuauuaacuuuaacauguc

SEQ ID NO: 4088485 - RNA, 17 nt, Variola virus
cuuauuacuuuuggaau

SEQ ID NO: 4088486 - RNA, 22 nt, Variola virus
cuuauuaguaacugacuuaaua

SEQ ID NO: 4088487 - RNA, 17 nt, Variola virus
cuuauuuuuaacaaaug

SEQ ID NO: 4088488 - RNA, 15 nt, Variola virus
cuucaauaaaaugaa

SEQ ID NO: 4088489 - RNA, 16 nt, Variola virus
cuucagacaacaucuc

SEQ ID NO: 4088490 - RNA, 19 nt, Variola virus
cuucagacaacaucucaga

SEQ ID NO: 4088491 - RNA, 16 nt, Variola virus
cuucauuaaucuuuuc

SEQ ID NO: 4088492 - RNA, 12 nt, Variola virus
cuucauuauuuu

SEQ ID NO: 4088493 - RNA, 12 nt, Variola virus
cuucauuucuaa

SEQ ID NO: 4088494 - RNA, 14 nt, Variola virus
cuuccaacauaaua

SEQ ID NO: 4088495 - RNA, 15 nt, Variola virus
cuuccaacucuguuu

SEQ ID NO: 4088496 - RNA, 20 nt, Variola virus
cuuccacuguccaaaaugau

SEQ ID NO: 4088497 - RNA, 14 nt, Variola virus
cuucgauagauauu

SEQ ID NO: 4088498 - RNA, 17 nt, Variola virus
cuucgccgcgacuuucu

SEQ ID NO: 4088499 - RNA, 22 nt, Variola virus
cuucuaaaauuacaaacaacug

SEQ ID NO: 4088500 - RNA, 14 nt, Variola virus
cuucuaucuuuagu

SEQ ID NO: 4088501 - RNA, 20 nt, Variola virus
cuucuauuaaccacauaucu

SEQ ID NO: 4088502 - RNA, 23 nt, Variola virus
cuucuggaagguuuguauucuga

SEQ ID NO: 4088503 - RNA, 15 nt, Variola virus
augacgauaacauuc

SEQ ID NO: 4088504 - RNA, 18 nt, Variola virus
augacgauccuuuaagag

SEQ ID NO: 4088505 - RNA, 14 nt, Variola virus
augacuaaacauuu

SEQ ID NO: 4088506 - RNA, 15 nt, Variola virus
augacucucaaauua

SEQ ID NO: 4088507 - RNA, 21 nt, Variola virus
augacuucguaagaaauaaua

SEQ ID NO: 4088508 - RNA, 18 nt, Variola virus
augacuuuaguaaaucau

SEQ ID NO: 4088509 - RNA, 23 nt, Variola virus
augacuuuaucagaucaaaauua

SEQ ID NO: 4088510 - RNA, 13 nt, Variola virus
augagaacauagu

SEQ ID NO: 4088511 - RNA, 15 nt, Variola virus
augagaacauaguau

SEQ ID NO: 4088512 - RNA, 18 nt, Variola virus
augagacagauuaucaua

SEQ ID NO: 4088513 - RNA, 19 nt, Variola virus
augagauguuaaaugaauu

SEQ ID NO: 4088514 - RNA, 20 nt, Variola virus
augagauuauuaaguauuua

SEQ ID NO: 4088515 - RNA, 14 nt, Variola virus
augaguauauguau

SEQ ID NO: 4088516 - RNA, 21 nt, Variola virus
augauacgauacuauauguau

SEQ ID NO: 4088517 - RNA, 18 nt, Variola virus
augauagaaaugaugaag

SEQ ID NO: 4088518 - RNA, 13 nt, Variola virus
augauagaaucug

SEQ ID NO: 4088519 - RNA, 16 nt, Variola virus
augauauuagaacuac

SEQ ID NO: 4088520 - RNA, 14 nt, Variola virus
augaucaaaaagac

SEQ ID NO: 4088521 - RNA, 16 nt, Variola virus
augauccuauucuaaa

SEQ ID NO: 4088522 - RNA, 13 nt, Variola virus
augaucuguuuau

SEQ ID NO: 4088523 - RNA, 20 nt, Variola virus
augaugaaacacaagaucaa

SEQ ID NO: 4088524 - RNA, 17 nt, Variola virus
augaugaauacauuuau

SEQ ID NO: 4088525 - RNA, 13 nt, Variola virus
augaugacgguau

SEQ ID NO: 4088526 - RNA, 17 nt, Variola virus
augaugaugaaaugaua

SEQ ID NO: 4088527 - RNA, 22 nt, Variola virus
augauguguuauuuuuuaacug

SEQ ID NO: 4088528 - RNA, 23 nt, Variola virus
augauuaaugacgauagauuuac

SEQ ID NO: 4088529 - RNA, 18 nt, Variola virus
augauucgucgacauguu

SEQ ID NO: 4088530 - RNA, 21 nt, Variola virus
augauucuaaccuagaauuac

SEQ ID NO: 4088531 - RNA, 17 nt, Variola virus
augauugauuagaaaau

SEQ ID NO: 4088532 - RNA, 17 nt, Variola virus
augauuuacaaaugguu

SEQ ID NO: 4088533 - RNA, 23 nt, Variola virus
augauuuucugggacuauuggaa

SEQ ID NO: 4088534 - RNA, 18 nt, Variola virus
augauuuuuaaucaagau

SEQ ID NO: 4088535 - RNA, 16 nt, Variola virus
augcaaagucuaaaua

SEQ ID NO: 4088536 - RNA, 21 nt, Variola virus
augcaacucuaucauguagua

SEQ ID NO: 4088537 - RNA, 18 nt, Variola virus
augcacagcgaagaauuc

SEQ ID NO: 4088538 - RNA, 17 nt, Variola virus
augcaucgguaaauaua

SEQ ID NO: 4088539 - RNA, 17 nt, Variola virus
augcauuuuuauauaca

SEQ ID NO: 4088540 - RNA, 15 nt, Variola virus
augccuauaaaguaa

SEQ ID NO: 4088541 - RNA, 23 nt, Variola virus
augccuauaaaguaauaaucuuc

SEQ ID NO: 4088542 - RNA, 14 nt, Variola virus
augcgauucaaaaa

SEQ ID NO: 4088543 - RNA, 18 nt, Variola virus
augcgauucaaaaaagaa

SEQ ID NO: 4088544 - RNA, 20 nt, Variola virus
augcggaaccucgagaaugu

SEQ ID NO: 4088545 - RNA, 14 nt, Variola virus
augcguacauaacu

SEQ ID NO: 4088546 - RNA, 18 nt, Variola virus
augcuagugcucaaacaa

SEQ ID NO: 4088547 - RNA, 22 nt, Variola virus
augcuaguuaauaguaaaugaa

SEQ ID NO: 4088548 - RNA, 18 nt, Variola virus
augcuauaccuaauacua

SEQ ID NO: 4088549 - RNA, 17 nt, Variola virus
augcugguuauuacaca

SEQ ID NO: 4088550 - RNA, 14 nt, Variola virus
augcuuaaaaugcu

SEQ ID NO: 4088551 - RNA, 16 nt, Variola virus
auggaaaaauauuaca

SEQ ID NO: 4088552 - RNA, 14 nt, Variola virus
auggaaaucaacau

SEQ ID NO: 4088553 - RNA, 19 nt, Variola virus
auggaaaucaacauaaugu

SEQ ID NO: 4088554 - RNA, 14 nt, Variola virus
auggaagaaacaga

SEQ ID NO: 4088555 - RNA, 15 nt, Variola virus
auggauauauuaaag

SEQ ID NO: 4088556 - RNA, 22 nt, Variola virus
auggauaucuucagggaaaucg

SEQ ID NO: 4088557 - RNA, 20 nt, Variola virus
auggauuuaucauaucaugg

SEQ ID NO: 4088558 - RNA, 15 nt, Variola virus
auggcacgaaauauc

SEQ ID NO: 4088559 - RNA, 14 nt, Variola virus
augguaaaggauaa

SEQ ID NO: 4088560 - RNA, 23 nt, Variola virus
augguaaggucuuagaaauagac

SEQ ID NO: 4088561 - RNA, 21 nt, Variola virus
augguacguaaccgaaucuuc

SEQ ID NO: 4088562 - RNA, 22 nt, Variola virus
auggucagugcauaauaaagua

SEQ ID NO: 4088563 - RNA, 12 nt, Variola virus
auguaaaugaua

SEQ ID NO: 4088564 - RNA, 18 nt, Variola virus
auguaacccgugcauauu

SEQ ID NO: 4088565 - RNA, 23 nt, Variola virus
auguaauaauugcucaaauaaua

SEQ ID NO: 4088566 - RNA, 14 nt, Variola virus
auguaaucauauaa

SEQ ID NO: 4088567 - RNA, 21 nt, Variola virus
auguacaaauucuuggauaua

SEQ ID NO: 4088568 - RNA, 22 nt, Variola virus
auguacguagcguacaaaauua

SEQ ID NO: 4088569 - RNA, 22 nt, Variola virus
auguacuguauauaauaguuuc

SEQ ID NO: 4088570 - RNA, 17 nt, Variola virus
auguaguagaaauaaua

SEQ ID NO: 4088571 - RNA, 15 nt, Variola virus
auguauaacuuuacu

SEQ ID NO: 4088572 - RNA, 19 nt, Variola virus
auguauuacgaagaagaca

SEQ ID NO: 4088573 - RNA, 15 nt, Variola virus
augucaaaaaaagau

SEQ ID NO: 4088574 - RNA, 18 nt, Variola virus
augucaaaaauuguagaa

SEQ ID NO: 4088575 - RNA, 15 nt, Variola virus
augucauauacucaa

SEQ ID NO: 4088576 - RNA, 17 nt, Variola virus
augucaucgaaauggua

SEQ ID NO: 4088577 - RNA, 19 nt, Variola virus
auguccucaaauaaauacu

SEQ ID NO: 4088578 - RNA, 20 nt, Variola virus
auguccucaaauaaauacuc

SEQ ID NO: 4088579 - RNA, 15 nt, Variola virus
augucuccaauuuuu

SEQ ID NO: 4088580 - RNA, 17 nt, Variola virus
augucuggaauaguaaa

SEQ ID NO: 4088581 - RNA, 17 nt, Variola virus
augucugucauauguau

SEQ ID NO: 4088582 - RNA, 12 nt, Variola virus
augugaauguau

SEQ ID NO: 4088583 - RNA, 19 nt, Variola virus
augugagagagaaauacuu

SEQ ID NO: 4088584 - RNA, 19 nt, Variola virus
augugaucuaugacaucau

SEQ ID NO: 4088585 - RNA, 18 nt, Variola virus
aucacuuuuuauacuaau

SEQ ID NO: 4088586 - RNA, 14 nt, Variola virus
aucagauucuauau

SEQ ID NO: 4088587 - RNA, 15 nt, Variola virus
aucagauucuuauau

SEQ ID NO: 4088588 - RNA, 19 nt, Variola virus
aucaggaauguuugcugaa

SEQ ID NO: 4088589 - RNA, 18 nt, Variola virus
aucaggauauaaagaaaa

SEQ ID NO: 4088590 - RNA, 21 nt, Variola virus
aucaguacguucuucauuuau

SEQ ID NO: 4088591 - RNA, 19 nt, Variola virus
aucaguaucuucuuuaucu

SEQ ID NO: 4088592 - RNA, 21 nt, Variola virus
aucagucaccaguuaauauau

SEQ ID NO: 4088593 - RNA, 18 nt, Variola virus
aucauaaauuauuucauu

SEQ ID NO: 4088594 - RNA, 21 nt, Variola virus
aucauacaaugaauuaauuaa

SEQ ID NO: 4088595 - RNA, 17 nt, Variola virus
aucauacauuaugaacu

SEQ ID NO: 4088596 - RNA, 14 nt, Variola virus
aucauauauguauu

SEQ ID NO: 4088597 - RNA, 21 nt, Variola virus
aucauauuccggcguaugaau

SEQ ID NO: 4088598 - RNA, 14 nt, Variola virus
aucaucaaauggau

SEQ ID NO: 4088599 - RNA, 17 nt, Variola virus
aucauccauuaauauaa

SEQ ID NO: 4088600 - RNA, 20 nt, Variola virus
aucaucugugggaaauggaa

SEQ ID NO: 4088601 - RNA, 19 nt, Variola virus
aucauguaaggcauacauu

SEQ ID NO: 4088602 - RNA, 15 nt, Variola virus
aucauguagauaguu

SEQ ID NO: 4088603 - RNA, 17 nt, Variola virus
aucauguguaaaaaguu

SEQ ID NO: 4088604 - RNA, 13 nt, Variola virus
aucauuaaaugau

SEQ ID NO: 4088605 - RNA, 19 nt, Variola virus
auccaaacccuugaucucc

SEQ ID NO: 4088606 - RNA, 15 nt, Variola virus
auccaaauucuggaa

SEQ ID NO: 4088607 - RNA, 21 nt, Variola virus
auccaacuuaacaaaucuuaa

SEQ ID NO: 4088608 - RNA, 21 nt, Variola virus
auccaaguuaaaggauauuau

SEQ ID NO: 4088609 - RNA, 14 nt, Variola virus
auccacaauuauug

SEQ ID NO: 4088610 - RNA, 14 nt, Variola virus
auccacuucuucca

SEQ ID NO: 4088611 - RNA, 17 nt, Variola virus
auccagauaauaaccuc

SEQ ID NO: 4088612 - RNA, 19 nt, Variola virus
auccaugggugacauaauu

SEQ ID NO: 4088613 - RNA, 14 nt, Variola virus
aucccauuguaaag

SEQ ID NO: 4088614 - RNA, 22 nt, Variola virus
auccgugguuagcauauaccuc

SEQ ID NO: 4088615 - RNA, 21 nt, Variola virus
auccguuaguuuaauauccuu

SEQ ID NO: 4088616 - RNA, 19 nt, Variola virus
auccuccggaguauuaaug

SEQ ID NO: 4088617 - RNA, 15 nt, Variola virus
auccugaauaguaaa

SEQ ID NO: 4088618 - RNA, 16 nt, Variola virus
auccuguaauacuuuu

SEQ ID NO: 4088619 - RNA, 19 nt, Variola virus
auccugugcauaaauuaaa

SEQ ID NO: 4088620 - RNA, 15 nt, Variola virus
auccuuaaauguuuu

SEQ ID NO: 4088621 - RNA, 20 nt, Variola virus
auccuuauaaagaaugaaug

SEQ ID NO: 4088622 - RNA, 13 nt, Variola virus
aucgacuauuuua

SEQ ID NO: 4088623 - RNA, 17 nt, Variola virus
aucgacuauuuuaaaua

SEQ ID NO: 4088624 - RNA, 19 nt, Variola virus
aucgacuugggucuucuca

SEQ ID NO: 4088625 - RNA, 16 nt, Variola virus
aucgaguuuaucagag

SEQ ID NO: 4088626 - RNA, 21 nt, Variola virus
aucgauaauuguuucauaugu

SEQ ID NO: 4088627 - RNA, 20 nt, Variola virus
aucgauggagcguaaaagua

SEQ ID NO: 4088628 - RNA, 21 nt, Variola virus
aucgauguuauuaucaaaguc

SEQ ID NO: 4088629 - RNA, 18 nt, Variola virus
aucgauuauauucuaaga

SEQ ID NO: 4088630 - RNA, 23 nt, Variola virus
aucgauuguuuauuguauauacu

SEQ ID NO: 4088631 - RNA, 19 nt, Variola virus
aucggacuuugugcauaug

SEQ ID NO: 4088632 - RNA, 15 nt, Variola virus
aucguacuauauaca

SEQ ID NO: 4088633 - RNA, 15 nt, Variola virus
aucguauaaauacug

SEQ ID NO: 4088634 - RNA, 18 nt, Variola virus
aucguauaaauacugucu

SEQ ID NO: 4088635 - RNA, 23 nt, Variola virus
aucgucaccgaugucaaaaaaag

SEQ ID NO: 4088636 - RNA, 14 nt, Variola virus
aucguuacaaaaga

SEQ ID NO: 4088637 - RNA, 17 nt, Variola virus
aucguuaucauuaauaa

SEQ ID NO: 4088638 - RNA, 12 nt, Variola virus
aucuaaaaaacu

SEQ ID NO: 4088639 - RNA, 13 nt, Variola virus
aucuaauacaaaa

SEQ ID NO: 4088640 - RNA, 13 nt, Variola virus
aucuaauauaauu

SEQ ID NO: 4088641 - RNA, 15 nt, Variola virus
aucuaauauaucacu

SEQ ID NO: 4088642 - RNA, 11 nt, Variola virus
aucuaauuaau

SEQ ID NO: 4088643 - RNA, 15 nt, Variola virus
aucuacaauauauau

SEQ ID NO: 4088644 - RNA, 22 nt, Variola virus
aucuaccucuccaaaaagaaaa

SEQ ID NO: 4088645 - RNA, 18 nt, Variola virus
aucuacucauagaaaggu

SEQ ID NO: 4088646 - RNA, 17 nt, Variola virus
aucuagaaauuacauaa

SEQ ID NO: 4088647 - RNA, 18 nt, Variola virus
aucuagaaauuacauaaa

SEQ ID NO: 4088648 - RNA, 19 nt, Variola virus
aucuagcgucgacaucuau

SEQ ID NO: 4088649 - RNA, 18 nt, Variola virus
aucuaguccuuuaauucc

SEQ ID NO: 4088650 - RNA, 21 nt, Variola virus
aucuauaaaacgauuaaacaa

SEQ ID NO: 4088651 - RNA, 12 nt, Variola virus
aucuauaaaagu
